United States Patent 6,833,447 (MYXOCOCCUS XANTHUS GENOME SEQUENCES AND USES THEREOF) - sequence listing, part 5

SEQ ID NO: 3949 - DNA, 2127 bp, Myxococcus xanthus
atcgagaagattcgaaatatcggtatctccgctcacatcgactcgggcaagacgacgctctctgagcgcatcctgttctacacgggtcggattcacgagatccacgaggtccgcggcaaggacggcgtgggcgcgatcatggacaacatggacctggagcgtgagaagggcatcacgatccagtccgccgccacgttcgcgatgtggggcgagtacaacatcaacctcatcgacaccccgggacacgtggacttcaccatcgaggtggagcgctcgctccgcgtgctcgacggcgccatcctggtcctctgctcggtcgctggcgtgcagtctcagtccatcaccgtggaccgccagatgaagcgctaccgcgtcccgcgcatcgcgttcgtcaacaagatggaccgctccggcgcgaactatgaccgcgtggccgcccagctgaaggagaagctgaaccaccacccggtgcagatgcagatgcccatcggcgccgaggaccgcctcaagggtctgatcaacctcatcgaaatgaaggcgtactacttcgatggcgagagcggcgaggacatccgtgaagaggagatcccggcggagctgctcgaggaggccaagacgcgccgccagcagatgatcgaaggcgtggccgaggtcgacgaccagctcggcgagctgttcctggccgaccagcccatctccaacgaggcgctgatcgccgccgtccgccgggccaccatcggcctgaagatgacgccggtcatgtgcggctccgcgtacaagaacaagggcgtgcagctgctcctgaacgccgtctgcgcgttcctgcccaaccccaaagaggcgacgaacgaggcgctggaccagaagaacaacgaggcgaaggtcatcctcgactcggacccggagaagcccttcgttggcctcgcgttcaagctcgaggacggccgctacgggcagctgacgtacatgcgcatctaccagggccgggtgacgaagggcgacttcatcatcaaccagtcgaaccagaagaaggtcaaggttccgcgcatcgtccgcatgcactccagccagatgaacgacatcaacgaggccaccgcgggtgacatcgttgcgctgttcggcatcgagtgcgcgtccggcgacacgttcaccgatggcgtggtgaactacacgatgacgtccatgcacgtcccggacgccgtgatttcgctcgccgtggcccccaaggaccgctccaacctgaccaacttctccaaggcgctcaaccgcttcaccaaggaggaccccaccttccgcgtgcaccgcgatgaggagtccgggcagaccatcatccgcggcatgggtgagctccacctggagatctacatcgagcgcatgaagcgcgagtacaactgcgaggtccaggccggcaagccgcaggtggcgtaccgggagaccatcagccagaagggcgagttcgcgtacacgcacaagaagcagacgggtggctccggccagttcgcccgcgtgtgcggctacatcgaaccgctgccctcggacgcggtgcagcagtacgagttcgtggacgacatcgtgggcggttccatcccccgcgagttcatcccggcctgcgacaagggcttcaccgaggccgtgaagaagggcagcctcatcggcttccccgtggtgggtgtgcgcgtggtcatcaacgacggcgccttccacgcggtggactcgtccgaaatggcgttcaagacggccgccatcatgggcttccgtgagggctacgccgccgccaagcccatcatcctcgagccgatgatgaaggtggaggtccaggctcccgaggacttccagggctccgtcgtgggtcagctgaaccagcgccgtggcaccatcctctccaccgagacggccgagggctacgtcacggcggtggccgaggtgccgctgaacaccatgttcggctactccacggacctgcgctccgccacccagggcaagggcgagtacacgatggagttctcccgctacacgccggtgcccgggaacgagtccgaggccctgaagggcggcgtacaagaagaagctggccgccgagcaggccgcgcgcaagtagtccgcgcatccgccgcactctggcggtaa

SEQ ID NO: 3950 - DNA, 1404 bp, Myxococcus xanthus
atggcggacttcgacctggtggtgattggctccggcccggcgggtgagtggggcgcggtacaagcggcgctggcgggcaagcgcgtagcggtggtggagcgggagcccgtgctgggtggtaccgcggcgaacacaggcacccttccctccaagacgctgcgcgagacggcgctgcacctgtccggcttccgggcgcgcgggctgtacagcgtggagacgacgctgcggcacgaggccacggtgtccgacttcctcttccgcgaacggcgggtgaaggacatcgagcgcgagcgaatcgcccgcaacctccagcgccacaaggtggaaatcatccagggcaccggcgcgctcgtggacgcgaacaccgtcgtcgtgcggcgccaggacgccccggagcggcgcctcaccggcggcaccatcctggtggccaccggctcgtcgccgtaccggccgccgctgtaccccttcgaggacccgcgcatccacgactcggacgaggtgctggagctcgaaaggctgccgcgctcgctggtggtggtgggcgccggcgtcatcggctgtgagtacgcctgcatgttcgccgccatggacatcccggtgacgctggtggaggcgcgcgcggagctgctgcccttcctggacgacgagttctccgcgctgctgggccagcgcatggaggcgctcggcatccaactgcgcttcgggcaggtggtggagcaggtagacgtgccgcgggacgcggacactcccatccggatgatgctctcctccggcgccgtgcttgagacggaccaggtcctggtcgcctccggccgcaccgccaacacggcgggcttggggctggaggctctgggcgtgcaggtgggcccgcgcggccaggtggaggtgggccccacctaccagacggccctgccccacatctatgccgtgggggacgtcatcggcttcccggcgctggcctccacgtccatggaccaggcgcgcatcgccgtggagcacgcgttcgacctgggcggcgtgcgcaccatggcgccggtgctgccctacggcatctacaccatccccgaagtgtcgatggccggcgagacagaggaggccctgcgcacgctgaacgtgccctacgtggccggccgcgccgccttcgccaccaacccgcgcggtcagattctgggagacacgcacggcctgctgaagctgctcttccaccgggagagcctcaagctgctgggcgtgcacgtcatggggccccaggcctccgagctggtgcacgtgggcctcaccgccctgctcaccggctccacggcccggctcttcgtggagacgtgcttcaactacccgacgctgtcggaggcctacaaggcggccaccttcgacgcgttggatcagctcagcggctgcccctga

SEQ ID NO: 3951 - DNA, 5973 bp, Myxococcus xanthus
tacaggaagcgcggcgtggatacccggcacgtccgcgagttcctgtcccgcaagctgcccgaacacctggtcccagcgacctacgtcgtgctggaggcgctgccgctgacccgcaacgccaaggtggaccgcaaggcgttgccgcatccggaccacgtcgcgcggcccacgcagcgcgaggagagcaagcccgctgccgccgcccgtccaggccgtgaggcccaggcgcttcagcagtccatcgcgaaggccgtggcggaggtgctgggggttccagaggtccacccggaccggaacttcttcgagctgggcgccaactcggtgcacctcatcaagctccacctcgagctcaaggagaagctggggctgtcggttcccgtcacggacctgttcggcaggcccaccgtcaaggtgctcgcggccaggctcgcggcggcgggcggtgaggagaagcccgaggtggcactcgcgccgcgggaggagacgccgcggacgcaggatgcgcgggacatcgccatcatcggcttgagctgccgcttccccggggcgtcgacgcccgagcagttctggcagaacctgatgcagggcgtggagtcggtgggcaccttcaccgatgacgagctgctggccgcgggcgtcagtccggaggcgttccggaatcccgggtacgtccgctcgtcggcggtgatggatgactttgacgccttcgacgcggagttcttctcgctgacgccccgtgaggcacgcgcgttggatccgcagcagcgggtgttcctggagtgcgcctgggaggcgctggagcacgcgggctatccgccgtcggggcgcaacgggctcgtcggcgtgtatgccgggaagagcgtcagccactatcgctatccctacccggacctgacgcgccccatcggcttcttccaggacctgatggcccaggacaaggacttcctggccacgcaggtgtcctacaagctcgacctgcgcgggcccagcatcaacgtccagacggcgtgctccacgtccctggtcgcggtgtccgcggcgtgcgcggcgctgaatgagggcagttgcgacctggcgctcgcgggtggcgtggccatcaaggtgccccaccgcgtgggctacttgtacgaggaaggcagcgtcttctcgcgcgatggccactgccgtcccttcgacgccggggccaacggaaccatcccgggaagcggcgctggcatcgtggtcctcaagcgcctgagccaggcgctggcggatggggaccgggtgctcgccgtcatcaagggctccgccatcaacaacgacgggcaccgcaaggtgggcttcatggcgcccggcgtcgagggccagacggacgtggtgcgccgtgcgcatcagcacgcgaaggtggacccgcggaccatctcctatgtcgaagcccatggcaccggaacggccattggcgaccccattgaggtctccgcgctgacggaggcgtttgggggacaggtccaggcgcagtcgtgcggcctgggctcggtgaagggcaacatcggccacctcgacagcgcggcgggcatcgctgggctcatcaaggtcgtgctcgcgctccagcaccgcaccttgccgcccacgctccactatcagtcgccgaacccgcggctggagctcgacaagacgcccttctacgtggtggacaaggcccggccgtggaccgcgacgcagggtgtcctgcgggcggggctcagttcgttcggcatcggcggcaccaacgtccatgtggtcgtcgaagaggcgccgccgcaggcgacgccagcgccggacgtgcagccgttggaccgctcgcggcacctcctggcgctctcggcgcggagcccggaggcgctgcggcagctcgcgggccgctaccgggcggcgctcgaagcaccgggcgcatcgctcgcggacgtgtgcttctccgcgaacactgggcgtgtcgccttcgaccaccggctcgcggtggtgggggaggacgccgcgcaggtggccgccgtcctgggcgcggcggagcggaaggacgagcacccgggggtcgtccagggagaggccgacacgaagcaggcggtgaaggtcgcgttcctgttctccggtcagggctcgcagtacgtcggagccgcgcgcgagctgtaccagacgcatccgggcttccgccggcgcatcgactcgttcgaccagatgctccgtgagtattgggaccgttcgctgatctccgtcctctacgcggagccggggacgccatcgcccatcgaccagctcgactacgcccagccggtggtcttcgtgttggagtacgcgctggccgagctgtggatgtcgtggggcatccagccggacgtattgctgggacacagcacgggcgagctggcggcggcctgcatcgcgggcgtgttcagcgtggaggatggcctgaagctggccgttcaccgcggacggttgattcagcagcttccggagggcggcaacatcgcggtctccgccgcggagccggagctgcgccagttcctcgcccagggcggttgggccagctccatcgcggccgtcaacgggccggacaacgtcgtcatctccggcatccccgcggagatcgtggagataggccaggcgctggacgcgaagggctacaaggtcaagcggctgaacattccgcgcgcggcccactcggtcatgatggaggccatcctcccggagttccgggccgtcgccgcgtcgctgcgttattcgccgccgtcgattccgatggtctccgggatgactggcgagctcatcacggacgggctctgcacgccggactactggtgcagccagcttcgcaacccggtgcagttcggccggggcgtggaggcgctgtaccgcgacggcatgagcgtcttcgtcgaggtcggcccgaaggcgaccctgctcggcatggcggcgcgctcggtgcccgagggcgcgggcacctggctgccgagtctgcgcgccgatgatgggggctggcggcagatgctggagagcctggcggcgctgtacgtgcgcggcgttgcggtggactgggcggcagtggatgccggctacccacggcgcaaggtggaagtccccacctatgccttccagcgtcagcgctactgggaggagggcgcgggcctccagcgtcccaacgggcgaagcgtttcccgcgccgagcacccgctgattggcgagcgcgtgcccctggccgtcctggaggccggtgagctgctgttcgaggccacgctggggcctgcctcgcaggcgttcctgggccagcaccgcgtcttcggaacgcccacactgcctgcgactggctacgtcgagatggcattggccgctgggacccggctgttgggcacgaccgcgctggagttgaccgacctggccatcctcaacgcgatgaccttcccgaaggatgccgagcggaaggtgcagtgcgccgtgcgccgcgacggagagggcagggccgctgtgcgcatcttcagccggacgggtgagggctcggagcgcgcgtggagccttcatgcgacgggcacgctcgccgtcctcggtgatgatgcaacggccaccgaggcgcacgacctcgacagcgtgttgagggacctgcagaccccgcttcccgtcgaggactactaccagcgggcacggaacgcgggcgtcgacttcgggccggagttccagggcatcaccgagctgcgccgggaaggcgagcaggtcctggcgcgcatcgagcgcccggcgggcctcgggagcggcggtggctacctcgcgcatcccgccctgatggatgcctgcctacaggtggtgggcggcgcctatccggacatggatggcaccgagctgtacgtgccggtgcacatcgagcggcttcacgtgctgggcagcatcgaagacggcgtgtggagccatgccgtggtgcggccggtggatgaggctgggaagcggttgcgtgcggatgtccgcatcttcggaagagatggcgcgctgcgcgcctgggtgcgtggcctggagcttcagcgcacgagccaggaggcgctgcgtgccgcgctctccacctcgctggatgagtggctctacgagcggcggtgggagccgctcgcattggaggggactcgtccggagacgctggtgcccgcgagcggcgcgtgcctgattctctctgagcgcgacggcgcagggcagcagctcgcacaggtgctgaagcgcgatggccgcgcctgcttcgtcgccatccgtggcacacggtcgcaccgtatcgatgagaccaccttcgaggtccccgacgcgcccgacgcgctcgtggaggccttgcgcgaactgccgcttccggcggcactgtccgacgtcatcctgatgtggggctcccataccgaggaagcggagacgctggatgcggatgcgctggggcaggcggctcgggtgacgggggggggcgcgctgggactgctccagttccttctggaccgtgggtactccggcaccgtgtggctggtgtcgcgtggcgcgcagcccgtgaagccgggcgttccgttgaccgggatcgcccagtcgttgctgtggggcatggcgcggcccctgaccatcgaggcgtcggagttggattgccggtgtgtcgacctcgatgcccagggcgaaccgagcgcccaggtggagttgctcgcgcaggagattcgccgccgcgcggaggtggcggaggaccaggtggcctatcgcgatggccgctacgtcgcgcgactccggagggtcgagtcacggaagctcgttgaagcatccgcggagcgagtcgaagccttccgggcggaccgaagctatctcgtggcgggcgggctcggacgcctgggcttgctgacggcggagttgctggcgagccggggggcacgaaacctggtgctgacaggccggggcgctccggggccgcagacggcggaacgtctggagcacctgcgccagcagggtgtccgtgtcgagtaccggcaagtcgacatcgcggatgcggagccgctggccgcgctgctgaacgaggtggcgcgggacatggcccctctgggcggcgtgttccactcggccggtgtgctggatgacggcgtgctgcggcagcagcgctgggagcgcttcgagaccgtgctgcggccgaagttgcgcggcgcctggaacctgcatcgtctgaccgcgggcctgccgctggactacttcgtgatgttctcctccgtcgcatcgctcgtcggctcggcgggacagtcgaatcactgcgcggcgaacgccttcgaggatgcgctggcgcaccaccgccgtgccctgggcctgcctgccctgagcatcaactggggcatctgggccggtgacgcgggcgcccaggtgtcggtgagcgaggaggctcggacgccgggcttcggtgtcattccgaaggcgcagggcctgcgcgcgctggagctgctcctcacatcgcgcgttcctcaggtcggcgtggccgccatcgactgggccgtcttcggcagcggccggtccacgccctacgccgcggagttgcgcgagcgggcagggggcgagcgcacggtggagcgcgcgtcgttcctggacacactcacggcggcgcccatcgagatgcgtcggcagttgctgatggactacgtgcgcgagcaagtggcgtggatgcgaggcgtgggctccagcgagtccatcgacccggcgcgtgggttccacgagctgggcatcgactcgctggcggcgctccagctcaagaaccggcttcagagtgggctcggcgtgtcgctgccggccacgctcgtcttcaattacccgacggcagagaagctcgcgacgcagctcatggacgcgttcatccctctggagttcacggaggaagcgcgcgtcacgtcgaagtcagacgccccggtcgagagcccactggaagggctggctgaagcgaacctcgcgcacctgctctccgagcagttgtcgaagatgaactag

SEQ ID NO: 3952 - DNA, 5523 bp, Myxococcus xanthus
atgaagcgcgcacttctgaagttgcaggagacgcagtcgaagctcgatgcccatgagcaggaaaagcacggggccattgccattgtcggcatcggctgccgcttcccggggggcgttaccagtcctggcgaatactggcgcctgctctccgagggcgtggacaccgtcaccgagattccatccgaccggtggaacgcggacagcttcttccaccccgacccggaccatcccggtggcatctacacgcgccacgggagcttcctgagggacatcgaccagttcgaaccgcgcttcttcggcatctccccgcgtgaggcggcgcggatggacccgcagcaccggctcttgctggaggtcgcctgggaggccgtggagcgtggcggccggaatccgacgagcctgagcgggacgcggactggcgtgttcgtcgggctgatggggcaggactacacgcaaattgccacccagtccccggagctcatcgacgcccacaccggcgcggggaatggcgcgagcgtcgccgcgggacgcctgtcgtattccttcggactcgaagggcctagcctcacggtcgataccgcgtgctcctcgtcactggtcgcggtgcacctggccatccgcagtctgcgtcagcgggagagcgacttcgcgctggcgggcggggtgaacctggtcctctctcccgtcgcgacgctgattgagtcgcgcacgcacatgctgtcggccgatggccggtgcaagaccttcgacgcctcggcgaacggcatcgggcgaggggagggctgtgggctcgtcttcctgcggcgcctgtcggacgcgatcgcggatggggaccccatcgtcgcggtgattcgcggctcggcggtgaaccaggatgggcggaccagtgggctcacggtgcccaacgggcttgcccagcagcgcgtcatccgggatgccctgcgggacggacaggtggagcccgcgaaggtgggctacgtcgaggctcacgggacggggacgtcgctgggcgaccccatcgagctggaggccctcgcgtccgtctactgcgccaggacgggacggcagcagcccctgatggccggctcggtgaagacgaacatggggcacctcgaaggtgcgtccggtatcgcggggttgatcaaatccgcgctgtgcctggcgaacgaggaggtcccgccgcatctccacctgcgcacgcccacgtcgcatgtggactggaagcagttggccatcgaagtgccgaccgcgcgccgtccgtggcaggggacggagtcgcgcttcgcggcggtgagttcgtttggcttctcggggacgaacgcgcacgtcgtcctggagtccgcgccacggccgaagtctccggtccgggatgtggaacgctcgcgtcacgtcctggcgctctccgcacgctcgaacgccagtcttcgcaggctggccgggtccatcgcggaggagctgtcgctgggccccgcggaagggctcgcggatatctgccacacggcgaacaccggccggagcgccatggaagagcgcgtggccttcacggcttcgacctccgaggagctgaccgaggcgctgcgtgcgttcagccgtggagcgcccacggtccgcgagacctgcgtggaaggccgccgcgacgccgaggcaccgcgcgtcgcgttcatcttcacgggccagggttcccagtacgcgggcatgggccgggagctgttcgacacgcagcccgagttccgccgggaactcctgcgcttcgagggcatcctgaagccgcacctggagcggccgctcaccgaggtgctcttccaggacacggaaggggcgctggacgagacgcgatacacccagccagcgctggtggcgctggagctggcgttggcgcacctgctgcgagcgtggggcctgcgcgccgacgcggtcctgggccacagcgtgggcgagtacgcggcggccatgttcgcgggcgtcctggagcccgaggccggcttgcccctggtggctgagcgcgctcggctgatgcaggcgctgcccgagcgcggcgcgatgctggccgtgttcgccgagtctgcgcgcgtgctgccgctcatcgccgggcatccccgggtgacggtggcggccatcaacgggccgcggaacaccgtcatctcgggggacagcgcggccatcgaagccgtggtccaggcgctcgtggaggcgggcatcgagagccggcgattgaaggtgtcacacgcgttccactctccgctgatgcagccgatgctggcggagttcgagcgggccgcgagccgggcctccttccagaagccgcgccttcccctcatctcgaacctcgacggacgcgaagcaggcgaggccatcacccagccggcctactggtcccggcatgtcctccagcccgtgcgcttcgaggacggcatccggacgctcctccagcgcggggtgcgtgtgttcctggaggtgggcccgaagccctcgctgtccaacctcgcgcgggacgtggttgcgggtgaagaggcgctgtggctggagacgcttcacccccgccgctccgactgggccggcctgctccgggcgatgtccgagctgtatgtgcgcggcgccaggctggactgggagcgcttcgatgcgggctatgcgcggacccgcaaggccctgccgacctatcccttcgagcggcagcggtactggctggatgtgcccgcgccgtggacgcgcacgtcgcgccgtgcgtcgactcacccgttgctggggacgcgtctggagtccgccgctttgaaggaggggacgaccgtcttctccagtgagctgtcggcgggaaccgtgcctttcgtggcggaccatcgggtgtacggcaaggcggtggttcccgcggcggcctacgtggagatgctggcctcggcggcggcgcaggtgctcggaacggagtcgctgcggctggaggacatctccctgcttcagccgctggtgctccccgaacagcagacgcgggtcgtccagacgttgctggaggaccagggcgaggcgggccttgcgtgcaaggtggtgagccggggggacgagcgctcggaggagggcggcggcggatcgcgcgcggcctgggtcacccatgtgacgtgccgggtgtcggcactgagcaccgtggccccatcggtggatcgggaggcgtggggtcgtgactgcgcgacgcctgtttccattgatgaactctccgccgtcttcacgcaccacgggctcgactatgggccgtccctgcgggtgctgacgtcgctgcatcgggggactggggccgcgctgtcgttgggccaggtggaagaccggagcgggcactaccgcgtccacccggcgctcttcgacggctgcttgcgcacggcggcggcggtgtcgcggctcacggaggaagacgcgctgcacctccccgtggccttgcagacgctggacctgtaccggccgctgccggagcgggtctggacgtatgcggcgcagcctccccgggagggacaggagggcttctccgcgacggacctgaccctgtgtgacgacgatggcgccgtggtggctgtcgtgtcggggttctcggtgcgcaaggccgaacgcgacgtgttgctgcgtgggctcgaaaacgacttccaggactggctctaccgcctcaactgggtgtcgcgtgccgtcacggaggaagcccactccgcgaatcagcattgggccgtcttcgccagcgaggacgacttcgcctcggacctggtgcaggtgctttcgcagcgtggcgagcgctgcacgttggtgcgcaagggggagtcattcagcagcacgccagagggcttccgcatcaatcccgccaacccggaggaccatgcgcggttggtcaaggcgtgggcgaatcagcctcccacggggctgttgtacctctggggcctcgatgagggaggccatgcgggtgacgcgggcgccaggctcgacgcggctcaggagttgggatgcctgggcgcgctgcggttgacgcaggccctggcgcatggacagggagcgtcgccccggctggtgctggtgacgcggggcacgcaaagcctgccctccgatacgcacggcgcccgcgtcgcgcaggcgccgctgtggggcttcggacaggccgtggcgacggagttgcccgaactgcggtgcctccgcatcgacctgcccgcggagccccggtccgaagacctgggcaccttcgtgcgggcgctcgcgttgccggatggggagtctggcgctgccattcgtggcggcggtctctacaccccccggctcgagcgggcccgttcacggtcggtcgcggcgaagaaggtgtccatcatcggggaggccacctatctcgtcgcgggaggcctggggggactcggcctgcgtgcagccaactggttggcggcacagggcgcacggcatctggtcctgatggggcgcagtgctccgtcgcctgaagcccgcgcccagctcgatgcgctcgagtcccagggcgtgaaggtgcgggtcgcacgggtggacatcgcgtctcacgacgccatggcggacctcttcgcgagcctgcgcgaagccccgcccgtgcgcggcatcattcattcggcgggcgtcctccgcgatggaacgctcgccaaccagacgtccgagcagttccgggaggtgctggcccccaagcttcagggcgcgtggaacctccatgcgctcagccagggcatggcgctggacttcttcgtctgcttctcgtccgccgcgtcgctcatcgggtcgccgggccagtcgaactacgtcgccgcgaatgccttcctcgatgcgctggtccatctgcgccacgcggaggggctgcccgcgctgacgctcaactggggctcgtgggctgagacgggcatggcggcgcggctggagcgggcagcctccgcgcggccgggggcgcagggcttcggcgccattcccgtccagcagggcttcagcgtcctggagcggctcatcgggagcgcgcaagtccagtggggcgtcttccccgtggactggacgcggctggcggagcagttgccagggctcgcgcggcaggcgctcgtccagggcttgctggggagcgtgccacagcgggcgcaagcgccggccttccgcgcgcagttggacgcggcgccgccgaatcgcaaggcggagttgctgcgtcagcacgtcgcggggcaggtgtccgcgacgttgggcatgccggagtcggagcggctgtccggaaacgagcgcctgttcgaactgggcgtcgattcgctgctggccatcgaaatcaagaaccggctcgcgagcagtctcgggcgaagcctgcgttcgacgctgattttcgacttccccaccgtgaacggactcgtcgcgcatctggccgaggagctggagctggggacagaggttcagaagaagcaggaagcatcgcgggaggcgcagggcgcgctctccgcggagattcaagggctgtcggagcaggagctgacgtccctcatcgaccaggagctggagagcgcgctcaccagatga

SEQ ID NO: 3953 - DNA, 5226 bp, Myxococcus xanthus
atgtacacgcgccgaggcgccttcatcgacggcgtcgacctgttcgaccctggcttcttcggcatcacgccgcgtgatgccaagggcatggacccacagcagcgcttgttgctggaggagtgctggcgagccttggagcgcgccggcatcccacccgccggcctcaccgggagccgcaccggcatcttcctggggctgatgcacaacgactacaacctgctgggcatcgccgagaacatggagttccactcggcgtcgctcaattacccgtccgtcgccgcgggacgcatctcccacacgctgggccttcaggggcccgcggtctccgtggacacggcgtgctcgtcgtccgcggtggccatccacctggcctgtcagagcctccgcaacgacgagagcgacctcgcgctcgccgcgggcgcgaacctgaacctctctcccgtcacggtgatggtggagtgccagaaccgcatgctggcggcggatggccgctgcaagacgttcgacgcctccgcggacggcttcgggcgcggcgagggttgcggcgtcgtcgtgctcaagcgcttgtcggatgcgctggcccatggcgatgccatcctcggcgtcatccggggctcggcggtcacacatgacggccgcagcagcgggatgatggtgccgaacggacgctcgcaggagcgcgtcatccgggcggccctggatagctgtggcgtggagccggaccaggtgggctacatcgaggcccatgggacggggacactgctcggcgaccccatcgagatggaggcgctgcggtccgtcttcgggcgcaagggcgctcgcggtgagccgctgtacgtcggctcggtgaagacgaacatcgggcacctggaggcagccgccggtatcgcggggctcatcaaggtcctgctcgccttgcagaacgaggccatccccgcccacctgaacttcgagcggcccaatccgaacatccgctgggacgacctgcccgtcaccatccccacggccacgcggccctggctgcgcggtgacaagcgccgtatcgcgggcgtcagcagcttcggcttcagcggcaccaacgtgcacatggtcgtggaggaagcccccgtgctggcgcggccccgcgtggacgcggagcgcccggcccatgtgctgacgctgtcggcgaagagcgaagccgcgctcgaagcgctgatggaagcgcaggaacgcgcgttgccggaggacccggcggcgctgggagactggtgctacacggcgaacacgggccgctcccagttcgagcaccgcgccgctgtttcgggcgccacggccgcggagctgcgcgcgaacctgacgcggctgcgcgaagagaagctgcgcccagcgcgcgaacccctgcgcggaacggagagcccccggcctgtcttcctcttcacggggcagggcgcgcttcgccctggagtggggcgggaactcttcgagacgcagccggtgttccgggcagcggtggagcggtgctcgaaggcgctggagggcctgctcgattgcagcctcgaagcgctcctcttcggtgagtcttccgcgatgcttctggaggacacgcgccatgcgcagcccgcgctggtggctctggagtatgcgctggcggagctgtggggcgcctggggcgtcacgccagcggccctcatcgggcacagcctgggagagtatgccgcggccgctgtcgcgggggtgttcagcatcgaggaggcgctgcgtctggtcgtgacgcgtgcgcggctcatcggcgagctgctgggcccaggcgcgatgctggcggtctctgctccgctcgacacggtgaaccgggccatcgcgccgcacgccggctcggtctccctggcggcggtcaacggccctgatgacgtggtcatctccgggacgcccgacgccatcaccgaggtggagcaggcgctgtcgagccagggcatccagacgaagcgtctgcggatgtcctacgccttccactccacgcagatggagcccgtgctgaagccgttcgccgaggccttccaagggctcacgctgtcggcaccgcgcatcccgctggtgtccacactggagggccggcgtgtcggcgacgaggtctcccggcccgagtactggtgccgtcagattctagagcccgtcgccttcgccaaggcgctggaggcgtcgcgggaggacgggcaccggacctatctggagctggggccggcgcccatcctggctggcattggccgcaggacgttccagtcggaagagctgtgctggctccccagcctgcgtccgtccaccggagagacagcgcagctgctctccagcgtggcggagctgtacatgcgtggcttcgacgtggattgggctgcgttcgatgcgcctttcgagcggcgcccgcgctgcttgccgacgcatcccttccaacgtgagcgctactggatggacttgcaaagccccgagaatcgccggggctatgcggcgcgtgacgatgccgcgcgaggcgatgcgcactccctgccggggacaccgctgtcgctcgcgggggcgaaggaaacgcgcttcgcggcccggctgagcaggcacgagcccgctttcatcgaggagcatcgtgtgctgggcaacccagtgctgccggccgcctgctacgtcgagatggcgctcggcgccgcgcaccacgcgacgtctggcgggaaacctctggagctcacggccatcgagctggagcgggcgttggtcttcgccgagggacagtcacaggacgtccagacggtgctgacgcccgaggagcagggctctcgcttcgaaatcttcgggcaggcgacagggacggcggatcggaattgggcccggctggcgcagggccgcatcaccgagggccgcatgaacccggagcacgtggccctggagtcggagctgttgcaggcgttcccccggcagggctccgtcagcgcgcactacgacatgatggcgcgcggtgggttggagtacggcccttcgttccgaggcatcgatgcgctgcggttcggcggggagggatgcctcgcccacgtgcggctgcccgatgcgctcgtcatcggtttgggggactactggctgcatccgttgctgctcgacgcatgcttccagacggcggcggcggcgttcacggacggcggcgcgcaggtggcgggagaagggcagggacgcattccggtcgccatcgagcggctgcgttggttcaagcggcctgggagcagcatctgggtgcacgcccgaaccggggcgcgcacgtcgctctcggagggactggcgagcgccgacctccgcatcctggacgaggacggcaccgtcgtcgccgaggtggaaggcctgctgctgaagcaggtcgaccgccgcgcgttccaggcggccttctcgggggcgatgcaggaactcctcttcgagctggcgtggcgggagcagcccgcgccctccgcgcgtgaccaggtggcttcgcagtccgggccttggctgttgctggtggactcggatcgcgtcgcggacgaagtcaggacgttggcgcggcaacgcgcttggatctgcgtggtggccacgcccggtgcgtcctacgaacgcgtcgacgcgaaccactaccggctgaacccccatgacgcggcgggctttgaccggctgctccaggacgtctccgctccagcggcagtggcctatctgtgggggctcggcgaccgttctcccgaggccctctccggcgcggtgacgtcgagcaccttgggcgcgcttcacctcgtgaaagcgatggcgcgtgccggctgggcgcagccgcctgccctctggatggtgacggagagcgcggtggccgccacgcccacggatgcggtggagggctttgctcaggcctccctctggggcttcggccgcgctgtggccatcgagcacacggagttcatgtgccgcatggtggacctggagccgggctccgaatcgctggagcgcttgttcctcctcatggcgcagccgccgcaggagaacgtcttggccctgcgcggcggccggatcctgggcgcgcgcctcgtgcgtcctggcaagccacctgaacgcgctgcccccgtgcgtatccgccccgatggcgtctacctcgtcacgggaggcctcggggcgctggggctcgagactgcggagtggctggtgggggccggggcgcggcacctgctgctggtgggacggagcgagcccacggacgcggcgaacgctcggctcgcggcgctgaccgcccggggcgtcggcgtcaccgtcgcgcgcgcggatgtctcacgacaggaggacgtgcagcgactggtggcgagcgtgtcagagcggggcctgtccctgcgaggcatcatccacacggcgggcgtgctggaggacggcgtcatcctgcaccaggatgcggagcgcttctcgcgcgtgttcgcgcccaaggtgcagggcgcgttgaacctgcaccgcgccacggccgggatgccgctggacctcttcgtcatgtactcgtccgcggcctcgctggtgggcgtggcgggacagtcgaactacgtggcggcgaacagcgtcctggacgcactggcgcaccaccggaaccgcctgggtctgccagccctcagcatcaactggggacggtgggcgggcgcgggcatggccgcgaagagcgcggaccggccggaagcgtcggatgccgccagcctctcacccgaagtggcgctccaggtcttcgaacaactgctggagcagggggccgtgcaggtgggcgtcgtgcccttcagcgtctcctcgctggaggcggggccttcgcccggccatggccccttgttctccgagctgatgctccgtgagcaggcccggtccgcggcggcttcgcggatgcatgagctgatggaagagctgaagcgggcggacggggagcgccggcgcgcgctgctgacacggtacgtacagagccggctggggcccttgctgggcttcgccccggaccacgaggtcctccagaagaggatttccttgaacgagatggggctcgattcgctgcgcgcggtcgagctgaagaaccgcattggccgcgagctgggagtggacctgctcatggcgcgtttcatcgacggcaccacgctcgacgggattgtggatgcgctgagcacccagctcgagctcaaggagctgctcgcgcgtgctcccgcggcggaggccgcagccgacatcgaggagttgacggtatga

SEQ ID NO: 3954 - DNA, 1956 bp, Myxococcus xanthus
atgctgagcgcgttcttcgtgctcctgcaccgcctcacggggcgtgaggacctggtcctgggcgcgaactccatcaaccggacgcgtacggagctggagccgttggtgggcttcttcgtggacaacctggtgatgcgggtggacctcggtggcggcccggggttcgccacggtgctggagcgcgtgcgtgagacggtgctcgatgccttcgctcaccaggacctgcccttcgacctgctcgtggaggagctgaggcccgcgcgcagcctgggcttcaacccgctgttccaggtcgtgttcgcctgggtccgcgcttccggcgaggcccaggacgagacgggcctccgcatgcggccgctcgagttcgaggcggaatcatcgcgcttcgacctcaacctcttcgtggatgaccacggcgaccggctgtcggcgcggatggtgttcaaccgcgacctcttcgagcagggcaccatccagcactacgtggactgcttccaggtgctgctcgaagggctcgtggccgagccccagcggccggtgggcgagctgcccgtgctccccgcggatgtccgcgagcgcgtgctccggcagtggaacgacacggggacgccggaggcggaaggcgcgtgcctccatgcgctcatcgaggcccaggcgctgcgcacgccggatgcggtggccatcgtcgtggacgactgggagctgacctacggcgagctcgaccagctcagcgaccgggtcgcagcgtcactccaggatttggacgtgggaccggaggtggtggtcggcgtctacctggaccgttcggcggagctcatcgtgagcctgctggcggtgatgaaggcagggggcgcgttcctcgcgctcgacgcagacgagcccgtggaccggctccgccacatcgtggcggatgcccggccccgggtggtgatttcttccgcgaagctgtccgagcgcctctggggcatggggggcttcgtcacgctccacgtggacgaaggctaccgggacatgcccgccgcgccgggccagcagctccgccgcgacgtcctccccgaccacctggcctacatcctctacacgtcaggctcgacgggccggcccaagggcacggaaatcacgcaccggagcatcgtcaactacctgcgctggagcgtggacgcctaccggcttcgcgaagggacggggagcccggtgattggctccgtcagcttcgacggaacgctgacgagcctcttcgcgccgctcctggcgggccgcgcgctgttcctcgtgccacgtggtcacgaaatcgaccagttgacgtcccgggactaccccgagcagggcttcagcttcatcaagatgacgccgtcgcacctgcgggccttcaacggcctggggcgcacgcgcgaggtgctcggccgcacccatgcggtggtgctgggcggggaagggctgcacggcgtggatctggccccatggcgggagcagggcctccccacgcgcgtcatcaacgagtacggccccaccgaggccgcggtggcgtgctgcttcgagacactgctgccggatggaacacctcccccggagcgggtgcccattggccggcccatctcgcacatgcggttgtacatcctggaccggtacctccagcccgtgcccgttggcgtacccggcgagctgtacatcggcggcgtcggactggcccgaggctacctgcgccggccggacctgacggcggagcgcttcgtccccaaccccttcgacgggggcctggagggctcgcggctctaccgcacgggggaccacgcccggtacctctccgacggctcgcatcgaatacctgggccgccaggacgaccagctcaaggtgcgtggtcaccgcgtcgagacgggagaggtggaggtggtgcttgcggagcacccggccgtccacgtcgccgtggtggtgtcgcggaaggacgcttcgaatga

SEQ ID NO: 3955 - DNA, 714 bp, Myxococcus xanthus
atgagtcagcagcgcaacggccccaagaagaaggaagcggctttcagcaacaaccccttcaagtccgccatccaggtgatgaaggaccaggagaagaaggaggcgcaggagaaggccgcggcggaggtcgcgaagcgcaaggccgcggcgcccccgccccgggccacgaaggcgcccaaggtccgcgaggaggacgatgcctcccttttcttctccgccatggacggtgtgcagcagctcacccaccggggcgaagcgcccgcgcccaacccgcgcctgcctgcaatcatcgatgaaaacgcggaggcgctcgcgcagctctccgagctggtcgccggccagggcgacttcgacttcaccggcacggatgagtgcatcgaaggagcgagccccggcatcgaccggaacctgatgcgcgcgctgcgccggggcgacttcgccatccagggacagctggacctgcacgggaagacacagagcgaggcgcgcgacgcgctggaacgcttcctgggtgacagccgccgcgcgaagaagcgctgcgtgctcgtcgtgcacggtcgcggtttgaactccaaggaccagattcccgtgctgaaggagcggctcaagggatggctgtccgagaagcggattggccggatggtgctggcgttcgctaccgcacggcctcaggacggaggcaccggcgcggtgtacgtgctgctccggcggtag

SEQ ID NO: 3956 - DNA, 2101 bp, Myxococcus xanthus
atggtgccctcgtggttcgtggtcctggagtcgctgccgctgctccccagcggaaaggtggaccgtaaggcgctgcccgcacccgacgtggacgtcagcgagcgacagtacgtcgcaccccgcaccccgacggaagagctgctgtgtggcttcttcagcagggtgctgggcgtggagcgggtgggcatccacgacggattcttcgagctggggggccactcgctcctcgcgacacagctcgtctcgcgggtgcgttcggccttccgggtggagctcgcgctgcgggagttgttcgaggcgcccacggtagcggagctggcgcgtcgcatcgatcaggcgaagcggtctggggccgagatgccgatgcttcggagcccggcggtgccacgcgcacgtgagctgcccttgtcgttcgcgcagcagcgactttggttcctggatcaactccagccaggaagtgcgttctacaacgtgtccgcggtggtgaagttgaccggcccgctggacccgatcgcactggagtggagcttcgaggaactggtgcgccgccatgagtcgctgcggacgaccttccgggccaaggatggaaccccggtgcaggtcatctcggccgagccgacgctcgccttcgctgtggtgtccctggaagcgctggatgacaccgagcgcgatgccgctgcgaagcgcttggctgaagaggaagcccagcggcccttcgacctgaagaaggggccgttgctgcgagccacgttgctacagttgcgagagcgggagcacgtgctggtgctggtgatgcaccacattgtgtcggacgaatggtccatgggcatcctcgtgcgcgaggtgtccgcgctctacgagccgctgtcccaggggcagcgctcctcgttgccggacctcccgcttcaatacggcgattacgctgtctggcagcacgagtggctggcagacgacgtgttggaggcgcagctcggatactggcgacagcagctcgctgggtcgccgagtgcgttggcgttgcccacggacaagcctcgcccggtgatgcagacgttccgcgggagcatgcaagaggcgctctggccctccgagctatgggccgcggtgaaggcgctcggacagagagagggcgcgacaccgttcatggtgctgctcgcggccttccagacggtgctgtcgcgctactcggaccaggacgacgtgagcgtgggctcgcccatcgcgggccgcacacgtgaagagacggaggggttgattggcttcttcgtcaacacgttggtgctgcggacgaaggtctcccctgtgtcgagcttccgcgagctgctcgctcaggtacgggaggtgacgctgggtgcgtatgcgcaccaggacgtgccgttcgagaagctggtggaggagcttcagcccgagcgtgacctgagtcgcagtccgctgttccaggtgacgctgacgctgcagaacacgcctttctccgaggtccaactgcgggagctgacgctgacgggcgtcgacgccgaggagaagacctcgaagttcgatttgtcgctgctcgcggaagaggtgccgcacgggctttccgtggcggtgaactacaacagcgacctgttcaaagccgcgacgatggaacggctgctggggcacctgcgggtgttcctggatgccgctgtgagcgctccagagacgcggctgctcgacctgccgttgatggggagtgaagagcgggagcgactggtgaaggaatggagcgggacggcgtcggagtacccgcgcgatgccagcctgagtgtcctcttcgagcagcaggtgcagcggacgccggacgcggtggcggtggagtacgaggaccagcgactgacgtacgcggagttgaatcgccgtgccaaccagcttgcacatcacttgagggggatgggcgttgggcccgaagtgagggtggggctgtgcgtggagcgctcgctggagttggtggtgagcctgctaggcatcctgaaggcgggaggcgtgtacgtgccgctggatgccagctacccgctggagcgactggcgtggatgaagcaagagtccggcgtcgcggtgctggtggcgcaggagaagctcgcat

SEQ ID NO: 3957 - DNA, 642 bp, Myxococcus xanthus
ggccccttctcgagcatcggcacgctgccggccaacctccgcgtggagctggacgctttggatgtgaggggccgccagttacaggacgcgctcaagggcgactcgcacaccctggccacgcgggccctggccctctaccgccagtgcaaggacgtggtgacgaagatgccgcccagcaccgggcgcacggagctgctgggcgtgctggagaagatgacgggcgacagcttctcactggcggaggtccacttcgggctggaggcgcagctcggctccgtggtggccaacgacgtggacgcccaggtgcgcgagctgcgagagcgcgccgccgccacgcaggacgcggtggcccgccggcagttggagctggccgcgtcctctctgggtgaagagctcaaccacctggacgtgctggcccgccgcaaggagcggctgctggcccagctccacgcgcaggtggcgctgctggagcgcgcccgggtctccttcatcggagtgcagggcaacgagctgggtgccaagggcgcgcaggccgctgacctggcgcgcaagctgaagcaactgggagagccctcctccagcggggggcccgacgacgtcgcctccgtggccgcgccgaaccccacgcgcgtcgccccctga

SEQ ID NO: 3958 - DNA, 759 bp, Myxococcus xanthus
atgacgctgggcgacctcatctactcgttcttcacctactacgcggtggtggcctacatcaccgtgggcatcatcagcctggtctttgccgtgaagtggttcgagaacccactgcgcatgctgctggcgatgctcgccgcgagcgtggcgttccccttcggctggtacctggtgcacaagcacatcctgcacagccgcttcctctacaaatcaccgctcaccgcggcgacgtggaagcgcatccacttcgaccaccaccaggacccgcacgacctgcgcgtgctcttcggcgcgctggccaacgtgctccccaccgtgggcggcgtgattgcccccattggctatctcattggcggcaaggcgggcgccgccgccgcgctgggctgggccatggtgattacgtgcttttatgagttctgccactgcatccagcacctgaactacacgcccaagtcccagttcctgaaggacatcaagcggctgcacctgtcgcaccacttccacaacgagcagggcaactacggcatcaccaactacttctgggaccgcctcttcgggaccttctacgagaagtcgggtgacaagcccaagagccccaccgtcttcaacctgggctacacggccgaggaggcccagcggtatccctgggtggaccggctctccggcggcacccgcggtgacggccacccgcgccgattctgggagaaccaggccgacgccaagacgccgccggagcccgcgacgcgacaggaaagctga

SEQ ID NO: 3959 - DNA, 396 bp, Myxococcus xanthus
atgagtgagacgaagctgccgcgtcccacggatggagagctggccatcctgcgggtcctctgggcgcgtggcgacagcacggtgcgcgaggtgcacgaagccctcacccgcgacgagcccgagggcaccgggtacacgacggtgctaaagctgatgcaaatcatgacggagaaggggttggtggagcgtgacgagtcccagcgcgcgcacgtgtaccggccccgggccacggagcagcgcacccagcggcagttggtgacggacctggtggaccgcgccttcggtggctctccggcgcggctggcgatgcaggccttgtcgtcgaagaagacgcgtcccgaggaactggcggagctgcgccggctgctcgacaccctggaaggaggcgaggaatga

SEQ ID NO: 3960 - DNA, 2118 bp, Myxococcus xanthus
atggagtccctggggtgggcgctgctgcactcgctctggcagggcacgctggtggcgctgacgctggcggtggcactcatcacggtggggcggcgcgcggcgcatgcgcgttacgcgctggcctgtggggcgctggtgctggcgctcgcgttgccggtggcctccgggtggaagcacttccacggcgcgcccgcgcgagtggcgatggacacctccgtgccgcgcgcgcagtccctgacctctgcgctgggaacgcggggcctggaggagacggtgacgcaggcggcgcggcccgcctggagagtggcgcccgtcgcggcgtcgcccgcatggattgacgcggacatggccgaggacggcgccgcgaacggcttcgagagcacgctgctgacgggcctcggctctttcctggtcatggccggcctgctactgcaacgcgcgctgtcccaggtggaagcacacctgcactggctggtgctggcgtgggtggcgggcgtgggcctgtgctcggggcggatggcggcggagtggatgaagctgcgccggctggcggaccgggccctgcccgcgcccgcggcgtggcaggagcggctggacgccctgtcgcgacgcctgggcctgcgccgcgcggtgcggctgctccagtcctccgacgtggacgtgcccgccgcggtgggctggctgtcgcccgtggtgctcctgcccgtgtccacccttgcgggccttcctgcccggcagttggagatggtgctggcccatgagctggcccacatccgccgtcatgacttcgcggtgaacctggcgcaggtgctggtggagacgctgctcttcttccacccggcggtccgctggatttcccacgtcatccgcgtcgaacgggagcactgctgcgacgacgtcgcggtggccgccagcggcaactccgtctcctacgcccgggcgctgacggcgctcgagacgctccgcgtgctgccgggagcgccaagccccgccatgtccgcgctgggcggctcgttgccggagcgcgtccggcggctcatcaccctgcccacgtcgcgctgcgcctcacgctgggcggcgggcgcctccgtgctcaccctggtcagcagcctggccgtggccgcgccgctgacgtcgctcctgctggggcagacggacgccgcgccgcagccaggcgacgagcccgtcctcatccagcctccgcccatcccggcgctctcgctcgccccgccggtgccgcccgcgcccacacccgtgccaccgccagcgcccccggcgcctcccgctcctccggccagtgtcgcggccgtggcggtccagtcagccccgggccccaccccgccacctgcgcctccggcgcggagcctgggttcgcgcgcccagcgtgagtcggaccagcagacgcgggtcggcgcggggcagcagctctccgtggcgcagctcatcgcgctcaagaacgcgggcatcaccccggagcgcgtgcagcaactgacggccatgggctacacgccgaccgtctccaacctcgtgaggatgagccacgccggcatcacccccgactacatccaggacatgaacacgcgcttcggccggaagctggaagcgaaggaactgacgcgcctgcggaacctgggcgtcacgcccgagtatgtccagtccctcaagtccgcgggcttcaacgtcgatgacccgaaggccctgtcccacgcgcgcgccgtgggcgtggacgaggacttcgtccgtggcatcaaggatgctgggtacgccggcatgtcgctggaggagctcgcccacctgcgcgccgtgggcgtgagccccgagtacatccgggagatgaacaagcacggcctgtcgaagctgaaggcccgggagctgatgcagcttcgcgccgtgggcgtggacccgggctggctcgccagcatccgcaaggcgggcgtgcagacgatggatacgaaggtgctccagcggctgcgcgccacgggcgtggacgcccacttcctgggtgagctccacgacgcaggcctgaaggacctctccgtcgacgaactggtgcggctgcgcaccggcggcgtggacgcggacttcatccggaagatgcgcggcaccggctcgaagtaa

SEQ ID NO: 3961 - DNA, 810 bp, Myxococcus xanthus
atgggcttcacggaacccctggcgtccttccagggactgtccaccacgggcggcgccaccaccttcaccctgccgcgcgaggccggtaccttccacttcgaaggccagttccaggacagccagggagcgggccacttccgcttcgatgccagcagcgacttcctcaagaagctggccacgctgggctactcggacatcacgcccgaggtgcagttccagttggcggcgaccaacgtcacgaccgcccgcatccaggggctggccgcgctgggctacaagcagctcagcacggaggaactcatccaggcgggcatcttcgacgtgacacccgagtacgtgcgcggcctgtccgacgcgggctaccccgggctgtcgttcaaggaactggtcgagagccgcatccaccgcgtcacgccccagcgcgtgaaggagttctccggcgtcggcttcgcgaagctgccctggaatcaactgacggccatgagcatccacggcgtcacgcccgacttcgtgaagcagatgcgcgagctgggcttccagggcacggacgcggatgacgtcatcgccttccgcatccaccgcgtcacgcccgacttcgtgaagcagatgcgcgagctgggcttcaaggacctcacccaggaccagattctggccttccgcatccacggcgtcacgcccgacttcgtgaagcagatgcgcgaggcgggctaccccaacgtcactccggacgagctggtgaccctgcgcatccacggcatcgaccgcatcttcattcgcgacatgtcggggacggcgccgaagaagaagtga

SEQ ID NO: 3962 - DNA, 494 bp, Myxococcus xanthus
atgcacggagcgccacccggccacatcttccccgcgggacggtggtggtggggagggtcggaatgtcgctgcttcgaaccgcttgtgccgggatgctcttcctggctgcgtgtgcatcaaccaacaagtccgcggcgcctgagccccgcgccacggcgccgcgagtcgagggggtggagtacggcttccacccccaggacccggtccgcgtcggctggggtgaccgggggatgatggccttcctggagctgctgcgaggcccccagggccagcgcatcgcctggcgccgcgtgggcccctgctgcggcaccggcgcgcccaccgagctggaggtcttcgaggtgacgtacgacgggctcgccgctccggtgagcctctacctggacccgaacaccgcgggcgccgtgcacgcgcccaacggcttcaacctccaggggctcgcctcccgctcgcaggtggagcaggaggagacgccccgggtcatcgagctgtag

SEQ ID NO: 3963 - DNA, 465 bp, Myxococcus xanthus
atgcgggtgaaggacatctacccaggcagggtgccgtcgcagccgacgaacctcacggtggtgaaggaccggctcttcttcgtcgcggatgacggggtgcacggccgcgagctgtggagcagcgacgggacgagcgcggggacgcggctgcacgccgacatcgccgtgggcgctctgggctcggagcccgcggagctgacggccgtggaggagtacctcttcttcagcgcccacacggaggccggaggccgggaggcgtgggtgagcgacacccgcgagccgggggtgttcgaggtgcagggcatcgcgccggggtccatgcactcggacccgagcaacttcgttcgctcggggtgggacctctacttcgtcgccagcgacagcaccgactacggccgcgaactgcgcgcgctgcgcatccggccggcgggcatgtgtgacatgagcggcaacgacgggctctga

SEQ ID NO: 3964 - DNA, 201 bp, Myxococcus xanthus
atggcggccaaccagctctacttcttgaagatccagtttgattcggcctgccagatccagaagatcatcccctacctggacaggcccgatgcgcccggcgaggtctactcccggcgagggaaacgctgggtcctcattggaatcatcaagccgagcaacaaggccgcaggcatcgtgacccccgttggcgggctggactga

SEQ ID NO: 3965 - DNA, 261 bp, Myxococcus xanthus
atggcgcgagccatccagctcgccatggaggacttctatccctgggacaagaaggcgccgaccccgtctcaccccggcagggagtgcctgtaccggcgcgagtcgtacgacgtctacgcggccccctaccaggagggcgtcgtcctggtcggcatcgtcctgtcgccccaggcctgcggcgcccaggcggtccccaacgacatgggcgcgctctatgccgtcgacacgcgaggttggcgcatcctcgccgtgcaacactaa

SEQ ID NO: 3966 - DNA, 1008 bp, Myxococcus xanthus
atacatgccgccatggcacgcgatctgatcgacctgcatatccacgtgggtggcgctgtggcgccccacatcctctggtccatcgcccaccagcagggcttcaagctcccggtgaagaactacttcgacttcgtggagctcatcacctcccgtccgggcaaggtgggaagcctggacgactacctgaaaatcctccacacctggacggagaagatccagtcgtcccccagcgcgattgagcgctccgtctacgaggtcatcggcaaggagtaccgcggcagccgcgtgacgcagatggagctgcgcttcaacccgatgaagcgcaacctgaactccgagctggacctggaccacatcatccacgccgcgctgcgcggcatggaccgcgcggtgctggagtacggcgtgaagatgggcctcatcttctgcctggcccgcgagttcgaccaccggctcaacagcatcatcgtggacaaggccatcaagtaccgcacgcgcggcgtgtacggcatcgacctggccggcacggagacgaacgccatggagctgaagccggaggtcgtcacccagtacgaagagctcttctcgcgggcgcgccgcgccgggctcaagtgcacggtgcacaccggcgagacgcgcggcaccggcgccgagggtgtcatggccgtggtggagaagctccagccgcaccgcatcggccacggcatccgcgccgcctacgacgagcacgcgatgaaggtgcttcgcgagcgcgacctcgtcctggagctgtgccccacgtccaacctgcacaccaaggccgtggagggcgtggaggagctgcgccacatcgtccgcaccttctgggaccgcaaggtgaagttcaccatcaacaccgacggcccctacctgctggagacggacatgcggcgggagatcgacatcatcgaacagaacggcatcctcacgcccgagcaggtggatcagacgctcgcctgggcccgtgaggcctcgttcatccccgcttga

SEQ ID NO: 3967 - DNA, 2223 bp, Myxococcus xanthus
atggacctctccggtgtccacgtggagcgcgcggccctcaccgacggcgccatccgcttcgtggaccgcggcgccggagaacaggcccgcgagctgggcgtgaaggacctggacatcgaggtgaaggacctccgcgtgggcaagccgctggtggtgaacctggccgccgccgtgctcgcggacacccagaacctccaggtgtccctccacgccgcgccgctgccggccacgctggtccccacgcccgagcgcgtgacgctgaaggcgcagaaaatcgacctcgccccgctgggccccttcctgccgccggacatcggcctgcgtgcgggcacgctggacgcggactggcaggcggacctgggcggcgccgttcccggcggccagggccccacgaagctggtgggcatcatcaaggccctgggcctgagcttcaccggctccgagggcggcaaggcgctggacgtcgtcatggacaccgacgtcgcgggcgacatcaacaccggtgacctggcgctcaacaagctgaaggtggacctgggccccgcgagcctcaccggcaagggcagcgtgaagggcctgctcacggacaagcccgcggtggagggcttcgagctgacgggccgcaacctggacccggccgtgctcgccgagtactacccgccgctgcgcaagcagctcaacgggatgattgccggtcccatcggcctggacgtgcgcggcagcggcacgcaggacgcccaggccatcgacgtcaacgtggacctgacgcccgtgcggctgcgcgttccggcccagctcaccaaggacgcgggcggcgcgatgaagctctccgcgcgggtctccggcgcggcggccacgggcggcgccctgcgcttcgacgcgaaggcggacctgggcggcatcgacctgcggcccggcctgctggtggacaaggccccgggccagcggatggacctgagcgccgcgggcacctacgcgcccggcaagggctccggcatgaaggtggacatccccaagctcaccgcgaacgtgctcgaggacacgatgacgggcagcgcgtccttcgcgctcgcgggtacggggaagaagcagacgacgacgttctccgcggacctcaagagccagaagctggacgcggacgcgctgatgatgagcgaggaggaagtccaggcgcgcggcggaccgccgccggaggagccgccgtcggatgacccgacgcgcttcaacggctaccggggcgacatccgcttcgcggtgggcacgctgcgctacatggagatgaacatgacccaggtgacgggcgtggtgaagatgaccgacgacctcatcaccgtggagaagttctccacgggcgtctacggcggacgcatcgtcgcggacggcaccacgatgcgcctgggcccgctgccggagcagcgccccttcgaggcgaaggtgaaggtggagggcgtcgcggtggagcaggcgctgacgcaattcacgccgcagaaggccgtgacgggcaagttcaacggcaacgtggacgtgaagggtgtgggctacacgcccgaccagctcaagcagacgctgctcggcggcatcaacggcgacctgctggatggcgaactgctgggcaaggacctggtggcctcggtgtccgagccgctcgccaaggcgctgcccatcgcggccaagggcctgaagaacgagcaagtgacgaagctgggcggtgacctgcccttcagcgttcaaatcaaggacggcgtggcccagctctccaagccgctgacgtgggcgcggccggaggcggagctgagcttcgacggcggcatccggctggatggctcgctggacctgacgggctccgtgtcgctgacgccgtccacggtgaagacgctgacgctgggcaaggtgacgccgccggccgccatccccgtgggcctgaagctgacaggccccgcgtggaagccggaggtcaccagcctggacgtgaagcctgcggtggcgcaaatcgcgaagctggcggcctcgtcgctggcgggcaacctgattggcggcgagcgcggccagcaggtccagagcatcatcgaaggcggcgaggacaagcttcgcgccgaagccgaagccaagcgcaaggagctggaggccaaggccgccgaggagaaggcgcgcctggaggccgaggccaagaagcgcgccgaggaagaagcgaagaagcgcctgcgcggcctcttcgggaagtag

SEQ ID NO: 3968 - DNA, 1197 bp, Myxococcus xanthus
caccatcgcgtgctcatcatcggaggtggcaccgccggaatcacggtggccgcccggctggcgcgcgccgggcagaagggcgtcgccgtactcgagccttcccagcaccactactaccaacccctgtggacgctggtgggcgccggggaggcgcgcgtcgaggacaccgtgcgcaacgagtcccgcctcatcccgcacggcgtgaagtgggtgcgcgacgccgccacggagatagacccggaggcgagggaggtcctcacccgcggtggcctccgcctgggctacgacttcctcgtcgtcgcccctggcatccagctcgactgggacaaggtcgcgggcctgcgcgaggcgctgaagacgccgcatgtcagcagcaactacgacgtccagctcgcgcccaagacgtggcgcctgctccagaacttccagggtggcaccgcgctcttcacccagccctccacgcccgtgaagtgcgccggggccccgcagaaaatcatgtacctggccgcggaccacttccgccgcaccggcgtgatggagcgcaccagcgtcgtcttcggctccggagccaagaccatcttcggcgtgaagcccttcgcttccgtgctggatggcgtggtgcaccgctacggcatcacgccccgcttccagcacaacctcatcgcagtggacggcgagcggcgcgaggccaccttcgaggccacgcgcgacgggcagacggagcgcatcaccctggcctacgacatgatgcacgtcaccccgccgcagagcgcgccggacttcatcaagcgcagcccgctgtcctggcgggagggtccgaacgccggctgggtgaaggcggacaagtacacgctccagcacccggaccatccgaacgtcttcgcgctcggtgatgcgtcggacctgcccaccagccgaacgggcgccgccatccgcaagcaggcgccggtgctggtggagaacctcctggcctacatgaaggacctgcccctgcccgcgcggtatgacggctacgcgtcctgccctctcaccaccggctacgggcgcctgctgctcgccgagttcgactacgacggcaagcccgcgcccaccatccccttcatcgacaccatgcaggagcggcgcgacatgtggctgctgaagaagtacggcctgccacgcctctactgggcattcatgatgcggggccttgcgtaa

SEQ ID NO: 3969 - DNA, 705 bp, Myxococcus xanthus
gtgcgcggcgccttcacgggcgcggtgcgcgacagcccaggacatttccggctcgcggacaagggctcgctgttcctggacgaggtggcggagatgcccctggacctccaggcgaagatgctgcgcgtgctggagacgcgcaccgtcatccccgtgggaggccgccagcccgtgcccgtggacgtgcgcatcatcgccgccacgcaccggccgcttcggcgcgaagtggagacggggcgcttccgcgcggacttgatgtaccgcctgcgcgtggtgccgctcttcctccccacgctgcgggagcgacgaggcgacatcctcccactggccctgcggttcctggaggaactgcaccagcgaggcgcccgccgcgtggagcgcttctctcctggcgcccgccgcttgctggaggagcacccctggcccggcaacgtgcgcgaactgcgcaacgtgatggagtacgcctacgtcattggcgaaggcccggtggttcgagaggcggacctgccaccggagttctccgagcagcggcaggccgctcccgcgaagctgccgcctccggatgcctcgctggagccggaacggatccgcgccgcgctcgcccaggcgggcggcaaccgctccgaggccgcgcgcctgctcggcgtcagccgcgtgacgctgtggcggcgcctgcgcgacctgggtgcgacggcggagcgctga

SEQ ID NO: 3970 - DNA, 705 bp, Myxococcus xanthus
atgctcttccgccagctcttcgacgcggacacctcgacgtatacgtacctcctggccgacgaggccacgggcgccgccgcgctcatcgacccggtgctggaacagacggagcgcgacctgaagctcctccgggagctgggcctcacgttgtccgtggtgctggagacgcacgtccacgccgaccacgtcaccggcgcgggtgtactccgcgagcggacaggcgccaccgtggtggcctccagccgcggcgcgccctgcgtggaccggacggtgaaccatggagacatcgtgcgcgtgggcggcctcgaagtccgtgtcctcgagacgcccggccacaccgacgacagcctgagcttcctctgtgagcgccgcctcttcaccggggacgcgctgctcatccgcggcaccggaaggacggacttccagaacggcgacccgggccaactctacgacgccatcacccgcgtcctcttcacccttcccgacgacacggcggtctaccccggccacgactacgccgggcacgccatgtccacggtgggcgaggagaagcagcacaacccccggctggctggacgcacgcgcgcggacttcatcgtcttgatgaacgcgctccagctcccacctccccggaagctggacgtggccgtccccgccaaccgggcctgcggacacacgccgccctcaccttccctccaggcctga

SEQ ID NO: 3971 - DNA, 156 bp, Myxococcus xanthus
atgcatcctctctgcgacaacgccgcgccccatcccgcgggctaccgcgacgtggaggtgggacagctcgcggcgttcctgccctccgagctcacgctggtcgacgtgcgtgaggccgccgagctcgacggtatctgggccacgtcgcgggcataa

SEQ ID NO: 3972 - DNA, 1581 bp, Myxococcus xanthus
atgcatgacgcccacctgccggacgtctcttcgggcgcgctgaagcgcaaggcggaggcgctgcgcggttggctgacgcgcctggagcaggtggtggcgcgcggtggcctgtcgggagacgctgccgtggacgtgcgcgtgctggagaacgcgatgcgcgccgacctgctggagctggaggaggtgcgcccctgggagcgcgacccgggcttctacgtgggcatcatctccagcggattggacggcctgtcgtcacgcgagttcgcccccgtggccgagcgcatgcgcgccatgcgctcccggatggcgcgcatccctggcgtgctcgacgcggcgcagttcaacctgagcggcgtgccaaagctgtgggcggagtacgcgctgcgcgacgcgcgcggcaccgcggcgtacctgcgcacggacctgccccgggccctggcggcgcaggggtatgcccaggtgccgttgagcgagcgcgccgccttctccgccgcgcgtgaggaggccgcgcggcagatggaggccttcgcggtgtggctggagcgtgagctgctgcccaaggcggacggcgacttccgcctgggccgcgagcgcttcgagaagaagctggcgctggaggagcacgtcacgctggacgcggacgcgctgcgcgacatcaacgagcgcgccattcgcgactacaaggcctgggtggcgcgcgaggccgcccggttggacgccaccaagacgcccgagcaggtgatggcggagctggtgaaggaccacccgaaggcggaggagctggtggcgtcggcgcgggcgcagttggtggagctgcagcgcttcgtgcgcgagcggaacatcctcacgctaccgtcggaccggctgcccgtggtgcgggagacgccgccctatgcgcggctgggcttcgcgtccatggacacccccggccccttcgagacgaaggccaccgaggccttctacaacatcaccaacgtggagcccggctggacgcccgagcagaaagcccagcacctgacgtacttcaaccgcgcgggcctgctgggcatcaccgtccacgaggccatgcccggccacttcgtgcagttgctctacggcgcgcggattcccacggacgtgcgtaaggtcttcacccccgcgtcactggtggagggctgggcgcactactccgagcagatgatggtggatgagggcctgggcaatggtgacccggccgtgcggctgggacagctccgccgcgcgctccagcggcacgcgcgctggtatgcggcgctggcgctgcatgtgtacggagagcccgtggaggcggtagcgaagcggtacgcggagattgcgtacttcgagcccttccccgcactgcgcgaggtggagcgcggcacgctcgaccccacgtacctgtattacgccgtggggcgcatgcagattttcaagctgcgcgacgactaccgccgccacctggagtcgcgcgggaagacgctggtgctgaaggactttcacgaccggctcctccaaatcgggctgccggtgtcgctcgcgcgggaggtgttcctgccgggcgacacggcgccgtcgctggagtga

SEQ ID NO: 3973 - DNA, 531 bp, Myxococcus xanthus
atgaacaacgcactgacgaagattgccaccgcgcaggctgcggctggcggacgctacccgcgcttcggtcgctacctgctcgaagtcgaggtcatccgcacgaaggagggcttcaagggcgactcggccatcgccgagctgaaggttcgcgagtccgagcccctcgcgggtggcgagactccgagccgaccgggcgagacggtcgactacgtcgagaacctgagcgaccagaagaaggggggcggcggacgcttcaagtccttcctgatgacgctcgtgggggccgacgaatacgagttcgccaacccggccgcgctgaagaagttcttcgacgagcggcaggcggggacgcacctcctgattcgctgcgaggtcttcccgaagcagctcccggtgaaggagggccacgccgggaaggtcatcagcggctatcgctggtcgcacgtcgagatgaacgacgagcagctcgcccaggccgagcacgcgcgcaaggcgagcaagctccccgcgctcaccgacgccctcgcctga

SEQ ID NO: 3974 - DNA, 1889 bp, Myxococcus xanthus
cccaagcccggcagttcttccgcgaggccatcgccgcgtctgacacgcgcctcgttggcgcaaacctcgcttacgacctgggcgtcatggcggcggatgacccgagccttgtggcgcccatcttcgcggcgctcgaagcaggccgactgcattgtgtccagattcgagaagccctcatcgacatcgcgaggggactctacggcgtggacccgtcgacgggccggaagctcgacgatgacgaaggcgcccgctacccgctcgcgcttctcgtgcagcgctaccttgggctcgacatcagcgaggacaaaaagaacccgaaggcatggcgcctgcgctacgcggaactcgacggcgttcctgtcgagcgctggccgacggaagccgctgcgtacccgaagcgagatgcccgctacacgctcgacgtcttcttccggcaggaagccgtagcacgggagacgcccaacggcggcaacctgcatgccgaagccgagcagatgcgcgccgccttcgcgctccacctcgcttccatctggggacttcgaacgaacggtgactcggtcgccgtgctgcgggagcgggtggaacgggagtggggagagaaccgggccaagttccaggcggcaggcatctaccgagccgacggcaccaaagactcgaagcgcctcgctgcgctcgtgactgccgcctatgacggacagccgcccattaccgcgcccagcgaccgattccccgacggccaggtcgcgaccgaccgtgacacgctgctcggttcgggcgacgcgctgctcgaagacttgggcaagagcgggcgcgtcgacaagtacaagtcgacttacctggacgtcgtcgaagcgggcacctcgctccccatcaatccgcgcttcaacgtgctcgttagcaccacgcgcgtttcgagcgactaccagcagctcccgcagaagggcggcatccgggaggtccacgaggcccgtcccggcttcgcctactgctcggtcgactacggagggcttgagcttcgcaccatggctcagcgggccatctgggaactcggctactcgaagatggccgaagcgctgaacagtgggctcgacgtccacacccttgccgcggccgaattcctcggggcgagctacgacgagctgcttccgaaggtgaaggcgaaagaccccctcgcggtcgccttccgtcagctcgcgaagattctcaacttcggcaagggcggcgggatgacgggcggctcgctcgtctacaacgcacgcgcgaaggaccgggtttccttctgcctgctggcgaagcgcgcagacgtctgcggcatcgagcgcatcgtcatcaccgtgcagcgcaagccgaagatggtctgccgggcctgcgtcgaagtggccaaggaactggacacgaagtggctcaacgcgtggcctgagcagcgcgagcttcagcagcgagcgaagtcgagcacctacgggggcgggttcgccgatgtgatgattccgggcgcgaacatcctgcgcggcgggtgcggctacacgcagattctcaacacgcccttccaggggctcggcgctgtcgggtgcaagctcgccatgtggcgcgtcagccgcgagatgtacgtcgaccgtcgctcgccgctctacggctcgcgactcgtcctcatggtgcatgacgagctgatcagcgagctgcccgccaatagcgcccagcggatgcacgacgcagccgagcgcaaggcgtacctgatgcgcgaggcgatgaaggagacgactcccgacctggcaccggcaatcgaagccgagcccgcgttgtcccgcatcatgtcgaaggacgtcgccaccgtgcgcgacagctccgggcggctgctcgtctgggagccaccaacaaagcgcgctgcctga

SEQ ID NO: 3975 - DNA, 174 bp, Myxococcus xanthus
atggccaagacaaccgacgcgctcgaacagctcccgcccgccctctgcccgtatctcgacgcggacctcgacgacgcggtcgccttcgatgtcgccgacttccacgagctgagcttgctgcccacgctgggaggtgaagcgacctctcgtcatctcctggtggcggccccctga

SEQ ID NO: 3976 - DNA, 561 bp, Myxococcus xanthus
atgccgacgactcggaacctactggtggcgcttgaccccgggcttcgcgagtgcggcgtcgcggtcttcgacctggactcgggcgagctgctcgcggcgggcatgcctacgaatcccgagcggaaggcccgtgggctcgcgacatggtcgcgcatggcgggaggggtcgccgagttcgtctcgacgttcctggagcctctcagggccgctggcgtggctgtttccgtcaccgtcgcgtgcgagtgcccccaggtctacacggccgggaagagcaagggcgacccgaacgacctgattgaactcgcgggagtcgtcggccgggttgccggtgagcttcgcgcgacgagtgagcgcagcttcctgccgcgcgagtggaagggaacgctcgacggcgacgtcatggtcgagcgcatcaaagcgcgcctcggcgagcgaccgcacgaacacctacgggtgcagctcccgcgagcccaggacaagcaccacaacgtttgggatgccgtcggcatcggccttcacgtcgtcggccgactcgcgccccggaaagtcttcccgaggtag

SEQ ID NO: 3977 - DNA, 1092 bp, Myxococcus xanthus
atgtacggactcacccgctcgctcctcttccagctctccgcggagcgcgcgcaccggctcggcatggcggggcttcactacctgggccgctcacgggacttgtgcgagtccctgcgcgagaaggccctggagggcgccccgcccggcctggccgtcgaagtggccgggctgcgctttgcccaccccgtggcgcttgccccccgcctggacaaggacgcggaggcggtggacggcctcttcgcctgcggcttctccgcagtggagattggcaccctcacgcccaggccccagcccggcaaccccagccctcgcctgttccgcctgccggagcaccgcgcgctcatcaaccgcatgggcttcaacaaccacggcgccacccaggccgccgcgcggctgcggatgcagacgtggcgtccgggcccgctgggggtgaacatcggcaagaacaaggacacgccgctggagcaggcggtggatgactacgtggcctgcgtggacgcgctggcgcccctgggcgactacgtggtggtcaacgcctcgtcccccaacacgccgggcctgcgcaagctccaggagcccgagcagttggggcagctcctgggcgcggtgcaggagcgcctggccaccgtggccccgggtaagccgctgttcctcaagattgccccggatctgtcccccgaggcagtggacgaggtggtggatgtcgcgcgggcccagaagctcgccggcctcatcgccaccaacaccaccgtggcccggcccttcgagcatcccctggcgaaggaagccggcggcctgtccggcgcgcccgtccgcgagcccgccaacgccgtcatccgccgcgcctggctgcgcagcgggggcgcgctgcccatcatcggcgtggggggtgtcttcaccgcccaggacgtctacgaaaagctgcgcgcgggcgcgtcggtggtgcaggtgtacacgggcttcatctacgagggcccgggcatggtgggaaacatcctccccaccctggccaccctgctcgcccgcgacggctacaagcaggtccgcgacgtcatcggcgccgagcaccggaagccgggcgcacccaactga

SEQ ID NO: 3978 - DNA, 2580 bp, Myxococcus xanthus
  unsure (1)..(2580): unsure at all n locations
cggctgcccgactcggtccgccccacgcgttacgcgctcgacctgaagctgctgcccgccgagcccaccttctccggcagcgtcagcatcgacgtggatgtgagcgagccggtgcgccaggtctggctgcacgggcaggacatggaagtctcgcaggcccgcatcgaagcgggaggccgcaccctggaggcccgtcctgtcaccgccagcgaagggcggctcgggctgctgctccccgaaacgctcgcgccgggcaaggcccgcatccacatcgccttcaccggcaaggtcgaccgcgagcgcagccagggcctctacgccgtggaggaaggcggcgagccctacctctacaccttcttcgagcccgtcgacgcgcgccgcgccttcccctgcttcgacgagccgggcttcaaggtgccctggacgctgcgcatcaccgccaaggaggaccacgtcgcgctcgccaaccaccccatcgtctcgcgcgagaagctgccggacgggctggcgcgcgtcacgttcgccgagagcaagccgatgcccagctacctcgtggcgttcgtggtgggccccttcgacgtggtggacgcgggcaccgcgggccgcaacgccgcgccgctgcgcttcatcgtgccgcgcggccggggcgcggagacggcctacgcggccagcgtcacgccgcgcatcgtcacgctgattgaagactacttcgacatgccgtacccgtacgagaagctcgatgtcgcggtggtgccgcgctactggggcaccatggagcacccgggcctcgtcgcgctcgggcagccgctgacgctcatccgtcccggcgaggagacgctcgcgcgccgcaagtggtacgtgaacatcgccaaccacgaactggggcactactggttcggcaacatcgtcacctgccagtggtgggacgacatctggctcaacgagtcgctcacctcgtggctggaccgcaagacggtggaccccttcgacacgagctggggcttcggactggagcagagcacccagtccacgctcttcgcgttggacacggacgcgctcgccgccaccccgccggtgcgcaagcccgccaacacgcatgacgaggtgctcggctcgttcgacaacggcaccacgtacgccaagggctcggccatcatcgacatgttcgaggcatggctcggtgaggagcgcatgcgcgacctgctgcgcggccacatcaagaagcatgaatggggcgtggccacgtcggaggacttcgccgccacgctgtcggccgccgcagggccggacgtcgcgcgtgccttccgcagcttcatcgaccagccaggcgcgccgcgcatcgccgccgaactgcaatgccagccgggagcccccgcgaagctgacgttcacgcaggagcgctacgtccccgcgggctccaccgccagcaaggaccagacgtggtccgtgccggtgtgtgtgcgcgcgggttccggcaagacgtccgagcgcacgtgcaccatgctcaccggggccacgggcgagttggcgttgcccggcaagagctgcccttcctggttcgtgctcaacgcgggcggcaccggctactaccgctccggctacacgcgcgagcagctcacccgcgtgctggccgcgcccacggaagcgttgacggtgcgcgagcggctgaccctgttggccgacatggaggccggggtgcgccggggagacctgcccctgagcgacgtcctgcgctacgtgcccaccacggccaagggcgaccaccgcctcatcatgcagcgcggcgcccggctgctgaccttcgtgcacgtggaccgactgtccaacgacgagagcgcgcgctaccggaactgggtggccgcgatgtacggccctcgggcccgcgcgctgggctgggagcccaagcccggtgacgacgacgcggtgaagtcgctgcgacccaacctcctggggctggcggcgctgcgcggcgaggatccggccttggtccgggatgagaaccccctggtgaaggngcggctggnggagnggaagtccgtccacccggaggccgttcccctcgcgctgatggtggcggctcgaaacggagacaaggccttcttcgacacgctggtcgcgcgcgcccgcgccacggaggaccggaccgaacgcagccgcgtcttcaccaccctgggctccttccgagacccggcgctcatgcgcgaggcgctcgcgctggtggccggcagcgagttcgacgtgcgcgacacccagtccatcctcacgggggccttctcgatgccgcagacgcgggcgctcgcctgggcgttctaccaggagcacttcgacgcgctcgccagccggatgcgctcggacgaagtcgccgggctcatcggactggtgggcatgctgtgcgacgagaagaccgccgccgaagcagaagcattcctcaccccccgagcggcgaagctggagaacgcgtctctcaccctcacccgcaccatggagtccatccgcctctgcgccgcgtccagcacgctgaacgcgcagagcgtcagggacttcctgaagggccagccgatccccgcgaagtcccgctga

SEQ ID NO: 3979 - DNA, 618 bp, Myxococcus xanthus
atgcctcgaacgtacacagcacaagcgggcgactgcgtctccagcatttcccacgcgcacaacctgagtcctcagcgcgtctgggaagcgcccgagaacgagtcactgcgaagggagcggacgagcccccatgtgctcaagcccggcgacacggtgacgctcccggacaaggaaatccggcaggtcccctgcgcgacgggaaggacgcacacgttcaggctcaagggcatcccggaacgcttccgcctgcgactgcatgaggacggtgcgcctcggacgaaggtgccctaccggctcgtcatcggggacgtcacccacgaaggagagacgaacgagcagggcctcatcgagtgcgggattcctcccggtgcccgcgaggcgacgctggaggtcggcggcgaggagtacacgctgtccctgggaacgctccaacccgtgtccacggaggaggggctgcgagcgcgcctggtgaacctgggtttcctcgcggacgaggccagcgaagaggacgcgctctccgaggcggtcgcgaggttccaggccgagtacgggctgatgcccaacggtacggtggatgagcggacccgccacaagctgcgggaggctcacggtgcctga

SEQ ID NO: 3980 - DNA, 4884 bp, Myxococcus xanthus
atggatgcgtccgacccgaaccgcttgttcgcccccttcgtggggctcttcaacgtgggccagggcgcgtgctcggtgctgtacgacaaccaggggcgcgccatcgtctattacgacttcggcagcccggcgaacggccagcaggggaccttccccatcattccactggggcactgtgtgggcccctgcatgtgcaacggcccgctcatcatcctgtcccactgggacatggaccactgtgatttggggcgctactacccggagtccttccgctgccggtggctcgcgccgcagcagcacatgggcaccgtcgtgtgccgcgacacggtcgcgcgcgtcgtccacgacggtggcgagttctacatctgggcggcgtcggggcggcctggaaccgccgcgagtccgcgcggcacgccgagctcctggaaccgcccaggtggcagtcacatgcggtttccctggggcttcgtcgaacgcaactaccgtgaaggcgcgcagaacccgctcgccagtggctcggacccgcgcaacaactccgggctggcgctgtatgtctgcgtgcgcgacgcggccggtgcggctgctgtcgccgccggccccgtggccaccgacgccaacaacctggggggcaatgggcgaggtctggtcaccatcggcggaggcgcccctccgggctgggtggcggcagcgttcgcggggcccaaccttcctggcattggaggcggcctggccgcatttctcgcggcgatggggccggccggtggcaaccccaatcccgcggcgatcctcgcccggcgacagtcggccgcggccaccgcggcggtgggagctggtggtccaggcgccggtctcaccgcgagacagcggctggtcatcgcgacgctggccgtggcgcaccccgcgctcgctgccgccacggcggtggcgctgggccgggccgctgaagtcgccgcggacgccgtggtggtcgcgggcggaaacctgccccagatggcggcggcggcgggcgcggccgtcatcgtggcgagcggcgcgccgggcacggcggtcgccaccttcacggccatggggacagcggcggcgggcggcgcgccgctgatgcccgggagcgccggggccctggcgttggcccatgtgcaaggagccatcgtcggtgcacctgccgcctcccccgtcacgacggcggcgaatacggcggccggcgtcgtgccacagggcggcgaggcggtgcgggccgcggtggaggccgtggtacgcacccacgcccccgcgccgctccccggcctgtcgctggaaggcgcggtggcccgcgccgctggcgtcagcaacccggccgcggtctgcaaggccctcgcgcccccgctgccaccgacactccagggagaggcgcccttccacgccaacgagcggttcgtgctcctcacgggcgacgtcaactaccaatacatccccgcgcagcggcgccccttcgccgcacccggcggcggagctcccggaggcgcggtggcgctgccctacgcccccacgggccacccgcccgtcgtcgtgggcctcaccgcgacccaccacggctccaacaaggtgggggcgaacgacctgaatcccgacaggattccatgggctcccaacacgctgcccacccgtgcggccgcggtcgcgcacgcggcgtcagcgcttcccaatcccaacatccgccgggccgcgacggccgcggcggccgcggcggcgctcccactcccattgcccgcgaacctggcgaacctggccgccgcggcggaacgcgccgcctatgcggcctccgcgggggccttcaccccgctcgtggtggcccgtgcggcggccgcggcggtggtcctggagaacgccgtcccgaacacgccacaagcgcagttcgtccaactgggggccgtgtccgcgggcgccccgctccccgtgcccgtcctggtcggaggaacggcggcggcgtgggccacggtgacggccgcattgggcggtggcgctgcggcggcggtgccaggactgggtcccgtggtggcagtgccaggaggcccccaggtggtcagggcggccactgcggccgtcctcatggccagggatctccccaacgcccaccgcaccgcatcagcgcgcagagccgtggagcaggcgcacgtcagcgcgaggcccggagcgccacaacccgtcctgcaggccgtcgccgcggccgtggccgtgcggcggagcatcgcccaaggcggaaccatctccgtcccgaccgccaccgccatcgtccaggcctcccgcttgagcatcaccaccggcgccgggggcaccgtggcggccctcgccggagcggggattgccaacctccccgcggtgacccatccctatttcgccaccgccgccgccgccattcccaacccgccgctggcggcggttcaggccgcgctggggctcgcgcggagcgcgcccatcgacccggcgaatgcgcccttcgcggtggccaacgccttcgccccctcgcccgtccttcccgaaatcatcctggatgcgctggtgtctcgcggccagtcgctcccgaagtttccgctcgcgttggttgagattgccgccgccctcgcggccatcgggcccgcggcgtctctctccgaagtggccgcggttgtcgaggcggcgcgcgcggcgcaaaacggtcaggcggcgggcgcacctcccgccgccgggctcgcacatgcggcggcggaccgcatcggttattcctacggcgtcgccacccagacgggtggcgcggcggcggcccctcccttcgcgcaccgctatctctctcagggcgtgggacatcccgcccatctcgccatcgacaagtaccagcgccggggttgggcggtgcgccgcaacaccagcatgcacgcggaccagagcacacagccagaccacagccctcgcgggcaccacgccttggggtgggagctggccccgttctacgaaggaccgctgcgtccggcctccgccgtcacgggcaccctttcgcggacctgccatggctgcaaggaggtcgccgcggtccgagccgccgcagccgtgggagcgggaacagcgccagccacggccgtagccaccgccatcggagtggtccccgcagcggccgccgccacggcccccgcggcaggtcccgtcaacgccgcgcaactgggccggcacggcgttccagccacacgagcggcccgtcggagcctggagcccgccatcgcggcacgggccgccgtgcccttcgccagggcagcagtcacgggcgtcgccgcggcccatgccacgagcgcatgcatcctcgtgacccaagcggtcctcgcggcctggtggcccgccgccatggcgcgaggggacgtcgtcaggggcgggcctctctccccggcggccgcgatgctcgggggcgtcccgccatcggccgccgaggccgtcacggcggcccgtgccgcggtgctggccgccccactggtcctgcccccggtggacctcgccgcggtggtggccgcgctggcggtgagcctgggagagccgcctctcaccgctgtcgccgcgaccgtggcgcttcccttcctgggaggcacgggcgcggcggccctcagcgcggcccaggcggcggccgccggtgtcgggattgacaacttcgcggcggccatcgtcggaagcacccatgcctgcgcattgggcgcgaacctgccagcgcccgtcgccgccagggtggccgccatctccgccatggtcggaggggccccacttcccgcgaggctggatgcggtggccaacgccatctcggcgggacctccggtcgcggcgcaccacgccctcctcctgcgcacggcgggcatcacccttccggccatcgccgcggtcgtcgcggcggcagcgggcatggcccacgcgggcgtgactccgccagtcgcggcggacgcgagcacctgtcatgccgccgcggccgccaccgtgccgggcatcgcccaggccgccgtgaatgtctgcgccgctacgctcgcgggcggcgccatccaccccaacccagccgctgtcgcgggcctcgtggctgcctccacgccaacagccgccgccgccgtgacagccgcatctgccgtgctgacagccaccggggcggcccccccggcgctcggggacgccgccgtctgttacgcatcagcgacagccgccgtcaccgctgcgatgggaggcgcagccgccgccgctgaagccgcggccgccaccctcacgggcgtccccgtgcccgccgtcggcaacaccgcggtgacggccgccaccgtcgcgaattccagcgaggaggcagccgcggctgtggcggcggcagacgccctcgtcacggcggatgcattgacgctgccgaccgcggcccaatcggcggcctgttacgcggcggcagcggcggcagcgggtgttccggcgctcgcggcgaacgcggcggctgggaccattgccctggccggcgtcaccgccgccaccgatgccaacacggcactggtcgcgggcgccgccccgctcgcatgtgccaccgtcgccgcggccatggtcgtcacccagctcgccgtgggtggcgccgccaatcaccgcgcggtcgcggccgcggccagcgcatcagccatcggcgttcccgcggggccggtggaccaggccgcccagagcctcagcgtgggcatggcccatcccatctccgtggccatcgccgagtccgcgtcgatgcgggcatcgggcgcatcggaagaagcagccgcggccatggccaccgtccgggcgctcgagcctcggagcgcccccctggctgccacggcagcagccagtgcgggcgtacccgccgcggacgccgccgccacggccgccatccgtctcttcaatgtctga

SEQ ID NO: 3981 - DNA, 756 bp, Myxococcus xanthus
atgttcgacgtcgcgcgctacctggagcgaatcggtgtcggggcggagcagtccctcacgaggctgcaccgggcccacttggaggccgtgcccttcgagaacctggacatccacctgaagcggcccattcggctcgacatgaacgccctcttcgagaaggtcgtcgtccagcggcgcggcggcttctgctacgagctcaacggcctcttcgcccggctgctgacggcgctgggtcaccgggtgacgctgctgtccgcgggcgtggccacggccccggatggcagcgcctacggccccgagttcgaccacctggccctccaggtggaggatgaacagggacgctggttggcggatgtcggcttcggtgagtgcttcaccgagcccctgcgcctggacacccacgacgtccaggtgcgctccggccgcgcgtaccgcctctcaccggagggtaacaacctcatcctctggagtgagaagccctccggatgggaggcggagtaccgcctctccctcgtgccccgccaactcgcggacttcgagggcatgtgccgctaccaccagacctccccggactccatcttcacccagcggcggctgtgcacccgggcgacgcctgagggacgcatcaccgccaaggagggcacactcgtcctgacccggagtggggtccggacagaacaacctctccccgttgaagacgccctgcggcgcgcgctcgtcgaacacttcggcgtcatcctcccgtccctggagtag

SEQ ID NO: 3982 - DNA, 1950 bp, Myxococcus xanthus
atgcacgcgctggtggacgaggtggaggacctcacgcccctgctgagcacctacgcctacgtggcctcccgccgcacctcggacccgaatacccgcgccaccgcgcagatgctcctgctggacaccgagcgcgcccggggacgactggtgcgcgccaacgaggtgaagcagtggctgggctacgtgggcgactactacgtcaccggcggcttcgaaaacgaaggcaaggccggctgtgacaccgacttcggccccgaggccgccaacctggacctgtccgccacctaccccgcggccaagggcggcaacaccacctggcgcaagctgacggcgaacaccgcggatggctacatcgacctggccaccgccatccgccccaaccgcgaggccgtggcctacgccgtcacctggctggagtcctcccaggagtcgcgcgtgtcgctgggcgtgggcacgtccggcgcgttccggctgtgggtgaacgggcagctcgccgcgaaggaggaccgctacaacctgccgcgcccggaccagtcccgcgtgtccgtgaagctgcgcaagggcctcaaccgcgtgctcgtgaaggtgtgccaggagtccggcccgctgggtttctacctgcgccaggagtcgcccaccgtgcgcgcgacgctgccggcgaaggcgcccgccctggagaagctcaccgcgccgcagccccagccgctgcccaccctcacctccgccctgcgcgcgatggtggagaagaacccggatgacgccgcgttgcgcggcgactacgcccgggtgctgggcttcttccgcgcgtatgacgagcgcgagcacaccgccagcgccgaggccgcgcgcgccgcggaagccgcccccaaggacgctcggctccagttgctcgccgcccatgcgcagcgggatgacctgaacgagcgccgccgcttcctggaagccgccatcgccgccgaccccgccatgccggaggcgcgcgtggcgctggccgaccacgagctggaccgcggccaccccgagcgcgtgcagccgctggtggcgcccgtgctggagaagacgccggatgacgtcaacgcgcggctggtgctggcgcgcgcgcatgaagccctgggcgagcgccccaaggcccacgccctggtggaggagacgttccgcctgcagccccgcgtgcctcgcgcggtgcgcgccgcggcccaggtgtcccggcagctcgaccgtggccgcgaggccatggaccggatgcgcgtggtgctggcgctgcgcttcgacgacaccaccacgcgccacatgctcgccacgatgctggcggaggccgggcaggtggagtccgcccagcgcgagtacgcgcagttggtgaagctcaaccccttcgacaatggctcccgcgtgcggctggcggagctgaaggccagcaacggcgcagtggaggaagccgtcgccctcttcgccgaggcccgcgcgctgtccccggacgagccggaagtctatgagcgcgagggccgcgccctgctggccgcgggccgccgcgagccggcgctggcctcgttcgaacgctcgctggcgctgcgcccgcagaacccgggcctgaaggaggccctgcgcaccctcaagggcgagagcaccggcaccggcatgcagtacctggtggacgcccagccgctggccaaggagtcggaggcctacgtccacgaggacgccctctacctggtggacaacacctacgtgcgcgtccagcagagcggcctgtccagccgcctgcaccagacggtggtcaaggtcttcaactcgcgcggcgtggacgcgttccgcaccatccccgtcacctattcgccggaccgccaggaggtgcgcgtgctgcgcgcccgcgtcatcaaggcggatggctccgtggtggagagctacggtgagaacgagcgcaacatcaacgagccgtggacgggcatgtaa

SEQ ID NO: 3983 - DNA, 432 bp, Myxococcus xanthus
atggaggtccacgtcgggggcgaccggaagaaggacgccgagttcaacgtgcggcgctatgcccggctcggaattcccgagtacttcatctacgaccggtcccgggagcgactggaggcctacacgctggagtcacccggcgcgggcgtctacgtgcggatggagccgacgcagggccgctatgtctcgcgggtgctgggcttggagctggagttggtgggagagcggctgcggttctgggctggcaacgcgctcttgatggagtccgatgagctcatcgtccggatgcgagagcgcatcaactggctcgaacagcgcgcggatgaggcggcccacctgcgagaagatgaaatccggcgcagggaagacgcggagcgtcgcgtggccgagctccaggccgaactggagcgagtccgggccgcccagaagtag

SEQ ID NO: 3984 - DNA, 87 bp, Myxococcus xanthus
atggccgtgggtccgcaggaccgcatcggcatggcgtacttcgtccgcaacgggacgatgcgggagaatgtggagaacatggactga

SEQ ID NO: 3985 - DNA, 657 bp, Myxococcus xanthus
atgacacgtgcgcattccaatcgggggcgcctgtcccggcgctccctcatccagcggctgaccttcctgggcggaggcgtggtgttgctcggccccgcctgcaagcgctcctccgaatcccaagagaagacgccccccgcggacacaggtcccctggcggcgaagcaggacggccaggccccgcgcaccttctcctccttcgaatacgcggtggtggccgccgccaccgagcgcatcctcccgcgagacgaagacccgggcgccctcgatgcgaatgtccccgtctacatcgaccgcatcctccagacacctgagctggagcccgtgcgcgaggacttcctctctggcgtggcggccctggagcgccgcgcccagcgcatgcaccagaagggcttcgccgccctgacggccgagcagcaggacgaactgctcaccctcttcaaggacagcccgccccgcagcggcgaggcgcacttcttcgagctgctgacggtgatgacgctggagggcttcctcggggacccgtcctacggcggcaaccagggcaaggtgggctggcggctgatgggcttcgacaccgtgggcaccgtcgcctccgcgccgccggaaggctacgacgggcccaagtgcctacgtgagtgtggggtccaccgatga

SEQ ID NO: 3986 - DNA, 1653 bp, Myxococcus xanthus
atgagcctgcccgaggtggacgtctgcatcatcggcagcggcgcgggcggcgcgcccatggcgctggagctgggccgcgcgggcttcaaggtggtggtgctggagaagggcccgcactaccagcccaaggacttcatccacgacgaaatcctgaacagccgccggaacttcttcatgccggtgccgtgggaggagccgcacctggtgcgccagggcgcgaagggccgctacgagaagacgagcgcggcgtggacggccaactgcgtgggcggcggcaccgtccacatgagcggcttcttctaccggctcaagccggtggacttccggctgcgctccacgctgggcgccgtgcccggcagcaccgtggcggactggcccatctcctacgaggagctggcgcccttctacgacaaggccgaggcggagctgggcgtgtccggcgagtccgtcccccaccccttcgccgagccgcgcagtggcccctacccgctgccgccgctggacgtgcatccggtggcgaaggaaatcgacaaggcgtgcggcgccatgggctggcattccctgcccaccgcgcgcggaatcatcagcaagccctaccggggccgcgcgccgtgctcatactgcgcgctgtgcggcagctacggctgcgagacgggcgcaaagagcggcaccaacgccagcctcatccccgccgccgtggccaccggcaacgtggacctgcgccccggctgcatggcgcgcacggtggaggtggacaagcagggccgcgcgcggggcgtcgtctacctcgacgcagacggcgtgacgcgcgagcagccggcgaaggtcatcgtcgtgtcctgcaccgccgtggagagcgcgcgcctgctgctcaactccacctccagccgcttcccgaaaggcctggccaacggcaacggactggtggggcgcaacctcaccttcagctcgttcggcgaatcccacgccaccttccgcctgtcgaagcagtccgccgcgcggccgtggctgaaggacccatctcccttcgtcaaccgcagcctccaggacttctacctgatgcccgacgcccagttcggcttccgcaagggcggcacgctgggcttcatgtgggcccaccccaatcccatccacgcggcagtggggctggcgggcaagggcgagaaggccctcttcggcaaggcgttgaaggacaagatgcgggagtaccgcgactcacgcatcctccagttcgaggtctacgccgagttcctccccaccgccggcacctacgtcagcgtggaggacagcgtgaaggaccgctacggcatccccgtggcggccatcaccgtggaccggcaccccatggacctggcggccacgcgcttcctggtggagcgcggagaggaggtcctcctgcgcctggacccggatgacgtccgccgcggcaccaccaccggggagacgtccatcctccagcacggcacctgccgcttcggcgacgacgcggcgacctccgtgctggaccgcgactgccgcgcccacgaggtgcccaacctctacgtggtggacggcagcttcatgcccaccggcggcagcgtgccgtccacgctcaccatcagcgccaacagcttccgcgtggcggaccacctggtgcgcaagctcaagggctga

SEQ ID NO: 3987 - DNA, 132 bp, Myxococcus xanthus
atggagcgacagggctccttcaccgaggaggcggagctcaccggcgtgggcgaccacctcatcgagttcgagtccgacatgcaggcgcgctacatcatcaaggtggacgtgacgccgctgcgcaatcgctag

SEQ ID NO: 3988 - DNA, 954 bp, Myxococcus xanthus
accatgccgagtcgcgaggagcagatcgccgggggaatctacggattgctggtgggggatgccttgggcgtgccctacgagttccacgcacccgcgcggattccaccgcccgaggacatcgacttccagccgcccgagggcttccagcgcgcgcatgacggggtgccgccggggacctggtccgacgatggcgcgcatgcgctgtgcctgctggattcgttgctctaccatgggcgattggacccggaagacctgggccgccgcctggtgaactggctggagtggggctacctcgcggtggatggccaggtgttcgacgtgggcatccagacacgcacggccctggccttggtccacgcagggacgcccgcgctgatggccggccccaaggacgaacgagacaacggcaatggctcgttgatgcgcgtgctgccattggcgctctggcattcaggcaatgacgcgaagctcgcctcggacgcgatgactcagtctcgcgtcacgcatggacacatgcgctcccaggtgtgctgtgcgctgtattgcttgtgggcccgccgcatcctccaaggcgcgcgtgcttcggaggcatggacggacgcggtggagacgttccgcaatctgtatcccgaaggcttcgaggctcgcactgaactggacacgcatgtcctgccgccgggctgggaggagattcgaggcacgggcacgggctacgtggtggattgcctccgctccgcgcgccagtgcgtggtcgagcacgacacctacgagcagggggtgaaggccgccgtgcgcctgggccgggataccgacaccaccgcggcggtggcgggaggtatcgccgggctcatccacggcgtgaatggcatccccgcgcgttggcgtgagtcgttgcgcgggggtgagttgttacatcccatgttgcagaagctgctcaagtgcaccgtgagttga

SEQ ID NO: 3989 - DNA, 438 bp, Myxococcus xanthus
atgtccatgcgactgcgtacccgttggctccccatcatcttcttcgccctggctggctgtggggaggagacggagcttccccaggcgcccacactcttcatcgaccgcgcggcgctgacgttcaaccgcgagttcaaccacggcacctacgtcgggcagacggcctacaactcgctggccatccagaaccgcggcctggacccgctggacatcaccgccatcaccctgtcggcgccgagcgtcttcaccctccagcttcccgaaggcttcaccccaggcacgccgctgcggttggagacgtatgaccgcgcctacctgacggtggcgttcatgcccaccgatgacgtggaatacaacggcacgattaccatcgaatccaatgccgccaacgccgcccagcaggtcatcaccctcaacgggctgggcgtcgcgccctga

SEQ ID NO: 3990 - DNA, 2379 bp, Myxococcus xanthus
atgcccacctctgtccgtctgttgccgttcgcgttgctcgtcctcgccgcctgttcgtctggaggaggcgagacaccagacgcggggactcccgtggtggaggacctgtgcaattcgcgcgaagaggcgctgacgcggcccgagtgcgagctcaagccgggcgagccgctggagcgcttcctggcgctggacagcgagccgcgcgctggtgaccaggactggtaccgcattgtcctgccgcccggcaccaacgcccgcacgctgctgaacgtcaacgggacgtacctggcgtccagcaccgcggtgaatctgtccgtcaccatcctggggccgctgccggacgggaaggagggctcgctggcgaggaaagaggacaagcacgcccagggcgcgccccgtccggtggacatcgtgttgccgctgcgcgacgggctggagaaccagacgctgctggtgctggtgcaggacgcgccagacgtgccgtcccggcccaacttcgacgcgcgcaacaagtaccggttgacggtgcgcatcgaccagaacccggacgcgcaggagcccaacgacacgcacgagacggccacgccgctggtgctgacgcagtctggggagatgctgatgggcgcctccaccggctatctggccacggacaatgacgtggaccactatgccttcgacctggcggaggggaagattgcctacgtgcacgtcaccgcgcccgacctggacgccgtgcccaactggcgcctgtcctacgagctgtggcgcccgggcttcacggagaaggaggacgaaggcgtggtgctgccccaggtgcgcggcggcgagctggccaccgcgcgcaaaatcaagaaggcggagctccccggccactggacgctggtggtgaagggctaccgcggcaccaatgaccgggacacggcccagggcgacctcacgcagccctacgaggtggaggtgcgcgtgctggaggaggaggacgcgcaggaccgcaccgcgccgggcaatgaccgcgcgcaggaggccaccacgcgcaacctcgtcagcgccacgcccggcggcgccggctcgtctgtctccttcaccggccgcctgggctacatccccgaccgggactggtactcggtgcggctgccggccttcagcacccccacgctgctgcgctaccggctggtgccgctggagacggggggccgcttccccgcgatgccggtaacggcctcgcgcgtggtgcacgtgttcaccctgatcgccaccgggggtcccctgagcgagtcgcgggagagctgcgccaccgacgccgccgtctgcccgcgcgacttctcggagaatcccgacgcccggggcctggtggatcgcttctgccggcgcacggatttgcccgcgcccatgtgtctgcactcgtctcgcgaggaggccgtgggcaactcgcgcttcaccgccctgagcaacttccggggggtcatcccggttccggcgcatgacgccgcgctgatgtactacttcctggtgcaggacaacggctcgtgggtcgacgacaaggactaccgcctggaggtgagctgggatgtggaggacgcggacgagctgtctcgctacgtcaatggcgcggaggcgccgttggcgcggacgctcgcgtccaccacgggcttcccgtcgccgcccgacacggcggagttctccgtcacgggccagctgtcgcacggccacgggcggctgcgcagcggcacggaccgcatcaacgggctcggggtgcgtggcccgctggactacgacgccgtgccttccgacgtggactcgtacgtgttcgacctgccctcggtgcctccgccggaggaccggacgtggctgctccagtgggaggtggcgaagctggccgacggtggcacgccgcacggcctggcgctggacctcaccttctgtgacggcgatgcgacggacgccggtgtcggcacctgcacgccggtgcgcacgggcaaccgggggccgctgacgttgggctaccgctcggacgcgctgcgcgcctggcacacgccgtccaacgcgggcaccagcagcctgcagtcgctctaccagttggaggaccgtcccaactccaccgtcgtcaccctggcgccctatgcctgcggctgcctggagcggcgcttcatccgcggcggcaccctgcgcgtggacgtgacggcgtcggagcggctggactacgagcgggtgaactacacgctgcgcaccggccacggggactatccgcagagctacccggtggacggcgggacgacggtgtcgtgcccggtcgtcaccgacggtgggacgacgccggacggagatggcggcgtcatccagaactacgccgggggctgcaacttcacctaccagccatga

SEQ ID NO: 3991 - DNA, 1446 bp, Myxococcus xanthus
atgctcttcgcgggcagcaccacggccttcctcacgcagcagccgggcaacccgccccaggacggcttcgtccaggtgtcctccatggatgacgccatgctgcggcgcctgactgagcagctgctcaccttccgcaaccccgacacctcgccgaaccgggactcgacggacttcgtcaagccgctgtcggacatctactcgctcatcaacacggacatcgcgcgcagccggctggacccgggcggtgcgcaggcgctggcgcaggcgcgctactccgtcatcttcctgtcggacggcaagcccaccaacgaccaggatgacgagctgctccggggtgacgcggtggtgcgcatccgccagttgcgggatttggtggaggacgtgcgcgtcaacaccgtgcacgtcttcaaccccacgcaggcggggtcctcggtgtgcgacctgtctggtgacgggggctgcccgctgctcatcatcaaccagaacgcggaccggttggagcagatggcgacgctgggcggcggcaacttccgcgacttccgcaacaacgagcccatcaacttcctggacttcaccttcggccaggtgcgccgcgccttcatcgagaaggagatgggggacttcaacttctccgcgccgacgggcaacccggtgggtgaggcggactcggacggagaccgcctgacggacgcgcaccagctgggactgggcacggacccgcacaaggtgaacacggacggggacggcttcagcgacggcgtggaggtgtacttccgcgaccgcggcgtggacttcaaccccacgcaggaggccctgccggacggcggcgggctggaccgcgggtgtccgccggcgctgcgcggcgtggactcggactgcgacggcctgctggactgcgacgagcagttcgtgggcaccaacgcgacgctggcggacagtgaccgggacggcgtgccggacggcatggagtggctgggcggcacgcagggcgccagcaacgacctggacgaggacccggacaacgacgggctgacgaaccgcgtggagctgcggatgcacacccgtccgctggtggtggacaccgcggacctgtcggtgaatggctatcgctacgccttcgaggcggacggcccgccggacaacctgggccgccagtgctaccgcttccgcgtggagaacgtcctgctggcccccacgatagcgtccgcggacgacgcgggcgtggtgcaacgcggggcgggcttcaatgacaatgcgttgtccgtggccctggtgcccggagacgaccccaccgcccggacgcttgtccgcacctttcgcgtgaatgacgtgcgctacccggtgggcggcatcaagtcgcccgccgatggcgtcatccgcgtggaacccgagcagctcgtcgacggctgccccggccgccccgacgacgtgcccccgacgccttga

SEQ ID NO: 3992 - DNA, 249 bp, Myxococcus xanthus
atggcgtgtacggattcctatctgtacgaccctcgccgtgacacggaagtgccggtggaccgggcggtgacattggaaggccgcttctgcaccgtgggcagcaatgaggtggtgcggcccatcaagctggtggttgccatggacgcctcgcagtccatgcgggtgagcgacccggacggcgcgcgcgccaccgcgctggtggagctcatccagaacctgcccagggaccccaggtgcacctggcggtga

SEQ ID NO: 3993 - DNA, 1980 bp, Myxococcus xanthus
atgcgccgcttcgttcgtacctcgctgctcgcggcgggcctcctggcttcgggcctgtggtcctgttcggacgccatgctcgaatcgagggtggatgcgctctccaacctcgatgaccggctgacgctccaggggcgggtgtgcacgcgcccgcccagcccctccggcttcccggtgaaggtggtggtggtcatcgacgagtcgggcagcatgtgcgtctccgacccgccgggcgcgcagctcgacaacggcttctgccagcgccgggagattctggacatcatcccggagggcgtcaccgagcccgcgcgcgtgcgcgccctcaagcggctggttcagcagttccgggaagtgaatgcgcagggcggcaacgtgcaggtgtccgtcgctccctttgaaacgaacgtgcgcaacgtctggccgcccaccacgacgggggaccgcttcgcccggccggacaacaacatcgacagctacatcgagggcctgcagagccagttgggcaagggcaccgactaccagggcgccctgtcctacgcctacagcctcatttccagcgacatcaacgcggtggcgcagtccaacccggagctgctgccgcgcacgcgctacgtcgtcgtcttcctcacggacggcacgccgtatccgcgctgctcggccaccgacaacctcagcgtctacgccgacccggacaacccggacctgacgtgggcggactcgctgcgtgacttctgcaacctcaccaacaccacggaccagattgacgggttcgaggtggggacggaccgcaaccagaactaccagctgttcagctacgtgcggcggctgatggagttgaaggaccagtacaacgtgggcgatttgcgcatgcacacggtgctgctcttcaaccaggaagcggtgcgggcgtgtggccccatctgccaggacatctacggcgtgtacccgggcgtggagccggcgcgctacccggaggccgcgaagaagatcgccgcgtggctgctgcggcgcttcgcggacatcggcaacggcgtgtaccaggagttcaacgacacgggcgaaatctccaacctgggcctgggcgcgctggactactcgtcgttcgcctcgcgcaacgtgatgaagacgttgatggtggagtcgctcagctccgcgccgggtgacaccggccgcgtgctggacagtgatggggacggggtgccggattccatcgacaacagcttcacgctgaagaccaacaccttcgtcgcggacagcgacggcgactgcctggatgacggcttcgagtaccgccgtgaggaccagggcttccgcgccgccaatgatttggacgcgcgcgggtgcaacccggcctcgccgctgacgcccaactgcgtctgccgcgacacggacggtgacggcctgtcccagttcgccgaggactacctgcgcacgcgcaccggcatcgtggacagtgacggagacggcgtgccggacggcctggaagcgcgctgggggctcaacccgctggagaacagcgtgtcgggcctggatacggacggtgacggcatcccggacgcccaggagttgcgtgcgggcagtgaccccacgcgccgcgacaaggccttccatgagcgcttcggctaccagtacgagacgcgtatcgcggaggtccgccccgacggcagcctctgctacgacttcaccgtgtccaacctgcagctcgtcacgccgccggaccgcgcgggcgtgaagcagggctacaacctcttcaaggtgtggttcgccgaggcgccggagagtggcgtgagcacggactacggcgtgtggcgcaccgcctgtgcctgggcgcagtatgcgccgcccagcgtgcgggtcccggtggggcccgagctggtcttcgaggatgctgacttccgccggcccgacaccttgagcaacccgtggaacaaccagaacgactgtgtcggaatcccgccctcggggagcgccaatccgtga

SEQ ID NO: 3994 - DNA, 258 bp, Myxococcus xanthus
atgtacgtcgacggcagcgtgcccaccttcgtcccggacaagaagggcgagtaccagctccagctgaccgcgcgcctggccttctccgaccgcgtcttcccggaccagcgcgtgtccacctccaccctcacggtgctcgtgggggatgaatcggagaagggcaacaactgcagctcggtgcccgccggcttcagcgccaccgccctgggcgctgcgctgctcagcgtgctgatgcgccgccgccgtccccagcagtaa

SEQ ID NO: 3995 - DNA, 660 bp, Myxococcus xanthus
atgggcaccgaccccctgcgccaggacacggaccaggacgggttgatggacggcgtcgaggtccgcatgggcctggacccgctccagccggacgtcatcaacggctgcaacgtgtccctggacgaggacggcgaccggctcaacacctgcgaggagcgcgtgcttggcaccaacgcctgcatcggtgacacggatggggacgcgcttccggacctggtggaggcgctggtgatgacgaacccgctcatccccgaggacctgctcgatacggaccgcgacggcatcaccaacgtgtcggaggtggaggcgcacggagacccgctcagcgccgacctcgacttccaccgcgagcgcggctacggctacgaattggtggagaccacgcccaccgcggacggccgcagctgctaccaggtgcgcgtggagaacgtcaccgtcgtccccacccgcgagcggccacaccccttcatcccgggcgaagtcatcaaggcgggcaccaacgaggtgtacctctaccttcaggctggccgggacaatgatccacggggcgcgggcatcggctcgctcctcatccaggaaatccaatacagcgaagaggggggccgcctgccggcgggcatcatccccctggatcccgataccttcatcccggggacctga

SEQ ID NO: 3996 - DNA, 1431 bp, Myxococcus xanthus
atggagctgctgcggcaggaggacgggacgctcgtctccacggtggcgccggggccgggtgtgtccatcgtcggagggaacaccgagcgcttccgcgagcaggtgatgggtggcaaggcgccgcgcttcctggtggcgagcgagcggctggggcacgtcttcatgtcgagcctggggccgaacgtggggcccaatccccagcgcatggaggtgagcgcgaacagcggtgtgtccgtggtggagccctcgcggggcggctacgtgcggcaccggggcttcggcgcgggcggcacggaggggctggcgctggacgacggcgcgggactcctctacgcggcggacgtgggactggggctcgtgcgggtgttggatgcgcgagcgctggtgtcgggggacgcgcccgcccggcgcgcggtgctccaggaggtggcggtggcgccgcccgacggtacgccgcgcatccggccgccagaggacttcggggtccggggcagggcgggcgaggagctccattcgggccccagcgcgctggcgctgtcacccgacgcgcgcactctgtacgtgctcaatcggttcacccggaccgtggcggtggtggacgtgcacgatgcgaacgcggccaatgcgctggtggtgcgtcagcttccggtggagacgtctcgcgcgcaggccaaacgccggctggggcaggtcctctactacgcggacctgggacgcacgggcatcacctgtgacggctgccacatcgagggccacacgggaggcatcttctacgagaagacgcagcccaaccgcatctaccgctccacgacgctgcgaggcagccgcgacacgccgccgtacttcacccccgccagccatgtcagcctcgtggacacggtgcgcttcgtgggcgcgcgcaaccgcttccgcaacccggacctgtcgccgtcggaggtggaggcgctggccctcttcaacgcgctcatcgtcacgccgcccaacccccatcgcggcgaggacggcgcaccgttggagacggtggcgttgccggacgggagggtggggcgcccggcgcgagggcgcgcgctgttcgagggcaagggcgcctgtgcgacgtgtcacccggcgcccctctatacgttggaccaggacctggccacgcggggccggtacctcgaggtgggcacgccggtggcgctgccgctgagattggagcaacaggacctggtgcccggcgcggcgacgccgtccctggtgggggcgtgggacgtgtggcccctgctgacgagcgccaccgcgggctatggggtgaaggacaaccggctcgtggtggagacgcgcttcgcgctgcgcgcgctgctggagacgtcagggccccagcacggccacgccagcgcgctgacgtccgaggagcgcgatgacctgctggcgttcctgctcacgctgtag

SEQ ID NO: 3997 - DNA, 378 bp, Myxococcus xanthus
atggctgtcgcccagcttctcggcgtcggcacgctggtggctccggccgaagcctgggcccagagccgcggccgtacctcgcgccaggcgaagtccaaggccgccaagaaggcggcctccaagacgccgccgaagatcgagaccaagggctcgtccgtagtagaccccgtgacgggcgacgcggccacggcctcctccaacgcgctgccgcagcgaggcccggcgcgcatcgacttcgatgaccggctcatccagggacagacgaacaagtccggagccgtgtacctctatgaccgcaaggaactgaagacgcggtcgatgatccgcgagcgcgagagcttccgctccgaaacgctctccacggtgtacgacccctag

SEQ ID NO: 3998 - DNA, 1404 bp, Myxococcus xanthus
atgcagttcgcggacgagctgatggcggacctcgccctcgatccgctcccggagcccacggggccgctgctgcaggagcagcgcacgctggcgcggcccacgcatgcgccgcgcatcgcgcccggcaaaggcacggcgcagctctacctggagctgtactggggcgccatccgccgcgacgcgcgccgcttcgcgccggacaagaagaagccggtgcaggcctcgctggacctcgagggggccatgcccctgtggggcttcacgctgccggagggcgcgcccttcacgctggccgagccgctcaacaacgccttccgcctcttcgtgccgccgggcaccgacgtggagaagagcggcggtgacggccgcttcacccccgtcaccggcgcggccctggagtccgacggcagccgccgcttcctcacgctgcgcgagggcaccgccgcgcgcctgacgcagggacagatgtccctggtggcttacgccgcacccaagcccgcgcgcgtcttcgtcaacccgctcaagggcctgccctggctgacgctgacctgcctgggcctcttcgcctccgccatggccgcgttcctggtcatgaagccggaccagccggaggtggcggacttccagcacaagagccttccgcccgtggcgctgcgcctcatcgcgcccgagccgaagaagaaggaagaggtgaagaagaagctggaggccctccaggagaaggtgaagaagcccaccaaggagaaggtggcggagaaggccccacccaagccggtggagaaggcgccaccgcctccgaagcagcccgagaaagcggtggccgccgccacgccgccgcagaacaaggcgctcaaggcgctggccaagctgtccgccgcgggccccgccaccaacgatttgctcgccgccgtggacaagctcggcagtggccccggcagcaagaacgcgaagaactccaactacaagctgtccggcctcatcgggaaggcccccatcgccaacgcgggcctgggcaccttcgggctgggcggcggcggcaagggcggcggcgccacgctgggcgcggagctcttgcgcggcaagggcggcggcggcatcggcgcgctgggcgcgggcggcgtgggcaagggcaaggtgggcggcaccgtcacccgcgccacggcccgcagcatcgcctccacgcagggcacggtggaccgtgaagcggtggcgcgcgtcatcaacagcaacctgcacgaggtgcatggctgctatgagcgcgcgctgctcaaggacccgggtcttgcggggcaaggtggtgctggagtggaccatcggcgcgaacggccgcgtggtggccgccaagacgaagtcctccacgctgcgcaatgcctccgtcgagtcctgcatccttttccaagctga

SEQ ID NO: 3999 - DNA, 867 bp, Myxococcus xanthus
gtgaacgcccagttgattgatggcaaggcagttgcggcgcgcgtgcgagcggaggtcaaggcggaggtcgaccggctcaagctcgagcatggcctgacgccggggctggccgtggtgcgcgtgggggaggaccccgcctccaaggtctacgtcaatgggaagaagaaggccgcggaggaggtgggcttccgctcctgggagctccacccggacgagggcatcacccaggcggcgctgctggaggtcatccaccagctcaacgcggacccggcggtgcacggcatcctggttcagttgccgttgcccaggcacatcgacccggacgtcatcatctccgccgtgaagccggagaaggacgtggacggcttccacccgctcaacgccggcaacctgctgctgggccggtccaccacccgggcgtgtacgccctacggggtgatgcggctgctggaggagattggctgcgaccccgcgggcaagcgggcggtggtggtggggcgcagcaacatcgtgggcaagcccatggcgctgatgctgctccagaagaacgccacggtgaccatctgccacagcaagagcgacctgcgccgggaagtggagggcgcggacatcctggtggtggcggtgggggcggccgagctggtgaagggcgcgtggataaagcccggcgcggtggtgattgacgtggggatgaatcgcaagccggacggcaagctcgtgggcgacgtggaattcgccgctgccgccgagcgcgcgtcattcatcacccccgtgcccggtggcgtggggcccatgaccatcgccatgctgatgcgcaacacgctcgacgcggccgtccgctacggcctggtgcctgtcgtcaggtag

SEQ ID NO: 4000 - DNA, 522 bp, Myxococcus xanthus
atgcaccacgagttgctgctcggcgtcggcgtgctgccggccaacgcctattacaagggcctggtgggcaccgtcggatacacgtaccacttcactgacaccttcgcgtggcaggtcgggcgcggcacgtacagctacaacctccagacgagcctgcgcacccagctcgagcgcgacttcaatacgtcccccaacgccgcggccttccaggaccaggtgcagtggatggtgggctcggacctcgtctggagcccgctctacgggaagatggccttcctcaatcagtcggtgctgcacatcgaggccttcctgctgggcggcggcacggtggtgaagctcgaccgcgacggcggcttccggcctgccgtcaacgtggggctcggcctgcgcctcttcacgggcaagacgctgtcgctgcgcctggacgtgacgaacaacaccgtcttcacgggcgccacgcgcgtcatccaggtgcccctcatccagctcggaaccgcgttcaacttcggcgccacggaatga

SEQ ID NO: 4001 - DNA, 739 bp, Myxococcus xanthus
atgacctcccgctcgctcatcgccgcgctcaccagcgccgcgctcctcgtgtctccagcgcccgccgacgcgcagtctccggccgccgcgcagcccacgtccaccgcccccgcggccgcgcccacccagggcacgcctccggcgggagcaaaggcccccggtgacgccaaggccgacgcgcccgacgccgccaggcccgccgcgaacgccccaacggcgggcgcggaagccccgccgtccgcgccgcagaaggtggacccgggcgtcttcgacaaggcgctcaaggactacttcgacggcaagccgcgcgacgccgccgggccgctccacgcatggctgcaggccgcgcccaagacggacgagaactacgcctggggccagtacttcctcgcgcgcagcctcatcgacctggggctgacgcacgcgggcgcctcgtacctggcccgcatcgcccgcgagcgctccaaccccaacgtgctgcctcgcgccctggacacgctcaaggcgctgacggaccggccgcacgacgaggtgatgattgacgagcaggtgttcggcgcgctggacctgggcttcctcccggaagacacgggcgcgtatgcgcactatcagcagggtctggtggacctgcgcgtgggcaacgagcgttgggccaacacccacttcgccaagctgtcggagacgagccccgaggccagccgcgcgaagttcgcgctgctcgtcacccgactggagcagg

SEQ ID NO: 4002 - DNA, 249 bp, Myxococcus xanthus
cgcaagctcaaggcgttgcagcgggagctcgatgcggtcgacatcccgtaccacctggtgatggagagcggcggctcacgctccatcgtcctcgagttcgtggacgaccagggcgcggacctgctggcgctgggcacccgggcgcgctccggtgtggcgttcgcgttgctcggcagcgtcgcgacggacctcatccgtgaggcgaagtgcgacgtgctcgtcgtccgcgaggccgagccccacgagtag

SEQ ID NO: 4003 - DNA, 831 bp, Myxococcus xanthus
atgctcgcggtgggcacggtgctcttcttcacgttctacgcggagcgcacggcgcacacgtatggcgtggcggtgattttcaacgtcttcggcacgcaccacaccctgtcccagcaccggggcatctggtcactccacgggctgcgcgcgggcaaggccggcctgcctggcgcgtcggcactggagcgcaagctgcaacagatgtacgtcccgctgctgctctcgctgctgctggtgcgcatcttcttcgtgccggaggcccccgggcccgatgcgccggcgtacctggacattggccagggcgcggtgctcccgcacggcacgctaggggtgctgctggcggtgtggctgggctatttcatgctgctgttccgcacggtactgcgcgcggaggccgtcagcggacccaaggtgctctacctcctggccatggcgacggcgaccgggctggtgctggtggcgcccacctggggctacgtcatgctgcccggcatgcacggcctggagtactacatgctcaccgcgcggatgctggagccgcgcgagggtgatacgccccggctgccgcggaagttcatcgtcccggcgatgattgcgtccatgctgcccctgttggcgctgggcgcggtgcacggcctgctccagcagggcgtggtgcgcggcgcgctgggcagcaacatgggcgtggcggagacgcatcccctgctgcgcgccatgacgtccctgggcttcgcggtggtgctggcgcactacttcgcggacgcgctcatctaccgcttccggattccctccatccgcgcggtgatgctgaagcggctgggcttcagctag

SEQ ID NO: 4004 - DNA, 1026 bp, Myxococcus xanthus
atgacatggggacagcgcggaaccttagtcggtatgtttcaggcccatcaaatgaacacccatctcctgcaagccgcgatgctcgcctggactccaagcctgcgggtgacacgcgccgaaggcgacctctccagcatcctgcgacgccccgccggggccctgttggagcagccgctccacgaggtcctcggcgtgtcgcccaagcgcgcccgtgagctggacgcccgcgcccgcgaggaccgccgcgcggtggagttcatctccgccaacctcggcggcgaggacgcgtcccccctccgcctgtccctgggactggacgacggcgaggccagcgccaccgtgctggacctcaacgccatgctggacggcgcccccccggtgcagatttcacggctgtcctcctcgctcagccacgagattcgcaaccccctctcctcggtgaagatggcggtgcagacgctggcccggaacaccggcctcaatgaccgggacaagcggcggctcaccatcgccaaccgggagattcgcaccatggagcgcatgctctggctcctctccgaatacggccgcgacaccaccccgaagctggacgcccatccgctgcgcggcgtggtgcaggaggccacggagatggtggcccccgagctggccgaacggcgcgtggaggtccgcgtggacgaggaacccgacctgccccgcgtccgggtggacccgacgcggctgcggcccgtgctggcccaggtgctgctcaacgtcgccatgggccaggcggagggcagcccgatggaggtggccctgcgccggggtggcccccaccaggtgatgatggtgctccacgaccccgccgccgccctgccccccgaggagaacggttcgctcttcgagcccttcggctcccggctggcccggggcgccggtctgtccctggccgccctgcgccgggtgatgacgggcgtggggggagacgtggccgcccggggcagcgccgagccgggcgtggtgctgacgctgacgttcgccacctga

SEQ ID NO: 4005 - DNA, 1467 bp, Myxococcus xanthus
atggagacccttctcatcgtcgacgacgacgtctcgctcctcgaaacgctgaagatgcatttcgaggagatcgagcaggacggccagccccgctaccaggtggccaccgccaccagcgccgcggcaggactgcgcgctgcccaggaggccatgcccagcgtggtcatcctcgacatgatgctcccggaccgcacgggtctggaaatcatcgaggagatgaagggcctgtgcggggacgcgcgcatcatcctggtcaccgcgtaccacgacatggagaccaccatccgggccatgaaggccggggctttcgactacatccacaagcccttcccggacccggccgccctggacctggtggtggagcgcgcgctggagtaccgccagctgtcgcgccgcgcggacgaggtccaccgggagaacgccgccgcccgcctgggcgacatcgtgggcaccagcccgctgatgcagcaactggtgaaggagattggaaaagtcaccggcagccacgccaccgtgctgattacgggcgagagcggcaccggcaaggagctcatcgcccgcgtcatccacaactactcctacgacgagccccggcccttcatcggcatcaactgttcggccatcgtcgacacgctgctggagagcgagctcttcggccacgagaagggcgccttcaccggcgccacggcgggcaagccgggcaagttcgagctggccgaggacggcacggtgttcctggacgagattggcgacatgtcgctgatgctccaggccaagctcctgcgcgtactgcaggagcgcgagttcgagcgcgtgggcggcgtcaaacgcatcaagctgcgcgcccgcgtcatcgccgccacccaccgcgcgctggtggaggaggtggaggccggccgcttccgcgaggacctctaccaacgcctcaaggtcatcaccctccagattcccccgctgcgcgagcggcgcgaggacatccccccgctggtgaagcacctgctcgagcgcatcaacgagaaggtccacaagcgcgtcacccgcgtgcccggcgaggtcatggagcgcctcacccgcctgccctggcgcggcaacgtgcgcgaactggagaacgtgctcacccgcgccgtggtgctggcccccggtgacgtcctgcgcggggacgatttgcccgccctggagtctcccctcccctcgccggagccgggccgggccacctccgcccaccacaccgccagcgccatgttcgccgcgccggccgaggacgacgccagcctgattcccactttggaagaggccgagcgccagctcatcgcccgtgcgatgaccgtcacgaaggggcacaagggtcgcacctgccagatccttggaatcagccgccccaccctggagcgcaagctccagaagtacggtcttgcacagagccagagccctcaagtgcacaccttccctgtgaaggatgcgttgtga

SEQ ID NO: 4006 - DNA, 747 bp, Myxococcus xanthus
atgcacggtttcaaccgccccctcggccccatcggttccaacgtcgtggcgccgctgcagacgaccagctccgggatgatggtcaccgccaacaagctggtgcccggccaggaggccatcgacttcaagggctacttcaaggtcgagtccttcccgcacaactcgaccatctaccgccccggtgacaacaccgaccgcgtctacctgctgaagtccggccgcgtgcgcctgatgcgcatcggcaagaacagcacccgctccgtggtgtccatcctccgcccgggcgacctcttcggcgagctgttccgccccgagggcacgccgattgaagagatggccatcgccgccggtgaggccgaggtctggagcatcgagggccgcgacttccgcgcccagttggaggcccgtccggccctggcggtggacgtggtccgcgcctacgccgagcgcgtgcgtgccctgcgcaagcgcgtgctgggcctgacgttcaaggaggttccggcccgcctggcggacaccctgctcaccctggttgaagcgcacggcgagcgctgcccgcacggcggcgagacggacctgcgcggcatcacccagcaggacctcgcggacctcgtgggcgcctcccgctccttcgtgtccacgctcatcaacgagatgaagcgcgagggcgtgctcggcaacgtcggccgtatcctctgcgtgcgtgaccagaaggccctgcggaagatcgccggcaaggagaagtag

SEQ ID NO: 4007 - DNA, 360 bp, Myxococcus xanthus
atgttgagccccaccgaggtgctggagacgctccagtggtccaaggagtacgtcgaggagggcgccttcggcgacaacgaggacgaactggaagccgccatcctcgagaagaagctccgcgagcggctcatccccttccagtacagcgcctactcgagcgtgagcgactactactacttcgacacggggatgcgtcgcgacaccgggctgctcatcttcccggcgcgccacgacgacttcgacctgtcgacgtggctgctggatggagcgcccgacgtctcgggctgcaccttcgacttcgacgaacacctgcgctgggtcctccgggagggcctggaggagaaggactgggggcgctga

SEQ ID NO: 4008 - DNA, 1548 bp, Myxococcus xanthus
ttccacatcaacggcctggtgctggcggtggcgctccagccgcatgccctggcggagacggggctgtcttcgtcggaggtggcgctggtggccggagcgatggtggtcatcctcacgctcgacacggcggcgggcatctggttcctgcgccggggcttcggccctcgccgggtggcgcgcacggtggtgctgatgacggccctgtgcaccatcgagcggctggtcaccgcgtccctcatcttcgcccatggcggcgccgtgcagcacgccaccaccaccctgcccctccaggcaccgttgcggatgaacaccctcctctcgcgcatcacgggcaatgcgcccgcatccggcctgcgcctgggcgtgagccctgaggcgggcgtgcccgcggcgagcatcgaccccgcggcggtgcgcttcacccgccgtcccgacatcgtcgtcgtcctggtggagagcctgcgtgacgacttcttcaccgccgacgtcatgccgaacatgtggcgcagggcgcagagcggcacgcgcttcctgcatcaccacagcgcggccagctccacggactactcgctgttcagcatgttcttcgggctggaggcccagcgccgcaatgccgtggtgggcgcgggccgcacgcccctcctcttccccgcgctggcccacaatggctaccagcagttcttcttcgccgcgtcctccgttgactggatgggcctcaaggacaccgtcttccgcgacgtgacgggaggcctgcgcacggactacacgggccgcagccacctgcgggacgaagccatggtccgtgacgcgctggcggccgtggaggccacgcctcaggacaagccgctgttcctgttcgtgttcttcgccggcacgcacttcgactacgactacccaccgcgctccgaggtcttctcgcccgcctggaatggcaagggcggactctccacggcgcgcgtgcctcccgagcacctcaaggcccgcgcgtggaacgcggcctacgaagtggacaccaaggtcgaagagctgctggcgcgcatcgaaagcttgcgcggcgcgcgtccgatgacgctcgtcaccggcgaccatggcgaggagttccgcgagtacggccgcgtcggccatggcagcgacgtgacggcctcccagcttcacgtgcccatgctcgtgttcgacgaccagcttcccgtgggccaggtcgacgccgtcaccggacacatcgacgtggtgtccacgatcttcgacctgctgggagacacgcacagccccgcgatgctgggtgacggcattcccatgtcccggccggacccgcagcgatacctcctcaccaccgtgggttgggaggcgcgttacgcgctcatcggccaggagctgaaggtccatttcggcgcggggcggcctggcaccgtcatcaccgacctgcgcgaccgtcccctggccgatggcaaggagcgcctcgcggccgaggccccgcgcatcctccgccgactgagggggacgtcggagtcgacgcttcccgacgccgccacggccacggacgtgccctga

SEQ ID NO: 4009 - DNA, 120 bp, Myxococcus xanthus
atgccacgccgcttccgcctggagctggcccgggacgtcctctccagcacggacacgccacgaacgctgcacttcatcgagcccgtgccagccgacccggagccggtcgacagccactga

SEQ ID NO: 4010 - DNA, 1119 bp, Myxococcus xanthus
ctccgtctggttcagttcacccggtctttccacattggagggaccgaagtgcaggtgctggagctgctgcggggactgcccgccagctaccggttgcaggtgtccgtgctggatgattcggggccgctgattgccgcggtgtggaagctgggccacgcacccgcggccttcccgctcaagggctccgtggtgcagccgaacacggcgtatcaggtgtaccgcatggcacgctggctcaaggcgaaccgcgtggagctggtgcacgtgcatgacttctactccacgatggtggccgtgccggcggcgaagctcgcgggcacgaaggtcatcgtgggccggttggacctggcgcactggcaggggcgtgcgcggcgcgcggtgcagtcgcggctgtgccgcatggcggaccatgtgattggcaacgcggaggccatccgccaccagctcatcaccgaggagggcctgccggcctcgcgcgtgtccgtcatccacaacggcctggacttgccgcgcttcgagtcccgcaggcgcgaagggctgcgcgggccgctccccgacacgggggccgcgccggtggtggtccacgtggccaacatgaatcacccggtgaagcggcaggaggacctgctgctcgcgctggcccaattgcgccattccggcatcacgctgcacgccttcctggtgggagatggtccgcgccggccgggcctggagaagctggccggtgagctgggcgtgtccgataccgtgcacttcctacggcaccgcacggacgtgcccgccatctacgcccgggcgaccttcggcgtcctctgctccaccgcggagggcatgtccaacgcggtgatggagggcatggccgcggggcttcccatggtggtgacccgagtgggtggcaacaccgacctggtccgcgatggcgaacgcggcctcgtggtggaccccgagcgtcccgctcagttggcccaggccttccgtcagcttctcgcgaatcccgagaaggcgagaagcatggggcatgcggcgcgggacttcgtggcgcgcgagctctccctggagaagatggtccggcgccatgacgcgctgtatcagcggattgcccggggcgcggacgcctga

SEQ ID NO: 4011 - DNA, 1443 bp, Myxococcus xanthus
ggaagcctcttccaactcctcaacgagacggccacgcgcgctggagaagaacggttggcggcgtggctctccgcccccgcgtccgcccaggaggtcgaagccagacagggcgccgcgcgcgaactggcgcccaacctggacttccgccaggacctctgcgtggacgcgcgggacgcctcgcgcgagaaggcggacccggcgctgttcatccagtgggcggagtcgggtccacagctgaatgccatccgctgggcccgaccggtggcggtggtgctgcccctggtgacgctggccgtctacgtcctgggcaagttcgaggtactgccggagtcggctttctgggtgggcttggccgcgcaactgggcgtggccgtcatcacccgccgcccgctgaaggtcatggacgaaggcgtggaggtgggtgagcgcggcttcgtgcgctacgcccccatcttcgagcgcgtggaggcccagcgcttcgagcacccgcgactgaagacgctccagtccggcctccagcagcccggccagccgcccgtgtccgagcacttcaagcgcttcagccggctgttctccttcatcgagttcaagcgccaccagttccacccgctgattcactggctcacgctctgggacatccacgcgcacttcgcgctggagcgctggcgcgaggcccacggtaagcagctgcgccagtggttcgaggccctggccgaactggaagccctgtcttgcgtcgcgggcctcgcccatgaccggccggacttcacctggcccgtcttggcggccaatggcccctgtgtggaggcgacagcgctgggccacccgctgctggacgctccggtgcccaacgacgtgtccctgcccggtccccggcacgcgctgctcatcaccggctccaacatgagcggcaagacgacgctgatgcgcgcggttggagccaacgtggtgctggcgttggcgggcgcgccggtgagcgcgaagcacttccgcctgacaccgctccagacgctcaccagcatgcgggtgaaggactcgctggagcgcggcgtctcctacttctacgcggaggtacagcgcatcaaggcggtgctggacgcggcgcaggccgcgcgcgggcaggtgctgttcctcctggacgaaatcctcctggggacgaacacccgcgagcggcagattgcctcgcgcgaggtgctgcgcctgctgctgggcaccggcgccattggcgcggtgacgacgcacgacttgtccctggcggtgctcgcggacgagccgggcgcccatgtcgtcaacgtccacttccgggaccacctggaggccgggaagatgatgttcgactacaagctgcgccagggcgtggtggacaccaccaacgccctgcgcgtgctgcgcctggccggcgtaccggtggacgacccggacgaagccacggcggcgcgctga

SEQ ID NO: 4012 - DNA, 696 bp, Myxococcus xanthus
atgggactggggttcatcgcgcttatcgcggggtcgattctgagtgtggcgctgacgcttcggctgagcgtgcgcatccaggcggtgccggtgggcgtgctgcgggtggcgctggcggtgctgctggagaacctgtgggtgctcgggatgttgccggtgctgtgctacggcgccgcgcgggtgatggagctgcgtccgtggaccacggcgggcggtgcggcgctcacgggcgcggccttcttgaacgcgatggccttcatccagagcggcgtgtacgggctgtgggccggggacatcggctccgtgttcagcctagcggccttcgctggaggcgtcgtgctcagcgcgcgtgcggtgatgatgggccggcacgccgcggcacagcagtcggtgaaaacccaggccaaggcagcggagcgcaagtccgagtacgacgagttcctccgcgcggcggagcagggcggggcgcggctggagcagcgagaagcccagtccacggctgtggctggagacgcgctcacggccgcggccctctcggcgacggttgcttccgcgcaggctcaggcgccagccagcgacgcgaacgctgctgcatcgcaggcgcaggactccggtggcgtggagcccgctgcgacggaagaggcaggggcatcacccgccaccgacacccaggccggcaaggcccccgaggcctga

SEQ ID NO: 4013 - DNA, 798 bp, Myxococcus xanthus
atgccccggctgaagctgacgctcgaatacgaaggaacgcgctacgtgggctggcaggtgcagcccaacgggccctccatccagtcggtgctggaatcgggactggagcggctgctgggggcgcgtgtgtcggtggcgtcggcggggcgtacggatgcgggcgtccatgcctccgggcaggtggcttgcttcgactcgccccgggtgttgccgatgaaggcgtacgtcatggggctcaatggcctgctgcctcccgacgtggccgtggtggacgcggtggaggtggccgaggacttcgacccacgccggtggtcccggggcaagcgctaccggtatcgcgtgagcaaccggcgcacgcgctcgcccctgcggcggatgacgcactgggaagtcttcgctccgttggatgtggaggccatgcggcaggcggccgcgcacctgttggggcggcatgacttctctgccttcagggccgcggactgccaggccaagcacgcggtgcgggagatacggagcctggcggtggaaggcacgtcgggggacgccgtgtccttcgtggtggagggcaccgcgttcctgaagcacatggtgcgcaacctggcggggacattggtggaggtggggaagggacggcggcccgcgtcctgggtggcggaggtgctggcctcccaggagcgcaagcgcgccgggcccaccgcgccgcctcaggggctggtgctggaggaggtcttctaccgggacggcccgcctgcccgcacgccggggggaacgacggacgcggaagaggatgagggctga

SEQ ID NO: 4014 - DNA, 1227 bp, Myxococcus xanthus
atgcctcccgccgccccgcagcgcgacaccggccgctttggaaagtaccgcctcatcgaccgcatcgccgtgggaggcatggccgaaatcttcctcgcgcatcagcagcaggaggacggccgcgagtctcccgtcgtcatcaagcgcatccgcccgcatctgtccaagcacacggccttcgtgaagatgttcctcaacgaggcccggctcgccgcgcagctcaaccaccccaacgtggtgcagattcacgacctggggaagattgccgacagctacttcatcgccatggagtacgtgtccgggcgggacatgcgccgcgtcgtccccaaggcggaggcgctggggattcccttcccactggtgtacgcggtgaagattgcctcgtgcgtctgcgcgggcctgcaccacgcgcacaccaagggggacctgtacggcaacccgctcaacatcgtccaccgggacgtgtcaccggagaacatcgtcgtcgccttcgatggctcggtgaagattctggatttcggcatcgccaaggccgccaaccagatggagcagacgcgcaacggcgaaatcaagggcaagctcagctacatgagcccggagcagtgtctgggcaagccgctcgactgccgcagcgacgtcttctccctgggcgtggtgctctacgagtggctcaccggcttcaagctcttcaccggtgagtccgaggccgcggtgatgcgcagcatcacggacgggaagatctacgcgccgtcgtacttccgcgaggacctgccggagcgcctggagaccatcctgatgcgcgcgttggagcgcgaccgggacaagcgctaccagacggccgcgcagatgcagaaggacctggacgccttcctggacgcgtacgacttcacgcccacggcgctgcacctgtccaacttcatcaagcagctcttcgaggaggagctggccgccgagcagcgccgcctggccgtgcgcgccgcggccgcgcccacgtcggaggaggccctggagctgtcggatgtggcggatgcgctcgacaccgcgaaggccatgcccgctccggagccggagcccccggcccacgatgaccgcaccgagccgcgcaccctggccgtgccgctgagtcccgccgtctcggaagcgctggaggcggtggcccgccgcaacaacgtgcccgcgggccgcatggtggccgagctgctcgagtcctggctcaagtaccgctga

SEQ ID NO: 4015 - DNA, 987 bp, Myxococcus xanthus
atgggcacactggcttcttctctcgtggagacgctgcgcgcctcgcgcggccggcgcgggccgctgctgggagacgcgcggaccacggcctggcgcgtggtaaacgccgaagcggacggtgtgccggatgtgacggcggatgtgtttggtgacgtgtacgtcatcagcctctaccgggacttcacgccggacgaggaggagacgctgctcgacgcggccgtggccgcctgggcgcctcgaagcctctacctcaagcgccggccccgggaggcgcgtgtcctggccaacgtggcgaaggagtcgctcgcacccgaggcgcccgcccggggcgaagcggtggagtccttcaccgcgctcgaaaacggcctgacgttcctcatccgtccggcgcaggggctgtcggtggggctgtacctggacatgcgggacacgcgggcgtggctgctgtcgcaggcgcggggcctcaccgtgctcaacctcttctcgtacacctgtgcctttggcgtcgtggccatggcgggcggcgcgaagcgggcgctcaacctggatgcgagccggcgcgtgctggagtggggcgaggagaacgcgcgcctcaatggccagacggtggaccgatatgactacgtggccggtgacgtgttcgattggctgaagcgcctggcgaagaagggcgagtccttcgacatcgtcatctcggacccgccgtcgttctcgacgacgcgcagtggccggttctccgcggcgcgcgactatgcccggctggccgaggccgccgcgcgcgtcgtcagtccgggaggccaactggtggcgtgctgcaaccacgcgggactggctgcccgccgcttcgaggccatggtgctcgaaggggtgtcccaggcgggacgccaggggaagtcgttgggctcgctggcgccgtccgcgttggatttcccaccgccgcccggacaggagcccgcgctgaaggtgcaccgggtgcaggtccgttag

SEQ ID NO: 4016 - DNA, 1260 bp, Myxococcus xanthus
atggccgtggtggtggaaggcaacaccatccgccgcatggctccggacgcccaggtgcccgtgctgcccggggactgggaagtcgcctgtcatggccggctggtggcgccaggcctggtggactgtcacacgcacctcgtcaacggccagttgctgccgccgacgggacacttcctgatgctcccgccccgcgagcgcctggaccggctccggcacgtggcgcggctgctcacgaacgaggacgtggaggccctcacccgctacgcggcggcccgggccctgcgtcacggcgtcaccctggcggtggagcacctgtcctgccaggacgtggccggaggactcgccgcccaggctcgcgccgcggaggcggtgggcttgcggttggtgacgagccactccacccacggattggacggcgccgcgcaggcgcaggcgtggctggacgccaacgcggacttcacgcgcgcgcatcgggaccacccgctggtccggggggcgcttggcttccatgcgtcgttcacctgtgacgacgcgctgctgcgccgcatcgcggagctgagccgggtgctggacgcgcccaccgtcttccatctcgcggagagcgaggacgacctctcctccacctactcgcagcacggcaaacgcgtggttccgcggctggatgcgctggggctgctcgggccgcgtgccatcgcgggctatgcgcgcgtgctggacagcgcggaggcggagctgctggagcagagcggtgccttcgtggcgctggcggcccggggcgtgcgcgcgctggagcgtggcgcggaccccatggacgcggtgctgtcgcgggtccacctgctggggctcggcaccgggggccatggcagcctccaggacgaactgctcgccgcgctggtgggcgtgctgcgcatctcccgttccggaaggctgccggacgtggatggcgcgctggcgcacctgctcgtcaacggcccggcggagctgtgcacgcggctgttcggcctgccctccgggagcgtggaggaggggagcatcgcggacctcgtcgtctacgacgtcgtgcccaccgcggatccggagacgggctactcgccctatctgctcgggcaactggcgcattcgccggtgggatggaccatcgtgaacggccgggtctgcgtgcgggaggggcagttgctggggctcgactacgtggcgctttcccgtgcggcgaccgaggcgctggagcgtgtctggacgcgcgcgcgtctgggcagttga

SEQ ID NO: 4017 - DNA, 780 bp, Myxococcus xanthus
atggccctgacggtgagccaggtcgcccggctggcgaaaatcagcatccgcgcgttgcaccactatgacgagctgggcctgttgtgtccttcggaccgcagcgaggccggctaccggctctattcacaggcggacctccagaagctccaacaggtgctcttcttcaaggagctgggcttcccgctggaggacatccgccgcatcctgggcgaccccaccttcgacctgcgcaccgcgctgcggatgcagcggcagctcctgacggagcgggccgcccgtctggacgcgctggtgcatgccgtggacgcggcgctggacgcgctggagaaggggacgcacgtggacaaggaagcgatgttcgaggcctttggcgacttcgacccctcgaagtacgaggaggaggcgaagcagcgctgggggaacacggaggcctacaaggaatccgcccggaggacggcgcgctacaagaaggaggactggaagcgcatcaaggaggagggggacgtcctcttccaggcgttggcggacctgctcgcggcgggcaccagcgccgcgtcggccgcggccatggacctggccgaggcgcaccggcaatacctgggcaggtggttctacgcgtgcccacccgccatgcaccggggcctgggggagatgtacgtggcggatacgcgcttcacggagaacatcgacaaggcgcgccctggcctgtcgctgttcctacgggatgccttcgcggccaacgcggagcgacagggggccgccgatgttccctgcggctag

SEQ ID NO: 4018 - DNA, 258 bp, Myxococcus xanthus
atgaaggcgatctcgaagaagcagcagctccgcaaggctcgtggccagggcatgaccgagtacatcatcatcgtcgccctcatcgcgatcgccgccatcggcgtggtgaccctgttcggcgacaacatccgcaagctgttcggcgcctccgccgacgcgctggccggtaacgcctccgtcgactccgaggccaccgagcgtcagcgccagctggagaagaagaccatcaagacgttcggccagaacaacgcgtactga

SEQ ID NO: 4019 - DNA, 2481 bp, Myxococcus xanthus
atgggcggcacgctgccggcgctggtgcggcacttcgcctccagcctgtcgggcgtgcgctacgagttggcgcggctctacgccgtcaacagtctgggcgcggcggtgggtgtgttcatcgccgggacgaagctggtgcccgccatcggcctgtcctcctcggcggggctggccgcggggctcaacatcctggtggcgctggcctcgctggggctggcccggcgcttcccgcccgcgctggtgccgggacagacgccccccgcggaagcgggcgacgcggaggtgtcctatccgcgcatcgcggtgagggcggcgctcatcggcgtgctgctgtctggcttcacgtccatgctgtaccaggtgacgtggatccgcctgctgtccatcgtcctgggcgcgtccacctacgccttcacgctcatcctcaccgcgttcatcatgggcattggcctgggcagcttctggctgatgacgcgcaagggacaggtggactcgctgcgcctgttcggccggctccaggtcgcgctggtggccagcatctgcgtggcgctgccgctctacgtccggctgccgcacctattccgcaaggcgcagtggatgatgacgcgctcgctggacacctggccgctgttccaggtgctgaccttcggcttctgctgcctggtgctgctggttcccaccttcttcatgggcgcggccttcccggcggcggcgcgcgtggccacggccaaggtgtccgaggtggggcgccagttgggcggcgtctacttgtggaacacggtgggcacgattacgggttcggcgctgggcgtgctggtgctgatgccgtggtggggcatggagggcaacttcatcgcgggcgtggcggccaacctgctcggcgcggggctggccttccacccggctcccggccgtcccgcacagcacgcgcgcgccttgtggccggtggccgccacggcggtgctggcgctggtggtgctgggcgggatgagcggctgggcggtgcggttgtcgggcatcgcctccatccgctcccacgagaagccgccggagagctacgcgaagctggtggcggacacggaggccatcatccgccccatcttctaccaggacgacaccttcgccacggtgatggtggcggacgttcccgtggacaacctgcgtttcatgaagctcaacgggaaggtggacgcgtccaacgggagcgacgtggagacgcaggtggtggccggtcacctgggcgccctgttgcacccgcgtgagcccaagtcggtgctgctggtgggcgccggcgctgccatcaccgcgggcagcgtgctggtgcaccccgtggagcacctggacatggtggagattgctcccgccgtcatcgacgcggcgcgcctgttcaaggcggacaaccgcaacgcggtggatgacccgcgcacccacgtgcacgtggacgacgccaagacgttcatggcgctgtcgccgcgcaagtacgacctggtggtgagcgtgccgtccaacccgtgggtgtccggcgtgtccggcctcttcacgcgggacttcttccagaccgtggaccggcacctggcggacgacggcgtgctggtgcagtggatccacacctacgagagcaacgaggacctcatcaagctggtggtccgcaccctgcgagacaccttcccgcacgccaccacgtggctggggccgcatgacctggtgatggtggccagccgcaagcccctggccttcgatgcggcgcgcctggccgagcgcatggggcatccggaggtgcggaaggacttgtcccgcgtgggcatcaacgacgtgttcgcgctgctgtccaagcaggtgcacagcgaggccggccagctcgagttcgccggtgagggccccatcaacacggacgaccacaacctgctggagtacgcgtcgcccatcgccttcttcgtgtcgaatctggacgtgcgcgtgaaggacgagcggcgcgcgcccgaaggggcggaccgcctcttcctgcacgactatgtccagcagcacccgcccaccgcggagcaggccgccgggctgtaccggaacatcgagcgctaccacgcgcccaatgaccccatggtgcgcggcgcggccgcgcagtggcggcggctggcccccgacagcccggagtccgccctggccctgggcaaggcggcgctggcccagcaggacttgacgctggccgcctcgctcctggagccggaggtggcacggggaggacgcgcgcccgcgctggtgacggcctacctccggctggtgacggctcagacctgggcttcgcgcaccatgtggacgcctgtaggtgccctgcacgacaccgtggccctggggcgcgaggttgcgtcccggcacccggacgacgaacatctggcccgggcgctgcgctcgctctgcgaggcgctgccccgttcgagctgcgaaggcacggcccaaacgcccgttgccgcccccgggggcccctga

SEQ ID NO: 4020 - DNA, 1579 bp, Myxococcus xanthus
atgatgatgactcccacggaacggacgattgcccgcctgcctgctcatctgcgtcgctacgtggtgagccaggactacgcggcgtatacgtcgcgggaccaggccgtctggcggaatatcctgggctccttgaggggccacctggcggacaaggcgcaccccgtctacctggagggcctggaggccacgggcatcggctcggagtgcatccccagcctggatgagatgaacgagaagctcgctcgactggggtgggcctgtgtgggggtgcgtggcttcattcctcccgccgtcttcacggagctccaggcgatgggcgtcctggcgattgccgcggacatccgcacccacgagcacatcgagtacacgccggcgccggacatcgtccatgagagcgccgggcacgcgcccatcatcgccaaccgccgctacgcggagtacctcaaggcctgcgggctggtgggcttcaaggccattgccagcgtggaggaccaggccgtcttcgaggccatccggaacctgtcggtggtgaaggaggacccggacgccagcgaggaggaagcggcgcacgcgcaggcccggctggaggccgccagcgcgagccgccgctacgtcagcgagagcacgcgggcgagccgcctctactggtggacggctgagtacggcctcatcgggagcgtggcgtcgccgcgcatctacggcgcggggctgctgtccagtatcggcgaggcgcagcactgcctgacgccggcggtgaagaagctgccgctgagcgtggcctgcgcggacatggactacgacatcacccgcatgcagccgcagctcttcgtggcgcgggacttcgagcacctgttcgaggtgctggcggagttcgagtccacgctgtcgtggaagcgcggcggcgacttcggcctgacggaggcgctgcgcgcgcggaccgtcaatcacctggtgctggcggacggccgcgaggtgacgggccgggtgctggagatgctcgccgcgccgcgcgaggtggcgccggggctgggcaccgcgcttgtctgcatggaggggcccatcatggcctcgcgaggcgggcgcgccctggacgacaagccgtggagcgggccggcgctggtggcgttcggcgcggggaccttgccggagcgcgggcccttcaagctgtcgctggagagtgggctggagctggagggcttcgccacggacggcggccaggtgctggcgctgcgcggccggttggcggggcgcgagctggcgctgcccgcggtggcgaagctcttcgtcagcacgcacctgccctcggtggcgggtgggccttcggacccggcgacgtgggaccgctggtacggcgagctgagcgccttcgcggaaggggatggcgaggagaaggccccgcacacgcaaggccctggcgctgcacccggcgctggccgcgctctaccgcgaggtccggaagatgcgggagacgcactccgtgaagcctgagcggctgagccagattgccgcggcggccacggacttcccggatgactggctgcttcgcgccgaagtggaagagctgcgccgccgcgtctga

SEQ ID NO: 4021 - DNA, 954 bp, Myxococcus xanthus
atcctgggcacagccagtgtccttcccggccccgccgtgacgaccgcggagctgtgcgcgcgcgtgggacgaaacgccgcggaggtggcacggaagacaggcatcctcacccgccacttcgcaccaccggggacgaaggccgcggacgtggcggcgcaggcgctgcggggcgcgctggacgcggcgggactggaggcccgagccctgcgccgaatcctctgcgtcacctccatgggcggcgacgtcaccacgcccgccaccgccaaccgcgtggcagcggcgctgggcctgtcgggaagttgcgacgcgatggacctgagcaacgcctgcatgggcttcctgagcgccttcgacctggcggcgcgctcggtggccacggggctggggccggtgggcatcgtgtccgtggagctgctgtcgcgcaccaccacgcccgaggagccccgcccctacctggtgctgggcgacgccgccgccgccgccgtgatgggcgcgggccgttcgggagaaggcgtcctgggcgtggccctgggcaatgacggcacgctgcccacggacgtcgtgctggagaacccgacggccaccggcaagctggagcggatgcgcttcctgacgcccagccaggagatgacccgcgtcgcgctggacgcgctggtacgggcggcgcgcgcggcgttggacgaggccggcgtgacccttcacgacgtcgagtgggtgctcacgcaccagccgaacggcagcatgttggaggccatcctccaggcgctggaggtgtcaccggaacggagcgtgcgcgtggtggacacggtgggcagcgtgggctcggcctcgctgggcaccagcctggaccggctgctgcgcacgcgtccagtgaagccagggcaccgcatcctcctggtgggcgtgggcgcgggcgtggcccacggcgcggtgctgtaccaggtgggcggatga

SEQ ID NO: 4022 - DNA, 1281 bp, Myxococcus xanthus
atggtgctgggagagcaggggcagcgccgtgacgtgtgggccttctatgcgctgaccgctttcgcggcggtcatgtactcggtgccgggcgagtggatcccggcgctcgcaccgctgcgcctcgcgttggtgacgtcggggctggcggcgggactcatggtgatacgccggctggggcgggcggagccgctgtacctggacggctcgcgcggtctggcgctgatcgccttctccacgttggcggtggcgtccgtcgggtggtccgtgattccggaggtgacgaccgccacgggcgtcgagctgctgaagctgacggccatctacatcaccttcattaacgtcatcaccaccggccgccggctggcggtggtgtgcggggccatggtgctggcgtcggtggtgacgtccattggcgccatcaactggtacctggtgggtgaggacctggtggaaggcttccgcgcgcgctgggtgggcgtctacgcggacccgaaccacatggccatgaacctggcgctggtggtgccgctggcggtggccttcgtggcccgcaagagcagcggctggctgtggcgtctggcgtgtttgacggcggccatcctggcggtggcggccattgtcgtctcgcactcgcgcggcggcttcatcggtctctccgcggccatggcggtgtgggccatccgcgagaagcgccgcatccaggccattgtcgtgggctcgctcttcgtgatgggcctgctcgtcttcgcgccgcagagcttctggcagcgcaacgagacggtggccgagttccacgaggacgcgtccgccatgggccgcgtctacgcgtggcaggtggccagccgcatcagcctggacaagccgctgctgggcgtgggggcgggtggcttccgctacgcgtggcccatgtacgcgccccccgaggcgcgccgggcgtacgtggcccacaacatcttcctggacgtcatcggcgagctgggctgggtgggcctgttgttcttcatggtgttcacgggtggtgccgcgggcggcgccttcgaggcgtcgcgggacaaggaagtggggtggctggcgcgagccttgtccgcgtcagtcgtgggctacctcgtgtgtgacttgttctctggctacatcctgtccgcgcacttgtacgtgctcttcggcctggcggcggcggcgcaccgggtggcgcgcgcgtccgaggcgttggacaggcaatggggtccggctccgagcgagccggtggtggcgacgtgggaggggtccggacatgcggcgtga

SEQ ID NO: 4023 - DNA, 912 bp, Myxococcus xanthus
atgcctccgcgcaagctcgttcggcacctcgtctggttggagtccttcgccgccgccgtggaggcgggcagcatcgaggccgccgcggagcacctgggcgtggcgcgctcggtggtgagcgagcacgttcgctcgctggagctggcgctggcggatggtgcgccgttgttggagcgcgggcctggccgtcgcttgcagctcaccgcccggggggagcggctcttcgcgggcacccagacgccgctgcatcaactggacatgaagcggctgcgcgacctggccagcgccgagcccgtggtgcggctgggcctcaacccgacgctgtccttgtccctggtgggcgccgtggcgagggacgccgccgccgcggacctcaagctggtgctcagcttcggagggccccacgagctgacgcgccaggtacagacgcggcagctcgacctggcgctcgacttcacgcccctgcctacccatgaaggcgtggagtcggagtcactgctgcgcatgcccttcgtcgtgctcgctgggccggacaacgcgctcgcgcggcaggccgcgtcccggaagtcgctgcacgtgaaggacctggaggggcagcgcttcgtggactggctgcgtgatgacccctacggcggcgccaacagcgcccgcttcgccgcccacggcgtgacggtggatgaagtggggcgcgcggagagcttccttctcctctacgagttgctgcgcgcgttccgcgcctgcgccatcactccggacctgcgccccatgcacccgtttccaccggacctccatgcgtggcccctcctggaagaggagccccaggcggtcgaggtggtggccttgtggccttcgggagcgctcagccccggcgcccggttggttctggatggacttcgccgcaagccaggctag

SEQ ID NO: 4024 - DNA, 282 bp, Myxococcus xanthus
atggtgggcgcgatgctcagctacacggtgggcgacgactacttcgcgggcctgcccagccgttacgaccggggctactactggttccgcaccgccgtccggcccgcgctgctgctgggcgccagcgcggggcgcccggtggaggcgctgaacctgcgattcgtggaggggtacttcgagctcgtcgccaccgactaccggctggtgcagttcatccgcaatcccaccaccgtgaacgtcgaactcttcacgctggccctgggcgtgaagctccggttctga

SEQ ID NO: 4025 - DNA, 531 bp, Myxococcus xanthus
atgggcgacctgacggagttcggcagcacgcaagagtacgagtggggcgtcgaactgctgtctcggttgaaggtcccgttcttcgtggtcatgggcaaccatgacgcactgggcatggggcagaagctctaccggcgcaccttcggaccggagtccttctccttcacgtattcgggcacgcgcttcgtcttcttcgactccaactcccgcgagtacggcttcccgggcgacatcccgaacctgcagtggctgaagacggcgctcgcaccggagcccgcggtgctgaacaccttcaccttctcccacgtgcctcctgggaacggggactttgacgatgcgctcgtcgcgcccttggtgaagctccagcagaagcagggcgtcgccatctccttccacggccacgtccaccagtaccacgacgtccatgcgcacgatgtccggtacgtcaccaccgattcgatgaagggccggagctacctctgggtggacgtcgatggcagctcggtgcaggtgcagagggccaccttctga

SEQ ID NO: 4026 - DNA, 975 bp, Myxococcus xanthus
atgaaggagattccgggcatccgcattggaatcatcgcccacggggactactgcgacgcgggctccacgtatgtcaccaagatgctggacctgacggacgacgagggcgccgtcgtccgcttcgtggaccgcgtggagcacacgggcgggggggacgcgcccgaatgctacgagttcgtacttcgccaggcgcaaagcctgtcctggacggttggttacacgcgggcgctggtcttgattggcgacgacgttccccacgggcccgcgcagaatccacacaagctggactggcgcaaggaggtggccgcgctggggaagatgggcattcccgtgtatggcgtgcaagccctggcgcgccgccacgcgacggccttctacaaggagctggcggagaagtcgggcggcttccacctgagcctggaccagttcgcccacgtcaccgacctgctgctggccgtctgctacaagcagtcctcggatgtacagcttcaatcgtttgagcaggaagtggtgcgcgagggccggatgagccgcggcctcaacgtgatgttcagcaccatgctccagcgcacggcgccgccgctctacggcgaggcggacctgcgcgcggttccaccgggccgcttccaggtgctggacgtggaccggacccagcccatcaaggacttcgtgcaggagaacggcctgcgcttcaagacgggccggggcttctacgagttcaccaagacggagaccatccagggccggaaggaagtggtgctcatggaccggaagacgggtgacctcttcagcggagaccgcgcccgggagatgctcgggcttccgcccggggagacggtccgcattcggcccgccagcctggagaagtacgtcgtcttcgtgcagagcacgtcggccaaccggaagctgatgggggattcgaagttcctctacgaggtcgaggactgggaaggcgcctcgtccgccgctgcgtag

SEQ ID NO: 4027 - DNA, 255 bp, Myxococcus xanthus
atcgacgtcttcgagctgaacgaggccttcggggcgcaggcgctgtactgcgtgcgcgagctgggcatccccgccgacaaggtgaaccccaacggcggcgccatcgccctgggtcacccgctgggcgtctctggcgcgcgcatggtggccaccatcctgcgcgagctgaagcgccgcaacggccgctacggcgtcgtctccatgtgcatcggcggcggcatgggcttcgccgccctcatcgaggcgcccaagtag

SEQ ID NO: 4028 - DNA, 945 bp, Myxococcus xanthus
tcaccgttggggtcaccgctaatgccctccgcgccgcgcgtgggtacaccggcgccgcaacgtgccgtgcccaccgcgtcgcccactaacacaacgtccgcggcgcccaccctgccccccatgccgggctcgctccaggacacggaggaggatggcttggcgcaggtggatgcatcgggtcacctggtggtgtcggcggacctgcggcgcctgttcgactactacctttccgctatgggcgaggaagggctgcccgtcatccgcgagcgcatcctcgcctcgctgcgggccaagaatctgccagccgcggcgatggaggaaaccgtgcgcgtgctggatgactacctggcgtatcgcgacgcggcgcgcaccttcgcggcgaaccaacggggcgcggagctggacgtgggcgcgcggctccagtccctgcgcgagctgcgccgcgagcacctgggcccctgggcggagggactctttggtgacgaggaacgggtggacgcggtgtcagtggagcggatgaagctccagcaggacaccacgctgtctcccgaggcgcgcgagcgccgcatcgccgcgctggatgaacaactccccgcggaataccgcgccagccgcgacgaggcgctgcgccccctgcggcagcaggcggtggagcgcgagctggtggaatccggtgcgtcggccgaggacctgcgccagcaccggctggccaccgtgggcgcggaggccactgagcggctggaggccatggaccgcgaggaggccgagtggaagcggcggctggcggagttccgttcccgccgggaggcgctgggccagtccgagccgaaccccgccgcgcgtcaggccgccgtgcagcggctgctgttcgactccttcaccccggaggagcgcttgcgggaggaggccctgaacgccatcgacgcggcggccggagccccctga

SEQ ID NO: 4029 - DNA, 591 bp, Myxococcus xanthus
ctctacgacggcagccccgcgtggagcatcaccggccactaccgcatcaacggctccgcgccggccagcttcgatgtggcgggcgcgcccgtcaccggcaatggaccgacgctggacttgcaggagcagggcctgttggagctttggttcctcgtgtccagcccgggctgcgagcactacgactccaactacggcggcaacttccagttcaacgtcctggaggccagcgccacgcccatggcgacgctcgtgttccagcagggctgggtggagcacgtggtgggcacgccgcgccagggccagcccttcatcgtggactacgacatcgcgcgcctgcccgagtgccggctgctctacaacggcgcgcctacctgggacgtgggtgtgcgctggcgcttcaacaacggggtgatgggcgagaagagcgtcaccaccaccagcggctatacgcgcactggcacgcccgtcaccatcatcccgcccgtcggggccacctccgtgcagatctggttcgagaactgggaccgcggaacctgccgccgctgggactccgactacggggccaactacacgttcaccctgcagccgtag

SEQ ID NO: 4030 - DNA, 1656 bp, Myxococcus xanthus
ttcttccaggacccgccgaggctgggcaatcagtacgacgacgatgcgctgctccagagctacctggcacgcaccctccccgaggacctgcggcgcgcgctgacggatgagttccgcgagttgggagagctgggcggggattacttctaccgcttccagctccgcgaccggctgaacgagccggagctgacccagtgggatgcgtggggccagcgcgtcgaccacatcgaggtgtcgccgctgtggaaggaagccgagtccctggccgcgcggcgcggactggtggccacggcctacgagcagaagaacgccgagctcagccgcgtccaccagttcatcctcaactacctcgtgcaggcgtcgctggacgtgtactcgtgcccgctggcgatgacggacggcgcggcgcgctcgttgctcacgctgggcaatacggcgctcatcgaccgcgccctgccccacctgacgtcccgggacccggccacggcgtggacgtccggtcagtggatgacggagcgcaccggcggctcggacgtgggcctcacgcagacggtggcccggcagaccccggagggctggcggctgtctggaacgaagtggttcacctccgcgacgacggcgcagatggcgctcacgctggcgcgtccggaaggcaacggccccggcggcaagggcctggccctgttctacgtggagacacgggacgcggccggaagactcaatggcatccagatcaaccggctcaaagacaaactcggaacgcgcaaggtgcccacggcggagctgaccttggatggcgcgctggccattcccgtggcggggctgacggatggcatccggaacatggcgtggatgctgaatgtgacacgcacctggaacgcggtgggctccgcatgggccatgcgccgggcgctggccctggcccgggactacgcccagcggcgggtgcagttcggcgcgaagctggcggacaagccgctgcacatggacaccctggcggggctggaggcggagtttcaagcggggttcctgctggccttccgcgccgtggagctgctgggccgcatggaggcgaaggcggccaccgagcaggagctgctcctgcagcggctggtgacgcccctggcgaagctgaccaccggccggcaggtggtgcacgtcacctccgaagtcacggaggccttcggcggcgcgggctacgtggaagacacgggcattccgcggatccaggccgacgcccaggtgctgtccatctgggaaggcaccacgaacgtcctctccctggacaccctgcgcgccctggcgaaggaaggcgcgttggaggcgttcttccacgaggtggagggccgtctgggccagacccgggacgcgggcctgcggccctgtgtcgacgcggcccagggcgcgctggagcacgcgcgggcctgggtggccggtgccatggaggaccccgccaccctggaggctggcgcccggcgcttctcgctgacgctgggacggacgctggagctggccttgctctgcgcccatgcgcagtggtgcctggaccatggccacggcccccggagcaaggcggcggcacggcgattcgcctcgcacggcgtggacctcatccaaccggccgcgagcctggaggatgtccggctcctggcctga

SEQ ID NO: 4031 - DNA, 717 bp, Myxococcus xanthus
atgatggtggggctcagaccaccagagaactgctgcctcgagcagctctcgcgggactccgtcgttcaggtcacggcgcttctggggaaatggtacccggatatccgggtcggcacggagagccggcacctggagcccgctttctatgatcagtgtgtctgtatccagggcgagtctccggatcgcccggtgtatgcgattctgggaagggatcgggacacccaggaagtcatcgggctgctgacgctggagaagaacgctcgcggcctgcagttgtctgccgcgatgggggccgttgaaccctctcagcgaggcctgggcctgggccagttcggcatctccctgctggagcaggtgggccgcaacatcggcgccgaggtcgtcctctattactccaccctgaagatggccagggcgcagcgcaacgccgagcaccgcggcttcaagctggtgggactggtgcccgcgttcgatgtggacgccatcgcgcccaacacggtgaagcgcgtctacgaggccatctacgcgaaggtgctcgtcggtccggagaagatccacctccccgactggaatgccctcatccccaccacgcgcgcgctgtacacgcatctctttggccagcacccggccgccgccatcctggagaacaggaacggcgtctccattcctgcctcggcgccggtgcccatctccgcgcccgaggcccaccatggttga

SEQ ID NO: 4032 - DNA, 1278 bp, Myxococcus xanthus
atggcggcccaccccacggcgggtcacaccaacgcgctgcgcgccattggagggcgcttgcgtgaactcggccacgacctggccatcgcaacggtcgtagcgccggcacgctttcccggcctgatgccagagccgctgcgcttcgcctcccagctgccggaagccctgcgccaggacggactcaggctggtgccgctgcgccctgctccggccgcgctctggtacggcgcgcgcatcacccgggcccggggactcgacgagctggggtgggcgctccggctgttcaccaccggcatggaggggcatgcacggcgcatcgccgaggaaatcgaagcctctgggactgacgtcgtgctggcggactacctcatgcccgcggccctgctcgcggcccggaggacccggcgcccctatgtggcgctgtatcattccgccctccccttccccgtggagggcgcggcgccttttgggagtgggctcgaggacgacgccccccgcgatgccacatggacccaggccgaacagcgggggctcgcgctgctgcgctggttcgatgcgcgtgtcgcccgtgccgcgaagcgcctgcgcgtccccttgaagacgaacggactgctcgcggcgcccatctccgacgacctcaacctgatggcgacgaccccggcgctggagcccggcctcgagccgctgcccggcccggtggagatgaccggcccgtgcctgccccggcccgtgccctcgagcatggatgaccccgcgctcaccgccatccggcccggccgcacgcacgtctacgtgtcactgggcacggtgttcaacgaccagccgcacgtcttccacgccatcctggacgggctggcgcggcacgacgtggacgtggtggtcagcgcgggtgccagcttcgaacggctccaggcccgcgcgggcccgcgcacgcaggtgttccgccgcgttccccaggtgcccctgcttcagaaggtggacctggtggtgacgcacggtgggaacaacaccgtgcaggaatcgctcgcggccgggcggcccatggtcgtcgtgcccttcggcggcgaccagctcgcgaacgcgcggcgcgtggagcggctgggcgtgggccgcgccgtgccgccctccgcgctgagcgccgacgccatcgcccacgcgttcacccaggtgtcccagccagaagtggccaccaaggcccgcgccctggccgcgacgctggagggtgtggacggcaccgaacgcgcggcccaggccgtgctgcggctcctcacgacatga

SEQ ID NO: 4033 - DNA, 1050 bp, Myxococcus xanthus
atggttgaggtccgcgccttcgaaggcggcgccaaggaagcgtcccagttcatcaacagcgtctggcagcgcacctacggcgcgaagatgggactgacaatctgggacgagcgtttcttcgactggctgctcttcagcaatcccctggcggaccgggactatctgctgggagcgtattcaaagggcaagctggtgggggcattcctggcggagcctgcgaaaatccagcttggccagcggcaggtggatggcacctacgggagctgggtcagcgtggcgccggagagccggggccagggaattggcatcaagctgtcggacaccatgcaggcacgccaccgcgagcgtggcgccgcgctcaccttgagctgcgtggccgacggcaccctgggccagggcttctggagccggcggagccacacgcgctacctcaacaacctgggcatgtggctgcacatcttcaacacggagaaggcggtccgttggtcgctgagcgccgccgagcgcgcgttcctcaccttcacgcgtccgctccaccgccgggacttcctggcggcgcgcaccgacaacattcgggcctaccaaccccgggacctgccgcagtgcatggccctggtccagaagatgatgcggccggtgaacctgggctacgcctacacctcggagcgcctggcccaccagctccagttccgtgacatcccgcacaccttcgtcctggagcgagatggcgtcatccaaggcatggtcaactactacaccctccagatgacggcccgaggcctcctgacgacgggactggtggacctgctcgccttccaggacgggctgcccttctcggagcaacggcggctgctgtgggtggccatgcaggacatggtggcccagggggccgactgcgccgcgatgctgcgcagcccgtgtacgcccacgcacctgatgctgcgctccgggtggttgccattccccggaggctcccgggtgacgtgcctgctcaccacccccgacgtggagctgcccgcctcgccccgggtgttcatgcacctgcgctga

SEQ ID NO: 4034 - DNA, 216 bp, Myxococcus xanthus
atgcttggccaggaggcggtggtggtggagtccctgggcgatccgctcgggggcacggtgcgcatcaatggcgagctgtggacggcgcgctccctgtcgggcccggtgcccgagggcgaactcgtcacggtggagcaggtggaaggtctcaaactctgggtgcgccgaccgacggcgtcgttgccggttccctcgggggacccgaggaaggagtag

SEQ ID NO: 4035 - DNA, 1107 bp, Myxococcus xanthus
atggaaatcgtgacgattttcggcatcttcgcggtcatcctggtgggcatcgccgccaccggcatccgcatcgttccgcaggccaaggtcatggtcgtggagcggctgggcaagttctacaagaccgccagcagcggcctcaattacctcatccccttcgtggatgccccccgcgccatcgagatgcgcacgggcaaccgcttcatgcgcagcaacctcgtggacctgcgcgaacaggtcatgggcttcgacaccgtccaggtcatcacccacgacaacgtcaacatggaggtcggctcggtcatctactaccagatcgtcgagcccgcgaaggcgctctaccaggtggagaacctcgcgctcgccatcgagcagctcacgatgacgaacctgcgcaacatcatgggcgggctgacgctggaccagacgctcaccagccgcgagacggtcaacaccaagctgcgcatcgtgctggacgaggccaccgagaagtggggcgtcaaggtgacgcgcgtggagctgcgcgaaatcgagccgccccaggccatcaaggccgccatggccaagcagatgaccgccgagcgtgagcgccgcgccgaggtcaccaaggccgagggcgacaaggccgccgccatcctccaggccgagggcgagaagatctcccgcatcctccgcgccgaggccgaacgcgacgcggagattgcccgcgccgaaggccacaagcgcgccaccatgctgcaggcggaaggcaaggccgaggccacccggctcgtcttcgaggccatccacaacggccgcgccactcccgaggtgctcgcgctgcgctacatggagaccctccaggagctgggcaagggcgacaacaagattttcgtcccctacgaggccaccgccacgttgggcgccgtcgccaccctcaaggaggtcttcgcccagactggggatgccgcaaagcccgccccggcgccggcccgctccgccgcgagcctgagcggccaggccattgcccggaacacggtggtccccgagcacgccaccctccccggcggcacgcccgccgtggcccctcggcgtccgcggcccgccctggacacgcaggacgactga

SEQ ID NO: 4036 - DNA, 1503 bp, Myxococcus xanthus
atgtcttccgtgcgcgcgcaccgcgtttcgttcgccttttccgacgccgttcctgtcctctctgaagtcgacttccacctgtcccctggctggacggggctcgtgggtgccaatggcgccggcaagtccaccctgctccggctgttggcgggagagctgacgcccaccgagggacaccttcagttcgagccctccacccccaccctccgcctctgccggcaggaggtggaggcgctgacgcccgacatctccgccttcgcggagtcgtgggactccgtcgcgcggcgactgcacggccaactgggcctggacgtcaccgcgctggagcgctggcccacgctgtccccgggcgagcgcaagcggtggcaggtgggcgccgccctggccgcggagccccatttgctgctcttggatgagcccaccaaccacctggatgcggaggcccgcacatggctcatctccgcgctgcgccgcttccggggcctgggcatcgtggtgtcacacgaccgcgacctgctggagtccctcaccacctccacgctgcgcgtccaccacggcagcgcgcggctgtggcccggcgcatacaccgccgcgcgggcgcactgggaagccgagcgtgaggctgaaatcgccacccaccagcaagcccgcgccgaacaacgccgtgcggcgcatctgctggaccaggcccggcgcgaacaacagtccgcggatgccgcgcggcacacccgcaagcgactgaagaacaaacacgacaacgacgcccgctccatgggcgccaaggtcgttgccggctgggcggaggctggggccggacggcgcgtgggcatcgcacggcgcgagttggagcgcgtcagtgaggccgtgggcgagttcaccgcggacaagacggtgggccgctccgtcttcctggactacgtgcgcgcgccgaacccgtggctcttcacgctggacgtgcccggcctccgcgccggtgacgtggagctgctgggccccgtgaatctctccgtgagccgtgaggcccgcgtgcgcgtcgaagggcccaacggcgccggcaagagcaccctggtgcgcgcactgctggagaacgcgcgcattccgctggagcgcgtgctctacctgccccaggacgtcagcgcggacgaggcccgggccacgctggacgcggtgcgcgcactgccgcccgaggaacgcggacgcgtgctgtcactcgtcgcggcgctcggcgtggacccggagcggctgctcgcctccgagcagccctcccccggcgaggtgcgcaagctcctcatcgcccggggactggggcaacacgcctgggccctggtgctggacgagcccaccaaccacctggacctgccgtccatcgaacggctggaggcggcgctgcgggagtaccccggcgcgctgatgctcgtcacgcatgacacgtccttcgcccaggcctgcacctccgaggtgtggcgcgtggagcatggccaggtgacggtgacgtccgggtag

SEQ ID NO: 4037 - DNA, 531 bp, Myxococcus xanthus
atggtgtccgtgaatcagctccgccccttcgccggtgcctcgctggacgcgttccgggccgcgtccggccctgtggccctcatccagcagcccgtggaactcgtcggccagcacagccggggcctggcggcacgcaccgttggcatggcacaccgcgcgtacatggacgagcggctgctcgccatgctccgcgacttcgacaacctggaggtccacttcctccagccctccgtggacggcgaggagctgacggtcggccgcaccgaggcgtgcgacctggtggtgcccgacccgtccgtctcccagcatcacgccacgatgcgctggagcgccgcccgcggcggcttctccgtgcgtgacgccgagtccatgaacggcaccttcatcaacggtgcccccctgggctaccgcgcccaggtgctgctccacgacggggacaccctggccttcggcgacgcccagttcctctaccttcgcgccgaaaccgtctacgaacacctgcgcctggccagcccgaagaaggcccgctga

SEQ ID NO: 4038 - DNA, 2484 bp, Myxococcus xanthus
atgtccgatgagaagaagaagggctccgctgcgagcgctatgcccaccgcgatggcccctccggggctcatcaacaaggaagacatcccgcaggtgcttcccatcctccccctgcgcaacagtgtcttcttcccgggcggggtgcttccgctggccgtcggccgccagaagaccatcgccctgatcaaggacgccgtgcgtgacgaccaggtcatcggtgtcgtcacccagcgccgcgccgaagaagaagatccgggtgccgccgacctctacaccatggggacggtcgcccgcatcgtgaagctcctgaagatgggcgaggacaactactcgctcgtggtgcaggggctcgcccgcttccgcgtggtggagctggtccaggaagcgccctacctcaaggcccgcgtggacgccgtggaggacaagacctcttcggagaacgtggaagtcgaggcgctgggcatcaacctcaagaagctggcgcgcgaggtcatcgagctgatgcccgagctgcccgccgccgccaccgagctggtggagagcatcacccaccccggccacctggcggacctgatcgccgccaacgtggacgtgcccatcgaggagaagcaggccgtcctggagacggtggacctcaaggcccggatgaagctcgtgctggagctgctcaaccggaagcgggagatcctcaagctctccaacaagatcgactccgccgtgaagggcgagatgtcgaagacccagcgcgagtactacctgcgccagcagctcaaggccatcaaggaagagctgggggagatgggcgaggaggaagaggagctcgacgagctgcaggagcgcctgaagaaggccggcctgccgcccgacgtggagaaggtcgccaacaaggagctcaaccgcctgaagaccattccggcggcctccagcgagtacaccgtcgcgcgcacctacctggattggatcgccgacctgccgtgggcgaagatctccgaggacaacctcgacatcgagaacgcgcgccagcagctggacaaggatcacttcggcatcaagaaggtgaagaagcgcatcctggagtacctggccgtccgcaagctgaagaacgacatgcgtggccccatcctgtgcctcgtcggtccgccgggcgtcggcaagacgtcgctgggccagagcgtggccaaggccacgggccgcaagttcgtgcgcctgtcgctgggcggcgtgcgtgacgaggcggagatccgcggccaccgccggacctatgtcggcgccctccccggccgcttcatccagagcatgaagaaggccggcacgaagaacccggtcatgatgctggacgaaattgacaagctcggcgccgacttccgtggcgacccgagcgcggcgctcctcgaggtgctggatccggagcagaacaacacgttcagcgaccactacctcgacgtgcccttcgatttgtccaaggtgatgttcgtcgccacggcgaaccagctcgaccccatccccggtccgctgcgtgaccgcatggagatcatcgagctgacgggctacaccttcgaggagaagcagagcatcgcccgcatccacctggtgcccaagcagctcaaggagcacgggctgagcccggaccacatcgacatcaccgacgaggcgctgctcacgctgaccaccgcgtacacgcgcgaggccggtgtgcgcaacctggagcgccgcatcgcggacatctgccgcgcggtggcggtggaggtggccggcgggaagacggagaagcagaccatcaacgccgaccgggtgaaggagatcctcgggcccgagatgttctactccgaggtcgccgagcgcaccgaggttccgggtgtggccacgggcctggcctggacggcggcgggtggcgacctgctcttcatcgaggcgacgaagatggcgggcaagggcggcatgacgctcaccggccagttgggcgacgtgatgaaggagagcgccacggcggcgctgagctacctgcgcagcaaggccgagcagctcggcatcagcccgaacttcctggagaagacggacctgcacctgcacttcccggcgggctccattccgaaggacgggccttccgcgggcgtcaccatcctgacggcgctcaccagcctcctgacgggcatccgcgtgcgtcacgacacggcgatgacgggcgaggccacgctgcgtggcctggtgctgccggtgggtggcatcaaggagaaggtgctggcggcgcaccgagcgggcatcaagcgggtcatcctgcccgagcggtgccgcaaggacctgatcgacgtgccggaccaggcgcgcaacgagctggagttcatcttcgtcacccacatggacgacgtcctgaaggcggcgctggagacgcctcccgtcggcgtggcgggaaccccgggcggtgagccgggcaaggaggctccgctgccgaagccggccgagtccgcccctgaggtccgcgcctag

SEQ ID NO: 4039 - DNA, 765 bp, Myxococcus xanthus
atgaccgccgacctcgaatggaacgatggggtgcgtccctatgtgccgctttccaccctcaagccggtcgcggacggcgtctggtgggtggacgggccggtggcgaggatgcgcgtgggccccgtctccctgccgttcccgacgcgcatggtcatcgttcgcctgggtacgggaggcttgtggctctggtcgcccacggcacccacgcccgagttgttcgaacaggtcgacgcactcggcacggtggaacatctcgtctctccgaaccggttccactacgcgggcatcccggcctggaaggcacgctatccgcgcgcgacggcctgggcgtctccgggcgttcgcgagcgggcgcgctcccagcagatggacgtcccattcgatgccgacctcgacgacgccgcgccctcggcctggtccacggagttgggccagctcatctttcggggcagtcgcttcgtggaagaggtggtgttcttccacggtgagtcctcgaccttgattctcgcggatctggtcatggcgttggagcccgagcgtctccggcctcgcctgagatggctgctgacgctcggcgggacgatgtggccggggcagacgccacgcgaggtgcgggtgacgacctggggccggaccgcgcaggcgcgcgcctgctaccagcagatgatggcatggcagcctcgtcgggtgctcctcgcgcacggccgctgctacctcgatgagggtgtggccccgctcgagcgcgccttctcctggctgcgctga

SEQ ID NO: 4040 - DNA, 3036 bp, Myxococcus xanthus
tacgccgagctggtctgccgctccaacttctcgttccttcgcggggcctcgcatccggaagagctggtggccacggccgcgaggctcgggctgggtgcgctcgcgctgacggacgcggatggcctgtacggcgtggtgaaggcgcacctggccgcgaaggagcacggggtgcggctcatcctgggcgccgagctgacgctggaggacggcccaccggtggtggtgtacgcggcggatgggacggggtactcgaacctgtgcgccctggtgtcccagagccggatgacccaccccaagggcgaggccgggctgccgtggcgcgcggtggcggaccggtccgcggggctgctcgcgctccttcccgcgcccgcgcccttcgagcaggtcgtctcgctggcggaggccttcccggagcgcttccacgtcggcatctgccggaccctgtccgcgggagacgcggagcgcgaggcccgggcggagcggctggcgctggagctcggcgtgccgttggtcgcgcacaacgacgtgcacacgcaccaccgccggcggcaggccctgcaggacgtgctggtgtccattcgccacgggacgtcggtggaccgggcggggacgcggctgttgcccaacgcggagcggacgctgaagtccccacgggacatggcgcgcctgttcgcggaccggccggaggccctggcgcgcgcggcggagctggcctcgcgctgccacgcctcattggatgacttgcactaccgcttcccggaagagggcttgcccgaagggcgcaccgcggacgcgcacctgcgcgtgctgacatacgaaggactgcggttccgctatccggaaggggtgcctccggcggtggtgaagcagattgagcacgagctgaagctcatcgccgcgttggacttcgccggctacttcctggcgctgtgggacatcgtccgcttcgccagggcccgggggattctctgccaggggcgggggagcgcggcgaactcggcggtctgctacgcgctgcagatcaccgccatcgacccggtgcggatgggcctgttgttcgagcgcttcctgagcatggagcgcaaggaaccgccagacatcgacgtggacttcgagcacgagcgccgcgaggaggtcctccagtacgtctacgagaagcacgggcgtcggcacgcgggcatggtgtgcgaggtcatctgctaccggggccggctggcgctgcgtgagacgggcaaggcgctgggcctgtcgttggaccaggtggaccggctgtcgaaggtgtccgcgtcgaacggcttcgacgtgacgccggacgtgctgcgcgaggcgggcctgtccgcggaggacggccgggtccagaagacgctggcgctggccatggagctggagggctttccccggcacctgtccatccacgtgggcggcttcgtgatgacacgcgagccgctgacggagctggtgccggtggagaacgcggcgatgccgggccgcaccgtcatccagtgggagaaggacgacatcaacgcggtggggctgctgaaggtggatctgctggcgctgggcatgctgacggcgctgtcgaagtgcttcgcgctgattcgcgagcaccacgggcgggagctgtccctggcgacggtgccggccgaggacccgaaggtctacgacatgctgtgcgaggcggacacggtgggcgtgttccagattgagagccgggcacagatgaacatgctgcccaggcttcggccgaggacgttctacgacctggtggtggagatcgcgctcatccgcccggggcccatcgtcggcaacatggtgcatcccttcctgcgccggcggaacggccaggagcaggtggagtacccgagcgaggcggtgaaggagattctcggcaagacgctgggggtgccgctcttccaggaacaggcgatgaagctggccatggtggcggcgggcttcaccgcgggcgaggcggacggactgcggcgggtgctgagccacaagcgcgccgaatccatgctgctgcaataccgggggcgcttcgtggagggctgcgtgtcgcgggggtacacacgcaaacaagccgaggagtggttcgacaacttccggggcttcgcgcactacggcttcccggagagtcattcagcgagcttcgcgttgattgcgtatgcgtccagctggctgaagtgccactacccggcggccttcacggcggcgctgttgaactcgcagcccatgggcttctatgcgccgcacacgttggtggcggacgcgcatgggcatggcgtggtggtgcggccggtggacgtgcggcactcgagctgggactgcacgctggaggagggcggggctgcattgcggctggggcttcggatggtgaagggcctgggcgagtccgcggggcggcgcgtggcgacggcgaagcgcgagggcttccgtgacgtgggcgacctggcgcggtggtcgcgggcgcccaggcacgagctgacgcggttggccttggcgggcgccctgtcgtcgctgtgtggctcccggcgtcaggcgttgtgggaactccaggcgctggggccgctggactcggatgacctgttcttcggcatggccatggacggaacggcggtggagctgccgtccatggatgtgctggagcgggtctgcgcggactacgacacggtgggactctcgctggagaagcacccactggagctgctgcgcccggtgctgaagcagcaaggcgcggtgacggcggagggactgaagaaggtggcccacgggcggagggtggcggtgggaggcatgctcatctgccgccagcgtccacccacggccaaggggctctgcttcatctccctggaggacgaaacgggcatcgcgaacctggtggtgcctccggacgtgtacgagcggtgccgcaaggacatccatggcgcgctcttcctggtgggagaaggcgtcctggagcgctccggcaaggtgacgaacgtgaagtccagtcgagtggcgtcattgcatggtcagcggggtacgctgcctgggtga

SEQ ID NO: 4041 - DNA, 975 bp, Myxococcus xanthus
atgcgggtactcgtcacgggagctgcgggcttcattgcccaccacgtcagtgcgcggctgttggcgcgcggcgatgccgtcatcggcgtggacaacctggacccgtccggggacgtggcgttgaagcaggcccggctgacgcggctcggcacgctgccgggggcgacgggcttcaccttccgtcccgtggacgttaccgacagcccctcgctgcgagcgctcttcgaggagatgcgccccgaggccgtggtgcacctggccgcgcgtgtgggcgtgcgggcgccggcgggcaccgcgcaggcatacgtggacgccaacgtgtcggggttcctccaggtgctggagcaggccagcgcggcccgggtgcggcacctggtctacgcgtcctccagctccgtgtacggcgcgggctcggtgccgccgttccaggaaggcgccgcggcggaccacccgctcagcgtctacgcggccacgaagcgcgccgatgaactgctggcgcacgcgtacagccatctgcacgggctccccaccagtggcctgcgcttcttcacggtgtacggcccctggggacgaccagacatggcccccctgcgctttctccaggccatccgtgacggcaccgagctgtcactgcacggcgaaggccggatgcagcgcgacttcacctacgtggaggacgtggcggaggccgtggtgcgcgtgctggaccggccgctcccaggggcacctcgccatcgcgtcctcaacgtgggccggggcgagcctgtttcggtgcgggccttcctctctgtcctggagcggatcctgggcgcccgggcgcgggtgaagtccacgcccgcgcagcctggggagatggacgcgacctgggcggacccttccgcgctggagcgagagacgggattccggccgcgcgtctccgtggaggaggggctgacacgactggtggcgtggttccacgaacagtcgggcacctga

SEQ ID NO: 4042 - DNA, 246 bp, Myxococcus xanthus
atgatccaggacaacgaggccgaggccggagtggtggtggtgctgaactgggtggacgtgacgtccgcccagctgatgggccgcgcggaggtgctgctggagacgggggtggtgggacccaacggcaagctgcgatggagcaaccccacgcgcaccgtctccacgattggcatgtaccaggcgcagacggacttccgctcctacctgcgcaaggcggtggtggaggccatccaggccattccgtga

SEQ ID NO: 4043 - DNA, 582 bp, Myxococcus xanthus
gagcttcaggacgtctccaaatgctacggggccacgcaggccttgcatccgctcagcttgagcctgccgacaggacgcaccacggtgctgctggggccgagcggctgtggcaagtcaacactgctgcgcctgctcaatgggttgctgccgtgtgacaccgggcgcgtcctcttcgatggcaagccgctgcccacgggaggcgatgcgttgctcgcggtgcgccatcgcgtggggtacgcgctccagggtggcggcctctttccgcatctcacgggcgaggagaacgtcaccctcatggcgagccacctgcgctggcccgcggcgaagacgcgcgagcggctggaggcattggtggagttgacgcgctttcccacggacgcgctggcgcgttatccctcgcagctctccggtggtcagcgtcagcgggtggcgctgatgcgcgcgttgatgttggacccggacgtgttgctgctggacgagcccctgggcgcgttggatccgctggtccgtcacgagctgcaaggtgacctgcgcggcatcttcgccaggctgcgcaagacggtggtgctggtgacgcaggac

SEQ ID NO: 4044 - DNA, 1512 bp, Myxococcus xanthus
atgcgcagggcctatctgcacctcacccgcttcccggttcagcgccgggtggtggagtccccggaacttgcgggccgtccctttgcgctggtggaggcggtgcgtggccagcgccgcgtggccttcgcctccacctcggcgctgaaggcaggggtgcgcccggggatgacgctgacggcggccaccgcgctggagccggggctgcggcacttcgactaccgcccggaggacgagctgcgcgcgctgacggcgctgggcgaggcgctgctgccactggccccgggcttccagctctgcgccccggatggattgtggctggacgcgggggccgcgcacctgtgcgacggcgaggaaggcctgggcacgcggatgctgtcgctgtgcgccgagctgggttaccgggcgcacgtggtggtggcctcggaggccttcacctcgcgcgcggtggctcggcatggcgcgcgccgggtggaggtggtggctccgggggacagtgctcgggccctggcgccgttgccgctgtccgcgttggaaggccgcgagggggcggcgttctccgcgctgggcctcaccacgctgggcgaggtggcggcgctgcccgtgggggccgtggcggcccggggcggcgcggctggcgcacgggttcatgcgcggtgccgcggagaggacgacacgcccttcgtccccgcggcgctggaagaggtgttggaggagcgcgtggtgctggacttcccggccgagtccttcgagccgctgcgcttcgcgctcaaaacgttgacggaccggctgggggcacggttgtccgggcggtgccgggcggcggtgcggctcaccttcacgctgaagctggacccctcggggcaacggcaggtgacgctgacgctggcgcggcccacggcgcgggcgaagctgctgcacgaactggcgcggcaccggctggaggagctgcggctggagaacccggtggcggaggtgtccgcccgggtggacgagcactccgaggacggaggacagcagctcgcgctgggggacgcgccggagggcgacgcggcgctggaagtcgtgttgtcgcggctggcgtccacgttgggggaggcgtcgctcttcgcggcgggcctggaggcggtccaccggcccgaggcggcccatggaatacgggccttccggcctccggaggcgcgccggggcctgtcggcggagttgctggagccaggcgcccggcgcgcctcggtgtcggcggcttcacgggagcggccctcccggttgctggcggagccggcgtgtctggaggcggaagtggcggagtccggacgcttgctggccgcgcgcatggagggccggcggcaccgggtgacggcgctcaccgggccggagcggctgggcggggagtggtggtcggagacgccctttcaacgggactactaccgggtccacttcgaggggctgggccccgcctgggtgttccgcgacggacgggatggacgtttctacctccagggactgttcgactga

SEQ ID NO: 4045 - DNA, 873 bp, Myxococcus xanthus
atgagcgcggcggagcagcgagtgggagcggggcaggggacgggctcggtcgtggagcagcttcgggagcggatccgccagttgcaggcagcgccccggcgctacctggcggtgctccgcacgggcctgtcggcggtggacgccctgctgccgacggggggcctgccactggggcaggtggtggagctgtgtggcgaggcggcctcagggcgcaccagcctggcgctgcacgcggtggccgcggcgcaccaggaggcgcggctgtgcgcctgggtggacggcccccgggagctctactcgccctcggccgcggccctgggcgtggacctggagcggctgctcatcgttcggccccaggcttctgagcaacgcatctgggcggcggtgcagctggcccggagcggggccttcgcctgcgtggtgctggacctgacgcgcggcatgaatcccggcgggcgagcgtgccgggtggccctggcggaggcgcgcaagctggcggacgcggcggcgcgcggcggtgggctgctcctgctgctgacttctccagagtccccggcggacggcgtggtccggctgcggacggaggcccgggacggggacggctggtcggtggaggtggtgcgcagccggcagggcggcacgggcgcgcgggcggagctgccgtggagcgcgctgtacccggcgctggggctggagggaggcggccggttgctggacgtggccgaggacacggaggacggcacgccggacttcctgcgagatcagtccggggcgctgcgcaacgggctgggcatcctgggccagcgtcccggccgtgacgcgcccatgccgcccatgcggcagggactggacgcggccctgccggcgcactga

SEQ ID NO: 4046 - DNA, 318 bp, Myxococcus xanthus
atggcggaggcgttcgaccaggggctcgacaacctcgattccatctgccgggacaactaccgcgacaccctgctgcgcatcgcggagctggccacggtggcgcagagcatcgaggtggtgaacctgcccgacccccggctggtccaggtggagctgacgcgcgccaatgacgaggtggagcggtgctcggtggccgcgggcgacctgcgctacgaggcctccacggaagcgtacccggcccgcctgttcttccagtcgagctgcctgcgccgcgcggacgacaagaaggtggaagtgaaggtcctctgcgccggctga

SEQ ID NO: 4047 - DNA, 768 bp, Myxococcus xanthus
atgcgcgcaccgctgccggtggacgaagtcgtgcggcaggccgcgctccttctggactcgggtgtccttcggctggcgcaggctcccccgcgcgaagccgccgtttcgccgtcattctccgttccccagcctgggggtgtgcctgttccggtggaggagccggtctggctacggcttcaggtggtggacgacaccaccgatgtgcccattgccggcatccagttgcgcatccaactcgacgaccggtccgagcatcaggcccggacggattcagagggccgcatcgacctgaaaggcgttccgaaggggggcgcccacgtcctgtccgacctcgaaggggccaccctggacaacacgttggcgctggtgcggacgggaggcccctggtcccagcaaaagcccgcgaagagaggtcagcgggcgaggggggccagcgggccgcgtttcctcgcacgtgtcacccagcaccgggtcatcgacggagagacgctggagagcgtggcggagatgtatggcctcacggtggaggagctcacccgcttcaactggaacaccacggatgcggcggacatcgagcggcacctcatcctcgatgtgggctgcacgcgtaagggctcgcgcgggcagtacgtcttcacccgagaggatgaccccggcatcctctacgttccccgtccagaggccatcccccggctgcctgtggagcacagtcacatcctgcgggtgaagcgcgtcccggagccgcgacacttcctgttctcgctctga

SEQ ID NO: 4048 - DNA, 2580 bp, Myxococcus xanthus
gggagccgtgcccatgaagggggaagggtgatggcggacacagccgttgcttcacagtcacatgctggcggcgagcgcttcgagcttcggcgtgaaccgggagccgagggcgtcttctatctcgtcgcggtggcccccacggagctcaagctctccctgaagagccaccgggccgctcaggacaggattgccttcatcctggagggaacgcacaagaacctgccggctgacacggtctgcagcgttctgatcaagacgcacgcgcgtgggatgccagcgcgggagtacacgctggtcaacgtcccactgcgtgtcaatggcaggtcatgcaccttggagttcgaggcggacatctacgaggcgagcttcttcggccggggccacgcggagatgaccgtcattcctgacttccccttcgcgcaggaatgctgcctcgaaaagccctttgagttcgacatccccttggggctcagggggctcgacctgagcgtccctgtcctgtttggccggcggttccgcttgaagccggacatggatgcacgtttcaccggcgcgacgcttcggctctccatctaccactccgtggagccgaagcgtggcgtggcgccgaggatggctccagaggcgcagcgctatgccgcgctggaatggggcgcttccgacttgggcgcgaaggactggagagttggctgcgcctggagtggggacggtctccgactgccatggcgtgagcccattcagggcgagtacgccttcgacctgcggctcgaagtgctccgagacatcgagggggagacgcggccctacgtggtgtgggatcagccaagggcatgcgtgtgcccgaagccgaacctgaccgggttggaattcaagcaccacgcggtcaccgcgacggtggagcatctggatccggatttcgagctccccttggagctgacccattggcggtacgaggctcagacgcgaggagaggccctgtccttcaccctgatggaccccgtctcgcggccggtgttggtgaacgccaacgagaggggcctgttcctacggcaattcctcgacgctgaggactggctgcgccggaagagcttcgccttgttgcggattccgcgctcgttgacggggtccgatgaatacgtgcccatccgctcggtgctggacttcgatgagacacaattcctcgcgttcgaggacgaggacctgtggctggaggccccagcgtcggccagggctccctcgcgacagaagcaggaccgggtgcgccaggagttggtgacggcactggcctccaaggaattggcggtccggccttcgcgcatgcctcgcttcggggacgtctggctgggggctcgcgacaaccacctgctcatcaccgtgaaggtcatcggggatctcgactactggcgtgaggcctcgcctgtcttttcgctctgcgacgaccagcgtcccgtggagccaacggtctctcgggaggccgaggtgcttcggttggatgcgcggccccttgatgggaatcctcgttactacgaggcgctcgttcgattcgacgatcctcgaatccgccagaaggtcttcatccaggggcgagtctcaaaaccggatgcacggctctgggacgaattggtggcagcgccaccggccttcttcgtggagtacccaggcgttccccaactccagggacttcgcgccgagttcgtccagctcacggatgatacgtccatcctggaagtccgctgtcaggccctccacgttcccaatggaaaggagggggatgtcatcgagttccgcctgtatgagttcttcgctgacgtcgcggagcccgttgtcttcggtgccgtgcccttccggtatgaggtcgcgaagggggcggcggggcaatgcgacgctcgtggacgggtggtggcgcgtctccgggagccggcgctcgtcgagcggatgcggcgcaagggccagtttcggattgaagcgcgcctggtggagcgggcgaatgccaaccactcgagcgcgcttcctgccatccacctggacctggagggaacaccgcgccgcatcgaaggaacgctcatctacggcagccacccgaatgtgacggaggcattccggaggaaggtgctgatcatcgccgagcaactggagatgaatgccgatgatttgatggcgtgcatggcctttgagacaggcaatgccttccgggcagatacaccgaaccgggctgggcatcaggctttcggtctcattcagttcacggccatcaacgaaggaaaagatgcgctcgacatcaagctgtccgcactggtgcggatgagcgctgtcgaacagctcgactacgtcgccaagtacttccgcatgtggaaggcgcggtcgaagctgcctctagacaatctgggtgatgtctacgcgtgcatcctctgtccagaagcgctcggcaaggacgcgtccttcgtctgttacgccaaggggtcgaggggctacgaacccaacaaggggttggaccgcggtggcaagggcttcatcaccaaggcagacatcttggttccggtggagcggcaccttcgtgaaggccagaagttccgcaaatag

SEQ ID NO: 4049 - DNA, 702 bp, Myxococcus xanthus
atgattttccggcagcttttcgattccgagtcctcgacgtacacgtacctcatcggcgacgaggccacgcgccaggccgtcctcatcgaccccgtgctggagcaggtcgaccgcgacctgcaaatggtggccgagctggacctcaccctcacccacgtcttcgacacccacgtccacgccgaccacatcaccgcatcgggcgcgctgcgggagcgcacgcaggccacggtggtggggagcgtgaacggcgccagttgcgccaacgtccaggtccgccacggggacgaggtgcgcgtcgggcagctcgtcttccaggtgctcgccaccccggggcacacggacgacagcatcagctacctgctcggcgaccgcgtcttcaccggggatgcgctgctcgtgcgcggcaacggccgcaccgacttccagaacgggaacgcgagccagctctacgacagcctcacgcgcgtcctcttcaccctccccgatgagacgctcgtctaccccggccacgactacaagggccgcacggtgacgagcatcgccgaggagaagcggcacaaccctcgcgtggccggcaagagccgggaggagttcatccacatcatggagaacctcaacctgcccaggcccaagctgattgacgccgccgtcccggccaaccgcgcctgtgggcacacggcgccctcaccccagggggcctga

SEQ ID NO: 4050 - DNA, 327 bp, Myxococcus xanthus
atgacactccgcccctatcaggacatcacgccctcgcagctcgacacgctcggccccgaggtgcggcgcatcgatgtgcgcgagccggacgagtacaccggccccctgggccacctgcccggagccgagctcatccccctggccacacttgaggccgccgccagcgcgtggccgcgcgaggcgccgctgctgctcatctgccgctcgggcgggcgctccgcgcaggcggcgcggttgctcgcccacggcggcttcaaacacctcttcaacctggcgggcgggatgctcgccgtgcgcgagccgctcgcgccgcggccccaaggttga

SEQ ID NO: 4051 - DNA, 762 bp, Myxococcus xanthus
atgggcctgtcgctcggcctgctcggcggcggtggctccatcatcaccgtccccatcctcgtgtacgtcatgggcttcggggccaaggagtccatcgccatgggactggccgtggtgggcatcaccagcctcttcggcgcggcgagccactggcgcaggggcaacgtccagtggaaggcggccctcgtcttcggggcggtggccatggcgggcacctacgccggggcgcgcctgtccgcgctcatctccgggacgacgcaactgctgctcttcgccacggtgatgctcgtctccgccgtcttcatgttccgcaatggccggaaggactccgtgcaggcgcccgagcccaagaaggcgtccttccccctcatggccctggccgccctcggggtggggggcctcaccggtctggtcggcgtgggcggcggcttcctcatcgtcccggcgctggtgctgctggtgggcctgcccatgaagcaggcggtgggcaccagcctgctcgtcatcgccctcaactccctcgtgggcttcgccggctacctcggccacgtcgaggtgccctgggtctcccttggcatcttcacggccatcgccgtggtgggcatcctgctgggcacctgggcgtcccacttcgtctcccaggcgacgctcaaggcagccttctccggcttcctcgtcgtgatgggcgtcttcatcttcttcaagaaccgggaagcgttggggctggggggcggcgccgccacgacgcagaatgcccactga

SEQ ID NO: 4052 - DNA, 663 bp, Myxococcus xanthus
atgcccactgacgtcacgcagaactccaggaggagcaccatggccgagcagccccccgacgcagccgctcaatgggacgcacgcttcagtcacccggcgtatgtctatggcacccagcccaacgacttcctcgtggagatggcctcgcgcctccctcccggcgggcgcgtgctgagcctcggtgagggtgagggccgcaacgccgtctacctcgcctccctgggccacgccgtcaccgccgtggacgcgtcgagcgtgggactccagaaggccaagcagttggcagacgagcgcggcgtcaacatcgagacgcgcgtcagcgacctggcgcacttcaccttcgcgccggaggcgtgggacgcggccatcgtcatcttctgtcacctgccccccgcactgcggcggcgggtgcatggcgcgctggtgaagagcctccgccccggtggcctggtcctcctcgaagcgtacacgcccgctcagctgggcttccgcacgggcggcccgcctgtagaggagctcctctacacggcggaagccctgcgcgaggacttcgcggggctggagttgcccgtgctccgtgagctgacgcgcgaggtccgcgaggggaccctgcacaccggaagggccgccgtggtgcagctcgtcggtcgcaaggcgacgtga

SEQ ID NO: 4053 - DNA, 1530 bp, Myxococcus xanthus
atgcgtgccccggcccctacgcccaagcgcaccgtctacaccgaggcgatggagatcttccatcgtgcagcggacctcatcgcgctggacaagcgcgtccgcctcgagctggaggagccggactacgagcacatcttctacgtcacggcgaagctgaaggaccgcctcgtcccgctctccgaggagaaggcgcgcaccttctccaaccttcccgagacgcaggtgcgcaacaaggaaggcctggagctgctggccaacggcaacatcatcctcaacggccgcgccctgctgggctcggacgtggacatccgccagggccacctgcgcctgcccgacggcaaggtgtaccagttggtccccggtgagtcgcagcgcttcaaggcctaccgcgtgcagcacaaccaggcgcgcggcccctacaagggcggcctgcgctaccaccgcgaggtgtccctggacctcttcaaggccctggccgcggagatgacctggaagacggccatcgccgaggttccgttcggcggcggcaagggcggcatccagatcgacccgcgcgagtacggccgcgaggagatcgaggccatcaccctgcgcttcatgtaccggctcaagagcatgattggcccggacatcgacatcccggcgccggacgtgggcaccaaccccggcatcatggccctgctctaccgccagtactcggacggtgagcgcgagcgccacaacctgcgcggcatcgtcaccggcaaggacgtgcgcatcggcggctccgagggccgccacaaggccaccggccagggcgtcgccttctgcatcgaggactactacgccgaccgcggcgagtccgtgaagggcaagacgttcatcatccagggcttcggcaacgtgggcagccacgccgccaacatcctgtcgcagatgggcgcccgcctgcttgcggtgaacgacgccgacggcaccatcttcaatggtgacggcatcgacgtgaccgcgctctccgcctacgtgcaggaccccaagaacctcaagcgcagcgtgctcggcttcccgggcgcccagcgcatcgagaagaaggacctctgggacgtccaggcggacatcctggtccccgcggccctgggcggcgaaatcaccgccgacgtggccgagcgcctgcgcgtcaagctggtggccgagggcgccaacggccccaccaccccggaggccgaccgcatcctggagaagcgcggcatcgagctcatcccggacatcatcgccaacgccggtggtgtgacggtgagctactacgagtggatccagaacaagcgcatggagcgctggagcgaggccgaggtcgaccagcggctcgagcgcgccatgaagcgcaactaccgcatcatccgcgacatctcgcgcaaccagccgcgcaagacggagatgcacgacagccgccagtactgcatcggtgagacggtggacacccgctgcgccgccatgattctggcgctcaagcgcatcgaggcccactacctcctcgagggcttctcgcagtag

SEQ ID NO: 4054 - DNA, 954 bp, Myxococcus xanthus
atgaggaccgccgcgaggctgctatgggtgtacctggccggggccctgtgctcgtgcgccgcgcccgcgcctcgtgtgtcgcccgtggcccccgagggcgcgacgcccgtgggccccttccttcccgaagcccgcgccttgttcgaggggtgcacgccggtgccggaccgggccgactcgcggctgtaccgctgcgatggcgtgacggtgtggttgaccgagcgggaggacctgacgcccgagcaggcactgaaggatgcccaggcccgaatcaccgaacggttggggcccggtgccacggtggtggaggaagcgctgccgctggcgggaagtccgtggccctcggtccgggtcgaggcgtgcgaggcggaggactgtcgcgccgccgggtatgcatccgctatcaccgggacactggggcgggtgcggcagctcgggtgcgtggtccaggctcccgtgcggcccctgctggcgcgctgcttggagttgctcgagtccctcgcctcgaatggcagccccgagggcgagacgctgggacgcgaggcgctgctcgttccgccgcgcctgccatggcgggccctggcagtaccggatggatgtctgctcgctgcgtccacggcgcgcgcgggacgcattcgctgcgagggggcatcgctgttgtggagcctctacgaaccggcccaatcccaggtaacggagcgctggcgctcgcagagcgtggcggagttggtggacgcgctgccgggagcggggcccgtcgaggaagtgccctgccgactggagaacctggacacgcgatgcgcgcgcttcacggtgccttcttccgaggggccgctgctcgtgtgggccgcggccgtgacgtgggagggccgagcgctcttcgccgcgtgcagccaccgggcctccgagcctccgtatcccgccgtctgcaacggcgcgttcaccctgccttga

SEQ ID NO: 4055 - DNA, 384 bp, Myxococcus xanthus
atgctcaccccggggccctattcgctgggaacgggcgagtacagcatcaacatcaccccgttcttccccggcggcagctcggcgctcacccacggggcgcccaagaagacggacggcaacggcaaccccatcctcccctacctcaccgtcaccggtgacatgccggcggggtggaacctgcagatgttcaaccgcctcttctccacgcgctcggtgcgggcgcagattgtcttcaccccgcagagcgtgtggaccctgcccaagaagggcggcgggaagagccacggcgtgacggcgcgcatcgaagccatcttcatcacggagggtcgcagcggccaggccatgggcctgtggctccacggcaaggacgccaagaagcgctaa

SEQ ID NO: 4056 - DNA, 159 bp, Myxococcus xanthus
atggaggaggtcgccgagcaactggaaatccccgtggaagtgctcgctcgggtggaacgaggggtgatggtgccgaccattcccaccctgacgcgcctgtgtgtgattctgaagctggacccggatgtgctgcccgagctgccggagatgagtgactga

SEQ ID NO: 4057 - DNA, 1686 bp, Myxococcus xanthus
cgttgccccacctgccatcgccgcgtggccgagcgctgtcctcgccacggcccggtcgaagcgcgtgccccaggctccgtgccggagcctccggatgtggtgggctatgtcctgggagcgcccttggggcgcggtgggtttggacgggtgttcgccgcgcggcgtgaggtggatgggcaggacgtcgcgctgaaggtgttggagccgctcgcgggcgaacggctggggcgggaattggaggccctgcgccgcatcggtccccccgccgtgccgcggctgctgggcgaggccacgacccgcgccggtgagcgggtggtcatcatggagcgcatcgagggcccgacgctggctcggcggttggcgacgctgccgggcgccggggccctgccctgggccgatgcggccctgctgacacgagccctggcggaggcgctggcccaggtccatgcggcgggcgtggtgcaccgggacctgaagccggaaaacgtcgtgctgtccgaagggcggctcgtcctgctggacttcgggctcgcgcggctgacggcccaggatgatggggaggggctctcgccagggctcacccgcacgggtcagcggctggggacccatgagtacatgtcacccgagcagtgccgggacgcgcgatacatcgacgcgcgcgcggacctgtatgggcttggggtcatgttctttgagttgctgtgtggtcggcctccctttgtcggagaggcggcagcggtgctccaggcgcatgtctcgcggcggcctccggcgatacggacgctcgcgccttggccggtgcccccggcggtggagacattggttcagcggctgctggccaaggtgcccgaggaccggggagacagtgcacggtcgctggcggaggagttgcgcgagcttcagggcgctggcgacgcgctgggcacccatgcggtgtccggggccctggcggagaacccgcgccacgccacgggggcgtcatggacagacacgggcccttcaaccgcccccaccccaggctccagccgagccacgcgcgaggtggccgtcctgggtgtgaagtcctcactggatgcaccggccttgcaggcctccctcaccggaagcggcgtcatcctcgcgcgcgtggagccgggcctttgcctcttcgcgttcccccacgaagcggcggtggaagccgggctgcgcgcggcgctccgggccgcggaggtgctgaaagccgccctccccccaaacgcaacgctcgcacttcattgcgcaccgctgcgcattcgtgagcgtgcaggtcgcttgacggtgggtggcgcggcggtggagcggcccgagcggtggtggccatcgcttgaatccgtctccacccctgagacggtcgcactgacggccagcgcccgcgcccacctgggcgacctgccatacagcacgccgcatggggacgcgctgacatctcctgacgtcctcctgggccgggacacggaacggcagtggctgcgcgaagccctgtcgcgcgtgcaggcacacggcgcgcccgtgctgcgcaccctgctggcggaagagggccagggcaagacacgcctgctcacgacgtggcggaccgaactggagggcacgcccggcgtctccgtgcgcttcgtcgaggcgctcccggatgaaggcagcgcgagcgaaagcggcctgcgaagtctcatc

SEQ ID NO: 4058 - DNA, 441 bp, Myxococcus xanthus
atgaacgaggcgctggcgatggacctcgagcggcatcacctcaaggccttctcccggatcgccccctgtgagttcgagtcctcggacccggccgaggtgaaggcgtgggtggagcgggaggtgggctatccggtggatgtgccggtggtgccaggcgcgacgctgctgggtgcccgtcgctgccggttgcatggaaagctctccgcctcgttgctgtaccggcacgaggagggcaaggcgatgacgctcttccttcccctgccgggctcggcggcggcgcaggaggcggcccgcttcgctggtgacgggcctcggtgcacgcaagggcccgtgggcgagcgtatctgcgtgctgcctggtgggggcgagcgggccgcgctggccgtctccgaaatggagcccgcggtgctcctggccgcgctggcccgcctctctccctga

SEQ ID NO: 4059 - DNA, 528 bp, Myxococcus xanthus
atgcccgtgagcgcccgcgccttcatcgaacgtgccctggagcacctgcccgtcttgaggcgggtggggcgtcggctgacgggcagcgccgcggaagcagatgacctggtgcaggagacgctgacgcgcgccctggagcagcgcggtgcgctgagagagaccgagcgcctcaaggcctggctgctcgccgtacagcgcaccgtgttcctcaactcccgccggggtctgcggcctcacctggaggtgctggagggcgggctgggccgggcgcttcctccggagccatccgcggacctggaggcggagctgcacgcccgcaccttgagtgcggggatgcaggcggcgctcgactccctggcgccggagtggcgcgacacgttgtggctgcgggaagtcgaggagctgagctacgaggagattgctcaggtgcagggctgcccggtgggcaccgtgcgctcgcggctggcgagggcgcggctggcgatgctcgacttcctcgagaaggagaaggtccatggaagcctgtag

SEQ ID NO: 4060 - DNA, 471 bp, Myxococcus xanthus
atgcgttcctccctcagtgcgttcctcagcggcctcatcttcgccattggcttgggcctcgcaggcatgacggacccggccaacgtcctcggcttcctcgacatcgcaggcgactgggactaccggctcgcattcgtgatgggcggcgccatcgccgttcacgcggcgctgcggcccctcatccaccggcgcgcgcagcccctgttcgccaccaggttccctgcgttcgccgccagcaagccggacgcgaagctcctcgtgggctcggccctcttcggcgtgggctgggggctggccggctactgccccggtcccgcgctcacctcgctggcgaccggggccttcccgttgctcgtcttcgtgcccgccatgttcgcgggcttctacctcgcgcaggtgctgcaggcgcggagcggcgtaggcgcaccgcgtccaggggctccgcacgtgggcgccacgcccgctcagtaa

SEQ ID NO: 4061 - DNA, 426 bp, Myxococcus xanthus
atgacttcctccatcctccttcctctcctgggcggggccctcatcgggctgagcgcctccctgttgctcctggccaacggccgggtcgccggcatcagcggcgtggtgggctcgctgctggcccccgtgcgcggtgacgtcgcctggcgcgtgctcttcttcgccgggctgctcgccggagggctgctgctcgcctggttgcgccccggttccttcccggcgccctcgactcctggcgcgggcggcctctggctgctggtgggggccggactgctggtggggttcggctcgcggctgggcaacggctgcaccagcggacacggcgtctgcggcatcagccggggctcggtccgctccatctccgccacgctcaccttcatggccaccggtgtcctcaccgtcttcctggtccgccacgtcctctag

SEQ ID NO: 4062 - DNA, 240 bp, Myxococcus xanthus
atgttcgtggaggtccgggaccaggtgggcctgggcgagaagctgaaggtgacgttcgcgggcgaggacgggacggagatgacgtgcctgtgcgaggtccgctaccaggtggccctggccttcgggcgcaaggacgggcgcgagggcagcagccgcggcgtggggctgcgcatcgtggcctatgagacgcaggacgacgcgcccctcttgctggtcgaccgcgagcgggtgatgcactga

SEQ ID NO: 4063 - DNA, 1296 bp, Myxococcus xanthus
tcctcgctggcgccgctgatccgcgcggtggaggcgagcgtcgtcaacatcaccaccgtggggccccgggccggtggcctggaggggatgaagaagtccaccggctccggcttcgtgctgacgcccgacgggctcgtcgtcaccaacaaccacgtggtggccagcgcgcagcagattgccgtgcgtctggcggatggccgcgagttcgccgcttccgtggtgggccgtgacgcctccacggacgtggcgctgctgcggctcagtggcgtggacctgggtaagctgcccgccgtctacctgggggactcggaccggatggcggtgggcgactgggtggtggccataggcaacccctttggcctggaccactccgtgtcccacgggatgatctccgccaaggagcgcgtcctgggcgtgggccagttcgacgacttcatccagacggacgcgctcatcaaccccggcaactccggtgggccgctcttcaacatgaagggggaggtggtgggggtgaacaccgccatcatcagtcaggggcagggcattggtttcgcggtccccagcaacctggtgaaggagctgctgcccaacctccgggagaacggcaagctggcgcgtgggtggctgggcgtcgtcatcaatgacgacgggagcaatgggggcggtgagcgccaggccccgctggtgaaggacgtctacaagggcagcccggccgcggccgtgggcatccgcccgggagaccggctggtggcggtgaacgggcggcccatcggctcctacctgcagttgttgcgcaaggtggcgctgctggcgccgggcaccgaggcgcgcctgtcgctgacgcggggcactgagacgcaggaagtgacggtgcggctggtggcgcgccccgcgcaggaggccaccgaggggctcatccagcggacggccagcgaggaggagatggggctggtgatccgtgacctcacaccggaggtggccgcgcccctgggggagacggcctggtccggcgtgctggtgtcgggtgtcacgccgcgcagcccggcggactcggccggcctgcgggcgggagacgtcgtgacggaagtgaaccgccgccgggtgaaggacgtggctggggtgcgcgcggcgctggggaaggggagcgccggggtcagcatcctcctgcgggtgaagcggggcgaggcgctccagtacatcgccatcgcccggtgaggtgacgcccggttagcgcttcttggcgtccttgccgtggagccacaggcccatggcctggccgctgcgaccctccgtgat

SEQ ID NO: 4064 - DNA, 477 bp, Myxococcus xanthus
gagcggatggtcgcggagctggagacgcttcgcaagaagttcgacatcgccgtccgcgcggtgcaggccgcggagaaggaccgcgaggagttcaagcagcgcgtgacgcgggagcgtgagcgcatgctggacgtggagcgcggcaacgtggctgtcacgctgctggaggccatcgacgagttggaccggtgcctgtccgtcagcgcccaggacacctcgccgctggccgagggcgtccggatgattcgtgacgagctcttgcgcaaggcgcagtccacgggcatcgagcgccttcaggtcgtcgggcagaccttcgacccgaacacggccgatgccgtcgacatggaagtgaccgccacgccggacgacgaccaccgcatcgtcgccgagctgcgtgcgggctaccggctgaaggaccgcgtcatccgtccggcccgggtgaaggtggcgaagtacgtcgcccccgtccaggcctga

SEQ ID NO: 4065 - DNA, 369 bp, Myxococcus xanthus
atggacatcgtggtggcggacctcacgcagccccggaccaccgcggggattggcggctcggggagcaaggacgggggcctcatcccggggccgagtctgcccatgcagcgcgcggacgcccgcctggagcaggccgtggcgcatgcccagcagcacctggacgtgctccgcaaggcgcagggccctgacttcgacgaggccttcctgaagcgcgtcatcgaggaccaggaggaagccctgcggctcgtgaagcaggcgcaggcgacgtacaagaacgatggggcgttcaccctcatgctcgacaggacgggcaacctcgcggaccgtcatctgcagcgggctcaggggctgaaagagtcattcgagtga

SEQ ID NO: 4066 - DNA, 1884 bp, Myxococcus xanthus
cgcgtgagctacagccagttccgtgacggggtggaagctgggaacttcagccgggtccagatttcgaacgagtgggtgaagggcttcctcaaggacacggcgcagccgcctcctcctccagcggacggggagcgcacgctgcgcggcgagccgagcgccctgccgtggatggcctaccgcgtcgccggtgacgaggggctggtgccgttgctggagcagaagggcatccagttcgaggccgtgccgcagtcagggctgggcgaggcgctgtggatatggctgttgcccctgggcctcttcttcctcttctggagcttcatgatgcgccgggtggccggcggcatgggccagggcccgcagagcgtcatgagcttcgggaagacgcgcgccaaggtgcaggccgaggccgataccggcgtgggcttcaaggacgtggctggcgtggacgaggcggtcgacgagctgcgtgaaatcgtcgagttcctcaagacgcccgagaagttccgccgcctgggcgggcgcatccccaagggggtgctgctggtgggccctccgggtacgggcaagacgctgctggcgcgagccgtggcgggtgaagcgggcgtccccttcttcagtctgtcgggctccgagttcgtggagatgttcgtcggcgtgggcgccgcgcgagtccgcgacttgttcgcccaggccacgtcgaaggcgccgtgcatcatcttcatcgacgagctggatgccattggcaagagccgcaactcgggcgtggccggtgggcatgacgagcgtgagcagacgctcaaccaactgctcgcggagatggacggcttcgacagccgcgcgggtctcatcatcctggcggccaccaaccgtccggagatcctggacagcgcgctgatgcgtccgggccgcttcgaccggcaggtgctggtggaccggccggacaagcggggccgcgagcgggtgctggagattcacgccaagggcgtgaagttgggaccggacgtggacctcaaggccattgcctcgcgcaccccgggcttcgcgggcgcggacctggccaacgtggtgaacgaggccgcgctcctggccgcgcggcgcaaccgcgacgcggtgatgcgggcggacttcgaggaagccatcgagcgtgtcgtcgccggtctggagaagaagaaccgccggatgaacgagcgtgagaaggagattgtcgcgcaccacgaggcgggccacgcggtggtggggtggatgctgcctcacgcggagcgggtgacgaaggtgtccatcatcccgcgcggcctggcggcgctgggctacaccatgtcgctgccgctggaggaccgctatctcatgtcgctggacgagctgcgcgacaagatggcggggatgatgggcggccgggccgcggaggagatcttcatcggggaaatctccaccggcgcgtccaacgacatccgccaggccacggaaatggcccggatgatggtgcgggactacggcatgagcacgctggggccggtggccctgagcgcggaccatggcccgggcttcctccgctcggcgggcgtgccggagacgcgcagctactccgagcagacggcgcggatgattgacgaggaggtgcgcaagctcgtcagtgaagcgctcgacagggcccgtcaggtgctgaccacccacaaggacagggcccaggcgttggcggcccggcttctggccgtggaggtggtggaggaggacaccatggtgacgattctgggtcccaaggtgttggcgcagcgtggcctgctgcacccggaggcgcgtcaggtcatctccgcgcacccggtggacgtcgggggcggtgacgaccagacgccgcccacgcagcactcggacgcgctcgactcctga

SEQ ID NO: 4067 - DNA, 753 bp, Myxococcus xanthus
ctgcccgagctctccggcctggccgccagccagcgccacccgggggccttctgggcgcacaacgactccggcaacggcttcgagctgttcgcgatggacgcgaagggcggcatcctcgcccggctgacgctcaccggggccacccctcgcgacatcgaggacgtcaccgtggggccctgcgcctcgggggcgtcgcgccgctgcgtctatcttgcggacatcggtgacaacttcgcgcgccgggagcaggtgcggctctaccggctgccagaaccggaggcgctcgaggatgccacggtgccggtggacgtactgtccttcatgtacccgggcgggccccgcgacgcggagtcggtcatcatcgacgcccgctctggccggttggccgtcatcaccaagacgctggactccctgggagatgtcttcgcgctggatggcctgagcgcggagacccccatccaggcccggaagctggggacgctgacggcgccgctcgggatggaccgggccaccaccgcggcctccctgcatccctccggtgagcggctgctgctgcgcacctactcgcgcgcgtacgagctgcgccgccccggcgccgcgcggctggaggacctgttgcaaggagagctcgtcgaggttccgagcgggagccaagcccaggcagaagccatcaccttcgtgcaagacggcaacggctatttgttgggcacggagttcactggccaacccttgtggctcatcgggtgtcgctga

SEQ ID NO: 4068 - DNA, 378 bp, Myxococcus xanthus
gcgatgctccagaatgagcaggggcgctacctcatcacccaacgcccccccaccgcgtcactgcccttgctgtgggagttccccggcgggcgcgtggaggagggtgaagaggacgccgaggcccttgcccgggaaatccaggaagagatgggcgtggaggtggacgtgctgggtcaggccatgcacacccaccacgagtaccccaactacgacatcgacttccgcgtcttccactgccggctctcgcggccgacggaggaagtccaacacctgcgcgtgcatgaccaccgctgggtgacgctggaggagatgtccgcgtaccgcttcccggacgcggatgccaagacgctggcgaagctgctcgacctggacaactga

SEQ ID NO: 4069 - DNA, 183 bp, Myxococcus xanthus
atgagcgacggccccaagaagagcccgaaggtgtttggcgttccggtgaagatcgacccgtacacgtcggtccggcccgagcaccccaccggcgagttcggcatgccgagcgcgaagaagaaggatgacaagcccttcgaccccttcgccgtcgtcatcgagtcaccaaaaggcggcggctga

SEQ ID NO: 4070 - DNA, 387 bp, Myxococcus xanthus
atgcgtcagcgcatcatcgccgcggcggtggcctgtgattacacggcgctcaataccctggccgacgagaacggcaaggccgtgcggttcaccttcggcgacggcaccgacgcgggagagtactggcgtgcagcggagaagctgggcaacccggagctggcccgcatcgtcaaggtcctgaacctgccctacgcgaagcaggacaatctctacttctggccggccgtccacgtcaccggcgcgacatccgacaaggattggggcgcgctcaagggcgtctacccggacgaggaaatcgcggggatgaaggaccagggcagctacctcggcctgcgcgtgggcatcacccccgaaggtgactggcaaattgcagtcgcgggggactga

SEQ ID NO: 4071 - DNA, 516 bp, Myxococcus xanthus
atgaagctcaaggccctgtgcatcaccgtgtcgctactcacccttcccggcgtggccttcgcgcagggcgggttcggcgccctcaccaaggccgcgggcgatgccggcaagtccgccgtggagaagcgcgtcaacaccaagctgatggacgagggccggcagaaccagtgcagcttcaagacaggcaccgcccagctcgatgccggctgcgaagccaagctcaagaagctgaccaacgcgctcgtcgacgccaagaagcagctcgtcgccgctggcgtaaagtcctacaagttcgaggtctccggccacaccgactccaccggtgacgcggccaagaacaagaagctcagcgagcagcgcgcggagaccatcgtcaaggagctcatcgcgcgcggcatcccccggggcgaaatcatcgccgtgggctacggctccgagaagccgctggtgaagcccgacgacaccgccgccaagaaggcgaagaaccgccgctacgagctccaggtccgcctgtag

SEQ ID NO: 4072 - DNA, 1527 bp, Myxococcus xanthus
atgagccagtcgcagtccatggccatcctgcctcccgacgggcaccacgccacacaggtcacgcaccagcgcatgacggcggcgccactctacgacaaagggatgcatcagcccggcgcggagattcaggcggtgcggggaacgaagcgcctgcccgcccagcccgacttcaccctgagcacgtcttctttttcacactccgaccaagccacagaaagcctttatttctcgaaaagcggaggctcctccccgcagcacgtcccccgtgctgcgacgcaacgccgtctccctggaggagcaatgcggatgaagacctggatgccggtctcgctgttgctgctgaatgccccgctggcccttgccgagccgctcaaggccaagccaacggacaagactgtctggattgcgattgggacggatgccatcacgcccatgcaggagaccttcgcggccgaaggctgtaacgtgcccaccgccctcaagcagcagaagcacgcgggcgtgttccaactgaaggagtcccagctgtcgcggctggcgctgatgatgcacgagaagttcgaccgatgcgcgggcttcatcacctacgagacgcaggaggaagcactggcgtccctggcgcccgtagcccccaatgcggcccagaaggccgtcagctacaccctcaccaacgccgcgaccgtgaacaccctggtgggtgagctctctgccgcgaacatccgcaccaccatcgccgacctgtccgccttccccacgcgcagccagagctcgcaagggggcgtggacgccgcggccatgctcctggcgaagtggcagggctacgtcactggcgcgggacgcacggacgtcaccgtggcgtactacccgcacacgggctggcggcagccctccgtcatcctcaccatccccggcaccgatttgtctggcgaggtcgtcgtggtgggcggccacctggactccatcagctccaccagcgccgcgcctggcgccgatgacgacgcgtccggcatcgcgacgttcaccgaagtcatccgcgccgccatggctcgcaactacaggccccagcggacggtgaagttcatggcctacgccgcggaggagacgggcctgcgcggctcgcgggagatcgccctttcgcacaagaacaacaacatcaacgtcgtgggggtgatgcagctcgacatgacgaactacaagcaccccaacgccacatcggatgtgggcatcgtcaccgacaacacgaacgccacccagaaccagttcatccgcgacctgataacgacgtacgtcggcgtgccgttcaccaatacgacctgcggctacgggtgctcggaccacgcctcctggcacagccagggctacgcggcctccatccccttcgaggggactgtcgtccagaagaaccccaacatccacacccccagggacaccctggcgaactccgacagcagcgccgcgcacgcgctcaagttctccaagattgccgccgcctatgtcgccgagctggccaagggcaccgcgcagtag

SEQ ID NO: 4073 - DNA, 1743 bp, Myxococcus xanthus
aatccgccgctgagccacgcatcccttcgtcgcgtcctggcactggctcgtcccgagtggaggctgctcttgctcggcacgtgcttcctcttcatcgggagcgcgggaggcctgctcttcccacaggccatccgggtcatcctcgacgaagccctgactaccgccacgctcgacatggtgaacgacaccaccctgtggatgctgggggtgtgtttcatccagtcggtggccatcgggctgcgcttcgccttcttcaacatcgcgggtgagcgcattgtcagcgacctgcgggagcggctgtatcgcagcttgctggagcaggagatcgcgttcttcgaccagcaccgcactggcggcctcaccagccggctgtccactgacaccgccctcatccagggcgccgtcagtacgcacatcgccatcatgctccgcaacgcaaccacgttgattggagggctggcgctgctgctctacacctcgccccggttgacgctcgtcatgctggcggtcgtcccccccgtgacgctgggggcgctgttctatggccgcaaggcacggcagctcgcgcgagacgcccaggccgcggtggccgaagccaatgaagtcgccgccgagtccctctatggcattcagaccgtccaggccttcgtcgccgaagacgcggagcgccggagctatggccgtgccattggcaaggccctggcgctggcgcgcacgcgaatcgtctcctcgggcttcttcatgggaggaacgggcttcaccggcctggcgtcgaccctgctcgtcttctggtacggcacgcacatggtcgtttcgggcgacatcacggtgggtggactgacctccttcctgatgtacacgctgatggtcgtcatggccgtcggtgccctgagcgagctgtgggcggagttcatgaaggccggaggcgccaccgagcgcgtcttcgagctcatcgaccgtacgcccgccatctccgtcagcggcggcgagcggcccgcgaacatggaaggcaacctgcgcttccgcgacgtcaacttcagctaccccacgcgccgggacgtgcccgtcctccaaggcctggacatggacgtcgcgcccggtgaagtcgtggcgctggtgggacactcgggcgcgggcaagtcgactgtcgcctcgatgttgatgcgcttctacgatccggaccgaggggccatcctcgtcgatgagacagacctgcgaacgctcgacgtccgctggctccgtcagaacatcggcatcgtgtcgcaggagcccacgctcttctcgggcagcatcgccgacaacatccgctacggacgcaccgacgccaccgatgcggaagtggaagccgcggcccgcgtcgccaatgcccacgacttcgtgagccggtttccagaaggctaccgcacgcgcgtcggcgagcggggcatccagctctcgggcgggcagaagcagcgcgtcgccattgcccgcgcggtcctcaaggatccgcggctgctcatcctggacgaggccaccagcgcgctggactccgaaagcgagcacctggtcaaggaggcgctggaccggctcatggtgggacgcaccaccctcatcatcgcccaccgcctgtccaccgtggcgggcgtcgaccgcatcttcgtgctggaccagggccgcgtcgtccagcacggaaaccacgaggcgctcatcacccaggacggcctctacaagcgcctcgtggaacggcagttcatcgccgcctga

SEQ ID NO: 4074 - DNA, 201 bp, Myxococcus xanthus
atggttgagagcaacatcgttttgaagcccgaggtggtgacgttcaagcagctggatcccgcgaaggtggacgcgctccgcggccagctgagcatgatcctgggtcgtggcgagttccccacgatgtccgctcgcgcgggcgccgtcgtcgtcaaggagccgcaggatcacaccagccacacgtctgacggctggttctag

SEQ ID NO: 4075 - DNA, 204 bp, Myxococcus xanthus
atggttgagagcaacatcgttctgaagcccgaggtggtgacgttcaagcagctggatcccgcgaaggtggacgcgctccgcggccagctgagcatgattctgggtcgtggcgacttcgcccagatctccgcgcgcgcggtcggccccgtcaaggaccaggagccgcaggatcacaccagccacacgtctgacggctggttctag

SEQ ID NO: 4076 - DNA, 207 bp, Myxococcus xanthus
atgctggcggcggatgagactgtctatgaaatctccaacacgcccatcactgactacgagctgtgcctggagtcgcagagccagggccggcgcaccacgagcgttcaggcgttcgaggactacaacgcgcttcgctgcgcgcgctggacgcggtgtggcgccagcgacccgtgcaccagcgtgacgcacggcgcctgcacgccctga

SEQ ID NO: 4077 - DNA, 801 bp, Myxococcus xanthus
atgaagattcacgaggtccgcgcgaccacgcagggcacggagcgcagcatcgacgccgagatgctccggcaggcggtgggggcctgcgacttgtttgtctgtttcaacacctggcacgcgacgggggtctccgagctgctcgaggggttcccggcggccaccgaaacagtgggcctgtatcgccgttacaagcagtgggtccggagtgaagaactccagcattccgcggaccggctcttctcgctggcccagcaggtggatccctccctgaggctggaggacttcgcccaggcccccgtgctgacggccgaggccaccgagggcgggaggcactttcgtgacagcgtccccgatggggccaaggtgctcgcgctccatacggagaccggcgcccggaaacagtggcccgtcgcccgctaccgcgccgtgctggatgccttcctgacagcccaccccgaatggctcgtgctcaacgtggactacagcgccacggagctggcgcccatggtccatgaaggccgcgtgctgtccgtcccaggcgccccactcgatgtcgccatggcgctgctcggcgcctgtgatggcttcctcggcatcgactcctgcatgctgcacgcggcggatttcttccggctcccttcggtgggcctgttcggaacgacctctccccagcaatggggcttccgtttcacgccggccttccgcgagcccaccgggaacgggagcatggacgacatcaccgaggaagaagtcctcggcgcgctcacggacctcgccgccgggcggctgcgccccgcctga

SEQ ID NO: 4078 - DNA, 507 bp, Myxococcus xanthus
atgtgtggccgtgtcaccgtccgaacttctcctgagcagattgtcaccgggctgggcctcgcgggcatccgtaccgcggtggaacgcccgcgcttcaatctctgtcccacgcagttgatgcccgtggtgaccaacgatggcgcgcggatgctggatgccttccgctgggggctcgtcccgtcgtgggcgaaggaccccgccattggcaacaagctcatcaacgcacggggcgagacagtggcggagaagcccagcttccgctccgcgctcaagcggcgccgttgcctcgtcgtggtggatggctggtacgagtggaagcagtccacgaagccgaagacgccgtactacttccaccgcaaggacgggcagctcctgacgctcgcggggctgtgggaagagtggaccgcgcccgacacgggcgaggtgctcaacacctgcaccctcatcaccatcgggcccaacgcgctgatggcgcccatccatgaccggatgcccgtcatcctcgag

SEQ ID NO: 4079 - DNA, 1446 bp, Myxococcus xanthus
tggcggcggcttctttcaggttaccgggtgggctcggagaagaagccggtggaggagccggcgcccgtcctgagtgacatggacgcgctgctccaggacgagcggaccgactacgaccgggactatgaccgcatcgtcttctccgcggagttccgttgcctgcacgacaagacgcaggtgtttccgctgtccacgagcgactacacgcgcacgcggctgacgcacagcatcgaggcttcctgtgtcgggcgctcgctggggaatctggcgggacggggactgcgggcgcgcgacgtcatggtgaatccctcgcacctgggcaccatcgtcgcggcggcgtgcctggcgcatgacattggcaatccgcccttcggccactccggcgaggcggccatccagcattgggtgtcacagcggctggcgcggcccggtgccgaggtggatgggcggaagagccccttcgagacggtggagcagtggcaggacctggaggccttcgagggcaacgcgcagggcttccgaatcctcaaccggcttcagtcgcgcgagcggcggggcggcctgcgctacacggcggcgacattgggggcgatgagcaagtacccgcgtgcgtcggtgctgccgggcgggcgtgagcgggacaaggggcgcgtgtctgagaagaagttcggttacttccaggacgacgaggccctggcgctggaggcgtaccgcgctgtgggcctggtggagcgggaggctggcgtgttctcccggcacccgctggcgttcctcgtcgaggcggcggatgacatctgctacgcggtcatcgacctggaggactcggcgaagctggggctgattcccatcaaggatgcgtgtgagttgctggacgcggtgttgcccaagctggtgaaggggccggtgcgtccgccaccgtcgcatccggagacgcggcttgcgcaggcgcgagcgcgggccattggcgagctcatccaggcctccgtgaaggtgttcctggagaacgtggaggcgatggaggacgggaagtgggagacgccattggcctccgcgcgggacgacgtggcgaagccgctgaaggccatccgcaacctcacgcggcgctacggctatgagagcgagcgcgtgctccagattgagagcgcgggcttcaagacgctgggcggattgctggacatgttcgcgatggcggtcgtcaccgacacgccgaaccgcgaggagaagaaactgcggcaattgctgccactggacctcttccagcgtccggaacacgtccgggacatggcggaagagcccgcgtcccgggacgaagccatcaccgaggcggtggcccgtctgtcgaaataccagcggctgctgtgtgtgacggactacatctccggcatgacggacggcttcgccgtggagctgttccaacggctgtcaggcatcaagctgccgacgtga

SEQ ID NO: 4080 - DNA, 1671 bp, Myxococcus xanthus
atgcgctggtgcgtgacctgtgtggcgtggtgcccgtcgggaggcaggatggccatggactgcgactggctcatcatcggctcggggttcgggggcagcgtcagcgcgctccggctgaccgagaagggctaccgcgtcatggtgctggagaaggggcggcgctttcgcgccccggacttcccgaagacgaactgggcgctgaagcgctggctctggatgcccacgctggggtggcggggcctgttcgagatgtcgttcttccgccacgtcaccgttctgtcgggcgtgggcgtgggcggtggctcgctcgtatacgccaacacgctccccatcccccgggacgacttcttccaggcctccacgtggggccacctcgccgcgtggaaggaggagctggcgccgcactacaccaccgcgcggaggatgctgggcgccacgccgaatccactgcgcaccgtgccagaccaggtgctccaggacgtgggcacggacctgggccgcaccgacttccagcccaccacggtggccgtgtacttcggcgagccgggcgtcaccgtgaaggacccatacttcaatggtgagggaccggaccggacgggctgtaccgcgtgtggcgggtgcatgctggggtgtcgcttcgatgccaagaacacgctcgacaagaactacctccacctggcggagcggcgcggcctcgcgctgcacgcggacaccgaagtcacctgggtgcgaccgctgccagacgggggctacgaagtcgaagcgcttcaaggggcgcggcgcttcttccggaagaaggtgcggttcaccgcgaagcacgtcgtcttcgcggggggcgtgctgggcaccctggacctgctgctcaagttgaaggcgagcccggacggactgccgcgcctgtcggaccggctgggagacggcgtgcgcaccaactccgaggcgctcgtgggggtggtgaacggccgcaaggggcaggatttgtcacggggcatcgccatcggttccatcttgcataccgatgcccagtcccacctggagccggtgcgctactcggcgggctcgggcttcttccggttgttgatggcgccgcaggtgtccggggccacgatgctccagcgcttcgtgcggctggtgggcctgctggtccggcatccgctgcgcttcctcaaggcgtggttcgtcccggacttcgctcggcggacgatgattctgctctacatgcgcaccctggaagggcacctgcgcatgacgcgctcgcggaggctggggctgagcacggcgctccaggagggcccggcgccgagcgccaacatgccggaggcgttcgacctggcccggcgcgtggcggacaagctggatggctatccgatgaccatcgtcagcgagaccctgctgggcattccgacgacggcgcacatcctgggcggctgctgcatgggggactcggcggagacgggcgtcatcgactcgcggcaccgcgtgtttggccatgaggggttgtatgtggtggacggctccgccatctccgccaatccgggcgtcaatccgtcgctcacgattacggcgctggccgagcgcgcgatgaccttcattcccgcggcccggacggcgccgcgggacgaggtggccgtgcccgcggggcccatgtcctcgggcgcccgcacgagctga

SEQ ID NO: 4081 - DNA, 2274 bp, Myxococcus xanthus
atgcgtttcccgcatgaggagcgtctggtgatggtgtgggactcgcttcccaaggcgggtgtcgagcggagcgagacatccctggcgacgctggaggactggaccgcgcaggcggggggcttcgagcacgtggcggggattgttccgcggagcttgaacatgggcggcgcgctgcagccggagcggctccaggcgtttcgggtgggcgccgcgctgttccccgcgctggaggcgaggccctcgctgggcagggcgttctccgcggaagaagaccgcgtgggtggcgaggcggtggtggtgctgtcggacgcgttgtggcggcgccggtttggtggcgcgccctccgtgctgggtgagtccgtcacgctggatggtgagccctacacggtcgtgggcgtgatgccgaagagcttcgacttcccgcctggcgccgaagcctgggtgccgctcgcgccgacgcaggcggagctggatgcgcgcggggaccggaaggtgcgggtggtgggccgcctcaagcctggcttctccgtgtcgatggcggaggacgccctgcgggtcctcgcagggcaactggcggagcggtaccccgacacggattcggagcgcaccgtgcggctgacgtccgtgcgcgaggcctacctggggcccttgaggccgctgctcatcaccctggcgggcgcggtgggcttcgtgttgctcatcgggtgcgcgaacgtcgcgagcctgctgctggcgcgcgcggcggcccggcggcgggagctggccattcgcggggcgctgggggcgagcccgacgcgtctgatggtccaggccctgaccgagagcgtcttgctgtcgctcctgggaggaggattgggaatcctgggcgcgctgtggggcacgcacatgattgccaccatgctgccgcccgggttggcggagcgcctgccagggtggcaatccatccaggtggatggaggggcgctgctgttctgtgtcgggctgtccgccatcaccggggtgctgtttggcctggcgcccgcgttccagatgtcgcggcagaacccgctggaggcgatgcgggagggggcgggcgccacggcggggcgaaagagcatccgctcggccctggtaacggcggaggtggcgctggccttgatgctggtcgtcggcgcgagcctgatgcttcgaagcctctaccagctccaggggacctcacccggcttcgccgccgaacgcgtgttctacttcgacgtcacgctgccggagaccaggtatccgacggacgccgagcgggttcgcttcttccatgcgctgcaggagcggttgtcctccattccgggagcccaggccgtctcggcggcgagcctgccgcccatcagccgtcgcagtcagagctcgaacatctatccggatgggcagccgaagccgctgcccgggcagttgcccgaggccagtcagcgcgtcatctccccgggctatttccggaccatgggcatccccttgcacgaggggcgcgatttcaacgcgttggacgtggaggactcgccccgggtcgcgatgatcaactcggccctggcgcggcgcttctggcccggagagtcgccgctgggcaagcgcttcttcacgggcggcaccgagccgtgggaggtcattggcgtggtgggggacgtccggacgctgtggcgcgggcaggtgcgttcatccgtgccggagttctacctgccgctggcgcaggccccacgtgacgcgatggtgatgatggtgaccgtgggagggacgggggcggcggcgtcgtcgctggcgctgtccttgcgagagggcatggcgtcgttggaccccgagcaaccaccgccgtcgccgcggcctttggaggagctcatcgcggagtcgttcggctccaggcacctgctggccgcgctgctggggttcttcgcgtgcgtggcgctgctgctggccgccgggggcgtctacggcatcatggcctactccgtcacccagcggcggacggagattggcgtgcgcatggcgctgggcgcgcgggaggggagcatcttctggttgatattgagccaggcgctgcggctcgccgggctgggggtcatcatcggctccgtgctggcgttggtcctggcgcggggcctgtcgaagttgctcttcgaggtcagccccgcggacccgctcgtcttcctcgggacggcttgcgtgctgctcttcgtggcgctggtggcgggctacgtgcccgcctggcgcgccgcgcgcgtcccgcccagcatggccatgcgcgaggagtga

SEQ ID NO: 4082 - DNA, 1506 bp, Myxococcus xanthus
atgagggtcccagggttgcgttatcgcgacgagtggctgcccaacttcttccccgcgaagcaggtgggcccggaccacttcgtgcggctgtcccggacgggcgccatgcaactgctgtccggcgcggagaatgcccagctcgatgaaatctccatggatgaggccctgttcgagcggctcgagcagaccagccacctcatcaccgcgcagaactcgtcgcgcgtgctggaggacctcaagcgctggcatgaccggacctacgcggggccggggctccatatcgtcgtgctgtccaagcggtgcaacctcaactgcacctactgccacatgaacccggagaacatctccgcggactccaagcgcttcgacatgcagcccgacgtcgcggatgccatcatccgcttcgcgctcggttctccggcccccttcctgggtttcgagttccagggcggcgagcccttcttgaacttcgagggcatgaagtacttcgtcgaggaggcccgcaggcagaacgaagccgtgggcaagcggctccgcttctccgtggtgagcaacctcatggtcgccaccgacgagcacatcgcgtactgcaaggagaaccgcatcaacgtgtcgtattcgttgaacggtcccgaggacattcacgactcattccgagtcactcggagcggggcgggcagcttccgcaaggtcatggagcggctgagccacttccgcgaccgattccccggcgtgctcagcgcgtcgcccctgtgcgtggtgggggcctccaacgccaaggagctgaagcgcaccatcgacttctatcatgcggagggcttcaaggacctcgccatcctcaagctcaaggccctgggcaacgcccgcaaggagaagctgcccttcgacatccaggacttcctccactactacctggacgcgctcgattacatctacgagaagaaccgccaggagaacgagaactactccgagcgcgtggtccgggtcgtcctggccaagattctccagtcgacggatacgggcttcgtggactggcgcaacccggtcggggacttcggttcggccatcacctatgaccatgacggcgaaatcctgccgtcggacgaagcccgttcgatgcgctccgagttcggcttgggcaacgtgaaggggacgacctatgacgcgctcatccgcaacaaggccacgttccggtccatgaacctgtcgctgcgggatcgtgacccgcagtgccgcgagtgcgccttcaatccctactgcggcgtgctgccggtgctcgactatgcccggaccggggacgcgacgccgcgcccccatgcgtccgaggaatgcctgcagacgttggcggtcgtggagtgggtcctgcgcaagctcgtggaggaccccatccccctgttgcggatgatgcctggaatggacgccgccctggtggagatggccaacggtctgccgacagagccttcctcgcaggccatgccgccgatgctgagcgtgcagagcggctga

SEQ ID NO: 4083 - DNA, 1110 bp, Myxococcus xanthus
atgggcaaccttgcttctctgctcatcgtccagcggctgcggggagaggtcacccacggcgaagccttcttcgtgacgccgcggacgctctactgcctgcctcggggtgagcggctcgacgtgcgcggccccggcgaggggcgcgtcgtttggcacttctctggcgcggagtgcctgctctccgtcgaggggcactccggccccgggctgcgcatcccgctgccgctcatgggcgatgcgcccgtgagcatccagccattgccctggtccgagacctggaacgttccggtgctggacgacagcgagatgctcggcatcaccggccggcgcgaccaggcgggcatcccggacgatgggagcacgggcacctggcggcccatgcccctgctgcaaagcacggaggaggccttccacatcctggggaagctgtggcccgaagtgctcgactgggcccgcgtgttgctccccgcgctcgtcgacatggggggcccggagaaccggagcgtgcgttgctcgtcctcgtatggggctggcacgcctgtcttcctcacgcgcgtggccaacggcctggagcatgcggaggacctggtccacgagctgcaacacgagcgcatgtatctgctgctcgactcgcgcgcattcggacggtgggacgactcacgtcccgagttcgtctccgcctaccgcaccgaccctcgccccctccgaggcgtgcatctgggcctgcactccttcctggcggtgaaccggctccggctgctggcgctggacaggcccgagttcaagcagcgggagtggcgcttccaactgctcaagtcacaccgctgcaacctgctctccttccggaccctcctggacttcgagcgtcccacgcccgaagggcgcgtgctcctcgcgcagatggcccaggccctgagtgagcagcatccgctcatcgagcgtgtcgcggatgcggacatggaccaggccttcgacacctggatgaagcagcacttctcgcgagtggccgccagcggtcccgtggtgaatgacgccgagacatacatgggctggcgcgaggcggcagtgctcgcggcccgctatacccagcacgccggaggtgccgcatga

SEQ ID NO: 4084 - DNA, 1047 bp, Myxococcus xanthus
atggcggggcggccgcgggaagaccgcctggagcgctacccggtcgacagagcgcattggatggccgccgcggtgactcgcgctcatgactcggcgctcgtgccctggaagcctccgtatcggctcgtctatggcgagcacgtcctggagcgctgcgcgctgctgcagcccggccgtcgtttcgaaccggcgcgggggcagcggcgtccccaggccctgctgacgaccttcttcacgggatatcacccgagcaaacccattcagcgttggggctggggagacaacaacgacctcgtgcgttggctggagccattcgaagccatccgggaagtggtgcgcgcatccacccgcgacctgcgctacttgctggagcggtgccaggtgtccgtcaacaagacccccgcggcggtcctggcgccccggacgctccgctgcctcgtggagggcaaggccttcgagctcgcggcgaggctggtctcgctcctcccgtcgaaggtctcggagcccacggacatggatgctggctacttcgccgctgtcgaggccgcgctcctgtctgagccggcgctcgaggagccgcagcgggaggacctggcggcctgcctgtggatggaccggggcctgttccacattcagtgcatgtcacgccggatgaaggagttggcccgccgtgacgagcgcaccgaggcgcttcgcgcgagccatcagtcggtcctgcgtgacagcctcctccagcgccgcccggtgttgggtccctaccacctgcgagtcacacgagacctggcgcggctgctggacgcgcgcccgctgtcgccggagacgtccgaggtcctgtgttacgcgagcccggcgggcatccgctatcagccgctgtcgacgctcgaggcgctcctgctggaccaatgtgatggacgcacggtcgccgagatggtcggcgacgtgagcgcggccctctccctgcctcacgacgacgtccggtcggccatcttcacgttcctgtcccatctgtcgcacgagtcgccgttggtgctcgactggagtcactga

SEQ ID NO: 4085 - DNA, 1338 bp, Myxococcus xanthus
atgaacctggggcgtccgacggacgtcaacctcttcgagcggacgttggattccatggcgtccctgctgctgagcgggcagagcgaggaggggctctggcccgtggcgccgctgtacgaggccggggacgtcgtctacggctcgctcgaggcatcggcggcgctgtgtatcgaagcgctcgtccggtacgtccgaatcgcgcgcatcgcggcggagcggaccgacaacttcctcccgggggcgctcccgcctcggtcgggcacctggaaggagacgttggcggccttcgacaatgattatccgcccgcgctgttttctcccgagtcgcgagcccgcctgctcgcgctgggtgaatggctgcccgcggcgctggagggagatgggggcttcgaggtccggctgctggaggggacgcctcgggtggacttcatcctggggatcaaacacgacgggcaggcgctgcttgctggcaggcatccgcactcagaactcccagcgcccttgttcgccgctcccgagtggcggcgcattcgcgacttcgcacgagcgtgggctgagccgggcgggctgctcgaccgggaagtcgacgcgttctggctggagttcgacctggacgcgcccgtcgcctcgcctccgctgcccatcgtgttcctctgcacacgggaccagcctgtcgccgtcaacgaagcgctccaccagcagaagtcggatacctaccgcgcgacgctgcacgcggggcttccgctcttgcgtggggatgaggcgccgctcacgcctgagcttcagcggggaatggatgtctgcatcgaggcgctgcctcccggtgcacacctctatgcggcctgcgtgatgatgtcgcggcgcagcaagaacctgcgcttcacgctcaagaacgtgcctcccgagcgcgtggtggcgtacctggaagccgtggcgtggccaggagacttccagcaactgcgggacaccctcgcgtgggtcctcccgctcggcgtcaatcgcttcatgctcaacctggacctggcgccgcagttgctgccgacgctggggctcgagtgctcgttccagggacgtgcgcagcccgccgaggagccccggtggcaacgcctgctcgacgaactcgtgacgcgggggctctgcgcaccctcacggcgtgacgcgctgctggcgtggccgggacgcacgcaggtcaatctgcccgctggctcggccacgcgagagagtgtcttcgataagcggctcgcgcacgtcaagctgggtttgacgggggccccggtgattgaggccaaggcctatctggccacacaccgcacgtccgagctgctccggccgcgctga

SEQ ID NO: 4086 - DNA, 2430 bp, Myxococcus xanthus
gggcgctatgtcctcgaggatttggccgggcgcggtggaatgggcgcggtgtaccgggcgcgggacacgctggtgggcgacgtggtggcgttgaagttgctggagttgggcgcttcgcccgcgccggagtggctggagcgcttccgccgcgaggtccgtctggcccggcgcatcacccatcggcacgtggcgcggaccttcgacctgggcgagcactcgggccgcctctacctgaccatggagtacgtggagggagagagtcttcaaacgttgatggaccgcgagcacacggtgcctcccgcgcgggcggcgcggctggtcctggcgctctgtgaaggcctggcggcggcgcatgccgcgggtgtcgtgcaccgggacttgaagccggccaacgtcctggtggaggcccgtggccgcgtggtgctcaccgacttcggcattgcccgggcattggcgggcgagggggcttcgcgcacgcagggactggtgggcacgcccatgtacatggcgcccgagcagttggagagtggcgaggtggatgcccgcgccgacctctacgccacgggcctggtgctctaccagttgctcaccggagcgcctccgttcgccggtgattcgcccatggccgtggctgtggcccgtctgaggcagccgccgcctgatccacgtttgctggcggcggtgccggatgcgctggcggagttggtgctcgcgtgcttgtcgcgtgagccctccggccggccgcgggacgcggcctgtgtggcggatgcgctgaggcagtggcttggttctgtcggcgaggccatcgagcccaaacatgcccatggcgtgcacctcgggacgcgaggacacgcgctgggtggcgatagcgtgtcctccgtggtgggaactcacggcacgtccacgccaaggtccagcggcgcttcccaggtttcggctgctacccatggcgcgtccacgccacagcccagcggtttcggccatgcctcgatgtcctcgggcgggctggtagctcgcacgccgttgcgccctgatgagcagtcgctggcggtgctgccgctgcgcttcctgggcgcttcagaccaggcatttctgggcgacggcgtgacggaggcgctcatcgacgtgctgtcgaggacgcggggcctccgggtgcagagcagcggggccacggagcgtttccggcaggagcgggaccctcgcgtcgcggcgcgcgagctgggagtggagttgctggtggatgggacgctccaggccgcgggcaagacggtgcgcgtgacgctccgggtggtggagggcgcgtcgggcacgcagctatggagcggccgtttcgacgatgcggatgacgacccattccagctccaggaccggctggggcagcgtctggcggaagccctgcgcggcgagttgaccatcctggcctaccgctccaccgtgccagcggaggcccttgccctctaccggcaggcgctctcccggatgctcgcgcactcgatgacgggcgaattgaaggacgaggtcatcacgccgctcgaacagcttcacgcctcggtgcctggcttcccgcacgcggcggcgcagcatgcggtggcgacgcttcgggcgggcttcatcagcaccctggcggacgaggtcgactgggatgccctggcgcggaccagcctggaacgggcccgccaggtggcgccggaactcgtggagacgaagctggcccaggccatcctggccacccgcgaaggccggtggcgggacgcggtggtggccttgcgcacggcgctcgacacggcccccacgttcgctcccgcgctccaactcctcggcaacctccaatgtgaggcggggcgcgcggacgaaggactgccgcgcttgaagctggcctactcactggagccgggcatgaccatctgcctggtcgaggtggcgcgttgcagtgcgctgcgtggcgatgatgcgacctaccagtggtgcatggcgcgcctgaacagtcagcccctgctgggcatgccggtcctcatcctccgcatgcgggtcgcggcctggaggggcgacatggacgacgtccgccagtgccgggacgcgttgaacgaagacccgagccacatggcctcctacgtggccacctactgctcggcggccctgggcgaggtgtcggtggaggccgcgatggcgaccctggacgacatgctcacccggcagcaggtgagctcgcgcttcgcgtcgatggtgtgtcagctcgcggcggagttgatgtgcatccggggcgcgcccgccgaggcgctgcgttatctccagcaggcggcgaacctggcgctcatcgacctggagtggatggaccgctgcccggcgctgacgcccctgcgcgcgcagcccggcttcgcggaggcgcggcgcaaggtgcgctcccgcgtggaagccatctggtccgcatga

SEQ ID NO: 4087 - DNA, 1773 bp, Myxococcus xanthus
atgaaacgcagtctcaacgggctgttgcccctggccctgcttggcttcttcctggcgcaggccgcccacgcggacgtcgtggacgacgtgtggcgcggcacgaacatccggctcaatgccgcgcgcatccgcgtgaaaggcaatgactacgccacgggctactggctgctgccgaaggcggcgaacacgctgaacctcaacgtgccggcgcggcagttcggtctcaactcggacctggtgctgcacatgtatggctcgcgctccgggaacgtcatcacctggaccttcgatgacaccttgcccagccgctacaacctgggggactccacctacgtgacgcgtgtgcgggggacgctcaaggcctacgcccggcaggtgcgtggctcggatgaccccttctgtaacagcgccgcctgcccccacaacgtggagctgacccttgcgcctggctccagcgcgaaggtgagcggctacaagaccttcatcttcgacatcgacttcacggaggacgtccaggtgaagcagttcgtcgcgtatggcggcgtcccgcgcccccggctgtcgtcgatggcggtggtcacccccagcagccgttgcccgtcctcggggcccagcgaactgtccggcgacgtggtgctcagcagccccgcgcccaccggcggcatcctggtggacctgatgagcgtggatgcgagcgtgggcgtgctgcccgtgcgcgtcccggagggccagcgctccgcgcgcttcacgctgcgcctgccgccctactggacggggcccaccgtcgtctacggcgcgtcgggcggcgtccggaagagcgtgaaggtgggcgtgcgcccgtgcctcgtacatgtcttccccttcgtgcgctggtacctcatcgattcgctctacgcccccgcgcacctgctcaacggtggggcggtgattgcccggtacaaggaggcggagtcggacgtcctgctgacgggcaagggcgaggcgtactggctgaacgaggtgctcggcgcggagcaggtgcgcgtgacgggcgtcaactcgacgggggacatcttcggcacggcatataccgccaagggccccaacgcgttcctgctccgttcggaggacgtgaaggcgggcgcggagcagtggcttgaaggctgggaggccgtgacggccaacgcacacggtacgctgctggtgcgtgacccgaacgacggcaagggcatctacctcgtagacgaggtggggcccgcgaggcaccctggcctgtccgagctgctcccgagccgcgtcctcttcaacgcgctgggggaggtggcggtgacgctggagacggagaaggggctccgcgccgcgcgcgtctacggcaaggacgtgcaggtgctgctggacaacgagtccgaggtcaccgcgctgaacgacgtgggggtgttcgtgggcaccgcgcttgattcggacaagcgcccccgtcctttcgtctggtcgcggcaggaggaggcccggtggctgccgatgcccaagggcgccgtgtccgcgaaggccgtggccatcaacgatggaggctgggtgctggggaccgccaccgccgaggacggcaagacgcaggtgcccttcctcgcctcacccgacgggaagacggccacgcggttggatgaggtgctgccggaggagttgaagaaggccggctaccgcgtcctgagggcgctcgcgctcgccgacgacttcagcgtgctggtgcaggccctggatggacaggggcagcgcgtccacctggtgctgagcccgtga

SEQ ID NO: 4088 - DNA, 771 bp, Myxococcus xanthus
atgaagatcgccacctggaacgtgaactcggtgcgggcccgtcaggaacggctgctcgcctggttgaagaaggcccagccggatgtcctctgcctgcaggagctcaagtgcgtggacgacgacttccccatggaggccgtgcgggagttgggctaccacgccgccgtccacgggcagaagacgtacaacggcgtcgccatcctcgcgaaggaggagccgaaggacgtcgtgaagggcctgtccgacggcgtggatgattcgcatgcgcgcctcatcgcggcgaccgtgggcggcatccgcgtggtgagcgcgtacgcgcccaatggccagtcggtggactcgccgcagtaccagtacaagctggagtggtacggccggctgcggcgctacctggacacacgggacaagcccgacgagcccctggtgctgggcggggactggaacgtggcgcccgaggacatcgacacctatgacccgaagttgtgggaaggccagacgctcttcacgctgaaggagcgggatgccctccagcgcctgggcgccttcgggctttcggatgccttccgcaggctgcaccctggcgttcagaagttcacctggtgggattaccgcatgctcggcttcccgaagaacctgggcctgcgcatcgaccacctctacgtgacggcgcccgtggccgaacgactgacggtcgtggacgtggaccgcgaggagcgcaagggcaagcagccctcggaccacgctcccgtgtggctcgaactgcgcgactga

SEQ ID NO: 4089 - DNA, 174 bp, Myxococcus xanthus
atgcgccgcaaccacacgaagcccacgtcccactccagcttccgcccgccggcctccgtgcggcgcgcgctggtgctggcaagcctcgtggtgctcggactggccctggcgtgggcggatgcgccgctgcccagggcactgcgcgcgtggctggccgcggaggagcctttagag

SEQ ID NO: 4090 - DNA, 1269 bp, Myxococcus xanthus
atgatcgcgaacctccacaacgccgacatcccccagcccgtgctggacgtcatcgcgcggctgcgcgacctgggccacgccgtctacctggtggggggctgcgtccgggacatggtgcgcctggtccaccccaaggacttcgacgtagcgaccagcgcgctgccgcaagaagtccagggcgccttccgcaaggtcatccccacgggcatccagcacggcaccgtcaccgtcctccagaatggcacgcacgtggaggtgacgacgttccgctcggagggggattacctcgacggccgccggcccagctcggtggccttcgagcgcgacatcgtcaaggacctgtcccggcgcgacttcaccatcaacgcgatggcctacaacccgctggaccgcgagctggtggacccgttcggcggacaatcggacctccggtcgcagctcatccgctgcgtgggctccgcgcaggagcgcttctccgaggacggcctgcgccccttgcgcgccgtgcgcttcgccgcggtgctcggcttcgcgctcgattccgccacccgcgccgccattcccgccacgctcggcgtcttccgcaaggtcgcgctggagcgggtgcgtgaggaactggtgaagctgctcctgtcaccccgggcggagagcggtctgctgttgctcgcggacaccgggcttctggacgtgttccttccggagctggcgcgcgcggaagcctcggccgccgcgtccgtccgggccgcggtgcaggcctcgccgctggaggtggaggtccgtgtcgcggtgctgctggccgatttggtggaccgagcccaggcgcgcgacatcggcctgcggctgaagttccccaacaaggtggcggacctggtggcgctgctcgtcgaacacgcgaaggcggagactcgtgtgggggagccggacgccgcgcttcgccggctcctggctcgcctggggccgccgcagcttccgctgtgggcagcggtcgttcgcgcccgggtcggagtccgccagccggacgcgctcccagcggtggaggcgctcattgcccgcgtggaggcgctcgccgccgcgaagccgccgttgacggcgaaggacctgtcgctgacaggaggcgacatcatggccgccctgggcgtggggccttctcccatcgtgggcgaggccacccgcttcctcgtcgagtccgtcctggatgatccgagcctgaacacggccgacgccctgcggcagcggttgcaggcgtggcaggcgcaggttgctcgctga

SEQ ID NO: 4091 - DNA, 1050 bp, Myxococcus xanthus
accatgcgagtcgtcgttgcgatgagcggcggggtggattcctcggccgcggctgccctgctcaaggagcagggccacgaggtcatcggtatcaccctgcgcgtctggtcctacgagggcaaggcgacgtgtgggagttgctgcagcccggatgacatcgatgacgcgcgggccgtggcccagacgctggggattcccttctacgtggccaacgcggaggagatcttccaggaccgggtcatcaaccccttcgtccagtcatacctgggcgggcgcacgcccatcccctgcgtcgcctgcaaccgggacgtgaagttcaacttcctcctcaagcgcgcccgagcgctcggcgcccggctggccacgggccactacgcccgcgtggaggaggtggacggccgcttcgtcctgcgtcgcgccgtcgatgccgccaaggaccagagctactttctcttcacgctcggccaggacgagctgcgcgatatcctcttccccgtgggcggcatgacaaaggcggaggtccgcgccgtcgcggagcggcacggcctggtcaccagccagaagccggagagcatggagatctgcttcgtgccggacggcgactacgcgggcttcgtggagaaggtcgccgggccgcagccggccggggacatcgtggacaccgagggcaacgtgctcggcacccaccagggcatccaccgctacaccgtgggccagcgcaaggggctcaacctggggggcggcgagattcgctatgtccaccggctggagccggagacgcagcgcgtggtggtgggccccgccgagggcaccggccgcgacaacttcggtctgctccaaccccactgggtggacgggccgcctccggccagtcagccggtggaggtccgcatccggcaccgccactcgggcgcgcaggggcgggtgcatgtctcgccgcacgggctcgtctccgtgaagctggacgcgcccgcgcgcgccgtcacccccgggcaggccgcggtggtctacgatcaggaccgcgtgctcggcggcggttggattgtctga

SEQ ID NO: 4092 - DNA, 783 bp, Myxococcus xanthus
atggcgcagcgcctcgtgggatgtctgatcgcggtcgtcaccgtcttcgcggccgctggctgcaaggagcgctcggacaaacccgtcgcggggctgctcgccgccggtgcgccggtgctgcgcgcggaaggcaagcagtggcggcccatcgccgtcggctcgcagttgctggggcatgacgagctgaaggccaccggccccgcggtgctggagttcttcggtggtggcctgcgcttcctggagaagggcgacacgctggaggtgggcgaagcggacgaggcgaagctccatggcgtcaacctgccgtcccgccacattgtcgagggcaagctccaggaggcgccgcgcccgctgcgcatcatcgccgcgcgctacacccaggtgcaggtgacgcccgcgagtgcccagcaggaagacccgtacagctccaacggctacttcgtcgccttcttcacgcccaacgggctgtcgcccaacaagacctctgacgaaccgtcgcgggatggccctcgcaagccgttgccgcctccgccacaccgcccccgcgtgccccacatccacgcaggcaacctgggcgagggcggtctggtggccaccgtggaggatggcttcatcgtggcggagacggacgacctggccaccgccgtgctgctggaagggggcgatgtgccgctgggccgcacggtacgactgatggtgcccgccggcacggaggtggtcctgcgcacgcagcagggacgcaagattgaagtcgaagggcccgcggacgtccggttgcggtga

SEQ ID NO: 4093 - DNA, 384 bp, Myxococcus xanthus
atgacgcgcagtgagctcatcgagcgcatcgtggagcgtgccacgcatgttccacggcgtgaggtggaagccatcgtccacgccgtcttcgaggaaatgtcccaggccctgatcgccggacggcgaatcgagctgcggggcttcggcgtcttctgcgtccgcacgcgccgggctcgcacgggccgtaaccccaagacgggccagcgcgtgtcggtgcccgcgcggcgcacgttgtccttcgccgccggaaaggacctgcgcgagcggctcaatgccccacccgccatggcggcttcccccgttccggacaccccacccggggaggcgctgtcgccgctgccgctcgccgcgggggcttcgttctccgtgcccgtcacgggttga

SEQ ID NO: 4094 - DNA, 861 bp, Myxococcus xanthus
atgaaggagaagttcgacgtctctctggacaaccggcagatcgtcagcctgctcatcgccggcattgtcgtgatgggcgcggtcttcgtgctgggggtcgtcgtcggcaagaagctcgcgggcaacgcggatgccgtggccgcgccggacctgctctccgcgttggatgccaacgcgcaggcgctccagaatgtgcagcaggagcagccgctcaccttcccggacgaactgacccgcaaggccgctgccgagccggtggccccgccgcagcccaagcccgttgtcgccaaggctccgccgccgacggagaagcccgccgccgcgaagccgcccgagccgaagccggccgccgcgcagcgcgccgcgctggcgcccacgccggacccggacacgggggagctgccgccggaggagcccaaggccgagccggagcgcgtcgtggtcgccgaggcccccaccgctccgactcccgcgaaggccgtgccggtgtcgggcaaggtggaggcgtccgccgtccccacgcgcaccaccaccacggagggtggcggcctgaaggaggccattgcccgcgccacccagcagccggcgcagcccgcctcgccgcccgcgcaggccgtgaagggtggggccttcacgctccagctctcggcgttccaggacaagcaggaggccgaccgcttcgccgctcggttgcgtgatcggggctatgccccctatatcctgacggccgaagtggccggtaagggcacgtggtaccgcgtccgcatgggaagcttcgcctcccgggatgcggccacccggtatctgtcagacttcaagcgtgagacttcgctcgacgcattcgtggccggcacgaactag

SEQ ID NO: 4095 - DNA, 363 bp, Myxococcus xanthus
atgacgacgacgaagcgggtggagaagccctggggatacgaactcatctgggctcacaccgaacgctacgtgggcaagctgttgcacgtgaagcagggccacaagctcagcctgcagttccacaaccgcaaggatgagaccatccacgtgcagagcggcaagctgctcttcgtcgtcgacgagggccaggggctcatcgagaaggagatgaaccccggtgagagctaccacatcaagccgctcaccaagcaccgcatggtggcgctgaccgactgtgacatcctcgaggtcagcaccccggagctggacgacgtggtccggctcgaggacgcctacgggcgcaccggcaccagcaacccgtag

SEQ ID NO: 4096 - DNA, 180 bp, Myxococcus xanthus
atggcccgaaagaaagtcagcaccaccatctacatcaccccggagcagaacgagctcctcaaggcgctgaaccagaagacgaaggtgcccgtggccgagtacatccgccagggcatcgacctggtcctggagaagtacaaggcgcagttgccggggcagtcgacgttcgacgagctgtga

SEQ ID NO: 4097 - DNA, 1953 bp, Myxococcus xanthus
agcatgcgtgggaagcgggtagcggtcctgggcggcgccggcttcgtcgggtcgcacctgtgtgagcgtcttctggatgacggcgcggcggcggtcatcgccgtggacaacctcatcactggcaacgaagagaacctgcgcacgctgaacgggcggccgggcttctccttcgtcaaggcggacatcaccgagcgcatcccggtggaagggccgctggactacgtcttcaacatggcctcgccggcctcgcccatcgactacgcgcagctcccgctggagacgctgcgtgtgggctccattggcacggagaacgggctgaagctggcggaggcgaacaaggcggtgttcctgatggcctccacgtcggaggtatacggggatccgctggtgcatccgcagcgcgaggactactggggcaacgtgaatcccattggcccccggtccgtctacgacgaggccaagcgctattcggaggccatcaccgcggcctacgggcgcaccaagggcgtgcaggtccgcatcgtccgcatcttcaacacctacggtccgcgcatgcgcctcaatgacggccgcgtggtgccggccttcgtgggccaggcgctcaagggcgaggacttcaccgtcttcggggacggcagccagacgcgctcgttctgttacgtgaaggacttggtggacgggctggtccggctgatgctgtcggatgagtcgaacccggtgaacatcggcaacccccgggagatgaccatccgtcagttcgcggaggccgtgcgcgcggcggcgggtgggggtgggagcatcatcgagaagccgctgcccaaggatgatccgaagcagcgtcagccggacatcacccgggctcggacgctgctgggctgggagccgaaggttccgctggaagagggtcttcgggagaccattgcgtggttccgagaggttgccggcacgaagcccccggcatagtttgccggcgcgaagatcctgcatggcctgcaggcgggaggttgcgtgaaggtcctggtgacaggtggcgcgggcttcattggctcgcatgtgtgcgatgagttcctgcgcggtggtcacgacgtcatcgcgttggatgacctgtccggcggcaagcgggagaacctggacccgcgtgtgcgcctggcggtccacgacatccgcagccgcgaggcgtcggagctcatcaagtccgagaagcccgacgtgctctgccacctggcggcgcagatggacgtgcgccgcagcgtggacgacccgagcttcgacgcggacgtgaacatccgcggcatgctcaacctgctggaggccgcccgcgtctccggggtgaagaaggtcatcttcagctccaccggcggcgccatctacggcgagcaggacgtgttccccgcgccggagagtcaccccacgcggcccatttctccgtacggtgtctccaaggcgtccggtgagctgtacctgggctactaccgggcgcagtacggcctgccctacgtggccctccgctacgccaacgtctacggcccgcggcagaacccgcacggtgaggcgggtgtggtggccatcttcagccagcggctgatcgccggtcagggctgcaccatcttcggcgagggcaagcagacccgcgacttcgtctttggtccggacgtggcgcgcgccaaccggctcgccttcgagaacgactacgtgggcgccatcaacatcggcacgggcgtggagacggacatcaaccgcctctacgcgctgctggccgaggcggcgggctccagcgtctccgtcgcccacgcgcccggcaagccgggggagcagatgcgctcctgcgtggacaacgcgctggccaggaaggtgcttggctgggagccgagcgtcgacgtgcgcgagggcctgcgccgcacgcttgagtacttccgtcagaaggccggcgcgcccgctcgcgcgcacggctga

SEQ ID NO: 4098 - DNA, 1671 bp, Myxococcus xanthus
atggacggcacgctgagcctggagggtgagctgacgctccaggccctggaggtccgcgcgaatggcgcgcgcgtgcggctggcggtgaagcggctggatcggcacgacgcgacgctctctggccaggcgctcttccccgacgccgcggccgtgcaggcgcacctgccccagacggcttcggcgtggctggagctggacgcccggggcgcgctggtggccgtccggttctccgacgcggagccgcccctgttccgccaggtcgcgcagacgctggcggcggagttgttccccacggagctgcgcgacgccgccgagtggagcgccgttgagtccacgcagacgggcgaggtggaggcgcgcttccagttcgacggcgaggacgcacgcctgacgcgccgccgtgcgcgctaccagtccctgcgtgccgccgccacggcgccagccttccggcaaacgctgagctccctcacgcacttcgaccgggacccggagggcttcctggccggggtgtcccacgacgaaatcctggatgccacgcacaccgatggccgctcgctgatgtcgcggcgcgtccgcctgcgcctcgcgttctccacgcgtcagcagaagccgctgccgccggccacggaggacaagcccattgtccgcgcgccgtcgcaggtggctttcgagggcgacgaggcgctggcgctgacgaccagccaggccgacggcatgacggtggacgcggcgctccaggtgctggcgtccgccaccgaccccggcgccatccccgagctgggcaccttcgcgcggagggccatcgccgcgctcaaactggagccccaccgggccggtgagctggggcaactgttcctccagaagggcaggtctcccgcgatgcgcgagctgatgctggacctgctggccggcgcggggcacgccgaggcccaggccacgctgcgcgagctgattgtctccacggaggcccgcgagcatgccggcgcgcatgggctgatggtgcagcgcgcgggcctcctccgcgagccggagcccgagacgggccggctgctggcgcggatgaacacggaggcccggaccgcgggtgacgtcggcgccgagcgcgcgtccgcctacgccctgggcgccgtcgtctcccgcctgcccgcgggcagccccgaggtggccgagttcctgcgcccgctggaggacgccctggcccgcgcggacaacgccgagtcgctggagcactccctgcgcgcgctgggcaacagcggcacggagcgcgtcatggacctggcgtcgccccacttgcgtgacgaggcgcccgaggtgcgctccgccgccgcgggggccctgcgcaccgcgccccaggaggccgccacgcgcatgttgctggacgcgctgatgtccgagccagcgcgtgccgtgcaaggcgcgctgctggacgcgctgaatgcgcgcaccctgggcgcacccgagctggagcgcctgagcggctgggtcgtggcggggcaactggcgccgggggccgaggccgcgctgctcaacgtcctcaccccccgcatggacgacagcgccgccgtcctccggatgctccaggccctctcggtccgtcccggccagcagcccgccacccgggcccgcgtcatggcgctgatggcccaggcctcggccagccgcggcggctga

SEQ ID NO: 4099 - DNA, 1815 bp, Myxococcus xanthus
atgccggctgaaaacgcgcatatccgcaacttctgcatcatcgcccatatcgaccatggaaagtcgacgctggcggatcgtctcctcgacaagacggggactctgaccaagcgcgaggcgcaagcccagttcctcgacaacatggccatcgagcgcgaacggggcatcaccatcaaggcccagtccgtgcggatgaactacaccgcgaaggacggcaagcagtacgtcctcaacctcatcgacacgccgggacacgtcgacttcgcctacgaggtcagccgcagcctggccgcgtgcgaaggcgcgctcctggtcgtggatgcgacgcagggcgtggaggcccagacgctgtccaacgtctacatggcgttggaccacaacctggaaatcatcccggtcatcaacaagatcgacctgccgagcgcggacgtggatcgcacgcgcgcggagattgaagacgtcatcggcatcgatgcgtccgtcgccgtgccgtgctccgccaaggagggcatcggcatccaggacatcctggagtccgtcgtgcagaacgtgccgcctccgagcggctccgcggacgcgccgctcaaggcgctgatcttcgactcctggtacgacaactaccggggcgtggtgacgctggtgcgcgtgctggaaggcacgctcaagctgaagcagaagatcaagctgttcagcaacaacaaggtcttcgaggtccaggagctgggcgtgttcagcccgttctcccgcccggtgccgcagctcatcgcgggcgaggtgggcgtgctcgtggccaacgtgaaggagctgcaggacgccaaggtcggtgacaccgtcaccgaagagtcgcgtcccacggccgagccgttcccgggcttccaggaagtgaagcccatggtgttctccggcatcttcccggtggactccgcggactacgagaacctgcgcgacgcgttggcgaagctggtgctcaacgactcggcgttcacctatgagccggagtcgtccaccgcgctgggcttcggcttccgctgcggctacctgggcctgctgcacatggagatcgttcaggagcgcctggagcgcgagtacaacctgaacctcatcaccaccgcgcccagcgtggtgtaccgcatcaccaccagcaagggtgaaacgctgctggtggacaacccggccaagctgccgccggttcagcacatcgagaagttcgaggagcccatcctcacctgccacatccacgtccccaacgaccacctgggcgccatcctcaagctgtgccaggagcgccgcggtgtgcagaaggacatgaagtacctgggcagcagcggccagcgcgtgcaggtcacctacgagatgccgctggcggaggtcgtgttcgacttcttcgacaagctcaagagcgtctcgcgcggctacgccagcctcgactacgagctggcgggctacatcgagtccgacctggcccggctggacatcctcatcaacggggacccggtggacgccctcagcgtcatcgtgcaccgcgagcgcgcctacctgcgcggccgcgaggtgtgccagaagctgaaggaggtcatcccgaagcagatgtacgaggtcgccatccaggcggcgattggcgcgaagatcatctcgcgtgagaccatctccgccatccggaagaacgtgctcgccaagtgctacggtggtgacatcagccgcaagcgcaagctcctggagaagcaaaaggagggcaagaagcgcatgaagcaggtcggaacggtggagattccgcaggaagccttcctcgcggtcctcaagtcggagcagtagccc

SEQ ID NO: 4100 - DNA, 1206 bp, Myxococcus xanthus
atggcggcccgccgcacgccggagatgcttcgcgcccgcaatgtgctggtgtggcgcgagcgcctcaccagcctctgggctccgttgatcatcctggcgctgctgtacgtgccgtacacggtgatcatcgagtactcgcgcgcgtccgccgtgtgggcccagccggtgatgaaggggctggggctgctgctggtcctctacttcgtggccctgctggtgtggcgcaacgtctcccccaagaagaaggcgctgcgcggcgtgcgccatgatgcgaacgagctgctggaggagaacgagcgcatcctccgcaagcccggcgtgagcgcgaaggtggcggggccggtgctggaccgcatcgccgagcaggcgctgcgcgtggagcaggcctccgccgcgggtgacgcggagcaactgcgcaccgaggtgaagggcctggaggcgttgaccgcgcagcatctgggcgcgttccgcaagcagtccgccatggacttcctgggcgggttcggcaaggcgctgctggtggcgctggtgttccgcaccttcatcgtggagccgtaccgaatcccctccggctccatgctccccacgctggagattggcgaccaggtcttcgtcaacaagttcatctacggcgtgcgcgtcccgttcctcaacttcgtgccgttcgtcatcgtccggccgccggagcgtggagacgtcatcgtcttcaacaacccggtgaacgagtcggtggactacatcaagcgcgtggtcggcgtgccgggcgacgtggtggaattcatcaacggcgtcgtccacatcaacggccagccgcagaagcgcgagctcgtctccaacgagttcaccgtccacaacatcaccgacgacgggcgctggtacgaccagcaggagaccctctacgaggagaacctgtccggcgtggcgcacgccgcgttgcagacgctgccgcgcatgccgcgccgggaaggcccctacgaggttcctccgggccacgtcttcgccgtgggtgacaaccgggacaacagcgcggacagccgccacggcctgggagtcacggggtacggcaaggcggagtacgtcccctacggccacatcaagggcaaggccatggtggtgtggctgtcgctgggctatcacgggctgctgcacggcctgttcggtggcaccggcctccgcgtggatcggttcttcgaaccggtccgttga

SEQ ID NO: 4101 - DNA, 2205 bp, Myxococcus xanthus
atgagacacctgcttggaatcgaaggctggcgccgggacgagctggagtcactgctcgaccgggcgaaggcacacctccccggcggtcccgacaccacccacctgcttcgcggcaaggtggtggcgaatctcttcttcgaggactccacccggacccgaacgtcgttccacatggcagcgaagggtctgggggccagtgtgctcaactggactcacaccggctcctcggtgtccaagggtgagacgctgctggacaccgcccgcaacatcgaagcgacggggccggtggccatcgtcatgcgtcatcgctcgtctggagcgccgcacctggtggcgaagcacgtgaagtgcgccgtcatcaacgcgggtgatggcacgcacgagcacccctcccaggcgctgctggacgccttcacgctgcgccagcgctggggctcgctggacgggcgcacggtgctcatcgtgggcgacgtgctgcacagccgcgtggcccgctccaacctgcactgcctcaaggcgctgggcgcccaggtggtgatgtgtggcccgcccacgctgcttccgccggggctggagtcgctgggcgcggaggtgacgcacaacctggatgctgcgctccctcgcgcggacgcggtgatgtgcctgcgcgtccaactggagcggcaggagcaggcgttcctgccgtccacgcgtgaatatgcacggctgttcggcctcaacgcggcccgcgaagagcggatgaaggcgggcgcggtgagtgatgcatccgggccccatcaaccggggcgtggagctggcgccggcggtggcggatggcgcccgcagcgtcatcctcgagcaggtgtccaacggcgtcgccgtgcggcgggccatcctggaggtgtgtacggcatgagctccacggtgctcttcaggcgggggcgtgtcatcgaccctcgcaacggggtggacggcgtccgcgacgtgctggtccgcgacggcaaggtggtggaggtgtcggtgaccctgctgccagtgccctccagcgccgaggtggtggatgccaccggcaagtgggtgctgccgggcttcatcgacctgcacgtccacctgcgcgagccgggcgaggagggcaaggagacggtcctcaccggctgccgcgccgccgtggcgggtggtttcaccgccgtggtggccatgcccaacaccaaggtggtcaacgacaacgccatggtgacggagctggtgctgaaccgcgcccgcgccgcgggcctgtgtcatgtctatcccgccggggccatcaccaagggcctcaagggcgaggagctggcggagatgggcgagctggtgtccgccggctgcgtggccatcaccgatgacggccgcccggtgatgaacgcgtcgctgatgcggcgcacgctccaatacgccacccagttcgacgtgcccgtcatggtccacgaggaggacctgacgctgtccgcgggcggggccatgcatgaaggcaccacgtccacgcggctgggcctgcgcggcatccccgcttccgcggaggtggccatggtggcgcgagacctggtgctgctggaggagacgaagggccggctgcacgtggcgcacgtgtcctgcgagggcagcgtgcggctcatccgcgaggccaagcgcagcggtctgcgcgtcacctgcgaggtggcgccacaccacttcatcctggatgaccgcgcggtgggggactatgacacccacgcgaagatggccccgccgctgcgcgcggacaccgatgtgcaggccctgcgcgaggcgctggtggacgggacggtggacgccatcgccacggaccatgcgccgcacggggtgttggacaagcaggtggagttcgagaagggcatcaacggcatcgtggggctggagacggccctggggctgacgctggagctggtgcatgcgggcgtgctcaccgcgaaccgcgcggtggagctgctgacgcacgggcccgcgaaggcgttcggcctgccgggcggtcacctggcgcctggggcgccagcgcacgtcacggtggtggatccgcacgcggagtgcacggtggacgcccaccagttccattcccgcagccggaatacaccgttccatggccggaagcagaagggtcgcgttatccagacgtgggtcgcgggccacaaggtgttcgacaagggccaggtcggccagagcaaggagtcgcggtga

SEQ ID NO: 4102 - DNA, 1125 bp, Myxococcus xanthus
atgacgaagcgggcagtgctcgccctggcggatggcaccacgttcgaaggccgtgcgtttggcgcggtgggcgaaacggtgggtgaagtggtgttcaacacgaccatgtacggttaccaggaggtcctcacggacccctcgtacgtgggccagattgtcaccatgtcgtacccggagattggcaacgtcggcgccaacccggaggacgaggagggctcccgggtgcacgcggtgggcatggtggtgcgcgccctcagcgagcagccgtccaactggcgcgcgaaggagtcgctggacgcgtacctgaagcgcaacggcgtcgccggcatcgagggcatcgacacccgccgcctggtgcgccacctgcgcacgcatggcgcgcagatgggcgtcatctccagcgagggcctgtcccccctggccctggtggagcgtgcccgctccgcgcgcggcatggagggcctggacctggccacgggcgtgtccacgaaggaggcctacaccttcacccagccctcgccggacgtcttcaccggcttgggagaggtgcgggtgccggccgagccccgcttcgacgtggtggcctatgactacggtctgaagaagtcgatgctgcacttcctggtggatgtgggctgccgcgtgacggtggtgccggccaacacctcggcggaagaggtgctggcgcgcaagccgaacggcgtcttcctggccaacggccctggagatccggcggcggtgaagggcgcggaccgcaccgtggcggcgctgctgggcaaggtgccggtgttcggcatctgcctggggcatcaaatcatggcgctggccctgggcggccggacgtacaagatgaagtttggccaccggggcggaaaccagccggtgaaggacctcacgacgggcaaggtggaaatcaccgcgcagaaccacggcttcgccgtggatgacgccagcctcaagggcctggccgtcgtaacgcacatcaacctcaacgacggcacggtggagggcctggccgtcccggacgcgcgggccttcagcgtgcagtaccaccccgaggcctcgcccggcccccatgacgcgcgctatctcttcgacaggttcgcgaagctgatggcggggtag

SEQ ID NO: 4103 - DNA, 666 bp, Myxococcus xanthus
atgacctcgtcgctgtcaccgctctcctatcagccgtatctggatctgctcatcgcctttggcagtgccgagccgcgcaaggaggatttgctccaggccaaggcggagtacttccgtctgacgggcgaggtcttcgaggacgacaagctcttcgaactgcggatggcgtccttcctggacttctacctctatgaccgcgtctcgccgctgacgaacaagacgccggccacggagttctacgagcagcgcctggccggttccgcgcccgaggaggccaacgccttccggagcttcacggagacggtccatggcctcttcgaggtccgcaagctgggcaagggcgaggtccgtcttcgcgagctgtactcgggcaaggacttcgacgtgacggagcgccgccacgtcgcgggcctggagacgggggacatcatcgaggcgcgcctcattcccttcggtgggcacctgctgttctcctccgcgttctgctaccacccccgcatggccgtgaaggccatcaaggcggaggtgaagcgccgaaagaagaaggagccggaccgcacgcccaacgagctggtgtgggagtgcgcccgccgttcgctcaacatggagcgctaccggcagctcgccgtcgagaagatctacgacttcgagcagaaggtcctctga

SEQ ID NO: 4104 - DNA, 846 bp, Myxococcus xanthus
ctgcgcatcgtgggcagcgtggtgcaagcgctggcgctgatccgctccttcatcctggtccacgactacttgcacggttcactgctgtcgggctcgcggatcgccaaagccctgttccacacccacgcggtgctgctgctcacgccgccgcgcgtctggaccgagtcgcacaaccaccaccatgcgaacacggcgcggctggctgcctccgcgtcagggacgttcaccacgtggacggcgcagcagtggcgagaggccacggcgctggagcggctggcctacgtggtggagcggcatccgcttgtgatgatcttcgcgtacccgctcgcgttcctgggtgggctgtgcatcgtgcctttcgtgaagcacccgctgcgctactggagcgcgggcttcgccgtgctcctccacgtgaccatcagcgcggcggtgttccacttcgggggcctgggcgtgtacctcacggcgatggtgctgccgctgtccctcggctacgcgctgggggcgtacctcttcttctcccagcacaacttcccggacgtcgcgctgcgcgaggacccggactggacgcacgcgagcgcggccctggaggcgtcgagctacctggcctgcggccccgtcatggcgtggttcaccggcaacatcggctaccaccacgtccaccacctcaacccgcgcatccccttctaccggctgccggaggccatggccgccatccccgaactgcagaacccgcgcaccaccaccctgcaccccagggacgtgctggcctgtctgcgactcaacgtctgggacggaaagcggggtcgcatggtccggttccgggacgttcccgcgtcacgctga

SEQ ID NO: 4105 - DNA, 645 bp, Myxococcus xanthus
ctggaacgcgcgttccgcaccgtgctggccgaggaactcgccgggcaactgtcgccgctgacggacacgcttctgcgcatcgcggagagcctgtcccccagcggcctccggcgccagccgcggcgtgagctgccgaacgcggccctggacgccctggcgtcgtcgctcgcgaccctggatacggggcccgacgacgccaccgaggaagaagtcgccccggaagcccgagcctgcgccgtcatcggctgtaagcggccggtgcgcagcctgggctactgcgcggcccactaccagaagcggcgcctcatggtggcgtccggccgcctgcaccacgcgtggacggaagacgccgcgccgaacagcattccggacgtcatcctgggccggaagcgccgcgagtcttcggaggcaccggagaccgccgtcaccccggagcccgtgcgtcccagcgaggggcctcgcgtctgggtccgcaagaagggcgccagccccgtggtcccgacgcccagtggcgacagcgcgccgattctgcagttggcccaggcttcggtgattccgaccgcgcagcgctccgagcgcgagcaggtggcatccatcgtcgagcagtgggccagcgagttccgggccaacaagcatcgctcgtaa

SEQ ID NO: 4106 - DNA, 2133 bp, Myxococcus xanthus
atggaccgccgagccgccaccctcctggcctacctgggcatggagggccccgcgtcgaaggccgccgtgtcccacctgctgtggccggactcaccgcccgccgccgtgcgcaacaacatgcgccaactgctgcgccggctccggctgagctgcggcggcacggacctggtggacggggactcccaacgactgggcctgtcaccagacgtcacgctggacctcgcgaggctgaaatgcgccgcgggaaagcccctgtcccccgatgtcctccaagcgctgctgcagggcaccggcgtcggcctgttgacgggagtgagcttcgacgactgcgacgagctgtcgcggtggctggatggagcccgtgccgccgtggagggatgggtgcgcaacgcccgggaggccgaagtccaacgccgcatggacgcgcgggactggcccaccgcgctggccctggcccaggcctgggtgcagcaggagccggagtccgaacaggccggccgccacctcatccgcctgcactacctccggggtgaccggggcgcggcgctcgcggccttcgagcggctgcgcagcacgctgtcacacgacctgggcgtcgctcccatgccggagacgctcaccctggtgcgcaccatcgaaaaggatgcggcgtggaccgcctccccccagcccacccgagcaccgctgcccatgagcgtgatgcgcccgcccgtcctcgcgggcaggcagcacgccctgcgccagctccaggaaggcctggaggcggggcagttgctcttcgtggcgggagacgcgggcagcggaaagacacggctcgccgaggagttcgccgcgtccgtggggacgtggttccggctcgaagcacgcccgggtgaccaggaggtgccctatgcctcccagacacgcgcggtccgagcccacctggcccggcggcccggcatcgtgatgccggactgggtccggacggagctgtcgcgcatcgtgccagagctgggcaatgggaccgccctgccaccgctcgcctccgaggccgacgagctgcgcttctacgaggcccacgcggaggcgatggccctgctgcacgagggtgaccaggtcatcgtcgtcgacgacgtccaatactgggaccaggccagcgcgaagctgttcatgtactcgctggcccggatgatggagcggaagtacgaagcgccggcccgcgcgcccgccttcatcgactgcttccgcaagggagagctcccgccctactccgaagccaacgtgcgcaaactcgtggacacggggctcgcgcgtgtcatcgaggtggggccgctcgcgctcgaagaggtccggcaactgctcgcgggcctggagcttccgggcgcagaacctcacgccgaggcgctgacgcgctacacggggggcaacccgctgtacatcgtggagacgctgaagcacctcatcgaaacggacgctctccaccgggactggccgcgccggctcccacctccggggcgagtggggccgctcatccaacgccgtctggagcgcctcacacccctggcccggctcacggcgcagttggcggcgcgagcggacctccacttccgagccgcattggcgcccgaggcgctccaggtcagcgtggcggagctgcacgcggcgctgtccgagctggagtccgcgcagatcctcgtagcggagcgcttcacccacgacactggtgctgggaagcggtcccacgcccagcgtgtccgactccgccgcccgcttcctgcacggccggcttgcacgcgtcttcgaacgggatggcgcgcccgccatcatcctggcccaccactggatggaagcggggcaggaggaccgcgccctgcccttcctgctcgccgccgcgcacgcggacgaacagttgctgcccaagggacaggccgccggacactacgctcgcgcggcggcgctgctcgaagccgtgggtcgcggctacgaggccgcgaacgctcgcgcggccgaatcgcgatgccgccagtcggaaagcgcatctacgccgggtgcctccagcgtggagcgctgagacgtcacgtcaggggcagtaggtgcgcaaccaccgacaccgcgacagtcgagatgtttcgcacgggcaattcctctcagtga

SEQ ID NO: 4107 - DNA, 2352 bp, Myxococcus xanthus
gcgcccgtagcctcgcagacaacacctcgcatccccttgttgcccgcgtgtcctcgcgttccccgtggcctccctctggagcgcgggtggagcgcctccggcacgcgccgtgctctgggccaccgccgggccgagcccggagccggtccctcaacaaggacgacgcgttacatgaatcagcggaaacacacgaaacagctacgccgccagttgcgttgggcgggcttgtccgcgacggtgctggccgcgcccgcgagcttcgcgcaggactgtcccaagcccacgtcgcagcagtgcgtggacgccgactaccgcgccggcagttgcggcagcgtccacgacgcgtactgccagggggtcgtggagtcggagtggaaggccggttgggaggctgctcccaagcgcgtggcgctgctgcccgaggagctggggggcggggtggacacggtggcctacgcgccccacatcccgaagcacacgcgcttccagggcatggaccagagcatcatggggcaggtgctcaaggggcagattctctaccgcaagagcctggagaacctgacgaaggaggagcaggtctacctgtctcggattcggagctgggagaaggacggcacccaggtgacgtcctgccaggagttcgttgacgagaagtacctcgacttcagccgcttcgagcggcaggcgggccggtacggcgacgactaccgcgccttcttcaacggcgccttcggcaaggacggcatcgcgcaccgcgtgctctacagcggggaccaggagaagctggcgcccatctgggacgggcagcgcgcggcgaagaacgcgtacttccacttcacgcccggccgctacccgaagggcatcgacggctacgtcttcaagtccgaggcggcgaagctggccaacaacgtggaggcgcgcaactgggtcgctccgtcggacgaatggcaccagaagcaggccgagcagttcagctacatcgcggatgacgtgctcaaccactaccaggtggagcaggagtccttcaccgcgctgctgcgtcagcgcgacgccgtctacgcggagtgggcgcaggcctcgaaggtcctccgctcgcgcgaccacgagacggtggagctggacaagctgaccgcggagcggctgtacgggttggaccaggccatcgaggagtcgctggtcaaggcgcagaaggacggctgcctcgacacccagggccccacggtgtgtgactggagcccccgccgctacaagacgatgctggaggccgccatggccccgcgccgcgaggccgacctgcaggcgtgcctcttcctgaccggcaacgacttcggtccggagagcttcgtgcgcaacgcggacaagctcgaggtgaagggcctggaccggaaggactacacgctctcctcgtcgttgctggcgcagtacctcgccctctacggcgcccacatccacgggctgaacacgccgacgaacccgtccacgggcgcggtgcggcacgggggagaggccagcgacagtggctacgcgggtggcgacaccttcggtggtggctacaactacgtggccggctgggagtacgtccagccgggctcgggcctgcgcaacaaggccctgggcgcctggtgtgacagcgacgtgcggctctacggcgagttcaacgcctatgcgaacgtgttcggtcccacccggcacgagatggcgcacgtgagcggcgaggctggcacggaaggcaatggcatccgcctcaagctggatgcgcgcgtgctgggcacctctctctacagccacgacaagcactacccgctgcgcttcaccttctatgagggcaagcccgtcttcgacagtgacgccgcgaaggcctccacgaccttcgtcgtcgtgttcgtccccgtcaccgtgcagggcggcctgtccgcggaggcgggcgtgaagatgaacattggcggcgccgtcacccgcaattgctccgaagacctgctgggcgtggacctgtacgggaccatcaccccgttcgcctcggtcaagggcttcgcgtccgtgggcatcggggttccgggtctccaggtgggcgtgaggggcgagctggtcatcgcccgcgtcaacgtgccgctctatggcgacatcggcctctacctgagctcgccctcgcacccgacgaatccgaacacgctgttcctgagggcgtcgtcgaagctcgacatcgagctgcgcttcctggacggcagcatcaagctcttcggtgagctgctcttcctgaagggcgagaccaccatcgtgagctggagcggcttcggcaacacctggaacatctacaacgagtccaagtcgctgccgctggtccgcgtctactag

SEQ ID NO: 4108 - DNA, 600 bp, Myxococcus xanthus
atgccacgctacaagcagttgattttcctaggcctcatgacctcgggggccctggcaggctgcgccagtagcaagtcggcggagcaggatggcgcgggcaccgcgaggggccggcaggccggggaggccatccgcccggaacgcggggccaacgaggaagtcacgcagcaggacgccaacggcgacggccgcccggacgtgtggacctacacggtggacgggcggaaggtgcgccaggagctggacctgaactgggacggccgcgtggacctgacgcgctacttcgacgccaacggcgacaaggcgcgtgagtcactggacctggacttcgacggacgcgtggacgccacctacttccatgagaagggcgtcaacacgcgccgcgagcgcgacaccaacggtgatggccgcccggacagcttcacgtactacgaaggcggcaagctggtgcgcaaggagcgcgacacgcgcgggacgggccgcatcgactactgggagtactgggaaggtggccaggtggatcgcatcggcgaggacctggacggggacggcacggtggacaagtggacccgcaacccgaacaacgcggcccgcgaatag

SEQ ID NO: 4109 - DNA, 1401 bp, Myxococcus xanthus
atgcgcaaggcgaaaatcatctgcaccctgggccccgcttcggacacgcccgaggtcatcgaagggctcatccgcgcgggcatgaacatggcgcggttgaacttctcgcacggcacgcacgaggagcaccgccgccgagtggaaaccatccgcaaggtcgcgaagcgcctgggcacgccggtggccatcctccaggacatccaggggccgaagatccgcctgggccgcttcgacggggggcaactgctggtgaagcagggccagtccgtcacggtgacgacgcgcaacgtcctgggccaggacggcgtcatccccacccccatcaagtcgctggtgaaggacgtggccaagggccacgaaatcctcctggacgacgggcgcgtgcggctgcgggtgctgcgcgtccacgggcaggacgtgcagtgccgcgtggaggtgggcggcgtgctcaagaatcacaagggcctcaacctgcccggctcgcccatgtcggtgcccacgattacgcgcaaggacgcggtggacctggcctttgggcaggaggtgggcgtggactacgtggcgctgtccttcgtccgcacgcccgaggacatcaagaaggcgcgcgcgcacgtggcgaagctgaagacgcccctcatcgcgaagattgaaaagccccaggcggtggagcgcgtggaagagattgccgccgtggcggacggcatcatggtggcgcgtggcgacctgggcgtggagatgcccctggagcgcctgccggccatccagaagcacatggtgagcgcggtgaaccgcatgggcgggctcgtcatcgtcgccacggagatgctggagagcatggtggccaatgcgcgccccacccgcgccgaggtgtccgacgtggccaacgccatcctcgacggcgcggacgccgtcatgctgtcgggcgagacggccgcgggcaagtaccccgtcgaagcggcgtccaccatggcgtgcatcgtggaggagacggagcgcggcgtggtgaagcaccagcaccactcccccttcgagcgctccgaggacctgggcaccggcgtggccgcggcggccgtggcggcggcgacgcaactgggcattggcaccatcgtcgcctacacggagagcggccacaccgcgcgcctcatctccgagttccggccccacgcgcgcatcatcgccctcacgccgagcgagacggccgtgaatcgcatggcgctctactggggcgtgacgggcatgcaggtggcgcgcgtgtccaccacggacgccatgctcacccaggtgcgtcagctgtgccggaaggagaagctctgcgcgcccggcacgcccgtcgtggtggtggccggtgtcccgctcaacgtcccgggcaacaccaacctgatgagcatccaccgcatctga

SEQ ID NO: 4110 - DNA, 78 bp, Myxococcus xanthus
atggacatggagggcctgccgccgggccactcgatgcccaagacgccgctgggcacgggcaaggaaatcgagctctag

SEQ ID NO: 4111 - DNA, 522 bp, Myxococcus xanthus
cggacgggacgacccagggatgaaaaagtgcgcctggccattctcacggcggcgcaggaactggtgctggagaagggctatgcggcggtgacgaccgccgacgtggcggagcgcgcgggggctgggaagcagaccatctaccgttggtggccgggcaagggggcgctggtgctcgacgcgttctccgaatgggtgagtcaggcgccccgcatgaaccggcgcaagccttccctgtcctcgacgctggtggagttctgccggggggccgcggaggcggcgcccgtgctgcgagcgctgatggcggaggcacaattcgacgaggacctccaccggcggctcatcgcccaactggtgcgcccgcggggtgacgagctccgggcgtgcctcgccgatcgccggcccgccgaccgggagctcgtggtcaacgtgctctccggcctggtatggcagcgcctcatgctcaatgagccactggacgcacgtttcgtgcgcttcgcgctgcgggtggttcagcgcatctga

SEQ ID NO: 4112 - DNA, 1023 bp, Myxococcus xanthus
atgtcctcgtccgaacttcccgttctcaagttcgtcctcacgaactacaagaatttcaacgcgcgcgcgacgcgcgatgcgctcctgtcctactgggagcatgtgtcgaacggtggccggatgttctggagcgtcgcgggcgcgatgtcgtcggcgcagctcggcatcacgctcgcaccggccatccgggcggggctgattcacggtctgtcggtgacgggcgccaacatcgaggagtcgctcttccggctcgtcgcgcatacggggtacaaggacttcccggagtaccgctacttcaccaagcaggacgacacgcgaatcctcgagcagcggatgcgccgggtcaccgatacgagcatccccgaggacgaggcgttccgcgcggtggagaagattgccgttccgatgtggaagggcgcgaccgagaagggcgagcgccgcttctggcacgagtacttctacgcgttcatccaggcgctcgacccctccgtgtatgagggtgacccggaggcctgctggctgctcgaggcggcgcggctccgtctgcccatcgtcgtccctggctatgaggactcgacgttcggcaacatcttcgcgtcttacgtgaaggcgggcgacttcaacgcgagcatcgtcaagtctggcattgagtacatggccgacttctacgaccgctacgaggagatgtccgagggccggggtgtcggcttcttccagattggcggcggtatcgccggtgacttccccatctgcgtcgttccttcgatcaagtacgacctgcagaagccggtgaagccctgggcctacttctgccagatcagcgactcgacgacgtcctacggttcgtactcgggcgcgacgcccaatgagaagatcacctgggacaagctgaccgagacgacgccgatgttcgtcatcgagtcggatgccaccattgtcgcgccgctgattctcagcgccctgctcgagtgcaagagcaacccggaagcggcgaacgcgctcatcgcgaagcaccagggctag

SEQ ID NO: 4113 - DNA, 333 bp, Myxococcus xanthus
atgggcgcgcaggtgggaatcctgctggcggcgcgtgagccgcgcatgacccacctggtcacgatggttcctcccaacatcgacccgtcgatggaggagggtgccccctcgcgtcacatggcgagcgttcaccaagactggctgctgctgacggcgaacaaggatgacttcgcgcctgtcgcggacagccgcgccctgttcgatgccgcttcgtcccgtcgcaagacacacaagaccttcgacagcgggcatgtcctccctcgggagtacctggaggaggtgcgccgctggctccatgcggaccgccgagcgcctggccgcaaggatccatga

SEQ ID NO: 4114 - DNA, 906 bp, Myxococcus xanthus
atggaattccgtcagctccagctcttcgtcgccgtggcggaggagttgcacttcggacgcgccgccgcgcgcatcggcatggcccagccgcccttcagccagcagattcgccggctggagtccgagctgggagtcgagctgctcacgcgcacgagccgccgggtagccctgaccgccgccgggagccgcttgctggaggatgcgcgcgcgttgctggctcggcgcgcggatgtcatccattcggtgcagcaggcggcgagtggagagacaggcacgctgcgtgtcggcttcgccgcgtcgtctgccttcggcgtgctgccggacatcgtgctgcgcttccgcacgcggttcccgaaggtgaagctggagttggacgacagcgagacgctggatgtcggcgccgcgctcgtctcgggggagctggacatcgccatcatccgggcgcccttccgtcacgaagggctcaccgtcgagcgactgctccaggagcgcttcgtgctcgccctgccagctcgacacccgcgagcccgtcaacaggtcgtcgcgctgtcctcactggcgaacgagccgttcgtgctctttccgcgtcactccgcgccgggcctgcatgacctggtgacgagcatgtgcctgggcgcgggtttctctccgaacatcctccaggaagccagctcgtggccgtccgtcgttggcatggtggaagcgggcctggggctgaccatcgctcccgcgtcctcccaggcgctgtgtcccaaaggggtggtgtttcgccccctgagcggcgctcccggacacgcggagctggtggtggccttccctggaacgcggcccgcgcccgcggcgcagcacttccgcgtcctcgcgcatgaagccgtctcccgctctggcaggcgtgcttctgactga

SEQ ID NO: 4115 - DNA, 2395 bp, Myxococcus xanthus
ccggtgctgctggccgagccagaggctgtctatccgtccgaggcactcgccgcggggcttgaaggcgcggtgaagctcctcctgacgcttgatgcggagggccgggtcacgcgcgcggaggtggtcgagggacttgggcacggactcgatgaggcggccgtgagcgcgctcgagaacgcgcgcttctccccggcgatgcaggacggcaaccccgtctcctgccagttcgagttcatccaccacttcgtcctcgcccgtcatcccgaggtagctccgtcaggcgccgaggatgtcgcccaagtcgctcccgacacgcccgcggaagaggcgaccgcgcagccttccgaggagccagagcctcccgctcctcctggcttcacctcggtcgtccgcgccaggtcgaccgaagcccgcgccctggtgcgcggctcggaggccgtggacgtcgtcgaattggagaaggcccatgagcgcgccgaggacctcgcggaggtgctgacgcgtgcctctgccgtgcaggtccagcggacgggcgggatggggagccggacccagctctcgctcggggggctctctggcgaccaggtgcgagtcctcctcgacggcgtccccatcgagtactcgccctatgtctacggactgggaagtgttccggtctcgctcatccggcaactcgaggtcttcaacggcgtcgtcccggtgcgcctcgcgacggacgcgctgggcggtgccatccacctgcgctccgacctcgcgaagcccgaaaccggcgcgtcccctgtcgctccagggcgggtccttcggcagctaccgagggactggcaggctgacgtggcgggcccatgagcacgtcttcgtgcgggcagcgggattccacgaccgcgcgcagaacgactacgtcgtcactgtccccgtggatgacccggcgacagggcgcgtctctccgcgcgccctgcgccgcaaccacgacgcctatcggggcaccggaggcgatatcgaggtggggttcgaggcactaccgggtatcgaccggctcgtgctcaatggctacctcggtcgctacgacaaggaggtcccgcacgatcagttcatgatccagccctatggcgcggtcacctccgcgcaggagagttggggcctcgggcttcgctacgaggtgtcgccccatgagcggctgaaggtgctcgccatcgccgggtacaaccagcgtgtgggcgagcttctcgacgcctccgactgtctatacgactggtacggcgcctgccgtgcgacgcgggcgagggccggggagactggctcgacgccgctggagaacacccagacgcgccagacgttgttcggccgcgtgcggctcctcgggacgctgctcgacccggaggacctcgaggtttcgctcggcgtcgatgacagtgaccgaagcggcgagaacgcctacctcacccgtctgcagcaggaggaccctctccgggtgccgctcgcgctcacgtccgccttcggaggtctctcccatcgtcagcttctctgggacggcaggttcgagaacaccgtgttcgtgaagggctacttgcagcgcttcgcctcgggaacgaggcaggaggccgcggagcgccggtgggccggtggtttcggtgacaccttgcgcttcagtctgacgcgggggctgctcctcaaggcgtcctatgagcggaccacgcggatgccgcgggtggacgagctctttggtgatgggggcctgctcgtggagaactcggcgctcgtccccgagtcgagtcacaacgccaacctgggcgtggagctcctccccatcgtcacgtccgttggccgtttcggcgccaacgcggtcgcgggcgtccgagacgtcgagaacctcatccagctcttccccggcgacgccacgcaggcctacgagaacgtggaccacgcccgctccttctcggcgcacgcaggcgtggactgggactcacccggcgactgggtggggctcaccggcaccgtcacctggcttgacttccgcaacctcgcgcgggaaggccagttcgcccgctttcacggggaccgcatgcccaacattccctggctccaggcctcggcgaccgcgcggttccagaagcgtcagctcttgagcgcccaggacgctcttggcttggagtggacgacccgcttcgtcgagtcgttctaccgctcttgggagagcgcagggcggggtggtgacaaggcgcgggtgcccacccaggtgctgcacttcgccgcgctcacctaccgctcccggttcgaggggcgcgccttctccttctccttcaacctccagaatctcaccgacgctcccgccttcgacatcgtcggtgtccagaagccgggccgcgcgttctccgcgcgcgccacggttgagctctga

SEQ ID NO: 4116 - DNA, 1272 bp, Myxococcus xanthus
ccgatgaagctgaaagcctcactcctcaccctcgccgtgttcgccacggcctgctcggattcggacggcccccaggtggaccccgacgctggaaccgccgggcccctctacgccgccatcacccaggtcgccatcgctggtggaaacacccagagctacctggtgacgttggacgacatcgagaaggcgcagaccgtcgggattggcgacgcaatcgagcttcccgcggacgcgtacatcgccgccggccttccgggcaccggcaagttcatcgtcagcagctcgaggctgccgacggtgaccccctacaccctcaacgcggatggctcgctcaaggccggcgatccgctttcgttcaccagccagggtgtcgccgcgaccggtggctatcagtcccagcactacttcgtcagcgagacgaaggcctattacttcgaccacgtgaactacaagctggtcatctggaatccccaggacctcgccatcatcacgtcgaaggacctgacgtcccagctcaaggatggcgacttctcgttccgctattcgcagagcctggccatcaccgctggcaacgacgtcatcatcgccggtggctggcacgccgcggacgtgaagacggttccggcgaagacggcgctggtcatcgtggacacgcagaccgacgaggtgaccgtcaaggtcgacaatcgctgcggctgggcgcgcgacggcgtcaagcacacggatgggaagatttattacgccaccgagtccctgggcagcggagcgcacttcgtgtctcccgggaccaccggcgcgccctgcatggtccgcttcgatcccgcgacgggcgagttcgatgcgtggtccaccacgctcgattccttcatcaacccggggacggagggtgacatcgccgccatgctcctgcctggagctcccggcaagggctacctgcgggtgatgaacaaggccgccgcgcagtccgcctgggacgccgcggtgaccgccgagcggacgttcaacgggcagagcgccgccgtgggcgcctggtggagcctgtgggaggtcaccctcggcgacgcgccgaccgcgacgcccgtcgtccgggatgacctcgtgcccaccaacggtcgcaccatcccgcagaatcctggtgagctcctggtgctgccggagttcatcaatgacaacgcccagacgcgcttccgcctcatgagccccgagacgggcctcggggacgcgaagacggtcgtcgagggccaggtgcgcggcctcctccggattcgctag

SEQ ID NO: 4117 - DNA, 1434 bp, Myxococcus xanthus
gtgggcgacccggccggccttcgcggcgtgtcgctgggccccattggcatgcccgcgggaagcgcggtgcgcgccgagcccggcctgtccgcgtacttcatcgagcagcgatggattcccgtcatggagtacagcccccacttcgtggacgggctggcctccttccgggcccagttcgaaatcgactacatgtggggccggtcggccaacgcgctccagcagaacgagggcggcggcttcaacgccgaccaggtcaacatccagacgaagaacgtcaacgtcgcgctgtatcccacgcgcaagccgcgtgagctgacgttgctggtgggcacgcagccagtctacgacaacgtctacgaccccacgcgcacgccgctgtcggacatcacccgcaccggctacaagatgagcttcctgggcagcgatgccacgggcatctccatcttcagtggctacaagggcctggccaagctgagcctgatgccgctgggcaccgcgcaggcggacaagggcacgcgcaacgacccgcgcctgaagtacatctggctcatcaccggtgactacgtctacccggtgcggcccaacaccaacgtgggcctgtcgctgtggttcctcaacgaccagacgaagggtgacgcctacgccttcgagggcctggtgaagagcggtccgtcctccacgggcctcaacaccttcacgggtacggcgcgcttcgacatcgcgcggcccacgggcaacgtcttctgggcgggcgccaacttcaaccacaacatcgacttccgcacgggccggttcggcgcgtccggcttcgtcatgtacaacggcggcaagtacgtcagcgacgacccggagcgctccgccctggccgagctcaacatctccggcctctccgccaacctggagctgatgtaccagtggggccgcgggcccgcggacatgctcacgctggagggcatgtacaccaccggcgacgacgacctctccgacagccgttacaccggtgccttcacgctcaaccagtacggtctgccgggcgcggtgtggttcaaccacaagatgctcatcctgttcccgttcaccagcacggtgaacaactacacgggcgcggtgacggacatctccaaccagggctacggcatgcgcgccgccatcgccaccgcggcgtgggacatggtgcccaacaagctgaacctcaagctgggcgtgggcaccgccacctccgacgcgacgcccgtgcggtggacgcccgaggtcgagcgcggccggtacatcggcaccgaggtcaacgcggagctgcgctaccacatccgctacctcatgacggccggtctgcacgcgggctacctgttccggggcagcttctacgacggctcgcccaccatccggaccaatcccttctccgtcttcaccaccttcacctggtacgcgttctga

SEQ ID NO: 4118 - DNA, 945 bp, Myxococcus xanthus
gtgctcctcgcggcgggtctgctgaccgccagttgcgcctcggggccggtgtcccgcgccgcgccggtggctcgggtggacggggctccggtgacgctccaggacaccttccagttcgatctcgactcgacccacaccggacggacccaccggttgtacgtggcggtccccgagggccccgcgcccgccgccggccatccggtcatctacctgctggatggcggtgcgcactttccctccctggagcgcctcacacgcgccctccccaggctcgcgcggggcttcggcgtcgcggcggccacaccggtcatcgtcgggctgacctacccgggtgaccaggcccacaacgaccaggcacgcggtgaggactacacgccgcccgccccgaatctctcgaacacgggggatgggttctcgaagaagcagggtggggcggatcgcttcctggacttcctgaagaaggagctcgagcccgcgcttgcttcgagattgccgatcgacggctcgcgcaccgcgctgatgggccactcctatggcggcctcctggtgctgcatgcgttcttcacgaggcccacgtccttcgacaccttcatcgcggggagcccgtccatctggtggaacgatcgctacgtgctcaccgagaagaaggccttcctggagcggttcgcgcggaccccggtgaagacgcgtgtgctgctcacggtaggagggctggagcagaagccgcgccagagtgaggggacgcggggcatgttcgccgccgagcggcggatggtcgacaatgcccgtgcgctcgccgtggaactcgaggcgatgggcggcggcgatttcgcggtccagtacctggagtttcccggcgacgaccactacagcgcatggctccccatgctgagccgtgggctgctcttcttctccgccccctcgctgcttccgggcgccgactga

SEQ ID NO: 4119 - DNA, 651 bp, Myxococcus xanthus
  unsure (1)..(651): unsure at all n locations
ttggagacccctggccctgggctgctgctgagcgtgccctccacgggccgctgggcgcggcggccctcggtgcatctggatgccgctccggactaccggatccggttgcgcggcgggggccagacgctgctatggacccgcatcgattcctactgggaccgcgcggtcttcgttcggggaacggccaccgctccccaagtcctgccgccgctgtccgcacccgaggtccgggccgtggaggcctcacccggctccgaggcgtggtgggaggcctggagttggcgggttgcgcgagcgctcgtggatgcacccctgccagtgctccacgctggccactggtgtctgcgccccgtgcgcgccatcgcggcggagaaggcggagcggcacccagtctcccccatggagtggggctttggtcagcctccgctgccaccgcactcgctggccgccatgacgcggttcctgttcgcgtggaaggaggactggtgggagtcgctgccggaacagcggccgggcgccgtgctcgggctgcgcgcgctctctgcgtccgaggatgggcgtgtgaagagctggcgaaagcgcgcgcgggacgggacattgccgnccgtgctgctgctcttcgtggacatcctggcaaatngggtgggctga

SEQ ID NO: 4120 - DNA, 402 bp, Myxococcus xanthus
atgtcccgccacgtatttctcaccggcgtcacggggtttgtcggcaaggtggtgctggaggcgctgctcgcgcagggcgtcgagcgcgtcacggtgctggtgcgcgagtcgaaggaccgccagggccgcgtgcattcggcggcggagcgcttcgcgaaggtggcgcaggccgagtgcttctcgcgcctccagccgggctggacggagcgcgtcgcggtggtgagcggcgacctcgagcagcccgcttgcgacctgtctcccgccgacgccgacgccgtgcgccagcacgtcacgcacgtcgtgcactgcgccgccagcgtggagttcgacctgccgctggcgcaggcgacctcggccaacatccggagcgcgctgtcggtgctggagctcgcgcgcacgtgc

SEQ ID NO: 4121 - DNA, 1848 bp, Myxococcus xanthus
aatgaggtgagcgagcgcttcggcagcacgtcacccacgccttcctccggagacacgcgcttcacgccgccgacgcctgccgcgtcgaaggacgaagaatcactcgaaggctggggcttcgccgacacgcgtttcgtggtgaagcccgacgggagcaccgttctcacgggcacccgctacaacatcagcaatgtcgcgctgccagacttgatgcagtggttcgccggcaagctggcctcgccgctggggtacgacaatcgcaacgagccgcactacccgcccgagattcccgcggcgaagaagaacgacaagcttgtagcggcgctgcgcgagttcctgaaggaagagcagctcaccgacgaccccaagcagcgcctgcgccgtggccatggccacaccggcggtgaaatctgggccatccgctacggaaagctggaccgggtgcccgacctcgtcgtcttcccgcgcggccacgatgaggtggtgcgactggtggaggtcgccacccagcacggcgcctgtgtcatccccttcggcggcggcaccaatgtgacggaggcgctgcgcatcccgctctccgaggagcgcctggtcatcgccgtcgacatgcggcagatgaaccggattctgtgggtggaccccgtcaaccgcatggcctgcatcgaggcgggtgccacgggccgtcacctgatggaggagctcgcgaagttcggcttcaccatgggccatgagccggacagcctcgagttctccacgctcggcgggtggattgccacgaacgccagcggcatgaagaagaaccgctacggcaacatcgaggacctggtgctcgacatgcaggtcgtcacgccccagggcatcgtggagcgcccgcgccaggccccccgggagagtgtgggcgtcaacccgcgccagtacatgttcggcagcgagggcaacttcggcatcgtcaccacggcggtggtgaagctgttcccccttcccgaagtgcagcgctacggctcggtcatcttccccgacctcgaaacgggcctctcgttcctctacgcgctccagcagtcgggagcggtgccggccagcgtgcgggtgatggacaacacccagttccacttcggccaggcgctcaagccagccaagcacgggctggccgcgaaggtgaagagcgaggtcgagaaggccgtggtgacgaagctcaagggcttcgacccgtacaagctcgccgtggccaccctcgtgttcgagggctcgcgcgaggaggtcgccttccaggagaagacggtgtaccgcatcgcctcggagcacggcggcatgaagggcggtggcgccaacggtgaacgcggctaccagttgaccttcggcatcgcgtacatccgggacctcaccttcgagcactgggccatcgccgagagcttcgagacgagcgtgccgtggagccgtgccatggacctctacgagcgcgtgcagcgccgcgtggagaaggagcacgccgcgctgggccttccgggcaaggtcttcttcaccggccgcttcacgcaagtctaccagacgggcgtggccatctatttctatctgggcttctacgcgcgcggcgtcagcgacccggtgggcgcctacgcggcgctcgagcatgcggcgcgcgaggagatcctggccgctggcggctcgctgtcgcatcaccacggcgtcgggaagattcgccgcgacttcctgcccgaggtgtactcggaggccgcactggccctcaaccgcaaggtcaaggccgccatcgaccccgacaacgtcttcggcgcgtcgaactgcggaatcaacggcccggtggccctgaccccggatgaggaggcgcactga

SEQ ID NO: 4122 - DNA, 657 bp, Myxococcus xanthus
gaggtgcgggccctggccgaagccctgcgtgtccgggatgcccgaatccaggaactgctggagcgggagcgcgccttcaaccgggacgcgagccatgaactgcgtacgcccctcgccgtggcgcaaggcgcggtggagatactggagttggacccacccgcggacacggagaccttcggccgtctgcggcaggccattcaccacatgggcctgctgacagagggcatcctctggctggcccggtcaggccgctccgacgaatcgtgcggactggtgagcatctcccgcgaaatggtcgcgctgtacggcaaacaccgccctcacggcgacgtggcgcttgtcatcgaggcgaaagaggaggtcctcgcgccacttccggggtccgtggcgcgagtgatgctgggcaacctcatcaagaacgcgctcgcctatacgcaccaggggcgcatcgtcatccacatcgcgccagagggctggagcatctccgacacaggcgtgggcttcggccaggtcgaacccggacactcgggcttcggtatcggcctgtccctcgtggagcggctggcgcgccggttcaactgcgacgtggccttcagcgccgtggagccacacgggacgagggtacggctcacctggccatccgtggagcccggctga

SEQ ID NO: 4123 - DNA, 675 bp, Myxococcus xanthus
atgcgagtgctcgtcgtcgaagacaacctggacctccaggccaacatcgagaggtttctggggaaggacttccagctcgacttcgccgccaccgggccccagggcctcacgctctcgctgggccaggaatacgacgtcatcgtcctggacctgatgctgccgggaatgagtggcatcgagctgtgtcaacgctaccggcagctcgctccccggctggtgcccatcctcatgctgaccgcgcgggacaccctcgatgacaaggaagaaggcttccgcgcgggcgcggatgactacctcgtcaagccgttctccttgagggagctgcggctgcggctcgaagccctggcgcggcgccccgtgcctccgagcggacggcggctgacggtggggccactgacgctggagccagacacgggccaggcacggcgaggcgtgcgcaccgtccacctcaacaagaccgagacgctcctcctgaggctcctgatggaggccgcgcccgagcccgtatcgccagccacgctggcccaccacctctggggggacgatgcgccggagtccagtgccttgcgcacccacgtctatgccctgcgcggagcactctccgagctggggatgagcgactgcatcaccaccctccgcaacaagggataccgcctggatgcgcgcgaggactag

SEQ ID NO: 4124 - DNA, 2214 bp, Myxococcus xanthus
atgctcacggcgctgacgggagcccccggcctggcgctggatgacgctcccccccccctcgccccctccggaaccacgccggatgcgcaggtccaggcgaagctggacctggcggaccggttcgtccgccgggcggaactcctgcgggacagcctggttccccccaggtggctgcgtgagggcgaccggttggtcttctggtcccgtgagggcaaggacggcgggacgtgggtgctggcgcacgcgaagaccggggagctgaagccactcctttccggtgagcaactgaggcagcagctctcgacgctgctgggcaagcccatcaccgcgccccgcttcttcgacgtcgcgctcgctccggatgagcggggcatcgtgttccgcctggaggggaagacctttggcctgggcctgtcaggtggccatgtcaccttgctgtcgccggaggaccgggccgcgctgacgctgtcgccccagcacttcctcgcgccgaaaggcggcgcgctcgccgtgcaacgccagggcggcttcgcggtgctgaacgcggaaggcgccaccgtggtcgagcgcacgggggaagcgaacctcgactggcggattccggagcgtccctggtcaccggatggccgcttcctggtggtgtggcgggacgacctccgcgccgttcaccaggtgcccgtcgtggactactcctccgcgctggagaaggtgacgacggtgccgtacacgaagtccgggacgccactgccgcgcgcggagctccatgtcgtggaagtggcgacgggccgcgtgacgcgcgttccgcccgtcgagggcgagacatatgactggttcgccggctggaatcccgagggcaccgaggcgctgtgtctccacctctcgcgtgacgccaagcggctggacctgagcgtcgtggaacccgcgtcgggccagcgtcggcacgtcctgcgcgaggagcgcccggagaccttcgtcaccggcctggacttcgcggtgggcggctgggcgaagcaggtgacggcgctgccaggagggcgcggctacctctggatgtccgagcgtgatggctggcgccacgtgtatgcgtatgaccgctcggggaagcgcgtgaggcagctcacgcgaggcgcctttcccgtgcacgaagtggtgggagtcgcccccacgggagatgccctctacgtgctggcctccgccgacagcggcgcgccatacgagcacctcttctaccggggaagcctgaagggaggcgcgttgaagcggctgtcctctgcctcggggatgcaccgcatcacgccgtccccctccggccagtactacgtggacacatggtcctcgcggacacagccccggttgagggagctggtgtccgtggagggtggcaagcgcgtgcggctcaccacgtcggacgcgagtgagttcgagtcgctcggcgacacgcggccggaggcgctgctcgtcaaggcggccgatggcgtcacgcccctgcacggcgtgctctacaagccacgcgacttcgacgcctcgaagcgctaccccgtgctcgcctccatctacgcgggtccgttcaccaccgttgtcccctggagcttcctggggacttcggattcgctgaccgccagcggcctggcgcaactgggcttcatcgtggtgttgctggacccccggggtggccccggacggagcaagtccttccaggacgcgaactacggccgcgtgggccagacggagattcccgactacgtcgcggggctgaagcaggccgcgtccacgcgcccctggatggacctggagcgggtcggcatccacggcggttcgtggggcggctatttcacgctgcgcggcatgctgacggcgccggacttcttcaaggcgggctacgccggagcccccggagcgctggaggaagaggccatcatcaacgagccctatctcaacctcccaagcgtcaatccccaggggtacgcggcgggcgacaacctcgcgattgcagacaggctgaggggccacctgaagctgatgcacggcacgagcgacgtgaatgccacgctctccgtgacgatgcggatggcggacgcgctcatccgcgcgggcaagcgcttcgaattgctcatcatgcccggccagccgcactcccctcggggtgccgccagccgctactaccgggacgatgtgggcctgttcttcctccggaccctgggcggtccacggtaa

SEQ ID NO: 4125 - DNA, 588 bp, Myxococcus xanthus
atggctgtcaagtcatccaaggtcgcgaagaaggccaccgccaggccgagcacgtcgaaggcggccagaccgagcaaggcagtcgccaagtcagcagcccccaagtccaagaaggccacggcgaagaaatcggcggcagcgcccaaggccaccgcggccagacgcaagagccccgctgcggccgccgagccggtcctcctctctggcggcaatccgcagattgcgaagggctacggcgacgcccccatccgggcctacatcaaggccatgccgggctggaaacgcgacgtcgggcaccgcctcgacgagctcatcgagcgcaccgtcccgggtgtgagcaaggcggtcaaatggaactcgccgatgtacggcgtcgagggccagggatggttcctcagcgtccactgcttcacgaagtacatcaaggtggccttcttccgcggcacctcgctgcgccccatcccacccggtgcgtccaagagccgggacacgcgctacctcgatatccgcgaggacgagccgctcgacgaggcccagttcgccgcctgggtgaagcaggccagtcgattgcctggcgaacggatgtag

SEQ ID NO: 4126 - DNA, 885 bp, Myxococcus xanthus
cgcccctatcgcgatgtggccgacctcaacaccatggctcgtctcgtggcgcaagcctgggcggagcgcggtccccacgtggagtgcgcgatgggagacctgacctggcgcctgctgcgcaatgcacaggtacggccgcgggaggacatcgccctgtgggaacgcgcgccggggcagctcgctggctttgcgtgggcctacaacaacggcgatgtggacctgttcgtccacccgctcgtgcacgctgacgccttcgcggaggatgtgcgtccctgggttcgcgcacgccacgagcgcaccacgcagccgaccaccgtatgggcgctggagagcaacggcccgctgctcgcagcgctgcagcggcggggctggcggcgcaccacgggcggatgctacctgcacctcgcacagccgctacccgcggtgccgtctccgccgtcttcgttgcccgcgggctaccgggtgcgcgcggtgcggggccctgaggaggtggccgcgcgagccctcgtacaccggcgcggcttcggctccgagcgggtgacaacagaggtgtacgcgcggctcatggaggcaccgggttaccagcctgcgttggacctcgtcgccgaggcgcccgacggaagcctcgcggcctgcgcgctgggttggctcgacgaggcgaacgcggtgggcgaattcgaaccagtggcgtgcgccccagagaacaggcgacgcgggctggtgcgcgcgctcctacacgaagggctccggcgcatgcacacgctgggcgccaagcaggccatcgtgtacgccttcgcggacaacccggcctccctcgccctctatcagtccgccggcttcaccgtggtggaccgcaacctcggccacaccctggcgtccccatga

SEQ ID NO: 4127 - DNA, 1035 bp, Myxococcus xanthus
atgcgttttcgcgtggtctcttccgccgtcttgctcgcgttcgtggcgctgtggacgtccatcacgctggccgcggactacttcaccgtctccaacatggtcctccaaatgcagacggagagctggccctccgtgcagggcaccatcacccggagcgaggtggatgcggtgcgctcgaacaaggccaccacctacggcctgaaggtggcctacacctactccgtcgacgggcagcagtatgaaggcagcaaggcccgcccctccatgtggcgctcgggggaccgcggattcgcggaggagttggtggcacgctacccccttggggccaccctccccgtgtactaccggcccggccagccctcggaggcggtgttgcagacgggcatggacgggtcgcagctgttcacgctcatgctcctgatgcccttcaacctggtgatgctctggctgggtaccctggtggtgggggcctggaagccggaaccgccgctcttgtccaccttcttccgggaggacggcagtgagtgcgtgacgctcgaggggccgtggacggccaccttggtgtccctggttctggtgggcgcctccctggcgtgcgtcgcgctcgcaggactcactgtgggcctccatgcaccgctgcccgtggccgtgggggcctggggggtcgtcatcgtcagcggtgtgctcgtcgggcggtggtcgcacacacgggtgaaggccgggtactacgacctgcgtctccatccccaggagcggagcctctccctgccccccttctccggacggaaacacgggctcgacgtacggtggcgcgacgtgcggtcgctccgcgtcgaaccccaggctcccacacagaagggggggcaggtgagccgctatcatctcacgctcgagctctccaccgccgacggcggggtgcgccaggaagccatcgccggcttcccccgccaggagcaggcagagtcgctggcacgctggctgcgaacgcgccttgaagttggcgaggtcgcttcagaagagcagcgctccgcctga

SEQ ID NO: 4128 - DNA, 717 bp, Myxococcus xanthus
ctgcgccggtatcaccgctacgaggtggtgaacctggagccgctgctccgccccggcgcgaagctcatcgtcggttaccacgggcgccccctggccgtggacctgtgcatgctgacggtgacgctccacgaacgcctgggctatctgccgcacggcgtggcgcacggcgcgttcgattcgattccgggcatgcgcgcggtggcggacgggctgggcttcgtcacgggggatgacccgcggctggccgaggcggtggcgcgcggcgaacacgtgttgttgcagccaggaggcacgcgtgagggctgccgtgacttccgccaccgctaccgcgtcgactggggcgagcgcatgggctacctgcgcctggcagtgcgctaccggctgccgattgtccccgtgggcggctgcggcatggacgacgcgtacgtgggcctcaacgacgggtacgcgctgggccggcgggtgggcatgcccgcgcggctgccgctgtggctgggcgtgggtgccacgggcctgtggcccttgtcgcttcccttccccgtgaagatgacgcagtgggtgggcgagccgctgacgcgccacctggagccaggcttcgacgcgggcaaccgggacgcgatgcgcgcggtgcatcaggaagtggcggacgcggtgcagcggctgctcgacaaggctcgcgacgtggacaagggcagcagacggaaggcagtgcaatga

SEQ ID NO: 4129 - DNA, 1107 bp, Myxococcus xanthus
cccgcgctctccttccaggatttggactacacctccgagggctcgaagcagccctggccggtgaaacggattccgcttccgcgcaccgcgaatcagtacggcatggccgtggtgccacagattgcctacgtcgacatgcccggcagcggcccggacgcgaaggccgtcgtcttcatccacggcctgggttcgtacctgaagttctggcgggcgcagctggacgccttccagaagcagggctaccgcgtcatcgcggtggacctgcccggctacggcaagtccgacaagcccggcaccttcccgtacaccatggaggccatggcggacgcggtgctggagttggtggacggcctgggcctggacaagcccgtgctcgccggtcactccatgggcgggcagacgtcgctctccttcgccatccgctacccggagtcgctgagcgggctggtgctggcgtcgcccgccggcttcgagaagttcagctggcgggagaaggagtggttcgcgcgggcgatgagctccgagttcatcaagtccgcgccggaggccagcatctggggcagcgtgcgccaggccaacttcatgcactggcggccggagttggagtggctgattgaggagcgcgtgcggctggcgaagtcgcccgagttcgacgcctacgcctacgccaacgtgcgcacggtgcgaggcctgtcccacaacgacttcgtgcgcgacaacctgcaccgcgtcaccgtgcccaccgtcatcatctacggcacggatgaccggctcatccccagccccttcctccacggcggagagacgcgcggcatcatggagtacggcgcgtcccacattcccggcgcgaagctggtggcgctggagggctgtgggcacaccgtgcagctcgactgtgcggagcgcttcaacgaggcggccttcgccttcgtccgtgacgcggcggcggggcgcatcgaggtgccgtccgctcccgcgaaggaggaggcgccgcggccggagtctcctcccgcgccggcgtccgagccgctcacgccggagagcctgcctccgcccacgccgggccaggaaggcgagccgacgccgggcgtgctgccccagccgtag

SEQ ID NO: 4130 - DNA, 861 bp, Myxococcus xanthus
atgacaggcgactccctgcgctggcacttctttgaccagcgaggctgcggcgcctcttcacgtccctttacccacgctccacccggcggcacgtggcagaccctgcagacggtggaggctcgactgggactcgccgcgcagctcgcggaccttgagcgcatccggcgcctgctcggcaaggagcgcctcacgctggtgggacactccttcggagccctggtggccgcgctgtacgccgcggagtggcccgagcgggtggaggccctcgtgctggtggcacccgcgccgttggtgacgatgcccgctggcgacggcgacctcttcacccaggtgcgggcccggcttgacgaggcaggccagcgcgagctggcggcgtggatgaagcacaccttcgacttccctgcccgcctgaaggacgacgaggcccggctcgccgagcacttcgccgccttcggaccgctgtacgtccaggccatgcggcgcgagcatcccgacgcgaagcttcccggctccggtgccgccggaggctttctctcgctggggctctacctgagcctgggccggcatcacgactggagcgactggctgcgccgggtgcgcgcgcgcacgctcgtcatccatggcgcccaggacctccagccccgctcggccaccgcgcgcgtggtagaagcgcttccccacgcgcggctggtggagctggcgggcagcgggcactttcccttcgaggagcagcccgagttgttcgcggccacggtgcgcgccttcctctcggaggagcttcctgggcccgactcttcgcccacgtccatgcgaaggagcgcaccccatccgtccccttgcgcgagacgcacctgcgcgtag

SEQ ID NO: 4131 - DNA, 435 bp, Myxococcus xanthus
atgggacagaccgcagacccctcgaagacgtcgccgctggtcctgacgaatcccaagggactgttcgacccggcgccctacggcttctcgcacgtggcgcaggtggcgccgggcacccggctcatctacctggcggggcaaggtggagagaatgagaccggggccctccagcccgacttccgtctccaggtgcgacaggcgttccagaacatccgcacggccctggaatccgtgggagccggcgtcggtgatgtcgccaagctcacgatgctcgtggtggaccacacggaggagaaactccggatcatcggccccgagttggacgcggcctggaacggcggcatgaagccgacctgtacgctgattcccgtccctcggctggcgctggacgggatgctcttcgaagtcgaagcggtcgctgtcctacgtgcctga

SEQ ID NO: 4132 - DNA, 966 bp, Myxococcus xanthus
atggtgggggtgcgctttcccctccccgaggacggcggtgcggtgccctcgaacatccccggactggtgacggtgccgccgctgctggagagcgtggattcgtccaccgttcggctgctgttgccggatggaacgcaggtgcccgcgaccgtcacgccgggcgcgcatcagacgcaggtcctggtcccggacgcaccgctggtgccaggcaccacgtaccgcatcgaggcaaagggtgtctgtcagttccagccaacccagaccgagtccgtaaccttcaccgccggccccgcactccctctacccacgaccactggcaccctgacggccgacacgccgagccagggcatcttcaacgtgtacggagattcgagctgcggcgacaggcaggtggaagggaacttcaccacgctgcgctttacgccgtcaccggagctggtgccgttccttccgtgggtgcattggacggtggaggtggacggcgagccctggtcgtatgcgaagcacagcgggctgacctccactggtgaggagagccccgagccgcgtcgctatgaatacaaccggcagctgctcttcctgtatacattctgtgactacgtaggctgcgctgattcctaccagcggccgaccatcgaaagcctcccgcccggacgacaccgggccacgctcaaggcgacgctggagcacgcgaacatcacgcttccccccgtgagcgtggacttcgagttgagctgcgcggcacgggtcgcgaacgcgggaatgagccagatgagcggatgctcggatggggggaccgagatggacggaggtatcgtggacggaggtatcgtggacgaggacccgctccccgagccggtcgacaccaagaagggctgcacccaggccggcggaggactgacggtgctgggcctgctctccacgctctggctcttgggcggccggaactcgcgccgcgcgaaatag

SEQ ID NO: 4133 - DNA, 936 bp, Myxococcus xanthus
atgccgctgtggcacgacggccggctggcggtgctgcatggcgtgggattgccggagccggtccgctcccacttcgacgcgcaggacttcgtggagtctggaacgccagggcgcaagtcgacgccggatggctggctcaaccgcgcgctggacgaagaggcgggcgccgcgctgcgcgccgtggcgttgcagcccacgctgccccgagcgttgttcggagacgcgggggcggtggccatggggcggctggaggagttccggttgcgaggcggacgccggggggaggaagccacccggggcttcagtgcgctctatgcgggcgccgtggacgaggcgctgcggacgacagggcagggcgcattcgaggcgatgtccctgctggacgaggaccggctggcgaagctgccttctcacgcggcggtggcgtatccgaaggggccgctcgggcagcggctgcgggacatcgcgcggctcatccatggagaagtggggctggaggtggcggcaacggagtcgggcggctgggacacacatgccgctcagggctccgcgacgggcgcgttcgccaaccgctgccaggagttggggagcgcactgtctgccttcgccgcggacctgggacctcggctggagcaggtgacggtggtggtgttgacggagttcggccgcaccgtgcgggagaacggcagtcgcggaacggaccacggtgtgggcagcgcgatgctggtgctgggcggcggcgtgaagggcggcaaggtgtacggacgcttcgattcgctggagccggaccacttgcaggacgggcgcgatgtgcctgcatggacggacatccgcgcgccgttggcggaagtcctgctcgcctgtcggccgggtgtggagttggcgagggtgttccctggcttcacgccgcctccgtcactgggcctgttcggatag

SEQ ID NO: 4134 - DNA, 1284 bp, Myxococcus xanthus
tcgcccgcagacgaggagacatcccgcatgccgaccgtgacaggcatcactcccaacaacgtcacagttgatggaggtgaacgggtaacgattaccggaaccctgttcacggcgggctcgaccgtcaccttcggggggactcccggaacgaacatggtgttcgtctccgccacccaaatcacggtcatcgtgcccgcccgggcgctcccaggcactgcggtcgtccaggtccggaacgtccatggggcaccggccactttcgtcggcttccactatcgctgtgtcgtgagcagcatcacgccagcggaggggccttcgtccggggggactgacgttgtcatcaccggcaagggattccacgcccagatggaggtggagttcggcggcgtcctcgcgaccaacgtcgtcgtggcgtccgcgaccgaactccgggcgcggacgccagcccacgccgcggggagtggcgttgccgccgccgacttctggaaccacggccgcgccgcggggacgcgggccgctttcagatactgcacgcccctggtgacaggcgcgacgccgaacagcgcgcggccaggaggcggcgaggacatcgtcctccgtggcaagttcttcgacgcggcggcgacggtctccttcggcggtacgccctcaccgcacgtcgttttccgctccagtacggagttggtcgcgcaaacgccagcgcacgccgtgggggccgccaacgtggtggtcaccaacggtgacggcgtcgccggcacgctgccccaggggctcaccttcattggcgccgaggtcacgagcatccaaccggcccgaggtccctccgttgggggtaccgacgtcaccatccggggcgcgcgcatcgccgccggagccacggtgtcgatcgggggcacgaacgtggtccccaccatccatcccccagactccctcaccgcgaggacaccggcgcacgccgcgggcgccgtcgacatcgtcgtccagaatgggggagaggccgcgagcacgctcgtcggggccttcacctacatcgcggcgcctgccatcacccgcgtcgaaccaccccgggggacaacggccggagggacggccgtgacggtgacggggacggacttcgcggagggcgcgcgggtcctgatgggcggccgccccgcgacccaggtcaccatcgtctctccgacgacgctgaccgcaaccaccccggcccacgccgcgggcaccgtcgacatcgaggtccagaacgcggacggcgcccccaccacgctggtgggggcgttcacctac

SEQ ID NO: 4135 - DNA, 789 bp, Myxococcus xanthus
atggggaagtaccagctccacccgcgtgagctcgaccacgaagcctgggagctggagtcgtccgagaagcttccccccgagcgggaccgctgcgacacgaatgccgcatggcaggccccgagtgggcctgacacgagggaagccatcacccacgtcgtgcaagccggcgagtgcatctcgacccttgcctaccggcacggacatctgccggagacactctggaacgcggaggagaacgcggcgctgaaggaactccgtggggacaagaacatcctcaatcccggggactccgtcgtgattcccgcgccccgccgtgggacggagggcgtcgacgctggcaacgcctacctcctccgtgggaaggggttcacggagacgcttcgcgtccggtttctcgacgcggagggccagcctcgcgtgaagctgccctacgtggtttcgctggagagcgacgtcaggaccgaggagcgcgctggagcgacgaacagcgaaggattcctcgtcgagcccgcatcggcgtcggtccataccctgaaggtcaccttcggctccggctccaagcgagaagcctacgcgttccaagtcgccagactcgcaccgctggacaccctcgctggcgcccaggcgcggctgtgccacctgggctatagctgtggcgaagaggatggcgtcatgggcccgtggacgcgacgagcgctccgcgacttccagcgcgaccatgacttgccggtgacctgtgagctcgacgacgccacgaggacacggctccgcgctgagtacctggcctga

SEQ ID NO: 4136 - DNA, 333 bp, Myxococcus xanthus
atggtcacccacctgcggtcacacttcccgagggaagtcgatggcctcggcgatggtgaactgcgcatccacatcgaagagagcctgacccgggcacgcggctacggcctcacgagcacgcaagacaccatccgcttcctgaacctctgcgcatcgttcggctggcacttcgaccaggaaccatcgcgcccctgggttggcgagtacctgcatgacgcggagattgcattgccctcggagcggctgagccgggtgtcgcgccggtgcctgcgtgacctcaagactgaatcgaacaaccgcaaggcgcgagctgcgctgggcggtgccgcatga

SEQ ID NO: 4137 - DNA, 228 bp, Myxococcus xanthus
atgcaggtgcagaacaaccccaccgacaccgggccgacctggcagctccgctattcactcaacctggtggatggcagcggacaggcctccgcctatgcggagtggaatgtctggagccgcgtagcgctcttcgcgctgggcgtcattcaccacggaggcccccggaccgagttccactccctgctgagccagtcaattctcgtgggagccaggggctacgtcctgtag

SEQ ID NO: 4138 - DNA, 744 bp, Myxococcus xanthus
atgaaacacatcctggcgctcatcctggggctgctgctcttgcacaccggcacggcgcgggcggcggagccagacgcggcggagattctcaaggcctcggaccgctcgcggggtggcgggcttcctggcatccgctggacggtccgcatcactcccgaaagcggcgtggacaaggagcccgagcggctgctcaccctgaaggccaatgccaccgccagcctcgcggagacacgagagcccgtgcgcttcaagggctccaagctgctccaggtggaccggaacatgtggatgagccgtcccggcctccgcaagcccatccccatctcaccgaggcagaagctctccggtcaggcgtctcaaggcgacatcgcatcgacgaactacgccgtcgactaccagggcaagctgctgcgcgaagaggacgtcaacggcgaggccagctacgtgctggagttgaaggccatcaacacgttctgcacctatgaccgcatcacctactgggtctccaaggagcggcaggtcggcgtcaaggcggagttcttctccctctccggcaagctgctgaagtccgccaccttcgagtacggcaaccagctcacccacgaaggcaagacgttccccttcgtgagcaagatgaccatccaggacgcgctcacgcccgccaggacgacgctggagtacgccgacgtgcaggtgacggagctggcgcgcgggacgttcgacgtcaaccggcttgggaactga

SEQ ID NO: 4139 - DNA, 1227 bp, Myxococcus xanthus
atgaactacttctccattggcttccgcaacatcctgaagaatcaccggcgcagcctcgtcaccctcctctccgtgggcttcggcttcgcctccatcagcctcttcgcgggatacatcaagtatgtgtacagcgggctggccaagcaggccatccatggggagctgctggggcacctgacggtgatgaagcaaggcctgcgcaccgaaggccgcctccatcctgcgcaatacatgttctccaaggaggagctggaccgggtgatgcccatcctccggaagtaccctcacacgcggttggtgacgccgcgcatgtccctcagcggaatggtgtccaacggcaccgcgtccaccgtcttcgtgggcgagggcatggtccccgaggacgtcaagaagctccagggtgacttccagcgcaagctgtcaggtgacttgaaggcggacaaccccatcggggtggcgacggcggaggacctgggcaggattctcaacctgaagcccggcgattcggccgcgctgctggtgagcacggtgacaggtcaggccaatgcgctagacgtggacatcgtggacgacttcaacacgggcaacgtcggcaccaacgacaagttcctgtacctgcccttcgacctggcgaagtccctgtatgacttcgacggcgccgagcggctcatcgtgctgctggatgacaaggccttcaccgagcaggcgcggacggagctcaccgcgcagctcaagcaagcgggcttcgacgtggagctcaagacgtggctggaactgtcgagcttctactcacaggtgaagcgcctgttcgacatgattttcgccttcatcttcagcaacgtcttcatcgtggtggtcatgagcatcgtgaactccatgagcatgacggtggtggagcggacgcgggagattggaacgctgcgctccatgggtcttcgccgctcgggcatcctgcggctcttcaccaccgaggccttcatgctcgtggtgctgggatgcgccggagggttgctcttcacgttgctggtgcggctggccgtcaacagcgcgggcatcacctacaccccgcccaactcctccaacgtggtcagcctcatggtcgacctcgacgtgccccggatggcgaggacgttcgtcatgctctcgctgctgggcatcgccgcggccttcttcccggcgcgtaccgccgcgcgcaagtgcatcaccgactcgctgggccatgtctga

SEQ ID NO: 4140 - DNA, 684 bp, Myxococcus xanthus
atggagcaggccgcggggttccccacggtgttcctcaccgcgtactacgcgctgttcgaactggcgcatccgcgtccgggggccaacgtgctggtgcactcggcggcggggggcgtgggtggggcgttgctccagttgggccgcatcgccgggtgccggatggtgggcgtggtgggcgggacgcacaaggtggagacggcccgcgcgcagggggcggaggtcgtcatcgacaagagtcgggaggacttgtggagcgtggccaagaaggcggcgccccgtggttatgacgtggtgctggatgcgaacgggccgtccacgttgcgcgacagctacaagcacctggcgtcgccggggaagctcgtcatctacggcttccactccatgctgccgcgcaccggtgggcggccgaactacgcgaagctggcctgggactggctgcgcacgccgcggttcgatccgctgacgctcaccaacgacaacaccagcgtgctggcgttcaacctgtcgtacctgttcgagcagcgcgccgtattggaggagtccatggcgcagctcttgggctggttggaggaggggaagctggtgccgccaccggtgaagtcgtttccgttggacgcggtggcggatgcgcaccgggcactggagtccggcggcacggtggggaagctggtgttggtgccgtga

SEQ ID NO: 4141 - DNA, 729 bp, Myxococcus xanthus
atggccaacttggaagggacggcggcgagcacggcgaacgaggacgtgctcctgtccctgaatgacatccggcgcgactacgtcctgggagaaacacgggtcgaagccttgaaaggcgtctccctgcgcatccaccggggagagttcgtcgccatctggggcccctcgggcagcggcaagtccagcctgatgaacatcctggggctggtggacgcgcccacctcgggtgaggtgtcgctggaaggcacgcccatcgcgaagctgacggacaacgcgctctccgacttgcgcagccgcaaggtcggcttcgtcttccagagcttcaacctcatccccgtgctcagcgccctggagaacgtcatggtgccgctgcagattcaaggcgtgggcgccgccgaggtacgcgagcgcgccagtcaggccctcaaagacgtgggcctggagaatcaagccagcgcgcgcccggacaagatgagtggcggtcagcgccagcgcgtggcgattgcccgcgcgctcgtcacgtcgccgtccatcgtcgtggcggatgagcccacggccaacctggactcggagaacagctacatggtggtcaagctcatgcgtgagctcaaccgctccaagcgcgtcaccttcatcttcaccacccatgacccgcggctcatggacctggtcgaccggaaactcctgctcaaggacggcttgctccaggcggacgaggctgtgcgatga

SEQ ID NO: 4142 - DNA, 1206 bp, Myxococcus xanthus
atgcgagtggtcatcaccggcatgggcgcggtgtccccctacggggcgggcgtcccgcccttgctggacgcgctcgccgagggacgcagcgccatccgccccatcgacgacttcgatgtgtccggatgcggttgcaaacacggggcgcgcgttcctcgagggagcctgtccgcgctgacgggctccaacaacctgcggcgtgcgcctcgagggacgcagtacacgatgctcgccacggaggaggcgctccagatggcggggcatgggccctccacctggaacccggagcgggtgggcgtgttcctgggcacctaccgggccatggcggaggtcagccaggacatctggcatcgcatcatcaccagcgagccgcgcttcgtccaaccgctgctgttccaggagaccgtgacgaacgcggtggccagcgcgctgagcatccgctggggctggcgcggcaccaattacgccatcagcgcggggaacgcctgcggcttccaggtgctcgcgctggctgcgcaggcgctgcgcagtgggcgggcggacgctctcatcgcggggacgttcgacctgttcaccacggccacgcacttcgacatggatgacattggcgtgctaagtgatgccaacgtgagccgtcccttcgacacccggcgagatggctacatcatgggagagggggcggcggtggtggtgttggagacgctcgcctccgcgcgggcaagaggcgccaccccgctggcggaaatcgcgggcctgggcgtggcgcacgacgggcacgccttcggcatccaccacccagagggccggggactggcctccgcgatgagtcaggcgcttcgcgacgcggaagcctcgcccgaggccgtggactacatcgccgcggccagcaactccacgcaatcgttggaccgggcggaagtggccgcgctgaagacggtgatgggcgccgcggcgagcaccgttcccctcagcagcgtgaaggggctcatgggcgaggccgagtccgccagcgacatgttcaacctgctcgcctgtgtcggcgcggttcggggaggcgggttgcctgtccaggccggcatcgagcagccggagttcgagctcaatctggtacgccagccgcggccacaccggcccgtccggacggccctggcgcactcctattcgttcgggggcaacgccggcgcggcgttggtccgggcgctctag

SEQ ID NO: 4143 - DNA, 1011 bp, Myxococcus xanthus
atgattcgcgtggcggcggcgcagggactggcggcgtccgggatggacctggatgtcgaggaccgctcgcgcattggcgtggtgctcggaaccaacctgggaggaatgcccgccaggaaggaaggctacgccgcgctgcactacccctaccggcgcgggcgcgcaggcccgaaggagccctggcgagccctggtgctcgacagcttcatctgcgccatgagtgaccacgtcgccagccagtaccagttggggggactcagcctggtcatgtccaccgcgtgcagcgcgggccttcatgccctgggcgtggcgatggatgtgattcgctccgggcggtcggaggtgatgttcgcgggcggagtcgatcccctcagtgagatgccccaggccggcttcggcgtcctgcgctccctggcgagcgacaagctgcggcccttcagcaaggaccgcgatgggacgctactgggcgagtccgcctcgctgtgggtgctggagagcgaggcgcacgcgaagcgccgcggagcgaacatcctggcggagctcgcgggctacggaggctccacggacgcctaccacatgacccggcccgacgagacgggacgcggccccgcgcgggccatgcaggcggcgctggcgagcgcgggcatgaaacccgagcagattggctacatcaaagcgcacggcacgggcacgccggccaatgacgtcatcgagacacgcgccatcaagcatgtctttggcgagcagacccgagtccccgtcagctccatcaaggcgatggtcggccacagcctcgggtccagcggcgccatggaggcggctgcggcggtggtggcgctgaacgacggcttcctgccgcccacgctgcacctggatacgccagaccccgagtgcgacctggactacgtgccccatcacagccgacccacgaagctggaagcggtgctctccaacgcgtttggctttggcggcaacaacgccgcgatggtcttccgccgctgggagggctga

SEQ ID NO: 4144 - DNA, 366 bp, Myxococcus xanthus
atgatgcagcaaggccgtggcgccatcatcaacatgtcctcctccgccggaatccggggacgcgcgggacaggtgccctacgccgccaccaaaggggccttgattgggctgacgcaggcgctggcgggagagctggggccacatggcatccgggtgaactgcgtggcgcctggcttcgtggagacggagatggtcgcggggctgatgaaccgtcccggggtgcgcgagggcttcatccaggccacccccatccgccggctgggaaccgtggaggacgtcgccaacgccacgctcttcctggcgtctcctgagagcgcctacgtggtcggcgacgtgctgcgcgtgaatggcgggctggtgctgtag

SEQ ID NO: 4145 - DNA, 336 bp, Myxococcus xanthus
atgcgcaagcgctcggggcgcatcgtcaacctgctggatgccgcttccggaggtgcgagccgcgtggccgccgaaggcatcaccgcgatgacacgcgcgctggcgaacgaggtggcccggcaaggcatctccgtgaacacgctggcggtccaactccttgaggaggagaccgcacacctcaccccagcgcagcgcgagcggctcgatggcgagttgggtcccctggggcggctcgggagcgcggaggaggttgccgaggccgtgctcttcctcggttcgagcgcggcgaacctcacgacgggtcagcgcctgtccgccaccggaggtctgtggtga

SEQ ID NO: 4146 - DNA, 450 bp, Myxococcus xanthus
atgactgagcaccccatggcccgcatctacggcgggacaccgcaccggttccccatgctgctggtcgacacggtggagacgctctcaccgggctttggcaggacgttcaagcaggtctccggcaacgagatgatgttcgagcgtttcggagacgcgccccccgccctgccctcctgcctgctggtggatgccctgggacaggtcgccatcatgctcctgcgcgagcccgacgaagtcacaccgtctgtctggtacctcggcggcatcgagacaatgacatttcacacacccatcccggccggcagcgtcctgcggatggaagccaacattctcaagcgatggcggaccacggtgcgcgtcgaggtcaaggcctgggccgacgctgtcccggctgccagcggcgtcatggtgctttcccagagaggttcgaagtcacatgagtcaccctga

SEQ ID NO: 4147 - DNA, 1023 bp, Myxococcus xanthus
atgagccggcgcatcgtcatcagcgggctcggcgcggtgtgtccccaggccacgggacctacggccctttgggagcgcttctcccaaggcgatgcgggcccaccgtcctccctggcggagcgcattcccgacgcggcgttcgcgaagcagtccgcccagttgcggcacatggaccggctcgggcgcatcgcgctcaccgcgaccacgctggccatcgaggatgccgggcccggcaatcccctccagacaggcatcgcgttcggctccagctacggctgcctgcccacgaacgcggagtacctggaagccatcctggagcggggcggccgctacggaaacccggtggtgttccagaacaccgtcaccaacgcggcgacgggctacatctccatggtgcacgaccttcgcggtcccaccgcgaccctgtgctcgggccacgccgcgggactggaggcgcttcgcttcggctgccagcaaatcgaggaagggcaggcggagcggatggtggtggtgggcgcggacaccctgagccccatgctcctggctggcatcgccctgcctgagggaatgcgggtgagtgaagcggcgtgcgccctggtcctggaggagcacacgcacgccctgacgcgcggcgcacaccgccacgcggaagtcctgggcaccgggcaccggggaggctcgctcacgaaccaggcgcacacgctggcccgcgcggtgcgggacgcgatgcacctggcccgaatcgagcccgagcaactgagcgccgtcttctcctgtgcgagcggccgaggagacttcgacgggtgggagcagcgtgggctgcacgaagccctcggggcgcacgcggcgaaggtgcccgtgagctgtcccaaggacgtgcttggagagacgttcagcacggcgggcatgctggccgtcgtgctggccacgcgggccctcgacaagggatgcgcgctggtcaccgccctggggggtgagggcagcgccctggccgtggtgctgcgcgggggtgctcatgactga

SEQ ID NO: 4148 - DNA, 1212 bp, Myxococcus xanthus
atgagcccccatcgcgtcgtcatcacgggccttggcgtgacggccgccaatgcgctgtccgccgacaagctcgcccaggccctgttgaaccgccgcagcggcatccggcgggctgccccgttcgacatcgaaggccggacgtactccgcgggcgtggtggacctgccgggcgagacgcccgacaacggtttggaccgcgtgtcaaagctggcacttcacgccgcggagcaggccctccgcgacagtgggctcgaagcccaggggaactggcgggaggtggcgggggtcatgctgggcacgagccgtgggcccgccttgtccctcgaacaggtcattcgctccggaggtgatgaggacgctcgccggagacacttcggggaggttcccttctcctccatcgcgcggaacgtcgcggaccggttcggcctgggcggcatcctgtccaccgtcaccatggcctgcgtgtccagcagcctcgccatgggccgagcactggacgaaatccgtcagggacgggcctccgtgatgctggcgggaggagcggatgcactgaccctgctcagcttcagtggcttctccgtcctgcgcgccatgacgcccacggtgtgccgccccttcgaccatcggcgcaatgggatggtactcggcgagggcgcgggcatcctcgtgctcgaggagctgaaccacgcccgccagcggggcgctcgaatccatgcggagctgtgcggctggggaacggcgggcgatgcccatcaccccaccagcccgcaccccgagggccgggggctccaacaggcgatgacgctcgccttgcgacaggcgggactgacgacggagcagatcgacttcgtcaacctccacggaaccgggacgccggccaatgaccccgcggagtgccaggccctgcgaggtgttttcggtgcgcgagccgcggcgctgccggtcaactccctcaagccctacttcggccacacgctgggggcctccggcgcgctggagctcatcggctccgtgctgggcatggctcgtgacttcctcccgccgaccctcaactgcgaggaactggacccgaagtgcgacgtcgacgtggtgcgtggcgagggccgcgcccaacgcatcgacacgctgatgagcaccaagtccgcgttcggcggggcgaacgtcgctctcgttacccggcgctttcctgagacagggagggcggcacgatga

SEQ ID NO: 4149 - DNA, 435 bp, Myxococcus xanthus
atgttcttgaatgtgttgctccaggggagcggctttccacggctgcgctccactgtcaccctcgtgcaatcccaacagcgaaacatcctggtggacagcggtctgtgcgacgacgcgggacgcctggtgctggcactcaaggaacgcggcctgacaccggatgacgtggatgtggtcgtcgccacgcacctccactacgaccactgcggcaatcacttgctgttccgcaacgcgcaatacgtcgtgggcgccaaggacttcgtcgaaaacgcgcacttcatcgaggcgtatcaccaggaccacaccccagggaaagccgcgacctcggagctgctgcgcgagcattaccagacggtgaaggagttctatgtccggtccatcgtgcgcgaggtgactcgggaacatcgggttctacaaccgcgtgctcgaacgtga

SEQ ID NO: 4150 - DNA, 471 bp, Myxococcus xanthus
caggcagcaacgcccgcggggctcggcatccaggagctcctccgactcctgccgcatcgctatccgatgctcatggttgaccggattgacagcttggaacccggcgtgttcgccgaaggaatcaagtgcgtcacggcgaacgagcccttcttccaggggcactttcccgagcaccccatcatgcccggcgtgctgatcgtcgaatccatggcccaggtggcgggcgtcatgctccgcacgaggagccgcccggacctcgcgcccgtggagccggcgacacagaagccagcgcggccgggcgtgatggccaacatccaccggatgcgcttccgccgccctgtcgttccgggagaccagctccgtgtccgggccactcacctcaagagccttggcaccatccaccatgtgaaggtcgaagcacgggtgggtgaagagctggtcgccgacggcgaattgatgctgggcgcctag

SEQ ID NO: 4151 - DNA, 1518 bp, Myxococcus xanthus
atgcccatcgtccatgactggctggcccggcgtgccgcgctggcccctgagcgtaccgccctcatcgacgccgaccatggcgagcgacgcatctcctttcgtgaatggaacgattcggcttcgcgtaccgccgctttcctccaccatgcgctgggtgtggggcgaggggaccgtgtcgcggtgctcgcctacaactgcgtcgagttcctcgacctcttcttcgcgtgcgcgaagctgggcgccgtccttcagcctctcaactggcggctgagtgccacggagctgggggggctgctcgcggatgccgagccatccgtgttcgtcttcgggccggagttccgaacccaggtggaggccgtgcggtctggcgcgtccttcgtgcgccactggctcagtctcgcggctccagggccgagcgagcgggccttctccgagcgcgacacgcagacggacgtggcccttcctccgctggagctagaggaggatgctccatgggtgctctgctacacgggcggaagcaccggtctgccgaaggccgcggtgctcacgcaccgctccatcaccgccaacgcggtgaacacggtgatgggctggggcctgaccgccgatgacgtggcgatcctcaacgcgccgttgttccatgccggaggactcagcgtcttcaccgcgccgctggcctacgccggcggcgcatcggtggtgtgccggagcttccatgtggagggcgtgttcgacctcgtgcggcggggcgtggtaagtctcttcttcggtgtgcccaccatgttcatcgagatgcagcgccacccgcgtttcgatgccgtggacctgtcacgcctcaagctggtcatcagcggcggcgcgccctgcccggcccccgttttcgagcgcttcttcgctcggggcgtggacttcaagacggggtatggcctcaccgaagcgggccccaacaacttctggcttccaccggaagacgtgcgccgcaagccaggggcggtgggcgtgcccctgttccacgtcgaggctcgcatcgacggtgagacgcagccgggcgacgtgggcgagctgctcttgcgaggccctcacctgtgtgcgggctactggcgccgtccgggggacactgcccgcaccttcgcggacggctggctgcacaccggtgacctggccacgcgggacgcggagggatgcttccgcatcgtgggccgcagcaaggacctcatcatctccggcggtgagaacatctacccgtcggaagtggagagcgtcctcgcggggcatcccgatgtggccgaggtcgccgtcatcggcgtggcggaccccaagtggggggagacgccgcgcgcgctcgtcgtcgcacggccgggcacctcgccttcggctgaggccctgctgcgcttctgcgacggacggctcgctcgatacaagacgccgaagtcgattcgtttcgtggacgccctgccgaggacctccgccggcaaggttgaccggcgcacgctcggtgccgcgcacggcgcgccctga

SEQ ID NO: 4152 - DNA, 312 bp, Myxococcus xanthus
atgcacctcgacaacacggaagtgaagagcggcctcaaggccatgatcgtcgaccgcctgcggctggacatcgaccccgcgagcattccggacggggcgccgctgttcggcggtgactcgcaggaaggtgaggcgggaggcctgggactcgacagcgtcgaggcgttggaaatcgtggtcggcatcgaggagaagtggggcgtcgtcatcgcggatgacagcgtcgccaaggagttccactccatcgacacgctcgcggcgctggtcaaccggctcatcgcggaaggcgggaagaaggccgcctgtgcctag

SEQ ID NO: 4153 - DNA, 132 bp, Myxococcus xanthus
atggagctggaggatgcgacgctggcgttcatcaccggcggcgatgccgaggccacctgccccgccacgcccacgcccaacgaactcacctgtctctatacgaactgcgggcgcattgcctgctgccgctga

SEQ ID NO: 4154 - DNA, 978 bp, Myxococcus xanthus
gcattgcgccacctgacctggcgcctggaggccgcgccaatgcaggtccgtggcgtgggcatcctcaatggctggggcggcatcctctacgccctgacccacctgggagccctgtggggggagcgcgcgctgttcgagaccgccgagtccttcgtggacgccatggctccccgcgtggagcaggacgagcacctggacctgggcagtggctgcgcgggcgccctgctcggcctgctgacgctcgtggggcggcatccttccgagcgagcgtcacggctcgcgcgagtctgtggggagaagctgctccagacagccacaccccaatcccatggcatgggctggctctcacccgcgaccggcggacaggcgctgtgcggactggcacatggaggggcgggcatcgcgctggcgctgctgcagctggcctccgccacgggagagtcccgcttccacaccacggccctggaggcgctggcgtatgaacgtggccggttctcgcccgaggccggcgactggcccgacctccgcgccgacgccggggtacacggcggtgatggacccgccttcatgtgtggctggtgcaatggcgcacccggcatcgggttggcgcgcatctccgggctgccggtgctcgatgaccaccaggtgcgtgaggaaatcgccgcggcggtccgcgcaacgctcgcgggaggcctcggctacaaccatggcctgtgtcatggcgacctgggcaacgtgctcttcctgctggaggccgcgcgcgcactgcacgatgacacgctgctgcggcgcacctatcagctcgcgggcggcatcctccagggcatcgagtcgcacggctatctacatggcctgcccgacagcatcgagacgccagggttgatggtggggctcgcgggcatcgcccacggcctgttgcggctcgcggcgccggagcgggtggcggacctgctctccgtggcccctcccgtctcgtga

SEQ ID NO: 4155 - DNA, 192 bp, Myxococcus xanthus
atgctgtggctcacctgcgagggcgatgcgaaagactacgtgctgcaccccggcgacacgctgcgcatggagcgctccgggcacgtggtggtgcaggcgctgaagccctcgcgcttctgcctgatgcagcgcactccggtccatacgccgtgcacgcctccggcgaggaagcatgaggcgcctgtccgatag

SEQ ID NO: 4156 - DNA, 132 bp, Myxococcus xanthus
atgcaggcggtcggagacatcgcgggccacgacgtgccaggcgccatctcgatttatgagctcagcatggaagagtcgctcgccacgaccattccctgcccgaagctccgcgcctgggtgaaggaggggtga

SEQ ID NO: 4157 - DNA, 333 bp, Myxococcus xanthus
cttcaggcgcgcagagtggcccgggtcctgcggtatctcgaatcaaagttcatggaggactgctcgctggacacgctcgcggatatcgcggggctcacgagctttcacttcctgcgcatgttccgagcagtgacaggacagacgccccgccagctcgtcatcgctacgcgactgggcatggcggcctcggcgctgcgcggcagccgtgcgcgaatcaccgatgtcgccctggatgccggcttcggtgacctgtcccacttcacgacgagcttcacgcgagcgttcggtctctcacctcgcgcctaccgcgctcgcgcgcgccaacacgcctga

SEQ ID NO: 4158 - DNA, 672 bp, Myxococcus xanthus
tttggcgcggaccgcgccgcgcactacgacgcccaggcgtccgtcgcgctcgcgggcacccacgccctgtatgaactcggcgtcagcacgctgacggcccagctcgacggccaggacgcggcctcgctgctcttcgtgggagtgggcacgggtgcggagttgatgccctacacccgcttcgacgtccccggctggcggttcacgggcgtggacccctccgacgccatgctcggcgtcgcgcaaaagcgcctggaggcggagggcctcctctcgcgcacgcacctgcaccacggagagctccacacgctcccgtccggccccccctttgatggcgcgcagatgatgggcgtcctccaccacgtggagggtgaagcagcccgcctcgatttgctccgggaagtcgcccgtcggctcaagcccggagcccctctcgtcgtgggctgccgcatcggcatggaccccgagctgttgaacgtggagctccggcgatggcgggcctatggcaccccacgagaggaactggagcgccggcgcgagcgcttcatgacgctacggcccatcgagtccgatgccgccctgttcgcgatgctcgccaatgcaggactggtcgcgccgaagccgatcttcgtatcgcttcagttcaaggtgttcctggcgcgatacgcgccctga

SEQ ID NO: 4159 - DNA, 552 bp, Myxococcus xanthus
atgagccagaacctctacgacattcccctcaagtccatcgatggtgccccgcagtcgctcggccagttcaagggcaaggtcctgctggtggtcaacgtggcctccaagtgcggactgacgccgcagtacgaaggcctggagaagctctacgagcgcaagcgcgccgagggcttcgaggtgctgggcttcccggccaacaacttcctgggccaggagccgggcagcgagtcggaaatcaaggcgttctgcacgctgacctacgacgtgaagttcccgctgttctccaagatttcggtggtgggcgcggacaagcacccgctctaccacgcgctgacgggcgccatcccggacgccgtgggcgaaggccccatgcgcagccggctccagggctacggcatcaccgccaaccccgtgccggaagtgcagtggaacttcgagaagttcctcgtcgggcgtgacggccgcgtcgccgcgcgtttcgcgccggacgtcgccgcggatgatgcgcgtctgctgtccgccatcgacgcggagctcgcgaagcaggcttga

SEQ ID NO: 4160 - DNA, 1509 bp, Myxococcus xanthus
atgagcacgttcattcctggtcccccgcccgagcgcggactgttctgcaaccgcaccctcaacctgcgcgccatcaaggcggtgggttacgacatggattacacgctcatccactaccatgtggaggcgtgggagcgccgcgcctacgagcacatccgcgaccggctcgtcgagcagggctggccggtggcggacttgtcgttcgaccccgagctgtcgatgcgcggcctcatcatcgacacggagaagggcaacctcctcaaggccaaccgcttcggcttcgtgaagaaggcgctgcacggcacgcaggccatgagcttcgaggcccagcgcgacgaatacgcgcgcaccatcatcgacctgcatgagcagcgctgggtgttcctcaacacgctcttctcgctgtcggaggcgtgcatctacgcacagctcgtggaccggctggacgccggccagctcccgggccccatgggctattcggacctctacgagcacgtgcggaagaacctggacgccacgcacatgcaggggcggctgaaggcggaaatcatcgccgacccggagcgctacgtcatcgacgacccggagacgccgctggcgctgctggaccagcgcaacgccggcaagaagctgctgctcatcaccaacagcgagtgggcctacaccgagcccatgatgcacttcgccttcgaccggcacctgccggaaggcatgacgtggcggcagctcttcgacgtggtgattgtctccgcgcgcaagccggagttcttcaccacgcgctcgtcgctcttcgaggtggtggagtccagcggcgaggcgctgctgcgtccgcacacgggccccttcaagccgggcacgccgtacttcggcggcagcgcggtggagctggagcgccacctgggcatgagcggtgaccagattctctacgtgggcgaccacatgttcggcgacgtgcacgtgacgaagaatgtgctgcgctggcgcacggcgctcatcctgcgcgagctggaggacgaggtgcgctccatcgcctcgttccgcgccacggagacccggctggccgagcgcatggtggtgaaggagcggctggaggcggagagctgccagattcgcctggagctccagcggcggcgcttccagtacggcccgcgcacggacacgccgtcggagacggagctggtggcgcggctggccacgctgcgcacggagctggaggcgctggacgcggagctggggcccctggcacgcgcggccaccgagctgtccaaccccatttggggcctgctgacgcgcgcgggcaatgacaagagccacctggcccggcaggtggaacggtacgcggacatctacacgtcgcgcgtgtccaacttcctgttcgccacgcccttcgtctacctgcgcagcccgcgcggcagcctcccgcatgacccaagcctgcccggcggcacgcccgtcttcggcgccagcgaggccggcggcggcatgtccggcacggacggcggggagtaa

SEQ ID NO: 4161 - DNA, 225 bp, Myxococcus xanthus
atgggccccacggcgcaggacttcggctaccgcaccatgcgcggcgagcgccggccccagtcctggtgccgcggctgccgtggcctgcacctggagcccacggagacggcgcggaccagcaacaccgccccgcgcggcgcggacggctggctgttcccgcccgagagcaccaccagcacccgcccgccccggcgtggcaaagggtcgtcgactcagtcccgctga

SEQ ID NO: 4162 - DNA, 864 bp, Myxococcus xanthus
accacccatttccgcaactggctgtcgtccaacggctacgacagctacgacttcattcgcacggacctcacgggcggcagctacggcggcaaggccagcgcctccgacaccgtgacgaagcagcccgtcatcttcatccacggcaactcggacaaggcggtgggctcggtcttcggccagacgggctggaccaactccctcgagtacttccactcgcggggttacaagacgagcgagctgtacgcgacgacgtggggcccggccaacgcgctccagtcggcgaaccagtaccactcgaagcagaacgtgatgaaggtgcgcaagttcatcgaggcggtgaaggcgtacaccggggcctcgaaggtggacatcatcgcccactccatgggcgtgacgctggcgcgcaaggccatcctcggcggcacggcccacgacgcggcggacggcggcacatacaacgtcggcgtaccgctcacgtcctcggtggacaccttcgtcggcatcgccggcgccaacctgggcctgacgtcttgttacatgtccggcccgtcgacgcccacctgcggctccaccaacggcctgtacccgggctacctcttctggggcagcgtcaccggccgctcgacgtacctcaatgacttgcgctcgacgagcggttacgagggcgccttccgctacaccatctactccacggcggacgaaatcatcggctacgacggcatcgtctacggtgagtacacgtcacgcatccccgggcagacgggtgagaagcgctacaccggctatccctacggccacttcaactcgaaggacctgacggccgaggttcagtacgacatggtggtcaaccacaccatcccgtag

SEQ ID NO: 4163 - DNA, 1437 bp, Myxococcus xanthus
atgggcgcggtggcacacaaagcaaagctctacgagcaggtggccgagcggctcgcggatgccatctccgcgggcaccttgcagcctggagacagactgccgtccgtgcggcagctcagcctgcgcgagcgggtgagcatctccacggtcctccaggcctacctgcacctggagtccctggggctcatcgagacgcgcccccagtccggccactacgtgcgccgccgtgagcggccccggctggcggagccccaggtgtcccggcccgcgtccagcgccaccgctgtcaccgtcagcgggctcgtcgcgagcgtctaccggtccatgggggatgcccgcatggtcaagctgggcgccgcctcgcccgcgccggagctgctgcccgtccgcaggctgtaccgcgagctgaacgcgctcagccgcgaatcgcgcgaccggagcatccagtacgacgcgctgcccgggtgtccggagctgcgccagcagctcgcgcgccgctccatggactggggctgctcgctggccgcggacgacttcatcaccaccttcggcgcgtccgaggccatccacctgtgcctgctcgcggtggcccgcccgggagacaccatcgccatcgagtcccccgcgtactacggaacgctgcagtccatcgaagcgctgggcctgcgcgcgctggagattccctgctgcccgcgcaacggcatgcagatggaggcgctggaggcggcgctgacgcggcggcgcatcgccgcggtgctggcggtgcccagcttcagcaacccggtggggagctgcatgcccgacgtgcggcgccagcgcctggtgaacctgctggatgctcacgacgtgccgctcatcgaggacgacatctacggcgacctgcacttcggcgccgagcgtccgcgctcatgcaaggcattcgacacgcgcggcaacgtgctgctgtgcagctcgttctcgaagacgctcgcgccgggcttccgcgtgggctacgtggcgccgggccgcttccgggagcgggtggagttgctcaagttctccacgtccgtgacgaccgccacggtgccccagtatgcgattgcgcgcttccttcagaatggaggctatgacaggcacctgcgctccttgcgccgccggctcgccgcgcaggtggagcgcatggccgaggccgtggcggagttcttccccgaaggcacgcgcgtgacgcggccctcgggcggcgcgctgctctgggtggagctgccgcggcaggtggactcgctggcgttgagtgcgaaggccctggaggcgggcatcagcatcgccccggggcccatcttctccgcgcggatggattcctatcgccactgctttcggctgaactgtggccacccgtggacgccgcgcatcgaggcggccatgtccacgctgggggcgctggcgcgcagcctgacctga

SEQ ID NO: 4164 - DNA, 102 bp, Myxococcus xanthus
atgacgaagcccgagcgcatccagcccttcgggttctggctccacaaacgcgtgacgcagttgacgcgcatcgtggagggcaacctgcgcgaagtgctctga

SEQ ID NO: 4165 - DNA, 327 bp, Myxococcus xanthus
atgtccgactggaagcgcctacagaagctcaacggcggcgacgccatctggtactcggagccccagctcgatgtgaaggatgaggtctggctctactcggcgggaggcgagctgcgagtctggagcgcggggaccctctacaagccggagcccaagacgctgaaggtgtccgctcccgtgaaggagcgcttcacgctcttcaagttgctgtcccagctcttcgtcgacgtggaggtgcgcggagagaaggccgtggtccgtcgaggcaccctgaacggcgcccacctcatctccctctgcgacgcatcggacgttggaatggcgtga

SEQ ID NO: 4166 - DNA, 951 bp, Myxococcus xanthus
atgacgctctgggagctgggttgtggcgcacacggtggacggcccgcgacggcactggagaatcacgggggcacctgcacgcccgaactctacggcgcggggctcttcaccaccggggcctgggacttcttcatggccttctctccagatcagcgacgcgtgctctttggaagggcagatgaccgtttccaacaatatacgctctacgaaacgcagttgaccgaagaagggcactggtcccgtccggtgctcccgcgcttcgccaccgagtggagcaacgcggacccacacttctcgcccgacgggcgcacggtgtacttcatctccaaccgtcccgagcttggggagcaaggcccccgaagctcgtatgacatctgggccgcgtcgctggacgccgacggagcatgggaggacgcgcgacgccttccggcccccgtcaacgacaagcaccgcgacgagtggtcaccggccgtggccgccaatggcaatctctacttcgggggtgagcgagacggcacactgggtggcagcgacctctgggtctcccgctgggtcgacggcgcctaccagccgccagagaacctggggcccggcatcaactcgtcggtccatgagctcgagccgtggattgctcctgatgagagctacctcatcttcagtgcactgcggcgggaagatggcctgggcggatacgacttgttcctcagccgaaaggtggatggcgcatggacgcctgcacgccggctctgcgagggcatcaacacgcccgcgagcgactacaaccacagcgtctcccccgacggaaagtggctctacttcagcagcacccgccctttcacgggcgatgtgggggcacgtttcgatgcgccacgggatgacagcgccgtccagggcattggccgcggcacgggggacatgtaccgcatccccatgagcgcgctggggttgtga

SEQ ID NO: 4167 - DNA, 609 bp, Myxococcus xanthus
atgaagaacctgacgcgtgcgttggtgctgtcgctctcactcctcgctgtgtcgtgtggtgactccaaggaagacgacaaagacggtgagggaggaggcggcggtggaggaggcggcaacgcgctccagtgctccgcggtggggtggtgcacgacgtggagcgcggaccccaacgaggtgacgaacgcaccgccgctgacggggggcaccctccgggagggcacctaccgcgtcgagcagggcaatggctacgacgcggcgatggtcctccgtggcagctccgtcatcctcctggggggaagctggaacaactacctgggcacctggaaggtgagcaacgggaagctggagctgacccgggcttcctcgtgcgacgactacagtgaggggccgctggacaacctcgtcaccgaggtccatgccttcgcggtccggggcgacgaactcttcacccaggaccaggacgactcgcgggggaccatcctccgctggaagcgggtgagtgacctgtgtgaggagagcgcctcgttcaagtgccggggtggcctctgctcctgcgccacgacgacgaacaggcccatgacggggcagcagagctgcagcgggtga

SEQ ID NO: 4168 - DNA, 2631 bp, Myxococcus xanthus
atggagttcctggagggcggcacgctgcggcgctggctgacggagcaaccgcgcccgctccgggaggtgctcgagcgcttccggcaggcagcggatggactcgccgcgtcgcacgcgctgggcatcgtccaccgggacttcaagccggacaatgtcttgctgacgaaggggggcctcgtccgcatcaccgactttggcctggccaacgcgaccctggtgcctggaacggcggctcccggcacggtgtctccggcatccctcaccgtcacggggaccttgctgggcacgctggcctatggggcgcccgagcaactccgcggcgagcacggtgatgcccgttcggaccagttctcattctgtgtcgcgctctacgaggcgctcaacggccagcgtcccttcgagggaaagacgcgtgaggccttgctggagcaggtggcgcggaaggccgtgcgtccggaacgcgccggtgtccccgcgtggctgcgggccgtcgtccggcgcgggctctccgccgaccccgcggagcggttctcctccatggaggtgctgcgtgcgcggttgtcccgggaccccggggcgcgctggcgcacggtggccctggtgatgctgggcgcggtcctgacggggctggctgtgttcgggctgctctccaggcaggcgcctcaagcgctgtgtcagggcagtgagcggcacttcgcgggcgtctgggatgcggagacgcgggaggccacccggcgggccttcctggccacgggcgccctggacgcggaagcgtccttctccgcggtggcggcggcgctggagcgctggaagctggactggacgcgcgcgcaccaggaggcctgcgaggccacgcgggtctggggcgagcagccagagcaggtcctgggcctgcgcatggcctgcctcgacgagcggctggaagaggtgacccgcgtggtggcggcgctccagggcgcggatgcgcgcaccgtggcgcgcggcttcgggctggggggctcgctggcgagcctgcggcgctgctcggacgcgaggacgttgctggaggccgtggcgcctccggaggacccggccgtgctgttggaggtgacggcggtccgggcggagttggcccgggcgaacgcggggctgttcgcgggccatacgccggaggcgttgaaggtggcgctggcggcacgggagcgggccgtgcgcacgcgctaccgcccgctggaggcggaggcccacctgctgtgcgccacgctccaggaagacgccagtgcgttcgaggatgcgcgagcctcgctggtccaggccggcctcgccgcggaggcggggcgccatcatgccgtgctggcccgggtgctctatgcccaggcgtggttgagtggccatgacttggaacggacccaggaggcctgggcctatctgaaccgcgctcaggcggtggctgagccgctgcgcgaccccgagttcgacgcgctgttgaactatgtccgcgccgagttgttcgaacaggagggacgtttctccgaggcggagccgctgctgcgcgaggcgctggaccgtgtcacggcgaagggcgtctcccatgccgctgcccgcgcggagctcaacggacgtctgggcttgctggcccgtcatcagggccggctcctggaagcgaagcgctggcaggaagaggcgctgcggcttcaggaggacttgcatggccccgaccaccgcgacaccgcccgggccctggtgaacctgggcggcacgctggcccacgcgggggagctggcccgcgcggaggccgtcgtgcagcgggcgctggccaacctccgccgcagcctgggcgaggaacacctcgtggtggcgcgcacgttgtccaacctggccgtcatctatttcgagtgggggcgggggccggaggcgctgcgcgcggcggagcagagcctcgcggtcgctcgcaagagcgtgccgccggaaggcgcggacgcggtgctcatgggcatgacgtcgaaccggacgggggtgctgggtgagctgggcgcgcgcgaggctgagctggagcaggcccggcgcagcctggcccaccgtgagcgcgtgtacggcgccacgcatccggaggtcgcgctggacctgcacgaggtggggcggctgttgcgattgctggggcgcgcgaaggaggcccggggtttccacgcgcgcggcgtcgcgctccaggagtcgttggtggcgcgcggcgagctggagggggaggggctgcgctggctcgcggatgccctgctgttcctggggcgcgtcgaggaggctcggggccacgcggagcgggcgctcgcgaggctggagcgggactgggggccggtggcgccggagcgcatcaaggcgctggtgctgatgggcgacatccatctggcgaggcgcgcgccagcggaggcggtggcgcccttgaggacggcgctggcggcgctcgcgagcgaacaggtggcgtccgcgcgggttcccctggcgcggcggcggctcgcccaagccttgcgtcagtccggggcgtccgacgaggcgtgtcaggaggcgcgcagggcgtggctggagtgggagccctggcgcaaggcctaccccggtgaagtcgccgaggctcgcgccgaaaaggaccgctgtccgcgctag

SEQ ID NO: 4169 - DNA, 363 bp, Myxococcus xanthus
atgctggccgcggaccccgcgcaaggcgggctggagctggggctggttcgcgaggaggcccgctcgcacgtgcgcgccgccttcgtccaggcggtggcctccctggatgacgaggaccgggagttgctgcgtctccacttcgtcgagcatctgtcgctggctcgcatgggggaactctacggcgtgcacaagtccaccctgtcccggcggctgtccggggtgaaggcgctgctggagacgcgcacgcacgaggggctgacggagcggctgtcgctctcccaggaggaactggacagcatgatgcgggccgttcatggccgcctcgacgtgagcctgtccggactcctggcggcgaaggaatga

SEQ ID NO: 4170 - DNA, 852 bp, Myxococcus xanthus
atcagcccgcgccgcgaggtgccgctccacatcccccgtccggactacgcgctgacgggccgcccgtcgcgcaaggacgcgggctccgacatcaagacgccggacgtcatcgcccgcatgcgcaaggcgtgcaaggccgccgccgaggtgctgcaagaggtggcctcccacgtgcgtccgggcatcaccacggacgagctggatgcgattacccacgaggcgtacatcaagcggggcgggtaccccagcacgctcaactaccaccgctacccgaagtcgctctgcacgtccgtcaacgaggtcatctgccacggcatcccggacagccgggcgctggaggacggcgatatcgtcaacctggacgtcaccatctacctggatggtgtgcacggtgactgctcggcgacgtacttcgtgggcaacgtggatgaggagagccagcggctggtgcgcgtgacgcgcgagtgcctggagcagggcatcgccgcggtgaagccgggccggcccatcagcgacatcggccgcgcgattgagacgcatgccacccagcacggcatgagcgtggtgcgcgcctactgcggccacggcatcggcgagacgttccacacctcgctccaggtgccgcactactacgaggccgaggccgacaccgtcatgcagcccggcatgattttcaccgtcgagccgatgatcaacctgggcggctggggtcaccgcacttgggatgacgagtggaccgccgtcaccgccgacggcacccgcagcgcccagttcgagcacaccctgctcgtcaccgagcagggcgcggaaatcctcaccgtggcgtgagcccgtggacgcgcgcggccggac

SEQ ID NO: 4171 - DNA, 678 bp, Myxococcus xanthus
atcaccgcacagaacacacagggtgtcactcgcgtggacgtgatggcccccgaagctgtcgccgcgcaaatcgacgccgtggcctccgacatcggcgcgggcgcggtgaagacgggcatgctcgtcaacccggccatcatcaccacggtggcccaacgcttgcgcgcgctgggcctgggtccgctggtggtggaccccgtcatggtgtcccgcgccggcgcgcgcctcatcgacgacgcggcggtcggcgcgctcaaggagctgctgctgcccctggccacggtggccacgcccaaccggcacgaggcggagctgctcgccggcatgaagttggagacgctggaggacatgcgggaggccgcgcgccgcatccaccggctcggccccaaggcggtgctggtgaagggcggcggcatgacgggtgcgctgcgcggcaccgacgtctggttcgacggcgagcgcctggagacgctgcacctgcgcgcggtggacacgcgcaacacccacggcacgggttgcacgctgtcggcggccatcgccgcgcacctggcgctgggacagccgccgctggaggccacgcggcgcgcgaaggactacgtcaccgccgcgctggagcaccccctgcccctgggcaagggcccgggccccttcagccacttcttcccgctggaggggtag

SEQ ID NO: 4172 - DNA, 1530 bp, Myxococcus xanthus
atgaccgtgacgagcacgctgaaggaccgcatcgagaacaccgagttgctggcgaaggtcgtccccgtcgaagaggcggtgaagcacgtcgtccacggcaacaccgtggccatcagcggcttcaccaagtcgggtgagccgaagacgttcctgccggcgcttgcctggcacttctcccagacggcaccggacgcccgcatcaccctgctgtccggcgcgtccctgtccgaggatgtggagggccccatggcgcccttcatcgccaagcgcggtccgtacatgtcctcgcctgcctcgcggcgccgcatccatgccggagagatggacttcacggacgtccacctgtccgccttcgcgcgcaacctgatgtatggcttctacggcgacatcgacgtggccgtcgtcgaggtgtcgcgcatccggaagaacggcagcgtcgtcctcacgtcgtcggtgggaatcagcgcggaggcgctggcccgcgcgaagaagatcgtcctcgaggtcaacacctccgggccggactacacgggcttccacgacatcgtcctgcccgccgtccatccgcacgtgggctggccgctgccgctggtgaacgtgagggaccgcatcggcaacccctacgtggagctcgacctgagcaaggtggtggcggtggtggagtcccgcacgcccgaccacccggtgcccttcaaggcggcggatgacaccgccaagcgcatcgccgagcacgtcatcgacttcctgatgcgctgccgtgagcagtaccagtggggcaagcgcctgccgcccatccagtccggcgtgggcaacgtggccaacgccatcatcagccagctctacgaccctcccttccagaaaatccgcttctggaccgaggtcttccaggacgggatgttgcgctacgtggaggacgacgcaaagttcgaatacgcgtccgccaccgcggtgtccttctcctctgagggccgccagcgcttcctcgacatgttcgagcggagcaaggaccggctggtgctgcggcccatgtggctgtccaacagccccgaaatcatctctcgcctcttcgtcatcgcgatgaacacccccatcgaggtggacatctacgggcacgtcaactccacgcacatcgacggttcgcgcatcgtcaacggcctgggcggctcgggtgacttcttccgcaacgcgtacctgagcatcgtccacacgccgtccacgcgaaagctgcgggatggccgcaccgtgagctgtgtcatgccgtacgtgcggcacatcgaccacaccgagcacgacatcaagtgcgtcgtcaccgagcagggctacgcgctcaacatggacatccgctcgcccaagcggcgcgcccaggacatcatcgaccgctgcgcgcacccctacttccggccgctgctgcacgcgtacctggacatggcgggccctggcgacgagccgcgcgccaccgacatgaaggtgctccagggctggtgggcggactacgacgcggcgacgcgtgccttcccccagaacggctga

SEQ ID NO: 4173 - DNA, 357 bp, Myxococcus xanthus
atgaagcgcgccgaggcgctggaggcgctgggccgggatgaagcagcggagcgggactggacgctcgcgattgaggaggccctgggcaacccgtggctgctccagcagcgcgccgccgcgcgggcccgcctgggccggctggacgacgcggcgcaggacctcaccgaggcgctagcgtcccagacgggcgacgaggtggacccggagctgctgcacgcgcgcggtgtgttgcgtgagcggcaaggtgacgtggacggtgcgcgcgcggacttcgaggcgggactctccgcctttcgtgaaggcgacccacccgccctgctggacgcgcttcgtgaaggaaccatgcgcaaaccatga

SEQ ID NO: 4174 - DNA, 1011 bp, Myxococcus xanthus
atgaaagcctacgaactgaagcagacagggagcgccgacgcatgggtgcaggtggagcggccggagcccacgccgggccacggccaggcgctggtccggatccgcgcggtgtccctcaactaccgggacctctacatcgccctgggccgctatcccggaccgcgccctgcctccctcatccccgtgtcggacggcgcgggagaagtcgtggccgtgggccccggcgtctcacgcgtgacgccgggtgaccgcgtggcccccaccttcttccagacctggacggatggcccagcctcgccggagaagacgcggaacgccctgggtggcagcgtgaatggcgtgctcgcggagtacgtcgtcgtggacgcggaggggctcgtcctcctccctgaccacctgtccttcgaggaaggcgccaccctcccgtgcgccgccgtcaccgcctggaacgccctggtcgccgaaggccggctccagccgggccagacggtgctggcgcagggcaccggcggcgtgtccatcttcgcgctccagttggccaaggcgctgggggcgcgcgtcctcatcacctccagccaggacgcgaagctgaagcacgcccggacgttgggtgcggatggcaccatcaactacaagacgcacccggactgggaggagcaggtgctggcgctcaccggcggccagggcgtggaccacgtcctggaggtggccggcgaggagacattcccccactccgtccgggccacgaagcccgggggccacatctccctcatcggcatgctcagcggcggcttcgccaagccggaccccgccctggtggagcccaagaagctcgacgtccagcggacttacgtgggcagccgcgccatgttcgaggacatgaaccggctcctcatccagcaccgcctcgagcccgtcatcgaccggagcttcccctttgagcaggcgcgcgaggccctgcgttacatggagtccggcgcccacttcgggaagattgtcatcgccgtctga

SEQ ID NO: 4175 - DNA, 627 bp, Myxococcus xanthus
atgctcgagaagctgatgccgaagtcggacgagttcttcgacgacttcgatgcgcaatgtgccgtcaccgtcgaaggcgcgaagatgctctacgagttgctcagtgactaccgcgacgtcggcccgcgggtccaagcgctcaaggacgcggagcaccgtggggacgaagtcacccacaccgccttcaaccgtctgcacaagcagttcatcaccccattcgaccggggacagattcacaccctgctctcccgcatcgacgacgtgttggatttgaccaacgccgccgccgcccgcctgcactactacgaaatcccggccagcctgccggacgccacggagctggcacgcctgctggtgctgtccacgcagaaggtgcaggaagtggtggccgcgctgcggctcatcaagaagccggagcagattctcgccgggtgcaaggaaatcaagcgcctggagacgcaggcggatgaagccctgcgctcgggtgtcggccggctcttcaagagcggcgcagacacgctgctcatcatcaagtggaaggagatttacgacttcattgagaccgccaccgacaagtgccagtcggtggcgaacgtcatcgaaggcgtggtgctggagcacagctaa

SEQ ID NO: 4176 - DNA, 1026 bp, Myxococcus xanthus
atgctactcgccgccgtcatcctcattgtcgcggtcgcactcatcttcgatttcatcaatggattccacgacgcggcgaactccatcgccaccgtggtctccacccgagtgctgtcccccaacctcgccgtggcctgggccgcgttcttcaacttcgtggcggcctttggcgggaacgtccacgtggccaacaccatgggcaagggcatcatcaacttcgagatgctccgggctcagggccccagcgcggtgctcgccgtcatcttctccgccctcatgggcgccatcgtctggaacctgttgacgtggtggtggggcctgccctcctcgtcgtcgcacgcgctggccggaggcatgattggcgccacgctgccggtgcttggcttcgcgggcctggtgggctcgggcatcgcgaagatcgccgccttcatcgtgctgtcgccgctcattggcatgacgctgggcatcggtctgatggtgttgagcacgtgggcggtgcaccgccagacaccgctgaaggtggactcgtggttccgccggctgcagctcgtgtcgtccgccatcttctcctacagccacggcaccaatgacgcgcagaaggtgatgggcatcatcgcggtggtgctcttcggcaccatctggcaggaccggccgttccacatcgactggtggatgatcatctcctgccacgcggccatcgccctggggaccttcttcggcgggtggcgcatcgtccgcaccatgggccacagcctcaccaagctggcgcccatcggcggcttcgccgcggagacgggcggcggcgtcaccatcatcgcgctggcccaactgggcatccccgtgtccaccacgcacaccatcaccggcgccatcgtcggcgtgggcgccacccggggctggcgcgcggtgaagtggggcgtctccgtccgcatcatctgggcctgggtggtcaccatcccggccgcggcgctgaccgcggtggtcttctacggactcacccaggtggtcatgcgcctggcaagctga

SEQ ID NO: 4177 - DNA, 1347 bp, Myxococcus xanthus
atgtggatctgcggcggtgcgagcggcgcgcccatcggcgccgacctggcgacgtgctccacgtacaaccgctcgaccaatgcctgggcgagcgcgccctcgctgccggcggtccgtcgcggtggattgatggcttatcggcccggcgcggggatgtatctcttcggaggaacgtccaacggtgccgcgcgcaacgatctgctccggttcagcgcgggggcgtggaccacggtcaccgcgcagggcgcagcggggagtcctccgagcagtggtggggtgaagctcgagacggaccccacgacaggcgacctcgtcctcctcacggggaccggggcggtgtggaccttcgacggaacggcgtggcagcgggccacttcgtcgtctgcggcggagaccgtcacgctgtcggggacgatttcgggcggagtgacgagcggcttcagtggcgccaccatctgggtggtcgcgcccaccggcttcagcgcgaccacgttctacgtcggtctgacgggtggggtcgccagctacaagctcacgggggtgccggcgggcgttccgctctccgtctatgcctactacgagtcgggaggcctttattctcacaaggacgtgggggaggtggggccgctggtcgcggacacgacgttggacatcgcgctggaaccaggccccctggcgaccacgacgacgacaggcaccctcgtgcctcccgcggattggcccgccttcatcaatgcccgctatgcgcgaggggttcgcctccagtcaggacttcccgcgcagcccaatggccccccagagagcacgggcggcacgtcgaggacgttctccgcgacctacatccctgcgtccgcacccgccactcaggccgtctcgctcgaggcgacggtcgtgggggcatcgctctgcgagacgttgacgacctgggtctacaatcctcccgcgggtgctgtcggcgcggtggcgctaccggatggcatccggggcgtggcgccggggctgagtgaatgcggcaccgggacggtgccgacggtcgcggagggggcgtatcagctcaccgcgcccgcgggcacggagttgatctccgtgcgtcgaggcgcgcgagggatgtcgtgggactgggtgcatctctcgcaggcacaggcgggcgcgcaggccttcgacttcccgcagcccagcacgctggctccgagcaggcccgcccccagcggtcagggcacggcctgggaggtgaccgccaacgtcttcgagccgggctccggcttccgctacgagcagttcgagtccgcgaatctgcggcccacgagcaccgcgcgcagccacccgcgcggcttcgtgcgtcagtag

SEQ ID NO: 4178 - DNA, 2460 bp, Myxococcus xanthus
atgagggtgatgaaattcggggggacgagcgtgggcaacgccgagcggatgcgcggcgtggcggacctggccgcggcggcgcgcaagcagacgcgggtgatgatggtcgcctcggccgtgtccggcatcaccaacctcctgttggaagcggcccgcgcggcccaggaaggtcagccggtggagtcgctccacggccgcttcgaggacgtccaccgcggcatcatccgcgagctggcgccggagctgggggaggcgcggcagcgctcgctggaagagggactttccacgctggcctcggagctgcgcgggctgctgcagggcgtggggctgctgcgggaatgttcgccctccgtgctcgcgcacctgtccggactgggcgagcgcgccgcgtgcctgattctgggcgcgctgatgcacgcacgcggactggagccgcacgcagtggagccacgggacgtcatcctctgcgcgggggacccgctccaggccacgccgctccaggaggagacccgggcgcgcttcacgccgctgcgcgaggccggcggtcccgggttgatgctgatgccgggcttcttcggcggtgacacccggggcaagacgatgtgcctgggccggggtggctcggattattcggcggcgctggcggcggcggcgctggacgcggagctgctggagatctggacggacgtggacggcatcttcagcgccgacccgcggctggtgccagaagccttcccgctgcccgaggtgagcttcgaggaagccatggagctggcctacttcggcgccaaggtgctccaccccaagacgattgcgcccgcgcgcgagcgcggcatccccgtgcgcgtctgcaacagcttccgccccgaccacccgggcacccgcgtgaccgacgacgccgcgccgcccgagcacccggtgcgcggcctctccttccttcccggcatcgccctggtgaacctgggcggcgcggggctcaagggcgttccgggcaccgccgcccgcgtcttcgagtccatggccctcgccaacatctccgtggtgctcatcacccagggctccagcgaatgctccatcagcttctgcgtccagcaggcggacgcggagcgcgccgtgcaggccctggaagtcgcgttcgagatggagcgcgcggcgggcaaggtggacaccatcgagcagcagcgcgggctcgccgtgctcagcatcgtcggtgatggcatgcgccaccgcgtgggcgtggcgggcaccttcttcagcgcgctggcggacgtgggttgcagcatcgccgccatcgcgcagggctccagcgagcgcagcatctccgcggtcatcgcggagacggacggtccccgcgccctggcccatgtccacggtcggtgcttcggcaccacggaagtcgtggagctgctgctggccggcgtgggcagcgtgggcggcgagctgctcaagcaggtccaccagcaggcgcccaagctgcgcgcccacggcgtggacctgcgcgtctgcgtcatcgccaacagcaagcgcgtcgcgacggcgagcgagggaattcccctggaggactggaagcagcggctggcggccagcagcgacggcgcgcccctggacgccttccgcgactgggcccgcgcgaagcggccgggccggcccgtcttcgtggactgcaccagcagcgaggacatcgcgctcgcctacccgtcgctgatggaggcggggctccacgtcgtcaccgccaacaagaaggccaacgccggccagtggagccactaccgcaagctgcgcgagacggcctcccgtcaccaacgccgcttcctctacgagacgaacgtgggcgcggcgctgcccgtcatcgacacgctgaagaacatgcttcgcacgggagaccgggtgctgcgcgtggaaggcattctctccggctcgctgtcattcatcctgggcctgacggaggaaggcgtccccttgtcgcaggcggtgggcaccgccatggagaagcgcttcaccgaacccgacccgcgcgacgacctccacggcaccgacgtggcgcgcaaggtgctcatcctcgcccgcgagctgggccgccaggtggagttggagcaggtgacgctggactccctgctgccgtcggacttcgacgccaccgggccgctggatgacttcctcgcccggctcccccaggtggacgccgccttccagcgccgcgtggagacactccgcgcggagggcaaggtgctacgctacgtgggcagcgtcacggaggacggttgctttgtcgggctcgtgccggtgcccctgacgcacccgctggcggcggtgaagggcggagagaacgcgctcagcttcacctcggagcgctacagccccacaccgctggtgattcgcggctatggcgcgggcgccgcggtgacagcggctggcgtgctggcggacgtgctccgcctggtcgacgggccactcccctga

SEQ ID NO: 4179 - DNA, 1041 bp, Myxococcus xanthus
atggacgtgactcgcaagccgacccgagacctcacctgcaaggtgctggcgctcgcattcaccctggcgctgacaactgcgtgtcccggtgatgacgacgatgatgatgggggcaacggtcccccgggcgaccccgtcaccctgagcggcacggtgacgtacgacttcgtcccagccgtctactctccctccacgcggcgggggaccctggagttcaaccaggcccagaagcgacccgtgcgcaacgcagtcgtccaggtgcgacaggggacgcgggtgctcgtcgatggaacgacgaaccaagagggccgctacacgctgacgtacaggccgtctggcagcggcgcgctaacggtcgtcgcgctcgccaagacgacccagcccgaaatccagattgaggacaacaccgacaacaacgccatctgggcgttgggtggcgacatcaccacgacggtgacgaccaaggacttgcacgcgacccacggctgggcgggcaccagctacacggccagccggcgcatcgcggcgcccttcgccatcctcgacagcatgtacaccgcgtcgcgggccttcatggacgtgcgcccggtcaacttcccgctgctgaaggtgaactggagcccgaacaacgtgccccagtctggcagcaagccgcagggccgcatcggcacgtcgcacttctccttctcggagaacgaaatctacgtgctcggccgggacggcgtggacaccgacgagttcgacgcccacgtcatcgtcccagagtgggggcactacttagaggcccacctgtcgcgttcgtacagcccgggcggacggcactccagcggagacatcctagacccgcgcctagcctttggcgagggctatgcaaatgcgctcgccagcatcctactgcgggagcccatcaacgacgacacgatgtggaacggctcgacgctggccgccttaggcttcaacgcggagagagagccgcccagcacagacgacccggaaaagggcgccttctcagagatgagcgtcttccgggctgctctatga

SEQ ID NO: 4180 - DNA, 216 bp, Myxococcus xanthus
atgacgctcagcgcgtcccatgcgtcgcaggacgtgggcatcgaagtcttcggccagggccggagcctggcggagtccgacatcagctacaccggtacggagacggtcagcatcccgacccaggcggacgcgcggtacgtcgtcgtcgtgtacggcttcaaggagacgaccggtaactacagtcccttccccaccctctccatcaccagccagtga

SEQ ID NO: 4181 - DNA, 501 bp, Myxococcus xanthus
atgaacctcaaggcaatcgcagccctgtccagtctcctcgcgctcacggcgcaggtcgcctgcacctccccgtcgaagtcgaaccccacgcccagcgacagctcggacaccacgaaggccggcgcgccagtgaaggtggacgcgaagctgggtgaggaccaggcccgcgtctccctgcgcttcgacgcgccggcgaccgacgtcaaggtcagcctctccggcgtggacggactggaagtgaagagctccgccacccccgtgtcgggtggcagcttcaccccggacgccgtgtccgagttcgacgtgagcttcacgccgggtgaagggcagtctcacctcgtcgtcaccgtcacgggtgatttccgcggcgcgcacctgtcgcgggtgttcagcttcgcggtgggcacgcccacggcggcgcagcagaagaccgagggcacgacggtgacgggcgacgacgggcagcccatcaaggtcatgccctcgtccgacgccgagtag

SEQ ID NO: 4182 - DNA, 2100 bp, Myxococcus xanthus
atgacgaccgaccttcccgccccgaagccctcgacccacggcctcacagggacgctgttccacctctgggtcttcctcggctccttcctgctcttccaggtggagctcatcctcgcgcggctgctgctgccctcctacggaagcagcgcggccatctggacgacgtgcctggtgttctaccaggcggtgctgctgctcggttacttctactcgagccgggtcgcggtggccgcgcaccagggccgctaccgctgggcccacctgggcttcgtgctgctcgcggtggtcgtcttcccgttccggctgcacctcttcgagctgcaccccgtggcggccatcctgctcacgctgacgctgtcactggggctgccgttcctcgccctgtcgacgacgagcgtcgtcgcccaggggtggttcacccgaacggagcatccctcccggggtgacccgttcttcctctacggaacgtccaacgcgggcgcgctcacggcgctgctcaccttccccttcctggtggagccggcgctcgacatccaggagcaactggccgtctggtacgtgggctacggcgcgttcgtcgtcttcgcgctgctctgcatccagcgcgttcgcccggcgcttgccggtggaagcacgacgtccgagccagcggcccggaccgagccggtgccccgcgcgccgcgcgcctcacgcatcacctggctgctgctgtccgcgagcgccaatgcgctgctgctcgcggtcaccaacgtcctcacgctggatgcctccatcccgctgctgtggatcctcccgctctcgctgtacctgctcacgctcatcgtctgcttctcgaagcggccccccacgcccacggggttgaaccggctcgcgctgggaagcctcgccgtcgcggcgggcgcggcgctcttctcgctggcacgcgcgcagacgtcgctcccgtccctggtgctgcacagcgcggtgctttgggtgggctgcctgctgatgcatggcaacctcgtgtggtgccgcccctcggacccgcgcctgctgggctcgttctatctgcacgtctcgctgggcggcctggtgggcaccttgctgctggccctgctcgttcccctgacgctgggctcgctggcgctcccgtacctggaccacggcatcaccggcctgctcctgctgggaggactggcggcgcgggacatgatgcgccggggccaggggctgcccgtcccgaagctggcgccctacgtatcgagcggagccgccctgttcgtcgtcgcggtcctggtgctctccgggtggatgctcgcgcgcgggcgcatcgaaggctcgcgcaccttctacggcctctacacggtcaaggacgcggagggcctgcggctgttccagcacggcagcaccgtccacggcgtggagaacctccacccggacgagcgaggcgagcccctctcctactaccaccggggctccgcggtgggccgggtgctggcctcggaacggattccgcgtgagcgcgtggccgtcgtggggctcggcatcggcagcctcgccgcgtatggccgcactggcgagcattgggacttctacgagttggacccggaggtggagcggctcgcgcgccagcacttcagcatgctcggctccagccaggcggagctccgcgtcctcgcgggggatgcgcgccttcgcatggaggaagccaaggacggcgggtacgacgtcatcgtcctcgatgcgttctccagcgacttcgtccccacgcacctgctgacccgggaggcgctgagcctctatctccggaagctcgcgccggaggggctcctgctgttccatgtctccagccggcttttcgacctggtccccgtgctcacccgcttgagcacggagctgcgggtccaggggctcgtgaaccggacggagcgcctcaccgccgaggagctggcgtcgggccgctcccccagcgtctggttcgccatgagcgccaacagcgacgtcgtggcccgcctcacccaggagctgcccttccagccggtggacacgccgcccgagctgaaggacaggcgcgtctggtccgacagctacgtcaacctgctgcacgcgctcgcgcactga

SEQ ID NO: 4183 - DNA, 402 bp, Myxococcus xanthus
atgcccccgggcatcaccttcccactcttcgtgcgggactacctcgcctggacggagacgtccggcgcgcgcgtgtacctcatcttctccgcaccgggcagccgcaagcccattggcatcatcttccgccgggacgccctgggcggcgagcccgtcactcgcatgtgcgagtggtgccacagctacggctcggctcacgaggtgtgcctgctcaccacagcggtggacaacaagcgtcgtgtgggggtgaacctctgcgccgaccttcggtgcagggagaagatggaggacgcggcggaccgctccggtcgacacccgcttgaatttctcggaaagctcaatgaacgaatgtttcgtttcgcgcatgaggcgttgggcatcgaagcgcagcccgccgcctga

SEQ ID NO: 4184 - DNA, 124 bp, Myxococcus xanthus
atggcgtccaacgccggcctgggacgcttcgtgctggagcccttgcctggcgcatacagagtcacgacgcgggagtccgtcaccctcatccagggcgaggcggcgccgggcgcctgtcgtggcg

SEQ ID NO: 4185 - DNA, 2215 bp, Myxococcus xanthus
atgcgtaagctcttcttcgctggcgcgggcatggccgtactcgtgtccaccggctgtgcgacgacctcgcaggagtcccagaacttggccaccgcgccccagacgaccgcccccgccgcgccggctgctccggagcagaccaacccgctgatcgcgaagtggacgggcgcccatggcggcgttccgccgttcgaccaggtgaaggtggagctcttcaagccagcgctcgaggccgcgatggagcggacgcgcggcgaactggcggccatcgcgaacgacacctcggcgcccacgttcgagaacaccatcgtcgcgctggagtccgccggcaagacgcagggcgaagtggagacgctctacggcatctggagctcgtccatgagcgggccggagttccaggcgctggagcgggagatggcgccgaagctggccgccttcgacgacgaaatcttccagaacgaggcgctcttccgccgcatcgaggcggtgtaccagtcgcccgacaaggcgaagctgacgcccgagcagcagcggctcacctggctgcactacacgcgcttcgtccgctccggcgcgaagctggacgcggcggccaagcagaagctggcggccatcaaccagcggctggcgtcgctctacacgtccttcagccagaacgtgctcgcggacgaagagggctacaccgtcgtcctggagtccgaggcggacctggcgggcctgccggactccgtgcgcgcgggcgccgccgccgcggccgagtcgcgcggtcagaagggcaagtggctcatcaccaacacgcgctcctccatggagccgttcctgacgtactcgtcgcggcgcgacctgcgcgagaaggtctggcgcaactacgtcaaccgaggtgacaacggcgacgcgcgcgacaacaacgtcatcatcgccgaagtcctgaagctgcgcgccgagcgcgccacgctgctgggctacaagacgcacgcgcactggcggctggagaacgccatggcccgcacgcccgagcgcgccatggagctgatggaggccgtctggaagcccgcggtggcccgcgttcacgaagaggtcgcggacatgcagcgcgtggccaacaaggagggcgcgaagctcaagattgaaccctgggactaccgctactacgcggagaaggtccgcaaggcgaagtacgacctggaccagaacgaggtgaagccctacctccagttggagaagctgcgcgagggcatgttctgggtggccggcgagctgttcggcttctccttcacgcaggtgaacgacgtgcccgtgttccaccccgacgtgcgcgtctgggaggtgaaggaccaggccagcgggcgtcacgtgggcttgtggtacttcgacccgtacgcgcgcaagggcaagcgctccggcgcgtggatgaacgcgtaccgcagccaggagcggttccggggtgaagtcaccaccatcgtctccaacaactccaacttcgtgaagggccagccccggtgagcccgtcctcatcagctgggaggatgcctccacgctgttccacgagttcggccacgcgctgcacggcctcagctccaacgtgacgtacccgtcgctggccggcaccgcggtggcgcgcgactacgtggagttcccctcgcaattgctggagcactggctgtccacgcccgaggtgctgaacacctacgcgctgcactaccagacggggaagcccattccccaggcgctggtggaccgcatcgagaaggccgccaccttcaaccagggcttcgggacggtggagtacctgtccagcgcgctggtggacatgaagctgcacctggcgggggctacgcccattgacgcggacgccttcgagcgcgacacgctcaacgcgctgggcatgccgaaggaaatcgtcatgcggcaccgcacgccgcagttcggccacgtcttcgcgggtgacggatactcggcgggctactacagctacctgtggtcggacacgctgacggcggacgcctacgagcgcttcaccgaaggcaagggcgcctacgacaaggacgtggccgcgctcctgcgcaagcacgtcttctccgtgggcaacacgctggacccggccgacgcgtaccgcgccttccggggccgtgaggcgggcatccaggccctgatgcgcaagcgcggcttccccgtgcctgccgcgcaggccgcgccgaagaaggccgcgaagtag

SEQ ID NO: 4186 - DNA, 990 bp, Myxococcus xanthus
actcatcccatgccgctgtctgtcgcgccgatgatggactggacggaccgcaactgccggtacttccatcgccagctcagccgccacacgctgctttacacggagatggtcaccacgggcgcaatcctgcatggcgaccgggagcggctgctgggctacgacgccgcggagcacccggtggcgcttcagcttggcggttcggagccggcggcgctcgccgagtccgcccgcatcggcgagcagtggggctacgacgaaatcaacctcaacgtgggttgcccgagcgaccgcgtccagtcgggccgcttcggcgcgtgcctgatggcggagccggacctggtggctcggctggtgggggcgatgcgagaggcggtgagcatcccggtgacggtgaagtcgcgcatcgccatcgacgagttggaggagtggcccacgctggagggcttcatccggaaggtgtccgccgcgggctgcacccgcttcatcgtgcacgcgcgcaaggcatggctccaggggctgagccccaaggagaaccgcgacgtcccgccgctgcgctacgacctggtgcaccggctcaaggtggagttcccgcacctggacatcagcatcaacggcggcatcaagacgctggacgccgccgcggagcagttgcgccatgtggacggggtgatgatgggccgcgccccgtatgagaacccgtacctgctggccgaggccgaccgccgtttcttcggcgccaccacgccggtgccgcagcggcacgaagtcgtcgaggccatgctgccgtacatcgagaaggccatgctgcgcggcgcgccgctgggcgccatcacccgacacatgctggggctcttccaggggctcccgggggcgcgcgcgtggcgcaggcacctgagtgagaatgcccacaagcagggcgccgggccggaggtcgtcgtggcggcgctggcgaaggtgcggcgggagcccgaagccgaagtcgcggcctga

SEQ ID NO: 4187 - DNA, 300 bp, Myxococcus xanthus
atgcgtatccaattcaaccctggtgagctcatcccgctcgccgagcacggcacggtgtatcccggcgcccgcatcgtcgatgcgtggggctcgctcactgcgacctccgacgtgctcctctcctcggactggaagacggccacggtgaacgcccccccgtcgggcccccgagatgcacgctgggaaggcgagggctgggtgttggagctggcccccggctggcgcgccaacaaggggccccgaccaggagacctggttctccaggctcccgaggctcgctcaccggcgcctcaaccctaa

SEQ ID NO: 4188 - DNA, 1368 bp, Myxococcus xanthus
atgaagaaggactcgctcaaggcccgcctgcgtcgcacgttgcggtgggacctctggatgacgctgggccccgcgctcgtcatcgtcagcatcgcgttcgccgtcacgttctacttcgtcaagcccgcgccgccgaagaaggtcgtcatcgccgcggctggggacgagggcggcttccggtacttcgcgcgcaagtatcaggagattctcgcgaagcacggcgtcacggtggagattcgtcccacggacggctcgctcaccagcatcaaactgctggaggacgagcgctcgggcgtggacgtggccttcgttcagagcgggacgtccgacgccaccaaggcgccgcacgtcgtgtccctgggaagcctctcctatgtgccgttgtgggtcttctaccgagggcccactatcgacgacctgaatgccctgcagggcaagcgcatcgtcgtgggccccgaggagagtggcacgcgcgccctgtccatgaagttgctggaggccaacggcgtgggcgccgcgcccacggaactcttgaacctggggcgcgacgaggccatcgagcagctcaagcagggcaaggtcgatgctgtcttcatcgtgtccccagcggagtcgccgcccgtccagcggctcgcgcgggtgccggacatccatctcctcagcttctcgcggggcgaggcctacgtgcgccgctacccctatctgtcccggcacgtgctgccgcggggcgtgctcgacctggccgcggacgtgccaggccatgacgtggtgatgttggcgcccaccgcgaacctggtcgccaccgatgcgctccacccggcgctggcctacctcttgatgcgcgcggccagcgaggtccacggcaaggccggcatcctggaccgcacgggcgaattcccggcggcgctcgaggcgggctttccgttcagcagcgaggcgcgccgctactacgagtccggcgttccgctcctgcaccgctatctgccgttctgggccgccaacttggtggaccggctctgggtgatgctggtgcccttcatcgccgtcctggtgcccctgggccgggtggcgccggcgctgtaccagtggcgcgtgcgctcgcgcatcttccgctggtacgcgcggctgaaggaaatcgagctccagctcgaggagggcccgggccgggagatgctggaggagatgctgcggcggctcgacgaggccgagcgcgaggtgaaccgcatccccatgcccctggcctacgcggagaacctctacttcttccgggagcacgtcgacgtcgtccgtcgccgcctcacccggcgcatcgccgaatccggcgagccctcgtccgaggtgctcacggcccgggagaagaccgcgtag

SEQ ID NO: 4189 - DNA, 1083 bp, Myxococcus xanthus
tcgcttgaaaccctcggctggggtccagccttcgaacacgcattctctacgctcgtctcgcagtccccactgtccctcgtccctggccgcgtcgtgcgccagcatcgagggctgctcacggtccagacggacacgcgcaccctgttggcgcgcaccgcgggccggcttctccatcaagcccccggcgtcgagtccctgcccaccatcggcgactgggtggcgctccaactccccgatggggacggcgaggcgctgctccacgcggtgctgcctcgcgccagcgtgctcgcccggcgcgaggcgggcagtgagcgcgacgggcagctcatcgccgccaacctggacgtcgtggtcctcgtcgcgggactggacggcaacttcaatccccgccgcatcgaacgggcattggcgctggcgtggaccagcggcgccgcgcccgtggtggtgctcaccaaggcggacctgcgcccggacgcggactcgctcgtggccgaggtggaggagctggctccaggcgtacccgtgctcgcgctgagttcctggacgggggagggcatcgaggcccttcgcgcgcagcttccggccgggaagacgggggcgctgctcggttcctccggtgttggcaagtccacgctggtcaaccggctcctgggcgaggcgcggctggtcacccaggcggtccgcgccgaggacgacaagggccgtcacaccaccacgcaccgcgagctgttcgtgctcccgggcggcggactgctcatcgacggacccggcatgcgcgagctggggctgtggggcgaggatgacggcatcggccagacgttcaccgacatcctcgagctggccgccggctgccgcttcacggactgccagcaccagcgcgagcccgggtgcgcggtgcgcgcggccgtgtcgtcgggggccctgcccgaggcgcggctcgccagctacgagcggctgcggcgtgagcaggcctatcaggtccgtcagcgcagtgcgtccgccgagcgcgaccaccggcgccacgagcgcggcaggaccttgatgggctgggaggcgtcacgctccaagcgccggcgggactga

SEQ ID NO: 4190 - DNA, 84 bp, Myxococcus xanthus
atgttcgagccaccccaggaggtgatgctcggctttggcgtgatggaccccttctccagcttcctcaccttcgtggtgtgcgtg

SEQ ID NO: 4191 - DNA, 534 bp, Myxococcus xanthus
atgccggtgttcaccgcggccttcgtcatcatcaccttctcctccatcgcggtgccgggcaccaacggcttcatcggtgagttcctggtcctgctgggcaccttcaagagcgacctgggcgaggccgcgggcaacccgcacctgacggcggtgttcggcgccttcgccacgctgggcgtcatcctgggcgccgcgtacatgctgtggatggtgcagaaggtgttcttcggtggaatcacccaccgggagaaccagcacctgacggacatgaacctgcgcgagggcctcacggtgctccccttcatcgtcctggtcgctgtgatgggtctgcagccgcagcccttcctggaccggctggcgccttccacggaccgcttcctggcccgcgcccgcgtgggcacgccgggggccgagttgcaggaggaccgacttcgggtagaggtgatgtccctgccatcccgtcaggtcgtcgccgcgccgtccgcgcccgttccgttggccgccgccccggccgttccctcgccgcggcagtag

SEQ ID NO: 4192 - DNA, 1203 bp, Myxococcus xanthus
  unsure (1)..(1203): unsure at all n locations
atgagcttcttcgacaaccacctgctcaacctcgtcgtcttcctgccgctggtgttcgcggcgctggtggcgctgctgcctgccggcgagagcggccagattcgcaccgtcacgttcatcgccatggtgctggacctggcgttcggggtctgggcctacatggcgtacgtgccgggcgggccggagttccagctcgagtaccgggcgcgttggttcgacctgttcggcaccagctaccacattggcgtggacggcctggccgtgagcctgctgctgctcaccgtcttcctggggcccctggtggtgctggcgtccaccacgtacatcaagttccgcatcaaggaattccacctggcgctgctggtgctccagacaacgatgctgggcgcgctggtgtcgctggacgtgctgctcttctacatcttcttcgaggccatgctcatccccatgtacctcctggtgggtgtgtggggcnccgaggaccgccagatggcggcggtgaagttcttcctctacacgctggccggctcgctgctgatgctggtggccatcatcgccgtgtacttcatcagctcgccggtgggtgcccgctcgttcgactacgcgagcatctacaacggcctgctggacgccaaccgtcagctcagcgcatgcaccgcggggcccgcgggcgcgtgtgactcactcaccgggctggccgccacgctgcacacctggggcccgtggctgttcgcggcgttcgccatcgcgttcgccgtcaaggtccccatgtggccgctgcacacctggttgccggacgcgcacgtgcaggcgccagtggccggctccatgattctggccggcgtcaccctgaagatggggaccttcggcttctggcgctacgcgattcccttcttcccggtggccacgcagcaggcgcggcccttccttgccacgctggccgtcatcggcatcgtgtacggcgcgctgatgtgcctggcgcagcgggacatcaagaagctcatcgcgtactcgtcggtcagccacctgggctactgcatgctgggcatcctggcgattacggccgagggcgccacgggcagcgcgtaccagatgctcaaccacggtgtgtccacgggcgcgctgttcctcctgttcggctacctgtacgagcggcgccactcgcgcctgatgggcggactacggcgggcatcgcgaaggtga

SEQ ID NO: 4193 - DNA, 2229 bp, Myxococcus xanthus
atgactctcgtcgaattcttccgggcggcacccgtggcgccagacatcctggcgccctcgctctggctcatcatcgcgctgcccctgctgggcgcgttcatctgcggtgtgttcggcaagatgatgggccgggccaacgtccagctcgtcgcctgcgcggcggtggccggctccttcgtcctgagcctgttggccttctgggccaccagccaccacaaccccgagacgggtcggctggcggccatcttccccaacccgttcggcatcgagcgggacttcgtgcgctacgcgctcgcgtacgactacggcacctggttctcggtgggcgacttccgggtgaacttcggactgatggtggaccatctgtccggcatcctgctgctcatcatcaccggcgtcggcttcctcatccacctgtactccaccagctacatggagcacgacgccgcgtactggcggttcttcgcgtacctgaacctgttcgtcgcggcgatgctgacgctggtgctggccgacaacctgatcctgctcttcgtgggctgggagggcgtcggcatggccagctacctgctcatcggcttctggtacgacgacccggccaaggcctgggctgggcgcaaggccttcgtcaccaaccgcatcggtgacttcgcgttcctcgtcggcaccttcctgctggtgctgctggtctccgccttcacccagcagtcgaacgcggcggactacaacaacgccggcaccaccgcgcagcactacacggccgcgctggagaagaagggcccggtgacgttcaagggcctggagaagatggccgagggcctggtggacggctccgcggacaaggtcgacctgagcacccccatcgaggcgggcccgctggagggctacaccttcggcggcgtgatgacggtggccatgctgctgttcctcctgggcgccgcgggcaagagcgcgcagttgcccctctacgtctggctgccggacgccatggccggcccgacgccggtctccgccctcatccacgccgcgacgatggtgaccgccggcgtctacctgttcagccgcatgtccgcgctgctggtgctgagccccaccgccatggcgaccatcgccatcatcggcgcgctcacctcgctgctggcagcgctcatcgccttcgcgcaggacgacatcaagaaggtgctcgcctactccacggtgtcccagctgggcatcatgttcatgggcgtgggcatgggcatcttctgggcggcggtgttccacctgatgacgcacgccttcttcaaggcctgcctcttcctcggcgccggcagcgtgatgcacggcaacggcgacgagacggacatcaagaagctgggaggcctgcgcaaggagatgccctggacctgggccaccttcctggtcgccaccctggccatcaccggcatcatcccgctgtccggcttcttctcgaaggacgccatcctgcacggcgtgcaccacaaccacctgcagggcctggagtgggtgtccagcctcgtctactacctgggcctgctcatcgcggcgtccaccgcgttctacatgacgcgcgtgtacctgctcaccttcgagggtccccgctcgaaggaggcccgggtggcccacgcccatgagagcgcctggcagatgaccctgccgctggtggtgctggcggtcctgagcgtggtcgccgcacgttacgcgttcggcatcgacttcctcaacatgacggcgcagccggtgctcgacaacttcctgagcccggtgttcagcgcgaccaagcgcatcaccgacgccagcacgctggtggcgctggacaccagccgcccgcagttggtgccggactacctcaaggcctgggccgtggccctggcgggtggcggcgcggcggccttcctctacctgcgctacttcccttcgcgcgtgggtctgccggatcccgccttcatccgcgcggtgcgccccctcgcgctcaacaagttctacgtggacgagctctatgagctgattgtcatccgtcccgtgaagttcatgagcttcctcctcttccgcgtggtggacgcgctcgtcatcgacaccgtggcggtccgcggcacggcgtgggtgacggcgcgcgtgggcagtgcgctccgctacgtgcagtcgggcgatgcccaggcctacgccgctgtgatggccatcgccctgttgggcgggatggcctacgccctcatccaggtgatgcaatga

SEQ ID NO: 4194 - DNA, 303 bp, Myxococcus xanthus
atggttcccatcacctattatctcctgcttgccgccgccctgttctgcatgggcatgttcggcgtgctcgttcgccgcaacgcgctggtcgtcttcatgagcgtggagctgatgctcaacgcggccaacctcacgttcgtggccttcgcgcgcatgcgcggtgacaacctcggccacgtgtccgccttcttcgtcatcgcggtggcggcggcggaagccgccatcggtctggccatcgtcatcgccgtcttccgaagccggggcagcatcctgctggaagacctccggacgatgaagcactga

SEQ ID NO: 4195 - DNA, 384 bp, Myxococcus xanthus
atggccggcatctacgtgctgctgtgggcgcacacggtggccgtcatgcaggtgctcgtgtacgcgggcgccatcatggtgctcttcctgttcgtcatcatgctgctcaacctgggagagtcgcccacgcgcggcaagcccacggtggcccgcgtcgcgggcggcgcggcgacggtgggcctgttcgcggtcctggccatcatcctcctgaagctgcccgccgagccggccacgctgagcacgggagcccaggcctccttcggcaccatcgccaccatgggtcaggtcatcttcacccagtggctgttcccctttgaagctgtgagcttgctgctgctggtggccatggtgggcgcagtcgtcgtggccaagtcgcggatctga

SEQ ID NO: 4196 - DNA, 1341 bp, Myxococcus xanthus
atggcctctacggcaaagacgatcgaaccgatcatctcggcggcctggggtaagcctcagtcctggaccctggacagctaccgcaagcgggggggctacgaggcgctgaagaaggcgctccagatggagcccgccgccatcatcgacgaggtgaagaagtcgaacctccgcggtcgcggtggcgccggcttccccacgggcctcaagtggagcttcgtccccaaggacagccccaagcccaagtacctggcggtcaacggcgacgagtccgagccgggcaccttcaaggaccgctacatcctcgaagacgacccgcacatgatgctggagggcatcgccatcgcgtcctacgcgctgggcgtgcacacctgctacgtgtacctgcgcggcgagttcaagttcccggcggagcgcacgcaggcggccatcgacgaggcctacaaggcgggcatcttcggcaagaaggtcctgggcaaggactacgagctgaactgctacctggtccgcggcgcgggcgcctacatctgcggcgaggagacggcgctgctggagagcctggaaggcaagaagggctggccccgtcttaagccgcccttccccgcggtggtgggcctcttcggctgccccacggtggtgaacaacgtggagacgctggccagcgtgcccgccatcttccagcagggcgcggaggcctacgcgaagctgggcaccgacaagtcgggcggcacgcggctcgtctgcctctccggcacggtgaaccggccgggcgtgtacgaagtgtcgatgttcacgaccctctccgagctcatcttcgacgacaagtacggccggggcatgcccgcgggccggaaggtgaaggccgtgattccgggcggctcctcggcgccggtgctgggcgcggacgagctggacgtggccatggagttcgaggccctcaaggtgaagcagaccatggcgggctccggcggcgtcatcgtcatggacgacaccacctgcatggtgcgcagcctgtggcgcgtggcccgcttctacgcggaagagtcgtgcggtcagtgcacgccgtgccgtgaaggcacgccctggcagacgcgcctcttgcgcaagatcgaagagggccgcggcgagccgggcgacatcgacatgctgtccaacgtcgcgtcgtcgatcgccccctacccgcccatcggcctgggtaacaccatctgcgcgctcggcgacgcggcggcgctgcccacgcactcgttcctcatgcggttccgggacgagttcgaggctcacatccgtgagcaccgctgcccgttcggcgacaagccctggggttcgttcggagactggtcttga

SEQ ID NO: 4197 - DNA, 489 bp, Myxococcus xanthus
atggcggagcccctgttcacctctgaagagcagaagaagttcgacgcgggaatcgcggagatcatctcccactaccccccggatcggaaaagcgcgggcatgctcccagcgctgcgtctgctccaggaaatcaagggatggctgcccccggaagggttgcggctggtggcgaagcatctggaggtcactcccgagcgggccatggaagtggccagcttctacgtgatgtaccacctcaagaagccgggcaagtacgtcatcgacgtctgcacgaacctgtcctgctcgctgtggggcgcggagaagatgctcgcctacctggaggagaagctgggcctcaaggcaggtgaagccaatgagaagttcaccttgcgagagaccgagtgcctggcctcgtgcggtactgcgccctgcctgcagatcaacgaggatcaccacgaaagcctgacccaggcgaagctggatgccatcctcgccaagttgagctga

SEQ ID NO: 4198 - DNA, 306 bp, Myxococcus xanthus
atgggcgtgtacgccgtgcgctgcctcgccaacggcaaggtgctggtgggcgcgagcgccaacgtccagggcatgctcaatcgcatccgcttcgagctgtccacgggcatggaccgcctgcccacgctgctggaggactggaagcgctacggggcggagcagttcaccttcgaggtgctcgacgtgctgaagccttccgacgagcccgtggtggcgccggaggaggagctgaaggtgctggaggcgctctggttggaccggctcaagccttacggcgacgcgggctacaacgtgcaaggcggttga

SEQ ID NO: 4199 - DNA, 750 bp, Myxococcus xanthus
atgaacccgggtccagaggacaagcgccagcacccccgcgtcccggccgtgctgagagtggactacacggacgggcgccaggcccgcgacgtgacggagaacctgtcccacgagggcctgttcgtccagacggaccagtccttcgtcatgggggacgaggtccggctcgcactttctttcccgggactgctggatccggtagaagtcagcggaaccgtggcctggatgcggccagcgggccccgatcagcctgcgggcgtcggcgttcgcgtggagcgcgagcaggaccggcggaaactgggtgacatcttgagtgcggcaggagcagacagccatgcgtcccacgcagagcacgagggctatcgtgtgctcatcgtcgaggacaacccgcacatcatcgagatgtacagctacgtgctgaagaagctggccagcggcgagctgcacggaaaggtccccctggaggtccacttcgcgccggacgggcaccacgcgctgctgatgctgcgcgaggaccgcttcaatctggtgatgacggacctctacatgccggtgatggacggcttcgccctggtggagcggatgcgcgaggaagacgcgctgcgcaccatccccatcatcgccatctccgccggcggcaaggaggcgcaggaccgcgccatgcagctgggcgtggacatctacctgcgcaagccggtgcgtttcgtggaagtcctggagacggtgaagcagctcttgcgcatcaagtag

SEQ ID NO: 4200 - DNA, 1551 bp, Myxococcus xanthus
atgcagaagcccgccctcaatcgcgacaccgtcagtggcgaggcgctgttcatcctccggaacctgagggagaacggccgtcttggacgctcgaacaagctggcagacgtgaaggccgcactcgagccatccgtgtcgctcgagttcgacaactacttcttcttcctgcgcaagttccactacatcgccatggaccgcgaggcccagctcaagctcaccgaccagggcgagcaggtggcgggtggggagctgaacgagcgcttctccctggaggtcggtgagttcttcgccgatcagctggtcgccgccgcggacgcgcccctggagggggccggtgggcacgagtcgctgatggttcccccgcctccgccggagctgctgctggacgaggccgaggtcgacggcgcgccgcatgtgccctccggcccgcccgcgccgccgcccatgccgccggtgcgcagctcgcgctcggccatgcccgcgctggacctgggcatgccgtccgcggccatccccatgccgccgccgtcagccgagccccgccgcgaggccaccgtcatcgtccaggggcccttcaccgcgtcgaacacccccgcaccgtcccccacccctcccgcgcctgccgccgcccccatgtctcctccccccgcttccaccgccgccgcagcagcgcccgccgctcccgctccgaagggtgccgagctggacctgcgctaccagaagttcgaccccatcggcaccgggccgctgggcaccgtcttcaaggggcgcgtcaccgcgctgggcctggacatctgcctcaaggagctgaaggacatctttggctacttctccttcctgcagcgcggcgaggtgctcaagcgcctgaagaaggagctgtgcgcccaggcgcaggtgcgccacccgggtgtggtccaggtggtggaccagaacgtggacgccgcccggccgtacttcgtgctggagctgatgcagggcagcctgcgtgagcggctggacgcgggcggtggcaacggcgtaccggtgcccttcgcgctgcgcgccttcctgcagatggcctatggtctgcgggccgcacacgccgggggcctcacgcaccacaacatcaagcctgagaacgtgctcttcgacgtgtacggcaacgctaagctggccgacttccgcctgggccgggtggtggaggtggacgccaccaagggcatgccccaggtcttcgtgggcacgggcggcatggcctacatggcgccggagctgatgaaccggggcggcaaggagccgggcgcctccgcggacgtgtacgcgctgggcatcctgctctacgagatgctcaccgggcagattccgggccgccgctcgccgctgccctccgaggtcaacccggaggcccccagcggcctcgatcagctattcgacaaggccacccaggacaagcgcgagcagcgctacccggacgtggacgccatgttggaggacttctacaaggcgttcccggacaaggagttcctcgccaagggcgacctcgtcatctcctcggacacgccgaaggagtga

SEQ ID NO: 4201 - DNA, 1200 bp, Myxococcus xanthus
atgactccgcccctgtccgaaagcgtgctcatcaccgtcaccgggaaggaccatcccggaatcgtctcgcgcctcaccggcctgctggcggaagctggcgccgagctgctcgacgtggagcaggtggtggtgcaggggcgcctcacgctctgcctgttggtgcgtctgcccccggcgagcggcaccctggagacgctgttgtccgccctgaagacgctgggcgtggcgatgcccttccaggtggtggaggcgcccgccacgcccgccgcgtccgcgcaccacgtcgtcaccgccgtgggccgcgccctgggcgcgagggagcttcatgcgctgacgcaggtgctcgcggggcacggtgccaacgtggagcgaatcacgcgcctcagcgagccgcacctgggctcggtggacatccacatcagcctgccgccgggccagccgcccgacgcgctcaagcacgcgctgctggagctgtccatgcagtcgggcgggttcgacgtggcgctgcagcgcgagagcctgttccggcgcggcaagcggatggtcgtcatggacatggactccacgctcatccgcatcgaggtcatcgacgagctggcgcgcgcgcatggcgtgggcgagcaggtgtcgcgcatcaccgagcgcgccatgcacggcgagatggactacgacgaatcgctgcgtcagcgcgtggcgttgctgcagggcctggacgcgtccgtggtccaccagctcgcggcgaacctgccgctgacggagggcgcggagacgctggtgcgcgtgctcaagcggctgggctaccgcaccgccgtcatcagcggcggcttctccgtggcggccgaggcgctgaaggcgcggctgggcatcgacttcgcgtactccaacgagttggagattcaggacgggaagctcaccggccgcaccgtgggccgcatcgtcaacgcgcagcgcaaggcggagctgttggagtcgctggcgcaggcggaaggcatcctgctggaccaggtggtcgccgtgggagacggtgccaacgacttgctgatgctggagcgtgccgggctgggcatcgccttccgggcgaagcccaagctgcgcgccgcggccgacacgtccatcgccgcgggcggcctggacagcatcctctacctgctggggctcaccggccgcgagcttctggaagcgggctcgggcgccggctga

SEQ ID NO: 4202 - DNA, 843 bp, Myxococcus xanthus
atggcctctccttcccggaatcgcattggcgacatcctcgtcaaggcacgcgtcatcgacgacttgcagctgcgcagtgcactggccacccatgaccagtggggcggacgtctgtcgcgcatcatcgcggacctgggtctggccaccgacgacgtcatcaccgaggccatctgccagggcctgggaatgcagcgcatccagttgggcaacgtcacgcgcgacgcgggcgcgctctcacgcgtcgacgtgagcctcgccgaacagaaggccgtcttcccggtgtcgctcaaggacaacggcaagacgctggtgctggccatggcggaccccacggacctcgtcaccctggaccaggtggcggcgaagagccgcgcccgcgtggtcgttatggtggcgggcgagcgtgaaatcgaacacgccatcctccgccactaccgtggccaggagcccgtcgtcagcacgcgcttcggcggcaacaagcgcccgagcagctcggacgcgccggaggacgaggacgagttcaaggtcgtcgacatgagcggcaacacggtggtgaagcgcatcgccgacatcaccccgcccgctcccgccgcggcgcctccgccccgcgcgccggagcgcgcccccgccccaggcgctggcgccagcgccgcggacatccttgacgagattctggcgggtggcgcgcccgccaacgagtggacggacgaggacctcaagcggctgcagacggtgcagcagaaccaggagaagagctccaagattctgcgcgcgctgctcgagctgctgctggagaagaaccagctccagcagcgcgaactggcggcgcggatgcggctgtag

SEQ ID NO: 4203 - DNA, 195 bp, Myxococcus xanthus
atgcagcccttcgcggaatccgccgcccagctgtgcccctactgcggtgaggaagtggaggtcgccgtggaccccattggtgtggcctcggagacgtacatcgaggactgcccggtgtgctgccgtccctggacggtgcaggtgtcccgcgacgaggagagcttcgccgtgcaccttggccgcgacgacgactga

SEQ ID NO: 4204 - DNA, 399 bp, Myxococcus xanthus
ctgatgcgcgatgtcgacgcgctcttccgcgagctgacgcagcccatgtggcgccaggccccgcgtgagcgcacgccggccgcggacatcaccgaatccgagagcggcctcaccctccatctggacatgcccgggctggaagcgaaggccatccaggtgacggtggagaaggacatcctcaccgtgcagtccgagcgcaaggccgagccgcgtgcggagggcgtcaacgtgcgccgccaggaacgcgccttcgggacgttcgcccgctccttcgcgctgcctgacacggtggacgcaagccgggtggaggctcgctacgagcagggtgtgctgacgctgaccctgcctcggcgcgaggagtccaagccccgcgtcatcgaagtcaaggtccagggctga

SEQ ID NO: 4205 - DNA, 606 bp, Myxococcus xanthus
atgcagcaagaggggagtacggccatgacggaccagctctacacgacgcacgacatcagtcgtttgcttcaggtggatccgtccacggtgagcaagtggattgaccggggcatcctgatggcgttcaggacgccgggtggccaccgccgcgtgcggtcggcggacctgcgcacgttcctcatcacccaccagatgccggttcccgaggagctcggcagcggcacggtgcgcctgctcgcggtggatgacgagcgtccggtgctggacgccatcaagcgcgcgttcaagccgttcgcggcccaggtggagctgcagacgacgacgagcggcgtggaggcgctgctgctcgtgtccgagcagaagccgcacggcatgatcatcgacctcaacatgccggacatcgacggtctggaagtctgccgccgcatccgcgcgcgcaagcagatggagggcgtgcggctcatcaccatgacgtccgcgcatacgcccgaggtcgtggagcagtccaagcaggccggcgcgctggcgtgcatggcgaagccgctggacgtgcagcaggtgctggaactgttccgcgttccgctggcgctcagcgccaagcggtag

SEQ ID NO: 4206 - DNA, 540 bp, Myxococcus xanthus
gagctgatgtcccgtgctgcgcgcgtgcggctgctcgtcttcgacgtggacggggttctcaccgacggcggcctctactacggccaggacggcgagctgatgaagcgcttcgacgtcaaggacggccatgcgctcgtcatggcccggctgtccgggttgcccgccgccatcctcaccgcccgcacctccggcatcgtggagaagcgcgggcgggagctgggcctcgcggccgtgttccaaggccgccgtgacaagtcggccgctctcaaagagttggtcacccagttggacgtgcccttggacgcctgcgcgtacatgggtgacgaccacaacgacctgggtccactttcaatggtggctctttccgcttgtcctgcggatgcggtccccgaagtgcgccgcgaggcacacttcgttacccagagtcctggcggccgaggggccgctcgcgaactcgtggagctgtgtctcaaggccagtggccgctgggacgacgcagtgggtctgatgagagggactgataggcgcggtactcagtga

SEQ ID NO: 4207 - DNA, 837 bp, Myxococcus xanthus
atgagcgcccccaaccccatcgagctgtgtggcttcaaggtcggccaaggtcagaagctgttcgtcatcgccggccccgacagcatcgaatccgaggacatggccctgcgccatgcctggatgctgaaggaaatcaccggccggctcggcgtgccgtacgccttcaagtgctcctacgacaaggccaaccgcaccagcggcaagtccttcagaggcccgggtctcaaggaaggcctgagaatcctgaagagaatccgggatgaagtgggcgttcccgtcctcacggacgtccatgagacgagtcacgtcgggccagcctcggaagttgtggatatcatccagataccggccttcctgtgccggcagacggacctggtggaagccgtggcgcgtacgggcaagggcgtgaacctgaagaaggggcagttcgtggcgcccaaggacatcgtccactcggcgcgcaaggccttcgaagcgggcaaccccaacgtgctcgtcaccgagcgcggttcaaccttcggctacaacaacctggtggtggacatgcgcggcttcgcgcagatgcgcgacgccggcctcgccgtgtgcttcgacgccacccactccgttcagctccccagcgccggcaacggtgagacggcgggcgaacgccgcttcgtgtcactgctggcccgctccgccgcggccgccgggattgacgcgttgttcacggaagtccacgaagatccggatcgtgccctgtgtgacggtccctgttcgctgaatccacagatgtttgaagacgtggtacgaaacgtgctgagcatccgccgggtgttgggccacgagccgggttga

SEQ ID NO: 4208 - DNA, 1641 bp, Myxococcus xanthus
atgcgctccaagaaaaccaagttcatcttcgtgacgggcggagtggtcagctccctcggcaagggtctcgcctccgcttcgattggcgccctgctggagaaccgtgggctggccgtcaccctcatcaagctggacccctacatcaacgtggacccgggcacgatgagcccgttccagcacggcgaggtgttcgtcaccgaggacggcggtgagacggacatggacctcggccactacgagcggttcaccaacgcgcggatgagccggctcaacaacttcacgtccggccgcatctaccacgcggtcatcatgaaggagcggcggggcgaatacctgggcaagacggtccaggtgattccgcacgtcaccgacgaaatcaagtccagcatccgccaggcggcgcaggacgcggacgtggtcatcgtggaggtgggcggcaccgtgggcgacatcgagtcgctgcccttcctcgaggccatccggcagatgcgctacgacgtgggcaacgagaacgtcgtctacgtccacctcacgctgctgccgtacatcggcgcggctggcgaggtgaagaccaagcccacgcagcactcggtgatgaagctgcgggagataggcatccagcccgacttcctcgtgtgccgcaccgaccgcgaggtgccccgcgagctgaaggacaagatcgccatgttctgcaacgtggacacgcgcagcgtcttcacgtcgccggatgtgcgcagcacctacgagctgccgctggagctgcaccgccagggcctggatgagcggctcgcggaggtcctcaacatctggagccgggcgccccacctggagcgctgggagaacatcatccgcaaggtgtacgagcccgcgcgcggccaggtccgcatcgcgattgtcggcaagtacgtcaacctcacggagagctacaagagcctcaacgaggcgctgctgcacggcggcatcgccaacgacgtgaaggtgaacctgcacttcgtcgacagccaggaggtcgaagagcagggcgcggagaagctgctggccggcgtggacgccatcctggtgcccggcggcttcggcgtgcgcggcaccgagggcaagatcgccgccgtgcgctacgcgcgtgagaagaaggtgccgttcttcggcatctgcctgggcctgcagatggccgtggtggagttcagccgcggcgtgctgggcctgtcctccgccaacagcttggagttcaacgagcacacgccgcacccggtggtgacgctcatggagagccaggtgaaggtgcaggacaagggcggcaccatgcgcctgggcagctacgcctgtgcgctgaagcccggctcgctcgcccaccagctctatgggcaggacaccatccaggagcgccaccgccaccgctacgaagtgaacaacgcgtaccgtagcaagctgcaggaggcggggctggtcatctccggctccaaccccgagctcaacctggtggagatgattgagctggccgaccacccctacttcatcggctgccagttccaccctgaattcaagagcaagcccttcgcaccccaccccctcttctccggcttcatccgcgcggcgctcgcccagcgggacgcgaacgcggcggccggcaaggtgaccgaatga

SEQ ID NO: 4209 - DNA, 828 bp, Myxococcus xanthus
atgagggaaggtgagggttccgaggcgcgggagtgggcgctcatcctgggagcttcgtctggcacgggcgcggccatcgcggaggcggtgactcgaaagcccgggttgaatgtctttggtgtccaccggggccggtacgcggaaggtgccgtgcagttggagcagcggattcgggacgccggtggacgcggtgtgctgtggcaggcggatgcgtcttcaccggaggccgcggaggcgggcgtggcggcgctgcgggaggtcgccgggcctcggagcgtgaagctcttcgtgcattcgattgcgggtgcctcggtggggcgattcctgtccgagggcgaggaccggctgcacgcgcggcgcatccgccggaccttcgacacgatggcgcactcgttcgtcttctgggtgcaggccctggtgaatgaagacatgttggcgccggaggcccggcttctcggtctgcagaatccgctggatgagacgcacctggggaacacagggctcatcagcgcgtcgaaggcggcgctggagatgtacgtgcgctacctggccatggagctgggaccgcgaggacaccgcgtcaacctgctgaagttcggcacggtgatgacgcccgcgctaaagcacgtgtactcgcccggggccctggcccgcctggaggcggcccacgcgaggatgaatcccgcgggacgcatgggcaccgtggaggacgtggcccgcttcgtcacggtgctcgccggtgaggaggcgggctggttcaacggagccaccatcgacttcaccggtgggatgacgctgcggctgttggacctggtgctgaatccgtga

SEQ ID NO: 4210 - DNA, 828 bp, Myxococcus xanthus
atgcttcccttcgcgctgctgggcgtcctgggctgtggcgatggcatggaagtcgccatccccttcgaggcccgggtgggcagcgagcccttcgcatgtggccgcatctacaccggggtggggacgaccgggacgacgtatgagcccatggacctgcgcgtgtacctgcacgacgtccggctcgtcacggccgacggcatcgaggtgccactgaagctcgagcaggacgggcggtggcagacacgaggcacggcgctgctcgacttcgcggacaaggcgggcctgtgcaccaacggcacgcaggcgacgaacctgcgaatcaccggcacggcgcccgagggcacctacaccggcctgcgcttcaagctgggcgtgccggagacgcagaaccacctcgacgtgtccacggcgccctcgccgctgaacgacacgagcctctactggggctggcgctcgggctatctcttcacgcgcatcgaaggccggacgaagggacttcccgaagggcacgtcatgcacctggggagcacggactgtgcaccgccgccggagggccagacgaacggcaccgcgggatgtacgttcggcaaccgtccggaggtggccctggactcgttcgacctggcgtctggcaaggtggtgctggatttgggggcgctcttctcaggctcgaacctggacgagaacgcggaggtgcccaacacctccgtggggtgcatgtcgcagcaggcggacccggactgcgcgcccgtgttcagccggatggggctgacgcaccggagccaggagctggcaccggggcctcaggcgttcatcaaggcggagtag

SEQ ID NO: 4211 - DNA, 1647 bp, Myxococcus xanthus
atcagcagcggagccacgctggcctatccccgcgccattggcgacctggtggaccaggccctcaccgcgcgcgaccggtatgtggtggaccggctcgcgatgctgatgctcgccgtgttcacggtgcagggcatcgccatggcgctgcgcatctacctcttcaccaacgccggcgaacgcgtggtgtcgcggctgcgcaaggacctcttccgcgccctgctgtcccaggaggtgggcttcttcgattcgcgccgcacgggcgagctcaccagccggctctcctcggacaccaccgtcctgcagaccaccgtcacggccaacgtgtccatgatgctgcgctacgtcgtcacggccctgggcggcgtgggcctgctgctctacacgtccgtccagctcacgctggtgatgctggccgtcatcccgcccgtggccattggcggcgtgttctacgggcgccgggtccgggtgatttcccgtcaggcccaggacgcgctcgccgccagcggcgaggtggccgaggaagacctgtccggcatccgcaccgtgcgctccttcgccgcggagcggcacgaggtggagcgctacagcgtcgccgtggagcgctccttcacgctggcgaagaagcgcgcgctccagacctccgtcttcatgggcgtggcctccatcgcggggtatggctccatcgccgcggtgctctggtacggaggccggctggtggtggaaggcggcctctccgtgggcgagctcacctcgttcctcatctacaccatgctggtggccttctcgttcagcggcatcgcggagctgtgggcggacttcatgcgcgccagtggcgccgccgagcgcgtcttcgaactgctggaccgcaagcccgccatcggcgctggcggcgagcagctgaccgacctgcgcgggcacgtgcagttccgcggcgtgcacttcgcctaccccagccgtcccgacgtgccggtgctccagggcctggacctggagctgcggccgggcgaggtggtggcggtggtgggcccctccggcgcgggcaagtccacgctggcctccctgctgtcgcgcttctacgacccgcagaacggcgaggtgctgctggacggccatccgctcaccgccctggagccggagtggctgcgccgcaacatcggcatggtggcgcaggagccccagctcttctcctgctccatcgcggacaacatccgctacggccggcccggcgccaccgacgcccaggtggaggaggccgcccgcgccgccaacgcccacgcgtacatcgagcgcttcccggaaggctacggcacccaggtgggcgagcgcggcgtgcagctctccggtggccagaagcagcgcgtggccatcgcccgggcggtgctgaaggaccctcgcctgctcatcctggacgaggccaccagcgccctggacgcggagagcgagcacctggtgaaggacgcgctggagcgcctgatgaagggccgcaccacgctcatcatcgcccaccgcctgtccaccgtggccaacgcggaccgggtgctggtgctcgacggcggcgtcgtcatccagagcggcacccacgcctccctcatgagccaggagggcctgtaccggcgcctggtggagcggcagtttgtcgcagcttga

SEQ ID NO: 4212 - DNA, 819 bp, Myxococcus xanthus
gtgtccgtgcccgtcctgggccaggggacctggcagatggaggaggatgaccgggcaggcgccatccgcgcccttcgcgccgggttggacctgggaatgacgcacgtggacaccgctgaactgtacggctacggcaaggtggaggagtccatcgtctccgaggccatcgcgggccggcgcggcgacgtcttcctggtgtcgaaggtgatgccgtccaacgcttcctacgcgggcacgctcgccgcctgtgagcggagcctgaagcggctgcgcacggaccacctcgactgctacctgctgcactggccgggttcgcacccgctggaggagacggtgcgcgccttcgagaagctggtggtggatggaaagattcgcgcctggggcgtgagcaacttcggggtggaggacctggaggaggcgctcgcgctcgcggggcccgggcgcatcgcctgcaaccaggtgctctaccacctggaggagcgcgccattgagcacgccgtcctgccctggtgcgaagcccacggggtggcggtggtgggctacagccccttcggcaacggccgttttccccggcccgacagccggggtgggaaggtgctgggcggcatcgcccgcgcgcacggcgtcacgccgtaccaggtggcgctccggttcctggtgcgcgggccgtcgctgttcgccatccccaaggcgagccgggaagcccacgcacgcgacaacgccgccgccgcgtcgctgacgctgaccgccgacgagctggcccacctcgacgcggccttcccgctggggcccgagccggcgtcgctgcccgtcatctga

SEQ ID NO: 4213 - DNA, 957 bp, Myxococcus xanthus
atgggcttcctcaagaacgtgtttggcggtggcgcggcgaaggcggacgcggagtccccggcgcctgacgcggcgcccgctgccgcgccagccacatccgccctgcccggagcgggaaccacggtccccgccgccgagccagcgggcgcgccccatgccgccgaggctcgggagcatgctcccgcggaagccccccgggccgaagccgccccgaaaccacccgcgcctccgaaaccgcagcgcgcgcaagagacccgcaagcagcagcaggaggacgaggacatggagggcgttcagcggctgttgtcgcgcaaggtggagcgggtgctggagcagttgggaacgctcgccacgcgggcgcgctcgggcgaagaagtgcccaccatcaccgtcacgctccacctttcgcacggtcattcgatgacgggcgaggtggtggactacgtgccccgcgaatcggtgctgatggccctgggcaaggaggggctgcgccgctcggagtcggtggcctacgtggacctgtccacggtggtggcggtggcggtgggcaacgcggagaagctgctggagctgacgcagctcgtacggcccaaccccacgcggcaggacgtggtgacgctgctggagaagctgccccacgccctcaccgagcagttctggccgggcgaggcgtccctgggcggcaagcccctgcgcttcgaggtggactgggtgggcctggacgacgagccgggccgccgcgcgctggagtccgccgtgaatgtcgccagccacgccttgcgcgccctggcccaggagcagggccgcgaggtgctgcgccgcatcaccaccgtgcgcttcctcaagggccgcgacacccgcgccgccgtggagggcgagacgggcacggtgacggtgggcccgggtgagcccaccgtgtccgccttccgcaaggccttcgccgccggcatcagatga

SEQ ID NO: 4214 - DNA, 669 bp, Myxococcus xanthus
gcaatcatcgccggccgaacaatgattgagcacgtctggcgccgctgtcaggaggcccaggccttcgacgaggtgtgggttgccaccgatgacgaccgcattcgcgccgcagtggagggctttggcggcaaggcggtgatgaccagccccgcctgcgccacggggacggaccgggtcgccgaggtggcgctcggccgtccagacatcgacatctgggtgaacgtccagggagacgagcccctggtggaccccgccacgctccagcggctggcgggcctcttccaggacgcgtccgtgcggatgggcaccctggtccgcccgctcgaagcggacgaagccgccagcccgcacgtggtgaaggcggtgctcgcgctcaacggcgacgcgctctacttcagccgcagcctggtaccccacgtccgcgagccgggcacgcccgtccagcgctggggccacatcggcctctacggctaccggcgcgaggtgctgctgtcgctggcgaagctggcgcccacgccgctggaggacgcggagaagctggagcagctccgcgcgctggagcacggcatccccatccgctgcgcgaaggtcacctcgcacacggtggccgtcgacctccccggtgacgtggagaaggtggaggccctcatgcgcgcgcgggggggctga

SEQ ID NO: 4215 - DNA, 731 bp, Myxococcus xanthus
atgggaacgcccacccgggtggcactcgtcacaggtgccgcacaaggtattggcgcggcagtggcacgtgcgctggcgggcgaagccctcatcgccgcggtcgacaccaacgcggacggcctgagcgccctcgtggccgagctccggcagaagcatcaacacgcggtggcctacccggccagcgtgagtgatgtcgccgcggtcgacgccgtggtggagcgcatcgagcgggagctgggccctatcgaggtgctggccaacgtggcgggcgtcctgcgcacgggccccatcctgtcctacagcgacgaggactgggcgttcaccttctccgtcaacacgctgggcgtgttccaggtgtcccgcgccgtggcccggcgcatggtgccccgccgaagcggtgtcatcgtcaccgtgggctccaacgccgccgccgtgccccgcacgcagatggccgcgtacgccgcctccaaggccgcctccagcatgttcaccaagtgcctgggcctggagctggccccgcacggcatccgctgcaacgtcgtgtcccccggctccacggacaccgccatgcagcgcgcgctctgggcggatgactccggcgcgcaggcggtgattgccggctcgcccgaggcctatcgcctgggcatccccctgcaacgcatcgccacccccgaggacatcgccaacgcggtgcggttcctcgtctcggacgcggcacgccacatcaccct

SEQ ID NO: 4216 - DNA, 330 bp, Myxococcus xanthus
aggcccgcgttggactgcgccgctgagtcagtgcggatccgtccggatggtgtggccacctgtggcgatggcgccgtgccgaccggagctcaggcgctggccctggggcgtccgttggatttgaactcggcgaccgaggaggagcttgccctgctcccaggcgtcgggcgcgcactggcgcggagcctcgtggaggctcgcgaggagcagggcggtttcaagagctgggatgacgtggatgccgtccgtggtgtgggttccgccaagttgcagaccctccgggcggccacggcgcttggcgcgcctcccgacgccgggcccgtgtggtaa

SEQ ID NO: 4217 - DNA, 474 bp, Myxococcus xanthus
atggcgtccctgcgtgacaccgtcgacacgcttcgcaaggaactggacgtgcaactggcccagttgagcaaggcgccggagtccgagccgcccagtgccgcgacggctcggctcaaggctcgcgccctccatgcctccgtcctggcggcaccggactccctggccctggccgagcgtctgcgcaacgtggagagcgcaccgtacccgtggagcacgctcgctcgggccgagtacgcgctgatcgccgggtcgccgccggagtcgctcgaggcggtggccagggatttggaggcgctgcgccaggccgacagcacgctgctgcgcgcctacctgctcggcgctcgcgtggcgctgaagctgaaggacacggccgccgcccgttcactcctggacgacgccgtggcgctgaacccggaccaccaggcggcggctcggctgatcgcgcagattgacgcggacgccgcctcgccctga

SEQ ID NO: 4218 - DNA, 1182 bp, Myxococcus xanthus
atgtcggaggtcttcttctggtgtgccgtgctgctgctcgcacacacttactttctctaccccttgagcctttttttgctcgaaggggccgcgcaggtgctcaagaacgcccgcgatggacggcgcgcggaaacagtcaatccaggctccggcgggcagcgggcgttgccctcggtgagtctggtggtggcggcctacaacgaggcttcgtgcatccagcagaagctggagaacagcctcgcgctggcgtacccggcggagcggttcgaggtgctcatcggttcggatggttcgtcggacgggacggatgaaatcgtccgcgcttgctccgacgcgcgcgtgcggctgtcaccggcgcctcgggcgggcaagacgacggtgctcaaccgctgcatccccatggcgcagggggacatcgtcgttctttccgacgccaacacgatgatcgaacccgaggccatcgagcggctggtgcgccacttcgaggacccggaggtgggggccgtctgcggcaagctgcggctctacaaccccacgaagcaggactacgaggagagcgcgtactggagctacgagtcgctcatcaagatgtacgaggggcggcgcggcgctgtggtgggcgccaacggtggcctctatgccatccggcgctcgctgttcaccctgctgccgccgtccaccatcgtggacgacttcgtgattccgctgcgcatcctggatcagggctacaaggtcgtctacgaagagcacgccgtggcgcacgaggagaccacggaggattacggcaaggagttcggccgccgggcgcgcatcgccgcgggcaacttccagagcatccgcatggtgcccgggctgttgttgccgaccgcgggcttcccggccttcgccttctggtcgcacaagctgctgcgctggtgcgcgcccgcgctgatggggatggcgctggtggcaaacctgttcctgctggaccggctcttctaccagttcaccctgttcagccaggtgctgttctacgcgctcgcgtacctggggaagacgggggtgctgaagcggggcacggcgaagaaggccgcgtcggtggcgtactacttcgtgaccatgaacctggccatcgtcgtggggttctggcgcttcctgcgcaactcgcagcgcgccgcgtgggaccggacggcgcgcgcgtag

SEQ ID NO: 4219 - DNA, 1692 bp, Myxococcus xanthus
atggcctcctttcgccgagccctcgccgtcctgttgctggccactggctgcatcccctcgccgtatgaccgcgcggcgaagaaggacaccatcgacggctatcgcgccttccttcgtgagtaccccacgcacgcggacaccgacgcggccgaggcgcggctggaggaactggagttcgaggaagcgaagcgactgcacacggtgattgcctacaagcgcttcctggaggcgtaccccgacgcggcccaggcgcgcacggcgaagacgctgctagagggcctgcgcttcaacggggcgaaggagacggataccgtcgccggctggcgccagttcctccaggagcacccggacggcgtccagcgcgacgaggcgaagcgcctgctggcggaggcggaagcacgtgagctggccaccacggaggatccgcgcaagctggcggagtacctgcgcgcgtcgccggatgatccccgccgccaggacgtggaggcccgcctggatgctcaagccttcgcgcaggccaaggcctccggcgcgacgaagctcttcgcgtacctcaaggagcacccggccggcgcgcaccgcgaggaggcgcgcgtcctgctgctgcaactggaggtggaaggcctgctcgtctccggcctggtggacgaggccgaggcccgggtgaaggcccatcccctgggcccgaagctcaccggcttcccggagcggctggctcacgcccgcgccgagcgcgccgccctggcccggccggagccactggcccaagccgcccacgtggggcactacctgcgcggggcggaggacctgagccgcgcgctggtggcgcccgacgcgctggaccgctggcaggccgcggaggagctggggcagcacgtgtcggtgcgcgtgttggatccgctgctggagagcctgcgcgcggcgcgcaacccgctgatccgtcagcatgccctggagtccctgcgcacggtgctggcggcgctgcccaagcccgtggcggagtacgaggtggcctcgcgcctggatgccctgcgcgagcgcgccaccagcgcggagatgtacctcacggtggcggtgctgctggacctgtccggccagttggcccaggcgtccacggagtaccagcgcgccgccgagtcaggcgtgccggatccggtcatcctgcggcgctgggtgcagattcgcgaggagcggcgccagcacttctccgcggcggtggcggcgcggcagctcgcgctgtggtccctggaggtggcgcaggaggagccggtgacgcccgaagggcgtgttcccctggcgtcggcgcggcagctctgcgcggcggccgtcaacgcgaacttcgccgtggcggccattgcccgcgcccggtccgcgagcaccgagttccccgaggacctggcggagttcgagcgcaaggcggcggacgccaagcggctggcggacgcgcggctggcggacgcggagctgctgctgcgtgagcagacgcccggcgtgaagacgtgcgcggaccgcggtgtgcgtgaccgcctggagaacgccgtgaaggagcgcaccgccgcgctggactcggtggcgacgaagctgccgcaggtggggcggctgctcctggaggtggcccgggagcgggatccgtcgccccaggtccgcgcggccgcgtccgcccggctgaccgcgctcaagccggttccctga

SEQ ID NO: 4220 - DNA, 1965 bp, Myxococcus xanthus
atggcctcccgcaccgatacgctccaggctccggccgtgacgccctcgctgcggatcgactatgccgcgctcctcaacgaggagcagttgcgcgcggtggaggcgggggaggggcccgtgctggtgattgccggcgcgggctccggcaagacacgcacgctgaccttccgggtggcgcgcatgctggagcgaggtgttccgcccgcgggcatcctcctgctcaccttcaccaacaaggcggcccgggagatgacgcgccgagtggaggagctggccggcgccttcgtggacgtgcggcgcatcctcggcggcaccttccaccatgccgcgcacgtgctgctgcgccagtacgcgggcgtgctgggcttctccacgaacttcaccgtgctggaccgcgaggacgcgcgggacctgatggtgacgtgcatcgccgagcgccggctcaagagcgacaagcgcttcccccggccagacctggtgttggacctggtttccctggcggccaacctccagcaacccgtgtcacacgtgctgatggaccgccggccgcagatgttgccgctggcgcccgaggtgctcgccgccgccgcgcgcttccagcagcgcaaggcgcagatgcacctgatggacttcgatgacctgctggtgcacctcaagcgcctgctgacgcatcacccggacgtgaaggcgcagctcaccgagcgcttccgctgcgtgctcgtggacgagtaccaggacaccaaccggctccagggcgacctggtggatttgttcgccggagagcgcaaggacctcacggtggtgggggacgactgccagtccatctacagcttccggggcgcggacttcaccaacatcatcggcttccccgaacgctacccgggctgctccgtccatgcgctgacgcgcaactaccgctccacgccggaaatcctgcggctggccaacacctccatcgcgctcaacacgaaccagttccccaaggtgttgacggcggcacggtccccgggcgtcaagccgctcatcgttcccgcccgggacgccggggagcaggccgcctacgtggcccagcgcatcggtgagctccgcgaccagggcctgtccctggaggccatggccgtgctgtatcgggcccacaatcactcgctggagctccaactggagttgacccggcgcggcatccctttccgggtgcgctccggcgtccgcttcttcgagcagtcccacatcaaggacgtgctggcccacctccggttggtgaacaacccgggggatgagctggccttcaagcgcgtcatccggcgcgtcccaggcgtgggaccggcgacggccgagcacctctggaccgctctgcgcgcatcgccggaggggacacccctggcggaggggctggcccatgcggacgtccgcgcgcacctgccacgcaaggcgcagaagggattccaggccttcagtgacctgatggggcggctgacccagccggaggcgtccccctcaccagggcgcctcatcgaggacgtcctcgccgggggctacgcggacttcctccgggcggagttctccgaggaggagcaccgggaggacgacgtccgccaactggcggagttcgccggccgcttcgaggacgtggcgcgcttcctgtcggagatcgccctggtgtcggagttcccggcggggcaggcattgaggcagcaggggccggaggcgtgcctgacgctgtccaccgtccatcaggccaaggggcttgagtggcgggccgtcttcgtcctgtggctggccgacgggcggtttccgctgtcattggccacgcgcctgcccgagtaggaggaagaggagcggcggctgttctacgtggccctgacccgggcgcgggacaccctggcgctggtgtacccccagtcggtgctgccccgggacggggagcggatcctcctgcgaccgtcccggttcctccaggaactgccc

SEQ ID NO: 4221 - DNA, 996 bp, Myxococcus xanthus
aatccgatgacggaggagaaggtgcagttgggccggaggctcttcttcgacgtgcgcctgtcacggaacgagacgcagtcctgcgcgtcctgccatgacccggcgcgggccttcaccgagcccctgatgacgtcgcagggcagcacgggcgagacgcaccgccgcaactcccaggggctggccaacgtcgcctatgccacgagtctcacctgggcgaatccctcgctcacgacgctggaggcgcaggcgttggtgcccttgttcggcaaggagccggtggagttgggcttcggtgacagggaagaggagttgctcggccgactgcgcgcggtcccggaactggaggcggagttccagcgcgcgtttccggaggccgtggagcccgtgtccgtggccacgctgacgcgggcgctggcgtcgttccagcgcaccctcatctccggcaactccgcgtatgaccgctatgtgtatggcaatgacgtggaggccatgacgcggcagcagaagcggggcatggagttgttcttctcggagcggctggagtgtgaccattgccactccggcttcaacttccaggacgccacggtgcacgagacgacgtccgagcccatcttcccctaccacaacacgggcctgtacaacgtggacgggcagggggcgtatccggcgaaggacccgggcctcatcgagctgacgggccgtcccgaggacatgggccgcttccgcgcgccgtccctgcgcaacgtggccgtcaccgggccgtacatgcatgacggcagtctggccacgctgtcggacgtgctggaccactacgccgcgggaggacacgcgcggcgggtgcgcggcggcgaggccagtccgctgcaaagtggcttcgtgagaggcttcacgttgaccgcggaggagaaggaagacgtcttggcgttcctcgagtcgctcaccgacacggagttcctgacggacccgcgcttctcggacccgtccagcgtgccgtga

SEQ ID NO: 4222 - DNA, 2057 bp, Myxococcus xanthus
atggcggacagacctcgcatcatcgggattgacctcggtaccaccaacacgctggtggcgtccgtccgcaaccgtatcccgaagatcgtccccaccgatcgcggcaatctcacgctgccctccgtcgtggcgctgtcggcgcgcggcgacctgttggtgggtggggtggccaaggaccagatggtcaccaacccgaagaacacgctctggggaaccaagcggctcatcgggcggaagtacaactccaagacggtggaggatctccggggctacttcccctacgacatcgtcgagggcgccaacggggacgccgcggtgatgatgggcggcaagctgtactcgctgccccacgtgtccagcttcgtgctgggccaggtgaagaccatcgcggagcagttcctgggcggccccatcgagggggcggtcatctccgtcccggcctactacaacgacaaccagcgcaacgcggtgaaggaggccggccggctggcgggcttcgacgtgaagcgcatcgtcaacgagcccaccgccgcggcgctggcctacggcttcaaccggggcctggatcagaaggtcctcgtctacgatctgggcggcggcaccttcgacgtgtccgtgctgcacctggccggcaatgtcttcgaagtcctggccaccggcggcgacaccttcctgggtggggcggacttcgacaaccgcatcatggagtacgcgctggagcgcttccgggaggagaccaaggtcgacctcaacacggagaaccccatcgcgctccagcgcatcaagaacgcggcggaggcggcgaagatcgacctcacgctgatccccaacgtcgtcatcgacctgccctacatcgacgagcgcaagggcaagccgatggacatgcgcatccccctgacgcgcgagttcctcaacagcctcaccggcgacctggtggaccgcaccttcgagatctgcgaccgggtgctggcggagaagggcatctcccgcgcggagatcgacgagatcatcttggtgggcggccagagccgcatgccgctggtgcagcagaagatccaggcgcacttcggcaaggcgccgcgcaagggcgtccacccggacgagtgcgtggccctgggcgcggcgctgctgggcgactcgctgggcagcatcgacgcggtgacgctgctggacgcgctgtccatgcccatcggctacgcgatgcccaacgggcgcgtgaagcgcatcatcgagaagaactcgctgattcccatggtgaagagcttccgtctgcctcctcccaaggagccgggctcgcccttcatcgagctggacatctaccagggggacagtgacctgctggtggacaacgaatatctgggcacggttcgcgtgccctcggccgccgccggccggaagatcgacttccgcctcaccgaggagtgtctgctccaggtgacggtggaggaagcgagcggcatgcgcaaggtggacctcgccacccgcgacacgccggagcagctcaagcgggcgctccaggaggtcgcgtcgcgtcactcacagcaggtgcccagctccagcaacagcgggagcgacgaccgggggctcttctccagtatcaagagcatcttccggaggggctaggagtccagatggcgaagttcccgtcgaaggagtgggtggacgaagcggtccgcctcaccaatgaggatcccgagtgcgccatggccggcaagggctggaagggcgacttcggggcggtggtggaagccgagcccggcaagctggcgaaggctttcgtggtgcacgtcgtccccggtgactgccgcatcgagaaggcgcgcgtcctggcggatccagacgacctggacgagctggagccggtgtacctggcccgcgcgccctacagcgtctggaagcagctcctcaaagggacgctggacccggtggaggcggtgctcaagcgccgcatctccatgaagggcgacctgcagccgctgatcgaacgcatgaagtacaagggcatcgccgaccgcgtcttcgcgcagctgcagacgcagttcatcgacgagccctga

SEQ ID NO: 4223 - DNA, 270 bp, Myxococcus xanthus
atgggaatcaaggacgacctgaagaagcaggccctcaatgtgtcgggcaaggccatggagaagctcatggccgacgaccgtcgcgcgatggccattgccaacgccattgggaaagcccagcgcggcaagcaggcgctcgaccgggggcaggaggagctgatgaaggcgctgaacttcgcgccccgcagcgagttcaaggccctgggcaagcagctgtccggcctcaagcgccggctgcgcgagctcgatgagaagctcggcgcgctgtag

SEQ ID NO: 4224 - DNA, 618 bp, Myxococcus xanthus
atgaacgtcttcacgtccaccggctacaagccgaaagagatcgccacgtatgaccgtgacgtgctcgccagccgtggctacatgcagtcgccaaacgactggaagaacatcgagatgacgggcttcgtgaagctcaactccgcgtccgatgagtccgacaacttcgacatgtatgcgcgtggcgggaagcacaacgacgaccacgagggctgtgagggcagcagctacaagggcgcgctgcacttcaatggccaggctcgtttccagaaggaggcgtggcacgtctcctacgagcaggcgccgtacaagaaggtgacggagccgctgacgggccgctgggtgggcttcaagacggtgatgcggaacacgcaggtcaacggcaaggaggccgtgcacctggagatgtacctcaacgagaacgccgacaaggtctcctgggagaaggtctacgacttcgtggacgccggtgattggggtggtgacgccgagcactgcggcggcgcggatggcgcgattccgctcacgtggggcggccccatcgccacgttccgttgggacagcaccgacgacgtggacttcaagtggctgtccgtgcgcgaaatcgcgccggagcagtga

SEQ ID NO: 4225 - DNA, 1515 bp, Myxococcus xanthus
atgcacattactttcctgggccacgccgggttcgtcgtggagacggcgggggccattgtcgtcatggacccgtggctgtcgtcccgcggggcattcgactcggcgtggatgcagctgccgtgcaaccaccacctggcgccgcgcgtgcgggagaagctggagacgcccggcaaggcgcgctacctctacgtcagtcacgagcacaaggaccacttcgacccggagttcctggccaccctccgccagagggacttcacggtgctggtgccgcgcttccaccgctccgaactgcaggacgtgttcgccaggtatggctgcaagcaggtcatcgcctgcgaggacggccacgaggtccccatcaagggcggctacgtgaagctgttcgtgtcggagcaggggaccaaccgtgactccgcggtgatggtgcgcggtgacgggcagtgcttcctcaacatcaacgactgcaagctccatgaccggatggggcgcatcgtcgcggaggaggggcccatcgacgtgttctccgcgcagttctccggggccatctggcaccccacctgctacgagtacccggcggagacctatgcggccatctcgctgaagaagcgggagagcaagttcgaggcggtggcgcgcacgctcgaggtgattcagccgcgggcgtacatcgcggcggccgggcccgcggccttcctggacccggcgcagttccacctcaatttcgagaaggtgaacatcttcccgaacgcgacgcagctcttcgcttttctgcggcagcgtctgccccaggggaagacgcgctacctggagccgatgcccggggacgtgctggacgcgaagtcgctggagttcgtctcgcaggtggccgagcgcgtgacgccggagaacatgaaggcgtacttgcacgcctacgcgaagcggcaggagtctgtgttccgcgagcggcggcgaaacctgctcgtcgcggaggtggcggagattcacgagcggctgcgcgtggaactccagcgcaagctggacctcctcgacctgcacgagcgcgtgggcatgccgctctacgtggagctgacggagcttccggaccggctcttgcgcgtggacttcaagtcgcgccgtgtccacgtggtggcggacatccaggaagaggttcgctacacgctgaagacgagcgcggccgacgtggggcgcgtgttggaccgcaagctcacgtgggaggacttcctgctgtcgttccgcctgcgcctgagtcgcaacccggacgtgtacgagccggtgctgcacggcttcctgggtgtggagatcgaggacatgcgcgagttctgcgacggcatccgctccaccgagtcccagcgggagcgaacggtggtggaggccggtggacggcgcttctccatccagcgcttctgcccccaccagggcgccgacctgtccgagggctgggtagagtaggggcgctacctggtgtgcccgcgccaccgttggcagttcgacctggacgccgggggcgtgtgcacg

SEQ ID NO: 4226 - DNA, 756 bp, Myxococcus xanthus
ctcgcgctgcgtccggatgaggtccatgtatggattgtcgagcccgagcgcatcgacgaccggcgcctcctggatgcctactgggcgctgctggacgcgaaggagcgcgacaagcagcagcgcttccgcttcgagcggcaccagcgccagtacctggtgagccatgcgctggtgcggctgacgctgtcgcgctacgcgccggtggcgccggaggcctgggccttcgacaccaacacgtacggccggccggtggtgcggggggagtggggcccgaagctgcgcttcaacctgtcccataccgacggcatggcgctggtggcggtgggctgggacgcggagctgggcgcggacgtggaggacgcgcagcggaagggggagacggtggagatcgccgaccactacttcgccgcctcggaagtggcggcgctgaaggccctgccggcggagcggcaccgggagcgcttcttcgagtactggacgctgaaggagtcctacatcaaggcgcgcggcgcggggctgtcactgccgctggaccagttcgccttccacctggagccgggacaggcgccgcgcatctccttcgacccgcggatgcaagacgtgccggaggcgtggcagttcgttcagctgcgcccgtcggagcggcaccaggcggcagtggcggtgaaccggccccgtgggcagccgctgtcggtgcgttggcagttcacggtgccgctggccggggacacgccgccccggttccaggcggcgtag

SEQ ID NO: 4227 - DNA, 546 bp, Myxococcus xanthus
gcgggcttcatactctggctgacaggtctgtcaggtgcgggcaagagcaccttgtcccgtgcactgcgtgcgcacctggcctcgtcgatgcccgtggaggtgctggacggggatgaggtgcgcacctggctgtcccgcgggctgggcttcacccgcgaggaccgcgaggagaacgtgcgccgcatcggtcatgtggcccggctgctggcgaagcacggggtgggcgtcatcgccgcggccatttcgccctatgcgagctcgcgcgccgaggtgcgccggctggccgaggaagcgggcatccccttcgtggaaatctatgtccaggcgcctctggacgtgctcatcgcccgggacgtgaaggggctctacaagaaggcgctggccggcgagctggcgcacttcaccggcgtgtcggacccctatgaggcgcctgacgcgcccgacgtcaccgtccactcggatgtggacaccgtggaggcgggcctgtggcgcgtcttggagacgctgcgaaagcggggcctgctcgacgccgccgcggcggcgtga

SEQ ID NO: 4228 - DNA, 831 bp, Myxococcus xanthus
atgggaatcctcgccacgctggcgaccggctgcgccaccacgggcgcgccgctggagccatggctggactcctacagtcttcgctaccgctcggcctccccgcccgccttcccgcgcgagtccctttccaagcaggtggccaccgcgaaccgcgaggcgcccgcggcacgtcccgacacggtggccgcccgcccggccaaggcgtcgggtggcaagtcccgcgcgacgccggcccgggccacgcgccccacccccgtggccagtgatgcccgcgccaaggtggtgaccacggcgcgctcgctggtgggcaagacgcaagtcgcactcaacggccgcaagtacccgtccgactgcaccggcctcatcgaaggcgtctatgcccaggccggcgtcaccttccggggaacggtgcagcccggcgacaacggcgtcaccgccatgtaccgcttcgcccgctcgcgaggccgcgtgtaccaggaagagcggccgaccccaggcgacctcgtcttcttcaacgagacgtatgaccagaaccgcgacgggcgccgcaatgacggcctcacccacgtgggcatcgtggagaacgtcagcgccagcgggacggtcaccgtcatccaccgcgtgcgccgaggcgtcgtgcgctaccgcatgaacctggaacgcccgcaccttcggagggatccgaagacgggcgaggtgctcaacgacatgctccggcacccgggccccaaccgcgagcccgtcctcaccgggcagctcttcgggggctacggcagcgtgctgcccaagagccccaaggcccagaagcccgtccccgtggcactccggtaa

SEQ ID NO: 4229 - DNA, 960 bp, Myxococcus xanthus
atggaaaccttcccaagcgtcggcagcccgggcctgtgggccggctttatcgccttcgtcatcgcgatgctggcgctcgatctcggcgtcttccaccgcaaagcccacgtggtgaagttcaaggaggccctgggctggagcgcgttgtgggtcagcctggcgctcgtcttcggcgcgggtgtctggtggaagttcgggcctgagcccggcctccagttcatcaccggctacctcatcgagaagtcgctctccgtcgacaacatcttcgtcttcgtcgtcatcttctcggcgctgcgaatccccgcgctgtaccagcaccgagtcctcttctggggcatcctcagcgcgctggcgctgcgagccatcatgattttcgcgggcgtggcgatgctggcccgcttccactggctcatctacgtcttcggcggcttcctcatcatcacgggcgtgaagctcttcctccagcgcaacaaggaggacaacccggaggaaggcgcgctgatgcgtcttgcccggcggaccatcccctcgacgcccaacttcgacgggcaccacttcttcaccgtggagaacggccgcaagctggccacgccgctgctgatggcgctcctgctggtggaggcgtcggacatcctcttcgcgctcgactccatccccgccatcttcgccgtgacgacggaccccttcatcgtcttcacgtccaacatcttcgccatcctcggcctgcgctccatgttcttcatgctggccggcgcggtggagaagttcagctacctgaaggtgggcctctccgcggtgctcgtcttcgtcggtacgaagatggcgatcatcgacttcgtgaagatgccgcccgaggtgtccctgtcggtcatcgccggcctgctgggcgcgagcatcgtcgcgtcgctaatcaagtcccggcacgcgcccaccagcgacgccgacgcgcccaaggtctga

SEQ ID NO: 4230 - DNA, 477 bp, Myxococcus xanthus
atgcgcgccatcgttcctgaaagcacgacgagcgacgtggcgctgcgcttcacccttctaggccccactgagcgccaggtggccctggcttcgggggagcagcgccagcaggtgggcctcaagctcttcgcggtggatgcctgcaacgtgctgtacgcgatgtggcggctggcacccaagccgggcatcgtcgtcaatttcaagcgcaacccggggcagcacaccagccgcgagtgcggaaaccggggctacaccctcctgcaccccgagcagcacgtccggctcgaagcgccctcgacaggggaacctcacacgctgcgggcccagttcgacggcaaggtcctccgcgtctgggcggacgacacgctcgcgtggacgggcgaggtgcccgaagaggcgctcgcgccggatgccccggtgggcctgcgctcggacaacgttcggctgagtcttcagctctccacgccgccgccctga

SEQ ID NO: 4231 - DNA, 2424 bp, Myxococcus xanthus
gccggggaggcgcctgccatcgaccccgtctgcggcatgaaggtggacccgaacgccccgaagggcggtcacctggagcacgccgggctgacctacgccttctgcaatccccggtgccgggagcggtttcgcgcggacccggagcgctacctctcgcccgcggagaccgcgccggaaccgacgccggcgccggggaccctgtacgtctgccccatggacccggaggtccgccagtcgcatcccggcgcctgccccaagtgcggcatggcgctggagccagagacgcttcccgtccaggaatcccgcgtggagtacgtgtgccccatgcatccggaggtggtgaaggacggcccggggacctgccccaagtgcggcatggcgctggagccgcgcacggtgctggcggaggagccgccggacccggagctgcaatccatgcggctgcgcttccgcgtgggcctggcgctcactgcgccgctgctcgtgctggccatgtcggacatgcttcccgggcagcccgtgcaacgcgcggtgtccgcgggcgtgctggcctgggcgcagctcgtgctggccacgcccgtggtgctctgggtgggctggcccttcttccagcgtggctgggcgtcggtgcgcaaccggcacctcaacatgttcaccctcatcgcgctggggacgggcgcggcgtatctgttcagcgtcttcgccacactgctgccgcgggccctgccacagggactgcgcacggggcacggcggctccgcgcccctctatttcgaagccgccgccgtcatcgtcaccctggtcgcgctgggacaggtgttggagctgcgcgcccggcacgcgacttccggtgcgctgcgggcgctgctgagcctcgcgccgccagtggcgcggcgaatgggagaggacggtcacgaggaggatgtgccgctcgcgagcgtccagtctggggacacgctgcgcgtgcgccccggagagaaggtgcccgtggacggcgtggtgctccaaggggccagcgcggtggatgagtccatggtgacgggcgagtcgctgcccgtggagaaggccccgggcgcgcaggtgacgggcgggacggtgaatggcacaggctcattggtgatgcgcgccgagcgcgtgggccaggacacgttgctctcccgcatcgtccagcgcgtgagtgaagcgcaacgcacccgcgcgccgattcagcggctcgccgacaaggtggcgggcgtcttcgtgccggtggtcatcgcggtggcggtggtgacggcgggcgtgtgggccatctggggccccgagccccggttggtgcacgcggtggtcaacgcggtggcggtgctcatcattgcctgcccctgtgcgctggggctggccacgcccatgtccgtcatggtgggcaccgggcgcggcgcccaggcgggcgtcctcatccgcgacgcggcggcgctggagcggctggaagcggtggacacgctggtggtggacaagacgggcacgctcaccgagggcaagccgcgcctcgtgacggtggtgcccgcgccgggcttcgaggaggcgcggctgctgcggctggccgcgagcctggagcgtggcagtgagcacccgttggccgcggccatcgtcgcgggcgcgaaggcgcgtggcgtgacgctggcgcccgtggaggacttccgctcgctcacgggcaagggcgtcgtggccagggtggagggcgcctccgtggcctggggcaacgcggccctgacggaagcgctccaggtgcatggcggggaactgacctcccgggccgaggcgctgcgggcagaaggcgagacggtggtgctggtggcggtggaggggaaggcagcggggttgctcggcgtcgaggacccggtgaagtcctccacgccggaggccctcgcgttgctgcgcgaggaagggcttcgggtggtgatgctcacgggcgacagtcagacgacggcggacgcggtggcgcggcgcctgggcatcaccgaggtcatcgctggcgtgttgccggaggcgaagggcgacgccgtccggaagctccagcaggaggggcgggtggtggccatggcgggagatggcgtcaacgacgcgcccgcgctggcgcaggcggacgtgggcatcgccatgggcaccgggacggacatcgcgatggagagcgcggccgtgacactggtgaagggggaccttcgggccatcgctcgggcacgccgcctgagccagggcacgctgcgcaacatccggcagaacctcttcttcgccttcatctacaacgccgtgggtgtgccggtggcggcgggcgtgctgtaccctgtcttcggtctgctcctcagtcccatcttcgccagtgccgcgatgagcctctcgtcggtgtccgtcatcggcaatgcgctccggctgcggaagctgaagctgtag

SEQ ID NO: 4232 - DNA, 858 bp, Myxococcus xanthus
atgtacgacctcgtgggcatctaccgcggtcgagccatccacaagcgtgcggaggcggactgccgccgtcaacgggcgatggtggtgctggagtccgccatccgccaggggagcggcctgggcgaacaggccgcgctggaggctcgagctcgcgttctggaggaggcgctgccccacgccgaggcgctgctcacgtcgcttcgcaacgacatgaagcaaggcctggtgacgctggaggagctgaacgcggtgcaggtccggctggatgggctgcgtcagctctcgagcaacacccagattgctcgcgagcggctggcggcacggcctcgggttcaagaaggtcagcggctggaaagtgtgctgaacgagctgcgagccgcggatgaccagctcgaggcgtatcacggtgcgctgcgcagctcgcgcgcctggcgcgtcagcgtgcgcggtgggtacgacaagctcatcgacgtcgaccaggacctgcccctcttcgggcagctcacgctgtcctacaatctgggccatctgtggctgggctcggccaacgcacgggcgagggagggccgccgtcgcgcgacgctcgatgatgtgtcgggcgtgccccagcgggtcaacgagctggtcgccgagctgcgcaccgtccaccgcaccgaggagggccggttgcgtgaggtgagcaccctggtgtcggacctggaagcgcagctgcagtccatggacgcgctccagacgcgggagattcgccgattccgcggctacctgatgatggaactcacccgcctgcgcgcggagcaggcctatttgcgtgcccatgtggaatcgcttcagtccttcctgggggcccggtcgccgtga

SEQ ID NO: 4233 - DNA, 1101 bp, Myxococcus xanthus
atgaaccaacgcgtcgccaatcgcgtcaacagcatcgccgtatcggcctacaagttcatcggttccctgctgctcgcgctcatcatgctcgggctggtgtccttcctgtccgtccagggcttcttcctggtgagccgcagctgggtgacccccacggtcatctcgcctacggacccgcagattctcacgctcaatacgcaggtggccgcgcagacgtccgcgcgcgaccacgtgttgtcggaccggcgttcggtggagaaccgcatctccgacgccgagcgcaccgtcgccgcggagcgcgcgttccagcagcgcttcctcgtcgccctgcgcggcgagcgcgacgccagggaccgggtggcacggcggctggcgttgctgcgccgggagtacagcagcgcccgggcggagattctccagtccaaccgtgccttcgccggactggcgcgcacgcgcaccgacgcgctgtacgacgcgcgcatgatggagcaggaggagaagctcaccatcaaccaccacctggcgcagctggcgcagagcaacctggcactggcgcagtcctcggcggacctggagacgcggctggattcgctccagcgggagattgccggcctctcggcggtgcaatccgggatgggcaagaacgagacgccccagggcatgacgtccgacgtgctgctgctggagcgcgagtacacgcactccgtcctggagcaggcccgcgcggaggcgacgctgaagagcctccagacggacctggccgccctggacgaggtggccctgcgctacgacacgctgattgcgtcgctgcgtgcgtccccgtacctcaaggctatcgagagggacctcaccgtcgcattcgtcccgtacgagaacatcccgaacgccgagcagggcacgccgctgtactcgtgcgcggccaaggtcctctggtgccatgaggtgggcgtcatcgggcgcgtgctcgagggcgaggtgtccctcaagcaccccatccgccagtacatgctccgcggcgtcatggtggaggtccaactgacggacgcgccttccgcccgggaagacctgctccacctgggccggccgccgctgctgctgtga

SEQ ID NO: 4234 - DNA, 1254 bp, Myxococcus xanthus
atggagctctttccaattcagttacttttcatggtggttctgatgaaccgctatgtcctcgggccattgctacggcgcctgaaggggcggaagttcgacagagtcgacgacacctacctgccgcgagtcgccatcgtcatcccgctgttcaacgaaggcgaaggcatctaccacggcgttcgcagtctcctggagcaggactatcccagccacctgctgcaaatcgtggtggtggatgactgctccaaggatgacagctacgcctgggcgctgaaggcggcggagggaaatcccaacgtcatcgtcatgcgcaacccggagaacatgggcaagcgcaagggcatcaaccgcgcggtgaaggccgccacggacgcggaaatcatcgtgtcggtggactcggacgtcatcgtcgacaaggccgccgtccgccaactggtgcgccgcttcgtcagcccgcgcatcgccgcggtgggcggccgaacctacgtgacgaaccgtcatcagaactggatgacgcggatgattgaaatcaagttccacttcgcccaggagtggctcaaggacctggagcgcagcttccgccaggtgatgtgcctgtcgggctgcctcaccgcgtaccgccgccacgtgctgctggagctggagcccatcctcgaggcgcgcgccatcgcgggcatccccatcaagtacggcgaggaccggttcctcacgcggcagatcgtcaagcacgactacgagacggtctacacgctggacgccttttgcttcaccgccgcgccgtcgacgctggccgggtacttctcccagcagctccggtggcgccgctccaacctggtggacctgctgggcggcctgtcacacgcctggcggctccacccggtcgtggcggtccactacgtgtcgcagctcgcgctgctcctctcctacccgctggtcatcgtgcacaacgtcctgaccggcgagttctgggacatcctcgccttccacttcctggtcatcggattgctgggggtcatctatcgcatcgaaacacggcaccttcccgcggaccgacgcgtccacggcgccagcttcctgcccatggccctgctgatgccggtgacgtacgcgctcttcacaccgctggcgctgctgacgctggactcggggagctgggagacacggggcagcgccaacaccgctcccgagacgtccccggtcgactccgggggccgctttcctcccacccatgctggtgagggcactacgccatga

SEQ ID NO: 4235 - DNA, 708 bp, Myxococcus xanthus
ctgcggctgttctgtctgccgtacgccggtggcagcgtggccatctacaaccagtggagccagggcctgccggcgggtgtggagctgtgccccgtccagcttcccgggcgcgaacgccgcctgtccgagaagcccattggcagcctgcctgccctggtggacgcgctgctgcccgccatcgcgccgctgctggaccggcccttcgccttcttcggctacagcatgggcgctcgcatctccctggagctcgccaggcgcctccaggctcgcaatggcccgcgccccgtgggcctgttcctgggggccgccgggccgccgtccgtcaacacccgcgagcccatccaccatctgcccgaaccggagttcatcgcgcaactgcggcgctatgacggcacgcccgaggagatcttccagcaccgcgagctgctggagctggtgctgcccatgctgcgcgccgacttcggcatcgccttcacggaggacggcccccagcccgcgaagctggaggtccccatctccgtcgtcggctcgcccgaggacaagcacgtccccaccgcgaacctggagcgctggcgcgacgagacgcggagcgaggacgtccgcgtccgcctcttccccggcggccacttcttcatcaagtcgcagcgggacgccctcctcgcgcacatcagcgaggacctgaaccggtggatgggccgcgcgccctga

SEQ ID NO: 4236 - DNA, 1590 bp, Myxococcus xanthus
atgctggaccgccccatgtacctcaagccgaacgtcgccatcgagccgctctacaatcaatggtacgcgtggtggtacctgctgtctccggcgacggccccgctgttcgtgacgaacctgcaccagaagctgatgcagtccttcgtggcgaacccggacgtgcacgtggcggccctgaagaacccgatgctgatgggcggcccgttcatcaaccacccggcggcgaaggcctcgcgcgtgaaggagctcctggagcggacgcagaaggagcaggccaacatgctcgcgtacaccaaggcggtggccgagctggagcagctcatggcgcccaacaacggcggctccctggagggcctctacgccaaggtgcccgacatcctccgcggctacgtggagctcacgtacgacctgagcaaccgcgccagcgcgcggtacatcgagccgctcctgtaccgcagccccttccacaaggagtcctcgcagagcgtgacgctcatgcaggtggacggcgactggcggccctacatcttcagcacgccccgcctggaggaggacacgcccctgtggctgcgcgtcccctacaagcacgaaggcctggacgccctcttccgcatgcgccacacgccgggctcccccggacaggtcgcggagatgctcggcgtgcccgcctccgccgcggacgccttcgccgcgctcttcaccgacgtcgagccccgccgcacggagcgctacaccggtgagggcgtgcgcgtgcgctacttcggccacgcctgcgtgctgctggagacgaaggacgtcagcatcctcaccgaccccgtcatcagctacgagttccccacggacctcccccgcttcacccactccgacctgcccgagcgcatcgactacgtggtcctcacgcacggccacgccgaccacctgatgatggagacgctcatccagctgcggcaccgggtgggctgcatcatcgtcccgcgcaacaacggcaactcgcttgcggacccgtcgctgcggctgatgctccaccacaacggcttcaagaacgtggtggagattgacgacctccaggagattcccgtgccgggcggctccatcaccggcctgcccttcttgggcgagcacagcgacctggccatccaggccaagacagcgcacctggtgcgcctgggcggcaagtccatgctgatggccgcggactccaacgccatcgagccgcgcatgtaccagcacctgcgcgacatcgtcggcaccatcgacgtgctgttcctcggcatggagtgcgaaggcggcccgatgagctggatgtacggcccgctgctgtgcaatcccctgccccggaagatggaccaggcccgccggctcaacggctccgacagcgcccgcgccatcgaaatcaccaactacctgtcgcccaaggaggtctacgtctacgccatgggccaggagccgtggctgcgccacgtgatgatcctcgtctacgacgacaaggccccgcagattgtcgagtcgaacaagttcctggagcactgccgcacgaagggcatccaggccgagcgcccctacgtgaagatggagcgcatcctcgcttga

SEQ ID NO: 4237 - DNA, 276 bp, Myxococcus xanthus
atgcgtacgggcatcatggtgggactgctggcagtagggctgatgacgggctgtggcggcatcgaagaggaggccgccgccgggctcgaaacggaggcccaggcgatcccctgtcgtgacatcaccggccgggactacgtcatcacgtactacgcggagcccgcgaaggtcaccaaggtcggtgagctcctctgcggctgcagcacgccggagacggtcctcaacggcacgaagacctcctactacgagaaggtctacggctgcttcgcgatgtag

SEQ ID NO: 4238 - DNA, 1488 bp, Myxococcus xanthus
gccctggagcgcctggccgcgcgtgacgccggcacgctgccttcagggactcccctacgccccacggacgaggaagtcgccgcacacgcggaggaagtgcgtcagcaggcccgggtggagaaggctcgcctggagtccttctttgatttctgctgcttcgactccagcttcgtcgagctgcgccgccgcacccgccacgacttggaggtaacgggcaacgcgtactgggaggtgctgcgcgacggcaagggcgacatcgcccgcttcgtctacgtcccctcctacaccgtgcgcctcctccctttggacaaggaggccgtcgaggtgcgcgagcgcgtgcgcatctccgccgtcagcttcgacaccgtcacaacccgtcggcgcctgcgccgctacatccaggtgcagggcaacgagcgggtgtacttcaagtccttcggggactcgcgcgtcatctcccgcctcaccggccgcgcattccaggacgtcgccgccctcaaggccgcggactcctcggacggccccgccacggaactcatccacttcgccatccactcgccgcgctccccctacggcattcctcgctgggtgggcactctgctgtccgtcctcggctcccggcagatggaggaggtcaactacctctacttcaacaacaagtccgtccctcccctggcgctgctcgtctccggaggaaggctctccgacgcttcggtgccgcgcatcgagcgcttcatcgaggagaacatcaagggcaaggccaacttccacaagattctcatcctcgaggccgacggcaccggcaccggcgacggaggccgcgcgaagattgagctgcgccccctgacggacgcccagcagcaggacgccctcttccaggcctatgacgcgcgcaacatcgacaaggtgggcagcgccttccgcctgccgccactgctgcgcggcgacggtcgggacttcaaccgctcggtggcggaggcgcagctgcggttcgccgaggaccaggtgttccagcccgagcgcgacgagttcgacttcttgctgaatcggaaggtgctcgccgacatgggcgtgcgcttctggcgcttccgcagccagacgacggccaccagagacccggagcgcatgacggagatggtggagcgtctggtgcgcgtgggtgtgctgacacccgaggagggccgccagttggccggcgacatcttccaccgggagttccggaagattggggacgactgggtccgacgccccctcacactcactttggcgggcatccaaaccggagtcgaagatttgaagccccggaaggacaaggactcgctgctgagcgaggccaagcgactcgtgggcctgcgtgaagagcttcgggccgaggaggagcgcctggcccaagggcgcctggcgctggcccgcaggtacatggacaccgagcacgtccccgtcccccgcgaggagttcgacacctggttctcggcgagggagtcatga

SEQ ID NO: 4239 - DNA, 1047 bp, Myxococcus xanthus
atgcacgaggcgcgggcggtggcggatgccctgctgggggacgtcctgcggctgccggtggccaaggccctggacgttggcaccgccgcgggcatggaccgcgctgtagccctgcttgccgcgcgcctccgtcgcgccgtcgggcgcgcggacgtggacgccatgcgagaggcagtggctgtcctcgacgtggactggaggacgacgacagcagcccaacgcaggcgcctcgtcgcccaggccctggaggcggccggccggcagacagccgtcattcccgcccgcatccaggcgcccctcggcgacgcggccgaggaggtggtggcgtccacccgcagccacgcccggcgcgagcagggcctcgccctcgccgcccgcttcaacgccgtcgacaggcgcgtggcccagcacatcgtccgcacccagggaaacttcgtccgggacgagtacgggcgccggctggacgccttcggcgaggaggtccggcgtctcgtggccgagggactggaggccggcctcggaagaagcgacatcgccgagtccttggagagggccgcgcgcggcgccctcatcgagcgggcccccttctactgggaggtggtggcaagccacttcatcggccaggggcgctccttcgcccaggtgagcagctacgccgaggccggcatccgccgctaccgcattgaagccgtcctcgacgaggccaccacccaggtgtgccgattcctccatgggcggacattcgcagtggccgatgccctccagcgcttcgagcgcgtcgagtcgctcgagcggccggaggacgtgaagcaggagctgccctgggtgagggagcgcctcgacgcggacaccgggcgtgccctcctctacgtcaaccgaggtggccaggaaacgcgcctggccgaggtgctccgctccgccgccagcacacgcgacgacgtcggcgagttccgcgcgctcgcttcggacaggcagctcgcggacgcgggcgtgggcttccctccattccacggcctctgccgcacgacgacgctcgccgtcacttag

SEQ ID NO: 4240 - DNA, 108 bp, Myxococcus xanthus
atggccaaggccgaggcgacgcccgtcgtctggccccgcgacctcaatctccccacctccggggagctgacgtggggcttcgacccggagggcctctgcgatgggtga

SEQ ID NO: 4241 - DNA, 1353 bp, Myxococcus xanthus
atgggtgacaccctcgccaaggccctcgctcgggcccgccacgtcctgaagtccctccagggcgagccggtggagaaaaccatctggggcagccccgcaggcaagaagcgcctggcgaagcgcctggtggccatgctgcccgcgcacaagacgtatgtggagcccttcgccggcagcgccgccgtcctcttcgagaaggctgcctcggacgtcgaagccatcaacgacgccgacaccgcaatcgccgacgcctaccggctcatccagaagctgacgcccgcgggcatggccaagctgaagaagctgccgtgggtgggcgacgagaagacgttcaagagcctcttcgacgcgaagccgaagggcgacgtggagcgcctgcaccgattcctctacctgacgcacttctcctacgggaagctgcgcggtcgcagcttcagccccaacggcatgggcgtcgaggcgaagacgctcgctcgcattgagcagttcgctccgcgcctcaagcgcgtgaaggtgtacagcggcgactacgagaaggtggtccgcaagtacgacgggaaggacaccgtcttcttcctggaccctccctaccccggctacaacgtcgacgtcggcgagggcgacttcgacgaggagcgcttctatggcgtcctcaagtcactgaagggccgctggctcatgacgtatggcatccgggggaagttgcctgggatgctgaagggctccggattcctcgtgaagcgcatccggacgcctcgcaccatcgccgccatgcgcggcgtgggcggctcctccgtgctgacgcagctgctcgtctccaactaccagcccgccgcgaaggcactggagggcggcagcgacttcgccgtggacgactggcagccggaggagtcgcccgacaccgcctccttcctcgcgacgatgccgctcctcaagggcgtcgagcctgacgacgagaggtacgtcctgggcatcgtcctggagccggagacggtggacgcgcagggcgacgtctactccgccgcggagattcgccaggccgcgcaccgcttcatggcggaattcggcggcctgggcctcatgcaccagatgcgcgtcaacgggcacgtgaaggtgctggagagctacctggcccccgtcgacttcaacctgggcgaagtgccggtgcgcaagggcacctggcttctcgccgtgcgcgtcctctccgacgagctctggggccgggtgaaggacggccagctgacgggcttcagcattggcggcaccgctcgccgcctccccgaggcctcgccgaccaccgagccgcccccttccgacacacctgccgctgactcccagccggaggccgcatga

SEQ ID NO: 4242 - DNA, 832 bp, Myxococcus xanthus
tggttcatcctctgtgcttcgagtgagctgggagacaagcccctggcacgcacgctccagggctcgcccctggtgctcttccgaggtgagggcggcaagcccgcggccctggtggaccgctgcccgcaccgcaacgtgccgctgtcgctgggccgggtgaaggaaggccagctccagtgcggctaccacggctggcgtttcgacggcgcggggcagtgccgcgccatccctggcttcctgggcgagcccggcgcgcgtgctcgctgtgccacggcgcatgccacgcgtgagcaggatggcttcgtctgggtctactccacgccgggcgtcgagcccaccacggagccctaccgcttcccgcttctggaggcgcgcgaatacaccaccgtgcgccgcacgcttcgggcccccggctcgctgcactccacgctggagaacacgctggacgtgccccacaccgcgtacctccatggcgggctgttccgcaccgaggagaagcggaacgaaatcgacgtggtggtgcgccggagcgcggacaaggtggaggccgagtacatcggcgagccgcgtcccagcgggctcgtgggccggctgctcgcgccgggtggcggggtggtacagcacttcgatcgcttcctgatgccctccatcgcccaggtggagtaccgcattggtgacaccagccacatcatggtgacctccgcgatgacgcccgtgtcggactgggacacgctggtgtacgcggtggtgacgttccgtctgccattgccccgctggttggtgcgcgcggcgctcccgctcctcatgcccgtggcgctccactgtagagcac

SEQ ID NO: 4243 - DNA, 618 bp, Myxococcus xanthus
atggtggtggaggaggtgtccctcgtggacagggccgccaacaagcaccgcttcctcctcgtgaagagagacgacatgcacgacgctccccaggactccgcgcaggccgaggacacctccaaggccgaggacgcgctcctcgccgctgcccagaaggcccttgaagcagtgacggccctcgtcgaggcattggcttccacggacggcatcgacggcgtgcgcgtggttgaggtggcccagcacctgcgcgcgctggccgacgcgttggaggacgaggacgaagacgaagaggacgtcgaggcgcgagagaagactgccagctccgagccccctcccgcccagccggctccgcccgcgcccacgccaggcgccgacgcctcgggccttcaggagagcctcaccaagctcaccgacgccgttcgcgcgctggagggctccgtgaaggagcagcaccagcgcctgggccgcgtcgagaagcagttcggcctgcccaacagcagcgcccccgcggagcgcccgcccaagcccaccgtcgaggacgttggctggccgctcgacctcaacaaaccgctcaaccgggagagcgtcgacaaggccctctccttccacgacgtctga

SEQ ID NO: 4244 - DNA, 935 bp, Myxococcus xanthus
atgagtcgtctcgacaacagcaccctcttggccaaggcggacctggccctcgccgacctcacggccggcggcggcatcctccagcccgcccaggcccagaagttcatgcgcctcctcatcaagcaaagcgtcttgctgcagcagtgcaccgtcgtccccatggcggcgcccaagcagcagttcagcaaactgaagttcggcagccgcatcctccgccccggccaggaggccaccgccgtccccgccgcccagcgcgtgaagccggacctctcccaggtggagctggacgccaagctcttcaagggcgaggtgcgcctctccgacgaggtgctggaggactccatcgagcgcggcgagctgcgccagacgctcatggagatgatggcggacgccatcagccgcgacatggaggaaatcctcgtcaacggggacacggcctccgccgaccctttcctcgccacgatggatggcgtgctcaagcaggccaccagcaacgtcgtggacgcggccggcgcccccatctccaaggacgtccttggagacttgctcaagtcgctgccctcggagcacctgcgcgacaagagcagcatggggttcctcttaccagcgtcgacgcggacctggactaccgcagcacgctggcggagagggccacggctgtcggcgacaagttcctcgagggcgacgcgcctgtcctctactcgggcgtcccgctgcggccgattcctctctggccggagaacctcggcgcgacgaatgaccgcacggccatcctcctgtgcaaccccaagaatatccacgtcggcatctggcggcagattcggctcgagtcggcgcgcgacatctccgagggcacgctgaaggtggtggccacgctgcgcttcgacgcgaagttcgcggaggagccgggcacggccaaggccatcaacgtgcag

SEQ ID NO: 4245 - DNA, 378 bp, Myxococcus xanthus
atggacaacacctatctcgtccgactcaaggcatacgacgcgcgccggggccacgtgctgcggcgctacacgtatgccggcatcaagtttcaagaggagcgcggctggtaccgggtggagaagccggtggcggactacctgcgcaccgtgcaccaactgcccggtgacacctactcgccgctcgccttcgacgtgtcctcggaggccgaggcgaaggccctcgacgcggccgaggccgacgaggcccgcgtgaagcgcagcgccagcgacgagctgaagctgagtgcggcgcggcctgtcggcacactgacgacggaggacttgccgaaggccagcgaggagaaggactcgcgccgcggcaagcgggagaaggactga

SEQ ID NO: 4246 - DNA, 618 bp, Myxococcus xanthus
atgcgcgccgagggcgtcacaccggccatggcgggcgacacccgcctggccgtcctcctcgatgaggccacgcgcaccatcgacaaagtgacggggtggtacttcgagccgcgctcggcgacgttgcacctcgacgggcgcggcaccccgtccctctggctgccggtgccacccattcgcctctaccgcctggcgctgtacggggcggacgtgtccttctccaaggagcacctggtggtggtgggtgctccggtgggccctggcttcgacgggccccgcctcaccttccggcatggccgtgtcttcccgcgcggcgagggtaacgtcacggtgggcgcgcgctggggctacaccgaggcggacggaacgcccgaggggcgcacgccggccgccgtccgccgcgcctgcatgctccttgtcctgcgcagcctctcgccgctggcggacgaagcctccctggaggagcgcacgcgctggcgcgtggtggaggagaggacgcgcgagcagagctaccgcctcgacactgtccgccccgcggtgcggcctctcaccggagagccggaggtggacaccctcctcgccccctacgtgaagccctccttgcccggagcggcctga

SEQ ID NO: 4247 - DNA, 525 bp, Myxococcus xanthus
atgaggggcaggctcatcttccccttcctcgcggagctgcaccgtttggacaccgccgccatggcgggccccggcccgggcccccatgccagcgggtacgacgcggacttccacgagccggtgctggtggacgcggacgacgacggcctggccgaagccttccgacgcgaatttccgccggtgcgtgtcccctgccaggtggagccggatgcctttgagtctttgcgcatgactccttccggcaacagcccccggacgagcttcgaactcgtcttccacttccgcgacttggagcgccttggcctcgtcgacgcggccacgggcgacgccctcatccgccccagcgacaggctgggggccctctacgacgtcgcgggcgccctcgtgcaggccgtgaggacgccccccgggctgtacgtcacggaggcgcgccccacgggcttcggactccaccgccggaggcccagccgaaacctccttctcgtcaccttcaacgacaggccccaggcccgaggactcgcatga

SEQ ID NO: 4248 - DNA, 294 bp, Myxococcus xanthus
atgaaagcactcctactcaccccacttctcgctgctgccctcctcacccgctgccgcgcgccggacgggtgcgcgccggtgtccacccggtgcgctggcaacgtcgcgcaaatctgcaacggcgacggcaactggcagcctctggccgactgcgacgctgtcagcgagcacagcggcgccgccttcacctgcgcctacgtcaatgaggagggcgtcgccggtcacacctgcctgcccaccaccgtggacgccggcaccgtggacgccggcaccgaggaaggcggtgtcctgtga

SEQ ID NO: 4249 - DNA, 552 bp, Myxococcus xanthus
atgcaggagcgcctgcgcaccaagacggccaacaaggccgactccctcgaaatgcaactggcggccgaggcgctgcagcgcatgggcatcctcgacaggcagcgcttcctggagaagtacgccaccaccgtgggccgcaccctctacgtgcccttcgaggtgggcgtgccgaaggggggctgggacttgtgggcccaggtggtggtgtgcgtccacgagcaccagcacgtcgtccagcatgacgaggagggccccagctacgagctggcctacctcaccagctccgccgcgcgcgcccgctacgaggccgaggcctacacctgcaacctggagctgcactactggcgctacggcaccctgcccgccgtgcggcccatggccgagggactcaagcactacggctgccagccggaggacgtggaagtcgccgcgcacaccctggcgctcacctcggtgtccgtccgccacggcgcggtggtgagtgaggccacccacgtggccctcgagtggctcaactcgcacgtcccccacctgcgggcgaagaagggctga

SEQ ID NO: 4250 - DNA, 528 bp, Myxococcus xanthus
atgcaggcggccctgcgtcaggaggcgcacgccctgcgcaaggaggtggtgcagggcctcacgcagcaggcgcctggtggcgagccccttcgcccgccttcgcccctcacgctggcggcgcgccagctcgcgggcttcagcgggacgaaggccctcctcgtctccggcgcgctgcgcaactccatctccgtcgtcgtggaaggcgacgaggccttcatcggcgtgtcccgcacggcgaaaggccccgacggtgaggcactcgtcgacgtggcgcagctccaggagtacggggggccgcccgtcgtcattccgatgacgccgaagatgcggcgcttcctcttcgcgctgctgcgccaggccggcctggccggccagtcgcgcaatggcggcggcgggcgcggcgtcattgtgacgcagacgcccgcgcggcccttcctgcggccggccttcgcgcggtttcgccagggcgccagccgccgcttcctcgcgcgcgtcgcgaaggagctgggcctcggagggccggggtaa

SEQ ID NO: 4251 - DNA, 903 bp, Myxococcus xanthus
atggccatccccactctcacctccgtgacgccctcctcggggcccaccagcggcggagacattctccggctcgccggcacgggcttcgccgcgcgggtggccgtgagcctgggcggactgcgtgcggaggtgctctccgtgcgccagcagtcgggcacctcgcatgtcgacgtccggacgccgccacacgcggtggccctcgtcgacgtggagctgctcaacctctccgcggacgggcgtcccattccaggagaggccgctctccttccgggcgcgtaccgctacctgcgcccgcgcgtcgcgaaggaagcggacctcacccgcctcgtgcgcaccctgctgcgcgagttgaagcggcaggtggtggccaacgtcagcgccagcgtctccgtcgactacgacgatacggtggcagacggcctcaacgtcatcgccatggcctcgctgccctccgtggtgctgtcaggccccacgctgcgcgagagtcgtcgctactccaccaacgtcttgcacgaggacgtcgtgcagggcccctccggctcggagctggtgcgcaggcgccccacgtacacggtggatttggccttcaccctcacggtggcctccgagcgcaccgccgagctcttcaacctcatggccgccgtggccaccttcctcaaccgcaatcgttggctgtccatggcccgggacgccgaggacgcctcgcgcggcaccgtgcgctgggagatggatgcggacggcgaggtacgcacgcagctcggcagccgcgacgacgtgcgcgccttcacctgggggcttctcgtgcgcggcttcgacgtggacgagggcctgcccctcgacatcggcaaggccgtcgccggcactcacctcgaaacggactctctctccggaggcacctcatga

SEQ ID NO: 4252 - DNA, 2203 bp, Myxococcus xanthus
ctgtcgtcgaaaatcgtggttgaggaggaggagccgcgcgtccgcggcattccctccgcgcccacctccgtggcgggtgccgtgggcctggcggagcgcggccccatcggccaggccgtgctgtgcacttccttcgaggagtaccaggccaccttcggaggcttcaccccggactcggacctcgccctcgccgccatgggcttcttcgagcagggcggcagccacctctgggcggtgcgcaccgtccactacgaggacgtctccaaccccgagtcgcacacggccacgcgtgcggcggcggccctcaccacgggcggcgggcccacgcccgctgtcgtgcgtggcaccctgcggccccccttcaccctggccgacggccagcgcctggaggtgtccgtcaacggcgccgaagcggtggacgtcatcttctccggcgcagcggcttccgtctctgcggggcgccctgggccctatgccctcaccgccggccaggcgctccgcgtgcgcgtcgacgccgggcgggacgtcttcatcccattcctcgaggagtccttcggcgacatcgcccaggccaccgcccaggaggtcgccgccgtcctcaacgccggactcgttgggggtcgcgccctcgttgaggacggtgtgctgagaatcgccagcgacacccaaggcgccgccagccgcctggaggtggacgacgaggtggctggcgacgtcttcggcttccccggcggcccgcaggtgggcagcggcaacgtccagagtctgcgcgccgtcgagttggcggaggtgcgtgctctcgtcgaggcagcggtggcgggcgtccgcgtggcaccctcttctcttgggacgctgcaggtgcgcacccagtccacgggccctggcgcgtccttgcgtgtacagggagacgcgggccccggcctcggactggacgcgctgctgcacacgggcgacgcatccggtgccatcgacgtcctccatctggaggccaaggatgcgggcgcttacgccaaccgcatcgaggtggaggtgcgccccgcgacggctggcgcgcccgacacctttgacgtcctcgtccttgaggacggcgcctaccgcgagtccttccccaacctctcctcggccgaggacgacgcgcgctacgccgagcgcgtcctcaatgacgagcgcaccgggagcagctacgtccgggccttcatggtgcaacccggcgccctccctgacgagcagacggtggcactcacaggcggcaccgacggcctcgtcggcctcaacgacacggacttcatcggctcggaggccggcgggagcggtcttttacgcgctcgacgaagtgcaggacctcacgcttctcctggtccccggccgggccacgccagccgtgcacaacgccatggtgcgctactgcgaggtggcgagaaacggattggtgttcgccattctcgactcgcccgcgggctacagggcggcggacatggtttcctacgtctcgcaggaggcggctctcgaaggcctctctgagcacgcggccctctactggccccgcgtgaaggtgctcaaccccgcccgcggcgtcttcggcaacgtggagcagctcgtcgtcccgccctctggaatcatcgccggcgtcttcgcgcgcaacgacgccgcgcgccccggcggtgtgtatgaggctcccgcgggcatcgaagccgggcgcatgttcggtgtcctcggcttcgagtccaaggagtgcctcgacgagaagaagcgggacatcgtctacccccgccgcatcaacccgctcaccacggggcccggcctgccgcgcttcattgacggcagccgcacgctgaaggcgggcggcaacttcccctacgtcgccgagcgccggggcgtgtccttcatcgagcgcagtctcaagtcgggcctgcaattcgcccggcaccgcaacaacacggaagggctgcgcgcccaggtgcggcgctccatcgccaccttcctcctcgcgcagatgaagaacggggccttccgcagccaggagcccgccaaggcctacttcgtcgacgtctcggacgccctcaacccgccgtccgtcgtcttcgccggaaagctggtggcgcgcatcgggctcgccaccaacaaaccggccgaattcatcgtcctgcgcatcgcccaggacacccgcgccctcgaagccgagctggcttcggcgggcctgtga

SEQ ID NO: 4253 - DNA, 954 bp, Myxococcus xanthus
gtgatgaagttcggtggcacgtccgtgggctcacccacgcggctccgccaggtagtggagctgattggcaagcacgcgcggcaaggcccgctggcagtggtcgtctccgcgatgggcgacaccacggactggctgctggacgcggcccacctcgccaccgagggtgacctggaaggcgcgctcgcggtggccacgcgcatcgccgacctcgcgaaggccaacgccgcggcgctggcgcccggacaagccaccgcgctggccgagcgtgtcgacgggctcctcgcgccgctgcgtcagttgctccatggcgtctcactcacgcgagagtgctccgcccccacgagagaccgggtgctgtcgttcggtgagttggtgtccgccacgctgctggcggagctgctcacggcccatcgcacgcccgccaccttccgtgacgcgcggcagctcctggtgacggatgaccgctttggcgcggcgcgggtggacctggttcggacgcgggagcgactccaagccgcccgggagacgtggggcgtcgaggtgcccgtgctccccggcttcatcgccgcgacgccggatggacgcaccaccacgctgggccgcaacggctccgactacaccgcggcgctggtggcccagggcctgggcgcgtcggaagtcacggtgtggacggacgtgctcggcctgcacaccgccgacccggagctggtcacggacgcctaccccgtggcgcacctcacccatggcgagggcctggagctggcggcggtgggtgcccgcatgctgcacccgcgcacgatgattccgctcatcgagtccggaatctccctgcgcatccgcaacaccatggagccggagcacccgggcacgctcatcgacgccatcggttcgcgcgacggccagcgtcccgcctgcatcgcgacgcgcgaggacctggcgctgctcggcatcgag

SEQ ID NO: 4254 - DNA, 462 bp, Myxococcus xanthus
atggccatcatcggacagccgcgcagcttccataagcgtttcaagttcctctgtgaggctgacggcctcgggcactcaggttttcaaaaatgctccgagctgtccgtcgaggtcgccaacgtccaatacttcgagggcggcagcctcatccccaacaagtcgccggggcgcctcaccttctccgacgtcaccctggagagaggcgccacgcaggaccaccagctcttcgactggttccaggacgtcgtccacaccaccagcggcctgggcctgccagacagcctctacaagcgcaacctcgacatcgtccagcaagacagagacggcaccacgctgcgtcggtggagcctctcccgcgcctggccggtgaagttcgtcgcgggcgagtgggacaacgagtccgatgaaaatgtcatcgaaagcgtcaccctcacctacgattccttcgagctggccaagtag

SEQ ID NO: 4255 - DNA, 774 bp, Myxococcus xanthus
atggcggacatcatctcatgcccctcggggctgacgggccgcattcgcggcatgcgagtgcgggaggagcgcgtcctcgcggataggaagctggcgaagagcggcggccaggtggatgagctgctctccgcgtgctgggaggagatgcaggaggcaggcccctacgccttcgccgacggaaaggtggattggggccaagtgcttcagggggaccgcttctacgcgctcctccaggtgcgcgtcctcacttacggccccgagtacgccttcgccgtcccctgtcagagtgcagcctgccgagcccgcatcgactgggagctggacctgacgcagttgccggtgcgcgtcctctcggacgccagccgcgcctccttcgtcgccggcaaccgcttcgagacgacgctgccggacgccggcacgcgcgtgcgcttcaagctgctgacgggtgaggacgagcggcgcctgcctcagctccagcgcgcggcccccgagaagctgctgtcctccgtcctcgcctaccggatactggacgtcgacggagtggatgcgcgcgacaagcgccgcttcctcgaggacctctcgctgcgcgacgccgacttcctcgtcgacgagtttgacgccgtcgactgcggcgtggacaccaccctcgaagtcgagtgcgcccagtgcttcatgcgacaggaggtggagctccctttcgaccggggcttcttccttccggggactcagcggacggcgaggcgtcgggagcgcaccacctcttcccgcgagtga

SEQ ID NO: 4256 - DNA, 60 bp, Myxococcus xanthus
atgggccagcagcgcgcccaggaggccaaggcgctggagaaggccgcgaagcggaggtag

SEQ ID NO: 4257 - DNA, 2694 bp, Myxococcus xanthus
atgctcaacaacctcggcctgggcttcgtcttcacggcgcgggacttggcctctggcacctttcagggcgtggagcgcaacttcatgagcctcgacaggcgcgtggggttgggcacggcgcgcattgagggcgccttcgagcggctcggcgtcgccatggccctcttctcggcgggcgccgtcacccttggcgcgtcgctgtccctggccaacaccgccggtcaattcgagcaggccgtggcgggcgtgggtgccgtctctggcgcctcggccgaggtcctcgggcagctccgtgacgcggccatcaaggcaagcctcgccacgcaattcacccccaccgagtccgtgctgggccttcgcgaactcacccaggccggcttcaccgccgctgagtccatggatttgctgctgccggtgctggacctggcgggtggctcgttgggagagctgacgccccagggcgcagcgggcctcgcgtcgcaagcgatgaaggccttcggcatctccaccgacaaggccgccatctccgtcgaccagatgctccaagccgtcaacgtcttcgccctcagcgcgaatgagctgcccctcgccctcggcaccgccgcgcgtggtgcacaggccctcaatcaatccctgcccgagacactcatcgcattggggttggtgaagaatgtcgtccccggcgtggagagagcatccaccgccgtggccgtggccatggagcgcatggcggacccgcaagtgcaagagcacctgcgcggcctgggcgttgccgtcaccgactccaaaggcaacttcctctccttcctcggcatcctcgacgagctggcaccggccctcgaacgcatgacggcggcgcagcgctccgccttcctgctgaaggccttcggccgcgaggcgctcggcggcgtgaatgccatcctcacgcagttcaccaacggaatccgcaaggacaccggagagattgtccgcggcgcagatgccctcaagcacctgcgcgatgagttcgagaacgcgggcggcacggccacgaagttccgtgagcagatgctggacacgtttcagggccagaagacgctgctcgccggcaacctggagacgctcgccatcgtcctcggagagcccttcggccaggtgctgaaacccttcgtcaccctcgtcgccagcgcggtgcagcaggtgctgggtgtcttccagtccctgcccggtccggtgaagcgagccttcgcagccttcgcgctcggagctggcggactgcttactctcgtcggcgctgtcatctccgcgaaggtgggcctggcgctgctggtggtgggcctcaaggtgctgggcctcacgctgggcagcctcctggccacggtgctgccagcggtagccgctgtcgtcctgctgggcgtcgccgtagccggcctcgcctacgccttccgtcacaacctcggggggctgggagacttcgtccggcgtgtgcaggagcaggtgacgctcgccttccgcggcctcgtccagctcttcgaggacggaggcttctccggcgcggtgcgggaggagctgggccgggccgagaattccgggctgaaggacttcctcatcaacctctacctgtgggcacaccgcgtccacagcttcttctccggcctggccgacggcttctcctccggactcgaagccgcgcgccccaccctcgacgccttccaggcgacgctagggcgggtgggcgaagcgctgggcttcctctccgagagggacgacgcggccaccgccgccgcgaagttcgccgctttcggcgacgcgggggccacggtgggccgcgccctcgcccgcgtcttcgacttcgtcgtcaggggcctgacggccgccgcggaagtggtggagggcctggcggggcagtggggctacatgaaggccggcgtcgacgtcctcctgggcagcctggcgcacctgggccgcgtcctcgccggggccctctcgggcctcttgggcaccaactccgccttgcagcagggcagcagtgggtgggcgctcatgggacaagccattgggtttgccatcggcaacatcaccaccgtcgtgggcgtgctggtgtccgccgtctccctcgcagtgtccgtggtgggaggcatcctcaacgcggccctggcggccttctccggcatcgtcgacgtcttctggggcgtggtgttgacgctcagtggcatcctcaccggcgactgggccgaggcgtggacggggatgaagctcgtcgtcttcggcgtggtggacgccatctccggcgtcctcctggaattggtgggcgccatcctcggcgtcgtggacgccgtggcgagcctcttcggcacggacaccggcctccagcaggccctgcggtcagctcggctgggcctccatcgggacttgtccgtcgccttcggcctcgaggacgccaccggcagcgccgccacacctgtgactgccgtctccgcggcctcgcccacctcgccggtggactggccactggagtcctcgtccatgccggcggtggcggccctccaggcctcgctgccccagtccgaggtgctctcctcgcagcctgcctcgactcctgccgcgcccgtcctcgtcagcttgcaggtggacggcgaggtgctggcccaggccacggcgcgcgccgagagggacgccgcctcccgcagcttctcccccatgccggcgtactga

SEQ ID NO: 4258 - DNA, 444 bp, Myxococcus xanthus
atggagtgcctcttcaaccccacgcagttggtggagaagctccaggtgaattggaaccgcctcgcggtgcccggcctctctcaccaggtgctccagtttcagggcacctccaatcggcagctcgcgggcgtggagttctacctcgacgccttcttcgccacgcagcaggccgacgcctccaacatcatggcgttccgcggcttcctgcgcgcgctcaccgtgcccccggcgggcaccgagggtgtgctggcaacggcaccaccgcgcgtcctcgtcctctggcctggcctcctcaccgtggagtgcgtcgtcgccagcgtggagttccattaccgccagctcgccgtcgacggacgcgtcctcgtctacaccgccaccgtcaccttcgaggaggtgctcgacacccgcgtcacctccgagcaactgcgccaggaggtgccgtag

SEQ ID NO: 4259 - DNA, 1284 bp, Myxococcus xanthus
atgacgcggcccctcgacaggagcgcgcctggcgtgcgcctcacgctgctggcacacgagaaggcccgcggcggcgagcccctctctcttgagggccgagtcctcggcctcaccttcgaggactccgcgacgaaggccgacaagctgtccctccagttggacaacttcgacttgtccctcttcgaccgagctgagctcgtgggcggcgcggtgctggaggtgtcctggggctacccggggctcatggcgccgcctcggcgggtggtggtgaagaggctgaagggctttcaggtgctgaccatcgagggccaggcgctcagcgtcctcatgcaccgcgaagcgaagacgcgcacctggaagggcaagacgcgcgcccaggtggtgcgtgaggtggccgccgagtacggctatgaggaggactccatccacgtcgaggacaccggagagtccttcgacaccatccaccaggccggggagacggacgcgaggctcctccggcgcctggccgcgcgggaggagttcgagttccacgtcgacgataggggcctcaccttcggcccgcgcaaccaggccgccgcgcccacccaggtgctgtggtggtacgccgacgcgggccgcggcgacatcctctccgtcaacgtcgagtcggagctgggccgtcgagtgggccaggtgggcgtccgtggccgggacgccatggccaaggcaaccatcgaagtccaggcgagcagtgccaccgtggagcgcaccaccctcgcggactttctcgaggtggtggagaagcgcacgggcaccacgtcgctgcagctccgcaacagcaccaccaacgtccagcccacctcggcatcgacacctgcccaagcccagcgcgagtccgaggcccgcttccgacgcgcggaagccggcacggtgaagctgtccctccaggtggtgggcaatcccagcttgcgcgcgaagtccgtcgtggaggtgcgcggcatctccagcttcctgtccggccggtactacgtcaccgaggcgaagcacgtcctctcctcctccggctacaccacggacttgaagctgtcgcgcgacggcaccggccgccggcagcaagccagccccgagaagcagggccagccccagggcggacagcccaacaccagtgcgcccgagacgactggggcgctgaaggaagtggaggcattcgagagggacaccggcacccggtacatcgagtaccgccgtgacgggcagcccatcggtgtcgaggaccccgaagccggaatgagtctccccaggtag

SEQ ID NO: 4260 - DNA, 579 bp, Myxococcus xanthus
atgagcagcttcgacgacgacctcctcgcccacgacacgcgcctgctcggcatgtacgtgggctacgtcacccagcgcgaggacgaggcgcagctcggccgcgtccgcgtgtgcatccccggtgtcctcgagcccgagtccgcctgggcctggcctctgggcacctccggcggtggcgccaaggacacgggcttcttcgccgtccccgaggtgggcgcagaggtcgctgtcttcttcaaccagggcgacgtcgacgccccctactacctcagcgcgcactgggggcggcccggcggtcagagcgaggtgcccgaagaagcccaggtgtctccgcccgacaaccgcgtcctcgccacgcccaccttccgcgtcgagttggacgagtccgcaggccaccgcaagctgaagctcaccaaccggaagacgggcgactgcctcaccttcgacgcagaggagaacaccgtcaccctggaggccaccaccgccctcaccctgcgcgcggtgggagctatctctctggaagcggcccaagtcaccatcgctggccgcgtagtgcgccccatcgccgagccgatttga

SEQ ID NO: 4261 - DNA, 675 bp, Myxococcus xanthus
atggcgctgcccatctgcatccacatccccccgctgccccaggcgcccaccctcaccctccctggcggcgccaccctgcagcaccaccaactcctgcaggccgtccagccggcgctcgcgccgctcacgcccctcttcgacatcatcggcgcggtgctggccctcgtcgaagtcgtgaaggcgatacctgacgcgctggggcctccgccggacccgacagccatcgccgcggctctgcccaaattggccgagaaggtgtccaagctgctccgcctcgtcccccagctctcggtgccgtacacggtggtgggcgtcatcgacatcgtcctcggcgagctgggccatgcccgtggccagctcctccacctgcaactgcgcctatcgagcgtcgcgcaggcccggcaacgcgccgcccagcttcgagacgcgggcctgctcgcggtggccggttgcgcggaggccaacgtcgcccaggaggccgccaacgtcggcaaggccctggccgccctctcccagctcatggccctcctcaacgtcttccttgggctggtgggtgggccccaggtgccggacttctccagtcttgaggggagcccgttggaagaagccattgctcccctcgatgccatcgtccgcacgctgcagcaggtgcgcgcggccatccccattccgtga

SEQ ID NO: 4262 - DNA, 444 bp, Myxococcus xanthus
atgccatcgtccgcacgctgcagcaggtgcgcgcggccatccccattccgtgaggaggacgtcgtgagtcgagccccccagaatctcctcattcccttccggcgcgacaggaagcgcgacttcgccgcgggcgccggggccgagctgctcgcctcgaaggtgcggcaggtgctgctgacggaaggtgccacgccccactccaccggcgagctgccctggcgcaccagcttcggcgcgggcctctcgcgccttcgccaccagcgcaacgacacggtgctggcggagctggcgcgcgtgtacgtccgtgacgctctcgcgcgctggctgcctggcgtccagttcgtgcaggtccgcgtcgagcagcacgcagccgtgctgacgcttcgtgtgcgcgtgcgcgacggtgacgcgacggcagccctggacgtccccattcctgggtga

SEQ ID NO: 4263 - DNA, 540 bp, Myxococcus xanthus
atgggggcgctgtgcaccatcctggtggccggagggctctactacggcgcgggcatggacttccggcacgtgctgggcatgggcgagtacaccatcgcccagctgttggcggatacgccggggccgctgtcgctgtggtggtacctgctgctcatcgtgggtgggaagctgctcaccacgggcttcacggtgcagtcgggtggctcggcgggcatgctcatccccagcatggtgctgggcggcgtgtcgggcgcggccacggcgcagatgctcgcgtcggtaacgggcacggggccggcggatgtgacggtgttcgtggtggtgggcatcgcctccgcgctggtggcggtggtgggcgttccactggcggccattgccctggtgctggaggtgttcggctccgcgtatggcccgcccgccgtcctcgcctgctgcgtcacctacgtgctgacgctgcggctgtccgtctacaacgagcagcgccgcgaacaggccgtggaggcggagcccgtcgcgagtgcgtgttcaacgcgttcatga

SEQ ID NO: 4264 - DNA, 1263 bp, Myxococcus xanthus
atgctgggctaccggcttcacggtgcccaggcggccacggccgaggtggagctgcgcctggcccagcctcctgccgcccacgtcaccttccccgccggcaccgtcgtccgcacccaggaggtgacggaggccgtccgcttccagcttctctcttccgtcaccattccggccggcgccaacccaccgcgcgtcgtcgcggtggtggagcactcgaagacgcacacgcagctcttcgacgcccgcggcctcgccgacttcgaggcgcacctggacttcgctccctacctcgacggctccgcccgcgtgtccaccgcccagggtgccttcaccgaggtggacaccttcctcaactcccgcgcctccgacgcccacttcctcatttcggtggaccagggggacaaggccaccgtccgcttcggaaacggagtcaacggcctgccgcccgctggcaccgtggcggtggtgtacaagacgggcggcggctcggcaggcaacgtggacgcggagcgcctcgtcgtcgtggaggggagctttcgggacgcccatggccacgcggtgcaggtagccgtccacaaccccgcctcagcctcgggtggcgcggacaggcagacggtggcctccgcgaagctgctcgcccccgagagtctccgggccctgacgcgcaccgtctcccgcgaggacttcgaaatcaacgcccggcgccttccaggcgtggcgcgcgccctcatgctgacgtccaacgaggacgccaccatcggggagaatgccggcatcctctacgtggtgccccagggcggtggagtccccacgcccgcgctcaaggcccaggtgctgcgccaggtaacggaagtctacccctgcaccctcaccttccaggtgagcgtccaggagccggtgtaccggcgcgtggacgtctccacccgcctcttcctgcgccagggcgcttcggctcaggacgtcgcctcgcgcatccgccaggcgctcgccgcccacttccgcatcagcgagccggacggcacgcccaacccccgcatcgacttcggcttcaacctcaaggacgcccagggcttccccgccggagaggtggcctggtcggacgtgttcaacgtcatccgcgacgtgcccggagtgcggaagctgggtgacgcgcgcatggacctgacactcaacggcctgcccgcggatgtgaagctgacggtgcgggagctgccggtgctgggcagcgtcaccctacaggacggcgacaccggaggactcctctga

SEQ ID NO: 4265 - DNA, 531 bp, Myxococcus xanthus
atggccctcctcaaccccagcttcgaggacgcgggcgctcggcccggcgaggctgctcactggacgctgacagcggtgacgcgcattgaggtcctggcgggcttcggtgtgccggaggaggcctgcgaggacttcgagcgctggtatgtgtggcacgccgccctctccgacgtccccgttgccctcgcctttttctccggccagcgcgacggcttcgaggccttctcccggggctgggacaacgacggcttcctcttcgagctgccgcccgcgcagctcgtcccgcaccgcttcgaggggaacgtcgccgagacgtggggtcatgggcccttcctcgcggactgggcggacgcaacttccgtggagggcctcttcagcgactcgccgcgcgaggacttcgagcagcgctggcacaccaacgaggcctacgcctggcgctgggaggacgtggcaacgcgcgcggccctcttcaacaccacgcagcccagcgaggacttcgacaccgggtggccagtggccgccacgcagtga

SEQ ID NO: 4266 - DNA, 568 bp, Myxococcus xanthus
atggacatcgccaccgtggacaggggcgtgacggcgggcattgcccgtcccctgggcggcggcaacttcctcttcgccttcaactccctcaccgccgcgcagggtgccgttgccctcttcgccaacctgccggacttcgcccccatggccaagggaggcagcatccgcggctgcctccagcgcgggcccggtggaggccccaccggcttctcccccttcctgtacctctgcggccagggcacctccgtcaacgactccgcctacctcctgggcctctccgacgacgagccgcaccgagtggtgctgcgcaagggcgcggtggccacgggacttcccgacgcggacggccccggtgtcctcctcaagtcctccgccagcttcacccagggcacctggctgcacctgcgcctggacgtcatcgtcaatgccaacggcgacgtcgtcctcaaggccttccacaacgacttggccatccacccgctgggcacgcctcccgaatggcagccagtaccaggcatggccgacttcatcgacgacgcccgcggcatcaactgcgacagtcagcccc

SEQ ID NO: 4267 - DNA, 2697 bp, Myxococcus xanthus
atgccttccgccctgaccgcctccgagatccgcgaggcgttcctcaaattcttcgaggagcgcggccaccgccgtgtggcgtcctcctccctggtgcccgccaacgacccgacgctgatgttcaccaacgcgggcatggtgcagttcaaggacgtcttcaccggccgtgagacgcgcgactaccgccgcgccaccacgtcgcagaagtgcgtgcgcgccggcggcaagcacaacgacctcgacaacgtcggcttcaccgcccggcaccacacattcttcgagatgctcgggaacttctccttcggcgactacttcaaggccgacgccatcgcgtacggctgggagttcgtcacccggacgctcggcctgtccaccgaccggctcgccgtcaccgtgttcaacggcgagggcggcaccccctgggacgaagaggcctacgagctgtggaagaagcagggcgtccccgccgagcgcctctacaagctcggcctcaaggacaacttctgggccatgggcgacaccggcccctgcggcccctgctccgaaatccactaccaccagggcgacgacatcccctgtgtcgaagaggccgagggcaagaagtgtcagggcgtcgcatgtgactgcgaccggtggctcgaaatctggaacctcgtgttcatgcagttcgagcgcaaggagaaggacgggcccctcatccccctgccgaagccgtccatcgacaccggcgcgggcctggagcgcatcgcctccgtcgtccagggcaagcggtccaactatgagacggacctcttccagaacatcctcgccaccgtcagcgaactgtgcggcaagccctactcgcaggagtctggcgcgtcccagcgcgtggtcgcggaccacagccgcgcggcggcgttcctcatctcggacggcgtccagccctccaacgagggccgcggctacgtcctgcgccgcatcatgcgccgcgccatccggcacggcacccagcagttgggcctggaggacgtcttcttcttcaaggtcgtcgaccgcgtcatcgagctgatgggcgacgcctaccccgagctccgggagagccgcaccttcgtcctggaggtctgtcggcacgaggagacgagcttccgccagacgctcagccgcggcctcaagctcatcgaggaggagctgtccgagctgcagaaggccggcggcaagcagctctccggcgacgtcgtcttcctactccacggcacctacggcttcccatgggaccttacgcagatcatcgcccgggagcgcggcctcgacgtggacctggtccgcttcgaggagcgcctcaaggaagaggcggacaagaacaagttcgcgggctctggcgacaaggccacgggcgaggtctacctgaagctggcggagcggctcgggacgacggagttcctcggctatgagggcgagggacacgaaggcgaaggcagcatccgggccatcgtcaaggacggcgccgaagtcacgcaggccacgcaaggcgacacggtggagctggtcctggaccgcacgcccttctacggcgagtccggtggccagatgggcgacaccggccgcatcgtcggccacggcggcaaggcggtggccaaggtcaccgacgcgcagcgccccgtgccgggcctcgtggtccactcggtggaagtctccgagggcaccttcaaggtcggcgacatggtccaggccggcgtggactcggagcgccgcaagtccatccgtgcgaaccactccgcgacgcacctgctccacaaggcgctcaagctcgtgctcggtgagcacgtgaagcaggcgggttccgtcgtagcgccggactacctgcgcttcgacttcgcgcacttctcgcccgccacgtccgcgcagcttgagcaggtcgaggacctggtcaacggctggattcgcgacaacgcgggggccgagacgcgcgtcatgagcctggaggacgcgaagaagtccggcgccgtcgccatgttcggcgagaagtacggcgagacggttcgcgtcgtcaccgtacaccccgagtccaccgagctgtgcggcggcacccacgtgcgccgcagcggtgacatcggcctgttcaagattgccagcgagagcggcgtcgcgtccggcgtgcgccgcatcgtcgcgctgacgggcatcggcgcgctccagcacgtccgcgagcaggaacacgagctgcgcaaggtagccgagctgctcaagtcgaacccgaaggaagtctccaagcgcgtcgaagcgacccagaagcgcgtgaaggaactggagcgcaaggtcgaggaagtggccgtcaaggcgcagacggccagcagcaaggacctgctggagcaggctcgcgatgtgaatggcatgaaggtcctggccacccaggtggacgcagcggatgacaacgtcctgcgcggcatggcggaccagctccgtgaccgcatccgctcgggcgtggtcgccatcggcggcgagaaggacggccgggccatcatcctggtcgcggccaccaaggacgtcgtggccaagggcatcaacgccggcgcgctggtgcgcgagatggccaaggaagtcggcggcaagggcggcggcaaggccgagatggcccaggctggtggccctgatgcctcgaagctccccgcggcgctggagaagctgtacgagttggtgaagggcgtgggcaccgcgtga

SEQ ID NO: 4268 - DNA, 651 bp, Myxococcus xanthus
atgaaccaccgggcctccgcttccgtggcgctcctggcggccaccctcgtcctgggtggctgcaaggaggagtccgtgcctgactacacgggtacgggtgacgaccggacgcttcagaagctccgccaggaagtggaccgggtgaaccagggcggccgtccctcccagggccccgaggccacgcgcggagacccgaacgcgaacctcgcgggcctggccgcgggcatcaacgtccccaccgagcgcgcatgggagcttcccgcccccaacgacgccgtgcacttggagaccctgtccgtgaagctcaccggactggacgcgtcgcactcggtgaagggctcggggaaggtgagcctgacctccgaggacctgttcttccgcgttcaactcatgacgcagaacgtgggcggcgcgtcgctcaccctggacctggacggggcgaagctcttcggggctgaaggccagtcgtacaccgtggcccgggatgcccaggtcgtcgggggcacccgcccccttcggcgcacctgggctccggatgagcgcaccgacgtggtcctcctgttcgagcttcctccggaggcccttcgggacgacgggctacacctgttgcttcagggctccgggggggatgtgcggattcccttgaaatga

SEQ ID NO: 4269 - DNA, 1563 bp, Myxococcus xanthus
gtgctgggcatcgacctgggcacctcacatgcgcgcgtcgccgtcgtccaggacgggacacccaagctcattcccctccccggcaccaccaccacggaccttcccgcgctcatcgcggtgaacggaaccggcgacctcgtcgtcggcgccacggctcagacggaaggccaacgtgccccccgccgtgccatctccggtctcaagcggctgctgggtctgaagccgcgttctccgcaacttcgctggctcgccccgttgctccccttccccgtcaccacggacacgaatggggactccgccgtggaggtccgaggccgcgtcatctcacccattctcttcacggccatgctgcttcgcgagctgaagcatgccgccgcgacgcacctgggccgcaaggcaacccgcgccgtcatctgtgcccccacgcacttcaccgaccgccagtgcgcggcccttcgcgaagccgccacgctcgcggggctcgatgcccagcgcatcctcatcgcccccgcggcggcagcgctcgcgtatgcacatggccgagggctcgcgcgaaagcgggtgctcgtcgtggacctgggcggtggcggtctccaggtctgcgtggtgcaagtcacaggcgatgacctcgaggtcattaccaccggaggcgacgccaccctcggcggtatggacttcgatgcgcgcatcgccgaggccatcgccagcgacctctcggaacagggcgtgcccaagccggaccatcccttcgactgggcccccctgcgcaccgccgccgagtccacgaaggtggccctctccagccaggagcaggtggacgtcaccctcccctcgggaaccgtgccccccatcaaccgggagcgagtcgaagccctcaccgccgacctcgcccagcgcgtcaccaccgtggtccgcgacgtgctcgaatccaatgcgctctccccccaggggctggacgcggtgctgctcgtcggcgggcagagcgccgcgccgctggtccgccgccggctcgaagagagcctgggcgtgagcgtgcgcgacgacgtggacactcgaggcagcgtggccctgggcgccgcgctgctcggacaggggcttctgctggccgcggccggcaagcccgcggccactgtctccgaggtgctgtcctcgccgctcgccgtcgccgagcgcggtggcaccttgcgccgcgtcctcgaacggaacacccgcctgcccgccaccaagacgctggtgcttcccgccgtgccgggtccactcgagctggccctcttccagggggcagtcacgcaggcgtccgacgccgagtacctcggccggctcaccctcaacgtggagcgcgcgggtgaggtggaacttcacctcgccctctcagtcgatggagccctgtcgctcgaaaccaccctgcctggcatgaagcggcacgcggtgtctctggccacggagcacttggacgacgcgaccttcgacgcgctcatcgcccgctcgccgctggccgctgagccggagcgacgcccgggtggcgtgctgtccggactgaagaagctcttcggccgccgctga

SEQ ID NO: 4270 - DNA, 582 bp, Myxococcus xanthus
atggcgggacctgccttcgccatcgaggcacagcaggtgggcgagcggctgcgcgtcaaggagcggccgctggtgggcgtcgacgtccgactgggtctcggcaacttcaccggagacctcggcagcaacaccaaggtgggcccgctgctgggcatcaacgccagcgcctatccctggcagtacggaggcgtcgaggtcggctacgaaggccagcgcttccccatcgacgactcgcgcctgcgcaacaacggcgatggcgaaggcgtctggcgccacaacgccaccctgctcgccaaggcgggaccgctcatcgacgaaaagtggcgccccttcgtcggcgcgggcgtcggcctgagctacctcaacccctctgacggcgcggaccgcttctacaacaatgactggcagacggagctcccgctggccgcgggcctggactaccgcttcggcaacctggtggccggcgcgcgcgccacgtatcggttcgtcggcggggagggcctcctccgaaaccccatcaccaacgccgacgagaaaggcagtctcctcaacggcaatgtgatgattggcgggcagttctag

SEQ ID NO: 4271 - DNA, 753 bp, Myxococcus xanthus
atggggctcctcggccgggccttctccctcatcctgcgcgaccgtcggctgttcctgctgtccgcgctctgtgccgccgtcaccgccgccgcgctcgtggggctcgcttggctgctgtggcgctacgcccccggtgccctggaatccgtctggacccgcccggagagctggtacggccaggccgcctggaccgcggtgctggtgttgtccggcctggtgctctgggtcgtgggcgccaacgtgctgccgcccctattgctggccccgctccaggatccactgtctgagctgaccgaagaggcctgtggcggcggcccaggcgcctccttcaccgtggcgggtttcgtccgggggctcgtcaccggcatcgcccatacgctcgcgcggctgttcttcctcctcgcgggcctggcggtgctcctgcccctccacttgataccgggggtgggcagcgtgctgtggacggtcctcgccagcctgtacaccatgacgtggatggcgggtgagtacctggccgcccccatgacgcgtcacctgtatcccttcgccgaggtgcgccggatgctgcgcgagcgccgggcgctctgcctgggcctgggcgcgggcatctacgtgctgctctgggtccccatcctcaacgccttcttcctcccggtggccatcgtcgccggcaccctgctctatggcgggctgcgcgaggcccggctgctggcgccccctcctggggagtccactaccgctgcgttgaaataa

SEQ ID NO: 4272 - DNA, 3210 bp, Myxococcus xanthus
atgccgcgtttcctccgccgaatcacagccgttgccgtgctcctcggcgcctgggccctggtgggcagcaaccgggctcccttgccgctgaccatgggtgcagccgaggccgggcaaggctcgtgggacggcagtcttcctaccgtcaaaggcgagaaggcaccgcacgacctcaacagcctgcgcgtcctgacgaaggtcatcctctacgtgaaggagaactacgtcgaccccaagcgggtgaagccgaaggagatgatgatcgcctcgctggagtacgtcgagaagagcgttcccgacgtgctcgtggacggcaacgcggagacgggcaagctcaacgtcaacgtgaacggcaagcagcgcgagttcgacatcgcccacgtggactcgctgtggaagatgtccttcgcgctcaaggacgtcttcgacttcctgtcgaagaacatgcggcccatcgaggacacgcgcgacgtggagtacgcggccgtcaacggcatgctgtccacgttggatccgcactcggtgctgctgcgcccggagctgtaccgggagatgaagctgtccaccaagggtgagttcggcggcctgggcttcgtcatccagatgcgcgagggcaacctcaccgtggtcaaggtgatcccgaagacgcccgcgcaccgctccggcatccagaaggacgaccgcatcaagaagattggcgaggagtccaccgtcaacatggacctcaacgaggccgtgtcgaagctgcgcggcccggtggacagccgcatcaccatcaccgtggagcgcgacggctgggacaagccccgcatcatgacgctctcgcgcgccatgatttccatcgagagcgtgcagcacaagatgctctccaacaacgtgggctacatccgcctgaagaacttccagggcaacaccacccgcgacctcgaggcggcgctgacgcagctgcgcaagcaggcggacgcgaagggcggcttcaagggcctggtgctcgacatgcgcggcaacccgggcggcctcttggagcaggccatccaggtgtccgacacgttcctgtccagcggcaccatcgtcgcgacggtgggcctgtccgacaagctgcgcgaggagaagcgcgcgcgcgccacggacggagaggacagctaccccatcgccgtgctggtgaacgctggcagcgcctccgcgtccgaaatcgtcgccggcgcgctgaagaacctcgaccgcgcgaccatcatcggccgtcagacgttcggcaagggcagcgtgcaggtgctgtacgacttcccggatgacagcgcgctgaagctgaccatcgccaagtacctgaccccgggcgacgtctccatccaggaggtcggtatcgtcccggacatccagctggtccccacccgcgccaccgatgagcgcgtggacgtgttcgcgccgcgccgctccatgggcgaggccgacctggaccagcacttcggcaacccggactccagcaccgtcgccaagaagcgcgaggacgtgctcaaccgcgagaagccgctggagagcctcaagtacctgaaggtggacgagaagcaggcccaggccaccgccaagaaggaagagggcaaggccccgccgaagacggccgccaacgccaaaaagcacggggacaaggacccgctgctggacgtggacgtggccggcatgggtgaggacctggacgaccagctcgacgccgaggcccaggaggagatcaaggaggacttcgaggtccaattcgcccgcgacttcgtgctgcgcgctccggccaccacgcgcaaggagcagctcaagcagggcaaggcgttcatcgaccagaagcgcgccgaggaggagtcccgcatcaacgccgccatcgccgcgctgggcgtggactggagcgcggggcccacgccgaagaacgtgcagatggccgtgtcgctgacgccgggcccggacgcgaagattctcgcgggcgaggtgatggagatggcgctgaccgcggagaaccgtggcaccgagccgctcaagcgcgtgcgcgcctggacggagagcgacaacgccttcctggaccgccgcgagttcctcttcggtgcgttggcgccgggtgagaagaagacgtggaaggtgaaggtgcgcctgcccaaggacctcaccagccgccgcgacgacgtgacggtgcgcttcttcgatgaccacggcgccctgcctgagacgcgggtggccgagctcaacttcgtggagctgccccgccccgccttcgccttcaactggcaggtcatcgacgactgcgccacctgcaacggcgacggcacggtgcagcgcggagagactgtatctgtgctgctcgacgtgacgaacgcgggcaccggcacggcgctcgactcgttcacgcagatcaagaatggcggcgacgccaacatcttcatcgaaaagggccgcttcaaactgggcgagctgaagcccggtgagacgaagacggcgcgcttccagttggaggtgaagaagggcttcaagggcaacaccttcccgctgaagctggccatcatcgacgagccgctcgaggagttcgtgatggagaagctggagctgcccgtcaccgacgccgcgatcgccacgatggagccgaagaagggcctcatccgcgtgggcgacaaggtggacctgtatggcgcccccgcgcagggtgcgcgcgcggtggcgaagctgagcgggacgacggtgctgcccgccgaggcggtcaccaagggctactaccgcgtggagctggagaaggaccgcttcgccttcgtgcgcagccaggacgcgaaggagctgaagacgggcaaggccaccaccccgaaggccacgctggtcaccaaccaccgcccgcccgacatccgcctggacgtggatccggccgctggcggcatggtcgccaacggggacaagttcacgctctccggcgtggtgacggacccccacgggttgctggacgtctacgtgctggtgaacgaccagaaggtctacttcaagggcgtggaccccaagggcgccgagccgaacacgctgaagttctccacggagttcgcgctgaaggagggcaacaacaacgtgctggtggtggcacgcgaggacaacgacttcgccagccgccgcacgctggtcatccgccgccgcccggccgaggtcgcccagaaaatggcctcgcctgccggtagccccgccaacaagccgcagtag

SEQ ID NO: 4273 - DNA, 708 bp, Myxococcus xanthus
atgcccccggagacgacgggccactcggcctgggccatcaacgcggagctctccgtggtgtcgctgcccggcagcgtgaacatccccacgcagaacgagcagccctccacggtgctcatcccctccttccacgcgcgcaagggcctgcccttctcgctggagctgggtgggcgcgtcggctgggtggagaagagcagccaggtggtggccaccggcgagctgaagtgggctgccaacgagggcttcacctacctgcccgacttcggcgtgcgcggacacgtgacgaagctgttcggcgcccgggacctgggcctcaccgtcatgggcctggacttcggcgtgggcaagcagttcccgctgggcggcatggtgacgctgacgccctacggcggcctggacctgggcttcgtcggcgcgacgtccagccgcatcgacttcaacccggaccgcagcttcgatgacacgacgggggacgattcgcgcgcggcgctgacggataccgccgcgtaccggaaggtttccttcggcagcaacatcaaccagcgcatctacggcggcgtccgcttcattggcggcgtgctccagttgggcgcggagctgtcgctgacgcgcacgggcagcgtctcctacgaggagaacggcagcaccgtggaacggggcctgccggccgtcttcgccttcaacacgacgctcggcctggacttctga

SEQ ID NO: 4274 - DNA, 459 bp, Myxococcus xanthus
  unsure (1)..(459): unsure at all n locations
gagcccgagcctgctcccgagcccacggtggcgaaggcggagccggcgtccgcgagcagcgaggcgtccccggtggccggggtggtgggtggcgtggtcgncggcgtcgtgggtggaacgcagggcggcatcgtcgggtcgacgggcattggcggcacgggtgacgcgctgacgctcaagcaggtgatgcggccccccacggtcctcaagcaggtcaggccggactacccccggctggcgaagcagcggaacatccagggcgtggtggtggtgcgggtcatcgttggcacggacggccgggtggagcaggagcacacccaggtgatgcgctccgtgcccgccctggacgctgcggcgattgccgccgtgaatcagtggcacttcacgcccgcgctgggccgttcggggcggctggcgcgagtcatgatcgacattccggtgaacttctccctgaagtga

SEQ ID NO: 4275 - DNA, 228 bp, Myxococcus xanthus
atgctgggcctcggcctcggagaaatcatcgtcctcggcttcatcctgctggtggtcttctcggccgcccgcatgggtcagctcggcaatgccgtgggcaagttcgtgtactcgttccgcaaggcgtcgcgcggcgaggacctggtggatgcgaagccgctgcctccgggccgccgcagcaccacggacgccgagttcacggagcccgagcagccgcgccgccgctag

SEQ ID NO: 4276 - DNA, 1395 bp, Myxococcus xanthus
atggctaccagggacaccgtctacacgctcgtggtgcgactcagcggcacgacaacggggtttaatgcgtctttcgcattggtgcgtgctgtgcgcggcatgctggagaaggacggggtatcggcaaccttcacgggacaggtaggccagaatggcatctatgaattcagcggcatgatgggggcgcgcctggggctgggggtgacgagtgtcagcactacgcctgccggagggggcgctgtcatcaggctgctcaagccggatggcaccctattggttgattgcagcaacttctacgtgccagggaactgcgacgtgccggtgttgccgatgacgggcacatacagcctgacggtgaatccatcagggacggtgacggcgacggtgggcctgttgctgtcgacgtcgctgggagacgtcctcacggtggatggccccgctcacaccttcagcactgcgcgggtgggccaggatggcttctacaccttctctgccaacgcgaattccaacctgacgctgctaatcacaggcaacaacttcggcagcaacacgttggtgcgcatcctgaggcctgatggcacgcagttgacgagccaaaccacgggctccgccactggctacacggtggacttcacgcccccaacgacgggcacgtacggcatcaccgtggacccgtaccaagccagcatcggccagatgacgctccaattggttgaggaggccagcggaagcgcgggcaccgtcgatggggtggagacgacagtggtcctgaatgcagggcagaacggccgttacactttcagcggcacgatgggggcgcgactagggctgggggtgacgagtgtcagcactacgcctgccggagggagcgctgtcattaagctgctcaagccagatggcaccctgttggttgattgcagcaacttctacgtgccagggaactgcgacgtgccggtgttgccgatgacgggcacatacagcctgacggtgaatccatcagggacggtgacggcgacggtgggcctgttgctgtcgacgtcgctgggagacgtcctcacggtggatggccccgctcacaccttcagcactgcgcgggtgggccaggatggcttctacaccttctctgccaacgcgaattccaacctgacgctgctaatcacaggcaacagcttcggcagcaacacgttggtgcgcatcctgaggcctgatggcgcgcagttgacgagccaaaccacgggctccgccactggctacacggtgaacttcacgccccccacgacgggtacgtacggcatcaccgtggacccgtaccaagccagcatcggccaactctccttgggaataaagaccgcgggcgctccctcggcaccagcccaagcggatgtccggaagtga

SEQ ID NO: 4277 - DNA, 1305 bp, Myxococcus xanthus
cccatctcctccgtcgacatgctgttggctggattccgagccgccgagaagcccagcggtgcgcaccgtctggggctcgagcacgagaagttcctctacccggtgggcgccgcggagccgccgacctatgaaggcgagcggggcgtcggcgcgctgctgaaccgggtggcctcggcgggctacacgccgtttcgggagacgccggagtcgcccgtcatcgcgctgcagcgcggtggcgccaccatctccctggagcccggcggccaggtggagctgtccggaagccccttcgtcaccgcgcgcgaggcgcatgcggagaacctgacgcacctgtcggaggtgtcctccgccgcgaaggagctgggcttgcggctcgtcttcctgggctaccgccctttcggtacgacggcgcagatgccgtggatgccgaagacgcgctacctcatcatgcgccgcacgttgccggagcgcggccggctggcgctgaacatgatgttgatgacgtccaccggccaggtgtccctggactgggcggaccagtcggactgtgtccgcaagacggtggtggtggcgcggcttgccccgctgatgaatgcgctgtacgccaacagccccatcgtggagggcaagccgtcgggttacctgtctttccgcaaccgcgtttgggacgaggtggaccccacgcgatgtggttacctgcccgcgttcttcgacggctcgttctcgtatcgcgcctatgtggagtgggcgctggacgcgccgctgctcttcctgcggcgcaacaacgagtacctgtacccgaagctgaccttccggcagttgatgaaggagggcttcgagggcaagccgcccgacctgaacgactggacggaccacctgtccacgctcttccccgaggtgcggctgaagacggtgatcgaggtgcgcggcgcggactgcgtgaaccccgcgatgacgggagcgctcgccgccctctggcgcggcatcctgtacgacgccaccgcgctggaggaggccgagcgcctgttgccgaagctgacctacgccgagcacctggccttccatgatacggcgcggcgcgaggggctgggcggccggctgggttcgcaggagctgcaccgcctggcggcggagatgctggccatctcccgccggggcttgatgcggctggatgcgcaggatgcgcccctgctggacgcgctggacgcggtggccgcgtcggggcgttcgcccgcggtggcggtgctcgaggcgtgggagaagaatccccgccccgaggcgctgctggacggcttcagcctgtga

SEQ ID NO: 4278 - DNA, 762 bp, Myxococcus xanthus
atgcacggcggcggccacccgcgcagactggagggcatgctcctgcttgcccaccgtggcgccagcgccgatgcccccgagaacaccctggaagccttcgccgaggcggtccgccaaggcgcggacggtgtggaactggacgcgatgctctgtggctcgggcgaggtcgtcgtctgccacgacgagcgcctggagcgcctcgcgcggctgccgtgggaggttcgcctcaccccgtggtggaagctccagcgggcggacgtcggctcgccgctgggcttcgcccccgcccgaatcccgctgctggaagaggtgctggaggccctgccaccgcagttcctggtcaacatcgagctcaagtgcgagcgcgccgacgacggaggcctggcggagcaggtggcgcggctggtgcgccggcgcggactggcgggccgggtcgtcatctccagcttcaacccgctgtgtctcttccgcctggcggcggcggcgccggagctgcgccgggggctgctcatcgacccggacaagtcctgggccctgcaggcctacggggtgagcccgctcgtgtcgtcacactcggtccaccccttccacgaggcctgcaccccggaacgggtggccgcgtggcgcgcggccgggatgagcgtggcggcgtggacggtggacgacccccagcgcgcccatgtcctggagcggatgggggtcagctacctcatcaccaaccggccgggggcggtccgtcaggccctgcaccccgccgcgtag

SEQ ID NO: 4279 - DNA, 600 bp, Myxococcus xanthus
atggccgcgctggagcaggaggccgagcacatcccccatgtggcgtcgctgcggcggctcgcgcacgtccagtcgctcgacaccgtggcggacctgttcgcccagggccccgcgaagctggagatggacccggacgccgccgcccgcgcggacgccaacgccttctcgcagtcgctcgggcacctgaagcagcaggcccgcctcacgagggacccggacaccctgtcccgcctggccaccgtcagcaatcccactgtcctgcgcaacgtgctcatcaacccccggctcaccgaggagttggtggtccgcatcgccgcgcgccgcccggctcggcccgagccgctcatcgaaatctggaagtcaccgcgctggtccgtgcgccacgccatccggcgcgcgctcgtcttcaacccctacctgccgccggagacgggcgcgaaaatcgtcccgctgctcaacacggcggacttgagggaactcgtctcgaacgccgccctccatcccgccctgcgcgcgcaggccacccggctgctcgccgaagggaatggaacagggcctgcggccgcgtcactcatccccgggcgtcgcgggcacgactga

SEQ ID NO: 4280 - DNA, 1683 bp, Myxococcus xanthus
atgcacgagctggcctggcggctccagtgcgccgccgagcgccacgtggagcgcgaggaacaggcgcgcagccaggaggacctagcgctcctgctggaactgacggcggactacgcggagacgtcggacgtggaggcgctgctgcacggcgtcacccggcggctggcggagaagctggacatcgcgcgcgccacgctggtgatgctggggcgcagcgcggatgagggcatcatcgtcgccgccagcgacgaccccacgctcaaggacctgcgcatcgacctgtcgcgctaccccgagattcgcgaggtgatgcgaacgggcaagccggtggtgatgcaggaggcctccacccacccgctgctgggggacgtggagcggcgcgcggtggccgcccggggcatccacgccatcgccgcgctgccgctgcccatccgcgggcaggtgcgcggcgtgctgctgctgcgcgcggcggggcggcggcgcaccttcacgccgcgggaaatcgacttcctcaccaccgtggcgcacgccaccgcggtggccctgcgcaacgcgtccgtgctccagtccgtgcgcgggcagacggaggcggagaagacggcccgcctggccgcggaggagcaggcggcctcgttcaagccgtaccagctcttcttcgcgcacgtcagtgaaggcgtggccatcctcgacgacaaggcctgcgtgctgtcgctgaatccgtccggcgcggccatgctggacgtggatgctccggacgcgcggggccgccacctgcaccaggtgactcagccggtggatgagaacgtgctgatggagctggtgaccaccgccgcgcgcggcgaggcccgctccggcgcggacgtgcaggtgtgcacccgcacgggtcgccgcctgacgctgtccatgtccgcggcgccgctgcgcgacgaggaggcggccaccatcctctccttccgcgacgtcacggacgcgcgaaggctggaggacgagctgctccagacgaaggacttcctggagcggctcatcgactcgtcggtggacgccatcatcgcgaccgacttgaaggggcgcatcatcctcttcaacaagggcgcggaggcgctgtgcggttacaccgcgcaggaggccctgggcggcggcctcaccgtgcaccagctctatccgcctggcgtggcgaagcgggtgatggccatgattcgggcgcccgagcacggcggcaagggccggctgtccctcatccgggaggagctggtgcaccgctccggtgagcgggtgccggtgaacatgacggcctccatcgtctacgaagggggccgtgaggtgttcagcgtgggcatcttcacggacatgcgcgcgcgcatgcagttggagcgcaagctgtccgacgtggagacgcggctggaggagagcgagaagagcgcggtcatcgtcgcgctcgctggcaccgccgcgcacgagctgaaccagccgctcacctcggtgatgggctacgccgagctgctgaagcggaagctgaaggaagacgacttcgcctggaagccggtggacatcatctaccgcgaggcggagcgcatggcggaaatcgtccggaagattggaaagattacccgctacgagacgaagtcctacatgggggcgcaacagattctcgacctggacaaggccacctcccatgaagactga

SEQ ID NO: 4281 - DNA, 1917 bp, Myxococcus xanthus
atgaagactgagacccgagccgtgcgcatcgccggcggccctgcccccgagttcttccaggccctgttcgaggcgctcgacgcccccgcggccatgtgtgacccggccctgcgcctggtcgccgtcaacgacgccttccgccgcttctgcgccgaccagcacgtgtccgtggaggaggtggcgcgcaccctgtccggcgccagcgtgccggcggatggcgccagctgcgacgtggagctcttgcccgacctgcccggcgtggtgctgacgctgtcccgccggggcgacgtggtggccgtccgcgcgcgcaacgagccggagctgtcacgcaaccggctggtggtggcggagcgggcccttctggagcaggcgcgcactgaaggcgtgctgttggacctgggccgcagcgtggccgaggccggcggcgaggaggaactggtcgccgcggtggctcgcggcgtgaaggagctgttccccgggcgttcgttctgcatccgcatcaccgactcgcggacgggcggtctcacgtcgctctacgcggaggggcggctgaaggaaggcgcgcacgagccgctggtgctgatggagcgcgcggtggagaagacgagcctggaccgcgcgtccctgcccgtggaccgcgtggcggtgctgggcgaagtcccgctgctgttccaggacagcacccatggcgtgagcgcgccgctggttgccagcgggcaactctttggcgccatcaacatggagtacccggcggacttcgtctccgacgtgccgcatgacgagcgcgtgctgctccagctcgccaaccaggtggcggtggcggtgaagaacgcgaagctcatcgatgagctgacgttcgtccgcaagtacctggaggacctgctggagaaggccaacgccctcatcctggtggcgaaccgggacaagcaggtcgtcgtcttcaaccaggcgctgagcgcgctcaccggcttcggcaaggaagaggtgctgggccgggacttcttctggctcatcccggagagcgagcacctgcggctcaaccagctcatcgccgcggcgattcgcggcgagccggtgaacagcttcgagacgcggctgctgacgagcagcggcgcggaggtgcgcgtctccttcgcgacctcctccaagctctcccagcacggggaggtggagggcgtcatcgccatcgggcaggacatcacggtggtgaaggagctggagaagcgcatcatccacgcggagaagctggcctccatcggtcagctcgccgccagcgtggtgcacgaaatcaacaacccgatgacggcggtggccacgtacgcggacgcgctgctccagcgctcgcggatgacgccgggggccaacccggcggaccaggagaagctgcgcaaaatcctggagagcagccaccgcatcctccgcttcacgcgagatttggtcagctacgcgcgcccggcgcaggaccggccggagcgggtgcaactcaacgccatcgtggacatggcggtgggcttctgcgagcacgtggtggcccaggctcgcgtcaccatccagcgcgagtacatcgaactgccacccctgtccgccgtgcgcgccaacctggtgcaggtgttcgtcaacctcatcaccaacgcgtgccacgcgatgccgccgggaggctccgtcatcctggccacgggccgtgacgggcaggacgcggtggtgaaggtgcgcgacacgggcacgggcatcgagcccaagcacctgcagcgcatcttcgagcccttcttcaccaccaagccggaagggcggggcaccggcttggggctctccatctgccagggcatcgtggagaaccacggtggccggctgacggtggagagcaccatgggcgagggcaccaccttcatcgtgcgcctgccgctccagcagggctga

SEQ ID NO: 4282 - DNA, 738 bp, Myxococcus xanthus
atggacctggcgtctgtgacgaacctgaccgtgctggcgaatgtcggcggccctcagcggggcttcttcgaagaaatcgccatgcgctgggaggccggccagtggggtatgtaccccatcgccgcctgcctcatcgtggcactcgccatcatggtcgagcgaagcatcatccttttcggcaaggcctccatcaacaaggaggccttcctgcgtggcctgaagaagcacatctacgcgggtgacctggacaaggccatcaactacgtggctggccagaagtccacgccgctgacgaacgtcatcaaggccggtctgatgaacgttccgaagggcaacgacgaggtccaggccgcgctcgacgaggccagcctccgcgagacgccgaagatcgaggcccgcaccggttacctcgccatgctcggcaacgcggcgatgctcgccggtctgctcggaacggtgtccggtctcatcgcctgcttcgaggccgtggccaacgtgaacccggccgacaaggcggcgattctcgccatcggtatttctgaagccatgaactgcaccggcttcggtctgctcacggccatcccggcgctgatctccttctccgtgctgacgggccgcacgcagagcctcatcaacgacatcaacgagaccagcgtctccgtcctcaacctcatcgtggccaacaaggacaagttcaagaacctgaacgtccccacggcggctcgcgacgaggagtag

SEQ ID NO: 4283 - DNA, 477 bp, Myxococcus xanthus
atggacacaggtggaggcaaaggcggcaagaagtcgctcgacacctccatcaacctcacggcattcatcgacctgatggcggtgaccatcagcttcctcatcctgacggcggtctggacccagattggccggctccaggtttcgcaggcgggtggcccctccacggaggaggagcagcagcaggaagagcagaccaagacggtccagctcaacctgctcatcacgcccacggagctgcggctgaccgcggaccagagcgctttcgatccgattcccctcactaaggatgcgaagggcaagacggacctgaccaagctggtggcgcgcttcaaggaactgaaggcgcagctgccggaccagtccgccatcaccctgcaacctgaagacaaggtccgctacgaggacctggtccgcatcattgacgagtgcatcggcgctgggttgccccaggtgtcggtgtccgcggcgatgggctag

SEQ ID NO: 4284 - DNA, 585 bp, Myxococcus xanthus
atggccattcaggttccaggcaagcgatacggcaagcggctccagcactccaaggtgttcgggcacggcgggaccgcgaagaagagcggttactccgacctcctcatcaccccgctggtcgacatgttcatcatcatcgtgctcttcctcatcgcgaacttctccgcgacgggtgaggtgctgatgatgaccaaggacatcgagcttcccgaggcggtcaacgtcaaggaagtggagatgcacccggtggtgatggtctccggtgagcagatcagcgtctccggcaccatcattggccgcgtggaggacttcaccaaggacgagtacctcaacattccgtcgctggaggagaagctccgcgacatgaagaagcagtacgaggacctccactccatggcgcaggacacggccaacaccttcaagggcgacatcaacatccaggcccacaaggacgtggagtactccatcatcaagcgggtgatgttcagctgcgccacggcgggctacaacaacatcaacttcgcggtgattacggcgggtgatgctgaggcggtgaaggccgccagcgccaaggccaccccgtag

SEQ ID NO: 4285 - DNA, 1329 bp, Myxococcus xanthus
atgcgcaccttccgaaacatcctcttctggattcatctcatcgtcggaatcgccaccgggctggtgattgcgatcatgtccttcacgggcgtggtcatcgccttcgagaagcagctcatcgaatgggcggagcgggatgtccggacggtgcagtcgccgtctccaggcgcgccccggctccccgtggaggaactggtcgagcgcgtccgcgctgcgcggacggacggacagccctctggagtgacggtgtatccggagccgacgtcctcggtgctcgtgagcatcggccggggctcggtgacctacgtcaacccctacaccggcgaggtgctggggaatggcgcgacgggcctgcgcggcttcctccaatggaacgtggagctccaccggtggctggccgccggcggtgacaaccgcgcggtgggcaaggcgatcaccggcgcgagcaacgccgtgttcctcttcctggccatctccggcctgtacctgtggtggccgcgcaagtggacgctgcgcgccatgcgaccgtcgctgtggttccggcgtgggctgaagggcaaggcgcgcgactggaactggcacaacgtcatcggcttctggtcgctgccggtgctcatcgtgctcacggcgtcgggcatggtcatctcgtacaagtgggcctccgacctcgtctacacggtgatgggccacgaggctcctgcgcggcaggggccgccgggctcggcgacgatgaaggtgcccgcgcccggggtggagacaccgcgcaagccgatggacgtggtcatcgccgaggcccagaagacgtcacctacctggtcctccgccacgctgcgcctgggcagtggagcgcgtccgggcggtgctcccgcacagggtggtcgtggtccggacgcgaagggcgagcggggcgagaaggggggcgcggcacccgcacagggtggccgtggtccggaggcgaagggcgagcggggcgggaagggcggcgcggacggtgtggacgcggtgacggtcaccctccgcgaggcggatgcgtggccgctgttctcctccaagcaggtgtccctcaaccccttttcgggcgaggtggcgaagcaggagacgtacgcggactacaacagcggccggaagctgcgcacctggctgcgcttcctgcacaccggcgaggcgctggggctcatgggccagttggtggccgccatcgcgtcgctgggcggcgtgttcctcgtctacacgggcttcgcgctgtcgtggcgccggttcttctcccggcgccggacgaacaccgagcctcgggaagaagccgccgcgcagtccgagccggtggcctga

SEQ ID NO: 4286 - DNA, 660 bp, Myxococcus xanthus
atgctgcttcgtgccgtcatcttcgacctcgatggaaccctggtggactcgctgggggacatcgccgatgcgacgaaccatgcgctggcccaccacggtctgcccacccatccggagtccgcgtacctgcgcttcgtgggcagcggtgtccgggagttgattcgccgggcggtgccttcagggcaggacgcgctcatcgagccggtgctggcctcctacaaggcctactacgacgaccacctcttcgaccgcaccgcgcactacccgggcatcccggagatgctgaccgcgctggccgcgcagggcacgaagctggcggtgctcagcaacaagtcagacgacttcgtgaagcgcctggtcgcgcgcctgctgccacaagcctccttcgccgccgtgtacggcgagcggccggagctgccgcgcaagccggacccgacggcggcgctggcgttggcctcggagctgggcgtaccacccgcggcctgcggcttcgtgggggacacgtccatcgacatggacacggcgcgcgcggcggggatgtacggcgtgggcgtggcctggggcttccgcgaggtggacgagctgaaggcccacggcgcgcgcgcggtggccgccaccgcggcggagttgctggcggcgctgcgggatgccaggccttga

SEQ ID NO: 4287 - DNA, 990 bp, Myxococcus xanthus
atggcgctgcgcctggcgcggttggaagtcgaggcaagccgcgtgttgggagagcctcgctacctggggcgcgcacaggcggtgctgcgtccgtggtgggagctggccacgccgccgcttggtgtgcggctggtacgcgccaccttccaccacgcgcggcgcgactttccggcggccttggaggacctggacgcggtggtgaaggaggaccccggcaacgtcgacgcgtggttgctgcgcgcggaggtgttggggattcgaggcgagcatgccgaggcggcccacagctgcgcgaggctcaccgcgttgacttcttcgttgacggtcgcggtgtgcgaggcccgggtacgaagcctcgcgggccattcgcgcaaggcgcacgcgctcctgtcggaggcgctgcggcgcagcgagcgcagtcaggagtcacgcacgcgtgcactggccacgctggcggaggccgccgcgctggcgggggatgccggtctggcggagcgttacttcctccgggcaatctcgctggattcgaaggactacgccgcacgcgcggcctacgcggacctgctgctggacgcgggccgcgcgcgggaggcggccgtcgtggtgatggaccacacgcaggacgaccggttgctcctgcgccacgcgttggcggagaacgcgctccggtcgtctcgcgcgcccgaagtcgcccacgccttgtcccgcaggttcgaggagagccgcctgcggggggacagtctcctcgcgcgcgaggaggcccgcttcgcgctccaggtggagaaggcgccggagaaggcactccggctggcgcaggccgtgtgggcgtcacagcgtgagccatgggacgtgcggctgttgattgaagccgcgctggccgcgggcagaccggaggcggcccggcccgcgctggacttccttcaagcttcgggctgcgaggacccggggctcgtcttcctggccgagcgcgtgcggagtctgctgccatga

SEQ ID NO: 4288 - DNA, 1122 bp, Myxococcus xanthus
atgagccgcgttgccctgctgtcgctcctgctggtctccctgtccgcccaggcgcaaaagccgagcgacagctacctgcgactgaccgaggcggacggccaaggcgtctccggccggtgggacgtgtcgctccaggacctggacgacgtcctcgggttggacgcgggcggagacggcgccatcacctggggcgaggtgctggcgcgcgaggccgacatccggagctatgtgctcggccggctggtgctcgggtcggaaggtgcaccctgtgcgctcgtttcccagggcgggctgcacatcaggcagcactcggacggggcctatgcggtggtggacttcgacgcgcgctgcaccggctccgccgcgcggttggacgtggactacacgctgctgttcgaccacgacccgcttcaccggggcatcgtgcgcgtgggcgcgcgcgagccgctcatcttctccgtgtcccagcacttcgcgcgggtgcacctgcgggacgagtctccctggcgcaccgcggagcgcatgacggtggagggggcgttgcacgtcgtgactcggcccgaccacctgctctttctcttcgcgctgctgctgccctcggtcctgcgccgtgacgtggacgggcggtgggtggccgtctcgggtttcggcacggcgttgtgggacgtggtgaaggtggtgtccgccttcacggtggcgcacgcgctgacgttggtcgccgccacgctgggctgggcatccctgccgccgcgcttcgtgtcgatcgccttcgcgctgggcatcctggtggcggcgctcgacaacgttcgcccgttggggtgggggactcgctggacggtggccttcgtgctggggctgctgcacggcttcggcttcgcgtcggtgctggcggggatggggctgtccgcgggaagcctcgcgctggcgctgctgggcttcaacctgggcgtggagctgggacaggtggccttcgtggccgcgttgctgcccctggctttcgtcttgcgcaaggcgccgctctaccgccgcgcggtcgtcgtgggcggctcggtggccatcgcgctgctggcgtgtctctggttggcggagcgcgccctgggcctgggcgtgtcggttacctga

SEQ ID NO: 4289 - DNA, 2418 bp, Myxococcus xanthus
atgctggggctggtcgtcgtgtacctcctcgcgggggccctggggctgcaggtggccatcgtgggcaacatcagcccggcctggcctccggcgggggtgtccctggcggcgctgctcgtgctgggggtgtcacgctggcccggcgtcttcgtgggcgcgtcggtcatttcggtcctgggggatgtgcccgttgtggcctcgctcggcgtgggcgtgggcagcacgctggcggccgtgctcggcgtgggccttctgcggtggttgggtttcgacaaggggctggagcggatccgcgatgtcgtcgcgctgtgcgcgggagcgggcgcgctgtgcctgggcgtgagcgcatgggcgggcgtggcgagcctcgtgctgggtgggcggcttccctcaacgtccctggccgcgggcctgcgggtgtggtgggtgggggacttgatgggggtgctcgtggtggcgccgccgttgatgctgttcaagcggtggtcctggccgcggcgaggcggcgaggcggtggtgctcgcggggctcaccaccgtgctgggcggcgccatcttcttcgtgccggacctgccgcacagcgcggcgcacgcggccgccttcctcctcttccccatgtccgcctgggccgcgcttcgcttcggtcctcggggcgcggcggcggccacgctgtgcatcgccgccgcttccatcgtgggcaccgcgcgggggcaggggcccttcgccacggatgacctgacgcaggacttgttggtgttgcagctcttcatcgccgccaacgccgtcactgggctgctgctgcggcggcgcagcactgagcgtcagcgcgccatcggccagctccaactgctgggcacctccgtgcgcagcgtgcacgaaggcgtcctcatcgcgcaggtccgcgcgggaggcgcgctgcgcaccgtgttcgcgaaccaggcgctgtgctcgctcctgggataccggctggaggaactggtgggccaggacccgtgctcgctctatggcgcgcaggagccggagttccgtcagcgcacgcggcagtcactgttcgcgggcgagccggtgttcgcggaggtgaagctggcgcacaagcagggcgacctcgtgtggagcgaggtgctgctgtccccggtgcgggccacgggcgaggacatcacccatttcgtggccacccaccgcgacatttccgcgaccaaggagctccaggcccgcctggtggcggccgaacgtgtggcggcggtggggacgctcgcggccggtgtggggcacgaaatcaacaacccgctggcctacctggtgctgaacctggaggccgccgagcgcggattgagccagggcggcatgtcgggcatgcgcgacgcgatggccaacatgcggggtgcgttggaaggcgccgagcgcatccgcctcatcgtccgggacctccaggtgttcagccgccaggggaaccaggacccggggctggtggacctcaacgcgctggtgccgcccgcggtgcgcatcatcagccacgcgctgcgccaccgcgcgcggttggtggaggagttcggtccggtgccgcgcgtgtcggggagcgaggcgcgcctgggacaggtgctgctcaacctgttggtgaatgcgatgcaggccatcccggagggcaacccatccatgaacgaggtgcgcgtgcgcaccagcacggatgcctccggccgggcccgcgtggacgtggtggacagcggcgcggggattcccgcgcacgtgctgccgcgcatcttcgaggccttctacaccaccaagtccagcggcgagggcacggggctggggctcgccatctgccagcagattgtccgcgcgcacgggggcgagctggaggtccgcagcgagccgggccggggctccgtcttcagtgtgctgttgccgcccgcgcgcgtgcaggcatccacgccgccgcggccgttgccccgcgccagtctgcctcagccctccgcggcccggcggggccgggtgctggtggtggatgatgagccgcgcctcgcgcagtccatgcggctgctgctggagccgttccacgacgtcgtcaccaccacgcggggcagcgaggcgctggcgctggtggacgcgggccaccgcttcgacgtcatcctgtgtgacttgcagatgccggagacggacggcgccgccgtctaccagcatctatgcgcccacgcgccggaccaggccgcgcgggtggtgttcatctccggcggtgcctatacgccggagtcccgcgcgttcatcgacaccgtgcccacccgcgtcttggagaagcccgttcggccggacctgctcatgaccacggtggccgcggccctgacggcagtggacgcgatggggccggagccgcgcgtggatgaggcgtcgcccgtggcggccgttggcggcgtgcggcactga

SEQ ID NO: 4290 - DNA, 657 bp, Myxococcus xanthus
atgaccgctcaagaacgcatcgagcgtgccgccagcgcgctgaaggtcttccccctcccgtcggcggtgctgttcccgcacaccgtcattccgctgcacatcttcgagccgcgctaccgggccctcgtccgggacgcactcgcgggcgaccgcgtcctggcgctgtcccagctcgagcccggttgggaaggcaactatgggggccggccgcccatgctgcccatgatgtgcgcgggcgtcatcgtctgggacgaacaggtggaggaggggcgctacaacatcctcctccagggcgtgagccgcatccgcatgacgtccgagctgacgacggaaaaggcctaccgggaggtgctcgcggaggtgctgccggacgtgccctacgagggccccgaggaggagcagttgcggcaggccgtcttcgagctggccggccgcgtcccgccgtccttcgcggagaacctgctgccggtggccgcgcgggcccagggcggcatgctcgcggacgtggtggcctccgccgtcatcccggagccggagcggcggcaggaactgctggcggagctggacgtgcgcaagcgcctggaaggcgtgctggaggacgtgggggcgctcatcggcaggctccagcccctgcggcccaccggccccttgaactga

SEQ ID NO: 4291 - DNA, 1893 bp, Myxococcus xanthus
atgcggctcgtgaagctcgggcttgccagtgtgaacaccaccgtggggtccttcacccggaacacggacaaggcgctggcgttggcggggaagatggcggcggagggcgtcacgctgggcgtcttccaggagcagctcatcgcgggctacccggccgaggacatggtgcagtggcagggcttcatggaccgccagtggccggagctggagcggttcgcgcgtgagacggcgcccttgcccaccgtcttcgtggtgggcgtgggcgtggcccatcagggcctgcgcctcaactgcgcggcggtggtggccggtggccgcatcctgggcctggtccccaaggagaagctgcccacctacagcgtcttctacgaggcgcgcaccttcggccgcggtcagccgggcatggcggaggtccaccggggcgtgccgctgggggactacctgttccacttcgacttcggcgtggtggccccggaggtgtgcgaggacatctggagcgcggacggccccatgcggcggcgcacgtactccggcgcggagctggtggtgaacctgtccgcgtcgcccttccggctgggcttcgtggagacgcggcgcgagctcatcgccacccgcgcggcggaccaccagtgcaccattgcctacagcaacgcggtgggcagcaacgacggcctcatcttcgacggcggcggcttcctcaaccagaacggccgccacgtcatggagacgccgcgcttccaggaaggctacacggcggcggtggtggacctggaccgcaccctgcgcctgcgcgccgaggccaccacctggcgcgtggaccgcgagtcatggctggcgcaaggcggccaggcggtgccggtgctggactgcacacaggtggtgcatacgaagcgcgacgcgctgacgttcccggtgcctccccaccgcagcttcttcctgccgtctccggacacgcgccgcaccgcgcgggatgcgctgtgcgaggacatcctcgacgcgctctccctgggcgtgggcgactacttcgagaagacgcgcgccttcaaggtgctgggcatcgcgctgtcggggggacgggactcgctgctgacgctgctcatcgcgcaccgctacgcgaagcgcgcgcggccggagaaccccggttcgctcatccaggcgttctacatgcccagccgttactccagcgacgccacgcgcgacgcggcggagacgattgcgcgcgagctgggcgtggccttccaggtggtgtccatcgacgaggccttcgagcgcgagcgcgccgtcgcgaagacgatgctgggtggcaaggacgtcacgccgattaccgagcagaacatccaggcccgcctgcgcgcccagcgcatgtggaactggagcaactcctgcggcggactcttcctgcagacgggcaacatgagcgagaagtccgtgggctacaccaccatcgggggtgacctcatgggcgcgctggccgtcatcgccaacgtcccgaagacggtggtgatgtacctgcttgactacctccaggacaccacgggctacgagggcatccgcaaggtgctcgccaagcccgcggggccggagctggcgcatgaccaggtgggcgaagaggagttgatgcccttccccatcctcgacgcctgcttctacctgtacggcagtgagaagctgacgcccgccgaaatcctccaggcgctcaccgccatgttcccggaggtgccgtcatcccgcctgagcggctacgtggagaagttcgtccgcctcttccagcagtctatctacaagtgggtgcagtcaccgctgtcgctccacatcggcaacctggacctggaccgggagcgcgcgttgcaactgcccgtcgtcaccggcacggagtggatgcggcaggggtag

SEQ ID NO: 4292 - DNA, 931 bp, Myxococcus xanthus
atgaaagcgaagattctggcgggcgccgttgcggcgctcatgtacggaggcgttgctgttgccgatgacggcgactgcccgccaccgcaggccagcaccagccagagccagcagggcacgatggtggcccaggcacagcaggaagacccgggcggtgatgacctgctgcaggaggacgacaccatcatcctggagacggagcccgttcccggcgtctccggtcagcagtcgcaggacagcatgggcatgggcggcagtggccaggagggcatggacgacgcggccctcggcggcagcggccagcagccctcgaacgcgcagggcgaggtctacatgaacgtgcccgtccgctgcgagccggtgggccagcagggcatgggcggaagcggccgggagtccatgacgccgcctcccgccgcgccccagggcacgcatgacagcgagcagctcgtggtgccgccggcgccgccgttgggcacgggcggcagcgggcagccttcctcggagcctgtctacccggagccggagtccgcgtacccgcccccgaagggcggcacgggcggtagcggcatcgccacgacgccgcctccctccaacttccagccgtcggccgagcgcgccgagccgatgaaggtggagaagcacgaggacaagaacaaaatcaaaggcctctcggtgatgctgggcggtggtgtggagggctacaccggcgcgctggctccgcagctcagccccggtgccaccgcgggcgttcgcgcgtccatcaagccgtccaaggtgctgggcctcgagctgggctacacgggcgcgctgaacaacatccgccgcggggagacgggcgcgagcgggccggacctcgtgcgtaacggtggtcaggccgtcctgacgctgggcatcacccccacggcgtggcagccgtacctgctggggg

SEQ ID NO: 4293 - DNA, 1074 bp, Myxococcus xanthus
atgcccctggcccttgccgcgctcgccgtgctgtccgcgtgcaccgaggcccgcggggccgcgcccgccgcgccaggccccaccatccaggacacccgccgctacgagaagccctcggacgccgacttgcggcgcaccttgtccccgctggcctacgaggtgacgcagaagggagccacggagcccgccttccgcaatcccctgtggaaccaccacgaagagggcctctacgtcgacgtggtgagcggcgagcccctcttctcctcgcgcgacaagttcgactccggcaccggctggcccagcttcactcgcccggtggacagcgctcgcatcgtcgagaagcgggacagcacgcagggcatggagcgcgtggaggtgcgctcgaaggccgcgggctcacacctgggccacctcttcggggacgggcccgcgcccgcgaagacgcgctactgcatcaactccgcggccctgcgcttcgtcgcggtgaatgacctggcgaaggagggttatggggcctggcttccactcttcggccgccccgctccggccgccgccacgaagcgccaggacacctcgcccttcacggagacggcgctgctggcgggcgggtgcttctggggaatggaggacctgctgcgcaagattcccggcgtcgtccagacggaggtgggctacacgggcggctccagcgccttccgcaatcccacgtatcacgacgtgagctcggacaagacggggcacgccgaagccgtgcgcgtcgtgttcgaccccacccggctgacgtacgagacgctgctggagcagtggttcttccgcatgcacgacccgacgacgctcaaccgtcagggcaatgacgtgggcacgcagtatcgctccgccatcttctacctgtccgacgcccagaagcgcgtcgccgaggaagtgaaggcgcgggtggatgcctccaggaagtggccccggcccgtcgtcacgcagattgtgtccgcgggcgcattcacccccgccgaggactaccaccaggactacctggtgaagaacccgggcggctacacctgccactacatgcgggactga

SEQ ID NO: 4294 - DNA, 891 bp, Myxococcus xanthus
atggcgaggaagcgcattggcgagctcctgttggagcagcgggcgatcagcgtcgcccagctcgaggcggggctcgcagctcaccggaaatcaggacaacggctgggggccaccctcatcgcgcagggtgccatcacggaggccacgctcgcggacgcgctgagccaggccctggggctgccgcgagtggacctcgcggccaccacgccggagtgggccgcggtgcacatgctgcgcgcgcgcttctgcgaacagcacgacttgttccccgtcgcactggaaagcacgggcgggcgcaaacagctcgtggtggcgatgagtgatccgctcaacgtgacggcggtggaggagattgagttcaccaccggcctcaaggtcagcccgcgcgtggcgccgctgtccaccgtgcgtggcgccatcctccgctactaccacaaggtgccggtggcctcgccctccgccagccgccccgcgcccgcgaggcccgccgcgaagccggtgaaggccgcgccgccggtgacacgccccacggcgccgccgtccgaagaggatgacgacgaggaggtcatcatcggcgaggagctgccgcccggcgaggcgacgcagcgcacgtccctggcggagctgattcgcgcccgcgaggagcagagcaagcagaagcgcggacagggcggcgccgcgaagcccaaggcccccgtggcgaacgcgggcggcgtgctggacgacctggactacctcttcggacaagcgcgagaagacccggatcgcgtcgaggagctggagcggaagttctgggcgctgatgcgcatcatggcgcgcaagggcctgctcacgaacgaggagttcacccgcgagctggacgacgaggacaaggccagcggcgagtcgtga

SEQ ID NO: 4295 - DNA, 222 bp, Myxococcus xanthus
atgtcgcgtcccgcaatcgcagccctgctgtcttttctcatccctggcgtgggacagatctacaacggggacctgcttcggggcctgttctggctcatcatcaccccaggcttctggattggcacgggtgggtgcctgggctgggtgtgccacatcgtcgccgctgtcaccgcccacaaccgggcggaggacaaggacaagtacagagtcacagtcgtctga

SEQ ID NO: 4296 - DNA, 1230 bp, Myxococcus xanthus
ctgacgctggaacaggcggtgcagcttgccgcgaagcgtaacgaggtggcgctggccgccgagcagcagtccgaggccgcccgggcccggctggctcgggcccgggccttcttctttccagagctgacgggaacgggcacctacacccggcgtctgaatgaagtgacgcgcgaagtgggtggccagacagtggtcatccagcgcaacaacgccttcaacgccaacttcgtcgcctccctgccgctgttcgacgcgcgcggcatcttcctgtaccgcgcggcgcggagggacggcgatgcggcggagctggaggccgtggaggcgcgccggcagattggcttcgaggccgccaacgccttcctcgccaccctggcccaggagcaggtgtaccgcgccgccgagcagcgcctcgcgttcgcccgccagtcacttcaggacgcatcggcccgcgccaaggcgggtctggccagcagcaacgatgtgacgcgcgcggagctggaggcggccagcgccgaggtgcagatgtccaacgcgcgcaacgccgcgcagaccacgcgcctggagctgggcttcctgctggtgtcttcggtgaagggcaccctggcctcgccggacgtgctgctgtcggacgccagccggccgctgcaggcccacgcctccctggcggatggggccctggaccgccggccggacatcctggccgcgcggctgcgggtggatgcgctggaggagagcgccaaggagccgctcgcccggctgctccccacgctgggcgcgtccgccacctaccgcctcacgaacgaggccggactcgcgggccgcacgggtgacggcttcctgggcgtcaacctcatctggaacttcttcgacggcggcgagcgctatgccgagcgccgtgagcgcgtggccctggcgcgggcggcggagctccaggtccaggccaccacgcgccgggtggacgtggacatcgagcaagcgagggtggcgctggagaatgcccaggccgccctggcacagagcgacctggcggtccgcacggcccggcagaacgcggaggagcaggggattctctaccgtcagggcctgtccacggcgctgacggtggcggacgcctcgctgcggcagttcgaggcggaggtggcgtatgcccagagccggttcgcgctgggcgtggcgctgctggggctgcgggcggcagtcggactcgacccattggggaaggaaccgtga

SEQ ID NO: 4297 - DNA, 963 bp, Myxococcus xanthus
gtggacgtcctcttcgcgggcctgtcccgccgcgcccggctcttctcccagggctggggtgatgagcagttcctcgaagaggtcgcggcggccgcgccgttccagcaacggcctccgcccatcgcgcccgagtggagcgcgccccggctccaacgcggtctccaggtccgggatggcacctttccgtctccgctggcccggctcgacgcggcagcgcgcacggcccatgtccggtggctgagcgcggggcaagggccctcacgcggcgcctgcgtcgtgctcgctgcgtcccgtgaggagggcttctccctgcgagagcgcatgtacgcgccgctcgcgcgggaaggcatcgacctgttcctgctggagaacccctattacggcctgcgccgtcccgtggggcagaagggcggcgcgctgcgcaccgtcagcgaccacgtcttgatgaacctgggcatggtcgacgaggcccgcgcgctgctcgcgtggctgcggagtgagggccatgcgcgcctgggcgtggcgggctacagcatgggcggctacatggcggcgctgacggcggccgtcgtcccggagccgctcgccgtggcggcgctcgcggctggagcgtctcccgtccccgtcttcacgcaggggctgctgtcctggtccattgcctttgcattgctggatggcccccggcgcgacgcggagcaggcccggagtcggctgggacggattttcgacctggcgaacctcgcgcgcttcccgcctccgaggcagcccgaagcggccgtcctggtggcctgccgacgtgacgggttcgtgcccggtgatgaaacgctcgcgctgcacgcgcactggccccgaagcgagctgcgctgggtggacgccgggcacgtcaccgcgctcttcacggagcgggccgcgctgtgcgccgccatccgggacgcgctatcgcgggtggaggccaccacgtga

SEQ ID NO: 4298 - DNA, 423 bp, Myxococcus xanthus
atttcgatgccgtggtgggtctatgcactgctctccgcgggcttcgcggcgctgacggcggtgctggcgaagatgggcgtggaaggcattccttccacgctcgccaccgccatccgcactgtcgtgattctggtgttcgcctggagcatctccctggcgcgcggggagcatcacgccctgcctgccatcagccgcaagacgctcctcttcctggtgctctccggcgtggcgacgggcctttcgtggctggcctacttccgcgcgctccagctcgggcccgcctcccgcgtggcgcccctggacaagctcagcttgccgctcaccctcgtggtggagttcctcatcctccacgaacccctcacctggcgcatgggtgtgggcgtaacgctcatggccgtgggtgcattgctgacgttgaaatga

SEQ ID NO: 4299 - DNA, 696 bp, Myxococcus xanthus
atggatgcgttcaaggttctggtggtcgacgatgagcagcccatcgcacgcgcgctgcagcgtctgttgaagcgagagggattcgaggtccagattgccttcaatggcaacgaggcgctggagcggctggaagggttcagcccggacatcgtcctgacggatttccggatgccaggaatgacgggcagcgagctgctccagcgcctcaaacgcagccatccgctggccctgcgcctcatcatttccggctatgcggacttcaagtccgtggtggcatccgtgaacgagggcgaaatctgccggttcatcagcaagccctgggacgacgcggagctggtgacgtacctcaagggcctgctgcggcaccgcgagacgatggcgtgcctctacgcccccttccggcaagcgccggacggcgtgaacgcggaggtgggcatgtcggccgcgtccatggtgctcaaggtccaggtggctgacccgtccttcccggcggaccaggccgttgcgctcatcgagcgcttcgcgggcctgctggccgacgaccgcctcaaggtggtgggcggattgctcgagcgctacggcgggcgcctgtccttcatggcggacgtcggtggcccccagcggctccggctggaggtgccgatgcccaccctggaaaccgtcaacgccctccgccctggcgcgagcgacgcctga

SEQ ID NO: 4300 - DNA, 495 bp, Myxococcus xanthus
ttggttcgaatcgcccggcgattgtgctcgggtggagccatcgacccggaggacctggtgcaggagacgctggagcgcgcctaccgccacttcgacaagctgatggcggagaacgcgggggcggtgagcgtctggttgagcaccacgatgagcaaccgcttcctggaccactgccggcggcggcgcaccgaggtcatgggtgcgcccatgctgcgcctggtgcaggacctggacgccgaaggcgaaacggcgccccaggagcggtgggagcgcgtgtctcgcgacgagttccagcgggccatcgaccagttgcgcccgccgcacctgcgggacgcctaccggctgcacgtcgcggggttgcggtatcgggccattgcccagcaactccgctcgacggaagggacggtgggccggtggctcacggaagcgcggcaggcgctgcgcgagctgctgggcggcaaggacgcctcgcacgaaggcatggctgaatcatga

SEQ ID NO: 4301 - DNA, 2712 bp, Myxococcus xanthus
atggtggtgccgctcgcgctcgccgcgggcctggccgcgctcgtgctggtcccccggacgcagcccaccgactccgcccccgagctctggctggcggaagcggccacccggcccctggaagtccgcctcacccatcccggcgcggacggacaccggccctaccaggtgatgcgcagcggcgcgggcgcccggccccaggcactggcgctgcgcgagctggcccggctggaggaagcggcggaccaccggggcatcgcctcggccttcctgctgcgcggtgacatggcccaggcctccgcgttcctcgacaagctgcccgcctccgccgacctggacacggaccgcgcggccctggcgctccaacaggatgaaccggagaaggcgctcgtcctgctggagcgcgcgctgaagcggaagcctcgccatgcccaggcgctctggaaccaggcgctggcgctccagcggctcggcctgtcactgcgcgccgcggagtccttcgaacaggtggcgcggctcggagagcgcggttggagcgacgaagccgcccagcgcgcccaggcgctgcgaaacgcggcggagcaggagcggcaggactggaagggcatgcgtcaggactgccaacgcatggtggacgggggggcgccgctctccaccgcgcaggcggaggccctgccgggcatggcgcgcgtgtgcctctacaacgccctgcgtgcggcggcctcgcccgagcgcgtggagtccctgcatcccctggcggtggtgctggaccgcaaggaggacggcacgcacctggaagatgccctgcgccgcaccgcgcggcgggatttctccgcgcgcgtgcccctggccagtgagtacgcgcgcctcacccggggcgagctgaagggccccgccctggagtccttcctgtcgcggctgcgcgaggcccggcaggaggacctgctgctgggcgcgctcgcctatgcggacccgcgccagttcccagacgagtaccgggcgctcgcgttggacacgaaggacccgtggttcgcgctgctggccgaggagcggcaggcccggacggacgcactggcggatgccccgcagcgcgcgcgggagcggctccaggccgcggtgaagacgtgcacggcctccgggaagcaactgtaccggtgcatgttgatgcagcgggagctgggactggtgatggcgcggctgcatcgccccgtcgatgcacgcgcccgcttcgtgggcgcactgcgcgccgcgcgcgacagccgggagtggggttctcagcggaacctgctccaggacctgggacaggtggcccggacgcagggagacctggtgctggcccgggcctatgtggaggagctgctgctccagacgcccgagggctgcgcggactccgaggtggcgctcaccagcctggcgctcgcgcaccaccgcgcgctggatgtcgcgggcgcccgggagctgctcgaccgggccatccagtgcagtcagaagccctccatggcgcggctggccctgctggccgacctggcccgcacgcccttccgcaagccggaggacgcgcggttgctggagcagggcctgggggcgctgcgcgattcgggcgcgcaggacgcgggggacctcgcgctgctgcgccacatcgagggccgcttctacctggagcaggacgcgcacaaggggcaggcgctgttgcggcaggcgctggccgacgcctccaggttgccagcggcgaacgtgagcgcgcgcaaggcccgcgtctacagctacacgtcactcatcctcgacgcgggccgaacgggcgagctggcgcaggggctggccctcttcgccgaggagcacgccatgcccgcgccggagcgctgcgtgctgggcgtcacggtggacgacgagcggaccttcgtcgtggcccgggacgcggagggacgcctcctgggccaccacgacacgggaaggacggcgccgttggagggcgtcgaaggcctggtgcccggcgcggtgatgaaggcccttcgcgcctgccccagcgtggacatcctcgcgcggccgccagtgcaggggcgcgcggggctgctgccgtccgacatcgcctggtcctaccgggtgggcggcctgcccgatacgccgccgtcccaagcgaaggcccagcggctcatcgtgacagacgtgctggcgcccgcgtcgctgcacctgcccacgctgcgcgcgtggaacccggccagcgacgcgggcgaaggactcaccctgctccgcggcgccgaggccacgccgccgcgcgtcctcgccgccatgcgggatgccaccgaggtgcaggtccacgcgcacggcatcatcgacccgtccgtggcggatgcctccgtcctcgtgctttcaccggaggccacgggtggccgcttcgcgctcaccacgggcgacctgaagggacagcggctgcgaggccggccggtggtgctgctcgcggcctgctacgcgggccataccagcgcgtacctgcatgagaacttcggactgccgctggccttcatcgaatccggagcgcgggccgtcctcgccgccacgcaggagattcccgacgacgaagcgcacgccttcttcgagcccgtcctcgcccggattcgcgatggcgtccccgcggccgtggccctgcgtgacgaacgtcaggcatggttgcgacgcaacgccagcgcctgggtccagcaggtactcctcttcgagtaa

SEQ ID NO: 4302 - DNA, 537 bp, Myxococcus xanthus
atgaagaagtacctcctccccctcgcgtgtctgttcctggcctcggcctgccggcacttgggcaacacgccggactggcccccctcggaggacattcccccgggcacctatgtcctcatcaccctgcaagacgcccacagtccccaacggcgttccacctacgtggtggacccgcgcacgggcaccgtggtggagcgacgggatggcaagcgtgcatacgcggtcgcggacccccagtcgctcgacaccgagtccacgggcgaggccgcgcaggccgccctcgcgcccaccagccgcgtcaccgtcgccatgtccgtcaattgccgtgacaccctgacgttgccggatggctgcgtggacctggccatcgaccccaagcatgagacgtccggggacccgaaccccatcaaggatgagaagcagcgcatcgccatcacggagcgctacgtgaagcaactggccgtgaacgtcctgcagacggcgcgccgcactggtgtccaggtgcatgtgcccgcgctcaagcgcccggcgaagtaa

SEQ ID NO: 4303 - DNA, 2016 bp, Myxococcus xanthus
atggcccattcgacgcgctacgcccatcccttcctgcccaccacccgcgccgacatgcaggcgcgcggctgggagcagtgcgacatcatcatcgtgacgggggacgcgtacgtggaccacccggccttcgggccggtgctcatcgcgcgcttcctggaggggcgcggcttcaaggtgggcctcctcccccagccggactggcactcggccgagcccttcaaggcgctggggccgccgcgcctgttcttcggcgtggccgcgggcaacctggactcgatgctcaaccggctgacggcccagaagaagaaccgctcggaagaccagtacagccccggcgggcagacgaactgccggccggaccgggccaccatcgtctacgcgcagcgctgccgtgaggcctaccccgacgtccccatcatcctgggtggcatcgaggccagcctccgccgcatcgcccacttcgactactggagcgagaaggtgcgccgctccatcctcttcgacgccaaggcggacctgctcgtcttcggcatgggcgagcgccccatcatggaagtggcggaccgcatgcgccagggtgagcgcatccaggacatccgcgacgtgcgcggcaccgcgtacaccatcaacgacgaggagatgcgcgccctggaggcggacccggccagacgcgccgcggaccgcaagacggtggtgctgccgtcctacgagcaggtcatcgaggacaagcacgccttcgcggtgatgagccgcgacttccagatggagaccaacccgggcaacgcgcgtccgctggcgcagcgccacggcaaccgcgccatctacatgaactcgcccgcgctcccgctggaggacggcgtgggcaccgcgggcgccgaaggcaagtccgtggccatggacgagctttatgacctgcccttcaaccgcgtgccgcacccgatgtaccgggagcgcatccccgcctacgagacggtgaagcactccatcgtcctcatgcgcgggtgcttcggcggctgcaccttctgctccatcaccgagcacgagggccgcgtcatccagagccgctccgcggagagcgtgctgcgcgaggtccgcgccctgcgccgcatgggcgacttccggggcaccatcaccgacctgggtggccccaccgccaacatgtacaagctcaagtgcaagagcgaggacatcgagaagcggtgccgcaagctgtcctgcgtccacccgggcgtgtgtgagaacctccagacggaccacggccccctcatcagcctcatgcaggacgtgcgcaaggaggacggcgtcaagcacgtcttcatcgccagcggcgtgcggtacgacctggcggagcgctcgccggagtacgtgaaggagctggccgcgcaccacgtgggtgggcagttgtccgtggcgccggagcacgtctccccgcgcgtgctggagaagatgaagaagcccggcatcgagagcttcgagcgcttccagcagatgttcgcgtgcgccagcgaagaggccggcaaggagcagtacgacatcccctacttcatcagcggccacccgggctccacgctggaggacatggtggagctggcgctgtggctgaagcagaacggcaagcggccccggcaggtgcaggacttcatccccacccccatggccatggccaccgccatgtacttcacgggcctggacccgctgaagatggagcccgtctacacggcccagggcctgcgcgagaagcggctccagaaggcgctgctgctctactggaacccggagcagtggccactggcgcgcgaggcgctgaagctggccggccgcgaggacctcatcggtcgcgggccccacgcgctcgtcccgccggagtcccccggggaggccgcgcgccggcagcgtaccgagcgcgacaccggcgctggtgcttccgcgccgcgtcacgaggccgcgccccggctcggaccgcatggaaccgcacgtccccgggcgcgccgtcccggtgggcctcgcgcccgctga

SEQ ID NO: 4304 - DNA, 621 bp, Myxococcus xanthus
atgctcagcctcctttccgcgttgtggctcgccacggctcccgtgacgacctcggaacagcccgtggtccgccccccgcctccgcagtgtgtgttctcccagggacgctcggtgtgcggctaccagtgcaagacgaccggaacacaaacagcctgtgcccggacgccctacggcatctgtgaggtcctggtgggaggcgtgcactgttgggacccgcccctggtcgccatccagcacccgcccaccacgagcgcgaagccagagtgcaaggagagccggggccaggtggcctgcggctacaactgccgtcagttcaacggcgaggtggcctgcaaccggacgccctacggcgtctgctccacgaacttcaacaagctgacctgttgggacccgccggacgccgtcatccaccagtacggcgcggagacgcccgcgccccgctgcctcaacgcctccgaggacatggcctgcggctatgactgcaaggccacgcgcaccgaggtgcagtgcgccaacacgccggacggcgtgtgccggctcgacaaccagcgcttcacctgcttcgacccgccgtcgttgctgcactgcgaccacagcgcgcccccgccgccccggcactga

SEQ ID NO: 4305 - DNA, 516 bp, Myxococcus xanthus
atggccaggacgacccaggagcagacccaggagcgccacgcgtttctgctcgagctcttccgccagcagccggacatcagcagcaaggaggcgctggagtccttcaaggataagtttggcggcaccatcaacatgaagacgttcaaccagctccgcgagcaggccgaggacgaagccgcgtcggccgcagccgccgcgcccgcccccgccccggaagtggagcccgagcccgagcccgagcccgagcccgaggagaccgaggcgacggtggacgacgccgcctcccgcctgaaggccgccgcggcccccgaggccatcaacggcgcggccggcgcccccgccaagaaggccaaggcgaagggcaacggcccgaagaacatcttcgtggacgcgcccaaggagcacctcaccttcctggagggcatcatccagcagttccaggaggccggcgccgccaacatccgcatcgaccacgccacggaccggtggatggtcgtcgtggtggactcgaagtag

SEQ ID NO: 4306 - DNA, 1023 bp, Myxococcus xanthus
atggcgcgcgtgatgcgcacgctcctcatcgcctccgtcctgctggtcgccaccgcctgctcgcgcgccagcaccacgcgtcctgattccgccgtggagcagcctggcgtccaggcgccgcttcccaacgagtggtcctctcctctgcaccgagagcatccgctcacgggccgcatctgggacgtgaaggcggcccgcttcgtggacgcggacaccatgcgccgctcgctcgcccaggcccgcttcgtggtgctgggagagcggcatgaccagcccgaccaccaccagctccaggcgtggctcgtccaggccctgaccgagggaggccggaagcccgcgctcgccttcgagatgctcgacgtggggcaacaggcggcggtggacgcgtcactggcccaggccccgcgggacgcggaggcgctcgcgctcgcggtcaactgggcgggcagtggctggccagactgggccctgtatcggccagtgttcgcggccgggctcgaggcggggcttcccatcgtcgccgccaacctgccgcgctcgcaggtgcgcgacctggtgatgcgaggtccggaggcccttgctcccgagctgcgccagcgactgtccttggacacgccgctgcctgagccggtggagcaggcgatgcgcctggagcaggacgaggtgcactgcggtcatctacccaaggagatgctcggccccatggtgcaggcccagcgtgcacgggacgcgcacctggcggaccggctgtcgaacgcggacaccggccagggtggcgtgctcatcaccggcaacggccatgcacggacggaccggggcgttcccgcgcagctcgcggcgcgtgtgcccggcaaggacgtgcgctccgtggggctgctggaagtcgccccggcgctgcgcgcgcctgcggactacgcggcctctttcggcacgcaatcccttcccttcgactacgtctggttcacgccggcgatgcccatggaggacccgtgcgcggcgctcctcaagcgccccaagaagtag

SEQ ID NO: 4307 - DNA, 1056 bp, Myxococcus xanthus
gttgaggtggctccggtggagtcgcgatacgtgaagtacgtggtgtacacggtggcctccgtgaagcccttcgaaagggtgcagatcaccgcccgcgtgccgggcgccgtgtagtgggtgctcttcaagtaagggcagtcgctataaaggggcgcggtgctcgcggagatcgagtccgcccgcagcgccatcaccgtccggtccgcgaagaccgcgctggcgcgagcccgccccacgctggtgaaggcggaggccggtgagcagcgccgcaccctggtgaaccaggccagccccggtctgctgcccgccgagcagttgcagaccttcgaggcgcgcgcgcgcacgctggagccggacgtggcgccggcgaaggcgctgctggaccaggcgcagctcaaccagcgtgacgcctatgtgcgcgcgcccatggacggcgtgctccagacgcgcacggtgcagacgggccagtacgtgcagcccggcatcgtgttggccacgctgctgcggcgcgagccgttgctgctgcgcttcacggttccggcggcggacgtgtcccgcatccagcccggcatgacggcgcgcttctccgttcgggccgcggagggtggctctttcacggcgaaaatcacacacgtggccgccgccgcggatgatgccagccgcatggtgccggtgacggcggaagtcaccggtgaggacgccgagcggctccgtccgggcgccttcgccacggtggcggtgcccgtggatacgcgcggcggcagtccggtgattccgcagacggcggtgcgcgccagcgaacgcggcttcctggcctacgtggtggagggcaacaaggcgcgtgagcgcgtgctggagctgggcctgcgcaccgcggatggccgcgtggaggtccgtgacggcgtgaagcccggtgagctgctggtggtgcgcggcggtgaggccctgcgcgacggggccaacgtgcgcgtggcggagggacccaaacccaccttcacgggtgagccccggctggagccggaggccgccagcggcggcggaggcgcccggcaatga

SEQ ID NO: 4308 - DNA, 837 bp, Myxococcus xanthus
ggtgcggacctcacgcccggcgcgcaggcgcgaagcacaccgccggagccggacctcacgggtgaatccctggcgggcttccagctgaactcccgcctgggcaccgacgccacgggctcactgtacgcagcggaaggccatgtgggtccatgcgtggtgaaggtgatgtcttcctcggtgacagcggatgcggaggcgcgagcacgcttccaccgggaagcggagacactgcgaagcctccgccacccaggtattgtccgcgtcctcgcggtgggcgaggagcgcggccactgctggtacgccctggagcccgtgattgcgcccgccctggaggcgagactggaccgggcgaacgcactgcccttccaagaggtggagcaactggcgctgcggctgctcgatgcgctcggcgccgcgcacgacacagggcttgtccacggggacgtgcggccccagaacatcctgctcgcgaaggacggcgcgatgctgacgaacttcggcctgtcgctcgtgcctcccggtgcccatggctaccaggcccccgagcaacgacaatggggccgcgccgtcccgcagtcggacctgcatgcgctggggcgcgtcctgcacgaggcgctcacgggaggcatgccggagacgcagccactcccccagggcgtgccccggcacctgcgccggttgctgaaaagcctgctctcggaagccatccaggaccgccccgacagcgccatctccgcgcggcgactgctgacccagcgtgcgccgctgggccctttggccgtgggcatcgcagcgctgctggcgatgctgatgttcctgctgctgcgtgcggcgtga

SEQ ID NO: 4309 - DNA, 1036 bp, Myxococcus xanthus
gaagccgccccccggtgaattgctccaggatgccacccgcgcctacgtgcgcggatatcgcacggcgtccctctgcgccggcatcacccagggaggcgtgcatcacgtcgaagcgctgcggagcaaaggcgcgccgcccgctgaaagcgccctcttcgcgctgggcgagctgaccccggtcttcacgggggccctcctcgcgttgctcgtggaccagggcaaggcacggctcgacatgcccctgtccgaggtgattccccggtcgctgctcgcggatgccacggcgggccgcatcaccctggagcaactggcgacacacacctcgggaatgccccacctgcctcccaacctggagcaggacacccagacgatggaggaccctttcggccattacgacgcgagacacttcggagaattcctccagacctatcagccggaatggccgccgccgcgccgctatgcgccctccatcctgggcatgggcgtgctgggccacgccctctcccggcgcgcggggctcaactacggacacgcgttgagggacctgctcttcaagcccctgggcatggccgacaccacgctgcgcgtgtccgaggaacaggagccgcgcctgacgcccggccacacggcgcgaggcaaacccatcccccaatggacgttccccgccctgccgggagctggcgccgcctactccaccgctcccgacctgctccgcttcctcgatgcgaacctcggacggggcgacgcgggcatcgtgcgtgccctgcaactgacccatgtgccgcgcgcggaggcgaaccccgggaagatggggctcgggtggagcgtgacgcaggtgcgcggtcagccagtggtgtggcgctcctccgtcatccggggctacaccagcttcatgggcttcgccgccggagcggacgcgggcgtggtgctgctggcgaaccatggctggtccttcttctccgcgctccgtgggcgcatccccctgcaagccccagggctcgagctgctttcccgcctcctcccgacggaggcatag

SEQ ID NO: 4310 - DNA, 663 bp, Myxococcus xanthus
atggccatcatggggggtcgttccatgacgttgctgaacgaattgcgccagcgcattgactcacgctttccgctcaccgcctatgcggacccagcgccacgcgcattccaacccgccgccctgctggcgttcgccacccgggtgacggatgcctatgcggccgacgcccggcaccttgatgagggatgcagcggctcctggcgagccctgctggcccacgccttcgacgtctacgaagccgtccggccctgcctgtccatccgctattcgacgcgcaccgtctactcaggcccggaggacatcgccgcggacctggagcggggacagctcgaaatcaacaccgagcactgcgagcatcccttgtggacgccggaggagaactgcgtcttccgcatcgtccatgacgtgattccccatgccatgtacgcgcggcccttctcgctggagggagaagtgctcgccttccatgaccacatccgccgggcccccgcagaggcgaagctggcgctgttcacggaaatcttcggctatgccgccatccgttactccaccggcgtgtatcccgaaacgcagaagtgcattgtcttcccggagctgctcgcggactacgaagcgggcttcctctcgcccgcgagcagtccccccacgcagcccggggcgtaa

SEQ ID NO: 4311 - DNA, 628 bp, Myxococcus xanthus
gcgaatacccaaacgcagacccgctatcccatcgtgctggcgcacggcatggcgggcttcgactcgctgtttggcgtctacgactacttctacggcatcggctccgacctgcgctcgggcggggcgacggtgtacgtgacgagcgttccgcagttcaacaccacggagcagcgtggcgaggcgctgctggcgcaggtgaaggacatcgtcgcgcgctcgggcaagggcaaggtgaacctcattggccacagccacggcggcctggacgtgcgctatgtggcggcggtgcgcccggacctggtggcgtccgtgacgacggtgggctctccgcacaagggcgcggacctggcggactacctgcgcgccaacctccggggcggctccttcacggagagcgtgctggcctacttcgccaacaacctgggcaccgtcctggggctgctgtcggggaagacgaacccgcaggacgccattggcgcgctggcggcgctcagcaagtctggcacggcggcgttcaaccagaagtacccggcgggcatcccctccagcagttgtggccagggcgccgcgacgggcacgcagggccagcgctactactcctggtccggcacggacccccttagagcac

SEQ ID NO: 4312 - DNA, 732 bp, Myxococcus xanthus
gaggacccggacgcacccgggggcatgcgaggcttcgaggtggaactggcggaggccctggcgcgtgagctgggggttcgggcccggttcgtccagaacgactggtccagcctggtcccctcgttggagcgcggctcgttcgacgtggcgctcaacggcctcgaagtcacgccgtcgcgctccgggcgcatcctcttcacgcggccctactacgtcttccacctgcgcttgctggcgcggcgggacgatgcggccatcaccgggctggatgcgctgaagggccagcgggtggggacgctggccaattccctggcgtgggacctgctccagcgcagcggcgtggaggcggttccttacgaaggcgtggaggagccctacatcgacctggagcaggggcgggtgcgcgccgtgttgatggacgacatcatcgcgcaacgctacgggcagccacgtccagggctccgggtggtgggcgacgtgggggaaggctactacgccatcgccgtgcggcccggtgaggaggacctgcgggaggcgctggacacggcgctggggaacatcgctcgctcgggcgagctgcgcgccatcttccagcgctggggcatcgacaacgccgagcagcagcgcatggtcgactggacggacgcgcagtcccgcgaggtgctggcgcccacgcagacggcgcgcatgggctggggacagctggtgctgttcctccaggccgcgggcgtg

SEQ ID NO: 4313 - DNA, 2466 bp, Myxococcus xanthus
atgctggaggacaccaagggcggcaagctgcgcgccagcatcgaggagcgggagcgggagctcatcctccagcgggtgcgaggcggccccgcccatgagctggccaagctccaggcggagctgcgcggattgcgcggcaaggtgaaggaccccacgctcaaggaagtggagaagggggactgcccgctggtggtggtcaccgtgcaccgcgcgttgcggctggtgtcggagctggagggaaagcggcacttcgcgcggctggtggtggacgaggccggcatggtgacccgcgcggccaccgcgttgatggggccgctggcggagcgggtgacgctggccggtgacccgaagcagattggcccggtgagccgcgccgcggagggcgcgggcaagggcacgcagaagtggcttcgcggcagcgggctgtcgcacctggaagacgcggtgaaggacgcggcgcgcgcggatgtgttgttgctgcgcacccagcaccgcatgcacccggacatcgcgaaggtggtgagccacttctgctacggcggcgcgctggaggacggcgacgtcgtcaagcagcgcgcggagcggcccgctccggtggccgcgttcccttcggtgcgcgcgggctgggtggtgctggacggcctcacgcgagattcaaagcgcctcacgcacggccgcggggagacgggctccggctaccagcgcgagctgtccgccaacctcgccgtgtccctggcgcgcgaggcggtgcgctctggcctcagcgtcttgtgtgtcacgccctaccgcgcgcaggccgcgctgcttcgccggctgggcaatgccgcgggcctgcgcggggacgtcttcagcgcgtccaccatccatcgccagcagggcacccagtacgacgtggtgctggtggacaccgtcgctggaggcaggccctttccgcctcacacgctggtgcccatgctcaacgtggccgccagccgcgcgaaggactacctgctggtgctggcctcccgcgacgaggcgcgcgccgccaccattccccagcgcttcttgtcgctgctgccgcgccttcgcgtgcaccccggtgagccgttgcgcctggagccattgcccatgccgcagcgcgcgccgccgccgccacccccgccggtgccggtggacctgggcgcggaaatctcgggcgcgcggcccggcaagcccctcttcacacacgagcaggtgtccctcttcgagcgccgcttcgacgacgggcaccacctggtgcgcggcgtggcgggcagcggcaagacgtacgtgttggcgcactgggtggcgcgctacctgctggagcactccgaggcgcaggtgctggtgtccttcttcaaccgggcgctggccccgctggtggacaagttgttggtggaggcgttggcccagcgcgcgggccgcctgcgagtgcgtgagctgcgcgcacgggtgacggtgcggcacgtgggggcgctgcgccgccatgcccccgaatcgttcgacggcgtcttcgtggacgaggcccaggacatggacgccaaggcgctggccatgctccatgcgctggtgcgtccggacacgttgccggacggacgagaggtgcgctgcttccagctcttcatggacgactcgcagaacgtctacggccaggtgcccatcgacgcgctcaaggagcagctgcccgaggggctgtcgttccgcggccgcacccgcgtcctcaaggagacgttccgcgccacccgggacatcctcgacgtcgccttcaacgtggtgctggacccgatgcgccagcacgccgcggccgagcccggcatgcgcgaatacatgaaggtgggcgagctggcgcgcgaggggctcgtctggcttccggaggagacgctggagggcctcttccgcgtgcagtccaccgagcgcggcggcgtgctgccccaggtgcgcggcttcgcatccagcgccagtgaggcgcggcaggtggctcgcgaggtggcccgcctcatccgcgaggagggcgtccaccccagtgacatcctcgtggtggcccccgtcatgccctcccagtacacggaggcgctccagcgcgcgggcgtgcccgcggaggcctacggaggcaagggtgggcgcaacgtgacggacttccgcgtcagcggcgtggaccacgtgcgcgccaccacggtgttctcctgcaaggggcacgaatgccccatcgtcttcttcgcgggcctggatgcgctggacaccgcggagcagtggatggccggtgcccgcgagcgctcgacccgggagaacgagcgcatccgccgcgccatgttctatgtgggcgcgacgcgcgcgatgaagcggcagtacctcaccggtgtgaagggcgcgcgcttcctccgcgtggccgccacctacgtggagacgctgagcgggctcgtgccggcggctccatcccccgagggagcctcgggggcggacgcgcggtag

SEQ ID NO: 4314 - DNA, 993 bp, Myxococcus xanthus
atggccatcaagccggccgtggcctttgatggaaaacagttcctggtcgtctggagcgaccagcgcggtggagtcctcacgccggacatcttcgggaaccgggtgacgaaagacggcatccggctggatggggctggcggtgtcccgctcgtcgtccgtgagggtgctcaaaccgtccccgacgtgacgtggacgggcaaccacttcttcgtcgtgtggcaggacgacaagaacgacaccgctgatatctacggcgcccgtttccgaaagaacctcgcgttggacgggcccgcggccttcggaatcgccacgggcgcggacgagcagacggcgcctcgggtggcgcccagtggcaacaagtcgctcgtcgtctgggatgccacccggcagggtatccaccgcgtgcgcggtgtccgggtgggggacaacggaagcatcctgggctcgaagtcgggcttcaccatctccacgggggacttccagcaggagatcgcgcccgccgtggcggccggagaccacaagttcctcgtcacctacgcgggcacgacgacaggcacggatgaattcggcccgcacgaaatcctggcgacccgtgtgacgcacgatgatgtggtgaaggacaggccggcgctgcgcctcacgcgcccgtggggccacaagcctccggtcgccgccgcgcggggcaccgatggctatctggcggtctggagtgagaatctctccggcacgccgggcatgctggccgctcgggtgagcttggatggacagttgctcgatgtgcccgtcgtgttgcccgccggggcgacgtcacgcgcgcccgtggtggtgtgggacgggacggcctggttcgtggcgtgggaagagggcgccgctgacgccacgggattccagggggcgcgcgtgagtggagcgggcccggcgctggaggtgagccgcctgtcccgttccgcgctgcttcctctggagatgctggcgccgtccgccgagcgctga

SEQ ID NO: 4315 - DNA, 963 bp, Myxococcus xanthus
atggcacagcagaaggtccaggttcctcgtgaggccgccggtgagcggctcgaccgcttcctgtcgaagcaggtcccaggcatcaacctggagcgggcccgtgccctgattgattcgggagcggttcgcatccggggcaagaggtgccagcccacgcggaagctgtggggcggcgaggagattgagctcgaaaggcccgagcctcgcgctgcgtcggtggccgcttctgaagggccggtgctgcctgtgcttcatgacgattcggccctggtcatcgtgaacaagcctccgggcatcgtggtggagccggaagggcgcgcggcctccgtggtggggttgctcgccgcgcagcggccgcccttcgatgtggagggcctggcccagccaggggtggtgcaccgcctggaccgggagacgagtggctgcctggccttcgcacgcacggatacggccgccgccgcgcttctgcgctccttccaggagaagcgtgtggacaagcgctactggacgctggtgttgggacagccgcccgcccagggccgtttggaggggccctatgctcgagacccggcggaccctcggcgcttcaccacccgcgtgccctccgcgcgtcgcgcggcgctctccttcgaggttcgcgagcgcttcgcggatgccgcgttgctggaggtcgacctggacacgggccgcacgcaccaggttcgcgtgcagctctccgaggcggggttccccgtgctggcggattcactctacggtccgccggaggcacgcgcgcatgccgcggcgcgggcgttgggccggcaggcgctgcatgccttcaccttggagcttccgagccctgctacggggcagcccgtccgcgtcgaggcgccattgcccgaggacttccagcgcgcgctcacggtgctgcgtggtgggtgagcgcggtcgtccttggaagcgcacctggagcaacaggttgcc

SEQ ID NO: 4316 - DNA, 201 bp, Myxococcus xanthus
atgacgcacgtcacggtgctggagcgggagctgccttgggcctggcggagcctggatgtggcgcggcaggcgcgtgggtggattgtccttctcaatgacgaggagcgcctcatcacctgctaccggcgcggcgatgcgaaccgcttcatccgccgcaagcccaagcaccgcatgtccggtgtccagctccagggcctctga

SEQ ID NO: 4317 - DNA, 300 bp, Myxococcus xanthus
atgaagctgggtcagtcacccgaagccattcagggaatcgagaagtctggctaccctggctcggtgttgctggccattggaatcaccgagctcatctgcatggtgctctacgcggtgccgcggacagccgtcttgggcgccatcctcgttacgggctacctcggcggcgccacctcgacgcacgtgcgtctgtccgagccgttcatcgcccccatcctcgtgggcgttttcgcctgggcgggtctttttctgcgggacgcacgtctccgggccttgctgcccctgcgccgcgcgccctga

SEQ ID NO: 4318 - DNA, 846 bp, Myxococcus xanthus
cggacctgtctcctccttccccttctcttcatatccggctgcgcgctggagcccggtgagagcttcgcggtgctggagcccgccgtccgcgcggactacacgccggtagccgggcgcgacgagggcaacggcttccagcgtctcgcctccgacttcgagcttcgcctggacggcgccgcgctgggcgtggaccacatcgacctggtgggcggcggtggcacccgcggccccaccaccttcgacccggccaacccgccgcccggctacaccaactgccacaacggccactgccaccacgacgatggcgcgctggtggactacgaggacatccaggcggagctggatggcggtggtggcggcgcggaggccacggtggccagcctgcacgtggacgcggacctggacctgctggcggaccagacgctgtcgcccgactgcgagccgtcctgcgagctgggccgcacccacgtcagccgctaccagtgggacgtgtcatcggtaatgctggaaggcgcggtacgcgacagccgcgccacgccgcgcttcaacgatgagcgccgcttccggctcgcgttggcggcggcggaggaggccacgccgctgatggtgctgcgcggcacggtggacatccccgcggaccgcgagaacaagccgcgcgtgaagctcgccctgcgcctggcgctgacgcccacactgttcgactcgctggattgggcggccaccacgccgggtcccgacggcgtggtggacctgaacgcacccgagaacgccgccatccggaccgcgatggtggaagcactggccaccttggagccacaggcggaggtccggcgtgaagaccgttga

SEQ ID NO: 4319 - DNA, 1695 bp, Myxococcus xanthus
cccgcccccgttgaggccaccttcgattccctgggcttgaagcccgcgctcgtcgaggcgctcagcgcgctcggctacgaggagcccacccccatccaggccgccgccctcccgccactgctcgcggggaaggacctgctcggcatcgccgccaccggcaccggcaagacggccgccttcgccctgcccctgctcaaccacgtggagcccggcgcgtgccggcccaacaccacgtccgcgctggtgctggtccccacgcgcgagctggccatgcaggtctccgaggccatccaccgctacggccagaagctcggcatctccgtgctgcccctgtacggcggccaggtcattggccagcagctccgcgtcctcaagcgcggcgtggacgtcgtcgtcgccacgccgggccgcgcgctggaccacctgcgccgtggcacgttgcagctcgatgacgtgcgcgtcgtcgtgctcgacgaggccgacgagatgctcgacatgggcttcgccgaggacctggaggccatcctctccggcacgcccgaggaccggcagacggccctcttctccgccacgctcccgccgcgcatcgccagcatcgccgagcgtcacctgcacgagcccgtgcgcgtgaagatcgcccgcgagaaggtggaacagggggagattccccgcgtccggcagacggcctacgtcgtgccgcgcgccttcaagatcgccaccctgggccgcctgctcgacgtggagtcgcccaccgcggccatcatcttctgccgcacgcgcacggaggtggacgacctcaccgtctccctcaacggccgtggctggcgcgcccacgccctgcatggcggcatgacgcaggagcagcgagaccgcgtcatcaagcagctcaagtcccagggcaccgacctgctcgtggccaccgacgtcgcggcgcgcggcctggacatcccccgcctgtcccacgtggtgaacttcgacgtccccaacgcgcccgaggcctacgtgcaccgcatcggccgcacgggccgcgccggccgcgagggcgtggccatcaccctggtggagccccgcgagcaccggttgctgcgcaacatcgagcgcgtcaccggccagcgcatcgaagtggccaccgtgcccaccgtcgcggacatgcgcgagaagcggcaggagatgctgcgcgcatccctgcgcgagacgctggtgaccggtgagtacgactccctccgcaacgtggtggagagcctggccagcgagttcgacgccatggacatcgccgccgccgccgtgaagctcctccatgaggcccaggacgagggccgcgacacggaggagacggagatccccgtcgtcgcgccgccgcaggagcgccgtgagcgcacgggcaagttcggagcgcccacggggcgtccaggccggccggagcgcggcccgaaggcccgcggtggcccgccgacgtgggacgtcacccgcctgtggattggcgccggccgtcacgccggcgtacgccccgccgacctggtgggcgccatcgccggggaagcgggcgtcgagtcctccaagattggcgccatccagattggcgacgccttctccctggtggaggtgccggagtccgacgccaaccgcatcatcgccgcgttgaagaacgccaccctgcgcggcaagaaggtgctcgtccgcaaggaccggagctga

SEQ ID NO: 4320 - DNA, 1239 bp, Myxococcus xanthus
atggcgacgggcaaggtgttgcgtagagcggtcaaggcggcggcggcggggatgatccattacagcgggatgcggcgggcaatggccgcgtatcggcgctcccagtctggcgggaggcgcatcctcatcgtgagctaccaccgcgtggtgagcgacttcaccggggagctgcagcgctcgattcccgggctgctcatctcccaggagaccttccgccggcacctcgaggaggcgcacgcggcgggcttcgagctggcctccatcggtgacgcggtggacgtcatgaatggccgccgggtggcgaagaaggacttgtgcgtcgtcacgttcgacgacggctaccgcgacgtctaccggtacgcctatccggtgctcaaggagatgggcgttccggccatcacctatctgcccacggcgttcatcagcaccgataagcgcttcaaccacgaccggctgttccacctgcttcgccgtgtccaggagcgccgcttccggccgttctacgactcgctgcccgcgcccgcgctgcaactgctggggcccatcctctccgggcagaagacggtgtcggcgtcgctggacgacttcatcggcgagcaccccacgcgcgtgctgacggagatcatcgatgcgctggagcagcagctcggcggcggcgcggacctggtgccggagcagggcgacgtcatgaactgggacgaggtgcgccgcatggcgcgcgacggcttcgagttcggcgcgcacacgctgggccacacggtgctgacgctggagccacaggaggtggtggagcgcgaaatcctggagtccaagcgcgccatcgagcgcgaggtgggcatcaccgtgcgcgacttcgcctactgcaacggctggtactcggacgaggtcatccgcgtgctgtcggccaacggcttccgttccggtgtcaccacggaggacatgcccaaccgcattggcggtgacccgttcaccctcaagcgcaaggtgctgtgggagaacttcagcctgggcatgctcggcgactattcgtcggcgctcaccggctgccagctggatgactgcttcggggtgctgggcatgagcagcccggtgccggggaagcgcccccatttcatcagcgcccccaccgtgggaaaccagttgagcagcgccccggtgcgggtgggccccaagcccgcgaccagtaacgaaatcgtggtgggcccagagtccgccacgaccatccaggaggctccgtga

SEQ ID NO: 4321 - DNA, 1017 bp, Myxococcus xanthus
atggtggtgccgccactcctgggcgcctcgctctacggaatgatgatggcggtggcggccttcgcgggcctccgctacctggcgacgtgggtggtgtcgctgcgcggtgccaccggaccttgggtggacggccagcgctttcgcgagcaactgacctacgcggcgcccttcggcgcggcgatgctcttggccattccccagcagaacgcgcacctgtacgcggtggcgggcgcggtggcgccggcgctgtatgcgctctatcgcgtcggctgcttccaactgccggtggtggacctgctgtacacgccgaccagcgaggtgctgatggtgcggctgggcgaactggagcgcgaaggccgcctggaagagggcgtggaggccttccgtgaagcggccggaaagctggcctacttcttcctgcctttcgcggcgttcctcttctcggcggcgccggagttcatcggggcgatgttcggtgagaagttcctgcccgcggtgcccgtcttccgcatcagcgtgctgggcgtggtgctctccatcctccccatggacgggacgctgcgcgcccgggggcagacgcgggccatcttcgcgtcctatgcggtgaaggcggcggtgacggtgccgctggtgtggctgggggtgaagcacttcgggctgatgggcggcatcggctcgtgggcggtggcggaggtggtgggcaaggccatgctgctggcccgcgtgcccgcggcgctgtccacgccggagcggaagctgggcgtagcggacgtgattccctggcagtcgctgggcaaggccacgctggcggcgtgcgcggcggcggcggcggtgttcgtcctgcgggctggtgcccacggggcctgggcgcacctgcccacgggctttctgtggcgcgtgctgcctctggcggtggccggggcactgttcttcatcggatacctggtggtgctgcacttcacgggggtgcgaccgctcagcttgatcgcggggctgcgagcgcgaagggcggggtag

SEQ ID NO: 4322 - DNA, 504 bp, Myxococcus xanthus
atgacgttctaccggctcgcgcgcaggctgaagaagcggggtgtgcccctgctgccagccgtgctgcgcaaggccatctactatctgcacagttcgtacatccccgaggacgcggagatcggcgaggggacacagctgggctacggcggcattggcgtggtcatccacaaggccgcgcggattggacgcaactgcctcatctcgcagcaggtgaccatcggcgggcgctcgggcatggagggcgctcccgtcattggtgactacgtgcggatgggcgcgggcgcgaagatcctgggcaacatccacatcggtgacttcgccgtcattggcgccaacgcggtggtggtgaaggacgtggctccgggcacggtggtggccggggtgcccgcgcgggtcatccggcaggacccggatccgctcgggacgtaccagcgcgagatgggggagctgccgccccgtgtgtcgctggtttccgtgccgtcgtcttccaggctgcgccagtag

SEQ ID NO: 4323 - DNA, 963 bp, Myxococcus xanthus
atggtgggaagcctgcccgggccgaagtctccccgggtcatcaccctccactccggactgctgccggactacctcgccgcgtccgacacgcgtcggagcttcgtgcgcgtggcgcttgcgggctatgcgcgggtggtcgccgtgtccgacgcggtgaagtccgcgctggtgggctgcggtgtgcccgcggagaagatcgacgtgctcccggctttctgcgcctcgcaggtgcggccggggcccgttccctcggcggcggaggccgcgcgctcccggcggcgggtgctgctgtccatggcgcaccatccatcgcccgtctacgggcgcgcgctgatgttccgggccctgcgcgagctggcgcagacgtggccggacgtgggcctggcgctcttcggtccgggcctggaatccgaggcgttcatccgcgacgtccgcgaagcgcgcgtcgcgggccacctggaggtgctgggggagctcgagcactccgctgcgctggggctcatcgcgcgcagcgacgctttcgtgcggcccaccacacatgacggggactccatctccgtgcgcgaggcgctgacgctgggagtgccctgcgtggccagcgatgtctgcgtccggccccagcccgcccgcgtgttcgccgcgggcaatgccagggagctggcgcgggtgattcgcgaggccgtggcggcagggctcatgcatgtgccccaggtggatgcggggccggagctgctctcgctgtacggggagctgtcctccagcaacggattgaagtcgtcacacgaacaaggttcaggcctggggcacactgagacatccgtctcagtgatgagttggacttcgcgcgcagggcactgcgcggacgtgacctggtggtgttctccaccgactgggatggggacccgctgtcgaaggtccacatcatgcggattctctcccggcagaaccgcatcctgtgggtga

SEQ ID NO: 4324 - DNA, 822 bp, Myxococcus xanthus
tggagcttcctgcccgcgtccgcgccggtgtccggcacgctgggcgaggcgttcgtcatctaccactgtgtggacgagttctccgccttcagcgacaccaatggccgccacatcgcggagctggaggagcggctgctcaagcgcgccgacctctgcatcacctccgccgagcggctgcgtgagaacaaggcccgcgtcaatccgcgcacggtgctggtgcggcatggcaccgacttcacccacttcgtgaaggcgtgcgacccggccacgacgattcccacggacatcgcccgtctgcccaaacccatcatcggcttcttcgggctggtggcggactgggtggaccaggaggccatcatcgccacggcccgcgcccacccgggaggctcggtggtcatcatcggcaagacgacgccggactgtgacgactccgcgctgcgcgccgagccgaacatccacatgctgggtcgcaagcggtacgcggacctgcccggctacagcaaggcattcgacgtggcgctcatgccgttcaaggtcagcgagctgacgctcaacgccaatccgcttaaggtgcgtgagtacctggcgtccggcctgcccgtggtgtccacggacctgccggaggtccgcaaggtggggctctgcaagattgccaaggacaccgaggacttcgtgcgcaaggtggacgagtgtctggcggacaaacccggtccgaaccgcgagcgcgccgagcgcatcttcggcgagagctgggacgcgcgcgtggatgagattcgccaccacgtgggcgcggcgctcatggcggacggcaaggcgctctga

SEQ ID NO: 4325 - DNA, 495 bp, Myxococcus xanthus
atggcgtgcacgccggacgccatcgatttcacgggcaagacgtgcgaggacgcacaggattgcccgccgccgtacgtctgtgtcgcggcgaggccaggggaaggacgcacctgtgaggtgctgggactgccgggagtgccggacggcggtgacgcggggcccgtgcccacgtggtgcgaggacatccagcccatcatggcggcgagttgcgtgagttcgtgccacggcgccgatacgagcgacagcggcgtgaagtcgttccgcctggactactacgcgcccgaggatggaggtatcccaggcgcgcacgcgatggcggcgcgaatccaggcgcgcgcgtacgtgttcaaggacatgccgccgccgtggcgtccggtacccatgccgacggcacaggagcgcgagcgcatcgcgcggtgggcgcgagaaggcgcgccgctgtgcgcggacgctggctccgaagaggtgcccggtggcgtggacggtggcctctag

SEQ ID NO: 4326 - DNA, 567 bp, Myxococcus xanthus
atgtcgttggtcgtcactggctgcagcaagcgcgacaacgtcgagtcgcagcgccaggacgtcgccgaggctcaggtggaggcgcagcagaagacggcggaggtccgtcaggacgcgcgggaggacatcgccaggacgcaaatcgaggcccaggaggacatcgctgggacgcagcgtgaggccgcggaagaggtcgccagcgcgcagcaggacgtccaggacgagcgccaggacctggccgaggccgaggctgatcgccggacggacctgaacggcgacatggccctgggtggctctggcgcagcgggtgccaccgctgccgcgagcagcgtcagcggccgcgtgctctccaccggcaacgatgagctgaccgtggtcgacaccagcaacaacaagcagctcgagctgaagacgaacgaccagacgcgcatcctgcacaacaaccagccgctgaagctggatgacatcgaagagggtgcccaggtccgcgcctcgtatgtccgggacggtgaggacatggtggtgcgcgagctgaccgtgacgcagccggtgctgaagaagaagtag

SEQ ID NO: 4327 - DNA, 1065 bp, Myxococcus xanthus
tatgagttgatccgctacctcggggcacggggctccggagagctgctgctcgcccggcggcactatgcgggcgtccccggcgacctcgtgctcgtcaaacgtttgcaggacgtcggagacgcgcagggtcgcgcgcgcctgcgcgaagaggtcaagctgctgatgcggctcagccacccggccatcgtgcaggtgttcctggtgcgggtgcatgaaggattgccccacctggtcatggagcacgtggacggaaagtccctggagacgctcatcagctacgcggccctgcggcgccggcccttctcggaagcgttcgccgcctacgtgggcgtggaagtggcggatgcgctgcaccatgctcatacgctggaagacgcccggggccgcccgttgggcatcgtccaccgggatgtgtcgccgcggagcctgcgtctggatgcgcggggccatgtgaagctgtctgacttcgccatggcctgggcgaagctgccggggcgcatcgtcacggagacccatgtcgtccggggcgacctggcctacgcctctccggaagcgctggagcgaaagccgctggacggccgcgccgacctgttctccttgggggtggtgctgctggaggtgctcaccggcctgcacctgttggatctggaggacgtggagcgggccgcgcttgccgcggggccgctgcctgacgcggaggtgctgctggcggaggtgccaagctggttgcccgcgcccttgatggccgcgcgcatggcgtgtctggcgccggcgcatgtggaacgcgccacccagggattgtccccggccatgcgggccatcctcggccggcttttgcgccgggagccctcagagcgcttccagtccgggcaggaactggcggacgccctgcgcgccgtgttggccggtcaggggtacgcctacggaccgaccgaagccatgcgggaggccacccaggtccgccgcgacgcccgctgccgccggcagatggcggatgtgctgcgctgggaggactccgtgcgtccggaggccccgccgcgcacgacatccgggtcggagccttga

SEQ ID NO: 4328 - DNA, 693 bp, Myxococcus xanthus
atcaccacgaccggcgccatgctggaggacaacctcgcgcaggggcggctgtccgcggtgctgggcgtggaaggggggcacgccatcgaaggccaggtggcgcgcctgtcggagcttcaccagcgcggggtgcgcttcatgggcctcacccacctgtccaacaacgacctgggtggttcttcctttccgatgatgggcaaccggggcctcacaccgctgggccgggatgtcatggaggaaatggcccggctgggcatgagcgtggatgtggcgcatgcctcggagtccaccctcaaggacctcttcacccacccctcggtccggttcttctgctcgcacacgggcgtccgcgcggcgggcggcggctggcgcaacctctccgacgaatccctgcgcttcatcgcagaccggggcggggtggtgggcatcatcttcgcccccgtctatctgggcggtgacaccgtggatgacgtggtccggcacatcgagcatgccgtggacgtcatgggggagggcggggtggggctgggctccgactacgacggaatggtgccgcttccccgtggcatgaaggatgtcaccgggttgcctttgctcacagaggcgctgttgcgccgccatccaccgtcctgggtggaacgcgtcatgggtggaaacttccgtcgtttcttccaggagacactgggtggttga

SEQ ID NO: 4329 - DNA, 378 bp, Myxococcus xanthus
atgaaccgctcacttctcgcactggtcccgttggttggctctctgctcctcgctggttgtggcccgagcgcgggaggcgactgcgacggaggcggcttcgtctgtcaggagcgggtgctggcgctggagtgccggggcggcaaatggcgtgagttgccctgccgggggccgctgggctgccgtgagacgtcggaggccgtgcggtgtgatacgtccaacaacgtcgcgggggacgcctgtgcctccagcgccgagggcacggggctgtgccgcgcggacggccaggccgtgttggagtgccgccagggcgtgttgacggagacggccacctgctccgcctgcaccgtggaaaacagccaggtgacgtgccagccctga

SEQ ID NO: 4330 - DNA, 1011 bp, Myxococcus xanthus
atggatgagcgacggttggagctgaaggtgggcgccctggtgctggccgccatcgtgggcgtgctgttgttgctgtggctgatgggcgaattgaagctgggctcggagacggggctggcggtggacttcggccacacggggaacgtggtgaagggcgcccccgtgaagctgggcggcgtgcaggtgggccgcgtgcaggacatccagctccaacccgagcggcgggacgcccagggacgcccgctgcctgtgaggatggagctcgcggtggcgccggaggccgtgggcgcgctgcgcaaggacgcgcgcgtgacggtggccacggtgggcatcctgggagagccctatctggagctgaacccgggctcggcgccggagcggctgcccgcaggcacggccgtgcggggaacggacgcgccccggctggatgtcctggccgagcagctcactcgcttcgtggacctgctgtcccagatgctggaggaggacccggaggccatccgcggcctcgcggcgaacgtctcccggctggcgcggacgctggaccagttgctgacggagaaccggggcgacgtgaaggtgctggcgtccgagctggcggcggcctcgaaggacttgcgccagctcgcggggctcgcgcgcgaggccttccagcctggaggcaagggcgcgcggctgttggacgatgcctcggcggcagcggccgtcgtgcgccgcgacctgccggggctgacgaagtccgccgggacgacgctggacggactggcggccgtgacgggggcgctggggcccgaggatggcgcgcgggtcaaggtcgcgctggagcgcctcacctcggcctcaggacaattggagagcatcgcggcccgcgcggaccgggtgctggcgaagctcgaggccggcgagggcaccgcgggcgcggtgctccaggacggcacgctctacgaggagctgcgcatgctggtgacggacctccgcaagcacccgtggaaggtgctctggaaggactga

SEQ ID NO: 4331 - DNA, 1446 bp, Myxococcus xanthus
atgttcgtcaacgcctgcttctcctgcacggggcagcgggagttctacggcgacgcgcgcggccagtccgtctccatcgagttcctgcaccagtacatcctgggcaactaccgccggttgtatgcacggacgctcgcggcgggcatcaaccacttcaatcaagcgcagatcatcctcaacctgctcgccagtggcagcccagcggatgcccgggacaaggcggaggagggcgcgctcattgccgccgcgctgcgcgccctgccgccccagcgggccttccgtgtcctggagtccctgcgcggccggcgcatcaacaaccgccgggcccgtgcgattgctcgggactacgtgcacggtcgcgccaacctggccttcgacgccgtgaagtaccgttccaagctgcgcgccgccgtgtcccacggacacctgaagctggagggagagctggggccgttcctcttccgaggctggaagaagcgcttcttcacccagcccctgctggagacctttcgccgcgcgcactacacccacgaggccctgtacgagctgccgtacacggtggcggagggcctggcggtgaagcacggcatctcccgcgaggtgttcctccggcgcatcgagccgcgcctcacggcggcagagcgcctgcgcctgcaagaatccgcggcgcgtgagcgcgggacgccgcccccggtggacctggggcgggcatccctgacgaagctggcgctgtatgtcctggccctgtcgctggaggttcgccgggagcgccacgcggagctgcacgccgcgctggagcaggccgcggcccgcgtgctgcgcagggccccgtcgccgttgcagcgggtggccgcgattctggacaacagctattcgtcgtccgggtcgctggagaagcgccgccgtccgctcggtgtggcactggccacgcactacctgctgtccgctgccgcccgggagtaccgcgcgtggtggacgtgcccggtggaggagccgctgctcgtcagtgcacgagggcagacggacattgccacgccgctgttggatgcgttggcctggggcgccgacctggtggtcatcgtctccgacggctacgacaatgacccgcccaaagcggtggccgagctgacgcgcgtgttccgttcgaagctcgacccggagcgccacacggcgctcgtccacgtcaatccggtgttcgattcggaggggtatgccccccgctctttcggtgcggccgtgcccacggtgggagtccgggacgcggaggacgtgcccacggtgctgggcttcgcgcgcttcgcggagggggtggcgtccctctccgaactggaggcctacctcgcgtcgcgcgtgggcgcgatgttgcagcgggacgccggggaccggcggggcgatgacgaggggcgccgtcaagaagcgccgtcggcggaggagggcgaatcatga

SEQ ID NO: 4332 - DNA, 1170 bp, Myxococcus xanthus
atgacggacgcacggctcattcaacggctggagcccgcgggcttgcggttggctccgtctcaggtctggggcggcatccggctggtgccagtcctgagggacgaggtgcgtggcgacctccgcatgagcttgcggacgtacgacgacgtggccgcggtcgtctcggtgaagggtgggctgaaagagcctggcctcaagtacatctcgtatgttcctcacggcctggtcatgacgtggggaaaccgtcaggcggaagccgtctatggaacgcagttgcaacccgaggacgggaagcgcctgaaggcgggccccttctccatccggctgctgcatcggatggtgcaccgtgaagaccgccgccagcttcggatgctcccgttgcatctggccatggagggcttcctgtccttgcagtttggcgggccggagattgcctgggctgagtattcacgcgagggcctctcgcgaggcctggcccctcgctccgagggctcggtccctgggtgggcttcgcccatgctggatggggcgctgcgcaccttcgaaatccatccacagcaggtgggtctgctgctgttcaacgcggacgtgttgctgtcggccttcgtcgtcgcgcacccggatgactaccgcgcgctccacaggacgttggtggaggacttctatggtgacctgctgctccagtacggattcctgggggacgcgcccgaactggggctcaccctggatgacgctcgggtgtccagcttggaggacttgcgcaatgaggtgcaccgcatgcgccaggactgggccgacttccacggtttcatggccgggagcctcttcggtgccagcatgtcgtccaccggtgtctacaaggcgggcgggtttctcctccagcgcttccacacctcgctggacccggcagaggagaaccacatcggcgaggccatcgtcggtacggacggcaccctggagtacctcaagacgtatcgcttgtcggcggcacagacgcgccgggcttacctgctgtcacagcttgcccagtgcgactggcatctggaggacacggcggagcgtctgcgaaccacggtcagtgacttgtccctccgcctgcgaaacgccggattcggctatctcctcaaggactccgtcctcgaagccgtccagcggaagcatcgccgctga

SEQ ID NO: 4333 - DNA, 792 bp, Myxococcus xanthus
atgagccagattgcccagggcatcacccaactgggcgaggccatgcgcaacccgtcggtgatgagtgaccggtggacgctgctggcggaagttcagcgcatccgcgcccggttccgcgagcagatgagcaacctggtgttcgagtcggcgagcctcttgggcgaggcaacgcgggcccaggtggtgccgggctacgcggtggaggtgaaggccgcggtaacggtccgcgccatcaccgccgacctgggccgcatcctcaccgcgcgcctgaagaaggtccgcgaagcggaggcgcaggacgtgcagtggaatgcccagcagctccagacggaaatggacgccttcgggcgcacggccgcgtaccggaatctgcgcgcgcaggacaagcggcacatcgtggagatgcgcgccgaggtcggccgcctggccatcctcccgaacccctcccgcgcggagttggtgacggtggtggaggccctggacaccttcgtccaaggcctgtccgcggtgaaccagcgacagctgctcatcatccatgaccgcgaggtgtgggcgtcgtgcggcgtccggctggagcgcgccatgtcgctggtgggttctgaccccgcgggcgcggcccgggccctggccgaggcggccggcagtggccagtccctctacggccgtgcgacggagctggacgctttcctgcgcaaggcgcgcaaactccaggtgggccagctctcgcccgacgagctgcggtccaccatcgtcgccttccagggactgctcgccggtctggacgtgatgtga

SEQ ID NO: 4334 - DNA, 171 bp, Myxococcus xanthus
atgttcgccgcctttggactgggcgtgggcgtggccaacgtgcgggccgtcctggaccgcatcgaggcgccacctgctttcatcacccgggcgcccgaggggcggggcttcgaggaactggctcgcgccatcctggcccggaggggccgcggcgcggcccgtgaggagtga

SEQ ID NO: 4335 - DNA, 1147 bp, Myxococcus xanthus
gtgaagctggaactggcgcgcggactggggcgccacctgcgcgcggggcacccgtgggtgttccgcaaggcgctggagcacgtgccgaagattccggccggcagcgtggtggacctgacggagaacgggaagttcgtggcgcgcgggtattacgacccgcactcggccatcgccgtgcgtgtgctcacgcgcgactcgcgtgacaccgtggatgcgggcttcatcacccggcgggtgcgtcaggccctgtccgagcgcacggcgctcatcgacctcaccgacacggacagctaccgcctgattcatggcgagggcgacggcctgccgggcgtggtggtggacctgtacgcgggctgggcggtgatgaagctgtactccgcgggcctcacaccgtaccggccgctcctcatcgaggcgctgaaggccggcgtgcccgggctcaagggcatcatcggccgtgacgaggtcggccgcgacgacgtcgacgaggacgagggacgcggctccgggaagatgctcttcggccacgaggccccggagctgattcccatccgcgagcgcggggccaccttcctggtggacgcctggaaggggcaaaagacggggttcttcctggatcagcgggagaaccgctacctcatccgtcggctgggcaagggccgcgacgtgctcaattgcttcagcttcagcggcggcttctccgtcaacgcggcgctgggtggggccaacagcgtcttctccgtggatcaggacccggacgccatcgcgctggctcgggagaacttcacgcgcaacggcattgccccggaaaaaccagactttctggcggcgggaggtcttcaagatcatccagtccttcaaggacgagggccgcaccttcgacctcatcatcctggacccgcccgccttcgagaagagccagcgcgcggtgcaggcggccattgacgggtatgcgtccctcaaccggcaggccctggccatcctccggccgggtgggttgctggcgacggcgtcgtgctcggcgcgcgtgagcccggacgacttcatgggcgcggtgcgcgaggcggggttcaaggcgggcgttgacctggcgctcgtcgaggagcgctaccagccgccggaccacccggtgcgcttgcagttcccc

SEQ ID NO: 4336 - DNA, 630 bp, Myxococcus xanthus
atgggaaagttcatcaagtggggcctgccggcgctggcgctggtcgttctcgccgcggggtggtggctgggactggagtgggcaccgccggaccgcgagatgggtgacgtgcagcgcatcatgtacgtccacgtcccgctccagtgggtgggcatggtggccatggtcatcaacttcgtggcggccatcagctacctcatgaaggcgagctggaagctggatgccgccgacgaggcgtccgcggagattggactggtgctgggcaccgcggggatgatcaccggcgccatctggggccggccgacctggggcgtctactggtcgtgggatccgcgcctgacctcgcaggccatcatgctggtgacgtacaccggctacctcgtgctgcggcgcttcgtggaggacccggagaagcgcgccacgtggagttcggtggtggccatcatcggcgccatcaacctgcccatcgtctggttctccgtgcgctggtggcgcagcctgcaccaggtgcagtccacgccgaagacggtggacccggagatgacgctggccctgcgcgtgtcggccttcggcatgctgttcctcaccctctggttcctggtgctgcgctaccgccaggccctggccgag

SEQ ID NO: 4337 - DNA, 702 bp, Myxococcus xanthus
atgagcacctcgcgtccccgccccatcggccttttgacggcgaccctggcgttgctgcgcaaggacctgctcatcgagtggcgcacccgcgcgcgcctcaacgccatcatcttcttcgcgctggccacgctgctgatgttctccttcgcgctgggccccgacacgaagctgctggagaagaacgccggcggctacttctggttggccatcctcttcgccagcgtgctcgccctgggcgagtcgttccgcgtcgagtcggagaacgcgtgcatggacggcatccggctggcccccgccgacgcccgcgccatcttcctgtccaaggccctgggcaacaccctgctgctgacggccctgggcgtcctgctggtgcccgtcatggtggccctgtacggggtgcgcatcgtcaccagcatggtggacctggggctcatcctcctgctcggcagcctggccttgagcgccccaggaaccgtctacgccgcgatttcgagcaatgcccgggcacgggatgtgcttctgcctttgctattgttcccgctggtcatccccgccctcctctccgcggccaaggcgaccacgctcgtacttcagggagaccccatgaatcagtttggctcatgggtcgggcttttgggcggattcaatctgatttattggggcataggcttcttgctgttcccgcggatcatcgaggactga

SEQ ID NO: 4338 - DNA, 624 bp, Myxococcus xanthus
cacgacgtcagcaagcggtatggtcgacggtgggccctggcgcgtctcacgtacgcgctccccgccggacgctcgctgctgctcaccggccacaacggttccgggaagacgaccctgctgcgcctgctggccaccgccctgagccccaccgcgggccgggtggaagtgctcggccgcgacgcggtggtggagcgcgacgcggtgcgccgggacgtggcgctgctgtcgcacgccagcttcctctatgaggacctcaccgcgcaccagaacctcacggtgctggcccggcttctgggactgccctcgcccgcggacgccgccagcgacgagctgacccgggtgggactcagccgccgctccgacagcccggtccgcagcttcagcgccggcatgcgcaagcgcctggcgattgcccgcctgttgctcaaggcgccgtccatcgcgctgctcgacgagcccttcggcgagctggaccccgcgggcatccgcgacatggaggccatcatcgccgaactcaaggccagcggcgtcaccgtcatcctggccacccacctcatcgagcaaggcctgacgctgtgtgaagaacgccttcacctgcaggaaggccgggcggtggcggcatga

SEQ ID NO: 4339 - DNA, 594 bp, Myxococcus xanthus
atgggcaagggcgaggtgtacgtgctggccggttcggacctgctggagaaccggcgcctggagctgctggacaacctgcgcttctgggaagcgctggctgcccgcgggcccctgctgttcgacgagtaccaccaccagctcgcgccgccgccccccttctcccgtggcatctgggtcttcacggcgcaggtgctggcggtgggtctgctctacgtcgtgtcgcgaggcacacgcttcggagcgccgcgcccgttgcgcgtggaacgccaccggtccgcgctggagtacgtgcgcagcatgggctggctgatgcgccgcgcgaaggtggagaaggagttgctacccgagctggaccaggccctgcgccagcagatgcaggagcgcctgggcatccccatgggcctgtcggacgaggacgccgcgcgcctgatggaacaggacggaggcgtctccgccaccgagtacctggaggcgaaggccgaccttacgcggacccacgcgcagcccaccgtggcaccggcggactacgcgcgggtggcccgccgctacgcccacctggagcgggcgctggcgggccgcgaagcccgcgcctag

SEQ ID NO: 4340 - DNA, 171 bp, Myxococcus xanthus
atggtggtgtcccacgactaccggcagttgaaggcgctggcggaccgggtgctggtggtggcgaacaagcaatgtgcctacctgggcacgccgaagggctttctggagtcctccgcgcccgagctgcgagtactgacagcgccattcatggagggcgcgacggatggatga

SEQ ID NO: 4341 - DNA, 450 bp, Myxococcus xanthus
atgctggggctggcgctcgcgctcatcctgtggagcgtgctccggctccgcgcgcggcgtggacgcaaggcggcgcatgtctccgcctcctccgcagcgaacgcggagccgttggtcctggactccccggccgaacacctgcgcagggcccgggcggcgctctccacggatgcacgcgaagccatccgggaaggattgttgagcctgctgtcctcactggaggagcggcggctggcccggccagaccgtgtgcgaacgaaccgtgagctggcggcggagctgccgggccgcggcgcgtccgcggcgctggtgcgcgaggtggagcggctgatgggctggtacgaccggaccttctattcgctcgcgccggtggcgccggaggaagccgcccgcttcgtcaccgaggtcgagtcgctgaatggaaccctggccacggagggcgcacggtga

SEQ ID NO: 4342 - DNA, 972 bp, Myxococcus xanthus
atgattgaccgtgccgccaccttctggcgctcccacctgaagcccctcttcctgctgagcttcggcttcacgctggtgaactacatcgcgaccaaggcgacgttggtgattggccaacggttggcgccactgctctacacgggagacgcggagtcgcgcgcccaactggacccggcggtcatgctgccgcaagcgagcatcaccatcgcgctgtggatgagcctgttcctgttcctcgtctggatgtactggctggccaccctggccgcgtcccgctacgtcctcacctcccagttgggagagccggtccgccccgcggatgcactgcgccggagcttctcgcggctgggcacgctgaccggggtgtacctgctgtcgctcggctggtccgcgctggtgacgatggcgctcatgctgcccgggctcatcctcgcgatcatcggcatcgccgtcggagtggcctcgggttccaacaccctggccgtcgtgctgggcgtggtcggtacgttgctcgcgagcctgggactgctggccgcggcgctctggtacatgctgcgcttcctgctggtgcccccggtgctggccatggaggacctgggcgcctgggagacgttccggcgctccggtcagctcctgtcgggccgcgtggagccgggcttcatgggacgggtgatggtgcgggcgatgattctcttcaccgtggtgagtctcatcctcatctccgtccagctcgtctccggattgccctcgtggctggtgatgatgccctacggcagccccttcgacccggggaccatggcccgcacgccgcagttgctgctcgtcccggtggagctgctgcagacggtggcgcagtccttcttcacgcccatcaacttcgtcttctgcgccctcttctacctggacatgcgcgtgcgccgcgaagccctggacctggagcaccagctcaacacgatgacgcccgccaattga

SEQ ID NO: 4343 - DNA, 126 bp, Myxococcus xanthus
atgacgctaccggacgcggcgggcttcgcggtcatctcgtccgtcctggaggccgacgacccgacggcggcggctcggagcctgctggccgcgcgcgccgggcgggctatgctgcgcaccccgtga

SEQ ID NO: 4344 - DNA, 786 bp, Myxococcus xanthus
atgagcatccaggacaagcctttcaccatcgccggagtgacgttcagctcccggctcatcctcggcacggggaagtatcccagccacgacatcatgaagcgctgccacgagtcctccggcacggagatggtgaccgtggccgtgcgccgcctggacctcaaggccacgggcgaggcgtcgctgatgaactggattgaccgcaaccgcctgcgcctgctccccaacacagcgctctgctacacggcggatgacgcggtccgcacctgccggctcgccgaggagctgggcatgagcaagtgggtgaagctcgaggtgctcggcgacgagaagacgctctacccggacgtcgaggagacggtgaaggcggcccgcatcctggtgaaggagggcttcaccgtgctgccgtacaccagcgacgaccccatcaccgcccgcaagctggaggacgcgggctgcgcggccgtgatgccgctggcggcgcccatcggcagcggcctgggcatccgcaatccgcacaacatccgcctcatcctggagacggtgaaggtccccgtcatcgtggacgcgggcgtgggcacggcgtccgacgcggccatcgccatggagttgggcgtggaggcggtgctgatgaacaccgccatcgccggagcgcaggacccggtgcgcatggccgtggccatgaagaaggcggtggaggctggccgcgacgcgtatctggcgggccgcatcccgcgaaaggcctacggctccgcgtccagcccgattgacgggctcgtccaccactga

SEQ ID NO: 4345 - DNA, 528 bp, Myxococcus xanthus
atgcatctgaaggacgtcgaggaccgcgaatccgatggccactacggtcgactgattcgcatggcccgagaggtgggctctcccgtcccgcaaatctggcacctgttcgcgtacaagccgcgattgggcgaggccctgtcccgcttcacccatgaagtcatgcggggcccttccccgctgtcgcccggactcagagagctgattgccgcgtacacgtcgcgcggcaaccaatgcttgttttgaacgggctctcacgccgcggtcgcggcggaactgctgggcaatcccgacctggtgaaagcggtcctggaggacgtggcgacagcccccatctccgaggccgagaaggccctctttgccttcgtggacaccctcaaccaccgtgcggcgcaggtgggacgggacgacatcgcacacttgaaggacgccgggtggacagacgaagccctcttcgacaccgtgacggtgtgcgcgctcttcaacttctacaatcgatggattgacggcaccggcgttcaggacatgccc

SEQ ID NO: 4346 - DNA, 798 bp, Myxococcus xanthus
atgctgaccgtcaccgtggatggtgtccccctgcactaccgggacgagggcaagggcccacccgtgctgctgctgcatgcgtttccgctgaatggcagcaccttcgacaaacaggtgaaggcgctgtcggggcgctaccgcttcatcatcccggacatccgaggcttcggagagagcgcgctgggcgacggccccacggagatgttccgcatcgcgcgtgacgcgctgtcgctgctggacgcgctgaatctggacaccgtggtggtgggtggagtgtccatggggggctacgccgccatggccctgctgcgcgaggacgcggggcgcgtcagcgggctggtgttgatggatacgcaggccaccgcggatgacgcggagggcaaggcgcgccgggagacctccgcgatacaggcgctggaggtcggcgtggagcccatcatccaggccatgctccccaagatggtggccgcgggaccggactcaccggtggcgcaggaagtggcggcactgatgcgcgcggcctcccccgcgagcgtcgcggccgcgctgcgcggcatggccctgcgcccggacagcaaggacatgctggcgcggtacgcgggcccggcactggtcattgtgggcgagcacgacgccctcaccccgccggccaaggcgaaggaaatcgccggactcatctccggagcgaagctggaggtcattccggatgcagggcacctggccaaccaggaacagcccgatcgggtcaacgccgtgctggatgccttcctgacgtcgcttcaggggcgcggcgcctga

SEQ ID NO: 4347 - DNA, 981 bp, Myxococcus xanthus
atgcgggccatgccgctggcttgggagcgctacgggatgattcaggtctgtcttgtgaaggacggtcaacttctcaccggtggtgaagagctgctgggcgaggaaggccggaagtggatcgacgtccttcatccgaccgaggaggtgctggcccggctggccgcccaattcggtctgcacaagctggccgtggaggactgcctccacctggaccagcggcccaagctggaggaataccccaaccaccagttcgtcgtcctccagggattcaccgtcacgggcaaggacatctgcgaactgacgctgcacgagcaccacttcttcctggcgaaggactggctcatcagcgtccacgagctccccttcgcgggccacgacaccgtgatgcgccgagtgaaggaggacccgcaggcgacgctcatccgagggacggacttcgtcttctacatgctcgcggacgcgttggtggatgcgcagttccccatcctcgacacctttagtgacgagatcgaggacctggaggccgccatcttcgacaagccggagaagtcccacctgcaacgcatcttcgccatgaagcggatgctcgtgacgttccggcgggtgctgtcgccccagcgcgacgtggtgggcttgctgtcccggcgaggcatctcccatgtccacgagaagacgacgctctacttccgtgacgtgtacgaccatctggtgcggctgtacgagcagattgatgccgggcgcgacatcatcggcaacgtgattgacggctacctgtccatggtggcgaacaaaacgaacgatatctccaagcagctcaccatcttcgccaccatcttcctgccgctgtcctgcatcgtcggcttcttcgggcagaacttcgaccggctctacacgaacaacgcctggtacctgatgtgggcgtcgattctcgggctgccagtggggatggtcttctggttcaagcacaaagagtggttctga

SEQ ID NO: 4348 - DNA, 666 bp, Myxococcus xanthus
atgggcatccgcgagctgctcttcgagtcgctccggtgggtggatgagcagcccgacgtggacaaggcgctgcccatcgacgcgctcagcgtgcgcgcgctggcgccgccgagcccgagccagcccctgatgcaccggatcatcctggggctgtgcacgtcgccgcagaacctgggacggctgcgcctgtccatgggcgtgtcccgctcctcggtgacccggcgcgtgcacgagctgctgcggtcgaagctcgtggaggtggacggggcgccgcaggtggaggcggacccggtggcggagatgttggagaagggcgcggtgctgatgcgcgagggccagtacgacgccgcgggcatcgtctgtgcgtccttgctcgccagcgacccggcggaccggcgcgtgcgcgaattcgcccggctggtgcagcgcgagcacgtggcggcgctctactcggacatgccgcccctgatggtgcccctcatgattcacgacccgcaggggcaggcgctgctcaagcccgaggagcggcagattgccgggctggtgaatggcacctgggacgtgtccacgctggtgctggccagtccagcgcgagagctggagacgttgaagacgctggcgaagctgcagcgcatggggctgctgcagctcgtcttcccgcgctga

SEQ ID NO: 4349 - DNA, 1083 bp, Myxococcus xanthus
atgacggacgaccttctgctcgagacgcgtggcgcggtaggcgtggtgaccctgaaccggcccaaggccctgaacgcgctgaacctgggcatgtgccgaaagctgcacccggcgctcgacgcctgggcggcggacccgtccattcaggccgtggtcatccggggggctggcggccgagccttctgcgcgggcggagacgtacgcgcggtggcgctgtcggtgggggacgcgtccgctgaagcgaaggagcgggtgtcgcgggagttcttccgcgccgagtacgggctgaaccaccgcatccactacttcggcaagccgttcatcgcgctggtggacggggtctgcatgggcggcgggctgggcctgtcgattcacggcacccaccgggtcgtcaccgagaagctggtgctggccatgccggagacggccatcgggctcttcccggatgtgggcggcggctggttcctgccgcgcttcccgggtgagtcgggcacgtacctgggcctcacgggggcccggtgcggcgcggcggacgcgatgtggctgggctacgccacgcaccacgtggagtccgcgcggctggaggcggtactggacgcgttggtgggggcgccctggggcaccggcgcggcgagcacggtggtggacacggtgctggccggcttccacgcggacgcgggcacgtcgccactgggggtgcagcgcgccgccatcgaccggtgcttcgcggccgagcgcgtggacgacatccagcaggcgctggagctggagggcacgccgtgggcccaggagacgtgggccacgttgcttcacatgtgcccggccagcttgaaggtgacgctgcgccagctccggatggggcgcacccgcgactacgacgagatggccaacgtggagtaccggctcagccagtcgatgacggcacggccggacttccgtgagggcatccgcgcggtgctcgtggacaaggacaacaagccgcactggcggccctccacgctggcggaagtcaccgaaggcatggtggaggcgctcttcgcgccgctgcttcacgacacgtggaaggttccggcgcgcgggtag

SEQ ID NO: 4350 - DNA, 651 bp, Myxococcus xanthus
atgggcgccgaggaaaccctctttcaacgtttcggcaaggagttcccccagggcaccgagctcttccgcgagggagaagccggcaaggagatgttcgtcatccaagcaggacgggtggccatctccaagcgggtccgtgacgtcgagaaggttctcgccgtcctgggccccggtgagttcttcggggagatggccatcatttccaacaagccgcgcaatgcctcggccacggtcaacgaggacgcgaggctgctggtcatcgaccccaagacgttcgaggggatgatccgcggcaatgcggagatcgccgtccggatgatcaagaagctggccgaacgcctctccgaggcggacgcccagatcgagaacctgctgcacaacgacccggccagccgggtggtgcaccagatcatccaggcctgccagagccggggccgtcccctggacgagggcgtggagatcgacttcgcgatgcgggaactgccgcgccagattggtgtgggcgagcccgcggtccgcgccgtggtggaccggctggagcgttccggtctggtcgagcggaacggggaccggatgaccgtgccggacacggccaggctgcacgacttcctccaatacctggagatgaagtggaagttcggagacctctag

SEQ ID NO: 4351 - DNA, 747 bp, Myxococcus xanthus
atgaacggcgtgctgtcgttcttcggagcgccggtggtgatgctggcgcgcacggtgcgcgcctccacccgggacggcgtgccctggcgcgagtccctggcgcagctccacgagctgggcgggcgcagcgtgtggctggtgatgtccggcatggccttcttcggcgcggtgctcgtcaccatcgccaacagccaggcacggcgcttcgtgggcaacgtggcggtgctggggcccgcgtacttcgagctgctcatccgcgagctgggcccggcggtgtccgcgctgctcacggcctcacgcgcgggcgcggctcacgcggccgagctgtccaccatgagcgtcaacgaacaggtggaggccctggagatgtccgcgggcgacccctacgcggacctcgtcgcgccccgggtgttcgcgggtgtgatgggcgtgcccctgctgtgcatcctgggcaccatcgcggccacgctgtccgcggcggccgtggcgcagttcgccttcggcgtggatgggcgggccttcatggatccgcgctacgtggacggctgggacttgctggccgcactcctgaaggccgcgggctgcgggctctacattccgctggcggcggcggtggcgggcctcaaggcgcgcggcggcgccgaggccgtgggtgaggccaccaccgacggcgtggtggcggcgagcctgggatgcctgctcatcgacctcgccgtgtcgctggccttccaactgctgcgcctgtga

SEQ ID NO: 4352 - DNA, 291 bp, Myxococcus xanthus
atgagcggcgacaccggccccacggacaagctgtggaaggcgctgaacgagacgaagaacctcaaggcgctgctgctggagacgtccttccccaacaagctccagtcgctggccgacatctccggccacctcacgccgcacacgctgagcctggaactccagaagttcgagcgcaacggcgcatcggtactgctgtatcacctgaagcccgccttcgtgtcgcagctcaagaaggagctggccgagctgccggtggaagtgctggagctgggcgataccttcgagctgtag

SEQ ID NO: 4353 - DNA, 780 bp, Myxococcus xanthus
atggagggtctgtgggcgaagtgcgagacgtgcgacgaaatcatctaccgccaggagctggagaagaactggatggtgtgtccgcactgcgagcaccaccactactgggcggctcgcgcgcggctggcggcgctgctggaccccgacagcttcgaagagttcgacaaggagctggagccgcaggacccgctcgggttcagtgactcgaagaagtacaaggaccgcctgaagtccacccggaagaacctgggcgagccggatgccttcatctccggcgtgggccgcatccagggccaccaggtgtcggtgggctgcttcgtcttcgagttcatgggcggctccatgggctctgtcgtgggcgagaaggtggcccgcgtcttcgagcgcgcgcacgagctgaagtgctccgccatcgtcttctccgcctcgggcggcgcgcgcatgcaggagggcatcttctccctcatgcagatggccaagacgtcggcggccatcgcccgcttccgcaccggcacgcggccgtacatctccgtgctgctcaaccccaccactggcggcgtcgccgcgtccttctcgtggctgggcgacgtcatcctcgccgagcccaaggccctcatcgggttcgccggtccgcgcgtcatcgagcagaccatccgccagaaactgccggagggcttccagcgctccgagttcctgctggaccatggaatgattgacgccatcatccaccgcaaggacctgcgcgcgaagctgggccagatcctggggctgctgggctga

SEQ ID NO: 4354 - DNA, 1131 bp, Myxococcus xanthus
atgacggcggcgtcgctccatgccgccgggcaccgcgtggggctctacacgtctccgcatctggtgcgcgtcaacgagcgcatccgcgtggacagcgaggacatctccgacgcggacttcggcctgcgcatcctggaggtgttggagcgctaccccagcgccgtgtcctctcccatgacgtacttcgagttcggcaccgtcgtcgccctgtggcacttcgcccaggtgcgcgtggatgtggccgtgctggagacgggcctgggcggccggctggacgccaccaccgccgccagcccggtggtgacggcgattacccccgtgtccttcgaccacatggagtacctgggcgacacgctggcggccatcgcgggcgagaaggcgggcatcctcaagccgggcgtgccgtgtgtcgtcgcgcggcaggccccggaggccttggaagccatcctccgcaaggccgagcaagtcggggccccggtgcggctggagggacgtgacttcacgggcgagcgtcagcccgatggtggcctgtcgtaccgcggggcgacctggtccctggatgggctgtccgtcgcgctgcgggggccccatcagcggcagaacgcggcggtggcgctcgcctgcctggaggccttgcaggagcgcggcgtcaccgcgccgcccgaggccgcgcgtgcgggcctggcgtcggcgtgctggccggggcgtctggaggaggtggggcagcagcccatcctcttgctggacggcgcacacaacccggcgggcgtggaggtgctgctcgcgtcgctgaaggacctctacccggggcgtcgcctccacctcgtcttcggcgtggtgggggacaaggaccggggaccgatgatgcgagcgctgttgcccgagtgtgcctcggtgcagctcacgcctttggagacgcctcgctcactggctcccgaggcctacctggcagaggcgcgcgcgctgtgcgcggacgtgactgcctggccggatgcggacgcggcccttgccgcggcgcgcaagcgggcagccgcgaacgacctcgtcctttgtacaggttcactgttccttgtcgggatgatgaaggctcgcatgtatcgaaaccttggcgcgatgcatcagccgccgtag

SEQ ID NO: 4355 - DNA, 786 bp, Myxococcus xanthus
atgctgggctacggctacgccggcatccacaatgacttcgaaggcctcatcaccatcggctctccggcggacctggggcgcggcttcatgctgctgcgcctgctggcgcacggcgcgcccatgctggccgggatgatcgacctgacgctcgccagcctcaacgtgggcggcaaggtggagggggcggggcgctcgctgctcgcgcggggcgtgggcgtgttgaacaagggcctgggacgccggctatcaccccgcgcgcggcggacgctgcgcttcgacgcggtgccggtggacatcatcctcaagacgctggagcgccagctcgcgaaggccgaggactcgccgctgtatcaacagctcaccacgcggttgaaccgtctcatcaatccggagcgcgtgagcgcggatgacatccgctggttgcttcgtgaaggcggggagcgggagccgcgccgggtgctggagcagttcgcgcggtggattcgccggggagagatggtctgctaccgcaccggcttcgacttcaagcggggcttcggtcgcatcgaggtgcccatggccatcatcttcggggacctggacccgctggcctcgctggagtcgacgcgcagcgtgtatcgcgccgccaagagtgagtatctgctctggcgtccggtgaagggcaatagccacatcgagctgacgatggggcatgacatccggcagatctgctacgacatcaagaacctcatcgagtacgcgcggacccaccggtatcgctcgccgagccttccgcggctccgctag

SEQ ID NO: 4356 - DNA, 1434 bp, Myxococcus xanthus
atgaagccgtttgccgcgtggctgctcggtgtggtgctcgtgcccttcgtggcgctcgcgcaggcgccggccacgaacctgaacaccatcaccgcggtgcaggtgaacggtgggacggtgaccatctccggctcgcagaaggccaacttcaccacgttcaccatgacggacccgccgcggctcgtcatcgacatctccgaggccgtcttctccgaggtgcccgaggaaatccaggtgggcaatggcacggtgacggccatccgcaccgccagctatggctccgaggcgtcatccatcgcgcgcgtgctcatcggctacgagcgcgaggtggaggcggacatccaggcccagggcaaccagctcgtcgtccgcgtcgcgggcggcggaggtcaagccgtggcgcaggcgccgggtaccgagaagccccaggcgggaagcagcgccgcggatgccgccgcggccgccgcggcggagcgtcaggcccaggagaaggccgccgcggatgccgccgccgcggcgcgcgccgagcgtgaggcccaggagagggcttccgccgaagccgccgctgccgcgaagcgtgacgcggaggccgaggcgaggcgtcaggaggaggctcgggccgcctctcagcgtcagcaggaggagcaggctcgggccgaggcggagcgcaagcgccaggaggaggcttcgcgtgcctcggcgcaggccgccgccgacgagaagcggcgccaggaagagtcggcgaaggcgtccgctcaatcggcggcggaggagaagcgtcgccaggaggaggccgcgcgcgcgtccgcccaggccgccgcagacgagcgccgggcccagcagcaggccgccgccgaggagcaggagcgacgcaaggccgcggcccgggccgaggccgagcagcggaaggccgctcagcagtccgccgccgaggagcgtcgtgccgccgcgcaggccgcggcggaggagcgccgggcccagcaggaggccgccgccgaggagcgccgtcagcgtcaggctgaggctcgtgcgtctcgggagagccgccagaatcaggcggtggagccctcccggccgagtagctccggttcggaggcctcggtgtcctcgcgtcgcaagacgctgacgctggtcggtttccagcagcagtcgggggcctcgcgcgtgttcatccgcaccaacgagccggtcagctactccgtgtcggagcgggggcgctccgtggtgttggagctggagaacacccgcgtggacgccagcaacaacacgctgccgctggacacgtcctacttcgcgacgccggtgctccgggtggacccgagcgcgtccgggcgggatgtgcgcatcaccatccagctccggcagtccgcgccgttccaggcccgccaggagggcaacgtcatttcattggacttccagcgcacaggccggtga

SEQ ID NO: 4357 - DNA, 2637 bp, Myxococcus xanthus
atgagcttcttcgttccgctcgccgccgcgctgctggtctccacgtcgcaggtgccactcgccaccccgttggctttgcccaacggtgagacggcgcagctggctgcggacctggtcgtctacgaagcggacacgaaggtcgtcaccgcgcgcggcaacgccgtgctgcgcacggagacgatgcagcttcgcgccgacgaggtgacgtacgacgaggtgaaccagctcgtcaccgcctcgggcggtgtgatgttcgtgggccccagcggcctggccgcggtcgccgacaccgcgaagatggatgtgcgcacctacgaggcgaacctcgagggcggcctcttcatgcagaagcagggcgtcacccaggaggccctgttcacggcgaagacgccccaggagctgcgggccatgggggagacgcccctcctcatgagcggctcgcgcatccgccggacgggggagaacaccttcctcgtggaggacctggccttcacgccgtgcaactgcagcccgggtgagcctggctggcgcatggaggcctcgtcggccaccgtcgtcctgggcgagcgcgccacgatgacgctgcccgtggtgtacgtgaagtccgtgcccgtgttcgcgctgccgtggctctacatgccgctgtcccagcggcgcaccggcctgctgctgcccaagcccaccttctcctcgctcaatggcttctccctggagcagcccctcttcatcacactggggcagagctacgacgtgacgctcacgccagggtacttcagcggcggctacgaactgcataccgttcccggcgccaccgagcaggttcgggagccgcgctacctgggcgtgaaggggccgcgcctgctcaccgagttccgttatgcgcccagcgaacggacccggggacgggcgacgctggggttcctctacgacctccggcccatccgggatccgcgcagcttcatgttctaccggcggacggaggacggtgtcgcctcgcctgagttcgtcgatgagcggcgaggactccggggcgaggcgtcctggcaacacacccaggacatggggggagggtggcacaaccgcgtcgatgcttcgttcgtctccgatggcaactacacccgtgacctcacggccgacctcatcacccgcgagttcacctacctgcgcagcacggggacggtgttccaacgccaggacgacctctatgcgggcctcgacgtggcgctgcgccaggacatccggtgggggtaccgcttcttccaggacaaccgcatcccggcggccacggacccggcgcgcccggacctgaaaggccccaacacgttccaacgcttgccggccatcaccctggccctgccggagcggcccgtgctgggcggaatcatggggggcctgtcggttcagtacctgcggctcgcgcccctgcgaggcgggtacggcgacgaggggatcgacggcatcttccgggccgacgggttccatgtcccgttcggctctgccgggtggccgtttcccgcggacaccacgcagtctgatggcatcttcaattcgaacgaccgcgaagcccgcgaccgcgtggacttcttcccacgcctgtcgacgtccttcggtctgggcagtctgatgcgcgtgtcgccgtcgctgggaatgcgccaggacgtgtggctgggcgaggtgtcgggccggacgtggcagcgggggtaccccatcgctgggttgctgctcgaaagccaggtggcgcgcgtcttcgagggccgtgagacgagcttccgccatgccatcaccccctcgctggagctgcgctacgtgccgggcgggtggggccgtcttccctcggccggggcctccggggagaacctggcccgcccctatgacgaagtggatgccgcggtgccgttccagagcgacggccgcacccggggcttcctccacgcggtgctcgccgtggaccagacgctgcgcttcaagcgtggcaacgacatccgcgagccgctgcgcctgcgcatcggacagggcttcgacctcacccgacacgtgcccgcggcggggaaggtggacgatccggggcccgtgctacgcgacaccttcgcccgcctcagcgccaccgccggaatcttcacggccgcgggcaccgttcgctacgaccccaacgcgggccgcatctctggtctctccgcggaggtgaatgtcgacaacggcaaggggcacgccgtgtacgcgcgcttcgacgacctgctgtggaccgggggagatgcgctcaaccgcggcgcggatccccgttccgtggggcccgatgtgctccgccgctcgctggataccttggtaggcggactatcccgagtagagcccggcttccctccggccgaacgggctcaagccctcatcgcgggtacgcgtttgaagctcggatttgggctgggagtgcggtacgaagcaattgtgcacccgctttaccaggatccaataactcgagaaaatcgccctcttgctcagcagacgttcggcctctcgtatgggcctgcatgcgactgttggcgggtagaaggggtggtgacgtcgcggcgagatttggggctggaattctccggcatcaacctcattgtggcggatttcggatcctttggttccggaggctag

SEQ ID NO: 4358 - DNA, 231 bp, Myxococcus xanthus
atgatcgagcgtggcgagcgtgtcccccatgtggagacgctggcggccctggccaacgccctgggcgtgagcctgggcgagctcttcacgggaacggagcagacccttgctcagacggaggacctcctgcggcccctgtctgacttcgcgcgcgcccgtggcctcaccgcccgggacgtggaccgtctgctgggcgtggcccgggtgatgttcagcggcaccgccgcctga

SEQ ID NO: 4359 - DNA, 1539 bp, Myxococcus xanthus
atgcgtccgggtctggccccgtgggtggccttcgcgagcctgctgtttgtcgcatgctcgccgtcggcccccgccacacttgaattcgtggaccagtcaccggctcagccgcgactgggagaaatcaccacgctgcgcttccgcgcggtggactcccgaggccagccgcaggcgggtacgccggtgtccttcacgctggagtcccccgttccgggcgtcgagctgtcgcccaccgagggtgtcaccaacacgggtgacggcatcgtgtccgtgcagatgacggcgcgcggcggccgggtggcctccgccgtggtcatcgccaccgccggcacgggtgccgagatgaagcgggccgtctcgccggtggtcagcttcgcgggaaccaactcgaactcgcgtcagttcaccttccagtgcggctcgttctcgggtgacggctccggtctgcaccacgccgtcggcgcctgggacgagacgcgcgccctcatcgcgggcgtgaaggtccggtgcatcgcccatgtgggtgatcgaaacggtgacggcgtggtgggtgcccaggtgtccttcctcacggaggcgggcaccatcggtcccagcgccgtgtccgtcaccgacgtggtgggcaacgcggaggtcctctacaagacgtccctgccgctgccgcaggacgtggagccgggcatcttcacctggagcccgcagaaggacgcgacccacacgggcgagtacctggcgccgctgtggatgcaccccttcctctgggacgagaaccccattgccgcctacggcaacgccccgcagccccagcaggaccgtccggagccgcgccgtccggaccccatccgccccggcatcgtcctcaacccgcgtgataacctggtctcgctgattgccatcaccagcggtgaggaggccttcgacgacctcaacaacaacggtgtctgggacacgggcgagccgttcgaggacctgaccgagcccttcgtcgacaacaacgacaacggcacgtgggacccgggcgagcgctacgtggacaccaacggcgacggtcgctggacgggcaagaatggccagcacgacgccagcacgctcatctgggtgcaggagcgcatcctctggacgggcatgccccacgggctggacaaggaccagacgcagcggcagctcgacccgccgcccaacgcgccgccgccgctcatcaaccacttcggtggcatctcgatttcgttcatcgtctccgacccctggtacaaccgcatggcccagaacagcggcaatgacggttgcagtggcggagcgtccggccccgtcacggtgtccccggccaacacgggcatcgcgctgacctacccgtccttcaacttcgagacgtacctggtcagcgatgcgcacgagccgcccgccgaaggccccccgccgccggtcttcaaccccccggttgattggagggtgacgcccatctgcaagtacacggcggcacagctggagggccacgaggccatcgtccagggacccgtcgtccggggcaccgtggagtag

SEQ ID NO: 4360 - DNA, 186 bp, Myxococcus xanthus
atggcgctcaccgccttcgtcgtggggctggccgacgcgcgcgaccccgacgccctggagcgggcgaagtcgcagattgccgactccttcctttacggcgtcctcacgggtgcccaggcagcggaggtgtccgaatggaagccggagaagtccgctacgaagtccaaggcacccaagcgctcctga

SEQ ID NO: 4361 - DNA, 783 bp, Myxococcus xanthus
atggaagccggagaagtccgctacgaagtccaaggcacccaagcgctcctgaccattgaccggcccaaggcccgcaacgccttgtccccggcggtggtgcgcgagctgatggccgcgctggagcgggccgaatccgacacctcggtgcgcgtggtggtgctgacgggcgccggtgagaaggtcttctgcgcgggcggggacctgggaaccctggccggtgacgagggcttcctgtccacgcacgagggccgccgttcctatgggcggctgctggcgcgcttccaggagctgcgcaagcccaccgtggcgcgcgtcaacgggcacgcgctggcgggtggcctggggctggtgctcgcgtgtgacctggccgtcgccgtggagggcgcggacctgggcacgcccgaaatcgacgtgggcctcttcccgatgatgatgatggcgctgctccagcgtcacctgggccgcaagcgtgcgctggagctggtgctcaccggagaccggctgcccgcgcgcgaggcgctgacgttggggctgctcaaccgcgtggtgccggccgcggagctggacgccgcggtgggcacgctcgcgggaaagctggcgggaaagagccaggcggtgctggcgttggggcgccgtgccttcttcaccgccgaggacctgccgctgcccgccgcgctggagtacctggcctcgcagctgtctctgaacgtgctggcggacgacgcgggggagggcatctccgcgttcctggagaagcgtcccccgaagtggaacgaccgctga

SEQ ID NO: 4362 - DNA, 774 bp, Myxococcus xanthus
atggcgctcctgacgaggctcggacgaacggcgctggacgcgctccgcggaaccggcgcgctgggcctggtcgtgggccgcacggtgctggcgctgccgaaactggagcgccgcgagctgggccgtgcgctggtgcaattcggctacggctccctgccgctcgccctggccacagcggcgctggccggcatcatcgtggtgctgcagtcgggcatctacgtccagcgcttcggcgcgcgggccttcctcggctgggcggcgggctatggcgtgctgtgggagttcggcccgctgctgctgggcctcatcatgtcggcgcggctcggcgcgcgaaacgcggcggagctggcgctgatgcaggtgggcggacagattgaagggctgagaggcatcggcctggaccccttcgccatcctcgtcgcgcctcgcgtggtggccatggaggtcagcatgctggcgctcagcggcgtcaccttcgcggtggccatcctcttcgagtccgtggccgccctgctcgccctgggccttccggtgcgcgtcttcttcggcaccttctcccagctcctggggccgctcgacctcctgggcggcgtggtgaagacgggcatcttcggactggccatcgccctgctgtccaccaccgtgggcctgtccgcccgaggcggcgcacacgccgtgggccaggcggcggccaacgcggtggtgcgcagttgcgcgcccatcttcgtcctcgacttcgccctcacgtccttgctcgcggggtggatgggatga

SEQ ID NO: 4363 - DNA, 654 bp, Myxococcus xanthus
atggcggaccgctccatcatccgatgggtgggcgcgacgggccgcacctccaccttcgccaacgcctatcccgccccctatctggacgcgctggaggtcccccgccggcccagcacctccccgccggagttcgtcctgacccgcaagtcgcgccgcaaggtgaagccctccgcgtccaagctggccttcgccgcggggggcatccccctgcggacgctcgatgacgcccgcgccggggacgggctcacccacgacatcaccggcgccagcgcccgagcctacggactgcccgcgccagcgcgcacgcccgaggaagccgccgctgtgttctgggacattgcgtcaggcgcggacttcaccttcttcgagcactacctggcggacgaggccggccacgcccaggactggacggccgccctggccgcgctggacgcgttcgacgccttcacccgcgcgttggtggccacgcgccccgtcgaggcccgggtgctcgtctgtagcgaccacggcaacgtggaagacctctccactcggggacacacgcttcaccccgtgcccgtgctctacttcggcccacccgcgcctgaggtggagtccttctccaccgtggccgatgtcggacgcgcggtggttcgctggttgggtgcggagtga

SEQ ID NO: 4364 - DNA, 1119 bp, Myxococcus xanthus
gtgagcagcgtcaatctgatggcccgtgaagtggccgcgaaaatcgttttctacggaccgggcctttccgggaagacgacctcgctgaggaagatctacgagactgtccgccccgcacaccgcggcgagatgatgtccatcgccacggagggggaccggacgctcttcttcgacttccttcccgtgaaggtggagcgcgtgggcgactgctccgtgcgactggcgctctacaccgtgccgggccaggtcttctacaacgccacccgcaagctggtgctccagggcgccgacggcgtggtcttcgtggcggactcgcagccggaggccatggacgccaaccgcgaatcactggccaacttggaggagaacctcttcgagcacggcatccgcctggaccgcttcccactggtgatgcagtggaacaagcgggacctggacggcgtgctgccggtggaggtgctccgcaaggagctcaacccccgaggcgtcccggagctggagacgtccgccgccaatggccgcggggtgctcgacacgctcaaggccatcacccggctggtcatcaaggacctgcgcgccaagcgcatcgtcccgccgccccgccccaccgcgagcgcacagcccgcgggcctggaggcccagctcacccagcacctgcaacaccggcagcagcccggcgccgtcgcgtctcagccggtgcaggctggcggcccggtgcctcgcgtggccccggtggccgtcatgccgcctccgcgcgtggagccgacgcccatccccgcgccccagcccggaccgaagctgctgggcgccgccagcgccctggcgccgggcgacatgttcgaccatgcccgcgccgccgaggccgcgttcatgacgggggactacgccacctgcgtcaccgcctgcaccgacgccatccggcgcgcgctggcattcgcgggcgagggttccctggggcagcaggccttcctgctccgcgtggacggcgccgacctgctccggctccaggggctgggcacgcagcagcacctgcgcgtggatgacgccgccttctccctgtacgtgatgatgcaggtcttcatccgcctcaacgcggtgggcctgcccaacggggagtag

SEQ ID NO: 4365 - DNA, 192 bp, Myxococcus xanthus
atggcgtggaagtgtgacttgtgtggcaagcgtccgctggtgggtaacaacgtcagccacgcgaacaacaagaccaagaagcggaccctgccgaatctccagaagatccgggccagcgttcagggcagcacccagcgcgttctcgcgtgcacccgctgcatcaaggcgggcaaggtgacgaaggccgcttga

SEQ ID NO: 4366 - DNA, 1530 bp, Myxococcus xanthus
atggcgacgtcctctgccaagctcaagcttcccgccgggccgtcccggcatgtctacgacgtcatcgtgctcggcagtcagctgggcggtgcgctcgcggcggccctcctggcgaagcgcaaccaccgcgtcctgctggtggagcacgacggcatggggcccggttacgagcacggtggctacgtgctcccctatgcccccttcgtcgctccgccgctcaaggccatgcccgcggtggaggaggccctcacggagctgggcctcaacgccaacgtccagcgcgcgctgcggccccacgcgccggagctgcagctcctcatgcctcgcagccgcctggacctccatggcgatgccgcccgccgcaaggccgaggtcacgcgggagctgggcgaggaaggcgaatccctattgggcgccctggccggcgccgccgcgcagcacgaagccagtgatgccttcttcaaggcgggccccgccctgccaccggacggcttcttcgagggctggggcctgaagaagctcatccgagcccatcccggcctggcaacgccgccccggctcacgggagacagcgcttcggtgtccctggtgcgggggctgcggcccttcgtcacccacctggaccgtccagaggcgcccctggcgctgactcgggccatgtcccaggtgctgtcggcgccttcctacttccccgggggccatgagggcctgcgcgagctgctcgcccgccgcgtggcggagctgggcggagacgtgctcgggcgcgacaacccgacgggcttcatcgtggaggagctggccttcgacggcagcaagttcgcgggcatgaagctgatgcgctcggacaccatgtaccgcgcgtcctgcctagtggcggccacggacgcgggcgcgctgcggcggctggtgacggacaagaagcaccaccgcggcttgctggaacacctggaccagtccaacaccaaggccctgctcttcaccgtgaactgggtggtgccggagtcggcgctgccccgcggcctgggtgagctggccctgctggacacgggcgacgcggagctgggccccgtgctgatccaggtccaccccgcgcgcgcggccccggcgcacggcggcaaggaggccaaggcgacggaagggctgcgcgtggtgtgcgcgggcgccttcgtcccggcttcggcgagggatctgggcgaggagcacctccagggcctggcgacgcgcatcgacgagcacttggacgcgctgatgcccttcaccgcccagcaccgcgtgctgcgctcggccccctacctggacgccggcggagtccgtggcagccggctgatgccgcaccccttgttcagcttcgagtcggaagcggtcctgggcgtcacgggtttgactcagcgcacgccggccaagaacatcctgctcgccaaccgcgaagtcctccccgggttggggttggaaggcgagctgctcgcgggcatccgggccgcacggctggtgcaggatatgttgaagaagaaggatccgctcaagggctga

SEQ ID NO: 4367 - DNA, 657 bp, Myxococcus xanthus
gtcttcgacatggacggcaccctcgtcgacaacatgcagttccacaacgaggcctgggtctcgttcgcccagaagctgggcttgccgctgaccgcgaacgacttccagagccgcttcgccggcaggaagaacgaggagatcatccccgagctgctcggccgcccggtggcccctgatgaagtggagcgcatcgccgaggagaaggagaaccactaccggaccctgtaccggccgcacctgaagctgcaccggggcgcggaggccttcatccagcgattgaaggaggcccacgtcccggcggccatcgccaccgcggcgccccagggcaaccgcgagctggtgctggacgggctcggcatccgtcccctcttcgcgagcatcgtcggtgccgaacaggtgacgcgcggcaagcccgccccggacatcttcctggccgccgccaaggcgctgggcgtggcccccaccgagtgcctcgccttcgaggacgccgtcctgggcatcatatccgcccgagaagccggcatgacggtggtgggattgaccaccgccgcgccagaggccgacctccgcaaggccggcgcgcactgggtggtccaggacttcacccagttgccccctgcgctggagcagcgcctcttcagcgcccaggcccgctga

SEQ ID NO: 4368 - DNA, 1698 bp, Myxococcus xanthus
tacaagcagtccggagtagacatcgaggccggcgacgcgttcgtcgagcgcatcaagccccatgccgcgcgcaccatgcgccctgaagtcatgggcggagtgggtggattcggcggcctgttcgccctgccaccaggcaagtaccagcagccagtgctggtggccggcacggacggcgtgggcaccaagctgaaggtggccttcgccgctggacgccatgggacggtgggcatcgacctggtggccatgtcggtgaacgacatcctcacctgcggcgccgagcccctcttcttcctcgactacttcgccaccgggcgcctggaggtcgacgacgccgccgaggtggtgaagggcatcgccctgggctgcgagcaggccgggtgcgccctgctgggcggcgagacggcggagatgccaggcttctacgcgcgcggcgaatacgacctcgcgggcttctgcgtgggcgtggtggagcgcgcggccatcatcgacggcaagagcgtgaagccgggtgacgcgctcatcgggctcccctcctctggcctgcacagcaacggctattcgctggcgcgcaaggtgctgctggacgacggaaagctggccctggacgcgacgcccgagggcctggaccggccgctcgtggacgcgctactggagcccacgcgcatctacgtgaaggacgtgctggcgctgctccaggcggtgaaggtgaagggcctggcgcacatcaccggcagcggcattccaggcaacctgccccgctgcctgccggacggcacgcgcgcggtgctgagtgagcagacttggcccaagccgcccatcttcgacctcatcgcgaagctggggagcgtggcccgcgacgagatgttcaacacgttcaacatgggcctggggctcatcctcgtcgtggcgaaggaagacgtcgcccaggcgctgagcgtgctgagcggccggggcgtgcaggccttcgaggtcggccgcgtggaagcgggccagggcgaggccacggcggtcatcgacccatgagcggccagcgagtccgcctgggcgtgctcgtgtccggcagcgggagcaacctccaggcgctgctggacgcctgtgcgcgggaggactttcccgccgaggtggcctgcgtggtgtccaacgtctccaccgcgttcgcgctggagcgggcgcgcaaggcggggcgtgacggccaaggtggtggaccacaaggcccacgcgacgaaggagggcttcgagaaggccctgctggacacgctgcgcgcggcgaacgtggagtgggtgtgccttgcggggttcatgcgcttgttgagcgcggacttcctgggccactacgcggggcgggtgctgaacatccacccgtcgctgctgcccgccttcccgggcctgcatgcgcagcgacaggcgctggagcgaggcgtgaaagtggccgggtgcacggtgcacttcgtggacgcgggcaccgacacggggcccatcatcgcgcaggtggccgtgccggtgctgccggatgacgacgagaaggccctgagttcgcgaatcctcgcggaggagcaccggctctacccgctggccgtgcggctcgccgtgacgggcaaggtgacgctggacgcggcccgcacgcgcgtggaggcgcgggccacggtgggcgaactggcgcttcggaatcccggcgcgacggtcgacccggcgtga

SEQ ID NO: 4369 - DNA, 651 bp, Myxococcus xanthus
atgggccccgtcacgccgggcgcaccgcaggtggagctgacgggcacgctggacgtcgtggagtccggctacccgtctcgcgagctgcgcgtggccggcaagtacgtgaagccgcccgcgtcggtgcgcaagcgcatggccgcggaccgccgcgccttcgcggaagccttcgcccaggacttcagcgcgccgcacttcgcgcagaacttcgtgtggccgagggcggaccgcatcaccgcgcccttcggcgaccgccgcaccttcaacggaaagctgtccagtcagcacttcggcgtggacatcgacggggacccgggcacgcccgtgcaggccgccaacgacggcacggtggtgatggcgcgcgacaactacgcggcgggcaacaccgtgctggtgcaccacggtgcggggctctacacggcgtacttccacctgtcccgcatcgacgtgaagacgggcacccaggtgaaacaaggccagctgttgggcacggtgggcagcaccggccgcgtcaccggcccgcacctgcactggggcgtgaaggtggacgggctgtgggtggacggtgagcgcctgctgaagctggacttcttcccgcacctgccgcccagcgtcgcccggggcggcaacaccgagctgggcacgccgtaa

SEQ ID NO: 4370 - DNA, 693 bp, Myxococcus xanthus
ctaaagcgggcgctgctcgaaggcttcgtgtaccgcttcaacgtgggtacggacgtggcggtgctcctgctgggcatggggcgtgtgctgcgggagcagggcagcctggaggcgttgttccttcaggggctccagtcgcgtgacaccttgcacggcgcgttggaccacttcacgacgggcctgcgcgccatccccatggacgccttgcgaaaggccctggggccggagcgcggcctgcatcacctgctgccctcgccgctgggcgggggagcggccaagcggctcaacctctacctcaggtggatggtgcggggtccggacaccgtggacttcggcatctggaagcgcgtgccaccttccgcgctcctgattcctttggacacccacattggtcgcatctcgcggcacctgggactgactttccgcaatgatttgacgtggcgcacggcggaggaggtgacagccgcgttgcgtgtgttggacccggccgaccctgtccgttacgacttcgcactgtgtcactacggcatgagtggggcctgccccgcccaacccatcgcggagaattgcggtcgctgcccgctgctgccggcgtgtgccgtggggccacaggtggtggcgacggcgacccgccgggtccaaggaaccaccgctcggaagcgcagggaactgtcggcgacgcgacgacgttga

SEQ ID NO: 4371 - DNA, 981 bp, Myxococcus xanthus
atggagctgcgtgaggtggtggccgaagcgcaggagggcgctggtcgcgtcagcgcgattgtccgcgacctgcgcaccttctcccgcgcggatgaagagctgcatggtccggtggacatggtgcacgtggtggacggcgcgctgcggctgctccgcaaccagattgggttggtcgcccggttgacgtgcacgttggagccggtgctgcccgtgcatggcaacgaagggcgcctcacccagattgtcgtgaacctgctgttgaacgcgctccaggcgctgccggaccgtgcgcccgaggagaaccgggtgcgggtgtccctgcgcgccagcagcagccggcacgtggagctggaggtctccgacaacggacacggcatggcgccggacgtgcaacgccgcatctttgacccgttcttctctacacgccccgtcggagagggcacggggctggggctgtccatcagcctgacgctggtgcaggccatgggtggacgcatcgaggtctccagcgcgcccggctggggcagcaccttccgcatcgtcctacccgcgcaggccgcgggctggacggatggcgcggagcaaacgcaggttgtggagccggcgcccgctcgtatccgtcgacgtctgctgctcatcgatgacgagccctccgtgggcaactcggtgagccggctggtgcgtgacgtgtatgagattcacgtcgtccaggacgcgcgcgaggccctgcgcttgctcaccatgggagagcggttcgatgccatcctgtgtgacgtgatgatgccgggcatgagcgggctggacttcgtggtggagctggagcggctggcgccggagctcgcgctgcgcaccgggctgatgacggggggcgccttcaccgcgcaggcgcgtgagttcgtgggccgccgcacgcgcgggctgctggagaagcccttcgagcgcgagcgcctgtgcaccttcgtggagcacctcatccaatga

SEQ ID NO: 4372 - DNA, 699 bp, Myxococcus xanthus
atggacctgcgcgcggacggcctcacggtgcggtacggagcgaggcaggtcctgtccggcgtgagctgcgcgctgccgcccgggacgcaggcactggtcctggggcgctcgggcgcggggaagacgacgctggtgaaggccctggccggcctggtgcggcccacggagggccgcgtgctgtgggatgggcaggatgcggcgcgtctgacggccgccgagcggcgcgagcagcaggcatcgttcggcatggtgttccagacggacgccctgttcgactcgatgacggtgctggagaacgtcatggcgccactcacccgccgccacgtcccggaggccgaggcccgggcccgcgccagtgacgtgctgcgggcggtagggctcgcggacgcggcgggtacactgccggagcgcctgtctggcggcatgaagaagcgcgcgggaatcgcgcgggccctggcggcgcgtccgtcggtggtgctggcggatgacccgttcgccgggttggatccgggcacggcgcggcaggtggcccgggtgctcctggacgtgtcccagggtggcacgctgctggtcgtggcgacggaggctccgatggacctgcccctgccccgctggctgtacctgcggaacggccggctggttcatgacgggccccccgcgcccgagtgggaggatgcaccggacgaggtgccggcatga

SEQ ID NO: 4373 - DNA, 1155 bp, Myxococcus xanthus
atgatccgtgcggcgcggcggagtctggcggcgtcgctggtggcgctgctggccgcgggcttgttcgtggtgccggggtggctgcagggcttgtcgctggtggtgcgcgctgcgggcatgcagggtcgcgtggagacggcgctcgcggactggcgcaccgggcccttcgacgtgagcgacgtccaggtgcccacgcgccacggtccggtgcgtgcccggttgtaccggccggtgacgcagcgcggacgcacggtggtgttgacctcgggcgtccacgcggatggcatcgacgagcctcggctcgtgaagctggcggaggacctggccatgggcggccaggcggtgcttaccccggagccgccggacctgctgcgctacgaaatcacgccgcgcctgccggacatcatcgaggacgccgccgtgtgggccgcgtcgcaagcagacctggcgcccgacggcaaggtgaatctgttcggcatcagcttctccggcggcttgtcggtggtggcggcgggacggcccgccttgcaggaccgggtggcggccacgctctccttcggcggtcatggggacttgccgcgcgtgctcaccttcctgtgctcgggcgacttgccggatggaagtcacctggccccgcatgactatggcgtggtcatcatcctgctcaacgtggcggagatgctggttcctcccgaacaggtggagcccctgcgcgcgggcatccggaccttcctgcgcgcatcccatcaggccatggtggatggccgcctcgcggcggagacgttcgccaaggcgcgtgacctccaggcggagctgccggagcctgcggccacgttgatgggctacgtgaacacgcgcgacgtggcggcgctcggcccacgcttgctgcccttcgtgaagacgttcgccgcggacccggcgctgtcgccagagcgctcgcctccgcccaccgcgcccgtcttcctgttgcatggcgcgggggacacggtgattcccgccatggagtccagccggctggccgcggctctgcgtccccacaccgaggtcaacgcgctggccacgccgctcatcacccacgcggagatggacgggccacaggcactgatggacgtgttgcggctggtacacttctgggcggacctgctcgacgcctga

SEQ ID NO: 4374 - DNA, 279 bp, Myxococcus xanthus
atgggggccttccccgtccggctgccggagaagctcgcgaagacccatggcacccagagcggcctcaaggtcgcgagcgtggagccggatggcccggccgaggaggcggggctgcatccgggtgacacgctgctcacgctcgaggggcagccattgcgagaggtggatgacctggtcgcgcagctgcctccggaacgtgtgggccagaccgtgcacgcaaaggtgctgcgcgccggggctgccaaggtcatcgacctcaccgttggcgcgcacccctga

SEQ ID NO: 4375 - DNA, 801 bp, Myxococcus xanthus
atgaaagccctgctcgatgaggccgagccccacttccaggcgaagcgctacgacgaggccgcgaagctgtacgcccaggccacggacctgtgtcccgagtgctacgtggcgtgggtcttccggggtgacgcggactacttcgccggagacgcggccaccgcgctggagcactacggccgcgccaccaccctcaacccctatgaccaccgtgcctggttcttccagggcaatgccttggcgaagctggggcgcttcgaggaggcgctggatgcctgggcgcagtgcctggcgctgagcccgcgctatcccatcatccgccagttcttccgcaccaacgcccacctggggttggtcatccgcggtgacaccattgttccgcgcgggtacgccgagcgcgacgcggagggcgtctccatccagttcgaccccaaccacgaccctgcctggctggcgttcgccaattgcaaggccctgtggctgggcgagccgtcacaccgggcgaagatgacgggctccaccgaggagcagttcacctccgtggaggagatggagtgcctggcatcggcgctggccgtccatgagagccagaaggcggagggcaagacggatgccttggaccccacgctggaccgcctcttcgccatcgcccaggaggggctgctgctggaggcggtgttgttcgaggtgggcgcgcgcgtccaccctcaaatcgcgctcaccctggaggatgagctccgccggcgcctcaagaagtacgtcctgacgcacgtcctggtgccggcgggaggccacgggggctga

SEQ ID NO: 4376 - DNA, 201 bp, Myxococcus xanthus
atgcccggctggcggcgctgggcggagcagagcctgggctccaaggacctcttctatccgtaccgcgaggatgtgcccctggagacggcggatgcgaaggcggtggacgcgctcgccgcgctgctggcctgggcgcgctcggagcggcggccagaggaggtgctcgtcatctcccacaacgcgaggcccccattcgaatga

SEQ ID NO: 4377 - DNA, 1065 bp, Myxococcus xanthus
atggcggatacggcagagaaccctcttgggctgaatggcttcgagttcgtggagttcaccagcccccagcccgaggtgatggagcacctcttcgagcggctggggttcaccgcgtactccaagcacccgtccaaggagctggtccgctacaagcagggcggcatcaacctgctcatcaaccgcgaggcttccgggcaggccgctgagttccgcgcggagcacggcccgtccgccagcggcatggccttccgcgtggcgaacgcgcgcaccgcctacgagatggccctggagcgtggcgccaaggcggcggacccggagcggggctcgctgggcgagggctcctatgtcctggagggaatcggtggcagcctgctgtatctggtggaccgccacggggagaaggggacgctctatgactcctggcaggagattcctggcgccgaggcggccgaggcgaagaacagcgtgggcctggagacgctggaccacctgacccacaacgtgcgccgcgggcagatgcgcacctggtcgtccttctacaaccgcatcttcggcttcaccgagcagaagtacttcgacatcaagggccaggccacgggcctgttcagccaggcgatgatcgccccggacaaggccatccggattccgctcaacgagagccaggacgacaagtcgcagattgaagagttcatccgccagtacaagggcgagggcatccagcacctggcgctcaccacgccggacatctacgacaccgtggagcggctgcgcgcgcgcggcgtggtgctgcaggacacgctggaaacctactacgacctggtcgacaagcgcgtccccaagcacggcgaggacctggcgcggatgcgcaagaaccgcatcctcatcgacggcagcgaggaagagggcctgctgctccagatctttaccgagaatctcttcgggcccatcttcttcgaaatcatccagcgcaagggcaacgagggtttcgggaacggcaacttccaggcgctcttcgagtccatcgaactggaccagattcgccgcggcgtcatcaaggtcgactag

SEQ ID NO: 4378 - DNA, 1279 bp, Myxococcus xanthus
gcctatctgtctggctttggcaacgagttcgccaccgaggcggtgcccggcgcactgcccgagggacagaactcaccccagcgggcgccgttcggcctctatgccgagcagttgtcgggctcggccttcacggccccgcgccgggagaaccggcgctcgtggctgtaccgcctgcggcccagcgccaaccaccctgcgttccagccgctggcgcagggactcttgcgcagcgggcccttcgacgaggtgcccgcctcgcccaaccggctgcggtggagtccccagcccccgccggcccagcccactgatttcgtggacgggctcgtcacctacgcgggcaacggggacgcggcgtcaggggcgggcatcagcatccacctgtacgcggccaaccgctccatggtggaccgggtgttcttcgacgcggacggtgagctgctcatcgtcccgcaggcggggcggctgcggctggtgacggagctgggcgtgctggacgtggcgccgggcgaaatcgcggtggtgccgcgcggggttcgcttccgcgcggagctgccggagggccaggccgccggctacgtctgtgagaaccacggtgcgttcttccggctgccggacctggggcccattggggccaatggactggccaacccgcgcgacttcctgacgccggtggcggccttcgaggacgtggaccggcccacggaggtggtgcagaagttcctgggcaatgctgtggtcggcgcggtattcgtactcaccgctggacgtggtggcgtggcacgggaacctggtgccgtacaagtacgacctggcccgcttcaacaccatcaacacggtgagcttcgaccatccggacccgtccatcttcacggtcctcacgtcgcccagcgaggtgccgggcacggccaactgcgacttcgtcatcttcccgccgcggtggatggtggccgagcacaccttccggccgccctggttccaccgcaacgtgatgagcgagttcatggggctggtgcacggcgtctacgacgcgaaggcgggcggcttcgccccgggcggcggctcgctgcacaactgcatgagcggccatggcccggaccggaccagctacgagcaggccatccaggcggacctgaagcctcacaaaatcaaggacacgctggccttcatgttcgagtcgcgctgggtcatccgtcccacgcgcttcgccatggagacgcccgcgctccagcaggactacgacgcgtgctgggcgggcttccagaaggcgaagttgccttga

SEQ ID NO: 4379 - DNA, 387 bp, Myxococcus xanthus
atggcccaaatcgacgatcgcgtgacgccgccccctcagcgacactacccgcccacctcgacccgcagcagctccgtggctgacatcctcgagcgggtgctggacaagggcatcgtcatcaccggggacatcaagatcaatctgacgaacgtcgagctgctgaccatccagatccgactgatcatctgctcggtggagcgggcacaggagatgggcctggactggtggacgaccaaccccaacttcagctcccgtgcgcgacagcagctctcggcggctcaggcgcccgtggcggctccggctcgaggtgcctcggccgaaccggcagctccggccccacgtgctgctcccaagcccagacgcgcgcccaaggccaagaaggtatag

SEQ ID NO: 4380 - DNA, 327 bp, Myxococcus xanthus
atggcagtcgagggcgcaccacaggcggtggaggagctcgcccgagcgttggagccgacgaagccgcccaagctggaactggacgaggagaacgtccaggccgggctcgtacggctggtgctcgccgtcgtcgagctcatccgccagttgctggagaggcaggcgctgcgccggatcgacgccggctcactgagcgaggagcagattgaaaggctgggcgtcaccttcctgcgcctgcaggagcagatggatgtcttgaagaagcaattcgacctgacggacgaggacctgaatctggacctcgggccgctgggcacgacgctgtga

SEQ ID NO: 4381 - DNA, 222 bp, Myxococcus xanthus
atgaacgggcaggcgacgacacccgaggcacagcaggagcgcgcctcggtgttggagttgctggaccgggtgctcaacaagggcgtggtcatcagcggtgacctggtgatttcagtggccgacgtggacctcatctacctgggcctgcggctgctgttgacctcggtggagacggcgctggaggtgggcacccttcccgaacatccgcagcgcttgcagtga

SEQ ID NO: 4382 - DNA, 258 bp, Myxococcus xanthus
atgtccccggttcggagcatcgcgtggatcttccgctcggtgcacaaggccgttcaggacgaacaggcccaggaacagaccgacctccgcacccgcctgagcgacctgtaccaggagctcgagcgcggcgagatcacggaggagcagttcgatgagcaggagtcgcagctgctcgaccgcctggacgcgttgaaggcagcgcaggagggggcagggcctgcgcctcctgaaacaggccctggaggtgaaaacagatga

SEQ ID NO: 4383 - DNA, 621 bp, Myxococcus xanthus
atggtgggcttcgaaagcggcaacagcgtggcgctgtacgcggtggacagccagggccgcatcctccgctggaactacgaggagggcgcccccacgcaggcggcccccgaggagctcacgcggctcaacgacaacctcaagtccattgacggcaccagcccgcggacgctgttcgccgcgggcgccgaggcacagggcggcaccaaccaccccgtggtctggcgcggccccacggaggacggcggcacgtggcagaaggaagccctgggcaacgtcgggtcgaccgaattcctcttcggcatccaggtgctctcaccgagccatgtctacgccgtgggtgacaaaggcctcttcctggagcgcgcgggcacgacgtggagcgtgaagcccgccatcaccctgccaacctcggccccggcggacatccgcggactggtggccttcggcagcaaggccatctacgccgtgagctccggaacgaacaacatccacttcttcaacggcacggcctggagcaccgccttcgcgccgtccagccccatgaacgcgctgagcggaaccggcccggccgacgtctgggtggcgggccacagcggcgcgctcgtgcgctggcggccctga

SEQ ID NO: 4384 - DNA, 573 bp, Myxococcus xanthus
atggaccaggcgccgatgctaccagtcgcgttcggcatcattgccggcagcgagcgggaagtacggaacctgctggccgagcacgcgaacgacttcctcacgcagctccgtgcggtgagagggaacgtggagatgggccttcggatccggctgagcgaccccgatgcgttcgggtactacgtcaacgccttccccgagctcaaggcgatgcgggacgacctctaccgcgagggggagccgtcgcgcgaagagaagatcgagctggggaagtacttcgtcgacctgctcaacggcttccgtgaggcgaccgccgacaaggtgctcgatggaatcgagtccgtggccaggcagaccgtggtcaacgagccgcgcaatgagtcggaggtggtgaatctggccgcgctggtgccacaaaagaaggtcgacgccttcaacgcgaccgtggagaagctgggcgcgacgctgcccgagaacttccaggtgaacgtgaccggaccctggccgccgtacaacttcacccatctgcgaatccacttcgaagaggtggaggaggcagcgcagggggcgccttga

SEQ ID NO: 4385 - DNA, 756 bp, Myxococcus xanthus
atgtacggcatcctggacgcacggcaggcagcgaaggagtcgctgccgccggggctgaaccaggcgccgctgatggcggtgaagcacggcaacctggctgcggccatctcgccggtggaggaggagctggcctcctcggccggcatcgagcaggcgctggagtacgcccgggtggtcgagcagttgcaccgccgactttcggtgttgcccatgcgctacggctgcttcgtccatcaccccgaacaggtggtggagttcctgcaccgctacgagcggcagttctcggacgcgctggcccaggtggagggctgtgacgagatggggctgcgcatcctgttccaggagtcggacgtggccgagcccccggagcaggcaggggcgcccaccggggcggacgcccagacccgcggacgggcctacctggacaaccggcgtcgcttctacgcgcagcagacacgtgtggaccgcgctgcccggcgcatggcggagcgggcgcaggcggccttctccgggcagttcgtccgctgcacctgggaccatgccgctcgcccagacgggcagctgctctccatggccttcctggtggagcgccccaagctcgccgagttccggcgggccttccttcgcttccagaaagacggccccggcaatgtgatgtgcagcggcccgtggcccccctacggcttcgttgcagacctggcaaagcctgccgtcgcggccctcgccgagctggagcacctccaagagaaaggatga

SEQ ID NO: 4386 - DNA, 306 bp, Myxococcus xanthus
atgcagcgcgagctcgacgtgcgcagccgcaacgagggacagagcctggcggcccacatccgcgaggaactcgccccggcggcgctctcggtgaaacccctgcgcctggcagatcgcgggatctcgggccggcaggacgacatggtgctgaactccgcgttcctggtgcactccgggcaggtgcagcggttcgcccagcgcgtgcagcagctcgcggcccggtaccagccgcaggggttgacggtggagacgaccggcccctggcctccctacagcttctgccccagcctggaggagcggccgtga

SEQ ID NO: 4387 - DNA, 2084 bp, Myxococcus xanthus
aaagacctgggccgtggcctcgcccgcatggaccccgccgacatgaagcggctgggggcgcatgtcggcgacatcgtcacgctgtccggcaagcgccgcagcgcggccaaggtgatgccctcctacccggacgcccgggggcgcggaatcctccagattgacggtgtgacccgggccaacaccggggtgcagttggacgaaccggtgaagctgaccctggcccccgcccgacacgccgagaaggtcgtgctggcgcccctggagttcacccccgcgcagcgtgacctggcctacatcggcacgctgctggacggactgccggtggtgaagggagaccgggtccgcgcgctgctgttcggcagccgcacggccgacttccgcgtcgtcgagaccactcctgtgggggcggtggtgattcaccccaacaccctgctggaggtcgccaaggcgccggagaaggagaaggtgacgcacgagcgggcgcgcgccgtcagctacgaggacgtgggtgggctgaagcgggagctgggccgcatccgcgagatcgtggagctgccgctgcggtatccggaggtgttcgagcggctcgggatcgacgcccccaagggggtgctgctgtatggcccgccgggctgcggcaagacgctgatcgcccgggcggtggcccacgagacggcggcggcgttcttcaccatcaccggcccggagatcatgcacaagttctacggagagagtgaggcccacctccggcagatcttcgacgaggcccagcgcagggccccggccatcatcttcgtggacgagatagacgccatcgctccccggcgcgagaacgtgcagggcgaggtggagaagcgggtggtggcgcagttgctgtcgctgatggacggcctggcccaacgccggcacgtcatcgtgctggctgccaccaacatccccaacgtgctggacccggcgctgcgtcgcccggggcggttcgaccgcgagatcgccatctccatcccccgaccgcacggcgcgcaaaggagatccttcgccatccaccagccgggggcatgccgctggcagaggacgtggacctggaccatctggcggccgtgacgcatggcttcgtaggcgcagacctccaggccctgtgccgcgaggcggcgatgctctgcctgcgccggctgattccccacatcgacttcgcctcggccgagattccctacgacgagctgatacaggtccaggtgacgatggccgacttccaggcggcgctgcacgaggtggggccatcggcgatccgcgaggtgttcgtggagaccccggacgtgggctggaaggacgtgggcggactggggcagctcaagcagcggctcatcgaggcggtggagtggccactccggtaccccgaggagttcgcgcgggccaaggtccgcccccccaagggcgtgctgctgagcggccctcctggctgcggcaagacgctgatggccaaggccgccgcccacgagagccaggtcaacttcatctcggtcaagggcccggcgctgctcagcaagttcgtgggggagtccgagaggggggtgcgcgagacctttcagaaggcccgtcaagcggccccctgcatcatcttcttcgatgagatcgactcgctcgtgccgacgcgctccgccgggggaatggacgagcgcgtcacagagagggtcgtcagccagttcctggccgagatggatggcatcgaggagctgaccggcgtgctggtgctcgcggccaccaaccgcgcggacctgctcgaccctgcgctgctgcgcccgggacgcttcgacctgctcgtcgatgtgccgctgccggaccgcgaagcgcggcgcgacatcttccaggtccacctgcgcgacaagccggtggagaaggacctcgacctgggcggactcgctgcacgcagcgagtccttctccggcgccgacatccaggccgtgtgcaatcaggccgcctgggaagccgtgcgtcacgtcatcagcggcaagggaaagcggctcgtcatcacatccgagagcctgctcaaggcgatccgagggcacaaggaggcacgccggccatga

SEQ ID NO: 4388 - DNA, 525 bp, Myxococcus xanthus
atggcagagaagactggcatcagcggtggagggttcctcgaaggaatcaccaccctcgtcacgaaactggcggagctcgcggagaagagcgaacagctccaacgctccggagagttcggagcctccgacaaggggctcaggggcgtctatggcttcaacgtgcgaatcggaggaggcgcacccggtcaaccgagcggcattccgcgcgtggagcccttcgggaacatccgccaggatcaccagaccggcaaggcggtcgtccaccccatccgcgagcccctggtggatgtcttcgaagaggggccggacgtgctggtggtggccgagctgccgggtgtcgaccgcaaggacatcacgctggagctccgcgaagacatcctgaccctgcatgccgagcacgaggcgctcaagtaccacaaggaggtcctgctccccaggcgcttcacccgccggcagatgcacaccaactgccgcaacggcgtcctcgagatccgcctcaccgcccaggaggagcgccgctcgtga

SEQ ID NO: 4389 - DNA, 249 bp, Myxococcus xanthus
atgggaaacccgggcatcgagtacacgcaccaggcgctcgccgcccgcgtggagggcaccatgatcgccaagtgcgtcatcacggtgcgcggcgacgtgacggactgccgcatcatcaagggcctgcctcacatgaatgaggccgtgctcgatgcgctccacgcccgacgctacaccccggtgcagttccagggccggacggtgagcgtgtcctacgtgttcaccctgcggctcaagctgccgcgctag

SEQ ID NO: 4390 - DNA, 456 bp, Myxococcus xanthus
atgctcaccgcgcgctctctggaggacgacatcctcaggggcttcgaggtgggcgcgcaggactacctcaccaagccctaccggctgcgggagctgctggcccgggtacgcgccctggtgcgccgctccggcacggcgccgccggagcagatgggcttcagcagcttcaccctggacctgggccggcggcaggtgtcgcgcgcggacggttcggtggtggagctgacgcgcacggagttcgacctgctggccttcctgctgcggcaccaggaccgggccctgccccgaggcgaaatcctggacgccgtctggggccgcgacgtggtggtggacccgcggacggtggacaacttcgtctccagcctgaagaagaagctggggtggacgagcacctctggattctccatccacaccatccggggcgtgggctaccgcatggaggtcgcttcgtcatga

SEQ ID NO: 4391 - DNA, 1830 bp, Myxococcus xanthus
atgctgcgccggctccttcctacgctcgtcgccctgggttgtggcctcctggcccttggctgggggctggtcagcctccagcgcatcttcagccaggagcgtgatgacgcccacgcgcagctgcgctcgcgccgggacgcgctggcccacgcggccgaagaggccctgcggcagaacctggcgaagaagctcgatgagagcatcccccccctccacgccgccgtgggcgacccgctcgagcccggcgagggctactacatcaacttccgcggctaccagttcctgccgcgcctcaccatccccatgccgggtaccgggacgcccgcgcgggacgtgcatgccctgctgggcgcgaggctgaaggacggcgcccccgcgggggaatgggagccccgcctcacgcggctgcgcgcggtggaggcggcgctggcggcccgggacgcgcggggcgcggccacccgcgtggaggagctgctgcgctaccacgcggcgaaccggctgacaccggagcaggagctgcccttcctgctgctggtggtggagcggctccagcgcggccctgccaccatgccgctggtgcgggccctgctgcgcgagggccttccagaggacctgggcggcttcgcccgggcgtcggggctgcagcgggacgtgctgcgcgagcgctcacgcttcacgcgggcggacttcgacttcctccatgcgcgcatcgtccgggtgagcgccgcactgggcgagcccacgggcgacttcctcgccagaacgggcgaagcgggcgcgggcatgctggtgattccccagtagctctacgagcccaccctcctgggcgagtcctggtacgtggcgctgctcggcaagacggtgtacggcatcgcggtggacctggaggcgatgctccagcccatcacccaggacatgcaggcgcgcggcctcttcgacgcgacggggcgcctgcggctgcgcgcgggcggcgccgtccgtcccctgagcacgctgaagctggcggtggacatgcctcagtgggcgcgccaggaggcggacatcgacgcgcgctacgggctgaagacgctgctggtggccgtgtgcggagggctcgcggtggccatcttcgcgctcgcggtggtggcccagcagcgcaagtaccgcttcctggagctcaagagcgacttcgtggccaccgtctcccacgagctgcgcacgcccctggcctccatccgcctgctcggtgagacgctggagcggaagctggcgcaggcaccggaggtgcgcgactacccggcgcgcatcgtccaggccgcggacgggctgcacttcctggtggagaacatcctgtcgttcaaccgcatcgacaagggccgctggacgctgcggacctcgcgcgtgcggttggaggagctcatccccccgttgcgcgacgacctggccaatgcgaccaacgtccccgtccacatcacctcggatctggaagatgtggagctggaagcggacccgggcctgctgcggatggtgttctccaacctgggccgcaacgcgtgcgcctacaaccggagaagccccgtcgaaatctccatccgcgcgcagatgattccgggctacggctgcacggtgctcttccaggacaacggcatcggcatccccgagtccgaatgggagaacgccttcctggacttctaccggctgacggtgcccggaccggaggtccatggcagcgggttgggccttgccctgtgccgcaaaatcatgaagctgcaccggggcgacatccaggtggccgcctcgggacccgacggcaccaccttcgcgctgatattcaacgagccggctcgatga

SEQ ID NO: 4392 - DNA, 669 bp, Myxococcus xanthus
cgcatgaaggcgaagatcgccagccgcgtgggcgtcacgccgcagtgggtgaagcctcccgccaagttccagctcctctacaagaacggccaccagttcttcggccgggccgcgtccctgcgctgcggctacttctccgcggacagcggcggctgcaccatctggccctaccgcgaagccgtctgctccaccttcttctgcaagtacgtggcgggcgcggacggccgcaagttctggatgtccctcaagacgtacctgacgctcgccgaaatccaactgtcacgctggacggcgctccagctcctccccgactacgtgctgaccggcagggaccgcgcggagacacagcccgggccgctcaccgtggaggacctggatgacaccgcgccgcccgccaaggcctacgcggcgctgtggcagggttacgagggactcgagctcgactacttccgggagtgctaccggatggtgaaggcgctgcccccggacggcgtggagaagctgctgggcctggatggcaccatcgagctgaagacgctggagaagctccaccacaccgccgtggcgccccagttgcctcgcacgctcaagctcaaccccgatgccaccgtccagtggatgcaggacggcagcgtggcatgggcgcgtacagcgaatacgacacgtggc

SEQ ID NO: 4393 - DNA, 567 bp, Myxococcus xanthus
atggaggtggagcggcgccccacgttgacggcggatgggaaggtggtggcctcgccgccgcccgcggcgctcgcggcggaggtggagcaactgcgcgccgaggtgcgcggcatggtcgccggcgaagcgctgaactccgagggcggccgcgactacctcaaggacgcggtgcgcaacgtccagaacgagatgcgcaatgagcagcgcgccgagcggcagcagcagtggcagcaggcgcaggttcagcagcaggcgcaacagcaggagcgcgtgcgcaagttcatcaccgacgctcggctgaactacacccaggagcagacgctgtcgcgccggctggaggcggagtccaccaagcgccaggcgctcatggaggaggtccgcgccggcacgaagaccgtgcgagacatgcgccaggcgctgcgcacggagagccagcagaccgaccaggagatgaacgccatcctcgacgaaggccagcgctcccagtaccagtcgctgcgccgcgaggaccggcccgtgggtggccccccgggcggtcagcgcggtggccagggccgcggccgctga

SEQ ID NO: 4394 - DNA, 2403 bp, Myxococcus xanthus
atggattcgctcctccaggacctccgctacgcgatacgcacgctgacacgaacccccggcttcacgctggccgcgggcctcacgctggcgctcgtcattggggcgaacgccgtcctgttcagcgccatccacgcgatgctgctgcggcccctgccctttcccctccccgaatccctggtccgtatctggtgcgtgcaggagtcggtgagccacgcctcggtggcggcaccggagttgctcggctggcgggagcattcgaagggcttcagccagctcgcgggcttcggacgcaccagcctcaaccggacgggaacggacgagcccgagcgggtgcgggcggcgcgcatcacccccaacttcttctccgtgttgggggtgcaacccgcgcaggggcgcgacctgcgtgaagaggacgcgccgcccgggggtgacacctccgtggtgttggtgagccatggctactggcagcgggcgctcggcggcgtcccggacgtggtgggccagacgctggtgctcaacggccggagccacgcggtggtgggcgtgctgccggaggacttctcgttccccgagttcgccgaggacacggatgtgtgggtccccgagtggcaggacccacagcggcatggcaaccactaccagtcggtgctgggacggttggcaccgggcgtctcactggaggcggcccgagcggacctggagcgcgcggcgcagggcattggccaccccgagccagggcagaagcgccacaccgtgcgggtgacgggctggcaggaccacctcacgacgaacacgcgagatgtgctgtggatgctgtgggtggcggtgggcttcgtgctgctcatcgcgtgcgccaacgtggccaacctcatgctggtgcgcacgttgtcccggcagcgggatggcgccatccgggcggcgctgggcgccagccagggacggcggctccagcagtccctggtggagagcgtgctgctgtccctcttcggcggcgtgctggggctcttgctgatgctgtggggcatggaactggtgcgcaccctgctgcccgccagcatgctgcgcgtggcgccgctggagctcaacggcaccgtcctgggcttcagcgtgctgctgtcggtgggcaccggcctgctcttcggcctggcgcccgcgatgcatgcgtcggggatgaacgtgctgcccctgctgcggcaatccggcagcgccgtgggcgcgcgctccgggcatccgctgcgcagcgcgctcgtcatggtgcagctcgcgctcgcgctggtgctgatggtgggcacgggcctcatcgtgcgctcgctgcagaacatccaggcggtggacccgggtttcgacgcggagggggtcgtcggcgcgcaattgacgctcgcccccgacgcgtaccaggaggacgcgcgcaagcgggccttcttcgaaggcgtcgcggagcggctgatggcgcggcccggcatggaagcggtgggcttcgtcaacgatgccccgctgggaggctcgagctcgaatggtgacttcatcctggaagggatgtcggcctcgcccggtgaccgccacatcacggcctaccgggtggcctcgcccggctacttctccgcgttgcgcattggcgtgcggcagggccgcgacttcgggcccgaggacacggagaagagcgcccccgtcatcatcgtcaacgaggccttcgtccagaggtacctcggtggcggggatgccctgggccggcgggtgcggctgacctggaatgacctgcagccgttccgggaaatcatcggcgtggtggaggacgtccgtcacgagtcgctcacccagcccgccacgcccgaaagctatctgccctatgcgcagtttcccctgcgagccatgacgatgctggtgcgcacccaggggccgcccgcctcggcgctggccgcgctgcgcgaagaggtgaaggcggtggacgcccagcagcccgtctacgacttgctgcccttcacggaccgggtggagaagctcctgctgcggcccagggccacgacgcggctgctggcggccttcgccgggctcgccgtcatcctggccggcgtcggtgtctatggcgtgctggcgtattcggtgggccagcggacgcgagagctaggcatccggatggcgctgggggcccatcccctccaggtgctgcggctggtgctgagccaggggctgtggttgacggccctgggcgtgggcgtggggctcatcgccgcgtatggcgccacccggttcatggcggcgacgctctatggcgtggagcccttcgccccggacatcttcctgggcgtggccgtggcgctggcggccctctccctgctggcgtgcctggtgcccgcgcttcgcgccagccgcgtctccccgtcggagtccctgcgcgcggactag

SEQ ID NO: 4395 - DNA, 258 bp, Myxococcus xanthus
atgcgctccgggctgctgaagctctacttctccaagcacacgccgctggacgagcgctccgggcagtacatcgccacggtgctccagcgttacgccgaggagcggctggagcagcgcggcccggtggacccgcggctggtgggcgtgttcgacgtcttcgcgggccgactcttccaggcgcccaaggcccagcagcgccggatgaacgacgtccggttggcgtgcgaggaaatcgccgcccggtgggacgtccactga

SEQ ID NO: 4396 - DNA, 72 bp, Myxococcus xanthus
atgaccgtcacccgtgagagtccgcgcgtttccgtcaacaagctgggccagtacctcaccgcgacatcatga

SEQ ID NO: 4397 - DNA, 2967 bp, Myxococcus xanthus
tcgcacgattggagccgcacccaacttggcccctacgaatcgtggccccgcccgctgaaggccttcgtcaccatgattctggagatgccggccccggccatcatcttctggggacacgagctcatccaggtctacaacgacggctacgcggtcatcatgggcccgcgccatccccgttacctgggcgctacctaccgcgagtgctggcccgacacctatcccgtcatctcgccctggatgcgcaagctcctggcgacgggcgaagtgacgcaggtggcgaagacctacttcatgctcacccgttacgggttcaatgaagaggcctatttcaccttcgacttcagtcccctgcgggacgacgcgggcaccatcgcgggcatcctccaggtcgtcttcgaggtcaccgacgtcgtgctcagcgaacgccggctggccacgattcgcgcgctggcgccccgggtgaacgggccttccgagagcgccaccacggatgccatccgggccctggcggacaaccccaaggacatccccttcgccctcatctaccactgggacgagggcgaacagcggctggagctggcggagtccacggggctcgacgggctggcgcagcacgccgtggtggacctgggacgaatcacggaggccacgaagcaggccgtggcggcgaacgtccccgtcctcctggagtcggtgccatccctcctgggagcccgccagttcggcccctggcccgagccgacggagaaggcgctggtgctgcccctgcgccgcacccgcacggacagcctccggggcgtggtcgtcctgggcatcagcccccggctgcgcttcgacgacacctatcgccagttcttcgaggacctggcgcgcgagttggccacccacctggccgtggagcaggaaaagcgcgccgagcgcgaggcctacacacacgccaagcaagcccgggcccaggccgaagcggaggtggcccggcgggcccaggcggaggccgcgctccgggccagcgaggaacgcctgcggatggccctggccgccggtcagttgggcgtcgtggaattgcagtacgagcgcggcgtgctgtcgtgggacgagcgggccttgcagcacctgggccttccccccggcaagtctccgacgctgaaggaagccgcggcccggattcatcccgacgacgtgaaccgcgcacggcgcaccatcgaacaggcgctgcgtccgggcgcggaggcgattcgcctggagtgccgcgtgcaaggctgggatggcgtgcagcgcttcctgctggccatggtgaagacgcacttcgacgcccaggggcagcctgaccgcgtcgtcggcgccctgcaggacgtgacggagcagcggagcgctgaacgggaacgcgagcggctggccaccattgtcgaacaatcccccgacttcatcggcgtgggagacccatccggccgggcggtgtgggtgaacgatgcggggcggcgtctgctgggcctgggactggatgaggacatcacccggtaccacctgcgggacttcttcctggccgaagaccagacctacgtcgacgaacacatcgccgccgccatcctccagggcggccggcgggagggagcgttccgcttccggcacttcccgacgggcgagcccatcgcggcgcagtaccacaccttcgccctggtagagcacgacacccagcggcagatgggcatcgccaccgtcggccgcgacatccgcgcccagaagcggctggaagcggagcgggagcggttgctcgcccgggagcgcgtggcgcgcgaggaggcggaggaggccaaccggctcaaggacgagttcctcgccaccgtctcccatgagctgcgcacgccgctcacggcggtgcttggctgggtgcagatgctgcggaccggcacgctgccgccagagaagcgggagcgggcgctggccaccgtggagcgcaatgcccgcgcccaggggcagctcgtcgaggacctgctcgacgtgagccgcatcatgacgggcaagctgaagctggacgtgtcgtccgtcgacgtgagccaggtcgtggaggccgtgctcgagtcactgcggccggccgccgaggcgaagggcatccgcatccaggccgcgctcgattcgggcggcaccatcatgggcgacgtgagccgcctgcagcaggtggtgtggaacctgctgtccaacgccgtgaaattcacccccaagggaggccgcgtccaggtgctggtggagcggcggaactcctcggtggaaatcacggtggccgacacgggccagggcatctccccgcagttcctgccgcacgtgttcgagcgcttccgacaggccgacggcagcaccacgcgcaaggccggtgggctcgggctgggactggccatcgtccggcacctggtggagttgcacggcggcaccgtgatggccaccagcgagggcgagggccggggggccaccttcatcgtcagcctgccgcaggccgtggcgctgaggcgggaggtgctggtgccccccaccctccgcggcccgttgcaggagcaggacatcccctgcccgccccagctcgcgagcctgcgggtgctcgtggtggacgacgaggaggacacgcgtgagctgcttcgcagcatcatcgaggcgtgtggcggcatcgtcaccacggccagttcttcggaggacgcgctggccgagctccgcgaggcctcgttcgatgtgctcgtctccgacgtcggcatgcccgaggaggacgggtaccgcttcattgcccgcgtccgggccctgcccgaggaacagggtggcggcatccccgcggtggccctcacggcctacacccgcatggaggaccggacgcgcgcgctgctcgcgggcttcaccacccacgtgcccaaacccatcgaaccggtggagctgatggccgtcatcgcctccatgtccaaccggggcccaccacgacgggcctga

SEQ ID NO: 4398 - DNA, 1125 bp, Myxococcus xanthus
gccatcgccgtcaccctgaacctcgcgctcggcatcaccgtcagcgcggggctgctgctcagcggggatgccatcctgggcgggatgaaccttcagggccacatgctggcgtacgccaagacgtacctgcacatcgtcggcggcttcctgttcatccaggccctcatcaacgtcttcgccgggctgctgcgcacctacggcttcacgcgcgcgtccatgttcgtctcgctgggaatgaacgtgctgcacgtgggtggcaactacgtgctcatcgccggccacttcggcttccccgcgatgggcgtggcgggcgccgccatctccaccgtcgtgagccgggccatcgcgctgggcgtcttcgtctacgtcctgtaccgggtgatgccggtgaagatggcgccgcgcgactacgtgacgttctccaaggactacgtccgcaagattctcaaggtcggcctgccctccgccttcgagcaggccacgtaccagggctgccagacggtgttcctgtactacgtgacgttcctgggcgcggtggcgctggcgtcccggcagtacgcacacgccatctcccagtatgtcttcctgtgcagcctggccattggcatggggacgtccatcatcgtgggcaggctggtgggcgccaaccgcgccgacgacgcgtaccagcaggccctgcgcagcctgaagtggggcctggccatcaccctggtcgtggacgtggccgtcgtcctcctccgcgtccccatcgtctcgctcttcaccgagaacgccgacatcgtccggctgacagcgcaggtcatcgtcatcgggctcgcgctggagacggggcgctgcttcaacctggtgctcatcaacgccctgcgcgccgcgggtgacgcgacattcaccgtctacatgggcatcgcgtccatggtctgcatgagcctgccgctgggctactacctcgtcttccacatgggcctgggactggccggcgtgtggatggcggtggccgcggatgaatgggtgcgcggcatcaccatgtggctgcgctggaagagccgcgcctgggagaagcaggtcctggtctccctcgacgcggagacggaggcggaggccgcgcccgtcgcagcgcacgcctga

SEQ ID NO: 4399 - DNA, 519 bp, Myxococcus xanthus
atgcacgtgcaggcgcacagcgagcccgccgtggcctgctccgtcacggaaggcatcaatctcctgcgggaggcgcgcaagcgccggctggaggtgcggatgctgctgctctccgcggtgagcacaccggaaatcatctcgcagtgcttcgacgagggtgcctccggctacctgttccgcgcggggctgggcacgacggcggtggcgtccgccatcaactccctggtccgaggcgagcggctgtttccggtgcagctcctgaggaacgacttcgaacatccaccggtgacgtcacccaccgcgagcgtgctgctggcgctcacgcagcgcgagcgcgaggtgctggcgtatgtcgcgggcggcgcggacaacctgaagattgccgcgcacctgcaaatcgccgagcgcaccgtgaagtcccacgtcacgcaactctaccggaagctgggcgcggagaaccgcacgcagctggcgctgagggcgtgccacctgggcgtccggccgccgccggacctctag

SEQ ID NO: 4400 - DNA, 1011 bp, Myxococcus xanthus
atgcaaagagtcttccgtgtcatcacggcgctgctcctcgcgctgggcgtcacctgggcggcgctggccctggcgttgacgggggcgggccccgagggcgcgcacgtcctgcgggcgttgggggccgggctgctcgcggcgggcgcggtggttgcctggcggcgtcactcacaaggggcggccctgtccgtcatgggcgttgggtgtgtggccatctgggggtggacccagacggtccgacctgcgacgcaggcggactgggcgccggacctggcgcgctccgcccgggcggtggtggagggctcccgtgtgacgttgcatgacgtgcgtgacttccgctaccgcaccacgtcggactgggatgcgtcgtggtactcggccacgtacgacacgcgtgagctcacgggcgcgtggttcatcgtggagcccttctccggcgtctggggcgcggcccacaccatggtgagcttcggcttcgcggatgggcgctacctcgtcttctccgtggaggtccgccgggagaagggggagaccttctccgcgctgggcggtctgttccgccagttcgagctcacctacgtggtgggggacgagcgggacctggtgcaactgcgctccaaccaccgcaaggatgacgtctatctctacccggtggatgcgtcgaaggagcgcatcgccagcttcttcctcgacatggtggcgcggatgaacgcgctgcacgagaagccggagttctacgacacgctcaccaacaactgcaccaccaacctggtgcggcacctggagaaggtgagccagagccgggtgccctacgaccaccggaccttgctgccggcgtactcggacgccctggcgtatgagctggagctcatcgaccgggacgcgccgctggagcaggtacgccagcgctaccacatcaacgcgcgcgcgcaggcggcggatggacgcccggacttctcgcggcgcatccgcgagccgctggccgccgccaccgccgacgccgtgccgtga

SEQ ID NO: 4401 - DNA, 993 bp, Myxococcus xanthus
atggcccagttcctcgacgtggcgttgaaggtaggagacctgaccgagttcaccgcggacgcggtgctgttcaaatacgcacaaagtctctatggcgcgacaggtcaagcggcgcggcgcctggagcaggcgggtgttcccctcgcgcagctcgagctcgcgccgggcgcgacgcgcctcgtggagacgcggggggcgctgaccgcgcgacgggcgctcttcgtgggcaccgttcgcctgggggagttcggctaccacgagattcgccagttcgcggtgcgcgcgctggcggccctggagaaccactcgggcctcgcgcatgtcgcgggcaccgttcatggccccaactacggattggatgaagacgaggccgtgctcgccttcgtgggcgggctcgttgaagccttccaacgtggctccgggccccaatccctggcgcgcttcacggtggtggagcggaacgcgagccgggcacaaagactggcgaaggccttcgcgcgcggcctgagcgcaacgcctggcgtggagacgcttccggagggtgtctttcgtgtgcggcgaatgtcttccgtgacgcaggcaccacccctggcgacggcgggcaccgtgtccatggcaaagcctcacgccttcgtggccatgcctttcgcacccgagctggaggacacctatcactacggcatccagggcccggtgaaggccgcgcgcatgttgtgcgagcgcgtggaccaggagctgttcgacggccccatcatccagcgcatccgcgagcgcatcgagacggcgaaggtggtgatcgccgacctgtccctggccaatccgaacgtgtacctggaggtcggctatgcgtgggggcggggccggcccaccttgctgctggtgcgtgacgtgaaggaactccgcttcgacgtcgcgtcctatcgctgcatcgtctatcgcaacattcgcgagctggagcagtcgctgacgaaggagctccagcgcatggactga

SEQ ID NO: 4402 - DNA, 1044 bp, Myxococcus xanthus
cagatgttgctggcgcgcgagcagacgtccgtgctcggcgcggtggagaagctcctggcgcttcaggcccaacaggcgaagccgccgttcatcggcctgtggtcgcgtgtcgcgggcttcgagcgagacgcgctccaggtgctgctccagcgcaaggaggtggtccgcgccacgttgatgcgcggcacgttgcacctggcgagcgcggaggactaccggcacctgcgagccagcttcacaccgctgctcgaagcctctgtggcgtcggtgctgcgcgagcgcgcgaaggggctggacgtagctccgctcgtcaaggaggcgcgcgctatgttccatgaagccccgagcaccttcgaggcgctgcgcgaccacctggtggcccggcattcccagaacgacgaacgcgccatgggcttcgcggtgcgtatgttcctacccctcatccaggtccccacggagacggagtggggctaccccggcaccacggacttcgcggtcgcggagtcttggctggacgcaccgctgcgcgccgaagcggaccttcccacgctggtgcagcgctacctcgcggccttcggtcccgcatcggtgacggatgcccagacctggtccggcctcaagggcctgaagtccaccttcgaggcgcttcggccttcgctgcgcacgttccgggacgagaaggggcgggagctgttcgacctgcccaaggcaccccggccggacaaggacacggccgcccccgcgcgcttcctcccggagttcgacagcctggtgctcggccatgaggaccgggcccggctggtggatgacgcgtaccgctccaagctcatcaccaagaatctgcgagtccccgccaccttcctcgtggacggcttcatcgccgggacgtggacggtggagcgcaagcgcgcggcggctacgctcgtcgtcgagccctttgcgcccatcaagaagaaggaccgtgacgccctggtgaaggagggcgaggcgctcctgcgtttcatggagcccgaagcccgcacgttcgaggtccgcgggcactaa

SEQ ID NO: 4403 - DNA, 2022 bp, Myxococcus xanthus
gagggaatgtggacctatgacgcctttccctccgacacggtgaacaaggcctacggcttcacgcccacgcaggcgtggctggaccacgtccggctcggctcggtgcgactggccggcggctgctccgccagcttcgtgtcgccagagggcctggtgatgaccaatcaccactgcatccgcggctgcatcgaggacctgtcctcgccgaagaaggacctgctggccaagggcttctacgcgtcgagcgccgcgcaggagctgcgctgtccgaaggtggaggccaaccagttggtggagatgacggacgtcaccgcgaagatgaacgcggcgacgaagggcctcaccggcgcggccttcaacaccgcgttgaagaaggagacggccgcggtggaggccgcctgcgccacgtccggagacgtgcgctgtgacgtggtgacgctcttcaacggcggcaagtatcacctgtacaagtaccgtcgcttccaggacgtgcggctcgtcttcgcgcccgagttctccatggccgcctttggcggtgacccggacaacttcaacttcccgcgcttcggcttcgacgcggccttcctgcgtgtgtggcaggacaatgcgcccgcgaagagcccgcacttcctgccgtgggcgaagcagggcgcgaaggagggtgacctcgtcttcgtctccggccacccgggtggcaccgagcgcaaggcgaccgtcgccgagctggagttccagcgcgatgtcaacctgccgtacacgttgctccagctcgccgagctgcgcggcatgttgcgcgagtacgccgggggttcggcggagcgctaccgcaccacgcgctccatgcttcgcggcgtggagaacggcctgaaggcgctgcgcgggcggcaccagtcgctggcggacccggcgctgctggccggcaagcgtcaggacgaggcggcgctgcgccagaaggtggacgccaacgcgcaggtgaaggccgccaccgacggcgcgtgggatgaaatcacccaggcgttggatgcgtaccgccgcatgctgcccgactaccgcatgaaggaggccggggacgcctatccctccgaactcttccgcatggcccggcacctggtgcgcgtggccgaggagaaggagcggcccaacgcggagcggctgcgcgagtacacccagtcccagctccccacgctggagcagcagctcctgcgcgacgcgccggtgacgcccgagctggaccaggcgctgctgaccttcggcctcacccgcgtgcgcgagacgctgggcgcggatgacccctttgtccagcaggtgctcggacgcgaggcgcccgccgacctggcgcgcaccctggtgcgtggcacgaagctgcgggacgtgaaggtgcgcgccgcgctgctcaagggcggcaaggcggcggtggaggcctccaaggacccgatgattctcttcgcgcgcaaggtggacgcggaggcccgcgccgcgcgcaagcgctacgaggacaccgtggaggcggtgctcaagcgcaatggcgagcgcatcgccaaggcgcacctcgcggtgtacggcacctccggttatccggacgccaccttcaccctccgcctcaacccggggcaggtgaagggctgggatgagaatggccgccccgtggccgcgctcaccacctttggcggcgcgtatgagcggcacaccggcaaggagccgtacaagctcccggacacctggctgaaggcgcgcggcaaggtgccgccccagacgccgttcgacgtggccaccaccaacgacatcatcggcggcaactccggctcgcccctggtggaccgcgatgggcgcgtggtggggctcatcttcgatgggaacctgcactcgctggggggccgctatgcctacgtccctgagacgaaccgtgcggtcgccgtgcacggagagggcatcctggcgggcctggagcacgtctacggggccaggcgcgtggtagacgaactgcgcaaggccagcgacgccgcggtcgtgcccgcgaagtag

SEQ ID NO: 4404 - DNA, 645 bp, Myxococcus xanthus
atgcctgtccttcgtggtgctgtcacgctgtcgcgcttccgggtcgaaccggcgaaggaagcgccttcggatgtcaaacgctggctgacgcgcggcctcaaggcgcacgcgttcgagcccatcgaccgccgctccgaagaagagcgcgccgtcggcttcgtggagctggagaacgaggagtccagcgagttctccgccggccgtctctattacggcgagtacgccctattcgccttccgcatcgacaccatcaaggtgccggccgcggcgctcaaggcggagctggcgaagtgggccgccgccttcgagaaggagaatggccgcccgcccagccggggcgagaagacgcagagccgcggtgaaatccgccagatgctgcgcacccgcgccacgccccgcacgtcgacggtggacgtgagctggaacctgaagacgcagcaggtgcagatctggtccgcgtcgcgcaaggtggtggatgaaatcaccgtcgcgctggagggcgggctgaacgtgaagttcttcggcatgacgccgtcggccatggcgcagacggcgggcatcgacgagtccctgctggggcccaccacggagctgattggcatggacctgccggcgacggcggaggtggcacatggcgaggcgtga

SEQ ID NO: 4405 - DNA, 651 bp, Myxococcus xanthus
atgcgcggtgatgtcggcgtggacggcggcgccaccgaggagacgaaggacgaggccgaagtcgaaaagggcaaagcgcaagatcagttgctgcgtggccgcgcctatctgggccgcgagttcctcacgtggctcctgtggcgcaccgaggccggcgggccgctcgtcgaggtggagggtgaaggcgtcagtgtcctcttcatgggccgggtggtgctgcgcggcgtgtccggtgaggtgacggagatgagcgccaagggcaccctggcgccgtactccgagcaggtgaagcactcgctggaccgcgggctgttggtggcccaggcccgcctgcgcttcacccagggcgagagggagttcgaggccacggtggactccgagttcctcgacattcgcgcgggcaagctgccggcgctgatgagcgaggaggaggatgaccagctctccgagcggctcttgctgatggagcaactggccgccatggtggacgcgctggtgcaggactacctgtccgtgcgcgccagcaagggttggagcaagacggtcgtccccgcgatgaaggagtggatgcgcggcgacgagcagggcgcggacgcgctcgccaaggcggcccgcgcccggggccgtgacgctcgcacggcgcggagctga

SEQ ID NO: 4406 - DNA, 2274 bp, Myxococcus xanthus
atgctgctgggcgtggtggcgctcgctatgagcttgctcggcatttcgctcgcatgtcctggcgcttcgggtgacggttccggtcgcccaggggacgaagttgaaatcaccgacccctcaccggaaggggagccgggtacggacggagacgggagcgctccgacggcgccagatggtgggggcccggattccctggggctcttcgggctcgacgtgcgtcccgcgaaccctacgtgcgtagcgcctccccggcccccggaccccgcgggggccaccatctcgcgcgcattcccggagctgagcttcacccagcccttgttcgccctccaggcgccgggggacagccgccgcatctacgtggtggagcgagggggacgggtgcgcgtgttcgacaaggacgccacgccgcccgtcagctccgtgttcgtcgacatctccgggcaggtgaacgtggagcatgatgagacgggcttgctcgggatggccttccatccggcgttcgccaccaatggccaggtgtttctctcctatgtcggaaacaacgccatgggcagtctacgctcgtccatcgtccgctaccgcagcccggatggcggggccaccctggacccggcgagcgcggaggtcgtgctcgaacaggaccagcccttctccttccacaacggcggccacctcgcgttcggaccggatggcttcctctacttcgccttcggtgacggtggcggacgcgtagacccgaaccggacggcccagaatccggagctcctgctggggaagatgctgcggctcgacgtggacagcgcgcggccctatgccattccgcccaccaacccctacgccaccgccggcgggcggaaggaaatctacgccaccggcttccgcaacccgtggcgctggagcttcgaccggagcacgggcgcactctggctgggcgacgtgggcgaaaagctcctcgaggaaatcaaccgcgtcgagctgggaggcaattacggctggagcatcctggaaggaaccgagtgcgcgcgtggtggcggctgccgcaccaccgggctgacgccgcccgtggccgtctatggccgcgcagaaggtgtctccgtcaccggaggctacgtgtaccgcggcaccgccgtaccgtcgctcgcgggcaagtacatctttggcgacttcggctcgggccgcatctggacgctgccgggtgacgcccttcccggtgccgccgcggcgccccaattgctcgtcaccacggcgctcagcatctcctcgttcgccgagctcaacgacggcgagctgctggtggtggacttcgcggggggaggactgcacagcatccacgcgtctctgccccccgcgccggggggcgaggcgttccccacactgctgtcggccacgggctgcgcggacccgacgaacccgaacctcccctcggcgggcctcatcccgtacggcgtgaatgccccgctgtggtcggacggcgcggggaaggagcggttcatcggtgtgccagacggggcggtgatgacggtggggccggagggcgtgctggacgcgccccccggcaccgtgacggtgaagacgttcctcctgggcgggaagcgcgtggagacgcgcctcttcatgcgccatccggacggcatctgggcgggctacacctacgagtggaatgacgcgggtaccgacgcgacgttgctggagacgggcaaggtgaagacggtggggacgcagacgtggacgtaccccagccggggggaatgcatgcagtgtcacaccgccgccgcgggcttcgtgctgggcctggaggtcgcgcagctcaacggggattacacatacccgggcgggcgcatcgcgtcgcaactccagaccctggagcatattggcgtactgaaattgccggccccggtggagcaattgccccggatgcctgcctacgccggaccggagcccgtggagacgcgcgcgcgggcctacctgcacgccaactgcgccgtctgtcaccggcccaatggcctgggccgcggtgagttggacctgcgcttttccacgccgctcgccgcaacgaagatttgtggtgtggcgccagaccacggtgagctgggcgtgcccggagcgatggtggtcgcgccgggagacccgtcgaagtcggtcctgtcgcggcgcatgcactcgctgtcgacgccacgcatgccgccgttggcaagcgcggtgaaggacaaagagggcacggggctcgtggacgcgtggattacgtccctgcccgcgtgtcccacgggtccctga

SEQ ID NO: 4407 - DNA, 183 bp, Myxococcus xanthus
atggccacgcccctgcccgcctacgtggcccaacgccgcgcggactgggatgcgctccaggccctgctggcgaagcagcgctccggcacgctgaagctgggcgagctgcgcacgctggacacgctgtaccgccgcgcgtccgccgacctggcgcacgcgcagaccttctacgccggcacggat

SEQ ID NO: 4408 - DNA, 765 bp, Myxococcus xanthus
atgcgctccgctccgactccccatctcgacgtcgccacccccgaacgcgtggcgctcacgcttcccatcgcgggcatcggctaccggtgcctcgcgtggctggtggacgcgagcctgctgttcttcttctggctggtggcctacttcgtcttcacgttgctggtgtcggacgtgctcggcgtcttccaggcgctgtcgggcgtggggcagacgctgctggtggtgggcgtcttcgccacgcagtggctgtactggacggtgagcgaggtcttcttccacggccagacggtgggcaagcgcgtgctgggcatccgggtggtgcgcacggacggctcgcccgtgggtgtctacgagagcgcggtgcgcaacctctgccgcgcggtggacttcctgcccatgctgtacgccgccgcctgtgtcagcatgctgctcacccgtcagcaccggcgcctgggagacctgctggccggcacgctgctggtgcgcgaggagcgcatcgacctggacaagtacaccgccgctccggccgcgtccgtgcccttgccacagagcacgggtgcgcggcccctgtcgccggaggacgtggagctggtgctgtccttcctctcgcgcgcgccggggctggcgccagaggtgcggcagcggctgggcgcgcggctggtggagcgcgtggggcctgacgacgcggaagcacgcgcggcggtgctggcgtccgaggagcgcaccgaggccttcctgcgcgcccgcgtccagggagagcgctga

SEQ ID NO: 4409 - DNA, 216 bp, Myxococcus xanthus
atgacggatgagcgagaggacacgaccgtctacaaggtcgtggtgaaccacgaggagcagtactccatctggccggccgaccgcgagaacgcgctcggctggaaggatgcaggcaagcagggcctcaaggccgagtgcctggagtacatcaaggaggtctggacggacatgcgtccgctgagcctccgcaagaagatggaagagctgaagtcgtag

SEQ ID NO: 4410 - DNA, 471 bp, Myxococcus xanthus
atgagctacatgaagggcctggtgctcttcccggtgcgcaaggtgttccgcaagatcttcttcgtcttgtgggtgaaggactgcgtggacgtggcgtcatcagcgctgcaccacggctacctgctcaaccatgccatggaccgtggcgacctgaggcccgaggacatggagggcccgctgcccgggaagattcacgacgccatcgtcgccgcctgcgcggagttggacccgcgccccgtcaatcaggccctccgccggctcttcgtcggcagccgcctgctcatggccgaggccactcgcgccttcttcagctccgacgccctcggcccccgtacgcccgagccgggcgagagcgccgaggtgaagaccttgacggagcgcctcatcgccgcgctctgggaggagcgcggttacttcgccgcgctgcaacagcactacgacacgcacctgaaggcgcgccacaccccgtaa

SEQ ID NO: 4411 - DNA, 957 bp, Myxococcus xanthus
atgcgattcgccatcttggggtctggaggcgtcggtggtttcttcggcgcgaagctggtccgcgccgggcatgacgtgacgttcctcgcgcgcggagcgcacctgcgcgccatgcgggaacacgggctcaccatccacggcgccgaaggagacttcacggtcgcggtcaaggccgacgatgacgtccagcgcttcggccccgtggacgtcgtggtcctcgcggtgaagaactacgacgtcgcttccgtgctccccgcggtgaagacgttgctctccgcgcgaggcgcaccggcgccgggcgaaacgccgcccttcgtgctcaccttgcagaacggcgtggacagcccctccgaagtggccgccgccgtgggcgaagccgccgtcctgggcggcaccacgtacatctccaccgccatcagcgagccaggcgtcatcacccagaccggaacgaaccatcgaatcgtgctcggagaagtattcggtgacacctcgcgcatctccgaccgggcacagtccctgcgggacgcgctggccggcgcgggcatcaccgtggaggccgtggcggatgcgcgcggagcgctctgggacaagctgtccttcctcgcctgcatgtccgcgttcagcaccgcgtcccggctgcccgtgggcgccctccgggacaatccggccttccgcgaggtgttccggcaagccgccgccgaggtgctcagcgtcgccgccgcggagggcatcaccaccacgcgcacgccggacgccctggtgcagtacatggacgggctgcccgcccacatgcgcccatccatgctgggcgacctggagaacggcaagccgctggaggtcgaatacctccagggctcggtggtgcgccggggccgcgcgcggggcgtccccacgccggtgatgagcaccctctatgtcctgctgcagccccacgcccagggggaacgaaaggcctga

SEQ ID NO: 4412 - DNA, 1320 bp, Myxococcus xanthus
gagcgcattgcaattgttggcgccggcaccgcgggacttcacctgggtctgaagctgctgtcccacggtgtgcccgtgacgatctacacggagcaggagccgagcaggctacgggtttcccgtctgctcaacacggtggcgcaccatgcccccacgcgcatgcgcgagcgcatcctgggcgtggaccactggagcggccccaacgctgacatgttctatatcggcatccatgtgaacggcggccctcacccgttcagcctccggggtcgcttggattcccccaccatcttcgtggactaccggcaataccagccgcgcctcgcggaggacttcgtggcgcgcggcggcaagctggaggtccttcccgtggacctcgacgtgctggagcgcctggcccagcagcacgcgctgatggtggtcgccaccggccgcaatggcctgacacgcctgttccctcgcgtgcccgctctgtcgccgcacacgcagccgccgcgcatgctcttcgccgcgctgctcaagggcgtgcgcatgcaggagcccattgggatgaatgccaacctgattccgggccagggcgagatcttcgagtcccaggtcgtcaccgcggacggccgggtccccagcgtgctcatcgaagcccttcccggcagtgagctgtcgcggctcagcacgcagcgctacgacgaagacccgcgcgccttcgaggcgatgctgatgaacttcctgcggcgcttcgcgcccaccacctacgagcgcgtggattcagcgagcttcggcgtgcgaggtcccatggactacctccagggttccttcacgccgacggtgcgccagggctgggcgcccctctccaacggccgcttcgcgctggcggtgggcgacacgcacgtgacgaacgaccccgtcgcgggccagggcgccaatgcggggtccgcttccgccttcgcgttggcggagcacatcgtcaccgcgctggcggacaaccggcccttcgacgaggtcttctgtcgggaggccgaagcgggctcgtgggccgccaccgcgccggcgacgcactggaccaacaccctgctccagccgccgcctccgcatgtgattgatttgctggccgctggcagcaaggacgcacgggtcgcggacgccatcgccaccgccttcgtgacgcccgagctcatcctctccgcatgcgccagcccggagaactccgcggcgttcatcgcacggcaccgccccatggtccgcgaggccgcgccgcctccgagccccctggcgtggcacccgcctcccgaggagcccaaggtcactgtgtcgttgacccgctga

SEQ ID NO: 4413 - DNA, 1086 bp, Myxococcus xanthus
gactggctcgacatgatgacgacacccgccgccctcgtggacctggaccgtgtggacgccaacctgaagcgcgtggccatgtacacccgccagcacggcctgcggtggcggccccacacgaagacgcacaagacaccggagttcgccgcgctccagctcgccgccggagcccagggcgtcaccgtggccaccgtccgcgaggcggaggtcatggccaccgtctgcgacgacatcctgctcgcctatcctcccgtgggcgacgacaggctcacccggctcatggcgctaccaccacacgtccggctcaccgtggccctggactcgggcgaggcgctggagatgctgagccgcgcggcccggagggcgggccgtacggtgggcgtgttggtggagctggacctgggcatgcggcgcgtgggagtccagtcccccgaggacgcagtcgcactggcccgcgcagtgacgtccagcagtggcctggagtaccggggcatcaccttctacgccggacacctgcgtatgccacaggcggagctgggcgacgcgatgcgtgagcaatccgtgcggctggccacctacgtggacacccttgcggacgcgggactgcggcccaaaaccgtgagcggcggctccacgccgacgctgtggcgctcgcatgaagtcgccgggctcacggagattcgcccgggcatcaacatcttcaatgaccgcaacgccgtatcggtgggtgcatgcccgtgggaggaatgtgcctactccgtgctggccacggtggtgagcaccacggtgccgggacaggccgtcatcgacgcgggttccaaggccctggccaaggaggaaggcttcaccgacacgggcgtctacggcgccctgctcgaccggccagacgtcctggtgcgcggcctgtccgaggagcacggcctgctggacctctccagcaccgactggcggccccgcgtgggcgaccgcgtacgcgtggtgcccaaccacgcctgcgcctccgtcaacctgcacgaccggttgcacctgctgcgtcagagtacctgggccggcacgcacgccatcaccgcgcgaggctggtgacgc

SEQ ID NO: 4414 - DNA, 1740 bp, Myxococcus xanthus
gctccctccaaacccaatgacattcccctcggcacggtgctgagggagacctatgagattgcaggcgtcctcggccgaggtggcatggggaccgtcttcctggccaaccacctgcggctgcgcggacggcaggtggccatcaaggtgctgcgccacgacgcgggcatgggggccgaggccttcgtgcgcttccggcgcgaggcggagattgcctcgaagctggggcaccccaacatcgtcgaggtgctcgacttcgacagcctcgaggatggctcgccctacatggtgatggagtgcctgcgcggcatgccgctgtcgcgcaggctgcgcaagggcccaatgacgctggaggaggtgttctcctgcgcgcggcagatgggctcggcgctccaggccgcgcaccgcgcgggcatcgtccaccgcgacctcaagccgggcaacgtgttcctcgtgcccaccgaggtgggcggcgtgatgatggagcacgtgaagttgctcgacttcggcatctccaaggtcatcgactcgcagagcgtgcacacacagggcggcatcctcctgggcacgccgcagtacatggcgcccgagcaggccaccgggaagaacggcgaggtggacccgcgcacggacatcttcgccttcgggtgcctcgtctacgagatgctggcgcgccggcttccgttccgggacaacggcaaccttccggagctcatctaccgcatcgtctatgatccgccggagcccctggaggcgctggtgccggacctgccggaccacgtcatcgcggcggtggagaagtcgctggagaagcgcccggaggaccgcttcccggacgtggccagcttcatcttcgcgctgacgggacgcgcgctccagacgatgggcgaggtgccgatgctcacgccgctgagcacgccgaggctcgcggtggagctggctccggagtcgaagccggagacggtgcccggcaggcgctcgggacgcggcacggaggacgaagacgtcgacgtgaatcctccggacgcgaacccgcccttccgggagtcggagacggtcagcctggccgcgccggcgcccgcggtggccccatcccacgacgccgcgaccatcgccgaggcgatgcccttgccggagatggaggcgcccccgcctcggcccgtcgtcgcgcccgcggacgtcgtgcccgcgcccatcgcccgttcgcccgtggggaggccgccctccgcggcgcctccagggccgagcgcccggaaaccgacgcctcgggacggggctgtggctggggcccaggtgccagacgaaggcgtgtcggcgtctcgggggcccgagaaacccctcgcgcctgctccgttgccgcgcggcgctgacgctgctccacccgtacgtccgccagcagggggcgcgcaggccggtgccgcgtcaccgaaggtggtccccgcgcccatcgcgcgggcgcccgtggcaggcggcccctccgcgccggtcgctgcccggaatgggccgccctcgccaggcgagggcgcggtggggtcgaccgtgttgctgcgctcgaaggcgggcgtggcccagtccgcctcgccaggcgtgctcgcagcgcagccgaagcggaagctgactccgctcacggtggcgatgatggtggcgctcgtcgccgccgtggccttcgccgtgtggccacggccggatccacgcgtggaggcgtccggaaagcacgccgtgcccgctgctggcgcggagtag

SEQ ID NO: 4415 - DNA, 372 bp, Myxococcus xanthus
ctctggatcaaccctgcctgttcaaagtgccgcgccgcgatggccgcgatggatgcgtccggtgcagcctacgtcgtccgccgctacctggagtcgccccccaccgctgcggagctggaggccgtactcgggcggctcgggatggagccctgggagctggtgcgcatgggtgaggccgcggcgaccaaggccacgctggagatgctgcccagagacgcgacacaccgtgccgactggattgcagccatggtccagcacccagagctgattcagcggcccatcgttaccgccagcgacgggacgactgtggtggggcggagcccggaggcgctggagagggtgctcgccgcggagcgcagctcgggcacctga

SEQ ID NO: 4416 - DNA, 2079 bp, Myxococcus xanthus
aaggagacggtggacacctaccacggcacggcggtgaaggacccgtaccagtggctggaggactcgtccgacgcgcaggtgaagcagtggaacgacgcgcagaacgcgtacacccgcgccctcctggacaagctgtccggacgcgatgccatccgccagcgcgtctccgagctgctgagctggaagtcccctggctacggcgggctgcacgaggccggcggcacgttgttcgccatgaaggcccagccgcccaagcagcagtccttcctggtcgtgctcgactcggtggatgacacgtccaaggagcgcgtgctggtggaccccatggtggtggacgcctcgggccacaccaccatcgactggtacgtccccacgctggacggcaagaagatcgccgtgtcgatgtcgaagaacggcaccgagagcggcgacgtcaccgtctatgacgtggccaccggcaagccgctgccgaatgagaccgtgccccgcgtgaatggtggcaccgcgggtggcagcctgacgtggacggcggacggcaagggctacttctacacgcgctacccgcgcggcgaggagcgccccgaggcggaccgtgacttcttccagcaggtctacttccaccagctcggcacgcccacggagaaggacacgtatgtgctgggcaaggacttcccgcgcatcgcgatgacggagctggacacgtctcacgacggccagcacatctccgccgtcgtggccaacggcgacggcggcgagtacatgctgtacctgcgcgacgccgccgggaagtggtcgcaggtatcgaagttcgaggacaaagtcatccgcgcgcgcttcggccacgacggcgccatgtacctgctcagccgcaaggacgcgccgcgcggcaaggtgctgcggctgccgctggccacgcccacgctggacaaggccacggtggtggtgccggagggcgaggccagcatccagggcttcttccccacgaagtcgcggctctacgtgagcgagcagctcggcgggccttcgcagttgcgcatggtggacctgaagggcaaggcgctggggatggtgcccaccctgcccgtgtcttccgtgggcgggctcgtgagccagggcgatgacgacgtgctcttcatcaacaccagcttcacccagccgatggcctggtaccggtactcggcgaaggacaactcggtgaagaagacggcgctggcccgcacgtcgccgctggacctgagcgacgtggaggtggtgcgcgcgttcgccacgtccaaggacggcaccaaggtccccgtcagcatcctcaagaagaagggcaccaggctcaacggcaacaacccggcgctgctgacgggctacggcggcttcaacatctccatcagcccgaactacaacacgctggccggtttctggctggaacagggcggcgtgttcgcggtagccaacctgcgcggcggctcggagttcggcgagaagtggcacgccgagggctcgctcacgaacaagcagaacgtcttcgacgacttccacgccgccgcgaagctgctggtggaccagaagtacacgcagccgaagaagctggccatccagggtggcagcaacggcggcctcctgatgggcgcggccgtcacccagcacccggagatgtacggcgccgtcgtggcgcgcgtgggcatctacgacatgctccgggtggagctgacgcccaacggccagttcaacatcaccgagtacggcaccgtgaagaacccggagcagttcaaggcgctgcacgcgtactcgccgctccacaacgtcaaggacggcacggcctacccctccgtgctcttcacgtccggcgcgaacgacccgcgcgtggacccgttccactcgcggaagatggtggcccggatgcaggaggccaccaaggcgaagaaccccatcctgctgcgcgccaacgcggagacgggccacggcgccggcacgccgctgaacgcgcgcatcgaggaggaagtggacgtgtactcgttcgtgttcaacgccctgggcatgaagtaccagcccccggcgaagaaggtcgcggcgcccaagccgcagtag

SEQ ID NO: 4417 - DNA, 1485 bp, Myxococcus xanthus
atgcgccgcatcctgtccgcctcgctgctgctcgtggcccccctggtcctctccggctgcttccgcgagacgcgccccgagggcgacacccttccctccctggcccgcgcgctcttcgaaaccctggaggccgaaggcgccctggccagcgcctacgtggtggacgcgcagacgggcgagccactcttcacccaccgcgagcatgtccggctcctgcccgcctccacgctcaaggtcgtctccaccgcgtcggtcctctccgcgctgggcgcggacttccgcttccagacgccggtggccctggagggcacgctggatggcgggctcttcctgggtgacatcgtggtggagcccacgggggacccgtccctgggctcgtggcgcttccccgagacggcgctggcgtgtgagcaggtggcggacgccctccaggcgcgcggcatccgccagtggcgcgggcaggtgcgcgtgcgcggcgcgaaggaggcggagttcccgttcggccctggctgggcctgggatgacgccgcctatgcctacagcgcggcgccaacggccttcgtcttccgggagaacgtggtggacgtggcgctgtcccgggcggcgggcgcggcctgcgcgcagccccccaccatccaggtgacccccaccttcgcgacgctgccggccgtggtgggtgtggacacgaacgcggagcgcccctccctggcctgcgtgcgccagcgtggcggccccggcgtgcgctgcctgtggcgctccaccgcggacacctgcccccgctccgccgcggtgaggctgtcggtggacgagcccgagcagctcttctccgcctgtgtggaggccgccctgctcgcgcgcggcatccctcggctgcccatgacgctggaggcgcccacgccgcggcaacccgcggtgcccgcacccctggtcaccctggtcagcccgccgctgtccgagttggtgaaggtgacgaacaaggaatccctcaacctgtacgcggagcgcctgggcctgcgcttcgcgcgcgagctcaccggcacggagagctatggcgccctccgcaccgcgctgacggaggaactgacccgccgaggcatcccctcgcgagacttgcgcccggtggatggcagtggcctgtcccggtacaacctggccaccgcgcggggactggtgcgcgtcatcttcaccagcctgcgtgaagcctacggcaccgcgctgctggacagcctgcccgtggccggcctggacggcacgctcgcggcccgccccgtcaccgccgacaccgcgggccacatccgcgcgaagacgggcacgctgtccggtcagcggtgcttcgtgggggtagtggaccggccgggagacgcgcggcacccacgcgtcgtcttcgcgctgatgctggggaacatggacgacggcaccgctctgcccgccaatgaggcgttcgaccggttcaccgcggggctggtcacactgccgctgcgctga

SEQ ID NO: 4418 - DNA, 390 bp, Myxococcus xanthus
atggcgggctgtgtggtgggctattgcctgggcgcgcgggccggaacggcggcgctgcggcgcatggcgggtgacgccgagttgggccgcctgacccgcgccgccgaaaggatggggccctggttcctgctcgccttccgcgcggtgccggtgctggcggagacgtccgtgctcttcgcgggaaccagccgcatgcgcccccggacgttcctcaccgtgagcgccctggccaacctgggcgtgtcggtgacctatgccgcgctgggcgccagcgccgcgcggatggagtcgttcctgctgctcttcgcgggcatggtgttgctgcccggcctggcgctggcctggatgcggcgaaggacaccaccgcatccggacccggcgacacgctag

SEQ ID NO: 4419 - DNA, 426 bp, Myxococcus xanthus
atgaatgaaaagagcgcgtcctaccagtcgtggctggagtcgttcgccagcgagcacggagccaccgcgggcaccgtccaccttcagcggggagacgacctcttcctcgtggctgccctcaacatcccgccgccgttgatggcggccgtccagcacgtgccacacggcaaggggatggcggggctcgcccaggtgcgcaagcaacccgtgcagacgtgcaacctgaaggaggacacgtccagcgacatcaagcccggcgcgaaggcggtggacgcgcgcgcggcggtggcgattccagtgctcgatgcgacaggccgtgtgcgcgcggtggtgggcatcgccttcaccgaggaaggctcgctggccgctgagcgcgagacgtccctgatggccgccgcgtcccggctccccatcgcggatggctga

SEQ ID NO: 4420 - DNA, 861 bp, Myxococcus xanthus
atgaacggaaaggccttcctcacccggcacccgctggtggacgcggcgcacttcacgtacgccacgcccgacgcggagcgggacgcggccatcatgcggcgtggcggagacccctgcgagattcccgaggaccggggcgcgctgtacgtgcgcctggaggtggagggtcacccggtggtgctctacaacgtgcaccacaccctgggcgactccggcatcaacgcccgcaacctccgccagctcaacgcgttgctacagcaccgtgaggtcatgcacgcggtggcgctgggcgacttcaacgccaacaccgccatcaagtcaggcggctcctggctgatggcccacctccggacctacgacgacaccgacacggtggaggaatacgaggttcgctacggcgagccccacgccagcgtgggggacgaaggggtgggcaacatcgccgacccgcggttgcgacacgagctccacgtgctggagcagagcctgccggagaccatcgcccatgccaccaccgcacaggtgcgcctgccggatggctcgctcatgacgccgaagcaggcgtgcgccgagctgcgctccggccgggtgcaacgcggcagcgagcaatggctgcggctccaggacatcgcggacagcgccaccctcacctcgctgccggatgagaatggcgtggtgcccgcgacgggcaagcgcttcgacaacctctacgccagccctggactggtcccccgcctcttcgaggtggaccgcagcaccgagtcctccgaccaccaacccgtggtggcgcactacgacgtgcggacgccagggttgaaggacggcaagcccgcccccggcaccgtccagcggcccacctga

SEQ ID NO: 4421 - DNA, 582 bp, Myxococcus xanthus
gcgctcgggcccttcacggacatcgaccggccgctcgtgcatgacaccgcgatggggatgattgacgccaccttcttcacgagcaccaccggggcgccctacctggtgtggaaggcggacggcaatgcggtggggcggccgacgcccatctacgggcaggcgctgtcagcggatggcctgtcgctggtgggctcgcgccagacgctcatcagcaacaacctctcgtgggagggcggagtcgtcgaggcgccgtgggtcgtcgctcggggcggctactactacctcttctatagcggtaacgcgtactacaacagcacctacgccgtgggcgtcgcgcgggcgacgagcccgctgggcccgtacaccaagctgggctcgccgattctcaagacgggtggtggctgggtggggccgggacacaactccgtcgtcaccggaccgcgcggtgacatgtacatggtctaccacgcgtggaacagcgcccacacggcgcgggtgatgctcgtggatgcaatcacgtggcccaatggctggcccgcggttccgtccgcgccgtcggcgagctcgcggcccatgccgtag

SEQ ID NO: 4422 - DNA, 531 bp, Myxococcus xanthus
atggagcgcaacgacgagaaggggttcttttcctgggtcaccagcctggtgcgcgaccatcgcggcgcgctcgcggcggtggctcgaaacgagggcctgctcgccgacgacgcgctcgacgcggtccaggacgccttcgcgaccttcctcggcctgccccacgcgcggaagctcgcgtacgaggaggacgacagccgcaacctccttgcgatcctcgtgcgcaaccactcgcggaacaggaggcggcgccacgaactcgcgcggccgcatctcagcgacagcgaagtggtcgagagcctgcccgacgatcgggagagcgtcgattcgctcatcgcgcatgccgaggcgcatgtgctcgccttccaatgcgtggagaagctcgccgcagtgcagcgccaggtggtgacgctgcgcctcctcgaggatcagccgggtgtccgtgtggcggatctccttggcaccacacctggcaacgtcgcggtgctcttgcatcgcgcgaagcgtgaactccgcgcgtgcatggaggagtag

SEQ ID NO: 4423 - DNA, 249 bp, Myxococcus xanthus
atggtccgtatcgccgaggacgagacccggcacgcggacctgtcctgggccatcgaccgttgggcggtagagcgactgccgtccgccgagcaagaggcggtgcgcgctgcacgtcagcgggcggtggcggcgctgcgtgaggaggtctccgcgccgaccgatgcggcgctcctgcgggcgctggggctgcccgaaccggaggtcgccgtcgcgatggtggacctgctctcgcgggagctctggaattga

SEQ ID NO: 4424 - DNA, 1776 bp, Myxococcus xanthus
atgggcagcaggaacgcggcggtcttccctgagcccgtcttcgccgaagcccagacgtcgccacctcgcaggaccacggggatggtcgcgcgctgcaccggcgtgggttcgtcgtatccgagtccggccacggcgcgggtgagcgcgtccgacaggccgagcgaagcgaatgtcatgggatggaagccttgggtagcgcgaggacgcggaagcctaccctgcccgggaggtccgcccccggaattcctacccccctctccatccaggcaaggtgtcgcccggaccccgaggggggcggggggcgtggactcgccccgtcgcgggacggcccgacgtgttacgagcatgcgcatggcgatttccacattccctgagcgtctgcgtgccgtcctcgtcggtgtccagcttccgggcgtctcggacgaagagcacgccgcggacttcgcggagctgcgccggctggtgcacacgctggggtatgacacggtggcgaccgtgtcccagaagcggacgcggctggccacgggcacggtgctcgggacgggcaagctcaaggagctggcggccctcaccggaggctcgggcgtgattgcatccggagcgagcgaccggacgtccaaggcccgcgagaagtgggaggccgccgccaacacggagcccgactccgaggacgaggttgtcgaagaggaggccgacggcgtggagacggaggacgcgctgctgcctccgccttcggaagaagacgacaaggcggagccccggcccaccgtggtggtcgtggaccacgagctgtctcccggccagctgcgcaacctggagaaggccaccggcgcgatggtgctggatcgcgcgggcgtgattgtcgacatcttccaccggcacgcgaagagccatgaagcgcggatgcaggtggagatcgcccggctcaactacctggccccccggctgcgcgaatccaccggaggccgcgagcggcagcaggggcgtggcgcgggggactcggcgctggagctggaccgccgcaagattcgcgaccggctggcggagttgcgcgagggcctggcggccatccagaaggaccaggaccaccgccgctacgcgcgaagggacctgctgcgggtggcattggtgggctacacgaacgcgggcaagtcctcgctgatgcgtgcgttgacgggcagcacggtgctggtcgcggaccagctcttcgccacgctcgacaccacggtgcgcgcgatgcagccggagacccgtccgcgcatcctggtctccgacacggtgggcttcatccagaagctgccgcacgacctggtcgcgtccttccgctccacgctggacgaggccctggaagcgtcactgctgctctatgtggtggatgcgtcggaccccacgtgggccgcgcagttggaggtcacccgcacggtgctccgggatatcggcgcggacgccgtcccgagcaagcttctcttcaacaaggcggaccggctggacgcggcggcgaaggaagcgctgctcgcgaagcacccggacgccttgctgctctccgcgcacctgccggacgacgtggcgatgctgcgcaagaacatcatcgccttcttcgagtcctcgatggtggaggcagacctggtgattccctactcccggcaggggcgcatcagcgaggtgtacgagcacaccacggtggtgtcccaggcctacgacgagagcggcagccggctgcgcgtgcggggccttccaggggccatcgcgaagctcacccagtcgttccaggaatag

SEQ ID NO: 4425 - DNA, 735 bp, Myxococcus xanthus
gagaagctcgtcatcggttacgacagcaaggccatcctgccgcccatcgacctgaccattcgccgcggccagttcgtggcggtggtgggccgcaacggctccggcaagagcacctggttccggacgctgctgggcatgcagccgccggtgtcgggcaccatctcccgcgcctccgcgcaggtgcgcagtgcctatgtgccgcagacgtccgccatcgactcgctgctgccactgcgcgcgggcgagctgacggcgtggggacgcctgcgcggctggagcttcctgtggcccttcgcccggaaggcggaccgacaggccgtgcagagcgcgctggagacggccggcgcgaaggccttcgcatcgaggccctaccgcgagctgtccgagggccagaagcagcgcacgctgctggcgcggctggtggccaccgaggcggacctggtgctcctggacgagcccaccgccgccatggacgccgtcgccgagcacgagacgatgcagcgactgtgcacgctgtcgcgtgagcggggcctgggcgtggtggtggtgtgccacgacctggaggtcgccgccgagcacgcggacgtgctcgtcttcgtggaccgcgagacgtccgccttcgtcgtgggcgatgcccgcaccgtcttttgtcaccccgccttccgccgccagtacggcgacgagtactgccaacgcgcgcccctgggacctcaccgtggaaacgacgctcgctga

SEQ ID NO: 4426 - DNA, 573 bp, Myxococcus xanthus
aaactatcggcgattctcttcacgggcattgaaggccctgatgggctctcatggcgtgacgaatcgctccagaacgacatgcgggatgagcatgcgctgctcgtccgtgagttgttgccgcgccatggagggcgtgaggtgaagcggctggaggatggcttcctcctggagttcgaaggcggcccctcggcggtggacttcggtctggaattgcagcgcgtcctggacgcccgcaacggagacgtgtccgccgagcgccgggtcatcttgcgcgtgggtgtccacctgggcatggtggtccaccgagacggtgatgtgtttggagaaggcgtcaacctggccgcgcgcatcgaggcgctggcccgtcccggcacgctctatgtcagcgagacggtggcgcgtcaggtggaaggccgcctggcttcaccgccggttcgcctgggccgtggtgagatgaagaacatccggttgcccgtggccgtctaccgcatcgacccgcccgagcaccgccgccggatgccgctgctgtcgcgcatgcgttccttctgggggcgccggagcgcggcgaactga

SEQ ID NO: 4427 - DNA, 1899 bp, Myxococcus xanthus
aggattccgagcgggccgctcgagcaaaagtgggagcgccgactgcgcgaaggacgcctggttggtccgagcaaccggcgcaagtacacactgctcgtggttggctccgggctggcgggggcttcggccgcggcgacgctcgccgagcttggctaccgtgtgcactgcttctcctttcacgactcgccgaggcgcgcgcacagcatcgccgcgcagggcggcatcaatgccgcgaagaactaccgcaacgacggcgacagcgtgtggaggctgttctacgacacgctgaaaggcggcgacttccgctcccgcgaggcgaatgtctacaggcttgcccaggtgagcaaccgcatcatcgaccaatgcgtggcccagggagtccctttcgcccgcgaatatggagggctcctcgccacacgctctttcgggggcgcgctcgtctcgcgcaccttctatgcgcgtggacagactgggcagcaacttctcctcggcgcctaccaggcgctcgagcggcaaatcagcgcgggccaggttcgcatgcatccgaggaccgaaatgctcgatctcgtcatggtcgacggacgggcgcggggaatcatcgcgcgcgacctccggacgggcgagctgagggcgttcgccggcgatgctgtgatcctcgcgacaggaggctacggcaacatctaccatctctcgaccaacgcgcgaggctcgaacgcgaccgcgatctggcgcgcgtaccgaaggggcgccggcttcgccaacccttgcttcacgcagatccatccgacctgcatccccgtcagcgggcctcatcagtcgaagctcaccctgatgagcgagtccttgcgcaatgacgggcgtgtctgggtgccgaagctcaagggggaccagcggacaccgcgcgatatcccggagagcgaacgggactacttcctcgagcggcggtacccaacctacggcaacctcgcgccgcgtgacatcgcctcgcgctcggccaaggaaatctgtgaccagggcaggggcgttggccccggcgggcgcggcgtgtatctggacctcggtgatgccattgagcgtctcggggccggtaccattcgcgaacgttacgggaacgtcctcgagatgtacgagcgcatcacgggcgagcacccgtaccgggcgccgatgcggatctaccccgccgtccactacaccatgggcgggctctgggtggactacgacctgcgcagcaccctgccgggcctctacgtgctcggcgaggcgaacttctccgaccacggcgcgaaccgcctcggcgcgagcgccctcatgcaggggctcgccgatggctacttcatcgtcccgaacaccatcgcggccgagctggcgcgtttcgggccagggtcggtcgaccttgaccatcccgcgtttcgagacgccgagcgcatcgtgcaggcaaagctcgagcgcctgctcgcctcgcgaggcacgcgaaccgtcgaggaccacttccgcgcgctgggtagcctcctctgggaacaatgcggcatggcgcgcagcgagcgcgggctgtcctccgcgctcgagagcatccaggcgcttcagggcgacttcgagcgagatctccggctgccggacaccggcatcgagctgaacgactcgctcgagcgagcagggcggctcgccgattactacgagctcgcggagctgatgtgccgcgacgcgctcgagcggcgcgaatcgtgcggagcgcacttccgcgaggagtttcaaacggcggaaggtgaggcgcgccgagatgacgagcacttctgccatgtgtcggtatgggaataccgcggccaggatcgacctcccgcgctccacaaggagccactctccttcgagtcggtcgcggcggagaccaggagctacaaatga

SEQ ID NO: 4428 - DNA, 474 bp, Myxococcus xanthus
atggaacagcgactcgatttcccccagaaatcatccagcgcctaccaggcgatgctcggattggaacgcttcgtccgcaactgtgggctcgagcaccccctgctcgatctggtcaagactcgcgcgtcgcagctcaacggctgcgcctactgcatcgacatgcacacgaaggacgctcgcgtcgccggggaaaccgagcagcggctctacgggctgtcggcctggcgcgagacgccgttctacactgaacgcgagcgcgccgcgctcgaatggacggaagcgctgacgctcatctcgcagaacgatgtcacggatgagctgtacgaccgcgtgcgccaacacttcagcgaagaagagctcgtcagcctcacgatggcggtcatcaccatcaacggctggaaccggatcgccatcccgttccgctccgtgcccggcagctaccaaccgccggcccgcgcggcggcgcatccgtga

SEQ ID NO: 4429 - DNA, 193 bp, Myxococcus xanthus
gtgcgcttcgttctgcagatctggagacaggagaggccgcggtccctgggcgccttccgccgttacgaggtgtctgacatcaccgccgacatgtcctttctcgagatgctcgatgtcctgaacgagcaactcgccgccaaaggcgaggccccggtcgcgatcgagagcgactgtcgcgagggcatctccggga

SEQ ID NO: 4430 - DNA, 366 bp, Myxococcus xanthus
atggcccagcagcgcgccgagtacatcgtgaaggcgctggcacctccgaagaaaatctggaggtttcgcaaccgccccgtgtccggggtcctcgacagtgtgaggcgcgccggcgaggggctctacgtcgtcgggctcgactaccacgtcgggttcctctggaacgacagcgcgcgggtgtggatgtgtcacgcgtcctacctgcgcgaagccacggtcgtctgcgaggacgcgctcacctcccccgcgatggtgtcgcgctaccacgtcgtcgggaagttgcttgagaaccggatgatggacgcctggctggaaggacaggtgctccccgtcttcatcccgtcggggcaggagccgaccgactga

SEQ ID NO: 4431 - DNA, 600 bp, Myxococcus xanthus
atcgagtcactcctccgtctcgccgcccgtgccgaccgcatcggaatgaacgtccttcgcgccggcctgatcgtcgtcctcgtctggattggctcgctcaaggtcgccgaatacgaagccgacggcatcgtcccgttcgtggccaacagcccggtcatgagcttcgtctatgcgtacgacgcccccgaataccggcagcatatgaatgccgaaggcgcgctcgttcccgccaaccgcgcatggcacgaggcgaacgggacctatgggttctcctacctgctcggcggcgtgatcgtgctattcggcctgctcatcgccgcccattggtggcgcccggagctcggcgcgattggcagcgccctcgtgatcggcatgtcggtagtaacgctctcttttctcgtcaccacacctgagagctgggtgccggcgctcggcgacgcccaccacggctttccgtggctgagcggccgcgggcggctggtggtcaaggatgcaatcatgattggcgccgccatcgtcaccatggccgattccgcgcgggtctggctggcgcagcgcaagccgcagccggccgagcagttccaccgcgccgccgcctga

SEQ ID NO: 4432 - DNA, 612 bp, Myxococcus xanthus
atgcgattcttcaaaatgtctgtctatctttgtaccgctgttctcttccctgcctgcggcggagaggatggggtgaccgggcaggacgacgcgctggcgcagcaagagtcagcggtgtcatccgtgtcgcttgacggatgcatctacagcatctccgcgtacccgcagccgaacgtgacgccgactgtctatgacgtcaagctcttccgccagcccatcccgacgtgtgtgtatggttacggcagcgtgaccctgggcacgtccatcgtctatgagccgacgcgatccgtggcggggaacgcgctgggaatcgccgcgagctacaccaagaagtcgagcctcagcggcagcgcgcccatcaccctcagcgtgcaccacgtggacccggccacactgaccgtcatccggagcagcggcttgggcgtcttcctgggggcgggcaacatcgtgtcggagaacgtggcgattgccgcggacggcaccacggtaaccgtctcgggctcgaagaccggcgtcatctcgggagagagcggcagcgggagccactacacagcgaggtatccggacttcttcaccagcaccacgccgccgacgatcatggcgttcccgtga

SEQ ID NO: 4433 - DNA, 339 bp, Myxococcus xanthus
atgggcatgggcggctacaacagccagggcctgtgcgccacgggcgtcagccgggccatccgcaattccctgggcattggcgtgtcgggcaacggcaaccagattgacaacaacctcccgcgcgacaagttcaagcaggtcaacatgtcgctggaggaggcgctgaagattccgggcctcgtcctcacctgggagagcacctccacgcgcctgggcagcatctacggccacacggccgtcaccctgggtgatggtcactcgtccgcgagcgacttcatcgagcgcaacacgaccaacagcgggcgcacgggcttcaaggtcttcatgcccatcgtgtag

SEQ ID NO: 4434 - DNA, 522 bp, Myxococcus xanthus
aagcccgctcctgagaaagttgcagtcgctccctatgatgccggatggccgacgcgctacgcggagcttgccgtggccatccagggtgtgatgggcgcatcggccatgcaggtcgagcacgtcggctcgaccgccgtgccgggcctttccgccaagcccatcatcgacatcgacctcatcgtcgccgaccccacgcgcgaggacgactatgtgcctgccctcgagagcctgggctacgacctcatcatccgcgagccgtcctggcatcagcaccgctgcctgcggctcgccgcgccacgcgtgaacctgcatgtgttcggcccggactgccccgaggtgattcgccacctcatgttccgcgactggctgcgcgagcacgacgacgaccggcagcgctacgcggcggtcaagtacacctccgccgaaggcatggacgatgtgatggaatacaaccgccgaaaggagccggtgatccgcgacctctacgcgcggatctttcgcgcggcgggctggattcgctga

SEQ ID NO: 4435 - DNA, 207 bp, Myxococcus xanthus
atggaggcgcgcaccgtgcgcctctacgagtgcgagccttgtgacaggtccttgctgttcgcccgcgcggtgaagccagcgcgcgccccgaagacgcccgcgcgtgccttcgtcgagtaccgggacgccgccgcgctgaagaagccgtttcccaagggcttcgtgccgtggcggtacgagcgcttcctcacgcgtcaacacgagtga

SEQ ID NO: 4436 - DNA, 195 bp, Myxococcus xanthus
atgtatctgctccccgtgctcgtcgtcctcatcgggacggtggccctcatctgctacgacgagttcgtctttcaccgtcggcggtgcgaccggtgggaggccctgctgcaccggacgctgctcgccggccatgcggcggccttcctcgcgtgggcgcatttctgcttcgtccgtgagaatcttcgtggcggatag

SEQ ID NO: 4437 - DNA, 639 bp, Myxococcus xanthus
ctcacacttgtcgtcggttcgaagaactactcatcctggtccctgcggccctacctcgcgctggcccacacgggacagcccttccaggaggtggtgattccgctggctgttccggacacagaggaccggattgcccggtactcccccagcaagcgcgtgccggtgctccagcacggcgacctgaccatctgggactcgctggccatttgcgagtacctggcggaggccttcccccaggcccagctatggccccaggacatggcggctcgcgcggtggcccgcgccgtcaccgcggagatgcactccggcttcggcgcgctccggcagcacatgaacatgaacctgcgcgcgcgcagcccgggcaagggccgtgcgcccggcgtggcggaggacatcgcccgcgtccaggccctctggaatgactgtcgcgggcgcttcggccagggcgggcccttcctcttcggccgcttctccatcgcggacgccttctacgcgcccgtcgtcacccgcttcgtcacctatgacgtggcgctggacgcggtgagcgcggcctaccgcgacgcggtgctcgcgctgcccgcgctccagaagtggaccgaggaagggcggagcgagcccagcatcccgaagtacgactga

SEQ ID NO: 4438 - DNA, 900 bp, Myxococcus xanthus
ctcaacgacggctatgtgtatcgcgagaagctcgggcgccgaccgggcagcagcgcgctcgcccatatgacggacaagtatcgtcactcctcggaggaggagtggcgggcacgcttcgcgcggggcgaggtgcgactcgacgacgtcaccgccgacggctcggagccgctgaggccggggcagtggctgtgctggcaccgcccgccatgggaggaggcggacactccgcagtccttcgagctcgtgtacgaggacgcggagttggtcgtcgtggtgaagccgagcggactgccgaccctgccctcgggaggcttcctgaagaacaccctgctctccttcgtccaggcacgatggcccgaggcggttcccatgcaccgcctgggacgcgcgacgtcgggcctcgtgctcttcacccgcacccgcgacgcagccgcgcgcctggcgagcgattggcgcgagggccgcgtgcacaagcgctaccgcgcactctcccagggactcgccgcccaggagtcctacgacatccgcgcgcccatcgggttggtgccccatccgcggctgggcgaagtccatggtgccagtgcgcggggaaaaccctctcacagcacggcccgggtgctggagcggcgcaccgagcacaccctcttcgaggtggacatccacacggggcgctccgagcagatccgcatccacctcgccttcatcggccacccgctcgtgggtgacccgctcttcgccgtgggcggcctgccgctggcggagaaccccggcctgcccggagacggcggctatctgctgcacgcggagtcgctcaccttccagcacccgcgctcgggcgagcacgttcagcttcaggcgccagccccgctcgagctccgcgtccaggactcctggcggtag

SEQ ID NO: 4439 - DNA, 606 bp, Myxococcus xanthus
atggcgcccctgtgcatccgcgcactggggatgatcctgctggtggcggtgctggtgtggcgcgacagacaagggcccgcgcaggtagggctggcgcgcgagggctgggcgaaggagctgctgctcggcgtaccggtgctcgtcgccacctacgcggtgcacatcgccgcgtcggtgcccatggcggccgtcgccgtggcgttgaagctggccgacaaggagatgctggcgcgcaagggcctggccaccgcgctcatcgacaccggcctggacgtgcccgccttcgcggccatcatggtgctggtgacaggcttcgaggagttcgtcttccggggcttcctcgtgccccgcctgcgcgtggtgatgggccgctgggtgcccgcggtgctggtcgcggccgtgctgttctccgtgggccacttctacgaaggcacgctcgccgtcttccagaccttcgtgatgggggcctggttcgggttcgtcttctggttccggggacgcctgctgcccctggttgtcgcgcacgcggccttcaacaccatcagcttcgcgctggtgatgtggctgtcgaagtcaggctacctggacaagctgccgccgctttga

SEQ ID NO: 4440 - DNA, 1273 bp, Myxococcus xanthus
  unsure (1)..(1273): unsure at all n locations
atgacattcgcttcgctcggcctgtcggacgcgctcacccgcgccgtggccggactcggatacgacgaacccacgccggtgcagcgcgcgaccatccccgtggtcctgcgaggtggcgacgtctgggcttcggcgaagacgggctcagggaagaccgccgcgttcctgctgcccatcctggaagccctgcgggcacgtcccggagggtcggtccgaccggtgcgggccttcatcctggtgcccacgcgggaactcgccgcgcagatcgtcgattcaatccagcggtacggccaacacctgaagaagccgctgaagacctgcctcgcgagtcggtggcgtctccgccaacccgcagatgctggcgctgcggggcggcgcggacatcgtcgtgnccacgcccgcccgcgcgctggacctggtgcatcaaaacgcgctccggctggaccaggtggagacgctggtgctcgacgaggccgaccgtctgttctcgttgggcttcgccgatgagctcaacagcctgctggcgctgctgcccacgcgccgccagaacctgttgttttccgccaccttcccgcccgcggtgcggaagttcgcggagcagttgctgcacgagcccacgcgcatcgacgtcgatgacggggagctgccctcgacggagttcatcctccagcgagccctccaggtggatgtgccccggcgcacgatgctgctgcggcacctgttggaaacacatgcgtggagccatgtgctcacgttcgtggccagtcgctacacggcggaccatgtcgccctgaagctgaaccgcgccggcatcgtcgcgacgtcattgcatggggaactcagccagggcgcgcgcacgcgggcgctcgcggacttcaaggcgaagcgcgtgcgcgtgctcgtggccacggacgtcgccgctcgcggcctggacatcgcgcagctgccggcggtcgtgaactacgacctgccccgttcgaccgcggactacgtgcatcgcatcggccgcacggggcgcgcgggcgacaagggcgtggcgatcagcttcgtcagcgcgggcaccgaagcccacttccgactcatcgagaaacgccaccagctcgacctcccgcgcgagcaggtgccgggcttcgagccgacggaagaggtctcgacgaccacgccgccccgggatccaaacggcggagtgaagggtcggcgcaagagcaagaaggacaagctgcgcgaagccgccgctgccgccgccactcgccctccgaagcaagggccgtag

SEQ ID NO: 4441 - DNA, 744 bp, Myxococcus xanthus
atgaagcggctcatccagggactgtccctgacgtctctgtgtctctctctggcggcttgtggtgccaacaagtactacacgctgcccgtcgactcgcatgacgcctcgacgaccaagacgtccatcggcgtctgcgccctggagagcggtctcgagtcgcagtccatggacaacacggccatcgccgtcacctacgatgcgacctccacgatgtattaccgttacaatgggaaggacgcgtacaccttccaggtctccgtggacgacaagcaggttcctccggaggagctggaagcgaagctcgccacggtgcgcaagaagggcgaggagctgtacctctgcgcccaggaccgcatcaacccgcgcttcgtcgccgcccctacccacgcgcccgcgcagacgaacgtcaccatcaacctgaacgccccggacgcgaactcgcgggactccctgtccgctggcgcgtcggtgtcgacgaacacgaacacggcctctgcctcgacgacgtcatcctccgcgtcagtggacctgggcgagggcacctgcgcccgcgccgtagactgctatgcgcggctggccaagacggtctgcgagggcgcgcaggactgcagcttcaaggtggagatgtctggcaacgacgaggcgagctgccgtgacgcgctgctccgcgtcccggacctgattcagccgttcaagatgattcgccccaacctctccgcgccggccgtctgccgcgccgagtag

SEQ ID NO: 4442 - DNA, 1118 bp, Myxococcus xanthus
tgctctaaagccgcaccggtgggggtgcacaacctctacggcccgacggaagcagcggtagacgtcacgtactggccctgcccgcgtggagaggacttccaccgggtgcccattggccggccggtggcgaacacagtgctgtacgtgctggacgtgcacgggcagccggcgccggtgggcattccgggcgagctgcacattggcggcgtgcaggtgggacgcgggtactggcagcggccgcagttgacggcggagcgattcatccccgacgccttcagcggcattccaggcgcgcgcctgtaccgcaccggagacgtggcgcggtggctggcggacggcacgctggagtacctgggccgggccgacttccaggtgaagctgcgcggtttccgcatcgagctgggtgaagtcgaggccgcgctgcgcgcccacctcgatgtgttcgacgccgtcgctgtggttcgcgaagacgccccgggcgatcagcgcctcgtagcctatgtcacgggggagccagccctggacgtggcggcactgcgggcacggctggttgagcagctaccggcccacatggtgcccacggccatcgagacgctgccgtccctgcctctgtctcccaacggcaaggtggatcgtaaggccctgcctcaaccgagggccactcctgcccctggagccgctgcccccctgcccgtgcaagagcgcatgactcccttccaacagcgcgtcgcagccctcttccgtgagctccttcgcgtggagcgcgtgggcctgcacgacgacttcttctcgctgggcggccactcactcctggccacgcagcttatctcccggctgcgtacgaccttcggcgtggagctctccctcaacgcgctcttcgacgcgccgtccgtggccagcgtcaccgagctcgtcgaggaaggcatgctcgttcgtgtcaccgcgccccagattccagtgctccggcccgtggcgcgcgatgggagcctgccgctgtccttcgcacagcagcgactgtggctcatcgaccagctccagcccggcggcagccagtacaacctgccgggcgcggtccggcttgaaggcgcgctggacaccgaggccctgcgccgagcgct

SEQ ID NO: 4443 - DNA, 96 bp, Myxococcus xanthus
atggccaccgagggcgcgctctactggctcgacatcccgggccgcaaggtgcaccggctggagctccagagcggtgcccaggcgagctgggacacc

SEQ ID NO: 4444 - DNA, 594 bp, Myxococcus xanthus
atggtcagtccgaggacggcaccaatccggacaggaaacaccagtaccttcatcttgaagcagcgacggctgcacctggtcctgttggatccacaggaagtgccctacgcggagacggaatacgtgctcacggtcggccgcaccgagcactgcggcagaacggcggcggatggctcgttgagccacgaagtcccgggcctcgccgcgggtgagttgctggtgaagctgtccaaaccgccagcgccaccgccccgccggagcgcgcctcccgccgccaccaagggcgcgccaccgccctacccacccgccgtcaccgatgaggactttccggacgccacgccgaccgccgcgtccgaaccggtgacgctccgctgggcgctgcagctccagtcgctcccaggattcgagtccgacgccctccgggccgcgcaggagcgattgcacaacctgggctacgccattgaaggtgagcgcgggtcgcccggagcctcgacgaagtccgccgtgcgagcgttccagcgccgccatggcctgccggaaacgggacagctcgcggacatctcccgcgaactcatccgcctgcacgacgcctga

SEQ ID NO: 4445 - DNA, 114 bp, Myxococcus xanthus
atgggctacgacttcacgacggagcggcgcttctgtgggctctgtctcctgcgcctgcggggatggaacacccacgccctggaccgcgacggtgcccggaacgcgcggccatga

SEQ ID NO: 4446 - DNA, 3309 bp, Myxococcus xanthus
atgatgaagcgcagcagaagcccgattcgggatggcgagtccgaggaactggcttggctggacctcctgcgactccacgccgccgagcaagacctggcaaacgcgccggaggtctccgtcgtcgtgccgtgcgagcaaacggtcacgaacgacgtcacggcgaacgtcgccgtcgcgcatgtaccaggctggttcgacgacgcagggcaagggacacgcccggcgatcgtcatgctgtccatcatagagacgcacccagacctgccgtatcaggggagcgggacggtgagcgtcacaggggacgccgacctgttctgcgatagcaactgcacgactcccgcagctgaagcgttcacggcggaggcacttcgcgcgactctcccgctcttcgtgcggggcaattcagccggcaacgtgacggtgacgctcaccatcactccagacgccaacccgaacgttcgcgtcatcgtaccgtcagcgacagaagtcgtcggcattcaggccatcaacgtggtgaacccgacggtgacagtgggagaggccatcgcgtggcaccacgaggaacagttcgcggccgcgcaaattacgctgggcctcgctgagagcacagggcagccgccgtacgcgggacgaggacggcccaccgtggtgggtggttcgctcttcaccgatgcgaactgtgagactcccgtcgacgccttcgacgcgggcgccctacgtcacggcgtcaccgtctacgtcaaaggcgcgaacgtgggcaacgccagcgtccagctcgcgctcgatgccgttgactccccgggcatccgcgtcgcgcctcctcaaactggagacatccccgtccaggccatcaacgtggtgagcccgacggtgacagtgggagaggccatcgcgtggcaccacgaggagcagttcgcggccgcgcaaattacgctgggcctcgctgagagcacagggcagccgccgtacgcgggacgaggacggcccaccgtggtgggtggctcgctcttcaccgatgcgaactgtgagactcccgtcgacgccttcgacgcggacgccctacgtcacggcgtcaccgtctacgtcaaaggcgcgaacgtgggcaacgccagcgtccagctcgcgctcgatgccgttgactccccgggcatccgcgtcgcgcctcctcaaactggagacatccccgtccaggccatcaacgtggtgagcccgacggtgacagtgggagaggccatcgcgtggcaccacgaggagcagttcgcggccgcgcaaattacgctgggcctcgctgagagcacagggcagccgccgtacgcgggacgaggacggcccaccgtggtgggtggctcgctcttcaccgatgcgaactgtgagactcccgtcgacgccttcgacgcggacgccctacgtcacggcgtcaccgtctacgtcaaaggcgcgaacgtgggcaacgccagcgtccagctcgcgctcgatgccgttgactccccgggcatccgcgtcgcgcctcctcaaactggagacatccccgtccaggccatcaacgtggtgagcccgacggtgacagtgggagaggccatcgcgtggcaccacgaggagcagttcgcggccgcgcaaattacgctgggcctcgctgagagcacagggcagccgccgtacgcgggacgaggacggcccaccgtggtgggtggctcgctcttcaccgatgcgaactgtgagactcccgtcgacgccttcgacgcggacgccctacgtcacggcgtcaccgtctacgtcaaaggcgcgaacgtgggcaacgccagcgtccaactcgcgctcgatgccgttgactccccgggcatccgcgtcgcgcctcctcggactggggacatccctatccaggccatcaacgtggtgagcccatccattcgctgcgatgagctcgtgctcgtccatggcaaccatgacaaccggtcgacagatccctcgcggctgatcctcgaaatagatcagacggacccaacacatacatgtggagacctcaatctccggctggactacggagcgcagattgcatgcttcagggaccaactgtgtacaaacgcagtggcttccgggacgactttcgcggccaatcagctccccgtaacgctctatatgcgcggagtgacggccggcaattgcgacgtgagtgctgaagctcgcggaacggcgggctccgcctggcggcttgccgcgcgcgcatcgaagacggtttgcgtcgagaagatcgagctgcaagtccccaccttcgctgggggattgtccctcaatcccgacccgctgctcaacgcccccaagcagcgcgagctccacgccaaaaacaaccaagccttcacattcgccaagatgacggtgaccgccccaagcaatgcgttctggcagaaggccgaccaattgtcgttggagcacgccaacctggaggtcttcgatgacgcggctggagcacttgcggggaccgctctcctcaatcaggcccacttcggcggccatcctgtcgttcgctacttcgccacgcaaggcaacaacccagcatgggatgcaatcccaacgcatgggcacggaattcccgccacgcgcaatccggtcaaggttgtcacagccaggtacgtctcgtgcgccgctcggataagtgcagccgcatccgcagacggcatcccgcgaacactgaaccatggggacgtcgtgtgccttgataccttcagcttcgatcagcacctcgatagactgacgggcaacgagtgtcggacacgagccctggccggtcccgccaacacggatgtcgcgcttgcgctcgccgcggcgcacaaatactacggccgacgaaccgctttctgggtcaaccgcaactatcgagccattgggggatcgccatttggtctattcctcaattcgatgaacaatccgcacgggaacaacaacacctgggcgaccgctggcgcgaactggattgagaacttcctcctgaacgaccacggcatcgtcctcaatgcgcagatgaagacccggatccgcaaccacatcttcgcggtcatttcgggagctacggtcattccacatggtacaaatgccgcctatggcttcgccgccttgtacggagtacccggagttcatgcggagtgcctcgcgaccaatcagctcctcgccgcgggcgtcgcagcgacagacgtcacggtggccacctacatgctacaggagcagcatcaacgtcaggggcgccccttcgtggcgtgtccaaactgctccggcatcctggtcgcccccggccagttccgggtgattacgggatga

SEQ ID NO: 4447 - DNA, 297 bp, Myxococcus xanthus
atgggccttttcggacagcgcatcctcaagctgctgtcgctcttcaccgtctacgtgctgcgcttcggcaggctgccgctgcgcgtggtgttccgcttcggccacctgctggcgcgggcggatgaccagctcgggtggaagcccacgctgctggaccagctctatgatcagctcctgggggacttctcctcggagcgccgtgacgcggtgtcgaagttcctcagcgacgtgggcaacgacacctcgctgattccacagctcacgccggagggcatcgacctgttcaacgccagcacg

SEQ ID NO: 4448 - DNA, 738 bp, Myxococcus xanthus
atggcctacatcgacggattcgtgatcgcagtcccctcggcgaacaaggaggcgtaccggcaggccgctattgctgccgcgccgctgtacaaggagtttggtgcgacgcgcttcgttgagaactggggggacgacgtccctgaaggcaaggtcaccgacctgcggcgcgcggtgaaggccgagccggatgaggtcatcgtcttctcctggattgagtaccccagcaaggcggtgcgcgacgaagcgaacgcgaaggcaatgcgtgacccaaggatgcaggcgatgggcgcgaacatatccttcgatgggaagcggatgatcttcggcggcttcgttcccagcctccatgagggcggagcgggcaggcccggctatgtcgatggctccctcgtgccggtgccggttggaaacaaagaggcctaccatgtcatcgcctcccgtctcgcggcggtgctgctggagcatggtgccacgcgcgtcgtcgacgcgtggggagacgacgtccccgacgggaaggtcactgacttcaaaggcgcggtgaaggccaccgcggatgagcaggttgtcttcgcttggattgagtggccgtcgaaggaggcgcgcaacgccgggtgggggaaggccatggccgatccgcgcatgcacccgggcagcatgccctttgacgagggccgcaggtcccacggcggtttcgtgccgatgctggttgagaccgcggcgacggacacgggcgcatag

SEQ ID NO: 4449 - DNA, 393 bp, Myxococcus xanthus
tgcctgtgcctggtggtccagcaggccgcgcgcgcccttgcgcggcgcttcgatgaagccctgcgccccgtgggcctcacgcatggacagttctcactgctgatgtcgctcaatcgcccccagccgccgtccatcggccccgtcgcggagctcctggcgatggaccggaccacgctgacagccaacctgaagccgctcgaaaggcgcgggctggtgaagaccaccgtcgacccagccgaccgccgcgggcgattgctgacgctgacggacgcagggctccagctccttcaatccgcgctgccccactgggagaagatgaacgaggagacggagcgattgctggcgcaaaccgatgtcgacgcccttcgggctgggctgcgggcgctctcctga

SEQ ID NO: 4450 - DNA, 636 bp, Myxococcus xanthus
cacgccgtcatcgatggcttcctgggggggccgctggcgtccgaattggccgcggtcttcccgggcgcgaccgaggcaagttggaagcgacgcgaccaccccgaacaggcggctcgactggggcagcttcagcgcaaggcattcgaagacgtccccggagcgctccggcacctgctttcggagttctccggcatggcgttcatcgacttcctggagtcactcaccggggtgcaagggctcatcccggatccgcatttccgaggcgccgggctgcacctcacgttgcgtggggggcatctggcgctgcacgcggacttcaaccgcgatcgcttccgcgcgctctcccgccggctcaccgtcctctactatctgaatcccggctgggaacccgcctggggaggggaccttgagctgtggagctcggacctctcccggtgcgagacgcgaatcgcccccctcctggatcgcctggtcgtgatggcccacggcgacgaccactggcacggacaccccaccgcgctggagtgccccgagggacgagggcgcgccgcggtcgcggcctacttctacaccgcggaggaagcccccaacgcaccggagccccacagcgccatctgggcaccaccgcgctcgtag

SEQ ID NO: 4451 - DNA, 1197 bp, Myxococcus xanthus
atgaaaaccggaccctcggagccgctgcacctgccggagtaccttcccgcgttggacgggctgcgcggcgtggcggtgctgatggtgattgcctatcactcactgacagggctgcgcagcgcgtcactgggctcactcttccaggtgggctgggcgggcgtggacctcttcttcgtcctctctggcttcctgattacgcgcatcctcgtgcagacgcgtgagcgtggaggctacttccgtaccttctacgcgcggcgggcgctgcgcatctggcccctgtacttcctggtgctggccttctcctttggcattatggggcggctgctgccggccctggccttcgatacccagcgctactcgtgggtgacctacgcgctgtacctccagaacctttggatgacggacttcggtcctgctcccatcaacgtgacgtggtccctggccatcgaggagcagttctacctggtgtggccgctgctcgtgttcttcctccggaacgggcagctccgcgcgctcctgtgggcgtgtgtgctgctgtcccccgtggcgcgcctcgcggccctgggggagggcgcagcgcccatccaggtctacaccttcacgctgttccgtttggatggactggcgctcggtggactgttggcgctgggcgtggtggatggccgcgctacggcggacggcctgtcacggtggggcgcgcggctcgcggtgcccgcgttgctcgtggcctgcgggttgtccctcgtcttcttcggccagggcgccgccattcacatggcaacggcgctcacggggccgggcggcccgaaggtccgcgtgctgctggtggcgggcctgtacacgctttgggcggtgggcttcgccagcctgctggggtgggtgctctccgggcgcgcgcgggtactccaggccgtgttgcaatggcggccactgcgcttcgtggggcaggtgagctacgggctctacctgttccatgcgctcgtcatccccgctggcggcatttacacgcggccgctgttctaccgcttcattccctcgaccttcgtcgctaccgcggtgggcatcctgttcgagtacgcggtgctgctggcgctcacgctcgtttcgtggcgcttcttcgagaagcccttgctgcgtctcaaggaccgcttcacgcatccggaagccgcggggaaggccgcggctcccgcggcttga

SEQ ID NO: 4452 - DNA, 762 bp, Myxococcus xanthus
atgaagcgcgcgctcatgctccgattcgtggcaatcattgccctcctgaccaccactcctacgctcgcgaacgaagaggcggaaagccccgcccccatcgccgagagcggcccgcccctcagccgagaagaggctctggagcaatatgagctccggcacatcgggttcgatgagtacatcgccgtgacgctttcgtattcgccactggccgtcaggagcccgccgagccgctggaccgtcccgtatgaggggaaatacaagaagccactggagggtgcggcgttctatcagaagctcggccgagacgacctcgttgcggagtatcagtcgagaagcgccacgaagctcaccctgaagatcgtcgggggagtcgtgatggttggcgggctcgtctacggaatcgcctcgccaggcgttcggaccgaagactgcgagctcggccccgacttctcggcctgcattgaccgcaacttcgcggctggcgaccggaagcggaacatgttcctcgtgggaatgggcgtgagcctggtgggagtagggctgctggggtggggcatcttttacaacccccatcccatcgcctccagcgaggcccgcgaactggcggatggccacaacaaacgccttcgccaggagttgggcctgacggatgtccccgctccagccccaggcccacgaaagcggccatacgtcatccaggcccgcctgacgcctgtcttcggcccgaactccgggggactgctggtggacgggcgcttctga

SEQ ID NO: 4453 - DNA, 894 bp, Myxococcus xanthus
gatgccccccagcttgtcgagctcgccggccaccacggactgaagctcaaaccccacaccctgtcggtcaacgaggccggactggactatcgcgtcgtgatggcgcgcgacctcgaagacacccagtgggtcctccgcatcccgcggcgtgaagacgtctccgcgaagctcccggacgagaagaagattctcgacttcatcaatccccggctcggcgtggcggtgcccagatggaatgtcgcccaccgggacctcatcgcctatccggcgctgccgggcaggcccgggctgacgttggaccccgcctcgggcgagcccgtgtggcacttcgaccgcgagtcccccgtctatgcccgccagttcggccagctcctggcccggatgcatgccatcgacgtcgaggatgcccggcgagcgggcctcatcgtcgagacgcccgaccaggtccgcgccaactgggcctccgacatcgctcgcatcaagcaggccttcgacgtggcgcccgccctcctccagcgttgggagcgctggctgggcgacgactcctactggccccgcttcgtcacgctgacgcatggggagatgtaccccgcccatgtcctgctagcgccggacgacaccatcaccggcgtcctcgattggacgaccgcgaaggtaggagacccggcgcgcgacttcgtcttccagaagatgctcggcgtggacgccgtgttcgaggccaccgtggacgcctatgtgaaggcgggcgggcaggtcccagaccgcctgggcgaccactgtgaggaactgctcgcggcttcacccgccggctacgccctcttcgcgctgctcaccggcctgccagagcaccgggcggccgcccaggcgcagttgaaccccgaagcggccatgtag

SEQ ID NO: 4454 - DNA, 525 bp, Myxococcus xanthus
atgaccgctgccctcctgtccctgtccctcgccttcacgctcgtcaccggccagttcgcgccccagcaggcgggaagtgacccgctcgcgccggagctggagacgcgtgcccagacgctgggcaagcagctccggtgcgccgtgtgccagggactgtctgtggcggacagcccgtcctccatggcgcgcgcccagctcgacatgattcgcgagctcgtctccgaggggaagagcgacgccgaaatcgtcgagtacttcgtcgcccgctacggtgagtgggtgctgctgtccccccgcgcggaaggcttcaactggttcgtgtggctgggcccggtggggctcgtcgccgtgggcgccttcgtcatctggcggcagctccagcgcggcgcgggtaccccggagcagaccccgcccgcggccacgacttcggaagaaacggcggccccggccgcgcccgctggaacgcctccagtggatgaagaagacccgtacctccaggccgtgcgccgggagctcgagcgctag

SEQ ID NO: 4455 - DNA, 969 bp, Myxococcus xanthus
atgcagccccagacgacgaattggttgcccggaatcatcgtgctcgccgtcaccttcgtgttggcggcgggctggatcctctttcagcgccgcaagggctccctggcgtcggccgagccccgcgacggcgtgctcgatgacctgacccagcgcgcgcagtccctcatcgaccagctccgcgcgctggaagcggagaagcacaaccagagcgccgagcagtatgccgccgagaagtcccgcctggagcgcgaggccgccgcggcgctgcgcgcgaaggacgagcacctcaagcgcaaggcctccggcgaaggcgtccgcgcccgtccccaggctccggcccccaccgggtgggcgtctcgcaatccgcaactggtgggcgcgctgtggggcgcgggcatcatggtgttctttggtgggctgggctacctgctcgtctccgagcagcagacgcgcaccgacggcatggaagccaccggccgcatgcccccgggcggcgccgccgcgcagcagcagggcgcgggcatggacgaccagatgcaggaaggcccggagatgcaggaggctcgcgcgcggctgaacgccaacgccggagatgtggacgcggcggcgctgctgagccacgagctcatccgccgtcagcagttcgacgaggccgtgaaggtcaccgcgaagggcctggcggcggaccccttcaacgtcgagctgaaggtccaccgcggcgtgcttcgcgccacccagggcgacatggccggcgccgaggcggagctgacggagctggtggacacctggccggacgcgcaggaggcgctcatcttcctgggcagcctcgccctgcgccgcggcgacaaggccgccgcgctggcccacttcgagcgcttctccgtggaagtgccgcgcaacatgcagccgccgcagctcggccccgcgattgcacagcttcgcgcggaggtcgctggcggcatgccctga

SEQ ID NO: 4456 - DNA, 1113 bp, Myxococcus xanthus
atgcgggaggaatgggccgcgctgatggatgcgagcgacgcggggcccttcaacgcctgggagtgggtgtacccgtggtgccggcgcatcgccacgggccggcgcccgctggtgctgaccgcgcgcgacgcggtgggcacgctggtgggcctgatgccgctgggcgtcgagtacctgggcgtcaccggcatcccggtgcggcggctgagcttcctgggggagacacacgtcggcagcgactacctggacgtcgtggcgcggcggggccgtgagcgcgaggtggcgggcgccttcgcgcggatgctgcacgcgctgcgcgacgaatgggacgtattggatttgtcggacctgcgcgaggactcgcccaccgtggacgtgctccgggagaccttcgccaggcaggacgtccgcgtggcgccgcgctacgtgtgtccgtacgacacgctgacgccgggcgaacccttcgacgcgttcctcaagcgcacgggacgccgcgacaacttcctgcggcggcgcaagtggctggcgaagcaggagggctaccgcatcgagcgcacggacgccccgggcgagctggcggcgccgctgacggacttcttccgcctgcactcggcgcgatgggccgcggatgggggctcgcagggcatcaagggctccggcgtggaggcgttccaccgggatgccacgcagttcctggcggagcggggccggctgcgcctctacacgatgaaggtgggcggccatgccgtggcgtcggtgtacggcatcctccaccgcgacaccttcgtgtatttccagtccggttatgacccggcgtggcgcaatcgcagcgtgggcctggtgctggtgggcgagacgttccgcgacgcaatggaggccggcctgacggagtacgacttcctccggggcaccgagacgtacaagtccgactgggtgtccaagcagcggcgcacgctgtccgtgcgggtccatgcggggacgtgggaggggcgctggttctcccagtccgaatccctggcgcgcctgctgcgcaacggcgccaaggcggcgatgccggacacgctggtggagaaggtgcggcgcttccgccgtcggcgggccgcggtgcactga

SEQ ID NO: 4457 - DNA, 1170 bp, Myxococcus xanthus
atgaagcactctggccggctgttcgtgccgtcactgcccacgctgtggccgcacatgctgctgtctcggccgaagcccggcgagctgccgccgttctcctcgcccaacgtccgctacttctacttcgcccgcaatgccatctggctgacggtgaagatgctggggctggattcgggcgaggtgttgatgcccgcctaccaccacggcgtggaggtcgaggcactggtggacgccggcgccacgccgcgcttctaccgcgtgggcagccgctgggacgtggacctggacgacgtggcccggcgcatcggcccgaaggcgcgggccctgtacctgacgcactacgcgggcttcccgggccccgtgggggagatgcgcaagctggcggaccagcacgggctcatcctcatcgaggactgtgcgctgtcgttgctgtcctccgacggcgcggtgcccctggggacgacgggatacgtgggcattttctgcctctacaagacgcttccggttcccaacgggggcgcgctggtcgtcaacggcccgcgccagtacagccttccggagccgcccgcgccgccgtccgtgtccaccttcagccacacggtgtccgcgctgctgcagaacctggagttgcgcggcggcctggccggccgggccctgcgcagcgccgtgcgcacgttggggcatggcaccgtgaaggcggccaacatcgagcgcgtggccacggggacgcagcacttcgaccgcaagcatgtggacctgggcatgagcccgctgacgaagcggattgcccaggcccaggacctggaatccatcgtcgagcagcggcgccgcaactacttcttcctgctgggccggctgcgcgacatctccgcgccgctgttcaaccagttgccgccgggcgcgtgcccgctgttctacccgctggtggtgcaggacaaggcggaggtgctggcgcggctgcgcgtgcagggcatcgacgccatcgacttctggaagcgctttcacccggcctgtgacgcatcggccttcccggaggtggcgcagctacgtcgctccatcgtggagattccgtgccaccaggacctgacgccggaggtcatggcggacgtggcgcaggcggtgcgcgaggcggtgaagtcggaccatcggtcgaagaagcgcgcggggtga

SEQ ID NO: 4458 - DNA, 303 bp, Myxococcus xanthus
atggcgtacgcgtgggccggggactggcgctacgtgtccggcgtccgggtcgtccgcattcgcgcctggttccagacggaggaggaccggaaggtcggtcccacgctggcggtgaatctcgaagggaaaggcaacggcatgacggacgactcggctgccctgccacgtgacgcccgcgaggctatcctgctggccagggggctcggctggtcgcccgaggggcgaggcacgttctggattcagcccgagcacggcctcgaactcgaggcactctcggtcatcgcgcctgacgcatccacgtaa

SEQ ID NO: 4459 - DNA, 1119 bp, Myxococcus xanthus
atggaagcaagagacctttctgcctcgccgcgcgtcaccgaagtgacgggacgcgcggccttcatatctctggagtccgagtggaacgcgctcgtggaggtcacctccaacgagctgttctaccggcatgagttcatccgcatctggatggacaacttcgtacccggtgtgattccgcgcgtgctgacgctgcgggacacggacgggagcctcggcgcggtgctcccgctgtgggaggagcgtacgacgctgctgggggtaccggcgcggcagctgtccgtggcggccaacgcccactcctgccggttcgacctggtggcgaaggaaccggaggtcgccgcggcggccttcgtgtcccacctgcgctcggccggtggctgggatgtgctgcggctcacggatgtccccgacggtggggccgcctggcggctgcacgcggtggcgcgcgagtccggcctgcccgtgggcgagtgggagtccctgcgctccccgtatgtgccgctgccggcgacccgcgatgccttgcagaagacattgcagtcgaagttcaaggccaactgccgtcgtcgccgccgcaagctggaggagaagggccagctcaccttcgagcgggtggacagcgggctcggcctggagggcgcgctggaggagggctttctgctggagcagagcggctggaagggcgcgcgcggcacggccatggcgcaggatgcgcgcacgcgcggcttctacacggaactggcgcgggactcggcctaccgccagcggctggcgctgtacttcctgcggctggacggccggccggtggcgttccagtacggcctggaatacggcgggcgctacttcctgctgaagcccggctacgacgaaagcctgcgtgagtgcagcccgggccagctcctggtggatgaggtcatcgggaactgcatcgaccggggcctgcacgagttcgacttcctggggcccgacatggtgtggaagcgcgactggacgaacgaggtccggcgccacacctggctctacgtgttcaatgactcccccttcggccaggcgctgtgtgcggccaagttccggtgggggcccgcggtgaaagaggtggtgtcgcgatggagacgatga

SEQ ID NO: 4460 - DNA, 483 bp, Myxococcus xanthus
cgcgtcacggtgagtcctcgctcgccgccgcccaccgagggcctgctggaggccatctacacggcggacctcatcgccatcggcccgggctcgctgtactcgagcgtgctgcccaacctgctggtggacggcgtggcccaggcgctcaaggagacgcgcgcgctgaaggtcatggtggccaacctgatgacgcagccgggggagacggacggcatgtcctgcctggaccacgtgcaggccgtcacggaccacgtggggccggtgctggacgcggtgctcgtcaacggcacgctgcccacggaagaggcgacccggcgctatgcccgtcgcggctcgttcgtggtgtcggccaacccgcgggacttgattggcgcgggcgtggtgccggtgcatgcggacctgctcaaggcagggtccaggatccgacacgacagccgcaaggtcgccgcctgcctgctgaagatggcccgcagcgggttgtag

SEQ ID NO: 4461 - DNA, 3084 bp, Myxococcus xanthus
atggggttgcagttcgaggagctggacacggcgagccgcgcgctcgtcgaaatgatgttgatgcggaagaccgtcgcggattccaacgcgcccgccgttcagcccctgcccgccatcgcgccatccgtggcgcctgcgattgcaccgtccatcgcgccgtccgtggcgcccgcgattgcgccgtccatcgcgcccgccgtcgcgcccatggcgcagtcccgtcccgcgcctccggtccaggcccgtcccgcgccccctgtgcaagcgcgccccgccgccgcgcccgcggatgtgggtggtatcgcgctcgactccctgttcgatgacctggagccggagggtggttcctccgcgccgattccggacgagccgctcgacctggttccgtcggtggtggaggagccgaggacaccgcctccgagccgcgtgcccgtctcctattcgccgccgcctccggtggccgcggatgacgtggacattccgctcgacgagctcatcgcgagcacgccgcctccgcccgtggccgcgctggacatcgatgagcccctgccgggcttcgagttcgaaatcgagagcccgtcgggtgatgcgcccgtggccatgggcgcgccgctcgatgagccgcccatcgaggtcggcatctccctggaggtcgagccgtcgtccgcgccggcgggtggcggggccctggagttcgagctcgacctgggtgactccgtcgctgagccgcctcgtgcgcccgcggttccacccgtgcgagtggtacctccgccggcgcctgtctccagtgacggcggcttcgagttcgacctggacctgagcgatgcggaggccgcacctccgccgcgtgccccagtggcccccaaggcaccgccggctccggtcacgtctcccgcggggagcggtggcatcgagttcgatttcgacctggccgaggacgtgagcccgcctccgcccgtggcgcctccaccgccgcgcgcaccggcggcgccacctcccgcgcctgtctcagccgggggcgtcttcgagttcgacttcgccctgtccgatgacgcggggacggtgccgcctccgccgccgcgcgccccctctccggtcagcgcggggggcggcggcatcgacttcgacctcgacctgtccgaggacgtggaggaagcacctcccgtcgtgcctccaccgccgccgcgcgcggcgatggttcctccgcccgcgccggtgcagccgcccatggcggcccgcccgttgcctccgccgcccccggttccgccgcttcttctcaagggcttccccaagtgcgccgtgaggcgcctcgggcaccggagccggcggagacgccctcggtgctcgcgcccgccgtggcgaaggccgccgcgcaggcgcccgggcctggatgaacacggcctgccgaagacggtgttcctgcctccaccggtgccgctcagcggcacggggcccgtcatcggcattgacctgggcaccacgaactcgtgcgtggcgttgctttccaacggccggccgctcgtgctgcgctcgcgcgagggctacaacacgattccctccgtcatctcgctcaacgcgcagaacaagctgctggtcagccaccgcgcgaagaaccagttggtgctgcgtccccagcacaccatctacggcgcgaagcggctcgttggccgtccctacgacagcgccgtggtgaaccaggtccgcgagcgcttccactacgacatcgtccctgactccgctggccgcgccgccgtgcgtctggcggacacggccctgtcgctggaagaggtgcaggccctcatcctccgcgagtgcaaggagatggcggaggcccacctcaaccagaaggtggagcgcgcggtggtgacggtgcccgcgtactactccgagccacagcgtgaggctgtgcgcaagtccggcatcctcgcgggcctcaaggtggagcgcatcctcaacgagcccacatccgcggcgctcgcctacggtctcaaccgcgagctcaacaagaaggtcctcgtctacgacctgggcggcggtaccttcgacgccacgattctgaaaatcgagaagaacgtcttcgaggtgctcggcaccggaggcgacgtcttcctgggggggatcgacttcgacaacctcatcgtcgactacctgctggcgcgcttccaggagaaggagggcatcgccttcacgggggacggcatcgccttgtcgcgcgtgagtgacgcggccgagcgcgcgaagatggggctgtccgagcgcagcaccttcgaggtccacatccccatgctgatgatggacgactcgggcaggccgcgtgacttgcgcgtggtcctcagccggcaggagctggagaagatctgcgagccgctcctcagccgcaccatcgacgtggtgcgcgacgtgctcctggacgcgaagctgaaggccgccgaggtggacgacatcatcctcgtgggcggcatgagccgcatgccgctggtgcgcgacaagctcaaggggctcttcggcaagggcgcgcaggccagcgtcaacgcggacgaagccgtggccctgggcgcggcgctctactcgggctccgtggacaaggtgagcagcgtggtgctcatcgacgtgctgccgatgacggtgggcgtggccatgcccggtggcgccttcaagcgcgtcatcgagcgcaacagcccgctgcccgcgcagcgctccttcgccatcaacacgacgaaggacaacgaggtcttcctggagctgtccatcttccagggcgaggacagccacatctccgccaacgagtacctgggcaccgtgcgcatcgaaggactgcccaaggggccgaagggctcggtgcgcgtggcggtgacgctcaagctggactccgaatgcgtgctgcacgtggaggcgcgtgagtactccacgcgcaaggaagtgaaggccacgctggccacgcgctactcgccggaggagctccagaagcagctccaggtcagcaaggagtccgtgaaggccgccgaggagcgccgcggcgccgacctcaaggagcgcgcgggcggcttctggagcttcgtgaagaaggcgctgggcaggaagtag

SEQ ID NO: 4462 - DNA, 252 bp, Myxococcus xanthus
atggcgctgcgcgaggccgtcctctgttggacgctcttcggccaccccacggtggtggcgctctgcgcggaggtcgcggcggatacggccgagtcacgcgcccggctcgacgccgccgcggtggagtgcttccagctcatcgcgaagcacgtcgagcaggcgccccagctccacgccctggcccaggggctggcggggagcgggggcgacgagacgctcggccggatgctcgtgctgctcaaggggctctga

SEQ ID NO: 4463 - DNA, 1971 bp, Myxococcus xanthus
ttcacccaccacgacatgatttcgctgcgccggctgagcagcccgcgcgtctcgccggacggcaagcaggtcgcctacgtcctgcgcaccacggacatggaggccaaccgcggccgcacggacctgtggctcgtcggcgtcgacggaaacgccgcgccgcgccagctcacctcgcatccggacgcggactccgagcccacctgggcgccggacggcaagagcctcttcttcctgtcctcgcgcggcggctcctcgcaggtgtggcggctgcccgtggacggcggcgaggccgtgcaggtgacgaagctgcccctggacgtgggcgccttccgcgtgtcgccggacggcacgcggctggccgtggcgctggaggtcttcccggattgccccacgctggagtgcaccccgcagcgcgaggaggaacgctccaagcgcaaggccaccggccgcacctacgacaagctcttcgcgcgacactgggacacgtggaaggacggacgtcgctcgcacgtcttcgtcgtccccgtggccggcggcgcgcccgtggacgtgatgaagggcatggacgcggacagcccctccaagccctttggcggcgcggaggagttcaccttcacgccggacaacaagagcatcgtcttcgccgcgcgggacgtgggtcgctccgaggcctggtccacggatttggacctcttcgtcgcgccgattgatggcaaggcgaagccgcgcaagctgacggagaagaaccgcgccaccgacaccagcccggtgttcagcccggacggtaagacgctggcctacctggccatgtcgcgccctggcttcgaggcggaccgctaccgcgtcatcctccgcacctggcccggaggtcaggagcgcgtgctcacccaggactgggaccgctccgtcggcagcctcgcgtggagcgcggacggcaagacgctcttcgcgagcgccgggcacgtgggccagcagcccatcttcgcgctggacgtggccacggggaagcccacccagttgacgaaggacggcgccgcggacgcgccgcagccggccgctgggggccgcatcgtctacgtgtatgacgacctggattcgcccgcggacctgcacgtgatgaacgtggatggctcggagtcgcgccagcttacccacgtgaaccaggacgcgttggctcgcatccgcttcggtgacttcgagcagttctcattccccggttggaacaacgagacggttcacgcctacgtcgtgaagccggtgaacttcgacccgaagaagaagtacccgctggcgttcctcatccacggtgggccgcagggctcgttcggcaatcacttccattaccggtggaacccgcaggtgtacgcggggcgtggctacgtggccgtgatggtcgacttccacggctccaccggctacgggcaggcgttcaccgactccatctcagatgactggggtggcaagccgttcgaggacctgcagaagggcgtggctgcggcgctcaagcgctacagcttcatcaacccggacaagatgtgcgcgctgggggcgagctacggcgggtacatgatcaactggattgccggtaactggccggacggcttcaagtgcctggtgaaccacgacggcatcctcgacgagcgcatgggctacttcgacaccgaggagctgtggttcccggagtgggagcacaagggcacgccgtgggagaacccggagggctacagcaagcacaacccgattgagcacgtcgcgaagtggaagacgccgatgatggttatccacggcgggcaggacttccgcgtggtggagacgcagggcctgggcaccttcacggcgctgcagcggaaggggattccctccaagctgctctacttcccggaagagaaccactgggtgctgcgcccggccaacagcgtgcagtggcacgacgaagtcctgggctggctggaccagtggacgcgcaagtag

SEQ ID NO: 4464 - DNA, 168 bp, Myxococcus xanthus
atggcctacaactccgggaggatttcccggctgagcccgagccagctcagcgtctctggcgcgcccacgcccgacgtcgtcatctccagtcccgacctcggggccacgcatggcgtcgcggtgtatcccgcccccgcgaacctgccgctgttccatcgattgccgtga

SEQ ID NO: 4465 - DNA, 657 bp, Myxococcus xanthus
atggcatcgggcaccgtcttgctgcgactcggcgtgttgggagggctgctcgcgggttccgcagcgttggcggcggacacggcggatgtgccccgggcggaagccgctccagtgggcccggagtcctcatccgtgcagtggcagctcctggcgggcggcctcgcctcgctcgacggctatgcctcaacgggttaccagggatggctgctcggggctggctgggagttcccccggctgcgcttccgcttccagttcctggcgggcctcccgtcgagcatggtggagacccgcaccgaggtgaagctggagcagtacgtcttcggcttctggctggacacgcccatgctccgctcgggtgcgtggcgttggagcgtgggcgcgggggcgggcttcctcctcttcggccggaccgcttttgcccgcgtgggcggactggacaccgcgggcccccgcttcgtccccgcgctcctcacggggccggatacctccctgcgctggcgtttctcgaagtacttcgccgtggagggctcgctggcgatggacatcgtcttcggccgccccctcatcggcttccagagcgcgcaggggttcgaaccgctccatgagggctgggccgtccggccgcgactgagcgtcgcgatgatggtcttcccgtga

SEQ ID NO: 4466 - DNA, 282 bp, Myxococcus xanthus
atgaaccgcactgactttgcatcgcacgcgcctcacgggacgttccggcacctgctcgtcctggcactgctcgcctggagcggaggctgcgccgtggaggaccccgtcgcgcgggtgcgtgtcgcggacggtgggacgggcaccttctccaccgatgacgacgaggccctgctcctcggtgaggatgacctggagctggcgcttccggattgcgcggaggtcgagccggatgccggctcgggcgtggcttgcgaggactcggggacgccggacgctccgtag

SEQ ID NO: 4467 - DNA, 357 bp, Myxococcus xanthus
atggcgcccgtggtgctggaggtgcgcccgcgggtccgcacggcggacgccgaggtgacggtgggcagcggcgccgagtgcgacatcgtcctcgccgagcccacggtgtcccgcctgcatgcgcgccttcgtcgtgagccgcacaccgggctgtggtgcgtgacggacctggagagcgagcgggggacgtaccaggatggggtgctcatcctgccgggccggcccgcgccgctgctgtgccgctcccggctcacgctggggaacgtggagctcctgttcctccagacgtatgccttcgagcagtccgtgcgcgtgtcctcgctgacgcccccggtgagcttgacccgccggaggtga

SEQ ID NO: 4468 - DNA, 655 bp, Myxococcus xanthus
gaggcgcgcgacacggcggagctgctcgtgggctcggtggggctcgcggtgcaggactccggtggttacggacagagcaagagtctggtggtgcggggcgcgtcgtccaacggcgtgctcgtgttcctggatggcattccgctcaacggcgcgggcggcctgtcggacctgtcactcattcccgccgcgctggtcgagcgcttcgaggtgctgcgaggtggcgcgggcgcgcgctatggctccggcggcctgggcggcgccatcaacatcatcacccgcgcaccggggccgaacctgcgcacgagtggtgaggtgacctacgggagctggaacacggcgctgggccacgtcgccgccacggggccgatgctgggcgggcaggcgctgctgctggtgcatgcgggccgctcggacggtgacttcgcctacgacgtggacgaactgcccgccgtggacggcaatccccaggtctccgaacggcgcgcccgcaacaacgcgcagggcggtggcgcgctcctgcgctaccggcgacggctcgtggggggctcgcggctggatgcgctcgcggagctgtccctggagaaccgcgccattccgggcaccgtgcagaatccccagtccaccggagaccaggagctggggcggaccgcgtcgg

SEQ ID NO: 4469 - DNA, 261 bp, Myxococcus xanthus
atgctcgacagcatcggcatcaacgccctctgcttcgacagcgaggaaggctacgaggcgatgtgcatggggcttatccagggcaagcccaacatcaccttccggcacgactggaaggagcgcatcgtcatcggcgtggaggagggcgtggcgagcatcgtcctgcatgatgcgaagggcacgccccacttgaagctcgcggtggacaaggatggcgccacccgggtcgaagaggtgaagccggcccccgcgagcaagtag

SEQ ID NO: 4470 - DNA, 387 bp, Myxococcus xanthus
atgatgggcgcggcgatgggactgtcggccgtggtgttctggcctccgttcgcggcacgcatggacttcatcatgttcgccgtggcggtgacggcgttccacaacgtgcagtaccacggcgtggtctggttctatcaccgcaaccgataccacgcggcgggcgtagacccggcgccgttcggctgggcgccgaaggtgagccagcgcttcgtcatctacgcggtgtgcggcgtcatcttcacactgttgtaccggggcctgggctgcggcttcggcgcgcacccgggctgcggcggcttcgacttgaaggttccgctgggcgcggggctgacgctgcgcaatctgatggaatgtttcatctgggggctcgcgctccatcactactac

SEQ ID NO: 4471 - DNA, 702 bp, Myxococcus xanthus
atgagcgagcccatcaccgtccgcgtctggtccgattacgtctgcccctggtgttacgtgggctacgccgaggtccagaagctgaagaaggagtacgacgtccaggtggactggcgtcccttctacctgcgcccggagacgccccccgagggactccccctgccggattacgtgcgcgagaagatgaaggacccgaacaacccgctgaagctccgcgcccaggcagccgggctcaccctggtgatgcgggaactcactccgtccacccgccgggcccacgaggccaccgagtacgcccgggagcagggccggctggagccgttccacgccgccctcctgcgccgctactggagcgagggccaggacctctggcagtgggacacgctccgcggcgccgcccaggaggcgggcctggacccggacgcagtgcagcgcgtcgtcgaggagggccgctacacgaaggccgtggaggactccatccaggaggcgcggaccatcggcgtcaacgcggtgcccaccttcgtgctcggggagcgcttcgggctccagggcgcgcaggagtactcggtgttccaggaggccatgcggcggctcggcgcgacgcctcgcgcgcaaccgtgagcgtcagagccccttgagcagcacgagcatccggccgagcgtctcgtcgcccccgctccccgccagcccctgggccagggc

SEQ ID NO: 4472 - DNA, 279 bp, Myxococcus xanthus
atgatgcctcggacgctgaccctgaccttcgtcatcaccgtgagcgcgctgctgaccggctgcttcagcgacacggacaccatctgcgagaaacggaaggagtgcttcacggacacactcaacgtccagtcgtgcgaggacgacctcaaagcctggatggagcggcaggaccaggaccgccgcagggaccagctcgccgcgtgcggggactgtgtcggcagcaagacctgctcacagattcgcaccgcctgcatcggcgcctgcttcggcgttccctga

SEQ ID NO: 4473 - DNA, 549 bp, Myxococcus xanthus
atggccacgtaccgcggctacaccgcccccacggacgagaaggcgctgctcgaccggctgcacctggcgaaccaacacgaaatcaagtcgggccagctcgctcagcaacgctcccagaatccagacgtgaaggccttcggcaccatcatgatgaaggcgcacaccgcgctggaccagaagctcacgtcctacgcgcgcagcaagggcctgaagctggccgaatcacccaagccgatgaacgacgcggaagaagcctccatggccaaggacaaggccacgatggagcagctccaggtcatccgcggcgcgcccttcgactccgcctatctggcctcacaggtcacggggcatgacgccgtcctgggcatggtcctcaccgcccagaaggccatgcccaaggccacgcccgagctcgccgccctgctcgaggacctcagcaagcaggtgcccgcccaccggcaccaggcctggaacatgctgggcaagctgggaggcgaaacgggcgtgggcggctccggcccggcgcacgcgcccccgccgaagccctga

SEQ ID NO: 4474 - DNA, 393 bp, Myxococcus xanthus
atggagtgggccggcgtgggcagcatggtgctgggagcggtgctcgccctcgtggtgctcgccacgcggcagcagctccccgccggtgaggcctaccgccgcttccggctgaacctgggccgcgccatcctcctgggcctggagttcctcgtcgccgccgacatcatccgcaccgtgagccagcgccccacgctggatggcgtgctggtgctcgggctcatcgtcctcatccggaccttcctcagcttcaccctcaccgtggagctggagggacgctggccctggcaacaccgcaaggacatcgccggtcctgttcatcctccgccaacgtcgtccaccccgcagcaccctgtgccgcccgctcccgacgcaccacgtccggtgaagcactga

SEQ ID NO: 4475 - DNA, 1728 bp, Myxococcus xanthus
atggccgtggggctcctctgcgtgcctcaggcggcgtgggcccagtccagctcgctcaaggacgaggtgaaggagcggctgggccgcgtggagacggagctggacgactgggacgtgcctggcgcccggcgcgagctgtccgaggtggagaagctcctccccgccgacgtggagccgctgaagtacttccagggccgggtggctttcgaggaaggccgctacgacgacgcggtggtgctcctggagggcgccaacatcgaggacaagccgggcagctacctgcggctggccaaggacacgcgcgccatcgtcaaggaccacgagcgcgcggagagcgagcacttcatcttccagtaccccaaggggaaggaagcggtgctggtgccctatgcgctggagacgctggagggcatccaccgggcgatgaaggaggacctcggctggacgccgccgggcggcaagattcgcgtggaggtggtgagcaacgcgcgcgagctggcgcgggtgagcacgctgacggagaagcagattggcaccacgggcaccatcgccatctgcaagttcaacaagctgatggtgaccagccccaaggcggtggcgcgcggctacgactggcaggacacgctggcgcacgagtacatccatctggtcatcagccagatgagccgcaacacggtgcccatctggttgcatgagggactggccaagttcctggagtcgcgctggcgcggcaaggcgggcctggcgatgacgccgtccacccaggcgctgctgggcaagcgggtgaaggcggacacgctcatcccattcgagaagatgcacccctccatcgcgctgctgcccacggcggaggacgcggccaccgcgttcgcggaggtgttctacgccatcgactacgtgcacagcgtcaagggcacggcgggtctgcgcgccatcatccaggagctgaaggccgggcagaaggaccgcaaggcggtggagacggccatggggatgcccttcgccctcttcgagaagtcctggctggcgcacatcaagaagcagcccttccccaccgagctcctgccgcgcgaggaccgcgtggtcctgaaggagaacgccaagggcaaggtgaaggacgagagcgagaagaaggggcgtgaaatctcctttggcgacttccaggaggtgacggaggtgccggcgcgcaagttcgcgcacctgggcgagctcttgcgcgagcgcaaccgcgttaaggccgcggcggaggagtacgccaaggcgcacaagctggtgggcgacaagtacgaatccgtgtccaacaagtacgcgctggcgctgctggagctgcggcggctggacgaggcggagggcgtgctgcgcggcagcctgcgtgtgcacccgggctcaccgtcgacgaacgtccacctgggccgcatcctgctgtaccggaaggactacccgaaggcgaagacggcctacctggaggcgctggcgtcggacccgttcgacccggaaatccacctggccctgacgcgcatccacggctccatgggtgagacggcgctggcggaccgcgcgcggcaggcgagcgcgctgctcacgggactcaaggtcgaagaggtggaccgcgtggcgcagcagttcctgcgtgacgagagcgggctgtcggagatgaacgtgtcgggcacgccggacgcggaggcaccgaaggaagcgcagcccgagaagccggacgcggggaactga

SEQ ID NO: 4476 - DNA, 2973 bp, Myxococcus xanthus
atgctgggcgtggccaccgtggcgctgctgctggtggccggcggcttcctggcgctggtggcgccgcgcgcgggcgcgtccctgctgtggacggcgctgccggtgggcgtggccgtgacgtgcgtcttcggcctgtggctggcgcgccgccgcgtgggagacgacgtcctcaccgcgcgcatggtgggcgaaaagcgcccggaactgtcgctggacgtgctggccgcggtggagctgatgcgcgagccggacgcgccgggcagcggctctccggcgctcgcgagcgccttcctgcgggagatggacgcgcgggcgcgcacggtggatgtccgcaccgtggtggacagccgcccggtgcgtcacgtggccctgggcgcgggtggcgcgctgctggccctgctggtgctgatggtcgcgctcggtgaccgctggtccgccggcatggcgcgcatccgcgaagtggcggcgagccccaaggcccaggcgcaggtggagcccatcaccggcgacatcgagctgacgtaccgctaccccgcgtacacggggctggccccgcgcacggtgcccggaacgaacggtgaaatcagcgcgccggcggggacggaaatcctgctgaagacgcgctcggaccgtccggtggagcgcgcggagctggtggtcaacggccaggcgctgccgctgacggtgacgggcaaccgggacctggagggcagcttcgtcacgaagcagtccggccactaccgcttcgccttctacggcgcgcgggacaaggcgctcgcggtggggccggacatcgccctcaccgtggaggcggacaaggcgcccgaggtgtcgctgctcacgcccacggtggagctggagatcgacccgggcgaccaggtggcgctcaagtacgaggcgtcggatgactacgggctgtccggcatggcgctcgtgttccgcgcgcccggcgcccagcaggagacgcgcgtgccgctgccgcgcgaggacggacggcgccaccggggcacgtactcgtggagcctggacaacctcaagctcgacccgggtgaccggattacctactacgtggaggcgcaggacaacgacgcggtggagggccccaagaagggcgtcagccgcacgcaggtgctgcgcgtgtactccgcggccgagcaccgccgcgcagcgctggagaaggcggagcagctgtggggccggatggtggaccacctcgcggaccggctggaaggcccggagcgcgcgaagcagaaggacccgcaggccatcaccgccggggccacggtggacaccagcggggagagcctcgtcgccgacatgaagacgctggcgcaggagctggcgcgcgagcgcgacgtgcccaccgagctggtctccgcgctgagcaacatctccgagtccctgggcagccacatccgcggcaccgcggagctgcgccggctctacctgcgcacccagcgcgcccgcggcgaggactggggcacgggcaaccgcctcaccgccgtggtcaacgaggagattacggagctggagaaggacatcctctacctggagtcactgctggaccggcagaagctggaggcgctccaggagatggccaggcagctatccaacgagcggcgcgagctggcgaacctcatcgagcagtacaagtccaacccggacgaggccgcgcgccaggcggtgatggagcagattcagcagctcaagtcccgcatccaggagctgatgcagcgcatggcggagatgcgcaagggcatccgcgacgagcacctcaacgccgaggccctgtccgagatgatgaaggaccaggacctgcgcagcgcgctcgacgacgtggagaagctgatgcgcgagggcaaggcggacgaagccctggcgaagctccaggaattgggcatgcagatggatgagatgctcgagaacctggaccaggcgagcgacgagttcggcggcgagcagcaccccgagctggcggagaagttcggcaagttcatggaggagctgcagggcaccgtgcaggagcagcagcgcgtcgcggaccagacgaagcagcttcgcgaccaggcccgctcacaaaaccgcgagcggctgtcggagaagggcgaggccatcaaggacagcctgatgcgcaaggtgcagcaggcgcaagaggactacaaggcgctggagcccagccagctcaacagccgcgccgcgcgtccgctggaggaggcccaggcggagctccagaacgtggagaacgcgctgaaggtgaacgactacgacctggcggcggaggcggcggcgcgggcggaggacgcggcccggcaactggcgatgatgggcgagcagcagcgccacctggatgagatgttcggcaacccggaagaggtggtgaagcagtccacggagctggcgcagcgcctcaaccgcgacgcgcgcaacgtgtcggaggtgaaccggcagctccagtcgctcttcccgcctccgggctcgcagctgtcgcagcaggagaagcagcagctccagcaactgggcgaacagcagtcgcagttggaggagcgcgcgcagggcctgcgtcagcagatggatgagatgcagcagatggcgcccatcttcggcgaggaggccacgcagcagatggagggcgccggccagcgcatgggtgaggccgcccggcggatgcagggcaaggacccgggccgtggctacggcgagcagcaggcggcgctggaagggctgcgccagttccagcaacagatgcaggaaggccagcgcggcggcaagggcgggctcccgctgcccatgggcatgggccgccgccagcagggcaacgggagagacccgaagcagaaggtggagctgccggacgaggatgccttccaggcgccgaaggagttccgcaaggacctgctggacgcgatgaagcagggggctccggagaagtaccgggagcaggtgaagcgctactacgaggagctggtgaagtga

SEQ ID NO: 4477 - DNA, 408 bp, Myxococcus xanthus
atggagtccacgctgggactcacgggtccacagcgcctggtcatccgcctggtggggcgcttccccgacatcaccgcgggcatgctcgcgcagatcctccacgtccatcccagcaccctgacgggcgtgctcaagcgcctggagaagcggggcctgctggagcgcaagtccgatcctctcgacgggcgcaaggcgctgttctccctgacggacgaggggcgcgcgctcgatatcccctccgagggcacggtggagtcgtcggtgcagcgcgtgctgtcgcgcctttcgcggtccaacatcgtcgcgacgcaggaagtgctcaccgcgctggcccgggagctgggcggcgttcccatgcctgaagtcgagtacgacgaggcgggcgcccgcaagcaagtcgtccgatga

SEQ ID NO: 4478 - DNA, 1704 bp, Myxococcus xanthus
atgaaccgacgcctgacgaacctgctcaccgcgctgcctgtcaccgccgcgctggttgctccgcccgtgctcgcctgcaccagcatgctggtctccaagggagccacggcggatggagccaccttcatcacctacgccgcggacgcgcacgagctgtacggcgagctgtacttcacgcccgcgcgccgccacgcgccgggcgccatgcgcgacatcatcgagtgggacaccggcaagttcctgggccgcatcccccagcccgccgcgacgtattcggtggtgggaaacatgaacgagcaccagctctccatcggcgagtccacgttcggcggccgcgaggagttggaggggcccgcgggcatcatcgactacggctcgctcatgtacatcgcgctggagcgcgcgaagacggcgcgcgaggccatccaggtcatgaccaccctggtcgccgagcacggctatgcctccaccggtgagtcgttctccatcgccgacccgaaggaggcctggctgctggagatgattggcaagggcaagggcgagaagggcgcggtgtgggtggcccgcaagctgcccgacgggtacctctccgcgcacgccaaccagtcgcgcatcggcacgttcccgcagaacgagaagcagacgacgttctactcgccggacgtcatctccttcgcccgggcgaagggctggttcaagggcgcggacaaggacttcaacttcgcggagacgtacaaccccatcgacttcggcgggcagcggttctccgaggcgcgcgtgtggagcatcttccggcgcgcggcgccgtcgatgaagctgggcgcggagtacgcggacggcgcggcgccccagaagcggctgccgctgtgggtgaagccggacaagaagctgtccgtgcaggacaccatggcgctgatgcgggaccacttcacgggcacgccgctggacatgacgaaggacgtgggcgcgggcccctacgcggcgccgtaccgctggcggccaatgacgtgggaactggacggcaagcagtacgtccacgagcgcgccatctccacgcagcagacgggcttctccttcgtcgcgcagatgcgggactggctgccggcgcccattggcggcgtgctctggttcggcgtggacgacaccttcaccaccgtctacacgcccatgtacgccggaatccggcaggtgccgcgcaacttcgcgcagggcgtggccagccgcggagagttctcctgggactcctccttctgggtgttcaactgggtgtcgaaccaggcctacgggcgctggagcgacatggtgaatgacgttcagaaggagcagggcgcactggaaggccagttcctcgcggaccaggccgacatcgagaagcgcgcccaggagcagttcaagcgcagccccgaggaagcgcgccagtacctcaccgactactcgctccagcagggtgagaaggtccacacccgctggcgcaagctcggtgagacgctgctcgtgaagtacatcgacggcaacgtgcgcgatgagatgggcaaggtgaaccatcccaagttccaggaggcctggtaccggcgcatcgtccaggagaatggcaaggccctgcagatgcccgccaagcccgcggagcccgccgccgcgccggctccggcgcccgcccctgctcagaagccggcgcccaagcccaccgtggctcccgcgccgtaa

SEQ ID NO: 4479 - DNA, 252 bp, Myxococcus xanthus
atgctgacggcgggtaagcgactggcggtcttctccattcgcgagggcaagggcgggagcatctgggtgcgggcggggagcgccttcgtgaacaaggacggctcgctcaacgtgttgctggacgtgctgcccctggacgggaagctgcacgtccgcgaggcggcggagaagcgcgacacggcgggaatgagcggcggccgctacgcgggcgagctggggctggacgcggcgccggtgggtggccactcgtga

SEQ ID NO: 4480 - DNA, 825 bp, Myxococcus xanthus
atgaagctgggcggctacgtcctccaccggaacaaccgggacacgttggagccgtgcctgcgcgggctgctggcgctctgcgatgacgtggtggcgctggactccggggccacggatggctcggcggagctggtgcgttcgctgggcgcgcgctccgtgccccatgcgtggcgaggctacggcgccgcgcgcgaggccgcggtgaacgccctggcgccctgtaactacgtcttcttcctcgactcggacgagctgctgggccccgaggcggtggagacactgcgcgcgtggaagacctcatcgcccacggaggccgtgtaccggctgccccgccgcgactgggctgagctggggacgcaccgcttccgctaccgcacgcagtggcgggcgcggctggtgcgccgggacaaggccgtgtggcggccggagcagattgtccacgaggccctgccgaagctggcgggcggacgcgtccgcgccttcatcgagcaccgcttcgccacgtcggtggagtaccgcgcgcagaaggaggaccgctatgccttgctgtgggccctgcgcgcccatgccgagcagcgcggcctcaagcccgtgggcgtgcagcgcctggcgtcctgggcgcgcgactgtctgctgaagggcgcgctgtggcgcggcggcgcggaggcctcccgcctggcatgggcggtggcgggttaccacgccacgaagtacgcgtacctgcgcgagctgcgccagggccgctacccggagctggtgcggctctacgcggaaggccgctacgacgcgctgttcgcgcgcgtgcgcgacggcgcgctgagctga

SEQ ID NO: 4481 - DNA, 2595 bp, Myxococcus xanthus
atggcggacccccgcgaggacgaggaccggaagctcaccgaggagcgactcgcgctgctgagcgtgctccaggagctcaccgtcgcggcgctcgacctcttcgacccgagcaagcccgcggacgccttcatggaccgtgtcgcggagcggctggggtgcatggtcgccctctgggtccaggtgaacgcgcgggggcaggtcatccttcagggcgcaagtggactctccgctgcgtcccgccagcttccgattcccgcccgctccgagcccggagggaagcaagggcccgccgaggtgaacctgccctttccggagttggaaatgccagggctcgtgcgctggtccattcccatcatcggggcggacgctgcgcacagcgccagcgcgctgctgctgtacttcgaccgcgagccgcagctcccgcgacattaccgaggcatgatggagcgcctcggcggcgtgctccgtaccgcgctcatgcaccggcagctcttcacccgcatcctggagagcgagcgcgcgctccaccagaagaagacgctgctggagtccctgagcgaggcctccgacgagggcatcctcatctccacccaggaaggaaggacgctcacgcacaaccgccgcctcgtgcagatgtgggggctggaggaggcgctcctgtccgcaccctacggggcgtgggtccgtgcggcggcggagctcgtggaggagcctgcccggttcatggcgcgcgcagccttcttcattgagcaccgcgacgcgtcggggcacgacgagcttcggctcaaggatgggcggatattcgagcagtacgacgctccggtggtgagtgctgacggcgtctactatgggcgggccgcctacttccgggacgtcaccgctcgacggcgcacggagcgggacctccagcacgagcgggacttcagctcggcggtcctggatacagcccgcgcgctgttcatcgtcctggatgtggagggccgaatcgtccgcttcaaccgtgcatgccaggagatgaccggctactccttcgaggagcttcgcggcgcgcggttctggaagcagctccaggccccggaagaagcggcgcgggtcgagcgggacttcgcccagctctccgcaggccaggggcacgaggagtacgagagctgctggctcacgcgagcgggagagcgccgcctcatcgcatggtccagcaacatcctccgcagcccgtcgggagcggtcgagtacatcatcggcacgggcatcgacatcaccgagcaacgccgggccgagcgggagcgagaccagaccttcctgcgtgagcagcaagcgcggacccgcgccgaggagcaggaaggaaggtccgcgttcctggcggaagcctcgggactgctcgcgggctcgctcgcccccgaggacgcgctgcgaaacgtggcggcgctgaccgtccagcggttcgcggactggtgtacggtcgacctgctggacaacgaccattccccccagcgaatcgcggtggcccaatcccagatactgcgggccaggtggcccgcgaaggacgcccacgcgccaccggacctcaatgccacgcatggccctgggcgggtgctccgccgcggcgagccggagttctgcctggagggttgcggctcctctgctctcgagtgcggcgtcctcgagttccagtcctggctgtcagtgccgctgctcgcgcgtggccggacgctcggcgcgctcaccctcgcccggctggacgacgggagccgctatggcctggccgagctctccgtcgcgcaggagctggccccccgcgcgcccatggccgtggacaacgcccggctctatcgggaagcccagcaggccattggccttcgtgatgaattcctctccgttgcctctcatgagctgaagaccccggtcacctccctccagttgtccgtgcagggactgctgcgccgcgcccggtcgggagcgctctgcaccgcgtcggcggagaccgtgacccaatcggtcgaaggcatcgaacgccaggcgatgcggatggcgaagctcgtcaacacgctgctcgatgtctcgcgcatccatgccgggcggctcgaactcgagctggaggaagtggacctcgccgcgctggtccgagacatcgcggcacgcttcgcacccgagctggccctctccggcgccacgctccaggttcatgccgacacgccgatgccaggaatctgggaccggtcgcggctcgatcagattgtcaccaacctgctctcgaatgcgatcaagtacggcgagggcaagcccatcgaaatccaggtcggcggagacgccaggaccgccctcctggaagtgagggaccagggaatcggcatcccgacggaacgacaggcgttgatcttccgggccttcgagcgggcggtgtcatcgcgccactacggagggctgggcttgggcctccacatcgtcagtcagctcgtcgaaaggctgggaggggcggtccgggtccagagcgaggcgggacgcggcgccaccttcacggtcgcgcttccacgcagcggacccgccgcgccgcggccggctccagcagacatgcacctggacgcgaaccatgcatga

SEQ ID NO: 4482 - DNA, 807 bp, Myxococcus xanthus
atgcggccggggcgccgccgtgcgctgctcgtcttcccggacgcgctgagcgggaatccaacggaagtcgtgcgcggggcgcagcaggaggcaggggcgggtgtcgtctgggcggggggcggagcgggaggcgacctccggagcgccatgacggcccagttcacgaatgggcaggcataccgggaccgggtggtggtgattgcctttgatgcccaggcgccgatcggcgtcgggattcagcacggctggtatccatacggcccaccgacccaggtcacgaaggcccacggcgcgaccgccatcgagctcgattacgagagcgcgttcgaggtctaccggcgcacggccgcgagccgcggagacgcgctggacgtgcagggcttcgcccgcttcgcgatgacccacccgctggggattccccaggccaatggggagttcgtgattcgcgagctaatctccatcggacccgacggctcggtccgctgcgtcgccgagatacctgatggctcgttggtccgggtgatggagggagcgcgcgcggacctgttggacgcggccgcaggggcggccaccctggctcggacaggaacccctggcgcgctgggtggcgcggtcgtgttcgactgtttctcccgctaccccatcctgggcgaggaaatccaagacgagctctcacgcgtccagggagcgctcggggaggccacgccgctcgtgggctgtctgaccctgggcgaggtgggggccatgggaggtggcgttccgcagttccacaacaagacggtggtggtgctcgcccttccagggtga

SEQ ID NO: 4483 - DNA, 627 bp, Myxococcus xanthus
cccgcacctctactggcagcaggtcgatccgtatccgtccggccaaggacgtgctgagagacgttgagtgaggagtcggcgccgtggaccctggcgtgcatgtcgaagccggaatggtggcgggttgctgaggccttcgaggcgagcggactgacgcagaaggatttctccgcgcagcgaggcgtgcggatggtgctgggggcgcagttcaactcgttcctgcaccccgtcacggtgctcaccattctgccgctgtcggtggcgggcgcggccttcgcgctgctggccacgggcagtacgctgaacatcttcagcatgattggcctgctgctgctgatgggcatcgtgaagaagaactccagcatcctggtggactacgcgctgcaggagcgggagcgcggggcggatgcgttccaggccatgctgcgcgcgggcccggtgcggctgcggcccatcctgatgacgtccaccgcgacgatgatggcggcggtgccggcggcgctggcgctggcgcgggctcggagacgcgcgcgcccatgtccatcgccgtgctcggcggcctgtccgtgtccaccgtgctcagcctgctggtggtgcccgccttctacgtcatcgcggaccggatga

SEQ ID NO: 4484 - DNA, 189 bp, Myxococcus xanthus
atgtccatcgccgtgctcggcggcctgtccgtgtccaccgtgctcagcctgctggtggtgcccgccttctacgtcatcgcggaccggatgaagacgcgggtgggagcgaggctggggaagaagccggatgccgagtcgggcccgcacccgcctcgcaccgacgagccccggccggccacgcacgactga

SEQ ID NO: 4485 - DNA, 711 bp, Myxococcus xanthus
atgctcgacgtgaagagcggcaagtacgtggcccagtcggtcatcctcatcgagggtgaccgcatcgtgaaggtgggccccgggctgcaaatccccgagggtacggaggtggtggacctggggacgtccacgttgctgccggagctcatcgactgccacacgcaccagatggcgcgcgaatcggagacgccgaacggctacgagctggccctgctcaccaagtcccaggccacccgcgcgctggagggcgcggcgaatgcgcgggccacgctgcgcgccggcttcaccaccgtgcgcgacgtggagaacgagggcagcggcttcgccgacgtggccctgcgcgacgccatccgccaggggctcgtggaggggcctcgcatgctggtggccacccgtggcatcgcggcggtgggcgcctaccacccgtttggcacctctcccgacgtgaaggacctgtccacgggagcgcagttcgtcagcggtggggaggaggcccgccgcgccgcacgtgagtaattggggcagggcgcggacctgctgaaggtctacgcggactgggccatgcccacgctcaccgtcgacgagctgcgcatcatcatcgacgaggcgcacaaggcgaagcgcaaggtggccgtccgcgcgataacgcccgagggcatccgcaatgcactcgccgcgggcgcggtatccgtccggccaatgacgtgctga

SEQ ID NO: 4486 - DNA, 315 bp, Myxococcus xanthus
atgtcgacgccggtggagaagcaggagtggtttcgggtcgccgaagccttcgaggggagcggactgacgcagaaggcgttctcccagcagcgaggcgtgaggttgagcacgctgcagtcgtgggtgtaccgacgacgacgccagcagcctgagaaagctgagacggtgcgcctgctgccggtggaggtggctggcatggcgcagccggggccggcgttgctggaggtggtgctggccagcggtgcgtgcctgcgattcgcctccggcaccaacgtggagtacgtggcccgcctcgtcgcggcactggggcggtga

SEQ ID NO: 4487 - DNA, 351 bp, Myxococcus xanthus
gcgtcggtgcgcgtggtgctggccacaacgccggtggacatgcgcaagtcgatagacggcctcatggcgctggtgcgcgccgagtggggcgaggacgtctactcggggcacctcttcgccttcgtctcgcgcaggggcgacagagtcaaggtgctgacgtggagccgaggcggcttcgtgctgctgtacaagcggctggagacggggagattctggctgccgccggtggacgcgggtgcccaggtggtgcacctggacgccacgcagttggcgatgctgctggacggcatcgacgtggcccaggtgaggcgccagcccgcctggacgcctcccgggcgcacgggcacctga

SEQ ID NO: 4488 - DNA, 1289 bp, Myxococcus xanthus
atggcgacgctggagcgccacgtcttcagccgcaggacggagaagctgccgacggtggcctccgagctgcgaggggatgcggacaccacggcggcccaggccgaggccgcgaagaagaagcgccgagagagagcggcccggaaggccgagcaggccccggcgcgggagattcgccacgcggtgcccgccgaggagcgctgctgccccgcatgcggcggcgaggacttgaggccgctgggcaagggccgcgcctcggtgctcttcgagcacattcccgcgcgcttcgagcggcaggtgcacgtgcaggaagtgctggcatgcacgtgcggcaagggcgtcgtcaccgcgccgcctccgccccgcgtggtggacaggggcgagtacggccctggcttcatcgcgcacgtggcgcacgtcgaagtgcgcggacgccatgccgctgcaccggctggcccagcgggtggagagaagcggcgtgcccatgagtcgcagcacgcgtaacggacctcttccaccaggccgcctcggtgctgctgccactgtcccagcacctcttgcagtgcattgcctcggcggacgtggtgtgggcggacgagacgcccttgcacgtgctggacgtgaagaagacgaagctgggctacctctggactttcctcacccagaatgaggaagggcagtggctcatcggctaccgcttcagcatgggccggggcggcaagacacccagggaagtgctgggcggcaccgcgggcgccctcgtggtggacgggtacaccggctacaacgcggtgacgctgccaaagggccgggtgcgcgtcggctgctgggcccacgtgcgtcgtcgcttcttcgacgcgctggccaccgcccccgaggcgcgtgaggccctggacttcatcctcgaactctaccgcgtggaggcccaggccaaagacgcggacctggtgcgcacggccgcccaccgcgagctgcgccaactgcgcagcgcccccatcctcgcgcggctgcgcgtctggctcgaagcccaggccccgcgtcacccgcccaagacatgggcgagcgcatccgcgaggtcggacagggcccggatggcgccatctggctgctccaggacggcaaggccggccgcctgctcaagctcacgcccaagggccagtaagcgccttcgcacacgtaaaaggccgggcattgcccggccttttgcgtggatgacaccgggtcggcaggcccggcctctcagccgcgcaccaccggcgtggcacagtcctgggcgcgctgcaggcccatga

SEQ ID NO: 4489 - DNA, 600 bp, Myxococcus xanthus
atggcgcaggtgaaggcagtgctgctggacctgggcaacgtcctcgtcttccacgacaacaccctgctcttctcccggctgggcgcccgcgcgggcctggaggccgcggaggtggcccggcggctgacgggcgcggggtggacggacgccaaccggggcgtgctgggcgcggagggcatccgccaggacgtgtgtcgcgcgctggacgtggacctgcccatggcggagttcgccccgctgtggagcagccacttcacgctgcatgatgccgtgctgccgcgcatcgagtcgctggtgggccgggtgcgcctggggctggtgtccaacaccaacgcgctgcacgtcgcctacctgcgtccgctgctgccggtgctccagcgcttcgacagcgtggtgatgagctgcgaggtgggccacgtgaagccggagccggacatcttccggctcgcgctgacgggcgtgggctgcgccccggaggaggccgtcttcttcgacgacctggccgagttcgtccaggccgccgaggctgtggggattcaaggccggctcttcaccaccgctgacgccttcgacgcgcagctcaaggcactgggtctatga

SEQ ID NO: 4490 - DNA, 267 bp, Myxococcus xanthus
atgctctgccttcactgccacaccgtcgcgctgggagagaaaccctccaaacgcgccacgctggcgctcatcttcgccacggtggggttcatcgggttcgtgccgggcctcgtggggctcgtgctgggctaccaggagctggcggccatccggcgcggtgccgctcctggctcaggggagggatgggccgtgctcgctcgcaacgttggctggttccacatggccatgctggtcatcatcggcctcggcgtggccctgcgaggctga

SEQ ID NO: 4491 - DNA, 360 bp, Myxococcus xanthus
atgctctacttcctggccggggtgaacaccttgctcggcgtcatcgggctgctggtggagagcgaggccctggaggccgcggggatggggctgggctccatcctcttcggcgtggtggtcgcggtgcttggcttctttacctaccggggcacccgggcggcgcccatcctcgccggcatcctgtacatcgccgatgcgctcaccacggtggtggataccgtcacggagggagggcgcgtgcccgtcgtcgccctcatcatccgcgcctatatcatcatcacactcttcaccgcggcgaaggctgcggcggagctgcgccgtcgcgaacaggaaggcgcgggcgtgtcgcttcagccctga

SEQ ID NO: 4492 - DNA, 210 bp, Myxococcus xanthus
atgacgtacgaggaccgcatcgaacagcagctgctggatgcccgccgcgagctggagcaggccgacaaggacctggcgaccgggacggaggcggcacgcgtgcgctacgcccgcgccctgcacgaagcggacatcgccgagcgccgcgccctgcggcacgcacgggaggctcggaaccatcagaagagctggaggctcgtcgcaggctga

SEQ ID NO: 4493 - DNA, 969 bp, Myxococcus xanthus
atggcctatcccatccaccgaccccgccgcctgcgccgcaacgccgtcctgcgtgacatggtgcgcgagacgcgcctcgacccgggcgacttcatctaccccctcttcgtcgtggaaggccgggacgtgcgccgtcccatcgtctccatgccggggatcttcaacctgtcgctggagcacgtcgtcgccgaggccaggcacgcccggaagctgggcgtgcccgccgtcctcctgttcggcatccccaaccacaaggacgcccgcggcacccaggcctacgccgacgacggcatcgtccagcgcgccattcaggagatcaaggcggccgagccggacctccaggtcatcgtcgacgtctgcctgtgcgagttcaccgaccacggccactgcggcgtgttggaaggcggccacgtcgtcaatgacgccacgctggcgctgctggcgaagatgtccgtgagctgcgccaaggcgggcgcggacatcatcgctccgtcggacatgatggatggccgcgtggccgccatccgcgccgccctggacgagacgggcttcggcgagctgcccatcatggcgtactcggccaagttcgcgtccggctactacgggccgttccgcgaggccgcccagaacacgcccacctccggtgaccgccggggctaccagatggaccccggcaacgtccgcgaggccctcaaggaagtggccctggacgtggaggagggcgcggacatgatcatggtcaagcccgcgctggcctacctggacgtcatccgcgccgtgcgcgagcgctgggagctgcccgtcgtctcctacaacgtgtccggcgagtactcgatgctcaaggccgccgggcagaacgggtggattgactacgagcgggtgatgctggagacgctcacgtccatgaagcgcgccggctccgacctcatcatcacctaccacgccctggaggcggcgaagctcctgtag

SEQ ID NO: 4494 - DNA, 183 bp, Myxococcus xanthus
atgcgaatgtcggagacgggcagccccaccgcggcgctcgcggccgagtacacgcgcgagcacgtcgagtgggccgcgcccatgatttctcctttgagcgcccacgaacggctcgcgcgtctggcggggctggatgagcccgagccgcgcgaggaaggactcacgctggagccggaggagtga

SEQ ID NO: 4495 - DNA, 621 bp, Myxococcus xanthus
atggcggcaagccggcaagggggtggccgcgccttgcggttggtgtccggagacgcgcaacccgattcgccctatcccaaggcctcgctctggctgcgcggcggcgcgcgggcggtggacgtgtcggtggcgtggggcctgtacgtcgtgggaggggcggcgggcgcggtggtggcgctgctgttcctgctgctggcggatgggatgctccagggccagagcgtgggcaagcgcatcttcggcgtgaaggtgatgcatctgcccacgcgctcggcggcgcggcaccgcgacagcaccctgcgcaacgcgccgctggcgctcatcgtgctgctgggaatgatgcccgcgccgcatgggacggtggccgcggccgcggggctcattgtcatcggcagcgtggaggcatggtgcgtgctgagggatccgctgggctggcggctgggcgacacctgggcgcagacgcaggtggtcgacgggaaggtcgtcgcgggcgtaaccgttgcagctcgcacgccggtcgcgcatgagcgcgcctccggcaggctcatgtccgcggcgaaggtgcgccgtggacgctcgtcgttcaggaagcgaagggggtacccatgcgcatcgcgctga

SEQ ID NO: 4496 - DNA, 1840 bp, Myxococcus xanthus
atgcgcatcgcgctgacccacaacctcaggctgtctgatttggaagaagaggcggagttcgacacgcaggagacggtcaacgcgctcgcggcggccatcgagagcatcggcccccggctggagcgcttcgaggtgagcggcccggcctcgcgcaccgtggcgcggatggaggcctacagccgggacctcatcttcaacaccgccgagggccgccgcggccgcttccgcgaggccttctatccggccctcttcaacgacctgggcttcccgtacaagggctcggaagcgtacgcgcagccggtaacgctcgacaagcagctcaccaaggtggtgctgtccaagcagggcatccgcacgcccggctggcagtacgtggagaagctcagcgaactgtccgcggagaacctgcgcttccctgtcatcgtgaagcccaactgcgagggctcgtccaagggcatcagccaggactccatcgcggagacgctggacgaggttcgcgccaaggtggccgccgcgctggagaagtacccgtccggcgtgctggtggaggagtacatctccggccgcgacctcgccgtgccgttcctggagtcggtggacaatgactacgacggcgtgctctccccggtggagtacgtcatcgacccggccgtcacgcagggccgcaagtacgccatctacgactatgcgctgaagacgtcgcgggagggcacggtcagcgtgcgcgcccctgcgcagattccgcctcgcacggcggaggacgtccggcggatggcgcaaaaggtgtaccgggcgctcgactgccgcgacctgggccgcatcgacgtgcgcctcagtgacgccggcgtgccgtacttcctggagatcaacgcgctccccagcctggagccgggcgcgggcatctacgcggcggcggagctggacggcctgcacctggatggggtcatcaactccatcatcaccagcgcggcgaagcggtacaaaatcaaggactcgtcgcgtcgccagggcaagccagcgcgcaagagcggtccgctgcgcgtgggcttcagcttcaacgtgaagcgcgtgaagcccacggccacggcggaggcggtggaggacagcgaggccgagtacgactcgccgaacacgctccaggccatccgcgaggcgattgcgtcgtggggccacgaggtcatcgacctggaggccacggccgagcttccctcggtgctgtcgagcacgccgctggacgtggtgttcaacatcgcggagggcttcaagggccgcaaccgagagagccaggtcccggcgctgctggagctgctggacatcccgtacacgggctcggacccggccacgctgtccatcgccctggacaagggcctggcgaagaagattgtccggcaggctggcatcctcacgcccaacttccagctcatggcgacgggcaaggagcgcctcaacaaggagttcaccagcttcccgctcatcgtgaagccggtggcggagggcagctccaagggcgtcgtcaccaagagcgtctgccacagcgaggcggagctgcgcgaggtggtgcgcgagattgccggcaagtaccagcagcccgcgctcatcgaggagtacatccgcggccgtgagttcaccgtgggcctgctgggcgagcggcgtccccgcgtcctgccgcccatggagatcgtcttcctggaccgggaggagaagaaccccgtctacagcttccagcacaagctcgattggacggaccgcatccgctacgacgcgccggcgaaactggagcccgcgctgctggagcggctgcgcacggcggcgcgcaactcgttcatggcgctgggatgcc

SEQ ID NO: 4497 - DNA, 177 bp, Myxococcus xanthus
atgctcgctgcgggcagccgcgacccagagcgcttcgacgaccccgaccgcttcatgcccgaccggcccaacaactcgcacctggggttcggcagtggcattcactactgctttggtgcaccgcttggcgcggttggaggcacagatcgctttgaccgaattcgcctgccgccttga

SEQ ID NO: 4498 - DNA, 943 bp, Myxococcus xanthus
atggcacaggccagcatcttcgagcagatcctcgacccggccaaccgggccaacccctacccgctctacgccgagttgcggaagactcccgtggcgcgcgaggccgacggcacgtacatcgtcagcacctacgatgagattgtcgcgttgctccacgacccacgggtcagctccgacatacgcaacctcgtccggcaggccggtgccacgccctccccccaggagggccctccagggctgccagagcccttcatccggcgcgaccctcccgaccacgaccggctccggaagctggcgatgaggcccttcgggccgccgcacacccccggacgcattgatgcccttcgtccctggctggtcgagaccacgacgggcctgcttgacgcgctcgcgggcaagaaccaagtcgacatcgtcggcgacgtggcctacccattccctgtgactgtcatctgcaagctgctgggagtccctcgcgaggacgaagcgcgctttcacgagttggccgacgcgggcgtcgagacccttgaccccaccacagggacgatcgagcagcgaaaggccaagcgcgaccggacgaaagcggagctggggcagtacctcgctgcgctcgccgatgcccacctgcgccagccgggcggcgacctgctctccgggttcctgacggataacggccccgacgggcggatgtcgcgggaagaggtgttgagcaccgccgcgttgctgctcgtcgctggccatgagaccaccgtcaacctcatcgccaatggcatgctcaccctgctgcgccaccccggcgtgttcgagcggctgcgccgcgagccccgagctgagcatcccgctggtcgaggagctgctgcgctatgaaccaccggtgcagttcctgcctgaccgagtcactctggccgacatcgacattgccggcaccaccattccccagggc

SEQ ID NO: 4499 - DNA, 1639 bp, Myxococcus xanthus
atgagagtcgtcgtcgacctcacccgctgccaggggtatgcgcagtgcgccttccttgcgccgagcgtgttcaggatgcagagcggggatgcgctgctgtacgactccaaccccgacgacgcccttcgtgagcagatcaagcgagccgctgcggcgtgccccgtccaggccatccacattggcgggatgggcaccctggcggcgatgcggaaagagcctgcacagcgacggaagcccagggggcccgtgcgtctcaccgacgcggaagcggcgttcaagcgcggtggccgcatcgttatcgtcggcgcatccctggccgggttgactgccgccctcatgctccgcacccaaggctttgctgggtcagttgaccctcatcggggatgaggcctgcgacccgtacgaccggccgccgctctccaagcaggtcctgacaggttgggtgaaggcagaccacaccctattgccttacagcgacgagctcgatgcggactggcacctgggagtccgtgccatgggactggacctagccggcaggcaggtcctccttgctgacgggaacagggtccagttcgaccggttgctgattgcgacgggggcgcgtgcccggccgtggcccaacgacgcggaggcgtcgctggagggcgtagaggtggtgcgcacccgcgacgatgcggcccagttgcagcgccgtctggccgccagacccggccgggttctggtcatcggcggcgggttcaccggctcggaggtcgcctccgcgtgccgcgagctgggtctgccggtgaccgtcacggagcggggggccactccactggtgggggcgctcggcggagttgtcggggcggtcgcagccgccttgcaacgcgaccatggcgtcgacctgcgctgcggcgtcaccgtcacgcggctggagggggatgcaaacgggaggctgcggcgggcccacttctccgacggctcgacactgaacgtcgacgtggccgtggtcgcgctaggggcgatccgcaacgtggagtggctgcgcgactcggggctggcggtgactcgatggggagtggcctgtgatgcggcctgccacgcgttcgacatcaacggcctggtgaccaggaacatcttcgtcgccggggacgtggcccgcgtccctcacccgatctacgactaccagttcctgtccctcgagcactggggcaacgcggtcacccaggccaagattgcggcccacaacatgctcagcccggaagcggaccgctggccacacctgaccatccccaccttctggtccacgcaattcggcgtcaacatcaaatcggtgggtgtgccgaccttctcggacgcgctcgtcatcacccagggctcactcgccgagcgccgattcgtcgccgtctatggctacaaggggcgtgtcaccgccgcggtcgctttcgaccagcccaaatggctggagttctaccagggcttgatcgatgcagccgcgccgttcccgcccgccttccgcaccgtccatcagcccgccgagatgcggcccgtccctcccgaatttccgaaacgggccgtgtccgagcacgaggccaccgtcatggtcaccggccgtgaaccctacgagcggcgggtccggtgggtgtaccggcacctttga

SEQ ID NO: 4500 - DNA, 1680 bp, Myxococcus xanthus
ctctcaggggccgaggaccccgcggtccgcgccgcgctgcgaggtgacgtgtcgcccgccgacgccatgctcggcgtgctccagagccgctacctcaccctcaacggcatcgtcgtcttcgacgacaccggccgcgccatctccgccaacacccctgccctgcgcgacgaatacctgcgccggcaggacgaggtgcggcgcagcccctggttcgcggaggcccagcaggggcgcaccagcagcgagggcatcaccgaggagcaccccatcttcaccggccacgtgctgtcgctggccttcccggtgctggacccggtctccaagcaccggctgggcgtgctgctggccgccttcgactgggcgcacgtggaccagttggtgcagccggcgctggcccgtgcccatcagcgcgccctgaagagcttcgcgattaccctccagcggccagacggcacgccgctgtacgactcgcgcggcgcgaacgcccagggcaatgacgcgctgctggccgtcacggccgtcaacggcacggacgtgcgcgacgtggccgacggctggcacttcgtggcgcgcgtggacccggcggaggcctacgccccggtggtgcgcgtgaaccgggtggcgctgctgatggcactaggcttcatcgtgctggccgtcgggggcgcgtggctgctgtcgcaccgcatctccggtcccgtgctggccctgcgcgcggcggtgacgcggctggtgagcgagggcgacctcacgcagacgctggacgtgaaggccggcaacgacgaggtgggcgagctggccggcgccttcggcctgctggtgttccagctgcgggagacggcgcagagcctgcacaccggcacgcgcgtgctcagtgagacggtggcggagctgcagacggcgtcgacgcagcaggagcgcaacgtggcccgtcaggccgcggccctccagcagacgcaggtgacggcgcaggaaatcaagcagacgtcgatgctggcctcggagaaggcggaggacgtgctcaatcgcgcctccgtggccgaagaggtgggacgcgcgggcgaaggggccatccgggacagcctgggcggcttctccgaaatcctgtcccaggccgagcagatgacggagcgcatcgcccagctcaacgagcgcacgcagcagattggcggaatcacccagaccgtgaaggacctggcggaccagtccaacatgttggcgctcaacgccgccatcgagtccgtccgctccggcgagcacggcaagggctttggcgtcgtggcgcgcgagattcgcagcctggcggaccagtccatccaggccacggaccgggtccgcgaaatcctgggcgatttgagcagcgccatcctctccaccgcgaagatgacggagcagagctacacgcatatggagagcggcctggagcaggtgcgcggcaccggcgagcgactgaaggagctggccgccatcatccaggacaacgccaccgcggtgcggcagattgccggcgcggtgagtcagcagaacgcgggcatcgcccagattttcagcgcggtcacggacctgtcctccatgatgaacgacacccaggagagcctggcggccaccacccgggcggcgaagctgctccaggatgtgtccgagcagatgcaggacgtggcccgcgcttatcgcatttga

SEQ ID NO: 4501 - DNA, 582 bp, Myxococcus xanthus
atgacgtccgacctggaccgctggtgcggcggcaactggtacgcctccgccatcttcgcggacggccatgacgcgacgacgtccgcgctcgtgacgaacaacatctttgagggcaacggcaccggggtgctgctctacttccacgcgctcgcggacgtgcgccgcaacctcttctggaggaatgactacgcgctcgccttcaaccacctccaggacgcggcggtcgtcgaagagaacatcttctggaagaacacctcgctcgccctcggcgtgcaggcgggccaggtcgacatccggcgcaacgtcatcgccggctcggccgtgggcctcagccacatgtacgtgcagacgggggacatccgctgcaacgtcttcttccagaacgaccagcacgtcgcggagacccacgccgtcccgccgcgcgtcgtcctgggtgagaacggcaacgtggtgctggagccgctcttcagggacgccgacgcgggcgacttccgcctccgccccgactcgccgctgaagctcgccgactgcctgggtgacgtcgacgtcaccttcgagggcctggggctcgtggccccctga

SEQ ID NO: 4502 - DNA, 1233 bp, Myxococcus xanthus
ctggagccctggccgatggcctggccggtcactgtgctggcggcgctgctgggggtggcctggctggccaacttcgtcaccaagaagatcctgctgcgcggcctgcaccatgtgatcgagcggctgtccggccccgagcacgacacccggctggccttgcgcgcggtggagcgcctgtccaacgtggtgccgtcggtggtgatcgcctccgggctgtcgctggtgccgggtctgccggcagcgctggtggtcctgctccagggcgcctgccacgtgtggacagtggccacgctcgcgctggccgccagccatgccttcgacgcttccaacgcgttctacgaacgccgcccggatgcgcggaacaagccgatcaagggctacctgcaggtggccaagatcatcgtcttcgtactggccggcctgtccatcgtggccaccctggccggcgtgaagctgctgcatgtgctcaccggtctgggcgcggccacggcggtgctgatgctgatcttccaggacacgctcctgtcgctggtggccagcgtgcagatcagcggcgatggtcgcgtgcgcatcggtgactggatcgagatgcccagccagaacgccgacggtgatgtgatcgatattgccctgcacacggtgacggtgcagaactgggacaagaccatcaccaccatcccgaccaagaagttgatcagcgactcgttcaagaactggcgcggcatgcggcagagcggtggccgccggatcaagcgctcgatctacctggatcagcacagcgtgcgcttcctggatgatgcgttgcagccacgcatctaccagttcgcattgctcgatgattacctggccagcaagcgcgaggagctggggcagtggaatgcccaagtggccgccgtgcatcccgagcccgtcaatgcccgccggctgaccaacctgggcacgttccgcgcctatgtggagcgctacctgcgcacccacccgcgcatcaaccagaacatgaccctactggtgcgtcagatggcaccgaccgagcacggcctgcccctggagatctactgtttcaccgcctccacggcctgggccgagtacgaggcgacccagtcggacatcttcgaccacctgctggcgatcctgcccgagttcggtctgcgcgtgttccagcagtcctccgatgcgatgttcatgggcctgcagcgcgcccaggactgtgccacgccggtggtgcgcggctga

SEQ ID NO: 4503 - DNA, 277 bp, Myxococcus xanthus
atccgccagaccctggtgttcgatctggaaatgggcgttgacaaccgcaagcccgccgccaccgacgacatcgcgcacaccctcaactacaaggccgtctccaagcgactgatcgagttcgtcggccagtctgacttcggtctggtggagaccctggccgagcgttgcgcggccatcgtgctggaggagttcggcgtgcagtggctgcgcctgaagctgtccaagcccggcgcggtacgtggcgcgcgcggtgggggtgctcatcgaacgtagccgt

SEQ ID NO: 4504 - DNA, 867 bp, Myxococcus xanthus
gtccatggtggcggcgagctgcactgggtgggtgacggcttccgcgtccacaccctcgtgccgagcggcggcctgcgccaggagcggaccagtccgttcctgctgctcgactaccatccgccccatgactaccccgcgctggcgaagggccagcggggcgtcggctggcatccgcaccgtggcttcgagacggtgacgctcgcgttcgagggtcacgtcgcgcaccgcgacaacgcgggccactccggcgtcatcagtcccggggacgtgcagtggatgacggcggcgtccggcatcctccacgaggagtaccacgagcacgacttctcccggcgcgggggcacgttccacatgctccagctctgggtgaacctgcctcgccagcacaagatgtccgctccgggctaccagcccatcacgaaggagcagattccggtggtccccgttcaaggaggcggggaggccacggagcacagccgggtgcgcatcatcgccgggagctacggtgacgcgaaggggcccgccaggaccttcacgcccatctccatgctcgacgtgaaggtgcgcgcgggcgaggacttcaacctgtcgctgccctcgaaccacaacgccctggtgctcgtcgccaacggccgcgtgacggtggacgcggagagcatccggagcggtgaactcgcggtgttcgccaacgacggggagaccctctccctccgggccgaagaggacacgcacttcatcgtcctcgcgggcgagcccatccacgagcccatcgcccacaccgggccgttcgtgatgaacaaccaccgggagatcatccaggccatccacgacttcgagtcgggcgccttcggtgggattcccgagtaa

SEQ ID NO: 4505 - DNA, 918 bp, Myxococcus xanthus
atcgaccagctccgcacgctccgcgcggtggccgaggagggaagcttctccgcggcggcccggaagctcggccaggggcagcccgccgtcagtcaagccatgcagcggctggagaagcagctcggcctgcggctcttcgaccggagcgggcgcgtcccgcgtctgacggcgaagggagaagccgtcgtcgcggcggcgcagcgactccacgaggacatcgcctcgttccaggcggtggtgggccggctcaagagcggcgaggagacgaagctggcgctggtggtggacgccatgttccccaccgacgcactgctggacttcgtgcgggagctggcgcgcacgcacccgggtgtggagctggcgctggaggtggagctgctgtccgcggtgacggagcgcgtgcgcgagcggcgcgcgacgctgggcatcgccggcgcggacctggacctcaccggcctggagcagcgccccatcgcgctcctcaagatgattcccgtcgccgcgccctcgcatccgctcgcggcggtgaagggcgtcctcacggaggcgcacctcgcctccgccatccaaatcgtcctgagcgagcgactgccggagggcaagacgggcacggcggaccggggcgtcatcggctcgcgcctctggcgtgtcgcggacctgatgaccaagcactcactcctcgtcggcggtatcggctggggcctcgagcccgagcacctcgtccgcgacgacctcgccgcaggacggctggtggcgctgcgactggcggcctgggagggggggcccccaccccagcgcccgctcgccctggtgcgccgcaagggcacgccgctgggcccggtggcgacgtgggcctcgaaccggctcacctcgctgtgccagctcgcgctcgggggcgcggaccatcacacgacgtga

SEQ ID NO: 4506 - DNA, 1368 bp, Myxococcus xanthus
atggccgccggcctcttcgcaccctacttccacgacgtctacgcccagtcgtcagcgttgccggcgcgcctggtgctggtcctcgagtgcaatggcgtctacccccgcgcgctcctgagcacgggcacccgcgcggcgctgggggggcgagccaacacctccgaccgcatcttctgggacgcgtacaaggacacgccgatggtgcgcgagggcgacaatctcgccagcgcgatcagtctcgggccgctggcggcgtcttccggcaacatcgacctggtgaaccgctccgccgtgctgctggggctctcgaacctcatcgcgggcggcgggcactccagcgggacgggcgggctgagctgcgcggtgaacggcgcgggcgcgaccttcgacgcggtgatcgcacctcgcctgcgccggggtgcaccgttcgacgtgctgcgcctgggcaccagctccgcgcgcgtgtcgatcgtgtacgagacctgcgcgctcggaccccgcaagcccgcgggcatcatcgtcaacccgtcgctcgcgttcgacagcaccttcggctcgctgctcggtggctcgacgaacgggcgcgatcgcaagatgctcttcgacttcgcgctggccgactcgcggaaggcactggcggagttcagcggcaactccaacgagcggctgaaactggagcgctacgtctcctcgctcgagtcgctgcgcacgcgggaggatcagctcgaaggcatggcggaccgcgtgcggccctacctgccaccggcgccgaaggacaacccgctcatcaccggcgcgggctcaccgcccgactcgctgaagtggttcgaggcgcagttccagatcgccacggcgtccctcctgggcgggctgacgaacacggtggtgctggcgacgggtacctcgggcttcgacgtggcctacggcccggacgtgaccgacatcccgcgacacagcctgcagcacggcctggatgcggggcagaactgggatcgcgtcgccgaggtcacccgccgtcacgtgcaactggtggcgaacctggcgaggacgctggccaccacgcccgaggtcggcgcgagcggctcgatgttggatcacaccgcgatcgtcttcatgtccgacaacggcgagcagcaccactcgacctcgcgtgagtggccgaagctcgtggtgggcggcaacgcgctgggcctgaagaccgacggacgcacggtcgtgtacccaaagtacgacgcggcccggaaccggcaggtctcgaacctcttcaacacgctcggccacgcgttcggagacgcggacttcaacaccttcgggcaggagggcagcacgcgcatcgcgccgggaccgctgagcgagctgtatggctga

SEQ ID NO: 4507 - DNA, 2079 bp, Myxococcus xanthus
atggatggagggctcagcaacgcccagcgcgcgctcatccgcatgcgcgacgacgcatctccgatgccgccggccccgcatgagcgcgcgagcgcagccgacctcgccgcgctcgagacctggatcggggaggggatgcccgtctgcagtgtcctgggcggcccgcccgtaaccgtggtgcccgagcccaacctgctcgatcagtctgcgctcttcagctgcaccgaaggcgtgcgctcggatgcgccgacgcgcatccgccgcttgaaccggcgcgagttcacccgcaacgtcggtggctcggtcgagcgcagctggaccgggttcagcttctacgacaacccgctcgatcccagcgccatcgagcagtacagctcctgggccacggacgagacgctggacgaggccacggtggagctcttcctgccggtggtcggcgaggccgccgcgccgtggacgatgaactacccggacggaaaccggatggagcgtgtctacaccaacagccgcttcaggtgcatgttcgacgacgcgaacccgagcgactcctgcaagcgcttccacctcggccagatgctcgagttcggcgtcttcttccgcccgcccaccgaggatgagctcacccgcatcaccgccttcgcgaccgaggtcatcgcgcaggagccgagctactcctcgcgaaaccgcgcggactccatcacgcggatctccaacgccgcgtggatgatgaccggcgccatgttccgccgcgagatgggcgccgagccggccgacggtcgcgtggagctgaccagcctcgagctgggctcgcagctggcctacgcgctggcggggcgcgcgccctcagccacgccaagcttcgtgtggccctacttctccgcgcccctcgaggggcatctggcggacgttgccaccgccgcgaaggatggatcgctcacgcaggatgcgacgaccaccgccctgatcgagaagtacctgggcggcgtcgacgcccaccagaacgggacaccgcgcttcgatctggtgcaggactacaacgaggagcagcgctccaagcgcgggcagtactggctgggtgacggcgtcgcgggcttcttccgcgagtggctcggctacgggcacgtggccgcggtgttcaaggagtcccccgcggcgacctcgcgcttcgagctcgaggggctcggctacatcagctcggtctcatacgagaacctgctcaccaacttccatccgctggagccgaccttcatccagcagttcgacgatctgatcgcgcgggtggtcgtcgaggataaagacgtgctggcgaacctgctcaccacgcgcaccttctacgtgccctccatgcagcacgcggcgtacgactcgcacaagggcctctcgcacccctacaacgtcagcgagattctcccggcgaccgtcgcgggccgctggaagacgctgcctgccaccgagcgcgcgggcgtgctgacccacccggtgtggctggccgcgcacggcggcaacttcgaggacgacccgtccatcgtccaccgcggcaagtgggtgcgcgagaaccttctgtgcggcttcgtcccaccgctcagcagcgtgcaggtggcagcccaggtcggcgctcacgctgccgacaagaacgcgcgccgccgcctgcaggaggcgacggccggatcgcagtgtcagagctgtcaccgcctgatggagccgctcggcctgcccttcgagatctacaaccacgcgggcttcctgcgcgcgcgggatcactcgaccagcggaggctggaccacgccggacggaagctcgacgctcacgtcgatgccggaccccgcgctggacggcccggtgcgcgacgcagtggagttgagcgagcgcctggctgcctcgcggcacgtgaaacgctgcttcctgcgacaggccttccgctacttcatgggccgcccggagaacgcgagcgacgcatgtacgctgacgcagatggagcaggcctatgaccagaacaacggctcgttctccaagatgctgaccacgctgatgaccagcgacacctggaagacgcggcgtgtgccgcaggctggagagtga

SEQ ID NO: 4508 - DNA, 1239 bp, Myxococcus xanthus
atgacgaaggcaccgatgcggctgaaggccatcgtcaaccacgtggacacccacaattcggaccggcacagcgctggcgagggccacctggtcttcgatgcaatcgatgcggacggcaagccactgcccctcaccgccaccctcgtgtacgacctgcatgcatccaagccctcggacgcgctccactgggcccggcaatggcatgcactcgccacgcagactccgggtacggaggcattcaacaccaccctccaggccgtcaccgaccgattcaccgccgccccaggccggctccaggtgagcacgacggaatcggtcctcgactcagcgcgctcgaaatccaccgacgcgcggcgcctcgcgaaggacttcggaaacctgctgtgcaccgatagcgcagcccctaccgtgacgctcctctcgccgagcccggacagtgccgtgcgcggcaccatcaccctgacggcgagcgcctacgatgacgtcggcgtcacgcgcgtggacttcttctcagggtccaccctcatcgcctccgacgcccagccccctttcatcgtggactgggacacgacgacgtccccttccggcacccgggcgctgacagcccaggccttcgacgcggacggcaacatgggcatctccgacccggtgagcgtcatggtggacaacttcgctcccatcattctttcgggcacgccccagtacaacccgcagaccctgaactatgtgcgcggcaacatcaccgtgggctggaccgtgacggaccagtccctctcaggcgtggtcctggccgagttcttccaggaggggtacctcaagggctcgctgacgagccccaccagccttgggtacaccttcccgtgggacacgcgggtgctggccaatcgatcctacagcctgaccctgcgcgcgactgacagggcaggcaatgtcgcgacgcacacccgttcgctgatcgtcgacaacgcgccgcccacgtccgtcctgaccgcaccggccaacggagacgtcgtcagtggtgtcgtcacgctggcggccaatgcgagtgacagccaatcgctctactacgtcgccttcgagatcgacggtgtcatccagacaccctattcgaccaccgcgcccttcacccgtacgtgggacacgacgggcaagtccggcacgcacgtcattgtcgccatcgcgtatgaccgcgtgggcaacagccaacgcagcaacgcagtgacggtcaccgttccgtga

SEQ ID NO: 4509 - DNA, 1068 bp, Myxococcus xanthus
atgctgttcgtggtggccgcggtgttgatgttcaccgggcagggtgaagagcccgccatggagacgccgaaggtggaattcccccggcggatgcgggcccccgagcgggagcgcgcggagcggcgccggacacacgtcatgcccgtgcaggtggacgcgggcacgcaggagcgcgcgcgtcccagggaccccctgctggccgccctgccccgcggcgagggaaagacggcggtggtcatcgaggcgaacgcactgcggcactcgcccattggtgagctgctgctggactgcctgatgcgggatggcggaaagcggctgcaggagctgcggaacctcagtggcgtggacccgctccaggacctggaccgcctggtcatcaccgatgaagggatgatgctgtcgggcaacttcggcaacgcgaagttcaaggagctgctgggcgagcgcgtgtccatggactacggcgaaggcgcccgggtgtacgagccgggcgacatgacggtgacgcggccggatgggagcacggcgcgtggccgaagcgaggccgcggtggcgacgtggaacaacgagttgctggtgattggcaagtcgccggacgaggtgaaggcggtggtggaccgggtggagggccgcggtccggacgagccccccgccatctccgagggcagcacctacggggagatgtatggcgtgctgtccgtggaccagctcgcgcggctgttgcccaaggagcaggcggagctggcggaccgcatccgccgggtggcccagaacgtggagctccacgtggacgcgagcggcgatgtggcgatggtcgccgaggtccgcggcgcgaatggcgacgaagtcacggacctgggcaagacgctgggcgccgcgctgagcatggcgcgcatcaaggcgcaggcggagggtgagaaggacctggcgcagttgctcgacttcgcccgcgtccagccggatggcacgtccttcaagctggagatggcggtgccgctcgacgtcatcaagcagcgactggcgttctgcaaggaagagcggagcgcggcggaggcggctgagcgatag

SEQ ID NO: 4510 - DNA, 540 bp, Myxococcus xanthus
atgtcacccgggcgcatcgagcacctgctggcgctgcccatccagcgttggcacctgctggcggggacgttcctgggcgtgatggtgctggcgctgggtgggacgctgtatgggacgacggggctggtgctcatcttcggcgtgaaggcggggtactggacggcggggccgctcatcgccggattgctggcgtgcgtgggattcgcggcggtgtacgcggtgatgctgacggcggcgacgctggtgcgcagcgcagcgctgtgcgcggcctccggcttcgtcttcctggtgggaggaatcatcgcgggctaccggcagcagatgacgcccttcttcgaggagggatttggacgcgaagccttccgggcggtgacgctggtgttgccgcggctgtccgcgctggccgtggccgcgggcgacatcgccgcgtccacgccgctggaggtgcgctcgctgggcttgctgttgctcggtgtgctggtgtttggattcggagccttggcggtggggttctggcgcttcgagggaaaggattactga

SEQ ID NO: 4511 - DNA, 879 bp, Myxococcus xanthus
atgctgtacgcgggcatcgcgggctcggtgctcgtgggcatcctgctgggcctgctcggaggtggcggctccatcctcatcgtgccgctgctcatctacgtgctcgacgtcgagcctcggacggccatcgccatgtccctggtggtggtgggcgtcaccagcgccagcagcgccttcctccacgcccgcgcgggccgcgtccgctggcgcaccgcgctcgtgttcggcgcagggggcatgggcggagccttcctcggtggccggctcaatccccacctcgcgcccgacacgctgctgctcctgttcgggagcgtcatggtggccgccgccgtggccatgcttcgccgccgggaagccgggcccgccgccaccagcgtctccccgctccccgcggcccgcgtgctcgcacaaggcatcgcggtgggcgcgttgtcgggactggtgggcgccgggggcggcttcctcatcgtgcccgcgctgtcactggcggggctgcccatgccagtcgccaccgccacgtccctggtggtcatcgcgctccagtgcgccgccggcctggtgggccacctgggccacctggacctgccctgggtgctcaccggcgaagtcctcctggccgcgatgacgggcagcctcgtgggcggaaggctcgcggggcgcgtgtcccccgcgatgctgcgcaagggcttcgccgtgttcgtgctgaccaccgccgccttcctcctgggcgcccagtctcccgcgcccctgcgtgagcgcgtatggacggaggggctgtggctctggagcgtggcgcctcttgccgtgggcattcccgtgacggtgtggcgcctgcgcgtggcccgccagcgtcaggccgcgcaggccctgccccggtga

SEQ ID NO: 4512 - DNA, 690 bp, Myxococcus xanthus
atcgaagtgaggggattgaggaagacgtaccaccgggccttccggaagggcggcaccgaggccctccgaggcatggacctgacggtgccggaaggaagcgccttcggcctcatcggccccaacggtgcgggcaagacgaccttcatcaagagcatcctcggcatcgtccagcccacggaggggtccatccgggtactggggggctcgcccgaggacccgcgcatccgcgcccgcatcggctacctgcccgagcgcctgcacctgcccggcacctggacggcgcccgccttcctggcgacggtgacgcggctgaagggcctccccgtggaccccgcggtgaacctgcgcctcctggagcgcgtgggcctgtcggacgcggtgggccggcgcagtggcgggtactccaagggcatgcgttagcggctgtcattggcagcggcagtggtgggtacaccttccttgttggtgctgtatgagcccacggacggaatcgaccccataggacggatgtaagtgcggcgcatcctccaagacgaggtgcagcgaggcacgacgctgttcctcaactcccacctgctggcggagaccgagcgtgtctgtgaccgcgtcgccatcctcgcgggaggccgcgtggtgcgcgagggccggctggaggacctggcgcgcggcggcgtccggtggctggtgcgc

SEQ ID NO: 4513 - DNA, 417 bp, Myxococcus xanthus
accagcaaccagacgctggccgagcaggtccacgtctcgccgcccacctgcctgcggcgcgtgcggcggttgcatgagctcggcctgatcgaaaagcaggtggccctgctgcagcccgaccggctcgcccaactgcaggggcacgggctcacggccattgtcgagatcacgctggatcagcagggcgcggagtttctgcaggcctttgaaacccgtgtggtcgccgatgcccaggtgcagcagtgctggcgcgtgtcgccggggccggacttcgtgctcgtggtgcacgcgcacgacatgcccgcctaccacgcgctcgcccagcgcttgttcacgcacgacgccaacgtgcgcaacgtgaaggcattcttcgccacgcaccgcgccaagttcgacacgcgcgtgcccttgctctga

SEQ ID NO: 4514 - DNA, 93 bp, Myxococcus xanthus
atgtcgccggtgcccttcgatgaccgcggcgcggcgcgcatctacttcggcgccgccttcaccagcgtctgggacaaccccgcggcgccctga

SEQ ID NO: 4515 - DNA, 1353 bp, Myxococcus xanthus
cgtgtcgcgatcatcggagctggccccagcggcttggcccagttgcgtgcgtttgaatccgctgcccgcaagggagcggagatcccggaaatcgtctgcttcgagaagcaggaggattggggcgggctctggaactacacgtggaggaccggcctgggacgctacggcgagccggtgcacggcagcatgtaccggcacctgtggtcgaacggtccgaaggaggcgctcgagttcgccgactactccttcgacgagcacttcggccggccgatcccgtcctatccgccgcgcgaggtgctctacgactacatccgcgggcgggtggagaagtgcgatgtccgcaagtacatccagttcaacaccatcgttcgttggctctcctggtccgaggagacccggaagttcaccgtggtggtcgacgacctcgccaagcgcgaggtccgcgaggagtcgttcgaccgggtggtgaacgcaaccggccacttctccacgccgaacgtgcccttcttcgagggcatcgactccttccccggtcgcgtgctgcacgcgcacgacttccgcggcgccgaggagttcgcgggaaagaacctcctgctgatcgggagcagctactccgccgaggacatcggcgtgcagtgccacaagctgggcgcgaagtcggtgaccatcagctaccggtccgcccccatgggcttcaggtggcccatgggcatgaaggaggtaccactggtgaagcggttcgaggggaaccgcgcgcacttcgcggatgggacctccgcgacgctcgatgcggtcatcctgtgcacgggttaccagcacaagtaccgcttccttcccaatgcgctgcgcctggagagccacaaccggctctacccgccggggctctacaagggcgtgttctggcaaggccagccggagctcgcctacctggggatgcaggaccagtactacaccttcaacatgttcgacgcccaggcatggctggtgcgcgacgtgatcatggggcgcaccgcgctgccgtccgccgaggagcgcgaggcggacatcgcggcgtgggtcgagcgcgaggaggggatccaggattcgttcggggcggtggacttccaaaccgcctacatccgggacctgctcgaccgcaccgactacccgggcttcagcgtggagaaggtcgcggagctgctgaagcagtggctgcgcgacaagcaggaggacatcctcggctaccgcgaccgcaccttcacgtcgatcgtcaccggcacccgcgccacgccgcaccgtcgcaagtggatggacgagctggacgactcggcggagagcttcctcgccgaggccccggagcgcaggaccgggtga

SEQ ID NO: 4516 - DNA, 276 bp, Myxococcus xanthus
atggcctggagccgggacacacggccttccagctcggggcctacgcggcggcacggggggctggtggaggccctcacgcgcaccggcgcggacgtgacgcgggccagcctggtgcagcacctggaggcgctgcgcgacttcgacacgggcgtgtctccgcccgtcaccgtcggcatcaaccggcgcgtgggcgtgcagggcgcgcagttcgcggcgctggacgtggccacgggcgggctcgtcgcggcgtcggagtggattcccctgacgccgtga

SEQ ID NO: 4517 - DNA, 477 bp, Myxococcus xanthus
cgtcagcctgccaggttcatcgccgcgctgggaattacgccgggacagcggattgccgatgtcggagcgggcctgggctacttcacgcagcgactctcggaggccgtcggtccggcgggacaggtggtcgcgaccgacatcaacgacgaggccctcaagcggcttcgcgcacggatgtccgagcggaagaacgtcgtggtgcgcaaggtggaaccggacgagccaggcctcgaacccggcgcgtacgacctcatccttctctccgaggtggaccacttcctctcggaccgtgtggcctacctgaccaggctgcgtctcgccctcaccccgaatggccgtatcgcggtgacgcaccttcgggcgatgcgcccgccgctcgtcgccgccgcccagcaggcgggctactccatcgtgtccgagtacgacggccttccggaccactacctgctgttcctgcagcccgcgtccagtcgatga

SEQ ID NO: 4518 - DNA, 2115 bp, Myxococcus xanthus
aagtcggacggcttcatccgccagctcgtggagacgcgctacttcaacatcggccgtcccatgggcacgagcttcaccccggacgagcagacgctcttcttcctgcgcaatccggagggctcacgcgccctcgcgctccacgcgttcgacgtggccacgggacagacgcgcgagcacctcaccgcggagcgccttctgcagcgtgcccgggagaacctcgccgtcgagccgaaggcgcgccaggagcccgcgcgtgtgtcctcgcggggcctgagctcctatgccctgtccgaggacggcgagaagttgctcgtgggcttgtccggcaagcagtacatcgtcacgcgcgcgtccgggaaggtgacggagctgaagacgggccccggcgccatggacgtgcgcttctctcccgatgccacccaggtggcctatgtgcgggggcatgacgtgtatcgcctggacctggccacgaacatcgagcaccaggtgacgaagggcggcacggaggagaagagccacgggctggcggagttcatcgccacgagcgagatgatgcgcttctccggctactggtggagcccggacggaaaggccctggcctacacggagtccgacacgagcggcgtggagaagctcgccatcgcggacgcgctccacccggagaacgatgcgcggcggctcgccttcccgcgcgccggcaaggccaacgcccgggtgcgcctgggtatcatccccatcacaggcggcaagacgacgtgggtgcgctgggacgtggagaagtatccctacctcgccacggtgcgctggccggcgaagggccctctgacggtgctggtgcagaaccggctccagacggaggagctcctgctcgcggtggacccgaggacggggagcacgcgcacgctgctcgtggagagggacgacgcttggctcacgctgcaccagacgttcccccactggctggaggatggaagcggcttcctctggtacacagagcgcaacggcgctggcgaagtggagctgcgcgacgcctcgggcaagttcgtgcgctcgctcgtgccgcccggcgcgggcttctatgacatggcgggctacgttgagaaggacggcaccgtctacttcaccggcggcccaacctccgacgagcgctacgtgtggcgcctgagcccgggcgggaggcccacccgcgtcacctcggagagcccggcgctggagctggcccggatgtccaagcggggcggcttgctggccatcacgtccgagggcccccggcgcatgcgtcacaccactgtgatgaaggcggacggcactcgcgtgggcgagctgccctcggtggcaatggagccgccgttccagccgcgagtggaggtgcggtacgtgggcaaggagcgctaccccacgtcgctggtgcgtcctcgcgacgcgaagcccggcgtgaagctgcccgtcatcgtggacatctacgcggggcccggcatccccatggtgtaccagagcatgcagcagcacctcaccaaccagtggctcgcggacgagggcttcatcgtggtgaaactggacgggcgaggagtttcgcccaccgccgacgcgaagctgcgcaagccgaagtacgactggccccggctgctgctggacgagcaggtggccgcgctgcgcgcgctcgcggccgaggtgccggaaatggacctgagccgcgtgggcatcactggcgcgagcaacggcggctacatgtccgcgctggccgtgctcacccgcccggacgtcttcaaggccgcggtggccgtgtcctcagtgacggactggcgcgactacgactcacacctgacggagcgcttcttcggcctacccgacgagcacccccaggcctacgagcaggcctcgctccttactcacgtgaaggccgaccagcccatgggaaagctcctgttcatccatggcactgcggacgacaacgtcctcttcttccacgccctcaagctttcggacgcgctgtttcgggcgggccagccccacgagttcctgcccctcagcggcatgccgcacatggtgttcgacccggtgctggccgagcgcatgtgggaggagaccgcgcgctacttcaagcggcatctctaa

SEQ ID NO: 4519 - DNA, 651 bp, Myxococcus xanthus
atgattcaggagctgtcggccatcacggtgagagaggaacgggacacgggaatgggccacgagacgaagcgcccggcgacctacgaggacctggtggcgctgccggaacaccaggtggggcagattatcgacggggagctcatcgctcagccgaggccgacgagtcgacatgcgcgggccaccacccggctgggtggtgagctgtacggccctttcgaacggggacgcggcgggcctggaggttggtatttcctggatgagccggagctgcacttcggcgcggatgtcctggtgccagacctggcgggctggcgccgcgaccggatgccggaagtcccggatacgccttacttcacgctggtgccagactgggtctgcgaggtgctgacgccctccaccgccgcgttggaccgcgcgcgcaagctgccgctctacgcgcgcgcgggcgtgtcgcacgtgtggctggtggaccccgccgcgcgcacgctggaggtgtaccagcgcgtcaagcggggctggctgctgacggggagctacgaggatgacgcgctggtgcgggccgaccccttcccgtcctcgacactggagctgggctcgctgtggctgcccgagggcgccgagaagccctctctgctggtggctgttccgtga

SEQ ID NO: 4520 - DNA, 144 bp, Myxococcus xanthus
atggtcgtgctcggtgatgggccccgtctggacatcacgcccgtgggctacaacgaatgggcctggatcatcggctggcccagcggtgcacgggcggggtcgaccatcagcttcgacatctactgcgtcgccgggcccgcctga

SEQ ID NO: 4521 - DNA, 594 bp, Myxococcus xanthus
atggagaccatggccacggcgctgcgacgctacttcgacgagagcggcttcggagaggacggcgggtacgcgtccgattgggtcgacttcaagctcggccccctccccttcccgctccccaacaccgaggctcgcaagcgcgcggtgcgcttccacgatctgcaccacgtcctcaccggctatcgcaccgacctcacgggcgagttcgagatctccgcgtgggagatcggcgcgggctgcggcgacttccacgcggcctgggtgctcaacctctcgggcatgaccggggggctgctgacggccccggtgcgcacctggcgcgcgttcgtccgcgggctcgacgagcagtccacctacgggcgcgactacgaggcgctgctcgagcgcaacgtcgaggacctgcgcgcggagctcgggatcggagcgggtccccaccgagcgggcctcggcgccgcgcttcgcttcgccgcagcgatcactgcgggcgcagtggtcggctcgctgatgatgctggtgctcgtctctcccatcaccctggcgctctggtggcggggccgaagggccaaggcccaggcgctggccgccgcgccctga

SEQ ID NO: 4522 - DNA, 414 bp, Myxococcus xanthus
atgctgttcctggtgcccgtgctggccacgggctgtgcctccaccgctggcgccacccggccagacgagcccgcgacggaagcggcggcccccgaggccacgcccagcgcgcccagcgcgcccagcgcgccctccggctatggctacagcaagaacgaccccatccacgtgggtggaggtgtcggcggcgaacacgaatacctccagcacctgcgggggccagaggggcagaagatccgctacgagcggggaggaagctgctgcgccttcgagtcggagggcgcgccgttcggcagcggcatgctcgacgtgtacgtcgtcacctacgacgggctggaggagccggtgatgctgtacctcaacatgtatgaacggaaggacccgcgcgcccccgaaggcttccgcctggactga

SEQ ID NO: 4523 - DNA, 2889 bp, Myxococcus xanthus
  unsure (1)..(2889): unsure at all n locations
gcggccgccctactgatggccgcctgtggaacgcctgagctcgcgcagcccgacgacgtacaggatgcgacgacggcccagggcatctccacgctctccgtgcgaggaaccaccagcgcgagcggtctggccatcaccgccctctccatccccacccccgtcggtacggccgccggagatgtgctggtgatgcagctgagcaatcgcgaggccgtcgccgccgtcgccaccccacccgctggctggacgctgctgcgctccgagcagagcgcctcggccatcaagtcctggctcttcctccgcgtggccagcgcggccgagccgagcagtcacaccttcaccctcgacctcgccagctccatggcggccaccctggtcgcggtgtcgggcgcggatccgctccagccgatcgacgtgcacgtgggccagaagaatggcaacagcgcgagcctcgcgctgcccgtcgccaccacgtcgtccgcgaacggcctcgcagtgtggttctcggcccaggtctggggaggcgccgcgtgccccgcggtccacacccctccgacgggcttcaccgagcagctcgacacctgcctcgtctcgtcgtcgcgcggcgtgctgcacagcgccgccacctcggagctcggggccgcaggtgcccagcccgccttcaccggcagctccacgctccccaacaccaacatcacgcacgcggtggtgctgcgtcccctccagccgccggcgaccggggagatcaccctcgtcggcaccacgcacgcgagcggcaagacggtcaccagcctgaccctctcgacccctacgggcgtcgccgccggtaacgtgctgctggcgcaccttgcgaaccggaaccagatcggcgccgagatcaccccgcctgcaggttggacgctggtgcgcaccgacatgagcacctggagcatccgcggctgggtcttcgtccgcgtcgccaccgccagcgagcccgcgagccacactttccagagcgccatcgcgagctacctcgtcggcaacctcgtggcgtatgccggcgtcgatccggccaacccgatcgacacgcacgccggcaagagcaacagcggctcgacggccttcactacgccgcagctgagcacctcgaccgcgggcggggctgccgtctggttcggcgcgcaggcgtggaccggcgccgcgtgtccgaccccggcgatcgagccccccgtgggcttcgccgagacctacgacacctgcctggtgtcctcgtcccagggcctcgtcttcaacgccgccttcatgcccctcgccggtgccggcctccaaggaccgttcaacgggagctcgacgttcgccgagaccaacgtcgcgcaggtcgtcgcccttcgccgcgccgaggtcgcgccgtcctcgggggtcgcgttgcgtgggagctcgcaccacagcggcctgtcgatcgcttcgctgtcgatccccaagccgtcggggaccgaggccaacgacgcgctcatcgcgcgggtgaccgtgcgcaacaacatctccgcgaccgtcacgccgcccgccggctggacgttcctgcgctcggagcagagcgcctgggccatccgcacctggatcttctaccgcgtcgcgggcgcctccgagcctgcgagctacgcgttcgaactggacgcgaccacccacatggcggggagcgtggaggccttcagcggcgtcgatccggtccagccaatcgacgtgcacgcaggccagaagaacggcgactccgcgtcgttcaccgtgcccgacgtggtgaccggcagcgcgggtggcctcgccgtctggtacggcacacaggtctggccggacgccacctgccctgccaccggcatcgagccgccgctcggcttcaccgaggccttcgacgcgtgcctgggtcacaccaacggactgctcttcaatgcggcctaccggtcgctcaccgcgccggggctccaggcgggcctctccggcagctccgcgttcgtgcagaccaacaccgcgcacgtgatcgtnctgcgcgccggcaacgcccccacctgcatggccggcgacacgtacgcgagcaccttcacgcttcagggcaccgtgaccgcgccggaaatcgtggagccctcgggcctggccgcgagccgcgtggtcggcaacgcgctctacgtgcacaacgaggacaccaccgcgatcgtcgcgatcgacacgctcaacgcgagcacgatcggcacgttcaacgtgaccaacgtgacgccggccgactgggaggacctcgcaaccgggccctgcccgagcggctcgtgcatcttcatcggtgacatcgggaagtggagcgccaacttccctgcgggtggcagccccacgtcgttcacgatctaccgcgtgcccgagccggatctcgccaacggccagacctcgggggggctcgtcgccgaggccttcccgttcgtctatccggacggcgcgaaggacgcggagtcgctgatggtgcaccccaccaccggggacatctacgtcgtcaccaagaacgggggcacggggcagagcggcgtgtacaagttcccccagccgctgacgccgggcgtgcaggccacgctgatccacgtccacacgatccagctgccgctgaacggagacgccaacttctcggccgcgaccgcggcggcgatccacccatgcgcggatcgcttcctccttcgcacctaccgcactgtctacgagttccgtgcgacgccgggacttggcttcgagtcggccgtcttcgcgacgcccgtcacgctgaccgacaccaccgagggccagggtgaggcgatcgagtacgaggccaacggcgcgagctacttcacgatgagcgagagcccctcgcccttcaagctcaagcgcgtgcccctgctgtag

SEQ ID NO: 4524 - DNA, 498 bp, Myxococcus xanthus
atgacgacgctgaaggagtggctcctggcggtcatgccgttcacggcgctggtcctgctctggcgcttctcggtctcgcgcgagaagcggcacacccagacgctctaccgcgccatcgacgaaggggccgtgagcgaggtccaggccatcctctcgaagcaggccttcccgaacctgcgctcggtggtcgtcgcgagcgccatcgtgagggccgtcgaatccagacaggttgccgtgcttgacttcctgctcagccccgagctgaagcccgtgacgctcacccagaagctcgattccttccttcacgaccaggcgatgaagggtggctggaggggcgtggtgctctggcgctcgcggaactcgcacctgttcttgccctggagggacctgagcaagcgggacaagctccggctgagggccatggccacccgcgtcgtcgaggcggagccctcgaaggtctttcttcgccacgacgtccgaggatggaccgtcgcctga

SEQ ID NO: 4525 - DNA, 321 bp, Myxococcus xanthus
ttcgaggcggacagcctgcacctggtggcgcaccaggaggagggggtgctcggctgcgtcctcttcaaccccgaggatgcccacggcggacggctgttccagatggccgtggcctcccacctccaggggcaggggctgggcgcccggctggtgcgtacgctggaagcggagctggtgcggcgcggcttcacccatgtccacctgcacgcgcgcgaaccggcggtcccgttctatgagcgactgggttacgccgtcttcggcgccccctacaccgaggtgggcgtcccccaccgcaacatgcgcaagacactcggggcctag

SEQ ID NO: 4526 - DNA, 2508 bp, Myxococcus xanthus
cccaaggtcgcgctggtgcgcgtcacctccaaccccaagggcgctgacgtctacgtggaccgcatggacctgggcagtcggggccgctctccacagacgctcgcgctgacgcccggccgtcacaaaatcatggtgaagaaggaaggctaccgcgctgcggaggccacgctcaccctggtgcgcggccgtgagacggaccagaccttcgacctcacgctcatcaccggcggcgtggaggtgacgggcacgccggagggcgccgagattcgcgacgcccccaacggcaacatcctggcccgcgtgcccggccgcgtgcgactgcctcccggccagcgcgtgctgcacgtgcgcgcccccggctacgcgcccagccaatacgtggtggatgtccccgccgacggcaacgtgcctgtcgccgtggcgctgcgtccccaggaccggcccaccgggcggctcgtcgtcaccgccaaccgcgacggcgccacggtgcgcgtggatggcaagcccgccggcttcacccccaccgtcgtcaccctccccgaaggcgagcacacgctggaggtggagagccgcgaggtgcggccgctccgccagacggtgaaggtggtggccgatgaagaagtgaaggtccacgccgagctgcgctacgcgccgcctccggtgcgcgccgcatcgaagagcctggtcgccgtcgacgaagcgcccgcctccaccaccgtgctcacacaggaggagctgcgcgccttcggctggcgcaccgtcgccgaggccgtggccggtgtgcgcggcttctatctcaccgacgaccggacctatacgtacatgggcgtgcgcggcttctccccgccgggcgacctcaacacgcgcatcctcatcctctgggatggccactccatgaacgacgtctgggccggccagggcttcgccgcccgcgacctcagcgtggacatccaggaagtggagcgcatcgaggtggtgcgcggccctggcagcgccctgtacggcacgggcgccttcttcgccgtcatcaacgtggtcccccgtgaatcgctgggttcggacaagcacctggaagtcacgggcgcggtgggcgcgctcggcaccacccggggacacgccgccgcgtcgtgggaggacggcaaccggtcggtgctggtgagcgccgccgccttgacgtccacgggcgcggacaccacccggctgggctccagcggtcccatcatcaccgggctggacgcggagcgcgccgccggtggctccctccgggcccgcgtgggcgacctgtccttccaggcccagttcaacgtgcgcaccaaggagttgcccaccgcgccctacggcaccgtgcccggcacggagggcaacatcgtggaggacatgcgcgccttcgccgaggcccgctacgagcgccagttcaccgagcgcttcagcctgtccgtgcgcggcgcgttcgacatcagccgctacgagggcacctacgtctacccggaggaggacggcggcgcccggaccgagggcggcgcggcggactggctcaccgccgaggcacgcgcgcgcatcggcctgttcgagggcaacgtcttcacgctcggcgtggaaggtcaggcgcagcttcgcgtccggcaggacgccggtgatttgcccttggagacacaggcgcgcacgctggtgtccgcgtacctgctcgacgagtggaagatccacccacggctgagcgtgtcagccggcctgcgtctggacaagtacgtggacctggacagcacgcccatcaccccgcgcctggccgtcatcgcccggccctacgagcggggcctcaccaagctggtggcgggtaacgccttccgcgcgcccaacgtctacgagctctactacgcggacggcatctcccagggcgcggcgctgaacctgcggccggagaccatcaccaccttcgagctggagcactcgcacgacctgacggacgagctgcgcctcaccgtcgcgggctaccacaaccgcatctccagcctggtgcagctcactgcggaggacgcggcttcaggcgactgcggcaccgccgcctgtctgcgcttcatgaacaccgacggcacgacactcgcctggggcgccgaggccggcgtgcactggcagccgggccgctggctgatggtggacgtgagctactcctacgtgacgctgcgcaacgcctcggaggaagtggccaacgcggcgcccgcgcacctggtggcgggccggatgatgctgcccattggcgccggcgacatgcgcgtggccacccaggccatctaccagagcgcccggcccaccggcccgggcggcgcggacagcggcgaggcgctgctggtgggcttcggcctgtcgggtgactacggccccctgcgctacttcgccggcgtgcacaacctgctggacgcccgctactcgctgccggtgtcggacgagaactccatcgcccccgtgccccagtacggccgcaccttcacgcttcagctcacggggactttctga

SEQ ID NO: 4527 - DNA, 72 bp, Myxococcus xanthus
atgggtgtgctgctcgccttcgtgacgtacggccgctacgtcctcaagccggtggtggtagccgccgcgtga

SEQ ID NO: 4528 - DNA, 609 bp, Myxococcus xanthus
ccgccccctgggctgaaggtggagcgcatcgcgggcgcggacatctccacggagaaggggaaggacaccggctttggtgggttcgtcgtcctggacgtggagacgttggcgccggtggcccagtctgaggccgtggtgacgttgcactttccctacgtgccgggcctgctgtccttccgcgagctgcccaccatcgccgctgcctgggaacggctcacggtgcgccccgatgtggtcatcttcgatggacaaggcaccgcccatccccggcgcatggggattgcgtgtcacggagggttgctgttcggcgtgccatccatcggctgtgccaagtccctgctggtggggacgcacggaccgctgggcgaggcgagaggctccaccgcgcccctcatgcaccggggcgaggtcgtgggcatggcggtgcgcacgcgcaagggcgtgcagcccgtctacgtgtccccgggccacctgatggacctgcccacggcggtggagtgggtgctcaaggtgagcccgaagtaccgcgagccggagaccacgcggcatgcgcaccggctggtcaacgcactccgtcgcgcggacggagaggccgccgaactggagtag

SEQ ID NO: 4529 - DNA, 2250 bp, Myxococcus xanthus
atgtccggaggtggctccatcgcgtggggcctcaaggaacggcggctcgggcgtctgtctccctggccgcccttcccgccagcccgtactggcggtagcacctcaggccgcgaaacagggctggggccagggcgggagatgtcattgggagcgccaatgcggaggttgtcgtcaccttggagtgagctggcgtcgcattacgccgtggtggtggtgggctcggggtacggaggggccatcaccgccagccgattggctcgcgcgggccagcaggtctgtgtcctggagcgaggccgggagctcctgcccggtgactacccgcgcacggacgccgagttcatgtccgagttccaggttcacttcgaccccgaagccgccgccgatgtgggcagtccgacggccttgttcgagctccaccggggcggggatgtctccgtcgtcacgggctgcggcctgggcgggacgtcgctcatcaatgccaacgtggccatgcggccggaccctcgcgtgttcctggatgggcgttggccggacgcgttccgcgccgacgtggacggcttgctggaggacggcttcgcttgggccgagcacatgctgcggccattgccctatccggaatccgcgccgccgctggccacgctgtcggcgctggcgaaatcggcggagaagctgggcggcacctttcgccggcctcccctggccgtcaccttcgaggagggcgtcaacgccgcgggggtgcgtcagggcgcttgcacgttgtgcggtgactgcatgacgggctgcaacttcggcgcgaagaactccgtgctgatgaactacctgccggacgcgcaccgccatggggcgaagctcttcaccgaggtgggcgtgcgctacctggcgcgcgatggtgcccggtggcgcgtgtactaccggccgatgaacgccggccgcgagcggttcgatgcgccagacctgtggttgaccgccgaccgcgtcatcctcgcggcggggaccatgggcaccgcggagctcctgcttcgctcgaaggcgctggggttgtccctctccgggcgtctgggccagcgtttcagcaacaacggggacgtgatggcgttcggttacaacacggacgtcccggtctatggcgtgggtctgggcgaggcgccctccgcggggcgcgagcccgtgggtcccaccatcaccggtatcatcgatgaccgggccacgctgcggcaggaagacggcatgatcatcgagaacggcgcgattcccgccgcgctcgcgcgtcccgtgacggcgctgctcgccgcggcgtcggccatcgccgggcaggacacggaccggggcgtcatcgaccgggttggggaactggcgcgcatcgcggacagtgccgtgcgcggcccgtaccacggggccatgcgcaacacgcagacgttcctcgtgatgtcccatgatgacggcgcgggtgaactgcgcctgtcgggtgaccgggtccgcgttcactggccaggcgcggggcggcaggccgtcttcacgcgggtggatgaacgcctgcgtcgcgccacggaggcgctgggcgggaccttcgtgcgcaatccgctctggaacaagctcaccggccacgaactgctgtgcacccatcccttgggcgggtgcgccatgggcgagcgcgcggaggagggcgtggtggaccacgagggccgcgtcttcgcggggcccgagggcacggaggtccacgagggcctctacgtcagcgacggctccgtgattcccaggccgctgggcatcaacccgctgctcaccatctccgcggtggcggagcgcaccgtggcgctgatggcccggcggcacggttggagcgtggactactcgccggttccggaggccccggggccgcggcccacgcagcccctggccgtgcagttcaccgagaccatgtacggctacatactccgcgggggccgacgaggacttcctgcgagccggggaccccgcgcgcagggatacgtcgccgttccgcttcatcgtcacagtggactcccgggacctggaggagacgctcgcgcatccgctgcaccccatgcaactgtcgggctgcgtggtggcgcccgtgctgtcctcccgtccgatgacggtggagcggggcgtgctgcacctgatgacccacgagggcgctcgtcctggcggacggcggatgcgctaccagctcccgctggtctccgagtccggcgagcgcttcttcgtcgacggctacaaggacgtccatga

SEQ ID NO: 4530 - DNA, 393 bp, Myxococcus xanthus
atgacggtggagcggggcgtgctgcacctgatgacccacgagggcgctcgtcctggcggacggcggatgcgctaccagctcccgctggtctccgagtccggcgagcgcttcttcgtcgacggctacaaggacgtccatgacgacgacggtccggacttgtgggtggacaccacgcggctcctggtgtccatcttccgcggcgaggacgcttcggggcgctgcatcttcaggggctacctgcggctgaacgccaaggacttcgccgtgcagctctccaccctacgggtgctccatgcccagggtacggtgcagcggctggccgcgctcgcccgcttcggacgtttcttcttcggggaactcttcgagacgtacgtgcgcagcaaggccgcgtag

SEQ ID NO: 4531 - DNA, 507 bp, Myxococcus xanthus
atgcccaatgaccgtgagcagggaaagggcgctccgcagggcagcgagcgtcaggccagccgccgggatacgcccatcgaggtccgcaggcggctgcggcacgagtcacgcacgagccagacgtacgcggccttcatcaagcacctgtgcgagcgaggcggcatgtcacccgccgtggccgagaaggccgcggtgtccgtcctctgcgctttggaacagcgaatcctcagtgaggaggcaagcgacctggaggaccagcttcctcgcaagctgaccctgctgctgcaccgctgtgagaagcacgaggaagagctgcctcccaagttccaccgcgagcaccttctgcgtcgggtcggcgaggacctgagccttcatccagacgcggtggagccggtggttcgcgcggtgatggatgccgtccgccaccagataaccgaaggggagtccgaggacgtcatgggccagctcccgccggacatccgcgacctctggacgcgcaccgtctga

SEQ ID NO: 4532 - DNA, 297 bp, Myxococcus xanthus
atggaagagccaccctccgaggtggctcgcgccgtcgagttcgggaagcggcgtgaagagcgcgccgaagcccaggagctgtattgggcggcatttgcccgcctccagcaggagcacccgaaggaagcttcggcttgggacctgtaccaccacgaagacgtcgaggatcacgaagaatgtgcccggcgcctgagcatcaccgtggtgaacagctacaagcgcgtcagccgggcccaggcctacctcaagctctacctgctggaccttcatcgcgagtcgcatggggaggaagcgtga

SEQ ID NO: 4533 - DNA, 828 bp, Myxococcus xanthus
ctggcgttcgatttgttcagggacccgctgctgtgcgcgctcatcgcgggcggcgtactgggcttcctgagcgtgtacgtggtgctgcggcgcatggtgttcgtcagcgccgcggtggcccaatccgcgggcctgggcgtggcgctggccttctacgcggccatccacctgggcacgcacgtggagcccgtgctgggcgccaccaccctggcgctgttggccaccatgttgctgatgacggagccggcgaagctgcgcctcacgcgggagagcctgctgggtctggcctatgcgctggcgggcggcgccgcggtgctcgtgggagaccgcatcgcgcaggaggcgcacgacatccagagcatcctcttcggcacggcggtgctggtgacgcccgagcagctctacacggtggccatcgctggcggggccatcatgttcatccacctgtggtggtaccggggcatcaccttcgccagcttcgaccggacgggagcgctggtgcaggggctgccggtgcgcctcctggacggcgtgctgatggtcagcatcggcgtcatggtgggcgtgtgcgcccgggcgctgggcgcgctgccggtgttcgccttctccacgctgtccgccatcgccgcgctgatgttggagctgcggctgccgtggaccttcttcgtcgccacgctcttcggcgccatcgcgggcgtgggcggctatctcttcgcgttcttctacgacttccccgtgggcggctcgcagacggtgttcgccgcggccatggtggccgtggcgaccgtcctgcgaatgctcgtccacgcggtacagaaggcgcgctga

SEQ ID NO: 4534 - DNA, 1656 bp, Myxococcus xanthus
atgacgctgagagccatgaccgacgtgggcgccgagctgggcctgtctcccgaagacgtgctgccgtggggaacccaccgcgccaaggtgtcgctggacgcgctcggcaagcggggcggccggcagggacgcctggtgctcgtgtccgccatcaaccccacgccgccgggcgaagggaagaccaccatgtccgtggcgctggccatgggcttgcgcaagcgagggcgccgcgcggtggcggccctgcgcgagccgtcactgggccctgtcttcggcgtgaagggcggcggcaccggcggcgggcaggccagcctggagcccgcggccgacatcaacctgcacttcaccggtgacttgcacgccatcaccagcgccaacaacctgctgtccgcgctggtggacaacgccgtcttctacggccagccggtggccctggatgccacgcgcgtgcgctggcggcgcgcgctggacatgaatgaccgcttcctgcgcaacgtcatcgtcggcctgggcggcaaggcgcagggcgtgccacgcgaggaccacttcgacatcaccgccgccagcgaggtcatggccatcctcgcgctcgcggagggcctgaaggacctggaggcgcggctgggacgcgtcatcatcggccacacccgggacggccagccggtgcgcgcgcgcgacgtggacgcggcggcgtccatggtggcgctgctcaaggacgcgctgatgcccaacctcgcccagacacgcgagggcggccccgcgctggtgcacgcgggccccttcgccaacatcgcgcacgggtgcagctccgtgatgggcacgcgcatggggctggcctacgcggatgaagtcatcacggaggcgggcttcggcttcgacctgggcgcggagaagttcctggacatcaagtgccgcggcagcgggctgtggccccggggcgtggtgctggtggtgacgctgcgcgcgctgaagcaccacgggggcgcctcccccgcgcgcgtggccgagccggaccgcgaggccctggttcgcggcttcgcccacctggagaagcacctggagtcggtggccgccttcggcctgccggccgtgctgtgcgtcaaccgcttcccgcaggacaccgagtccgagctggaagagctgcgcgccttcggcaaggcccgcggcgtggagacggccgtgtgtgacggcttctcgcgagggggtgacggctcgctggagctggccgactgcgtgctggagatgctggacggtacggacgccgcgccgccccagccgcgcttcctctacgacgtggcgcagacacccgaggagaaggtggccgccatcgcgcgcaccgtctacggcgcggacgacgtggccttcaccgcgagcgcgaagaaggacctggacgccatccgcgagctgggcggcgccggactgcccgtgtgcatggcgaagacgcacctgtcgctgtcggatgaccccacgaagctggggcggccgcgcggcttcacgctcaccgtgcgcgaggtgcggctgtccgcgggcgcgggcttcatggtggcgctcactggagaaatcctcaccatgcccggcctgccacgcgagcctgccgcccgccgcgtcaccgtccacgacgacgggcgcgtcaccgggctgatgcagggggagtga

SEQ ID NO: 4535 - DNA, 1188 bp, Myxococcus xanthus
atgattgttggagatacgctgtcccgctattccgcccgccgctcgcagctcctgtcgggcacggcttctcccggtgaagtgctcgaggcggcgggtgacctgctgcgccgccgctcccggttggagaccgaaggtgtggacgccgccctgcggggcctgggtcgatctcaggtggaagcctggttgaaagcgcagaagccccagtcgctgcagccggtgctgctgagggcggcggaagaagctgtcgaggtggcgctcgacggcggtgaagaggcggacatgtggcgggtctccgcgctggagggactttccgctcgcgaccgggccgcctccgccgcacacgccctggccgtctgggagggctttcacggtgccctcgacggcgagtccgcgcagcttcgagaccgctttctcgccgcgctccagagtctggactcagcactccgtccccgagcgcgttggttcatcccactcaatccgcagcgccggcaggagcgcgacctcatcgagcccgccgagcaggacgccgcctggtggttctccgcgcgcgccggctgcgatgacctggtcgccacctggacggccaatccccagacgctgacggcccatcttcaggactgcgacgcgtgccgcgcggacatggcggacgccgcgcccgtggacatgcccccccgccggcacctcaccgcggacgacctctggcgcctcgacatggggctgctgtccgaggacgagcggacccggctggatgcgcacaccgcgcgctgtggcgagtgtgcccaggccgtgctggcgctggacgagggcgaggcggccatcgaggaagcgctggacatggaggaggacgggacggtggcccgctccgcgcgcacctcgcgcgcgcctgtctcccaccgcgctcacgccgcccgcctgccggagcagcgcgaggtgctggatgagcgccgcgactttcgcgtggtgctggtgcgcgagcgtcagcgcgtgcgcctgctggtgcagcccctgtctggccggacggtgacggcggcggtgttcctgagccccggccgtccctcgctcaagccggcccatgggccggagggcatcgcctttgatttgacgtccgcgtcgtccaccggcgcgcgctctgcccacctgtccgtgcaggcggggagcgaaaccctggagcgcgacttcgccttctga

SEQ ID NO: 4536 - DNA, 2352 bp, Myxococcus xanthus
atgtctcccgcgaacccacacgaatccgccctcctcgaagacctcaatgcgccgcagcgcgaggccgtgttgcatggtgacggccccctgctcgtcctgtcaggggcgggcagcggcaagacgcgcgtcatcacccggcgcgtggcgtatctggtgaaggtccacaacgtctacccgtggcgcatcctggccgtcaccttcaccaacaaggcggcgcgggagatgcgcgagcgcctggtgcagttgctgggggcccaggcgaacgagctggtggtgagcaccttccactcggcggcggcgcagattctccgccgagaggcggagcacgtggggctcacccgctccttcgtcatctacgacgactcggaccagctcaacgtggtgaagcgcgccatgcgcgaggcgggcatcgagtccatgcagccgcgcgaaatcctccaccgcatcgaccaggagaagaacgcggcccggctcccggagcacatgcaggtcgcgcccggcgacgagcggggccaactggtgcgcaaggtgtacgcggcctaccaggagcggctgcgcgcggccaacgcggtggacttcggagacctgctgctcctgctggtgacgctgttccgcacccggccggacgtgctggagaactatcggcgccgcttccaccacgtgctggtggatgagttccaggacaccaacccggtgcagtacgcgctgctgaagcaactggcgccgcccccttccgccaacctggtggtggtgggcgacgacgaccagtccatctaccggtggcgtggcgcggacgtggacaacatcctcggctttccgcggcagtaccccggcgcgaaggtggtcaagctggagcagaactaccgctccgaccagaacatcctggacgcggcgcatgaggtcatccggaagaacacgcggcgcatggagaagaagctctggtccgagcgccagcggggccagacgctcaacctgatgctcaaccgcgatgagcgggccgaggggcaggaggtggcgcggcagattctggcgctgcagcgggagggcttcatcaagctctccagcatggcggtgttctaccgggccaatgcgcagagccgcgtgttggaagaggcgctgcgtctggcgcgcgtcccgtacaccctggtgagcggacgcagcttctatgaccgggcggaagtgcgggatgcctccgcgtatctgcggctgatggtgaacccgcgctcggacgcggacctgctgcgcatcatcaacatcccggcgcgtggcattggcgacaccacggtggagcgggtgacggacttcgccaacgcgcgcggcgtgagcctctacgaggtcttgtcccagccggagcagattcccgcgctcaatggtgccgcggtgaagcggctcaagggcttccgcaacctgctggagtccctgacggccttcgcccagacgaacgaggaagccgcgggcgcggtggaccagatgcttcgcgagacgaagctggtggagacgcttcaggccgagggcagcgacgagtctcagacgcgcgcggagaacctccgcgagttcctgggcgcggcgcaggagttcgacctgaaccgggcggccgcggcggtggcggccgcggcgaatccccccagcgacgttcctcccgaagtggacgcggccccgctgacggcggacgtgccggcgctgcaggccttcctggagcagatttcgctggtgggcgaggcggacgcggaggtgggcgacggccgggtggcgctgatgacgctgcacgcggccaagggcctggagttcgacgccgtcttcctcaccggcatggaggagaacgtcttcccgcactcgcgcgcggtgaagtccgagtccacgttcctgaacgaggtcgcctcggcggatggggagccctcggaggagatggccgaggagcggcgcctctgctacgtgggtttcacgcgcgcgcgaaagcggctcttcgtgagtctggcccagtgtcgctcgctgttcggtgagctgcgctacaacgcgcccagccgcttcctgcgggatgtgccgccggcgctgttcggcatcagcgagcaggaagtccccgaagcgcctcggcccatggtgccctccacgcagcgcaggcggacctgggacgaggatgacgggccgcgcatcgaccgctcgtactcgcaggcgtcgtcggacatggacggcgtgggcggggacgtgcgcggcatgcgcgtgcgccacgagcagttcggcgtgggccgcgtggtgtccgcggacggcaacggccccaacgcgaaggtgacggtggagttcggtggaggcgtgggcctcaaacgcatcatcgcccgtttcctgataccgggctga

SEQ ID NO: 4537 - DNA, 354 bp, Myxococcus xanthus
atggacctgcgctccgtggaggccgggcccccggcgctggcccgctttgacgggggattggagctgcgctcggtgcgcggcgcggcgcccgccctggatgcaggcccggaggccgtgctggcggcggcggggttgaaggcgcccggaaagttgcttcaggacacggagggtacgctcccggcggggcccgtggcgcgctacgaattctcacagacgggcggcgcgcgcacgctggtgtacttcgtgcccaggaaggacggcttcgtcctggttaccttctccgcgcccgagcgtgactacggcacgctgtccgcccgcgtggagcgctcactgtcgacactgcgaatgtggtga

SEQ ID NO: 4538 - DNA, 1161 bp, Myxococcus xanthus
atgcctaccattcgtgatgacgagattcccagcgccaccggcattccttcgtccgcccgtcggacggacttcgtgccgccgcccaccctggcggtgacggaagagctgttgcgcgcactgcccaagacggacctccactgccacctggacgggtccatgcgcctgaagaccatcctggagctggccgagcagcagaaaatcaagctgctcgccgacaccgaggatgggctggccaaggccatccacatgggcgaggtgtgcgagagcctggaggagtacctcgtcgccttcgacgtgacgctctccgtgctccagacggccgagtccctctaccgcgccgcctacgagctggccgtggacgccgccgcggagaacgtgcgctggctggaggttcgctattcgcccgcgctgcacctgcagaagggcctgaagatgactacggtcatcgactccgtgctggagggcctgcgcgccgcgaagcgggagacgggcatcaagtgcggcgtcatcgtctgcggcatccgccacatcaacccgcagacgtccatgcggctggcggagctggcggtggcctacaagaaccgcggcgtcatcggcttcgacctggccggcgcggaggcgagcttcccggcgaaggaccaccgggacgccttccagctcatcctcaagaacaacgtcaactgcaccgcgcacgcgggcgaggcctacggccccgagtccatctcccaggccatccacaacctgggcgcgcaccgcatcggccacggcacgcggctgcgcgaggacggggacctgctcaactacgtcaacgaccaccgcatcccgctggaggtgtgccccacctccaacgtgcagacgggcgccgtgacgagcctggcggcgcacccgctgaagttctacttcgactacggcctgcgggtgaccatcaacacggacaaccgcctcatcaccgacaccacggtaaccaaggagctgtggacggcgcactccgcgctgggcctgtcgctggaggacctgaccaccatcctcgtctccggcttcaagagcgccttcctcccgttccgggagaagcaggacatgctgcgggcggtgaacgaggagatcgcccagacgctggcggccttcgaccagaagcggcacctggtgaagcagcccgcttga

SEQ ID NO: 4539 - DNA, 780 bp, Myxococcus xanthus
gtggacctggaactgggtggcaaggtggtactggtgacgggtggctcggaggggctgggcgccgcggtggcccggcggctcgtccgggagggcgcgaaggtggcgctctgtgcccgtggggcggagcggctggaagccaccgccgcggccctgcgcgccgagggtggggacgtgctcaccgtccaggccgacgtgtcgcgtgcgtgggaggtggagcacttcgtggatgccgcccacgcgcgcttcgggcgcatcgacgggctggtgaacaacgcgggcaccgcggcgggccggcccttcgcctcggtgagtgacgcggagtgggaggccgacctccagctcaaggtcttcgcggcgattcgtgcctcgcggcaggcgctgcccttcctgaaggagtcggggagcggcgccatcgtcaacgtgctggccatcgcggcgaagacgcccggcgcaaactccacgccgtcgtcggtgtctcgcgcggcggggctcgccttgacgaaggcgctgtccaaggagttgggcccgcacgccatccgggtgaacgcggtgctggtgggcatcatcgaaagtggccagtgggcgcgccgtgccaaggaggtgggtaagcccatggagtccttcctgcaggagatggcgcgtcacgccgggattccgctgggccgggtggggaaggcggaggagttcgccgataccgtggccttcctgctgtcgccccgtggtggctacatcagcggcgcggccatcaatgtggatggcggcctgtccgcggccgtctga

SEQ ID NO: 4540 - DNA, 1425 bp, Myxococcus xanthus
atgcagccgaaactgaaccggcttctccgggcgctcgcccgcgaggggctcgaggtcgcctatgacggccgcctctattccgtccgcctcctgggtgacgctcacgcgccgcccgccgaagtccttctcccgccggacctgcccgtggagggcaaggccttccaacaactcgcccagctcgcggccctgaggcaccccggtggtggcgaggtgctgcgggtacgtgccacgcccgacttccacccgggagactccggggtggccattggctcggtgctccacacgcgcgggctggtggtgcccggcgccattggcaccgacatcaactgcggcatgcggctgcacgtcgcggacatctccgtggaggactttctggcgaagcggtcggccttcgtcgagcggatgaagggccactacttcttcggtacgcgtgacgtcaccatggcctcacgggcctccgaggcgctgctgcgcgacggcgtgcagggctggctcctggagacgctggagcagccgctggggtgcgcgggacgggccgacctggcccagctcgacgcggaggtgtcgcgcatccacctgggcggcgggctgaagggccatccgcgctgggcgcccgagtccttcacgcgcgaagggctggtgcgcgacgcgggcctggccaccattggcggcggcaaccacttcgtggaggtgcagcgcgtggaggctgtggaggaccgggcgcgggcgtgggactggggcgtgcgcgagggacagctcgcgttcatgattcactctggcagccgggacgtgggcaagcacgtgggcgtggcctggcaggaccgtgcgcgccaggcgtggcccgcgggaacgccgcttccggccagcggcatcctccccctgggggatgcgcggctcgtcaccgaatacctggaggcggaggcgacggcggccaactacgccttcctcaaccgcctgctgctggcggaactgctgcgccagacgctcagggagctcttcggggacgtggaggcgccgctcgtctacgacgtgccccacaacctgacgctgccctacgagggcggctggctggcgcgcaagggcgcatgcccggcgggggcggagcaacccgtcatcatccccggctccatgggggccacgtccttcctcatggtggggtgtggggatgcgcgggcgctggagtccgcgtcgcacggcgcgggccgcgcgcgctcccgcttctccctgtcgcggggcggcgcggaccagagcgaggccgccctggggctgaccggcgtggactgcatcacccttcgcgcggagcgtcgcgtcgaggaggcgcccgcagcatacaagcccatccgtccggtggtggatgcccaggtggaggccggcatcgtccgggaggtcgcccggctctcccccctgctcaccttcaaggcctga

SEQ ID NO: 4541 - DNA, 234 bp, Myxococcus xanthus
atgacgaccacgggcggcaagctgatgttcgcgctgcccacgcaggtgctcaatggcctcgtcttcttcggcgcgctgaagatgaagaacctgcagaactacgggctggcgatgaccgctgccatcatctccgtcatcccctgctgcggcccctgcgcctgtctgggcatccccgtgggcatctgggccctggtggtgctgaacaagcccgaggtgaaggcggccttcacctag

SEQ ID NO: 4542 - DNA, 1077 bp, Myxococcus xanthus
atgttgctgatgggggcgtgcgcatcgcggcaggtgccctgcaaggaccgcacggccagcaggcccacgatgggccagaagcagaccggcaagttcatcactgtccgaaagaagattccgggtgaatacattgtcgtcctgaagtcgcccgcacaaagcctggaacaggtcgaggtccagcaagccacgacgagcctcatcacggcttacggtggcaccgcattcgcgatgtatgagaatgcgttgcgtggtttcgcggccaagatgacggaagcccaggcgcgggccatggcgaacgaccccgcagtggactacgtgcaagagaatggcgtggtcaaaatcgccgaaagccagcagggtcccacgtggggcatcgaccggatggaccagcgcaagctcccgctggacaaggtctacaccttcaccgcgacgggccagggcgtgcacatctacatcctggacaccggtgtgcgcttctcgcaccgggagttcggtggccgggcctccatcggctacgacgccattggcgacagcatgcggggcaatgactgcaacggccacgggacacacgtcgcgggcacggcggcgggcgcctcctacggcctcgcccgcaacgcgattgtccattccgtccgcgtgctgggctgtgacggctccggagccacctctggcgtcatcgagggcatcgactgggtgacccggaatcacatctcgcccgccgtcgcgaacatgagtctgggcagcgacgaggacccggcgctcgacgacgcggtccgccgctccatcgccgcgggggtcacctacgtcgtcgccgcgggcaacgaagacaacgacgcctgcaagcactcccccgcccgtgcgccagaggccatcaccgttgccgccaccgacaacaaggacaagcgcgccaccttctccaactggggggactgcgtggacgtcttcgcgccggggaacaagatcaagtcctcctggcactacggcgaccgcgagagccgggagatgagcggcacgtccatggccacccctcacgtgacgggactggccgcgctgttcctcgaggtgaatcccacggcg

SEQ ID NO: 4543 - DNA, 771 bp, Myxococcus xanthus
atgcgcggtgggacggacgtcgtcctgggccacgccctgccacggagcatcctctaccggggctatgtgctgctgatgctcgcgggcatcgaacgcgcgggcatgcaggacgctgcgtccacggcgctcttcgatgccctggccagccaggtcgtgaaggcgctcgaacaccagttgctgctgcccagcttcagtacctccatctggccgtgtgacagtgcgccggccgccgcggcgctgctgctccatggccggctgcgaggccatgcgccctccgaggccgcggcagagcggctcatcgcgagactggtggaactgtccgccctgccctccggctttcccacccgggtcgacgcgaagggacgcgtcgtggagcgtacgcaacgggccaccacgctcgcgtggacgggcgccttcctcgccatggccgcgcaccccgctgcgggaaccttcaccgccaccctggtgcgggattactgcgctcggcccgcgggctcgctcctacctttggcggcctgccgggagtggcctcgcggagtgaacgggaaggaggactccgccagcggtccgctcgtctttggcggctactccgtgggcgcgagcgcgctggccatcgccgcgacgcgactctccgacgcgcatggcacgtggcatgcccacctggtgaacgcagcacgagagatgggcatcaacgacatcctgtcacgccccgggaaacgtccactggaagcagtcttgtacgaatggggaaccaccattcgtccttggtag

SEQ ID NO: 4544 - DNA, 390 bp, Myxococcus xanthus
atgcctgaggagacggccatgtccacacgagaggtctgcctgctcatcggccacggcggcgaagtgctgtggtgcgacgcgtccgacagcccgaatcaactgcccgactcacgcgcccgctgggaagccatctggcggctgcgtgacgtccttgaagaggtggcgcacagtcaccccgacggtccactcggcttctccgccgaggatgaaagcaccacggccgcgctcacctccgcgctcgggaagcccctgcgcttctccgtcgtggcgcccgagggcatggtggcgcggctgcgaggccgagacgtcctggtggcggccgagccctggtgggcggaggcgcttcgcagcgcctctggcatccgccatacccccagcggcctcgcttga

SEQ ID NO: 4545 - DNA, 1350 bp, Myxococcus xanthus
gagcgccccatgcgggtgctggtggtggacgacgagcggaacatccgccacaccctgcgcgtgtgcctggagggcttcggctgtgaggtccgcgaggcggccacccccgaggccgcgctggccgcgctggcgcaaggccccgccgacctggccttcgtcgacctgcggctcggcacggccagcggaatggagctgttgccgcgcctcctggccgagtcgccccacctggacgtcgtgctcatcaccgcctacgccacgttcgacacggcggtggaggcgatgcgacgcggggcacgggactatctgcccaagcccttcacgcccgcgcagattcgccacgcggtggagaaggcgcggcggcaccaggagctggcatcgcagttggagaacctggaggggcagctttcccaggcggtgccggaggccacgttggagacagcctcgcccgcgatgcacgcggccatcgggctgttgacgcgcgcggcggcgtccgacgcggcggtgctgctgcggggagagagtggcaccggcaagggggtgctcgcccgcgcgctgcattcgatgagtgctcggcggcgccggcctttcgtcaccgtcaactgtcccacgctgtccgagcaactgctggccagcgagctgttcggccacgtgcgcggcgcgttcaccggcgcggtgaaggaccagccaggacgcgtggaggcggcggaagggggcacgctgttcctggatgaaatcgcggagatgagtccggggctccaggcgcaactgctgcgcttcctccaggagaagcagttcgaacggctgggcgagggacgcacgcgcaaggcggacgtgcgggtggtggcggcgacgaatcgggacctggagaaggacgtggccgaggggcgcttccgggaggacctgctctaccggctgaacgtcatcgaggtgaagctgccgtcgctgcgagagcggccggaggacctgctttcgctggcccggcgcttcgtctccttcttcgctcgcgcggcgcagcgcccaccgccggagctgtcgcccgcgacggagaagatgctgttggcctatgggtggccgggcaacgtgcgcgagctgcggaatgcaatggagcgagcgctcatcgtctggcccgcggaggtgctggagccgcaggcgttccccgaccgcatcgccgcggcggggagtccggtgatgaccctgggcgggccgcacacgttggaggacatcgagcgcgagcacgtgctgcgcgtcatggcctcggcgcccacgttggatgaggcagcgcgggtgctgggcatcgacgcgtccacgctgtggcggaagcggaagaagtacgagtcgggcgagggctga

SEQ ID NO: 4546 - DNA, 261 bp, Myxococcus xanthus
atgcagcgcgcacagcaggcgctggtgaacgcgggcgctcgtccgctggacctgcggcggctcgcgggccagcgattggaggtgacgtatgccttcatgggggagcgcttcgtctccatcgtcgcggcggactcgctccaggtcctggacgcgggcatctgcctggccggtgcggacggagatgtcacgctggagagcctgccgtccgtcattcgcgaggccattgaaacggatgtcctggtggtgacccggcatgcctga

SEQ ID NO: 4547 - DNA, 1770 bp, Myxococcus xanthus
atgacgacccagacgcagaacccgaacgcgctgctgcccgagtcgcagcgcggtcccgccgagcgcctgctggacctggtgctcggaggctccgcccacctgtggcacaaccggcctggcctggatgtgaatggcacctggtacgcggcggcgcacgccacgccgttccagcgtgacaaggggcgtccggtgaagccgggcctcttcgtgcccgccgcggtgaagctctaccggcagctcctggacatctaccggctcaacgcggagctgatggcgcacttcgcgtcatacgcgctgacccagacggactggcgcgacctcaaggtcgcgacgtgcgcgctcatgctggtgcaggagcacgcgggccagcccgtgcgcgacgaacagggcggcgtggccttccacgacgacgactggcgagccattggcgaggcgatggtgctccactacgagcgcaagtcgacgcgcatgctcacgcccaaggcggtgctgcgcgtggcggagctgctggagcatccggagatcgctcgactcaaccgcgaggcgggctttggtgacccggcgtcccgaaaggcgccgctgggccgctggaagcgcgtggcgtcgaagtggctggcggcgcgtgaggccaacatgcccatgctccagggcctggtgaaggcgggctacaaggagacgctgaagaagctggcgcgcaaggcaggctacaagccgcgcgcgcagggcttcttcgaggtgctcggctggaagcagaagcagtccgcgcagggccaccgcgaggtgggcctgaatgggctgacgctggtcaagcgcgagcgcttcgacggcctgtctgaggcggaaatctgcgagtggatcgacctggagcgcctctcctacaaggaggtcgtgggccggctgccgaaggacgtgggtctcacgccggccatcatggcggcgctgctgccctcgctgtcggaccgtgacctgcggctgatgacgcccacgctcgaggaactgggcctgctgacggacccggccatccgcgcgcgttgggagaaggcggtgcacacggccacggaccagcgggcgctgaacatcgcgaagaacgtccgcagcgcggtgctgcggcgcaagttggaggaggccagcgacaacgcggcacggcaggccgtggcggaggcgacggcggagaccgacgtgcgggtgatgttcctcatcgacaagtcgggctccatggagggggccatcgagagttcgaaggaggcgctgtcgcgcatcctcgcgggcttcccgatggacaagctgcacatcgccgcgttcgacaccctgggaacggtgctgcgtcccaaggccgccaaccgcatcgccgtccagcacatgctggcggggctgcgggcgtcgggaggaacggcgcacgcgtccgcgctgtacgcgttgcatcgtgacggcgttcgcgtgccggaggacgcgaagctggtggtcatcgtggtgggagacgaggccggagaggcaggcgaccagttcgcccgggcattccgtgacctccgcatcccggtgtcggcgatggccctgctggtgtcggtggcacatgcgcggggctcgacggttcgaagctgcgccgcgcagttgcgagtgcccttcagcgaggtgaacgtggaccagttcgaggacccgtaccaggtcacccgggtgctcaaggcgctgatggatgcgcccacgctgcctggaaccgcccagtccggctgggtggagcgggtgatgcgcacgccgctgctgaaggtggcgtga

SEQ ID NO: 4548 - DNA, 708 bp, Myxococcus xanthus
atgtcccgccgcaccatcgtcatcggagaccttcacggctgctacgacgaagccgtggagctgctcggcaaggtgggcgcgacctccagcgaccggatcatcttcgcgggtgacctggtggaccggggcccgaagcgccgcgagtgcgtggagttggccatgcggcacgaggccatcctcggcaaccacgaggagaagcacctccagcagcgccaccgggcggacgagcggttgcatcccgaccacctcgagactcgccgggtgctccaacccgggcactacgactggatggcccggctgccacgctacctgcggctgccggagcacaacgccatcgtggtgcacgccggcatgctgccggacatccctgtcgagaaacaggacccgtaccacctgctccatgcccagtgcatccggcctccggcgtccaagagctactggccgtccaaggcacctcatggctggaccttctggacgcaccactggaagggcccggaccgggtcatcttcggtcacaccgtcttcgacgcgccgctcgtcaccgagcacgcggtgggtatcgacaccgggtgcgtctatggacggtcgctgacggcggtggtgctccccacctgggagctcgtctcggtgccggcccggagtacgtaccggggcggcaaggacgtggcccggattccggtccacggcgacgtgtccgtcttctcgtaa

SEQ ID NO: 4549 - DNA, 1173 bp, Myxococcus xanthus
atggacttccggaagaaactcgccgccctgctgctcgcgctggcctccaccggggccggtgcgcagccgtcggaaggcgcccagaagctgccagtcggctggtatgtgacggagagcgcccccaagcgctacgaggccggcgtggacagcagcgccacgtgcgaaggcaaccgcagcgcctacctccgctcgctgtcgccggatgagaatggctacggcaccttcatgcaggccttcggcgcgcatgacttccggggcaagcggctgcgcttctccggcgcgctccgcatcaaggacgtggagggctgggcaggcctgtggatgcgcgtggaagggcccgacccgaagcagcccctggccttcgacaacatgcagtcacgcgccctggtgggcaccgcgggctgcaagcgctacgacgtggtgctggacgtcccgaaggaagccaccaccatcatggctggcctcatcatgagcggtacgggacaggcctggctggacggcgtgcgcttcgaggtcgtcgacacgtccgtgccggtgacggacctgctggcctcgcggccggtggtggccgccgccggtccgtcaggactggaggacgaacccgcgccggtggcgaagaacgaccaactgccactgggccgcgtgggtgacgtctggttcaaccacggccgcatcgccgcggacaagccgtacacccggcgcaaggacggcgtctgggtaagcatcctcggcgaggaggtctacgagcacggcatcgcggtgacgggcacgctgggacagcgcgcgctcgagctgaagctgaaggctggtggacggcgcaccctcatcgaggggacgtggggtggggagcccgtcaacatccagctcacgccagagaagctcaccatgcgctggggccgcaccatgcgtgagatggcgcgacacctggacccgcaggtgggcaccacgtgcaaccgctaccagcgcaccgaaggcccccgggtgctggaccaattggatgtctgcggcgcggcgctcggcacccgcccacccaacgcgcagctcatcatcgccctcctggtgaatggcttcagccccacgttgcctgcggggagcattcccattccgcggccccccgtgcgcagccgtcaagcgctcgacacggagcggaccgcgctccccccgtcgccctga

SEQ ID NO: 4550 - DNA, 648 bp, Myxococcus xanthus
atgagtgcagccgtgcagggcctgcggatgacgacgctgcgattgtcaaaggaagccgacgagccagccgaggcgacggcgcccggggaggatgaagccctcctcgcgcggcgcgccctgacgggtgagagggcggcctgggacgcgctggtcgcacgccatcaccggcgggtcgtggtatcgctgctcgcacgtggcgtccgggtggaccgggcgcaagagctggcccaggagacctgggcgcggctcatccagcaacagcagcgcgggctgctgacggagcttcgcctgcccaacctcgccctcacccaggcggccttcctggccgcggacgacgcacgacgggcccgtcgcgagtccattgccggggcggtggatgaactgccggagcgtcaccacccggtggacccgtccgtgtccgcggagcggcgcctgctgaccgaggagcaactctcccgcgcacatgctgcgctggcgcaggtgtctcccagcgcacgaaacgtcttcctcctggcctgtgacggccaggagctccctcatgccgcaatcgcctcacgcgttggcctgtcggtccagcgcgtgcggcaaatcctgtgcgaggtccgcaagaagctgcgcaccgcgctcgaggaggaaacccatgcttaa

SEQ ID NO: 4551 - DNA, 192 bp, Myxococcus xanthus
atgagcttcgagcgcgccgtcaccggcgacagtctgcgcgtggagtccgaaatcgacagccagacggtgtccctcctcttcgccaccgcctgggtgtacgacggtgaaggccgtgtgtgcggccgctgccagggcgtggtgaagctctccaacctccgctgggcgtcgggagacagtcccgcagtcaactga

SEQ ID NO: 4552 - DNA, 879 bp, Myxococcus xanthus
tggcgggtctccctggacagggaggtggccacacgcccggcccttctgggagacagtgtcatcgccgggacggtgggcggagacctggtccggctgaacctcgcggatggcgcggtgcaatggcgcctcaccggagagccccctgtccttaccgcacccgtggcggatgcggaggggaaattcgtcttcctggtcgcgccggatgggtccgtccgctccctctacacggacacggggaagacggactgggagcgccccccacccggaaagcccgagccgacggctgcgccccgtggatttcccatgccggtcctccaggacggcctgctcgtggtggcgctgggtgacgcggggctgatggccctggccacccaggatggggcgaagcgctggcagcgggacctccgggacgtgctggggatgacgttgtggcgggacacgctctacgtgagcacccgccagggtcacgtcctggcgctgcggctcggggacggcacgtccctgtgggagcaggcccccgcggaggccctgagcagtcccccctcgctggcgctgggaacggtgtgggtcggcacggctggagaggtctccgcgctcgtcggcctgtccccttcgaacggaaaggaggtggcgcgcatcacgctgcccgacccgctcatctcggaggtgacgccggtgagagaggacctgctgctggtgcccaccagcgggcgtcagggacggctcatcgcgttgaacacgacgacctgggcgcaggccttctcggtccgcgcggatacgccgctgcgcacccgccccgtggtactcggcgaccaggtcatcgtcctgggactggatggccgcgtgctgtcgtggcggctgcgcaagaccgacccttga

SEQ ID NO: 4553 - DNA, 522 bp, Myxococcus xanthus
atgggcgcggaaggactcctgctgaggcccgcgaaggagtccgaccgccgcaccctgtggcgcatccacacccgggccgtggaagccctgtgccttcgcgcgtacgcgccgcacgaggtgagcacctgggtgcggctcttgaaaccggagggctacctgcggccggagcgtccgcgcacggtgctggtggcggaacgcggccggcgcgcggtgggcttcggccaggtggacgcggcgctaggtgagctggaagcgctctacgtggtgccagacgaggcgggccatggcgtgggccccgcattgctgtcggccctggagtccgccgtctggcggggcagcgcgccgctgatggggctggatgccagcctgaacgccgaacacttctatcagcggcacggctatgcctccgtccacgcctcccggcgcccactcacggtcgacgtccagttggcgtgcgtgcggatgcagaagcagcggccggccacggccatggggcggtggccggcctggcgccgcggctag

SEQ ID NO: 4554 - DNA, 561 bp, Myxococcus xanthus
aagtccatcatcagcgagctgtacaagcgcgcgccggtgtacgtgtacgacttcgcccagaacgaggtccccggccaggaggccaaggagcgcggctactggcgggacgtggggaacatcgacgtctactaccagtccaacatggacctggtggaggtggacccgacgttcaacctctacaacgaccgctggcccatccacacccagcccaacaactacccgccggcgaagttcgtcttcgcggacgagcagaaccaccgcgtgggccacgccatggacacgctggtggcggagggctgcatcatctccggcggcagcgtgcggcgctcggtgctgtcgccgaaggtgcgcgtcaactcgtactcggaggtagaggactccctcctgttcgagaacgtcaccatcggccggcgctgccgcatccgccgggccatcatcgacaagaacgtggagattccgccggggatgaccatcggattcgacccggtggaggaccggcggcgcttccacgtcacgcccgggggcgtcgtggtgattcccaagggcatgaaggtgacctga

SEQ ID NO: 4555 - DNA, 2337 bp, Myxococcus xanthus
atgaccgccgccgtcgtcgtgattgcccagttggtggtggtgtccaggcgcgtgcgccaggtatcggagcggctcagctccccccggaacagttgggccatggcctgctgggagagccagggcgactccagcacatcggtcctgtcacgttcacgcacgggcatccttcgccggaaggtgggctgggcagtgggcgtttgcaacgcaggcggggtgggggtggcaggcgggcgggcgagcgcacgggtggccatggcgggcgcgcgtgtgcagcttgctgacttgaacgtgcccgacgtgaatcccatacaggccctgtcccacctcctccaggaggagcgcgagcgcctggcgcgcctgtgggccaagcgcctgcgcgcggagacatatgacgtggaggtccccgggagggacctgcgcgctccgctgcgccggttgctggacgagctggcccgcctgctcaaggaccggcccgacgacgtcgtccggctctggccggaggtggtccgcccgcacggcgccttccgctacacccagaacttcgaccccgaggacctgacgcgtgagttcaagtccctggaagaggtgattctccacgtctacgcgcgccgcaacggtggcttcatcgagtcccaggtggcggagctcgtggcggagctggtgtgggaggcggacgccgcggcccaggcgtcctatgcgcgcatcctgaagacggaggaggtgcgctttcgtgaagcggcggtgatggagtcggtgctcaaccaggtggacgtgggcatcatgctggcggaggtggacggcaccgtctccttcgctacgccgccggtgagccgcctcatgggggtgcccatgcgcgcggtggtgggggggcgggcggcgaacaccatcaatcccgtgctgacgcaggtgaacgcgcgccacctcacgggcgagcccttcaagctggccgacatgcccttcctgcgggcactcaaggagaaggggcccgtgcgtggggtgatgatggtggtggagcgccccggcggcgacaccgcgacgctggagctgagcgccacgcccgtctgggaagaggagggcgagctggccggcgccatccagaccttcaccgaccgcacggaagcggtgaacaagacgaaggcactccagagcgcgcacggggaactgcgcagactccagggccgcctgctccagcgcacccgccagcaggcgctgggacagctcgccagtggcgcggcgcatgcgctcaacaacttcctcaacgtgctgcggctgcgaatcaccctgctgcaacgcgagttcaagcccgagcacctggaggcgctcgacaagacggtgcagcagattggcgagttggtggcccggctccaggagttcaacatccagcgtacccaggagcagcccaccgacgtcccggtggaccagacggtgcgggaggcgctggagctggcgcgcggcgagctggagcagcgcgagcacccggtgtacgtggacctggacctgggcgatgtcggcaacgtgcgcgcggatacgggcttcttccgcgaactggtggtgaacctgctgctcgtctcgcgcgaccggatggaggccggaggccggctgcacgtctccacgcgcgcggaaggctcctcgtggctgacgctgcgcatcgaggacgagggcacgccctacgcgcccgatgagctggcgcggctgttcgacccgctgcgccgggacgcgagcgcgccgcagttgtccctgttcctggcggtggcgcgggcacaggtggagcgctggggcggcgagctgacggcggaggttccggcctcgggtacgggcacggccttcgtggtgcgcctgccccgcgtgcatgaaggcgccgtgtccaccgcgccacgtccggagccgtcgcgcgcggaggtgatgcggccggcggggccccggcgcttccagcagacgcgcagcgtgctggtggtggatgacgacctcgacaacgcgcggatgatggcggaggtgctgggcgaggaaggctacgaggtccaggtggcccacagccccgcggtggcgctggggatgtgggaccggcgccgctacgacgccgcgctgctggacgcggtgatgccggagatgagcggctgggagctggcgcgcgagctgcgcaagaagacccctcaggcgctgctggccatcgtcaccggcatggacgtgcgcggacagaaccgctccaacctcgcgctggtggacgccgtgttccgcaagcccatcgacgtgggcgcgctggatgacttcctggggcagtccgacaccgccgcttccgagaacggtgcgtcgaccacgggttccgcgccacccgcctga

SEQ ID NO: 4556 - DNA, 225 bp, Myxococcus xanthus
atgattcgcgcgcgcaacgacccgcagaagctggtggccctgttcggcgaactggagaaggtggtgaaggaccacgtgacgatggaggagcgcgacgtactgcccaagctcggtcagaaggtcaccgagcaggacctgggcatgtcgtgcaaggacatcgtccgcaccgcctccgaggtccgccgcgaggagatgcagaagctccagggtcaggcgaacgcctga

SEQ ID NO: 4557 - DNA, 2154 bp, Myxococcus xanthus
atgatgctggccggcggcggtgccatggcggaagagagcgcggtctgcgaaggccgtacgtcacaacctcccctgcagcgggatgcccaggggcgcgtgaaggtgggtgaggacgtcgtcgccaccttcaagtcacgtcagcccagcgcgcgtccggagggtgttcgcgccaaggccgagctggcctggacggaccgcgtcagcagcccgggtgccacgtacatcgcgccgcacttcagccagttcgcgctcgcgtcgggggactacgtcatcgtccgcgcgccggacggctcgcgtgagtaccgctacgagggcttcggcaagggcgagggcaacgcgccggtgaggggcggcttctggagtggtcacatctccggtgacgtcgccatcgtcgagttgtggagcacgggcggccaagcgaagtccggctacaccatcgaccggttcgctcgtggcttcgccaacctggcggcgctgggcgaggacctggacaacaaggccctctgcggtccggacgactcgcgcaacgcgcgctgctaccagacatcggacccgcgtcagtacaagcactcgcgcgcggtggcccgtctgctcatcaacggcagcggggcctgcacgggctggctcgtgggcaaccagggccacgtgatgaccaacgagcactgcatcgccaacacctcggacgcgctcaacaccgacttcgagttcatggccgagggcggcgcctgtacctccgcttgcaacagttggttcggctgtccgggcacggtggtggccacgagctccacgctcatcgccgtggacgcgccccgggactacgccctggtgcggctgcccaccaaccccacggccacctacggctacctccaactgcgcaacaccaccgcgttcgtggatgagcgcatctacattccccagcaccccgccgcctggggcaagcacatcgcccgcaactccacgcacgcgtcggacgcctcgggcttcgcggaaatcttcgccctcaaccggcccgcgtgctcgccgggtggcccgctggacatcggctactacgcggacacccagggtggctcgtccggctctcccgtcatcgccaactccgaccaccgcgtcgtcgcgctgcaccactgcgccaactgccccaaccgtggcgtgcccatcacctccatcatctcccacctgggttccctgttgcctcagtgcgcgctgcgcagcgccacctgcccggacccgtatgacgtctggatgcgcgacacctggtccgacaccggcctggagccggaccccgccaccgcgggccaggacatgtgggccagcccgtacatctggattcgccgcaacccggacggcgtcgccaacccgcacgtccaccagaaccccgagttgggcgcgacgaactacgcctacgtgaagctgcacggcgggccccgtccgggcgccacggggcgcctcaagctgtactacgccaacgcctccaccggcctggcctggcccacggactggacgcagttcggtgacgtcgccgtcaacggcttcacacccgacacgcacatcgtccaggcgccgtggagcagcctgcccggcgagggccactactgcctggtggcgcgctgggagtccgcatccgaccccatgtcgttcaccgagacgacggacatcgacaccaacgtgcgtcagaacaacaacatcatctggcgcaacgtgaacatcgtggacctggagtccggcagcgaggaggtccacttcatcgtgcgcaacgtgcacgagggaatccgggcgctgcggctggcggtgcgggtgccggaaacggaccggcagcggcccttcccggggaatggcggccgtgtcgtcgtgcgtctgccggacgagctgttcaagcgctgggtggaggcgggcggcaaggccgagggcatgaagatgctgcgcgagggcgagttcgaggtcgtgtctccggaagggggcgtgttccacgagctgccgctgggcttccgcgaggagcaccagttgcggatgttcttcgagcgctcggcggatgccacgccggagccctaccacctggaggtcgtgcaattcgaccaggacaagcctgagcgtgagagcctgggcggcatcggctacgacatctacacccacggcgagccgaagccgaagcagtag

SEQ ID NO: 4558 - DNA, 702 bp, Myxococcus xanthus
atggcgccggatgggctccagtcgatgctgaccggcaacctgatgctggcgttgcagcaggcggcccgggtccatggcgcggagttggtcatccccgagtccttgcgcggatgcgtccggcctgcgttctctcggggagaggacccggggtggattccgggcaaggaattgctgcgcctgcagtccaatcccgacgtgtaccagatgtacctgttccacgaactggcggccgggcccgcgcccgtggccgaggggccgtcctgggacgaggcgcggcgtggcttcacgaaggcattgcgggaggcagttgccttctcggccgcgcagggctcgaacttcgcggatgcgttcaagctggcgctgttcgcgctcgaagggcaggcgccgcgctacgacgaactgtcaccggagcgggtgccggattacctggaggcggtgaaggccgcgggcttcgacgggcggccggtgcaggtcttcgaggacaggttgggctcgttgggactgttccagtcgctggggatgtccgaggagaagctgcgtggactgctcgcctacctgctgtccgatgtatttggcggcatgggctcgtggaacgaccagtacttcgagacgcccgaggcgcagcagcaatacgatgcggtgtcagcgcggctgttcagcgagcggagtgcgttcttcgtggccacgctcaacgcgcgttga

SEQ ID NO: 4559 - DNA, 243 bp, Myxococcus xanthus
atgtcacgcaagacgatggactgccggaaggcgcccagtgacacccactgcacgctgacgatttcgggcgaggaggacgaggtattccaggcggccatctcgcacgcggtctccgcgcacggccacgaggactccggtgagctgcgcgagatggttcgcggcatgctcgaggacgaggcgcccgaggccagcatgggccagcccatgtcgatgcaggagccgcagcagccgagcaggcactga

SEQ ID NO: 4560 - DNA, 1281 bp, Myxococcus xanthus
atggtcgttagagtcccgccagtgagtgcccccctggacctggagcgcgtccgccgcaaggtggaggcgggtgagattctgagcgacgcggagctggccctgctccgtgccgaggcgcagcgtggcaccggctccgccttgcgcttggccctggcgcacgccctcatcaacgcgggcgctgaacgtgaggcgctgcccctgctggagaccttgcggcgggacttcccacgcgacctgcctgtgcggctgggactggcgcgggccctgctcggactggagcgccacggcgacgcggagcggctgctgaccgaggtcctggcccaatcgccaggagacccggaggtgctcaaggtgctcgcggtgctgggactgcggcgcggtgaagcggacaaggcgcgtgcctatgtcgcggatgcgctggctcgcgaccccttcgacgccgaggcacggctgctgaaggaggaactggagtccgtggacctgccgcctccgtccgttccccaggagcaggtgctgcgcccggagttcaccgccgcgctcaccgccgcgctgggccgcgcacgggtggcgttccgacggcaggggaaggacctgctcgtgaagctcgccacgggcggtgttggacgcgtggacgtgggctcgctgtacgcggcctaccaggagtccccgggcacgcaggggctcactgcctacgcggatgcgctggcggcgcggctcggcgggttgtcttcgggcctgagcgcggaggtcgcggcgttggaagcgcggctgcgcccggtgctgcgcccagcggacttcgcggcgcgcgccgtgggcgccttgcaccggcccggtcccgcgggtctggaagtcttctacgtgctggaggacgcggagttcgtacgctacctgcccgaagccgcactggcccccgcgggactcacgccggagtcggcggacgcggcggcatggcgcaacctcgcctcgcgtctggctccggtgcggcccgtgctcgtcgaccagggggaagtccggctggcggaggccttctccggactctgggccgtggcggagggggacggccatgacgccgcgcggctgctcctgccttcgcagcgcgaggagctggcactgctcgccggagagggccccctgcgcgtggccctcggacggcgtgagctggtgctggtctgccgcgagtcggatgccgccgcgtgcgaggccctggcgcgactcatgccctcgccggatggaatcccgggcaccttccgcctgacggaagagggcctgtccgcggtgtga

SEQ ID NO: 4561 - DNA, 729 bp, Myxococcus xanthus
atgattcgcatcgacaagagcatcctgattacgggcgcgagccggggactggggcttgcgctgatgaatggattggctcgccgaggcgcgcgggtggtgggcgtggcgcgtcatgccgcggagatgggggccgtcgcggaggcgctgcgctgggaggggttggaggcgcacgcgctggcctgcgacgtgggggacaaggaggccatctacccgatggtgggcgcggccaccgcgctggtgggcccgctggacgtgctggtccacaacgcgagcacgctggggcccacaccgctgccgctgctgctggacaccgcctgcgaggacctgcagcgcgtgctggaggtcaacgtggtgggccccttccgcctcaccaaggcggtggccgggaacatgtcggtgcgaggcaaggggctggtcatgcacatcacctcggatgcggcggtgtccgcctatccccgctggggcgcatacggcgtgtccaaggccgcgctggaacacctggggcgcgtctgggccgcggagctggagggcacgggcgtgcgcttcgtctcggtggaccccggggagatggacacgcggatgtaccgtgacgcggtgccggacggggattactcccagttgagccggccggaagcggtggcggcccggctggtggagtgggtggcgtggcagtcggagtcggtgccctcgggcgcccgcctggaggcggcgaagctggaggccgcatga

SEQ ID NO: 4562 - DNA, 1026 bp, Myxococcus xanthus
atgaagcccgcgcgctggcccgcggaccgccccgaggagggacgcctgctgcatgtggagccgcgcgcccgccgctatcgcgacacccgcgtggcggacctcccgtcgctgctgcgcgccggggacctgctggtggtgaacgacgccgccacgctgcccgcgtccctggtggggcgaacggagtccggagaacgaatcgagctgcgcctgttgtcacgcgagccggacggcacctggacaggggtgctcttcggcgcgggggactggcgaaggcgcacggaggaccggccaccgccgccggtgctggccgtgggcgcggggctcgtggtgggaggcctgaaggcgctggtggtggcggtgctgccaccgtctccccggttgctgcgtgtggccttcgacgcgacgggggcggcgctctggtccgggctctaccggagcgggcgtccggtgcagtatgcgtacctggaggcgccgctgtcgctgtggcatgtgcagacggcgtatggcgcgcggccctggtccgtggaggcgccctccgcggggctgcccctcacctggagcgtgctgctgacgctgcgcaagcagggcgtgcggctggcctcgctcacccacgcggcggggctgtcctccacgggagacgcggcgctggacgcggcgttgccttggcccgagcgttccgacattcccgccgccacggtggaggccgtcctgcacacgcgggcctccggggggcgggtggtggcggtgggcaccaccgtggtgcgggccctggagggccgcgcggcgcggcacggcggctggttggtggcgggggaggaggtgacggacctgctgctggggccgggcttcgtccctcggctggtgcacgggctgttcaccggcgtgcacgagccagggagtcgccaccacgcgttgcttcaggccttcgcgccgctgccgctgctccaggaggtggccgcgcacgcggaggcgcgcggctacctggggcacgagttcggagactcgtgcctgctgctggacgcgtga

SEQ ID NO: 4563 - DNA, 1053 bp, Myxococcus xanthus
ggtgcctaccgcgtactcggagagctgggacgtggtggcatggccctggtgtaccgaggcctgcacgagatgttgcagcgcgaagtcgccatcaaggaactgctcccggatggccagcgcgacagggagacgttgtcgcgtttccggcgcgaggcgctcgcgctcgcggccttccgtcaccagaacatcgtgacgctctacgacatggtggagaagggtgagagcctcttcatggtgatggagctggtggacggccccaccctccacacgctcatcaaggaaggcccgctgcccgcggatgtcaccggcgtcatcgccgcgcgcatcgccagcgcgctggaccacgcgcacttccgccacatcatccaccgcgacctcaagcccgccaacgtcatgctcaccaagtccggtgaggtgaagttgatggacttcggcatcgccaaggacgtgggcatggaggcgctcacccagcagggcatggcggtgggaacgccgtcgtacatgtccccggagcaggtgacgggcgtgccggtggatggccgcaccgacatcttctcgctcggcgtgctgctctacgaagccctctccggcgcgcggcccttccacggcaagacggcgggcgaggtcttcgcgaagattcgcgacggcaagtacacgccgctctccaaggtggcgcccaacgtccccgcgccgctggtgcgcatcatccagcgcgccatggaggtgaagccggaggaccgcttccccgacgccgccgccatgcgccgtgaactggacgtcttcctcgcgcaggaggtgcaggtgtcccacgcggcgctgctggtggccttcctgcgccaccgtcagaagctgacggagacggaggcccagcagctcatgcggccgcacgaactggacgccgcggtggaggtgttcgacacggggcgctcccgccagggcgggaagctgcggtgggccctggccgccgccatcgcgttgatgacggcggcgggcaccgggctctacttcacccaggcccagtgggcgccgctggtggagcagctcacccgctga

SEQ ID NO: 4564 - DNA, 1899 bp, Myxococcus xanthus
atgccgcttccctcggacgtcgaagatgcattatcgtgcctgccgctggcgctggttcgcgtcggtccggacctgcgcgtgcagtggtgcgaggaaggattcgcccgcaagacgggcgtggcgctgcacgccggtggcgacatgcgggacgccttggagcgcacccggagtctggacgccctggagcgcgccatccgggacggtgcgtcccataccggccacgtcatcacccgcgcgctgcgtcaggtccgggtgcaggtgaagcccgcctcggcgggcgaggcagcgggcgtctggttggtggtggagccctcgggcgtggacgacgagggggccttctcccaggcggtgcaggagattgcccgttcggtgggggagacgctggaggtggacagcgtctgcgccgccgccgtggtggccctggtccgctgcgcgcacgtgcgccgcgccgaggtctttctctgcgaagaggagggcgggagcctgcgccgggtggcggtgtcggacctggccggctcggagtcccccgaggcgaccttcgactcccagtcggacccgttccggcaggcgctggcgctgcgtcaggcgcagttgggcatccagcggggctatggggattccatgggctccattttcgccgctgtgccgctgtgcgcgccgcgccggacggtgggcctgctgctgctctacaaggaacagggcacgtccttctctgtgcgggagctggacttgtggagcgccgcggcgaaccagttggcggtggctgtggagaacgcgcgcctgctgcgcgaggccaaggcggcgctccaggtgcgcgaggagttcatctccatcgccagccacgagctgaagacgccgctcacgccgctgaagctgggcctcttcaccatggagcggcgcctgtcgtcgggccagccggtggacctggccacggtgctcaagtccaagcggcaggtggatcggctggtggggctggtggatgacctgctggacgcgtcgcgcctggacgcggggaggctggcactggacctggcgccgctggaggtggggcaactggtggcggaggtggtggaccacttccgcgcggccttcgagcggcccttcgccgtggaagtgccccgtgagcgcgtctgggtgcgcggggacagggacaggctggagcaggtgctggtgaacctgctggagaacgcgcacaagtacagcgcgccggaagagcccatcgtcgtgacggtggagcgctcccagggcgaggcgcgcatccacgtccaggaccacggcatcggcatcccgggcgcggaccagtcgcaggtgttccagcgcttctatcgggcgcgcaacgtgtcgcaccgccacttcggcggactggggctgggcctcttcatcagtcactccatcgcccggcttcacggcggcgcgctgtcgatgcgcagcgcggaagggaagggcagcaccttctcgctgagcctgcctcgcatggcgccgcacgacgtgaggcggctgccccaccggctgttgctgctggacgaggaccagacccaggaggccgcggcggagcaggtgctgctctccgagggcttcgaggtgctgacggcgcgcgacggcgccgaggcgctgcggcgagccacgcacctgccggtggacctcatcgtcctgtccaccagcgccacgcagggacagacgagcgtcttcctggagaccttcgccacgctgccgcgcgcgcggccggtgcccatcctgctggctggggatgagcgcccctggtgggcgcatgagggcacgtcgttgtgtacgcgcccctacaggcccgaggacctggtgacccgggtgcgcaacgcgctctccgtggagcggcggtccacggccgaggcgccgctggacctgctcagctcccggacgtga

SEQ ID NO: 4565 - DNA, 1023 bp, Myxococcus xanthus
tgctgtgactccgcacccatggcgaccacacgaactgtcacgatcatcaatggcgatggcattggccccgaagtcatggcggccaccgttcgcgtcctcgaggcgctcaaggtcccccttgatttcgagtacaaggacgcaggcacggaggtggtggccaagtacggcaccaacctgcctcacgagacggtggaggcggtgctgcgcagcggcatcgcgctcaagggccccacgggcacggtggtgggcggtggcctcccgtcggccaacgtgggcctgcgcaagcggctggacctgtactcgtcgctgcggcccgtgaagagcgtaccgaacgtgaagacgcgctacgagggcgtggacctcgtcgtggtgcgtgagaacacggagagtctctacgccggcctggagcacatcatcgtcccgggcgtggtggagtcgctgaagatcatcaccgagaaggcctccacgcggattgcccgcttcgccttcgagtacgcccgcaagcacggccgcaagaaggtcaccgccgtgcacaaggcgaacatcatgaagctgtcggacggtctcttcctggactgctgccgcaaggtgggccgtgagttcccggacgtcacctacgaggaagtcatcatcgacaacctcgccatgcagctcgtgaaggacccgacgcgcttcgacgtgctggtggcggagaacttctacggcgacgtgctcagcgacctgtgcgcgggcctggtcggcggcctgggcgtggtgccgggcgccaacatcggcgagcgcaccgccgtcttcgaggccgtgcacggcaccgccccggacatcgcgggcaagggcatcgcgaaccccaccgccctgatgatgtccgcggtgatgatgctggaccacctggagctgggcgaggcggcgcgccgcatggagaacgccatctggaaggtgtacggctcgggcgaggtccgcaccggtgacctcggtggcaaggccaccacccgcgagttcaccgacgccatcatcggcgcgctgtag

SEQ ID NO: 4566 - DNA, 765 bp, Myxococcus xanthus
gtgcgtgaacgtgacaggaccgatgtgctggagtcgccctggctctcccagcaggccatggcccaactgttccggggggagctgagccgctccgatacctggcgcacgcgcctggacaccaccaccaactgggcaatcacgacgacggcggcggtcatctccttcggcttcgcgtcgacgcagagttcacacgtcaccttcctggtgggcatctggatggtggtgtcgttcctcctcatcgaggcgcggcgctaccgctactacgacttgtggaaccgccgggtgcgcctgctggaggaaggctggtgggcccccatgctccggcacgagccgatggacccggacgccctgcgcgagctggccctggagctggaacggccccaaatccagctttccctcttctccgccatctccacccggctcaaccgcgcctacgggcccatcctgatggtcctgatgatgacgtggttcgtgaaggtctacagccacccgaagccacccgtggacctcgacgagttcctggcgcgggcgggggtggcctggattcctggcgaggccgtgacggccatcctgctgctgctcacgctgaccgcgtcctacctgttcctgtcgtccttcttcatccgggcacccctgggcgagctgcggacccggccccggggacgccgggcggccctgtgggagtccttctaccggccctacgccatccacacccggcgcaagcccacccggcgtccgcgaccgtcctccacgtccgagcactga

SEQ ID NO: 4567 - DNA, 1155 bp, Myxococcus xanthus
gagtcctcgatggggcaggtcgccgaaggcggtctgacgcggcacgcgccggagagcctggcgcacatgaactcggtgctgcgcgccacgttcgactcgattgcggaaggcgtcatcgtggtggacctgaacaagcgcgtcacggccttcaacaagcgcttcctcgacatctgggggctgaccgaggagatgatggtggaccgcgacgcggagcgggtgctggtgcgcgcggcgggcggcgtgaaacacccggagtcgttcacgtcgcgaatccgggagcgcttcgagccgtccgaagaggtggacgtggagacggtggagttgctggacgggcgcatcctggagcgcaagtcgctgccgcagcggatggggggcgccatcatcggccgcgtgtggagctaccgcgaggtgacggcggagcggcaggccgaggccgagcgcgagcggctgctgcgcgaagcccaggaggccatccgcgtgcgggacgacttcctgtccatcgccgcgcacgagctgaagacgccgctcacgccgctgaagctgcacctccagatgctgcggcaacacggcgccgagggggacggggcctccgcccggcacgtggacaagtcgttgatgcaggtgagccgcctgacgggattggtgaatgacctgctggacacctcgcgcatccaggaagggcggctgacgctgaagcatgggcccgtcgtgttgcaggagctggcccatgacgtcgtctccgagatgcgcctgtccagcgcgcaccaccgggtcgagtacgaagcgccggaggcacccctggtcgtcctgggcgacgcggaccggctcgcgcaggtcctggtcaacctgatggagaacgccttcaagtacagccccagtgggggaacggttcgcgtccgggtggctcgggaggaccgccacgcccatgtctccgtccaggacgaaggcatcggcattccgcgggatcagcaggagcacctcttcgagcgcttcttccgtgctcgcaacgcccccatctccggctttggtgggctggggctggggctctacatctgcggggacatcgtcgagcggcatggcggccgtctgtgggtggagagcgtgctggggcacggctccaccttccgcttcaccgtgccgctggcgtccacgtga

SEQ ID NO: 4568 - DNA, 87 bp, Myxococcus xanthus
atgattgtcggcaccgagcggttcatggaaacggtgcgccgcctggaactggacggagtctcgttccgcgagctgcccacacactga

SEQ ID NO: 4569 - DNA, 492 bp, Myxococcus xanthus
atgcgggacgtggcccggctggagacgctggaggtctcgctctacaagaaggtgaccttcacgccggagccccaggccacggatgcgctctggaaggacgtgctgaactgggcgcgttacgcgctccagaatccgcatggccgcgccatcgtcttcgcgaacgcgcacctgggcttcgacttccagcgcttcgaccgctctcatctccaggtgacgggcacgcgcgtctacgtgatgctgccgcccatggaggtgaaggtggagctgcgtcctggcgagacggaggtcatcgactccaacctggacagcgagcagacggcgcagttgctggagaaggcccgcctcgccttcgagcaggaggtccgctcgaacgggaaactccagcggcgggcgcgggagtcagcggagcgttcgctgcgggcgctgctgctcacgctgggctaccgtgaggtgctgttcgtggaccacctgcccgcgggcacggcgggctga

SEQ ID NO: 4570 - DNA, 558 bp, Myxococcus xanthus
atgaacgacgatgacctgcccggcagactggcccgcaacatccgttccctgcgcgaaacgcgaggcgccacacaggcgcagttgtcccggctggcgggcgtgccgcgcgccacctgggcccatctggagtccggcgcggccaacccgaccctgtccgtgctgcaccgcgtggccgccgcgctccaggtgtcgctggaggagctgattgcgaagccccgcgccagtgcccggcactacccgcgcgccaccctgcccgtccggacgcgtggtggcggaatgctgcgcaagctgctgccggacccgctgccgggcatggagttcgaccgcgtggagctgccgccgcaggtgcgcatcaccggcgttccgcacacccccggcacccgggagtacctggcgtgtgagtcgggggagctggtgctcgtcgccagtggggagcgcttccacctccagcccggggacgtggtcgtcttccggggggaccagaagcactcgtacgagaatcctggagcacggacggccgtgggttactcggtcgtcctgctggcgccttcgatatga

SEQ ID NO: 4571 - DNA, 1221 bp, Myxococcus xanthus
atgaaggctgtcgttttccatgggattggggacatccggctcgacgacgtggaggagccgcgaatcgagaagtcgacggatgccatcgtccgcctgacggcgagcgccatctgcggcacggacctccacatgattcgcggcaccatgccgggcatgaagccgggcaccatcctgggccacgaaggcgtgggcgtcatcgaggcgctgggcgatgacgtccgcaacctcaacatcggcgaccgggtggtcatcccgtccaccatcgcctgcggcaactgctcgtactgccgcgccgggtaccacgcacagtgcaacgacgccaaccccaacggccccagcgcgggcacggccttcttcggcggtccccaggagacggggcccttccacggcatgcaggcggagaaggtgcgggtgcccttcgcgaacgtgggcctggtgcgcattcccgagggcgtcagcgacgagcaggccatcctcatctccgacatcttccccaccggctacatgggcgcggagctggcggaaatcaaacccggtgacaccgtggcggtgttcggctgcggccccgtgggcctcttcgccatcgtcagcgcgaagctgctgggcgccggccgcgtcttcgccatcgactgccacgaggaccggctggacctggcgcgggcccagggcgccgaggtcatcaacttcgaggaggaagacccgctcgagacgctcaagcgcctcaccaacggcattggcgtggaccgcgccatcgacgcggtgggcgtggacgccatgcatccgcaccacggccccgcggcgaagaaggcccaccaggagaaggccgagttcaagcgcgaggtgaaggaagccgccccgaagacgaatcccaagggtgacaactgggtgcccggcgacgcgcccgcgcaggccctgatgtgggccgtggagggactggccaaggccggcaccctgtccatcatcggcgtctacccggcgcaggtgcgcacgttccccatcggcatggcgatgaacaagaacctcacgatgaagatgggcaactgcaaccaccgcaagtacatccccaagctgctggagctggtgcgcactggcgtggtggaccccacggccatcctgtcccatgtggagcccatgggcagcgccattgacgcgtaccgcaacttcgacgcgcgcaagcccggctgggtgaaggtggagctggagcccacgcagctccagtag

SEQ ID NO: 4572 - DNA, 1488 bp, Myxococcus xanthus
gccgccattgacgtgggcaccaacgccgtccgtctggagctggcacggccagacgccgacggcgcgctcgaaaccatgcaccaggagcgcgacgccatccgcccgggagagggcgtcttcgccaccggctccatgccggaggagacggccgagcgcctgctggccaccctgcgccgctacgccgccctctgccgccgccacaaggcccaggtgcgcgccgtggccaccagtgccatgcgcgaggccaagaacagcgccgacatcgtccgccgcgtgcgcgaggaggccggcctcaacctggaggtcgtcagcggaaaggaagaggcccgcctcatctgcctgggcgtgctccaccgcaagccgtcccagacgcgctcgctcctcatcgacatcggcggcggcagcaccgaaatcgtcaccgccatgggcgagaagcccgacaacctttggagcctcgcgctgggctccgtgcgcctcaccgaggtcttcgacgcctcgcgcaccgtgccgcccaagcaactgcgcctcatgcgcagcttcgtctcggacgtgctgcaaaagacgctgccccccacggtgcccaacgtcccccgtgtggcgctgggctcgtccggaaccatcaacgccgtggtgtccttcgccgccgcggagaacagcggcaacgccaccgtccgacagctcacgcagacggtggacaccctggcgcagatgcctcccgagcgccgccgcaagcgcttcgacccgcgccgcgctgacatcatcgtctccggcgctgtcatcctggaaggcgtggccaggcacctgggcgtcgagtccgtcagcgtcgtcaaccgcggccttcgcgacggcatcctcgtggacctgctctaccggcaggatgagcaccgcgaggaccacagcctcgcggacgccgccctggccctgggcaagcgcttctacttcgacgagaagcacgcccgccaggtcgcccggctgtcactcaccctgttcgacaacctggccgccctgcaccagttgccgctgtcggtgcgctcccacctggaggtcgccgccctcctccacgacgtgggccacgccgtcagctacgagcggcaccacaagcacacgtactacctcatccgccacgccgacctgccgggcctcgccgaccgcgagcgcgagctggtggcccgcgtcgcccgctaccaccggcgcagcccgccggagctgacccacgccggcatggcgggcctcaatccggccgaggcacggacggtgcgcaagctggccaccttgctgcgcgtggccaactcgctggacgtcagccaccaccagcccatcaaggacttcaaggccaccaacggccgcgatggcgtggcgctgcacctgcacacccggcaccccgtggacctggagctgtggaacgcggaccgcgaggtcctgaacttccgccgcgtcttcggcaagcggctcaccttccacgtccaccacgcatccagcggccgctag

SEQ ID NO: 4573 - DNA, 1137 bp, Myxococcus xanthus
atgcgcgccgaagcctcactgccgccggtgaccgctcctggtctccgccttcccctcaacgaggtccgtgaggagcgcgtcaccctgctcgacggcgggacggaggcgtacccgcggatgctggaggccattgccaccgcgcaggtgcgggtgcacctggaggtctacaccttcgagcgggatggcattggcgcgaggttcctcgaagcgctggtggccgcggcgcaccggggcgtcgcggtgaaggtggtggtgtacggctggggcagcattggcgccagccggcacctcaagcagacgctggaggccgcaggggcgaaggtgcgcgtgtacaacccgctcacctccctgtgcaccggccgctcctggcgcaaccaccggaagattctcctcgtcgatgactcggtggcgttcctgggaggcatcaacatcggggacgcgtacgcggcgaatggggaccagcccggctgggccgacctggcgctggagctgcgaggtgacatctgccggcagctgggggccacgctgcacgcgggggcctccgcgctggagtcgggcgcggtgaagctgttcctgtccggcttcgcgggtgggcaccggctgcgcaagcggtacctccaggcgattgacggcgcggagcacgaggtggtgctggcgcacgcgtacttcctgccggacaagggcttcatgcgggcgctcaagcgcgcctcgcggcgaggcgtgacggtgcggctgatgctggccgggcgcagtgacgtggtgttcgtgcgctctgcgaccatgcgcctgtgcccgacttcctgctgcgccggggtgagcatccacgagtggacggactccgcgctgcacgcgaagtcggcgctggtgatacggaaagaatctgctggtggggagcttcaatctggacccgctgtcgcatgtgtgaacctgcatacgctggtggaggtggaggaacccggcgtggcggcgcaggcgcagcggtggctcgacaagcacctgcgcggctcgcggcgggtgtacctggaggactgcgcgcgctccggactccagcagtggctgctggacatcgtggggctggccgtcgcccgcctcgcggagcgcttcgccagcttcatgggccggcggcggaagcggtag

SEQ ID NO: 4574 - DNA, 369 bp, Myxococcus xanthus
atgccctcgcagccgtccaaggaacttcagaccttccccaaccccgccgccgatcgcgactacgaaatcgtgttcgacgtcccggagttcacctgtctctgcccgctcaccggtcagccggacttcgcacgtttcaaaatcacctacgtgccggaccagagctgcatcgagctcaagagcctcaagctctacatgtgggcgtaccgcaatgagggggccttccacgagaaggtcaccaacaccatcgcggacgacatcatcaaggccatccagccgcgcaagctcaccgtggtgggcgacttcttcgtgcgcggcggcatcggaaccatcgtcaccgtcacgcacgacaagtccaagcagcaggcctga

SEQ ID NO: 4575 - DNA, 252 bp, Myxococcus xanthus
ttcgtcggggatgcgggcccggaggcgtattggacgctggagcgcttcgcctcggagctcgccgccctgccccaggacggcgtcatcgagctgatgtgccacccgggctaccggccggagacgctgaagagcggctacgcggcccagcgagaggtcgaactggagaccttcctccacccccaggcgcgcgaggtcctggcccgggcgggaatcgtcccggtggacttccgcgtgctcacgtccgggagctga

SEQ ID NO: 4576 - DNA, 393 bp, Myxococcus xanthus
atggcgacccgccgaaccctggacctgaaccggatccgcgaactcctgcagcgccgccgcagggagatcctcagcgccaacgagggggcgcaccgcgagctcaccgccctgaagaaccaggagcgggaccccgaatacgaagaaaacgcccagtccgagctggccgactacaccctctccagtctgatggaatcgcagcggcgcgaaatcatgctcatcgacgcggcgctgcgccgaatggacatgggcgtgttcggcgagtgcgtggactgcggcttcgagattcccatcgaacgcctggaggccctgcccttcgccatccgctgcgaggaggacgccagcatccacgaactcgagacgcgcggcggccccatggccagcccgtctctctga

SEQ ID NO: 4577 - DNA, 1938 bp, Myxococcus xanthus
atgcccctgggtcccgacactgttggtcgcaagctgctgtggagcatcgccctgcccgggctgctcgtggcgctgctgggcgtcggccacttctggcgtgaggcgcgggtcgcggtccaggacgccacccaggtggagtcgctggcgctggcggagttcgtcgcatccaccttcaccctcccgcaggcacgcggggctccggcccatggcgcggtgacggaggtgatgcgctccgacacccggctcttccgctcggtggaggacgtccgggtgctgacgccggatgggcgcatcctctggtcccgccggtcgggtgaagaaggcacgacgcacccggaggccgcgcggctgacggcccctggcccggagcgggcgcgctcggtggcgcagatgacggaggtcatccgtcccctcggcgggcccgagtgcgccggctgccacacctccggcgacgtgccgggcgccagcatcctgcagctgcggatggcggagccggcgctccaccagcagctgtcgtccgtgttcggcgcggcgctcggctccatgggcctgttcgtggtgctgctggcgctcatcaccgggctggcgctgcacttcgtcctcacccgcccgctgcgcaagctgagcgtggccatgcggcgcgcggaggcaggcgacctgctggtgcgcgcggaggcgcgaggcaccgacgagctcgcgcagctgggctcggccttcaaccagatgctggcgcggctcacctccatgaaggcggaggagatcgacacccaccgcgacctggagctggtgaaggagaagctggccctcaaggacgagttggaggaccgcctcaaggagctgtcgctgctcttcgacgtggcgcgctcgctcaacgccacgctggagctggatgagctgctggacgccgtcacccggctggtgaccgagcggctgcgcatccccgagttctccatcatgttgatgaacccggagagcctgctggaaatcaagcacgcctggccggagggccgcggcgcggagggcctcaccttcgcgctgggcgaaggcgcctgcgggcgcgcggcggagacgcgcaagtcggtgtacctgccggacacgtcggaccgctccagcgtgttcgccaagccggacctggtgaagggcgggctcaacagcggcgcgctgctggcggcgcccatggtgcacatggagacgctgctgggcgtgatgaacttccagcgccccgaggtggccagcttctccgcggaggaaatcgagctgctcaacgcggtggcggacgtggtggccacggcggtgaagaacgcccggctgcacgcggagacggtgaagctcaccatgacggacccgctcaccggcgtgcccaaccgccgccacctcttccagcgcatggagctggagctggcgcgttcgaaccgcttcggcaccccgctggcgctgctcatggtggacgtggaccacttcaagcgcatcaacgacctggccggccaccgcgtgggtgacgagacgctgcgccgggtgtgcgacgtgctgcggctgcgcgtgcgcaaggtggacacgctggcgcgctacggcggcgaggagttcgtcatcctcctgccccagacgaacaaggcggaggccatggaggtcgcggagaagctgcgccgcgccgtggcggagtccgtggagctggtccagccgggcctgccgggcaaccacgtcacggtgtccattggcgcgtcgcacttcccctccgacgcctccgcccaggaagagctggtggactgcgcggacgcggcgctctatttcagcaagcgcaccggccggaaccgcaccacccagtacgaggccggcatggagctgcacccgggccgcgagcggggcccgcacacgcccacggccgagcctcccgccgtgactgccgcccccaatcctccgggtggcgtggccaaggcgtag

SEQ ID NO: 4578 - DNA, 1566 bp, Myxococcus xanthus
atgttgttgccggctgttgtcgcggtgttcctggtggccatcctggtggcgttcatcgccctgggcgcgcgctccggtggcgtgtacgcgcgcatcagcagttcgcaggttcccaccatcgagctgaaccgtgaggtgatgcaccgcttcccgggcctgcaccgcaacgtgctggcggcggtggcggcgaaggcgggagggttggagccgctgagcgcggaggtggacgagctccagtcgaagctcgacctggcgggggccgtaccggacgcgaaccgccagcgggtggatgaactcaagtcgtccctggccacgtactggacgaactccagggcggcggtgacgttcgcggtggagggggacgagaaggcggcgtccgcgctcgcgagcgtggagtccctggccgccgcgctgtcccatgagctggagagggccgtggaagcggatggccaggccatcgcgacctcctacgcggaggtggccgggctgcaccgcgccaccacctggacggtgtgcgtgctggtgctgttgtgcatcgcgctgacggtggggctggcctactggctgcaccgcgaggtgacgctgccgctggcgaagctgacccacgtggccacgcgcatcgcggagaagggcgacctgacgcaggccatcgacgtgagcgcccacgacgaggtgggcgagctggcgcgcggcttccaggtcatggtgacccggctgcgcaacgtgcccaccaccatccagacggtggtgacggacctgacgaacgcggcgaagacgctgacgcaggccagccaggagcaggtgaacttcctcaccaatcagtcccgcagcctcaccgaggcgagcaccaccatcgccgaaatcgcgcagacgtccagcatggccgccagccgcgcggagatggtgctccgcgtggcgggacaggcggatgcgttcagcgcgtccggccaggagtccatcgagaagagcgccgagggcctccagcagattcgccagcgcgtgggcgcgctggtgggcagcatcgcgcacctgagcgaccaggccgtgcatgccggtgaaatcatcggcagcgtgaaggacctggcggaccagtccaacgtgctcgcgctcaacgcggccatcgaagcggcgcgcgccggggaacagggccggggcttcgcggtggtggcgcgggagatgcgctcgctcagcggccagtcgctgcagagcacccagcgcatcggcaagattctgctcgaaatcaaccaggccatccgccagacggtgggcatcgccgagggcgacagcgagaagatggaggagggcatcgagcaggtgctcgcctcggccaacacgctgaaggaaatcaccaccgtggtgcaggagagcagtcaggccgcgcgccagattgtggcctccgtcacccagcagaacgcgggcatcgcgcagatgaccgaggtgatgaccacgctgtcctccatgatggcggacgtggtgacggccacgatgacggccgagcaggcggtgacgcaaatcaacgcgtcgctgggacagctccatgagctgtccaccggcttccgcgtctga

SEQ ID NO: 4579 - DNA, 939 bp, Myxococcus xanthus
atggccgaggaagtggacctcgagccggagcggaagaaggagatcatcgagctggagcgctcgctcgacgcgatggaccacttcgccgtgttggggctgaagcccggggctcccgcgtcggaggtgaagcaggcgtattacaacgcttcgcgccgcttccatccggaccgctacttcgggaagaacctgggcagcttccgcgcccgcatggagcgcatcttccggcgcctcacggacgcgcacaacgtgctcatgcagcccgacaagcgggaggcctacctgcgcgcgaatccggcactggctcaggccgaacgcgccgccgcgccgccgccaccctccgcgccgcctccgtccgcgcctgcgcagcacctgctgacgccagaaccgccgccggtgcatcagctttcatcgccacccccggcgcctcgtccgcccgtggcgtccagcgggccttcatccattccgccgccgtcgcgtccgctggcgccaccgccggatgatggcgcgtccgaagcgcgccgcgcggagcggcaggcccggttggcccggcatccctacctggcccgcacgggccgactggccgagctgattgcccggggcaaggccgccatcgccagcggcgactgggagcgggcctatcacgacttccatcaggtccagacgatggacccgaagaaccgcgaagtcgctcttctcctggtcaaggcacgccgggggcatgactcgcagcgggcgaccatcgaggtcgctcgagggcgggagatggagcggcatggggacacgcatggcgccatgtcggcctaccggctcgcctgctcgctggacgaccggaacgccgaggccgcctggcgctgcgcccgcctggggaacctgttggggcaggatgcagccgaaagccgagggctggcgcagcgcgccgtggagctggaacccgacttt

SEQ ID NO: 4580 - DNA, 1149 bp, Myxococcus xanthus
cacctgctgcagaactacaagcagccgcccttcgtcctggctcggggccagggggctcgtgtctgggacatggatggccgcgagtacctggacctgattggcggcatcgccacgtgcgcgctgggacactgccacccggaagtcgtggctgccgcgaaggcgcaactggattcactgtggcacgtctccaacgtgttctattcgcagccccagattgacctggccgcgcagctcaccgagtggtccggcctgtcacgcgcgttcttctgcaactcgggcgcggaggcgaacgaggcgctgctcaagctgacgcgcaaggtgatgaaggaccgcggcacgccggagcgcttcgaggtcatctccttcgacagcagcttccacggccgcaccctggccaccgtcaccgccaccggccaggcgaagtaccagaagggcttcgagccgctgcccgccggcttcacccacgtgccctacggcgacctcgaagcggtgcgcaaggccgtgggcccggcgaccgccgccatcctcgtggagcccatccaaggggagggcggggtgcgcatggcgcccctgggtttcctcgtcggtctgcgcgcgctgtgtgacgagcacgggctgctgctgctggtggacgaagtccagacgggcatgggccgcactggcaagccgttcggcttcatgcacgagggcatcgtcccggacggcatcagtgtggcgaaggcgctgggcaacggcctgccgattggcgccatgctctgcaaggaagagctgggcgccagcctcacgccgggcacgcacggctccacctttggtggcaacccggtggctgcggccgccgccaatgccgtggtgcgcatcctccgccgtcccggtttcctggacgaggtccaggagaagggcgcctatctgctcgcccgggcgcgtgaactccagggccggctgcctgcgggtcgcatccaggccgtgcgcggccaggggctgctggtgggcgtgcagttggatcacaaggtggcgcccgtcatcgcccaagtgcacgaagagggtctgctggtgaatcccgcaggcgaccgcacaatgcttttcgctccgcccttcatagtcacggtgcgtgagttggattaaggtctgtccattcttgagcgcgtgctc

SEQ ID NO: 4581 - DNA, 1377 bp, Myxococcus xanthus
tccgccttcacgcctcgcgaggtcgtcagcgagctggaccgctacatcgtcgggcagaacgccgccaagcgcgccgtcgccattgccctgcgcaaccggtggcgccgccagcaggtcgatgacgatctgcgcgacgaaatccacccgaagaacatcatcatgattggccccaccggcgtggggaagacggagattgcccgccgcctggcgaagctcgcccaggcgcccttcgtcaaggtggaggcctccaagttcaccgaggtcggctacgtcggccgtgacgtcgagtcgatgattcgcgacctcgtcgaggccgccatcgcgctggtccgcgaggaggagaccgagaaggtcggcccccgcgccgaggaactggccgaggaccgcttgatcgagctgatgcagggcggcggcgtgaagtcgtcgtccgcgacgccgccgttcggcttcgccccaccgccacccccaccggtccagcgtgtcagcgacagcgcgcgcgagaagttccgcgcccagctccgcgccggcaccctggatgacgtggaggtggaggtggagaccgcggagtcgtcgcccaccttcatgcggggcttctccggccagggcatggaggagattggcgtcaacctccaggacctcttcaagaacgtgccgggcatgaacaagacgcgccgccgtcgcgtgcgcgtgcccgaggcgcttcagctcctgcgcaaggaaaaggccgccaagctggtggaccccgaccgcgtccagcgcgaggccgtggcccgcgccgagatgaacggcatcatcttcatcgacgaaatcgacaagattgccagccgtgagggcggcaagggcgggggcggcccggacgtgtcccgggagggcgtccagcgggacatcctccccatcgtcgagggctccaccatcaacaccaagtatggcgtggtgaagacggaccacatgctcttcatcgccgctggcgccttccacgtctccaagcccagcgacctcatcccggaattgcagggccgcttccccatccgcgtggagctggagcccctgacgggcgaggacctggtccgaatcctccgggagccgaagaattcgctcttgcgacagtacacggccctgctcagcaccgaaggtgtgcgtctgtccttcaccgacgacgcggtgacggagctggcgcgcatcgcccagcaggccaacgagagcacggcgaacatcggcgcccggcggctgcacaccatcctggagcgactgctggacgaggtgtctttctccgccagtgagatgggcccccgggatttccaggtggacgccgcctacgtgcgcgagcgcctggccgccatcgtccaggacgaggacctgtcgcgctacatcctgtag

SEQ ID NO: 4582 - DNA, 525 bp, Myxococcus xanthus
ttccacggcaccaccatcctctgcgtgcggcgtgacgggaaggtcgccatcgccagcgacggccaggtctccctcgaaaagaccgtgatgaagaacacggcgaagaaggtccgccggctgggcgaaggccaggtgctcgccggcttcgctggcagcaccgcggacgctttcacgctcttcgagcgcttcgaggccaagctcaaggagcatcagaagaacatggcccgcgcctgcgtggagctgggcaaggactggcgcaccgaccgcttcctccgccggctggaagcgctcctcatcgtcgccgacaaggagaagacgttcatcctctccggcgcgggtgacgtgattgaacccgactacggcatcgccgccgtgggaagtggtggcccctacgcgttcgccgccgcgcgcgccctcatggcgcacacgcagatgtctgctcgcgacgtggtgcaccagtcgctcaccatcgcgggtgaaatcgacatctacaccaacgccaacatctccatcgaagagctctag

SEQ ID NO: 4583 - DNA, 1806 bp, Myxococcus xanthus
ctcatcacccttggcatcctcgccgtctccctggtgctcttcgtgagcgaccgggtgcggctggacattgtggcgttgctcgcgctgctgtcgctcctcctcttcgacatcgttcctgtggatgatgcgctcgcgggtttcagcaacccggtggtcatcatgctggtggggctcttcgtgattggcggcgccatcacggagacaggactggccgggtggctggggcagcggctggggcacctcgctggggaaggggaggggcgcaccatcgccgtggtgatgctggccaccgccgcgctgtctgccttcatgagctccacggggaccgtggccatcctgatgccggtggtgggaacgctcgcccttcgccgcggaatcgcgcctgcccgcatctacctgcccttcgcgttcgccgcccacctgggcagcatgctgacgctcatcagcaccccgcccaacctcatcgtgagtggggcgctccgggacgcgggccatgagccgttccgcttcttcaccttctttcccatcggcgtggtgatgctcgccgtgggcatgctgttcctcatcttcgctggcaaatacctgctgccctcggcggcgcaggggcaggtcgcggcgcaggccgtgctgtcgcccgaggacttcgccacggagtacggcctgggaacgttgcttcatgccctccgcgttccccgtggctcgaagctcgtgggccggacgctcggcgaggccaacctgcgctccgcgcacggagtgaacgtggtgggcatctcattgatgggcgccgcgcatccggtggttccgcaccgtcccttcggagcggacgaggtcctggtcgtccagggccatgaggatgccgtcgtcgcgacggtggagcactgggggttggagcggctcccgtccttgcagtcgctgtcgctgccacccgaggagtcgctcgcggaggtggtgattccccgccgctcggcgctggtgggccggacgctccggcaggcgcgctttcgtgaccagttccgggccacggtgctcgcgattcgccggggcgcggacgccgtggtggatgcctcgtcccccgcactcaaggacttcacgctgcggcgcggggacaccctgctcgtgaagggccgcaagaagcacctgcgcaacctgtccgaggcccgaaaggacctcgtgctgctcgccgagcccgacccgcgcaccgaccgcctcgcggatcctcggcgggcgacgctcaccgtcatcatcaccctggcgatgctgaccgtgatggccttgggcctgctgcccaacgtggtcgcggtgctgctcgcggcggtggccatggtgctcacgggttgcgtgcgctccgcggacgtctaccgcacggtcaattgggagagtgtcgtgctcatcgccggaatgttcccgctggccaccgcgctggagcggaccggcgtgacgcaactggcggtggcgggcctggagcggctcttcactggcgccagcccccacgccgtattggcggtgctcgccatcgtgacgtccaccctgggcctgttcatctccaacaccgccaccgccgtcctcgtggccccggtggccctccgcatcgcggagtccatggaactccggcccgagccgctgttgatggcggtggccattaccgcgtcggcggcgttcgccacgcccatcgcgtcgcccgtgaacacgctggtcatgagccctgggggctaccggttcgccgactatgcccgggtgggcatcccgctccaggtgctcatcgtcgcgctggcggtgctggtggtgccgtgggtgcttcctttttga

SEQ ID NO: 4584 - DNA, 903 bp, Myxococcus xanthus
atgacgagcctgtcgccgctgctggagaagttccgcgcccacctggaggacgagaagggctcgtccccgcacacggtgcgcaactacctcatcgacctggtggacttcgagcgctacctggtggagcgaatgaagctgtcgctcctgtcggggacgcacgcggcgattcgtggctacctgggcacgttgagcacggaccacgccccggcgagccgggcgcggcggctggcgagcatcaagtcgttctacaagtacctcgttcggcagaagctgttgcccgcgagccccgcgaagctggtgaagagcccgaagctgccgaagacgctgcccaaggtgctgccggtggaggaggttttcgccatcctggacatgcccgacgtgaagacggtgctcgggctgcgggacagggcgattctggagctgctctacggcggcggcctgcgtatcagtgagttgtgcgggttggacctgctggacatcgaccgcagcgggcgaatcgtcagggtgatgggcaaggggagcaaggagcggctcgtgcccgtgaacgcgcagtccatccgagcgttggaggcgtacctcgcacggcggggggagctgctggccacgattcggaaggaccaggcgccagaggcgatgttcctcaacttccggggaggacgcctgacgccgaggagcatcgcgcggcacctggatacatacgtgctgaagtgcgcgctgacgcggaaggtgagcccgcatgccatgcgtcactccttcgccacgcacctgctgggcgggggcgcggacatccgcagcatccaggagctgctgggccattcaagcttgtccaccacgcagcggtatacccaggtgacgtgggagcagctccagcaggtctacgactccgcgcatccgcgggcgtga

SEQ ID NO: 4585 - DNA, 2103 bp, Myxococcus xanthus
atggacgcggacggcaacggccgcatccgcgtggcggaggtgcgcacggcggtggactgggccgccaaacagctcaaggaccggcgcggcgcggatgcttccagtgacgtgctggagttgaacgcgctcagcgaggaggcgcggcccctgcgcggcgcggcggagatgattctccggacgctgaaggcgacggacgccgggcgcatctccctggcgcaggttcgcgagagcgagaaggccctgcgcgagaccgggcagaacggcgatggcatcgtcgctcctgagcacctgtccgagcacctgcggcccctggcccaggagctgatggccagctttcccgcgctgacgaatcgggcaggcaaggcgggcgtggacgcggcgctggtggcacgcttccgcgaggagcgcgcgaagctgcgggagcaccgggagaagcagggcgcggcgttcgtctggggcgacatcagcctggagacagccaagcgcgtgcgcgacgtggcgccgttgctggatgcgtacttcgtgcagtgccggctggtggccgcgcagcccgaagcggcggcgagcctgcgcctgcgcgcggagcgggtggagggtgcactgggcgacatggcggcgctggggaaggcggcgggtgacctgcccatcgcgccgccggatgcgtcgggtgtgctggagtggtcccgtctcctgcgcgggcccgcgtacgaggtgctggaggcgttccgcacggacgtcgccacgccgatgacgggggattcgcagcggctgtcggactcggcgtggcgggggctggcggcgaaggcggatggcgtgctggcgtggcaggcgcagctcgaggcgaacccggtgcgcacgctgatggacacgctgccgtcggtttcggacgcggacctggatgccctggaagcggcgagcgcggcggacctcgcgctcaagcccacgctggatgccgtcaacgagctggagcggttggtcctctaccagcgctggctgctgctgttcgcgaacaacttcatcagcatgcccaacctctacatgcccaagcggttggcgctggtggagaaggggacgctcatcctgggcgggcgcaagtacacgctgtcggtgctggtgacgaaccgggccgcgcactccgcgctcaccgcgctggggaccacctgcatcctctacgtccaggtggcgccgaaggacgggacgcccgggtatgaagtggcggtgccggtgacgagcggccggagcacggagctcgcggtgggcaagcggggcgtcttctacgacgtggacggcgtggagagcgacgccatcgtgacgcaggtggttcgtcagcccgtgtcgctgtgggagtcgatgaccatgcccttcgcgcgcatcggcgaattcatcaccagtaaggtggagggcctggcgtcggcgggcgagaagacgttcgattcgacgctggagaagggctacacgaacgcgacgaatgcgccgccggtggcgccttctccggcggcgggcgcggctcccgctgcagcagccgcagcacctccaggcggcgggctcgcgggcatcgtggcggcgggcggcctggcggctgcggcgctgggctcgtccttcgcgttcatcatgacgcaggtgaagtcgctgacgctggtggacctcatctccgcggcgacgctgattgccattgtcgtcatggccccggcaggacttctgggctggctgaagctgcgccggcgcaacctggcgctgctgttggaaggctcgggctgggcgctgaatgaccggctgatgctgacaccggagctgtcctcgctggtgacgcgccgtccgaagctgccctcgaacgcccgggtggaccgcttggacatggtgcgctcggcgctggtccggcagcaggaggacgacgaggcggagggcgcgtccgggtggacgaagctggccatcacgctggcggtggttttcgtgttgctctggcaggtccggattccgctgttgacctggttctgccacgcgggctggttgtctcaggacacctgcctggcgctgttgccgtcccaggcggaaccggctccggcggcggcagcgcctgccgcggctccggccaaggcgccgtag

SEQ ID NO: 4586 - DNA, 1644 bp, Myxococcus xanthus
atgatgcggatgcggcaggggcggctgtggaccgcgggcctgatggcctcgctggtgatggcgggcacgggctgcaagcagggcgaaaatggcggctcggaggccccgggcgtgcggcgcgccaaggccgccgcggcggcggagaagccacctccgcccggtgcccccggcgcggggcagggcacgctcctggcctcgggccgcgtgacggacctgcgggtgacgtcggacggccgcttcgccacgtacctcgtcaacgggcagaagccccggctggacggcattccgccgcagatggtgctgggcgagctgtacgcggtgcccgtggagggcggcgagccgcgcaagctgggcgagggcgtgacgaacgtccccggcggacagttggtggcgccgggctcgaagtacgtcctcttcctcactggctacaacccggcgacgcagtcgggcgcgctgaacgtggcgtcgctggatgacgcgaaggcggcgcctgtcgtgctgggcacggcggtcagctacatgctgcccagcccggacgggacgaagctggcctacgtggatggcggcaagctgaagctgggcacgctgccgtcaggacccttcacggacgtggcggcggaggtcagcaccgcccagttcacgccggacggcaagacgctgctcttcaagcgccggctgtccgcggcggggggcatggcggccatctccgtggagaagccagacgcgccgcccatgaaggtgggggaccaggtgggggactacgaagtctccccggatggtcagcgcgtggccttccaggtgcgcagcgagtcggtgcgggggctgtatgacttgtacttggcggagctgcccgaactgaaggcgaagcggttggcggtggcctcgggtgtgtttgccttttcgcccgatggcaagtggctggcgcgcacggagaacggcaagccgaacgtgccaggggacttgtacctgggcccggcggcggggggcgcggggcgcaagctgggcgtgcaggtggagaagctggccttctcgccggactcgcaggcggtgggcttcctggagaagtatgactcgactgcgaacgcggggctgatgtcggtggccgcgctgccggacggcacgacgaagcaggtgggcggccgcgtgcccaacttcgtctggggctcggacgggcgctatgtggcgttcctctcgcgcatcctcaagcccgcgtattcggtggacctgatgctgtacaccctgggggaggagcgggcggcgaaggtgcagcagggcgtctttggctatggcttcacgccgggcaacgggcaggtggtgttccgctccaactgcatccgcaatggacgctcgtgtgacttcatggccatggacctgccccggcaggcggaccctcgcacgtggctgcaaggcatcttcagctacaagctgtccgatgatggccagcgggtgctcgtcacgtatgcccgcatggactcggacacctacgatgtggcggtgtacgacgtgaagacccaggcgcggaagacgctggatcagggcatccaggtgccggtgtccttcgggggcaagaatgactcgctggccgtgtacgcgattacgcagggcccgaaggccggcatctacagcgtccccgcgacgccgtag

SEQ ID NO: 4587 - DNA, 1374 bp, Myxococcus xanthus
atggcggatcagaagcagcgggtgacggtgattggcggcggcctggcggggacggagtgcgcctaccagctctcccgccgcggggtgccggtggtgctgcgggagatgaagccccagaagcgttctcccgcgcacaagtcggacacgctggcggagctggtgtgcagcaactcgctgcgctcggacaacccggagagcgccattggcctgctgcacgcggagctgcgcgcgctgggctcgttggtgctgagcgcggcggacgcgaaccgggtgcccgcgggggacgcgctggcggtggagcgcgagcgcttctccgccgcgattacggagtccctgctgcgccagcccggcgtggagctggtggccggcgaggtggagcagctgcccgaggacggcccggtggtgattgccacgggaccgctcacgtcggatgcgctgacgcgggagctggagcgccacgtgggcacccggctctacttctatgactccatcgcgcccatcctgtcggcggactccatcgacatgaacgtggcgttccgccagagccgctacggcaagggcggcggggacgactacctcaaccttccgatgacgaaggacgagtactaccgcttcatcgccgaggtgaaggcgggtcagaaggtggtgccgcacgctttcgaggaacccaagtacttcgaagggtgtctgcccattgaagtgatggccgagcgtggcgacgacaccctggcctatgggcccatgaagccggtgggcctgagggacccgcgcacgggccaggagccctacgcggtggtgcagctgcgcatggaggacgtgggcggcacgtcctggaacatggtgggcttccagacgcggctgacctggggtgaacagaagcgcatcttcagcagcttcatccccggacttcagcaagcggagttcctccggatggggcagatccaccggaacaccttcatcgactcgccccggctgctggcgaaggacttgtcgctgaagacggagccccggctctacttcgcggggcagatctccggcgtggagggctacgtggagagcgcggcatgtggatacctggtggcgttggcgctgcacgcacggctgacggggacggagttcgttccgccgccggccaccacggcgatgggcgcgctgctgcggcacgtgacgggcgaagcgcacccgccggactacccgcaccagccctccaacatcagcttcggcatcttttcgccgctgaccgggcggatgaagaaggcggagaagcgcgcggcgtattcggcgcgagcgaagcaggacctggcggcatggctgccgcatgcgggcgtcccggcggcgggcgcccccgagcacgtggatcagaggagcgcatga

SEQ ID NO: 4588 - DNA, 582 bp, Myxococcus xanthus
atggccgacccgacgacatccgccgtggacacgcccgacgcggaagccgtggcgcggctgagctaccgccgggccctggcgcgcaagaagcgcaaggagcgcgaggcggcgggggagatcaaggagctgaacatcaccgcgatgatggacatgatgaccatcctcctggtgttcctgctcaagtccttcgcctcgtcgtccgcggcggtgacggcgtccgaggacgtgcgtccgcccgtgtcctccacgcgcgccacgcccaaggacaccgtggccgtcaccatcacgcccaggaacgtgctggtgggtgagcgggaggtcctacggctgcagaacggccagttcccggccgacaagctccaggggcggctggtgctgccgctggacgcgcagctcaagaaggaagtggagaagctgaagtacatcgccgcgcgcaacccgtcggcgcccttcagcggggagctgtccgtcatcgcggacaagaagattccctacgacatgctcctcaccgtgctctacacggcggggcagaacgagctggagaactaccgcttcgtggtgctccagaaagagggcgagtag

SEQ ID NO: 4589 - DNA, 87 bp, Myxococcus xanthus
atggcggacttcctcacccgcttcacggaatgtgacgcgacctgccagcaggagattgcgcccgcgctccagcgctccgtgcgctga

SEQ ID NO: 4590 - DNA, 522 bp, Myxococcus xanthus
atggcgttccactactcccggcgcaagctgaaggtccgtgaggaagaagaggcgggcgagctgaacatcgtcccgtacctcgacatcctcatgaacctcatcatcttcatgctgctgtccatcaccggcctggcgacgttcggcatcatcaacgtcaacgcccccgcctatggtgcgccgacgacgggcatggcccaggagaacccggacgatgcgccgaagctgacgctgtccgtgctcatctccaagaaggggcacttcgtcagcagcgagaacgccatccttggagaggcgggtacgcccaccatccccgtgaaggcggacggcgcgcacgacttctccgcgctcaacgcgaagatggtggagatcaagtccgctttccccaaggagacgaaggtcatcgtgggcgcggacccggacgtcccctacgagacgctgacgcagacgctggacgccatccgtgagacgcagggccgcgagcgccggctgctgttcccggacgtcaccctgggagccatctga

SEQ ID NO: 4591 - DNA, 738 bp, Myxococcus xanthus
atgattccctcggtaagcgagctgctgctggacgtgaccctcgcggccacggaagggggcaagctgggcgtcacggactccgtcatcaagttcttcaaggatggcggaccgttcatgttcgtgaacctgttctggctggcgtgctcgctggcggtcgcgctggagcgcatcgtcaccctggtgttccgctacaacctgaacgcgccgcccttcatggagcagatcgccaagctggtgcgcagcggcaacctggaccgcgcggtgaaggtgtgcgccatggcgcccaacgcgccgctggccaaggtggtccgcgcgggcctggtgaacgccaaccgcggtgagattgaggtctccaaggcggtggaggaggccatcgtcgagcacagcccgaacgtgtccaagcgcatcccctggctgtggtccctggcgaacatcgccacgctggtgggcctggtgggcaccatcttcggcctcatcggcaccttccaggcgctgggcaacgtgccggcggagcagaagcaggtgctgctgtcggacggcatctccaaggcgatgaacaacaccgccttcgcgctctccatcgccgtcatctgcatcatcttccacctgttcctcacgtcgtacgcgaagagcatggtggaggggctggagctcaacgcgctcaagctggagaacctcctgtcgcgccgcggttccgtggacccggcgaccacggagctcgaggcgcgcgcttcgtag

SEQ ID NO: 4592 - DNA, 2571 bp, Myxococcus xanthus
atggccacgcggacgaagaagaaggtggaagagactgaggcggccgaggagaaggcgcccgccaagaaggccgccgccaagaaggccgccaagaagaagcctgcggccaagaagaagaccgccgccaagaagacggcggcccgccgccgcaccaagaagggggacgaggacgaactccccaccgtggaagcagacgcggaggaggaggccacgccccgtggcaagggcccgcactacctggtcgtcgtggagtctcccgccaaggcgaagaccatcaagaagtacctgggctccggctacacggtgaaggcctccgtgggccacgtgaaggacctgcccaagagcaagatgggcgtcgacgtggagcacgacttccagcccgagtacacggtcatcaagggcaaggagaaggtcctcaacgagctcaagaagatggcgaagtcggccgaccgcgtcttcctggccacggaccccgaccgcgagggcgaggccattgcgtggcacatcaaggaggagctggcgcatcccgacgcgctccgagtgaccttcaacgaaatcaccaagaaggccatccaggaagccatcgcgcagccgcgccagctcaaccaggacaactacgactcgcagcagacgcgccgcatcctcgaccggctggtggggtatcaaatctccccgctgctctggaagaaggtgcgccgggggctgtccgcgggccgcgttcagtccgtggcggtgcgcctcatcgtggagcgcgaggacgaaatcaaggccttcgtccccgaggagtactggacgctggacgcgctgctggagggccccgctggcccgccgccgttcaaggccaagctgtccaagctggacggcaagaaggtggagctgaaggagcgcgtcttcacggagagcctggtcgccgagctccagacggccagcttctcggtggccaaggtcgaccgccgcgagcgccgccgcaacgcgcccgcgccgttcatcacctccaagctccagcaggaggcggccaaccggctgtccttcaccgcgaagaagacgatgacgctggcgcagcgcctctacgaaggcgtgccgctgggtgacgagggccagacggcgctcatcacgtacatgcgtacggactccacccgtctgtccgacgacgcggtgaagcaggtgcgcgagttcatcgacggcaagtacggcaaggacttcctgcccgacgagcccatggtgtaccgcagcaagaagagcgcccaggacgcgcacgaggccatccggcccacgtcgctggagtacccgccggagcgggtgaagcccttcttcgaggccatgggcgaggaggacatgtaccgcctctacgagctcatctggaaacgcttcgtcgcgtgtcagatgaagcccgccgtctatgaccagaccagcgcggacatcgccgcaggccgggccaccttccgcgcctccggcagcacgctgaagttcgccggctacctggcggtctacggtgctggcctgacgccggaggaagaggcggagaaggagaaggccaaggccgccggtgacgagaacgccgagggcgccgacgcggtgggcgagctgccggtgctcaacgacggtgacgcgctgaacctccagaagctgctccacgagcagcacttcacccagccgcccccgcgcttcagcgaggccacgctggtgaaggagctggaagagcgcggcattggccgcccgtccacctacgccgccattctctccaccatccaggacaagaagtacgtggagaagctggagggccgcttccggcccacggacctggggaacatgaccaacgagatgctggtcaagcacttcccccacgagctggacgtcaccttcacggcgacgatggaggagaagctcgaccagatctccgagggcggcgccaactggaagtccgtgctgcacgacttctacgggcccttcaaggagacgctcgagaaggccgaagcggagatgcgcgacgtcaagcgggaggagatcaagacggacatcccctgcgagaagtgcggcaacctcttcgtcatcaagttcgggaagatggggcacttcctcgcgtgctcgaactacccggactgcaagaacacgaaggacttcaagcgggacgccgagggcaagatcgtcatggtggaggaggagaccaccgacgaggtttgcgagaagtgcaccaagcccatggtcatcaagcggggccgcttcgggcgcttcctggcctgttccggctacccggactgcaagacgtccaagcccatctccattggcgtgtcgtgcccggagtgcaaggagggctacctgacggagcgccgcagtggccgcgggaagattttcttcggctgcaaccgctacccggactgcaagttcgctgcctgggaccggccgctggccgagccgtgccccacctgtgcgtccccctacctgctccagaagttctccaagcgggacggcccgtacgtggcgtgccccaacaaggagtgcgactaccggcgcgaaatcaccgagcagcccgggggcccgggtgggtcacccgaagcctcctcggctgcttga

SEQ ID NO: 4593 - DNA, 120 bp, Myxococcus xanthus
atggtgaccgaggtcaaggagcgtacctccaactgcctcatgacccgctccctggaggagctggtccccggcgaccgcgcccacatgtccgcgggcgcgtcgccctcggccagccgctga

SEQ ID NO: 4594 - DNA, 471 bp, Myxococcus xanthus
atgttgagcctcgccgtcgcgccaaccgcgtacgcccagcaggagaacgaggaagagcaggacacgggcggggagatgggcggcgccgaggtgatggacgaggcgcccgattccgcgccgccgacctccgtcgccatgccgcccggcgcgccccggggccgtgagagcgctcccggtgaggttcactccgtggagtccggtgacacgctgtgggacttgtcccagcgttacctgggcagcccctggtactggcccaaggtctggtcctacaacccggagatcgccaacccgcactggatctaccccggcaatcaggtgcgcttcttcgccgcgggcgaggaggtccccacccaggtgacggagatggtggtcgacgagggcgacgtgacggcccccatggagatgacctccaacgaccaggtcatcgtgacgggcaagattggcgtcgacctgtccattccgtccccgtga

SEQ ID NO: 4595 - DNA, 513 bp, Myxococcus xanthus
atggagccggacgacgagcagatggagatgttcatcagccccgcgccggacgaagggtccgccgtgtcggcgagcgccgcgtcggccgcgaccatggttgcgtcgaacgaggacgcgggggagcagcaggaccccgacgtgctcgacgcggagttcgacaaggccgtgaacatgctgcgcaccggcaacgtggagggcggggtggagaagctgcgccgcttcgctgatgagaacccgcgtcacccgcgcgccgacaacgcgctctatttcagcgggttgggccagattggcctcaacgagttcaagggcgccgcgaagacgttcgagcggctcatcgacaagtatcccgccggggacgccatgctggacggcatgctccggctcgccgagtgccggatgcggctcaatcagtccgcggatgccaaggtgctctacacccgcgtcgtcacccagttcccggggacggcggctgctacccaggcggaacagcggctcgccgcgctcccccagtga

SEQ ID NO: 4596 - DNA, 762 bp, Myxococcus xanthus
atgtcgaccgagtttctcacctccgcgctgttgccggtgccgcacggcttcaccacccgcgcgggcggttgttcggaggggccctacgcgtcactcaacctgggtttctccgtgggcgacgagcgggcgcgcgtggaggagaaccacagccgccttgcacaggccgctggcgcgccgctcgaagcgctgagccgcgtgtcgcaggtgcacggtgatcgcgtggtggaggcccggagcggggagggggcccaggggctgcgccccacggagggcgaggcggacggactgtggacgcagtcaccggggagctgggtggcggtgggcacggcggactgcgtgccggtgctgctggtggacccggatggtcgcggcgtggcggcggtgcactccggctggcgggggacggacgcggacatcagcgcgcgcgccgtggaggtgctggtggcgcgcggtgcgaggccggagcggctgctggcggtggtggggccgtcgatccaggtttgttgctacgaggtgtcggaggagctggcgcagcgcttccgcgcgcgcttcggggatgaagtggtgcggtgggtggaaggcaagccgcggctggacctgacccgcgcggtgcgtcagacgttggtgggggcggggctcaagctggcccacgtcgatgtgctacaggcctgtacggcgtgtgagcccacgcgcttcttctcccaccggcgggacgcggggcggacggggcggcacctcaattacgtggtacaccgcttctag

SEQ ID NO: 4597 - DNA, 594 bp, Myxococcus xanthus
atgagcgtcaactacgtcgcgcttggagacagcacggccgtgggcgtgggggcggcgcgaggaggcggctatcccgagcgcctcgcctcccggctgagcgctgttggcctgcccgtgggcctcaccaacctggggcagagcggcgcgcgcatccgtgacgtcttcacggggcaggtgaagcgcgccgtggccgcgcagcccacgctggtgacgctgggcatcgggacgaatgacctctggcgcggcacgcccgtggaggacttccaagacgacctggaccgcatcgcgcgaaggttgaagcagaccggagcgccgctggtggtggtgaacctcgcggacctggcgctggcccccgtggcgcggctggtgcccgcggcgctgtacgaaggccgcatcgagcccttcaacgccgccatcgcggaggtggcccgggtgcacggcatgcaccacgtggacctcttcacggcgagcaaggacatgattcccaagagcccccacttcttctcggacgacggcttccatccgtcggccgatggctatgaggagtgggcggacctgctgctgcccacggcgcagacgctcgtgagccgctga

SEQ ID NO: 4598 - DNA, 1386 bp, Myxococcus xanthus
ccgcccgcggccacccagccgggcgccgggaacgtcctccagcccgcgacacgggaggcccaggcgcttccgtcgctggcgccgctggtggagtcggtgaagtcggcggtggtcaacgtggacgtgcaggctcgagggggcggcgttccgcgtgggatggaggacaacccgctcttcgagcgcttcttcggtggaggccgcgagggcggcaggccgcgccgcgagccgctgcgccaaggggcagggtccggcttcatcatcgacccgaagggcgtcgtcctcaccaacaaccacgtggtggaggatgccgtcagcatcaccatccgcctggatgacggacgcagcttcagcggcgaagtggtggggcgtgatccgctcacggacgtggcgctcgtgcggctcaaggagaaggtggagaacctgcccaccgtgaagctgggcgactcggatgcattgcgcgtgggggactgggtggtggccattggcaaccccttcggtctggcctccagcgtcagcctgggcatcgtctccgcgagggcgcgtgagattggcgccagccagtacgacgagttccttcagacggacgcggccatcaacccgggcaactcgggcggcccgctcttcaacatgaagggcgaagtggtgggcatcaacaccgccatcgtcggcggtggctccggcatcggcttcgcggtgcccagcaatctcatcggttcactgctgccgcagttggagaaggaaggctccgtcacgcgcgcatggctgggcgtgggcatccaggacttgacgcgggacctggccagcgcgctcaagctccccgtgaatcaaggcgccatcctcacgcaggtgatgccgtcgtctcccgcggcgaaggcgggcctgaagcaggatgacgtcgtcatcgccatcgacggccggaccgtcacctccagcggcgagctgacgcgcaccgtggcgctcaagcgtcccggaagcacctccacgttgacgctctaccgcgacggcaagaagcaggacgtgaaggtgacgctcggtacgcggccagacctggagggcgtggcctcggggaagcagcggccggaggaccagcaggagagctcccggcgcgtgggcgtcagcctccagaacctggatgcgcgcaccgcgcagcaggccggcttcacggacagcagcggcgcgctcatcaccgacgtggtgcccggctcgccagcggaccgcgcgcagttggagcccggcatggtcgtcatcgaggccaaccgcaagaaggtggagaacgcggacgccctggcccgcatcatcaagggcgccgagtccgggagcaccttgctgctgcgcgtgacggcgccgggcggggctcgcaacctgcgcgccctgcgggtgccgtga

SEQ ID NO: 4599 - DNA, 936 bp, Myxococcus xanthus
gccgtgccccggcccctgcatggcccctacgcacccgtcttcaccgaggcgggcgtcgccgcgtatgcccgagacccggagagcagccagcaggtgtggagcaccgagcacggctacccgggcgacccggactaccgcgagttctaccgggacatcggctgggacctggacctggactacatccgcccgttcatccagcccaccggcgagcgcaagaacaccggcttcaagtacttccgcatcaccgggaagacgaacgagaagcgcccctatgatccgctcgccgcgcgtgagcgggcctcggtgcatgcgggcaacttcctcttcaaccgccaacggcagattgaagacctggcctcgcgcctgggcggcagggagccggtggtcgtcgcgccctatgacgccgagctcttcggccactggtggttcgaggggccccagttcctcgacttcctcatccgcaaggtcgcgtatgaccagaagacgttccggctggtgacgccgttggatgacctgcgggagcacccggagaatcaggtggcgacgccgccgctgtcctcgtggggcgcgggcggttacgccaacatgtggctcgacggcagcaatgattggatctaccgccacctcaatcactgcgcgaagcagatggtggaactggcgcgtgacttcccggatgccggtgagctgcaacgtcgcgcgctcaatcaggcggccagggagctgctgctcgcccagtcctccgactgggccttcatcatgaagacgggcaccatggtggagtacgcccagcgccgcacgcgcgagcacatcctgcgcttccagcgcctgcacgagcagctacgcggcggcagtctggacgagggctggctctctctcgtggaggggcgggacaacctctatccagagctggactaccgcctctatctgcctgcctga

SEQ ID NO: 4600 - DNA, 507 bp, Myxococcus xanthus
atgaagtgtgagagctgcggtggggagctcttggagacacgactcgacagctaccacttcgacgagagtgggctggaggatgtcatcctcgtgggggtgattgagcgtcggtgcgagaagtgcaacgaacgagaggtcgtgatcccgaggttgaaggagttgcaccggacgattgcgaaagccctggccgcgaagaacagcctgctgacgccgctggaagttcgattcctgcgcaagcatctggggttctcacaggctgacttcgcgaagcgcatcaatgtccgctctgaggctgtgtcccgctgggagaccggcgccgaagagttcagctggcatttcgagctgcttcttcgcttgatggtgatgttggagcttcacgagcggaactacaccgtgaagtccttcgacgaggtccaggagaagagactcactgcccctgtccgaattttcgcggagaagtccgcgtggaggccagacagcaccaacatgctgaccgctgcctgctga

SEQ ID NO: 4601 - DNA, 2589 bp, Myxococcus xanthus
tctaaggttcactccgcaggccggcgcttcctgaagcggcttggcgtctccctgttgatggccctcctcttcggcggcgtgctggggctgctcgtgtacctgcgccccacaggcatcgtgccgcccaaggacccgccgtcggcctgggtcccctccgcggcggtggatgccgcgcaggcctggctggaaggctgggagcgtgtcacctacgactggcgcgtgcgggaactgggagagcgctccgagcgtcccgacgaggccgtcgtcatcgccatcgacgacgagacgctggccgaggcccgccaggatgtgcgccctggcgtcgccacgcagccctggccgcgccagctcgtgggccgcatggtgcaccggctggtccaggagggggcgctgctggtgctcgtggacttgcccttcacggacctgagccccaacgcctgtgccgaagcctcgcccgcgtcgctctcctgcgatgacgcggccttcgccgcgcagttggcgaaggacccgggccgggcgctgctgtcattcacctgggaagcgcagggcccccgggtgctgccccccgccaaccgcctgtggccgtaccgcgtgaagctgggtgtctacgacgcgtccgacgcggcctccctgcgcgcgcaggccgtgctcgcggcgcagcgtcccgccttcatcatccccgcgggcagccaggtggaggtgtgggggggcgccatggacgcagcggacggcaaggcgctgggctcgcgcctgggcgccaccgcgcacgtcatcgaggagcgccgcgccgcggatgacagctaccgcgtgggccccacggagctcttcgtcgcgctggcggaagtgcaggtggagggactggacgcggcgaacctcatcgagttgcgccaggttcagcaccccgtggtgccgctgctgagcggcagcgcggggttcggtgcatccacgctcgtggcgggccaggacgggcgcgtgcgcgccgtggcgcacctcatgagctacaccgtgcggggcaagcgccacatcctgccgtcgctgcccctggccgcggccatgcggctcgccggtacgcgctcgcttcgctacgcggacggcaagctgcacgtgggggaccagtacgcgttcccgatgagcgcctcgggcctgagcctgctgcgctgggatgcgcccaacgcgggccggggctcacgcggctcgctggcgcgctccatccgcgcgtggaatgtgctcctcaacgtcttcgacgtggcggacgagcgccccgcgcgcttcgagaatgacctggaaggccgcaccgtcgtcctcacgcggaccgccggcgagtccgcacacctgcgttccacgcccctggggccggagacgccggggggcgcgattctggggcaggcgctggccaacatcctccgttcggagggcattacccgcgcggcgccagatttggacctgctcctcacggtggggctggccttcctcggcgccttcctggcgctgtcgctcagcttcctgctgcgctcggtgcgcggcgccgtgctctacgtgggcttcctggtggcggcgggcgcgggctacgccttcggagccgcgtacgtcttcgtcgaacagcggctgtgggtggccatggccgggccgctgctggccatggtgggcgccttcgtcgccaccatccgctacgcctacgggacggagcggcagattcgcgacttcgtgcacaacgcgctcggccgctacgtcagcccggacgtggcccgcctggtggcgcgagacttgagcctgatgcgccccgagcgccggaagatgtccgtgtacgtctgtgacatcgaaggcttcacgcggctgtcggaaagcatgccgcccgagcaactggtgggcctcttcaacgcgtacctcaccgagatttccgcggtggtgcggtccacggcggggcaggtggacaagtacatcggcgactcggtgatggccttctggggcgcgccggtgcgcacggaccgccacgcgcacctggcctgcgaggcggcgctgaagatgcgggaggtgctgaccgagcgccagtccgcctgggagaagaagtacggccgccgcctcagcttccgcgcggccgtggacaccggggagctggtggtgggcgacctgggcagcgagatgaagtccaactacaccgtgctcggagacgccgtggggctggcctcgcggctggaggccatcaacaaggtgtacggcacctacgtgctggccggggacaccaccgcgcagctcgccagcggcagctacgtcttccgcgtggtggacctggtgcgcttcaagggccggccgcagccggtgcgcgtgcatgagctggtggcgcgccgcggagaaatcacgccccgcatgcaggagcagctcgcgctccacgagcaggccctcaccgcctaccaccagcgccgcttcgcggaggcgcatgcgctcttcgagcgcgcttcccacgagtaccaggacaccgtcgccgcgctctacgccggccgctgcgcccgcttcctcgtcacgccgccgcccgcggactgggacggcgtgcacggcatggaggagggcgagccctctgccgcggcggcgtga

SEQ ID NO: 4602 - DNA, 333 bp, Myxococcus xanthus
atggggcccgcggcccacgcccgcatcctccaggagaaggacgtgggtgccttcgacggccagcgctggtgggtggaccggccccaggccaacggcacgttgctgcgcgcctgccagggcgactgtgaagggccggacgccctcgcgctggaggcgtggttcgaccgcgtgcaggggcggacggtggcgggaggctggcgtaaggtggccggccatgtcgacgactccggacaccccgagccttcaggaacgctacgcgccccaaaacagctgcttcggctgcggcccggccaacgcccagggcctgcgcatccgcagccgcgtggagggtga

SEQ ID NO: 4603 - DNA, 237 bp, Myxococcus xanthus
atgcgcgcgcagggcggggatgcgccgccgtgcaccgtcaccgccgagtacaccatcaccctcaagcgccccacgcccatggccgggccgctgcgcctggaggcgaagccggtggaaatccagggtgaccgcgccgtcatcgaaggcacgctcaccgcgggtgggaaggtgacggccacttgccggggcaccttcgtcgccgtgaagccgggccaccccgcgtaccatcgctggtag

SEQ ID NO: 4604 - DNA, 1563 bp, Myxococcus xanthus
atgtggggccggctcggcttgcgaacgcaggtggccatcgcggtgctcgtcccgtgcctggcggtggtgagcttctgcgtcgtgtacttccccatgcaccagcgggaagtcacgctggagttgctccaaaagcgggtgcgggtggtggcgcggctgatatcgcagcaccccgcgctcctgtccgcggacagcacgccggaatccacggcccgggtgcgggacgtgttgtcgatgctggaggccccggaggcgctgaacgagcgcggtggcttcaccctgcgctaccaggggctggtgtcggcggaaggcaccgtgctccatgggcgcggctccattcccacggccatccgctcgctcggcgtggaggggctggagggctgcgccacgtccacccaacacgacgaggtgtcggtccgctgcgccagtggtgagcgcatctacgtggcgggcttcggcgtccaggaggcgctcagctcggtggatgacatgcggggcgcggtgctggccggcctggcgggcgcgctggtgctggggctggccctgtcgttgttcatcagccgcgccatcgccgaaccggtggcccgggtgacggaggtggtgcgggacgtggcccggggtgacatgtcgcgcggggaactggacgtgccggccacgggcgaggtgcgcctcatggcgcagtcgttcaacaagatgctgggcacgctgcgcacctcggtgatggagatggtttcgcgcacggagcagttgtccggcgcatcgcggggcctgttgggggcgtccgcggaccaggaacacgtcatcagccagcaggcggcgtacgcgcagcagattgccgccacgttcgaggagctgagccgcacggccgagcagatctccagctccacggaggtggtggagtcgagcgcgcggcgcacccacgaggccgtggcggaggccatggcggtggttgcgcaggtggtggcgggcatcaacgacatccgcaccgagtccaagggcgtcgcggacgcgattgtcggcctcaaccaggaccttcagcaggtgtcgaagattgcccaggtcatcaaccaggtggcggagcgctccgacttgctggcgctgaacgcggcgctggagggcaccaaggcgggcgaggtggggcggggcttctcgctggtggccgcggagatgcgcaagctggcggagaacgtgtccgcatccgcgcgtgacatcgcccgcatcgtggagaaggtgcaggactccggcgaggaagcggcagccaaggcccgcgtgggcatggccaccagcgaccggggcgtggaggtggccgagcaggcctcctccgtgttccagcgaatcgtcgagctggcgcgcggcaccagcgaggcggcccggcagatcaccatcgccacccgtcagcagcgccagtccagtgagcaggccgtgcagggcgcccgcaacgtcgcggagctggtgaagcagggcgtggacgcgacgggacgcaccacgcgcatcgcccaggacctgcaggcggtggccgaggggctcaccgccgtcaccagccgcttcaagacgacgcggaactga

SEQ ID NO: 4605 - DNA, 288 bp, Myxococcus xanthus
atgggcaagaagtccgatacgaccatcgagaaccgggtctacctcttcgagtcattggcgagcagctacgtggcgtccgccaccgaggtcttgtcctcggaggaccccgcggtgcggcagcgcgcgcgccgggccctggcggagctggccttcgtgtcctgtgtcatggcggacactgctcatctgccggccgagcaggttcgggcccaggtgctcggcgcgcccgagcgcgtcccggaggctccgtcgaaggtgtccggcggcgcggcccggaagcgcaacaagtag

SEQ ID NO: 4606 - DNA, 435 bp, Myxococcus xanthus
atgagcccgccgcagacgcccgccacgggcgtggtgatgacgctggtcagccagccccagttcaagacgcagctcacccatggcccgtcgggcacggtgaatcagacggaggcgccgcgcgacaacggcggcaccggtggcagtttctcgcccacggacctggtgggcgcggcgctgatgtcgtgcgcggtgacgacgatgcacctgttcgcctcgcgtgaaggcattgccctgggcgaggtgagcgcccgtgtggagaagcggatgtcgccgccgccgcgccgcatcgccgagctggtgctggacatccagatgccggccggcctgtccgccgagcaccgggccaccctggagaaggtgggccgcgagtgcccggtggcccgcagcctccacccggacgtgaagctgccgctgacgttcagctatccggactga

SEQ ID NO: 4607 - DNA, 528 bp, Myxococcus xanthus
atgcatgcgaagcggctgggcatctacctcaatgaccacctggcgggctcggtgggcgggctggagctggcaatccgcacagaggtggagaaccgcggcaacctgctgggccgctatctggcgacgctcgtccccgagctgaaggaagaccagtccacgctgctagcggtgatggacgccctggcgctgaagcgagatgggctgaagacgcgcgccgcgtgggccgtagagaaggtgagccggctgaagctgaacggcacgctcgtgcgctattcgcccttgagccggctgctggaattggaaggcctgtgcgcggccacggagggccgcttgtccctctggcgcacgctggcgcgcgtgtcggtgaaagacgcgcggctcgcggtgtttcccttcgagtcgctcgtgcagcgcggcgaggcgcagcgctccgtgctccagcgcctgagggcccaggcggccgacgtggccttcgcggaggagccgcagcctttcggcaccggagagcctctcatcgcgggccactga

SEQ ID NO: 4608 - DNA, 1071 bp, Myxococcus xanthus
atggagtcgtccgcacgcagggaagaggcgctgctgaccccgcgggaaatctacgagcggctggatcgcttcgtcatcggccaggacggggccaagcgcgcggtggccattgcggcccacaatcacctcaagcgactgctggcgcgaaggctgcgccggacgtcgctcatcaagaaatccaacatcttgctgatgggacccaccgggagcggcaagacgcacatcgcccgcaacctggcggacatcctccacgtgccgttcaccaccgtggacgccaccgagtacacggaggccggctactacgggaaggacgtggaggtgatgatctccgacctcctcttcaaggcgaaccactccgtggaggacacccagcggggcatcatcttcatcgacgaggtggacaagattgcccgccgctcccagggcgcccgcaacggcgcgggcagccgcgacatcggcggcgagggtgtccagcagtcgctgctgaagctgctggagggccgcgaggtgtacgtacccctcaacgtcacccaggcctggaacaagagcgacttcgtgcaggtggacacgcgcgacatcctcttcatttgcgcgggcacgttcagtgacttgcacgacgatggggatgaagggcgccgcgccatgggctttggcgcggaggactcggcgaagcgcagccagaagcgcatcagcacccgccagttgacggacttcggcatgctggcggagttcctcggccgtctgccggtggtggtgcaactggagcggctgggcgaggaggacctgatgcgtgtgctcaccgagccgccggactccatcgtgcgcgagttccgcgaactgctgtccatggacgacctggaggtggacttcgccgacccgggcctgcgtgaggtggtgcgttattccgtggagcgcgggctgggcgctcgaggattgcggtccgtcctggagcacgtcatggcggacgtcatgttcgaggcgcccgagcggcggcggcgccaggtgatggtggacgcgggcttcgtgcgagagcggctgcgggggctggattcgacgcagttggacgtgtga

SEQ ID NO: 4609 - DNA, 213 bp, Myxococcus xanthus
atggggcccaacgtcgtcgtccgtgaggacaccggccgcaagagagacccgctctctcccgaggactaccagctcatgggctggccgggagaggtgtactactcggcgatgacttctgagaagatgcgccgcgtggtggcggagcacatcgcgaaggacgcccccgtgaaggagctcttcggccagccggactcggacgacggcgaggaatga

SEQ ID NO: 4610 - DNA, 765 bp, Myxococcus xanthus
atggcctacaaggtaagcaaggaccctcgcacggatatccgcgagcggacctatgtgcccaacctgctccgcggcctgggcatcaccgcgaagcacttcttccgcaacctcttcgggacgcgtgacaccaacacgcaggtggtggaccgcaccggcgccagcctgatgacgacggtggcgtaccccgaggagaagcccatctaccccgagggctaccgcggcctgcaccggctggttccgcgcgaggacggcaagccgcgctgcgtggcttgctacatgtgcgccaccatctgcccggcgcagtgcatctacatcgaggcgggtgagtacgaggacgaagcctcggactccgaggaccgcgtcatcgagaagtaccccacccagttcgtcatcgacgagctgcggtgcatcgtgtgcggcctctgcgtggatgcgtgccccaaggacgccatccgcatggacacctacacgcacaccccacccgagtacacgcggcagaacttcgtctacgacattccgaagctgctcaagggcgcgccggtgtcccacccgtcggacccgtggaacaagcgcgagggctccgaggagccgcaccacgtccacaaggaagcgcacactcgcatcggcgagggcctggtggagctgaagctgccgcacggagagcacggcggccacggcaaggcgctgcccgcgggggcccaggcgggccaccaggcggtcgtcacgcagcagggccccatccaggtgacgaagttcatcaagtga

SEQ ID NO: 4611 - DNA, 201 bp, Myxococcus xanthus
atgaaggagcggaatctcgcgaccacggacatcgagaacatcatcgaaggcggcgtcgtgaacagcgagggggagcagaaggatggtcggtggacctacgtcatcgaaaccccacgaatggggctcgcggtggcctttcgctgtgacgaagcgggtgaggcgcacgagttggtcatcgtgtcagtctggaggaagtcatga

SEQ ID NO: 4612 - DNA, 1419 bp, Myxococcus xanthus
atgttcaccatcgtcttcctgatggcgggtggcatggcgtcggcctacctcgtgggtggcctggtggaggagcactggttcactggcgcgagccggctgaccaacgtgctgttcctcgtcctcatcttcgtgatggtcatcgccacgctgctgaccatggcggagcgcaagtggagcgcgttcatccaggaccgcatgggtcccaaccgcgcccgcatcgccctgcccggcctgaagaaccgcccgctgggcggccttccgcacatcctcacggacgtgctgaagatgctgaccaaggaagacctgattccggccgccgcgaaccggttcatgttcaacctgggccccatcctggccttcgcgcccaccttcgccctgttcgccgtggtgcccgccggtccgtcggtgcaggtgttcggccgcaatgtggacatggtggtggccacgccggacttcggcgccctctacgtgctcgccatcgcctcgctggccgtctacggcaccgcgctggccggctgggcctccaacaacaagttcggcctgctgggcggcgtgcgcgccacctcgcagatgatcgcctacgaggtcgcgctcggcctgtccctggtcggcatcttcctcacgttctcctcggtgcagttcccggccatcattggtgacatcggcaacgcgctcaccggcggcaccggacagggccgctacctgtggcgcacggacggcgccttcgacctggggctgcccgcgtggggcatcttcatccagccgctgggcttcctgctcttcttcgccgcgtccttcgcggagaccaagcgcgccccgttcgacctgccggaaggcgagtcggagatcatcggctacttcgttgagtactccggcatgaagttcggcctcttcatgatctccgagttcgtggaggtcgtggtgctggccggcgtgacgacagcgttcttcttcggcggctaccacctgcccttcggcaacgagtggctggccaacctgcccatcatgcaggagcacggctggctgctgggcaccatcctgggcacggtgttctggctgaaggtgctgttcctcatctgggtgcagctgctcatccgctggacgttcccccgcttccgctacgaccagattcagtcgctgggctggaagatcctcctccccctcggcctggtgaacgtgttcgtgacgggtgcgctggtcctctgggatccgtccctgcgggcgctcgcggtcctcggcatcgcggagattggtatcctggtggtgttgaccacgacgacgaaggtccccgcaggcggtgcgcacggggcgcacgccggccatggtcacgaccacggacatggccacgcccacggtgggcacggtgcccatgacctgccggcgcacgcccacggcgtggccccggcctccacccactag

SEQ ID NO: 4613 - DNA, 1644 bp, Myxococcus xanthus
atcgacggcaaggaagtcgtggtgaagccggggacgaacatgatcgaggcggccaaggcggtcggctcggacatcccctactactgctaccacccgcgcctctccatcgcggccaactgccgcatctgcctcatcgaggcgtccaacgcgcccaagatggtgcccgcgtgccagacgcccatggccgaaggccaggtcgtcaagacgaccacgcccaaggtgaaggagcagcagcgcgcggtgatggagttcctgctgctgaaccacccggtcgactgctccatctgcgaccaggccggtgagtgcaagctgcaggactactacatgaagtacgactaccggccctcgcgcctggagggcaccaaggccctcaagaacaagcgcaaggtgctggggccccgcgtcgtcatcgaccaggagcgctgcatcatgtgcacccgctgcgtgcgcgtgatgaacgaggtggccaaggagccgcagctgggcgtgttcggccgcggcagccacgagcgcatcgacgtgttcccgggcagcgagctgaacagcaactactcgctcaacaccgtggacgtgtgcccggtgggcgcgctgctcagccgcgacttccgcttcaaggcgcgcgcgtggttcctgtccgccaccccgtcggtgtgcaccggctgctcgcgcggctgcaccacctacgtggactggatgtcgcaggactcgtaccgctaccgcccgcgggagaacgaggccatcaacaagagctggatgtgcgacgagggccggctcacctacaagtacctgaacctgggccgcgtgctccaggcgcaggtgggccgccgcaccaaccgcgccggtgaggcggtgcccgtcaccacgcgcaaggaagcggtccaggccgcggccaaggcgctgcgctcggtgcagggcagcaagcagctggcggtgctggcctcgcccctggcctccaacgaggacctgctggccgggctgaacttcgccaagagcacgctgggcgtgtccaccgtgtacgtgggcggccgtccttcgggctccgccgaccacttcctgatgacggcggacaagaaccccaaccgcaagggcctggagctcattgcgaaggggctgggcctcaagctggagaccttcgacgcgctcaccaccgcgctgaaggcgggaacggtgaaggcgctctacgccatcggcaccgaggtgccgggcaacgtggacgccttcgcggaggccgcgggtcagctggacgtgttcgtggcgcaggccttcaccgagtccgccatcaccgcgcaggccacggtgctgctgccggcctccgtccccgtcgaggacgagggctcgttcgtgcagcaggacggcatcatccagcgcttccgcaaggcgtacccgcccaagggcgacgtcgtccccggctgggagtgggtcagggagctgacgcgcgagttgggtggcgagtccacctggaagcgcgccgtcgacgtatggcgcgagctggctggcaaggtggccgagttcgcggagttcaactgggagaaggcgtctccggcggaccgggagaagccgggcatcaatccgctgccggcaggtgccgacggtcgccccgcggggtaccgtgagttcggcacgcctcgggtgaggggtatctag

SEQ ID NO: 4614 - DNA, 1779 bp, Myxococcus xanthus
ttggacagggtctccgcccagctcccagaggcggtggcggatcgctacgtggatcggaccggaggcgcctgggccgtcatccatgcagactcgctcccgaaggtcgccgcgttcctgaagaacgacccggagctggagttcaagctgttcggctccatcgacgccgtggatcggctgcacctggcggagaacgaccctcgcttcgaggtcgtctacttcctctactccctcaagcggcacgagcacgtgcggctcaaggtgcgggtgagcgaagccaacccggtggtgcccaccctggtgccgctcttccgcggcgccaactggtgggagcggctgaccttcgacttctacggcatccgcttcgacgggcacccggacctgcgccgcatcctcctctacgacgagttcgaggggcaccccctgcgcaaggactacgcgctgcgtgaccggcagccgctcatccccgagcgccccatcaaggacatcttccgcggtcccggcaccagcgggctctcctgagcgaggacatccatggctgacaccctcaagcccgaagcgccgaaccccgacaccgacgcgtacgcccacgagtcggagctggacgcccacctccagaccaagcggatggtcatcaacatgggcccctcccacccggccacgcacggcaccgtgcggctgaaggtggagctcgagggtgagacgatcgtcaagatcgaccctgagattggcttcctgcaccgcggcttccagaagagctgcgagaacgtcacgtggacgcagtgcctgccctacacggaccggctcaactacctgtccgcgatgatgaacaacttcgggttcctcaacgccgtggagaagctcatcggcctggagattcccgagcgcgcccagtacatccgcgtcatcggctccgagctccaccgcctgacggaccacctgacgtgcgtgggcgccaccggcctggagatgggcggcttcgcgccgttcctcctcgccatggagttccgcgagctgctccatgaccgcaccgccgagctgaccggcgcgcgcctcaccaccagcttcggccgcgtgggtggcagcaaccgcgacctgcccgagggctggattccccgcgtccacaagacgctggaccagggactggcgctgctcgacgagatggaaggcctgctgacgaacaaccgcatcttcgtggaccgcacgaagggcacgggtgtcatcagcgccgaggacgccatcgagtacggctacaccggccccgcgctgcgcgcgtgcggcgtggactacgacatccgcaagacgaagccctactgggtctacgaccggttcgacttcgacatcccggtgggcgagcacggcgacaactacgaccgctacctggtccggctcgaggagatgcgtcagtccatccgcatcctgcgccaggccatggacaccatccccgcgggccccatcatcgtggatgactggcgcatcgcgctgccgcccaagcccgaggtctacggcaccatcgaaggcgtgatgtcgcacttcaagctggtgatggagggcatccaggtgcccgccggcgaggtgtacgacgccaccgaggcctccaacggcgagctgggctggtacctggtgagcgacggccgcggccgtccctacaaggtccacgttcgcgccccgggcttcccggtgctcgcggccgtcccccacatcatcgaaggcaagatgctggcggacctcatccctacgtttgacaccatcaacatgatcggcggcgaggtcgagcagtga

SEQ ID NO: 4615 - DNA, 513 bp, Myxococcus xanthus
atgggctggctccagtccatcgtctccaagggcctcggttgggcgcgcaagtactcgctcttcacctatccgtacgccacggcctgctgcggcatggagtacatgtccgtggccgccagccggcacgacatctcccgcttcggcgcggagttcccccgcttctcgccgcgccaggcggacctgctgatggtggtgggcaccatcaacctgaagcaggcccccatcctcaagcgcgtctatgagcagatggccgagcccaagtgggtcgtggccttcggcgtgtgcgcgtcctcgggcggcttctacgacaactacgcggtgctccagggcatcgaccgcatcatcccggtggacgtctacatccccggctgcccgccgcgcccggagcaggtgctcgacggcctgatgctcctgcaggacaagattggcaaccaggtccaccgcatcgcggagcgcgaggaggccaaccccacggccgctcggcacaacctgctgctgtccatgaacaagtaa

SEQ ID NO: 4616 - DNA, 372 bp, Myxococcus xanthus
atgactccgactcccctcacgccatacctgccgctggccgtcgtcctgctgctggcgggtggcatggcgatgctcattccccagatcaccacgcggctgggtcctcgccgcccgagcgccatcaaggcgaccagcttcgaggccggctccgagtcgagcggcccggcgcggcagcgcttcgcggtgaagttctacgtcgtggccctgctgttcatcgtgttcgacgtggaagcggtgttcctgtacccctgggcggtgaacttccaggcgctcggctggttcgggtacgtggagatgctggttttcgccgtgacgctggtggtcggccttatctatatctggaagaagggcgccctggactgggagagctga

SEQ ID NO: 4617 - DNA, 237 bp, Myxococcus xanthus
atggcgcaaaagaaggcgaagcgagcgaaccgagacctggagaagacgtacccgcgcaaggacttcgtcgcgaagctgcggcggttggcggacgccatcgaggagggcaaggccttcaacatccaggtcgctggcgagcgcctgcgcatccccgccgacgcgctcttcaacatcgagcacgagcgcggggacggcgtggacgaggtcgagttccagctgcgctggcagcgggagtga

SEQ ID NO: 4618 - DNA, 198 bp, Myxococcus xanthus
atggaccgcatcgccacgctgtacgcggagccccgctccagtgtcgcacgccacgtggcccaggcccgtgagcggctcctgaagctgacccaccgagagctggccgcccggctgaagctggacgggcgcgaggtggagagcctcctgggcctggtccagagccgcctggacctcagcctccaccgtctgatgagctga

SEQ ID NO: 4619 - DNA, 432 bp, Myxococcus xanthus
atgagccaggctccggaaacgctgacgccgctgctgctcgcgggggcacccgagtcactgcacgacacgctgcgctccgcgcccgcgctggaggccctgctcacggagctgctcgaccaaggccgtgcggcgtggcccaccgtggcgctggcgcccgcggccctgttgcaccacgtgggccggcacctgcgcgaggaaggcacacccctggatgcgctcaagcagctccatgccgcggacgtctacctggcatgtgcctgtgcccagggagagccccaggcgttgcagctcttcgagaagcacgtcctccagaaagccgccgcacgactgtcccggcacctcacggcgatggtggacgaggtgctccaggtgacgcgccagcggctgctactggacgttcacggctgcgcgccgaaaatcgcggagtactag

SEQ ID NO: 4620 - DNA, 3117 bp, Myxococcus xanthus
atggggtgcccgagcgagacgacactgagcgacttcctcgaaggggcgctcccggacgcgcaccgcacgcgcgtactggcccacgtggaaggatgtgagcgctgccaggagcacctggccctgggcgccagcgcggcggaggccgtgcccccgcccgtcgagggcccgctggtgaccacgggcacccagctctcacgctacgtggtgcagcagcgcattggccggggcgccatgggcgaggtgtacgcggcccatgacccggagctggaccgaagggtcgcgctgaagctgctgcgccccgagggccgacacctggaggagctgcgcttgcggctgctgcgcgaggctcaggccctggcccggctggcccatccgcacgtcgtcactgtctacgacgtgggcgtctgcgaggactgtgtcttcctggcgctggagttggtggagggcgcgtcgctggcggagtggctggaggcgccgaggccctggcaggacgtggtgcgcgtcttcgtggacgcgggccggggactggcggccgctcacgccgccggactggtccaccgcgacttcaagccaggcaacgtgctggtcgggaaggatgggcgcgtgcgggtgacggacttcggtctggcccggccttcccaccggggagtctcgggccacgccgcgccagcgagcctggacacggtgacggcgccggcgtcgctggtggactcgccgctgacccattcgggcgcgctgctgggcacgcccgcgtacatggcgcccgagcagcttcaaggtcacggcgtggacgcacgctcggaccagttcagcttctgcgtggcgctgtacgaagcgctccacggcgtgcgccccttcgagggccggacgctggaggcgttgggtcaggccgcgcgggaaggacgcatccgcgcgccagagcgcgagtcgaaaatcccggcccgagtgcggcgcgccgtgctgcggggtttacgagcccagccggaagagcgcttcccatcgatggaggcgctgctgaccgagctggccccccgcgctggaaggcgccttgcctgggtgggcgcctccacggccgtggcgtgtctcgtagggctcaccgtgggctacgtggcggcgcatcggaggcaggcccgctgcgagttggaggcggagcggctcaccaccatctggggaccggagcgccgtgcgcgaatccacgcggccttcctggccacgggaaagcccttcgccgccgccgcgtgggaagccgtcgccagcacgctcgacggacacgcggacacgtggcgcgagctgcgcaccgacgcgtgcacggcctcgcgcgatgccccccatgcatcatggcagacggccgcgtgcctggacacgcggctgtggcacctggccgccgtcgtcgacgtgctggagaaggcggacgcgcgaacggtgcagcacgcgccgcagatggtggcgtccctggagggcgtctccggctgccgggatgctccggagctggcgaaccggccgcagcctccggatgccctgcggcctcgcgtggacgcggcgcgacgcaagctggccgaggcgcgggcccacatggacgcgggcaaccaccccggcgcgctgaaggagacgacggccttgcttcaggacatccaggggctggactaccggccgctggaggcagaggtcctcacgctgcacggctatgcccatgggctcgcgggcaagcccaaagaagccgaggagcacctctacaaggcgctgtgggccgccgaggcgggccgcgacgacgaaaccgtggcccgtgtctggaacctcctcctgtgggtggtgggcgaccagatggcgcgcatggacgaggcgaaccggctggtgcaccacgcccgcgccgcggtggagcggctgggccgggagcgcttcccgcacatcgccaccgacctgcacctgcgaatgggcggcttgctcctggtgcagggcaagctggacgaagcggacgcggagttcacccagggactggagctggcgcggaggaccgcgggcccctcacggcctcgcgtgacgtacttcctcaccggactgggacgcgtccgctcgcgccagcttcgcgcggaggaggccctggcgctctaccaggaggcgcaggcctacgcattccaggagcgacagtggagccccgagcacccggtgctcgcgctcaacctcaacaacatcgccaccgaactgctcgccctgggccgcacgcaagaagcgctcgacacgttccaacgctcgctggcgctgctggaggccgcgcgctccaaggaccacgcgagcctggccgcccccctcaacaacctggccggcctgctgcgccgcgaggggcgcctggaggaagcccggagccactatgcgcgagccctggccatcttcgagcgcagcaaggggacggaccaccccaacaccgtcaccgcgctcggcgggctgggcatggtggcctatgattccgaccagctcgacgaggcgctcgcccacaaccagcaggcgctggagcgcatccaacgcagcgtgggccaggactcgccgcgcctggagatgtcgctgcgcaacctgggcctcattcacctgcgcgcgggccggccggcggtggcgcggcgcaacctgacgcaggcgcttggcctcctccagaaggcgaacggcaccgacagcgtggtggcatgtggcgtggagcgggacctggcccgggtggacctcgagacgggcgcattccgggcggcactgacccgctgccagcgcgccctggcgctggatgaagccgcgcagggtgacgacagcccggacgtcgcgctcgacctcgcctgcctcggcgaggcccacctgagcctgcgcgcgccggagcgagccgtcccgttgctcgagcgcgcacggcgcatccatgctcgcgtgtggctggaccggaaggaagccgcgcgagtgtccttcctcctcgcacaggccctatgggaacggcccgccccggaggggcgcgagcaggccacggccctcatccacgaggcgaaagcgtggctggaagcccagggtctgcgcgcccggcgcgaacacgacgagctcgtggcatggcagacgcggcacctgccccgtgtgagcgaggtcacccgatga

SEQ ID NO: 4621 - DNA, 813 bp, Myxococcus xanthus
  unsure (1)..(813): unsure at all n locations
gacntgcactcgcacaccactgccagcgtcggtcaatatgctcccacggagctgctggcccgcgccgccgccgccggggtgtcggtgttggcgattaccgaccacgacaccgtcgcggggttggccgaggccgaggtggcggcgcgcgcccacggcgtggagctggtgccgggcatcgaaatctccgcgttcattcatggacgcgagtgccacatcctggggcacttcctgaggccggacgacgaggacatcgctcgcttcgccgaccggctccgactggagcgcgagcagcgcatggaagccctgctggagcgcatgcggcagctcggctaccccgtgcgcatggagcacgtccgggcggtggccggcgacgcgcagttgggacgtccccacctggcccgtgtgctggtggaccgcggctgggtggtggacgtgaaggaggccttcgaccgcttcctgggcatgcgcggcgccgcctgggtggagcgcttcaagctgacgggcgaggacgccatccgcctcatccgcaacgcgggcggcacggccaccctcgcccacccgggttcatcgcgcatggagcgactggagatccgcgcgctcgcccaggcgggactggcgggcctcgaggtactgcacgaggaccacaaccccagcgtgcgccagaagtatctcagcctggccaaggagctgggcctggtccccaccgctggcagcgacttccacggcgaggccatctccgccgaccaccggctgggcaccgcctccatgcctcccgagctcttcgcccgcctcaagtcacgcgcccaggcctga

SEQ ID NO: 4622 - DNA, 1434 bp, Myxococcus xanthus
ctctacggcgtgcgccgcatccacctggtgggcgtggcgggcacgggcatgggctccttcgccggcatgctcaaggccgccggctacgacgtcaccggcagcgacgagaatgtctacccgcccatgagcgacatgctccggacgtggggcatccccgccgccacgccgtaccgtccggagaacctggacgcggcgaagccggacctcgtcatcatcggcaatgtcatccgccgcgtgaatcccgaggccaccgccgtgcgcgagcgcggcctcaagcagatgagcttccccgccgcgctgggctcgctcttcctggaccgctcgcactccgtcgtcgtggccggcacccacgggaagacgacgacgtcctcgctcatggcccacgtactggtggcggcgggcaaggacccgtccttcctcgtgggcggcgtcacgcagaactacgcgggcaactaccgcgtggggaaggggccgcacttcgtcgtcgagggcgacgagtacgacaccgcgtactgggacaagggctccaagttcctccactaccggccgcgcaccgccatcctcaccagcgtggagttcgaccacgcggacatcttccgcgacttgccgcactacgaggcgaccttcgagaagttcgtccggctcatcccccaggacgggcagctcgtcgtctgcgccgcctaccccaacgcggtgaagctggcgcgcgagggttgcccggggcgcgtggtgacgtacgtggcgaaggagggcgcggacgcggactacacgccgcgcaacctgtccttcggcccggagggcgcgcgcttcgacgtggtggcgcgcggcgaggtgcagggcacggtgcagctccccatgggcggcgcgcacaacgtggagaacgcgctggccgtcatcgccgcggcgcagggcctggggctcaccttcgacgaaatcgcgcaggggctggccaccttcagcggcgtgaagcgccggcaggagattcgcggcgagccagacggcgtcctggtgattgacgacttcgcgcaccacccgacggcggtgcgggagaccatcgccgccatccaccaccgctacccggagcggcggctgtgggccatcttcgagccgcgctccaacaccagccgccgcaacatccaccaggaggactacgcccacgccttccccggcgcggcccgcgccagcctcaaggtgcccgagcgccacgacaaggtgcccgtgggcgaggaactggacgtgcgcaagctcatcaccgacctccaggcccagggcattcccgccgagggctccacggacgtgcaggccctggtggacctggccgcccgcgaggcccgtcccggcgacgtgctgctggtgatgagcaacggggcctttggtggtttcatcgacaaggtgctcgcggccctcgcggcccgggcgcagaagggagcctga

SEQ ID NO: 4623 - DNA, 2019 bp, Myxococcus xanthus
gcccctccccaccgctggaccctcgccgacgcgcatgagctgtacggaatccggaactggggcaacccctacttcggcatcaatgagaagggccatgtcatcgtccacccggacggtccccaggccccgaacatggacctgaaggagctggtcgacgaagtgcgccgccggggcatcggcctgccgctgctcatccgcttcacggacgtgctgcgccaccgcgtggtccacctgaacgaagccttccgtaaggccatgagcgatcaggggttcaagggcggctaccgcggcgtgtaccccatcaaggtgaaccagcaccgctacgtggtggagaccctcatcgaggcgggcaagggctacaactacgggctggaggccggcagcaagccggagctgctcgcggtgatggcgctgttggagaacgagaacgcgctcgtcatctgcaacggctacaaggacgaggagtacatcgagacggcgctcttctactcgcgcctgggccgcaacgtcatcctggtggtggagaagcccagcgagctgccgctcatcgcggaggtcgcccggcgcacgggcatcgccccccggctgggcattcgcgtgaagctgtccacgcgcggcgccggcaagtgggaggccagcggcggcgaccgctccaagttcggcctgacctcctccgagctgatgaactgcatcggcttcatgaaggacgcgggcctgctcaactccttcgagctgctgcacttccacctgggcagccagatttccaacatccgcaacgtgaagaacgcgctgcgtgaggtgggctgcttctacgtggaggtggcccgtcagggcgcgccgctgaagtacctggacgtgggcggcggcctgggcgtggactacgacggctcccagacgaacttcgcctcttccatgaactacaccacggaggagtacgccaacgacgtggtgttcggcgtcatggaggcctgcgaccgggccggcgtaccgcaccccacgctggtgtcggagtccggccgcgccgtggtggcgcaccacgcggtgctggtggtggacgtgctgggcaccagtgagttcggcccggcgccggtccccgacaaggtggacgagaaggccccctccgtggtgcgcaacctctggtccacctaccgcgaggtcaccaacaagaacctgctggaggcgtggcacgacgcgcaggacgccaaggaggagagcctcaccctcttctcgctgggccacctgtcgctggagcagcgcgtggcggcggagaacatctactgggccacctgccacaagatcatgcgcatcgcgcgtgagcagggcgagattcccgaggagctggactccctggagaaggcgctcaacgacacgtacttctgcaacttctccgtgttccagtcgctgccggactcgtgggccatcgaccagctcttcccgatgatgcccatccaccggctggcggagaagccgacccgccgcgcgacgctggcggacatcacctgcgactcggacgggaagatcgagcacttcatcgacaagcgcgaggtgaaggacgcccttgagctgcacgcgctcaacgatgacgactactacctgggcatcttcatggtgggcgcctaccaggagatcctcggcgacctccacaacctgttcggcgatacgcacgccgtgcaggtgtcgctggggcccaacgggggctacctcatcgacaatgtggtggccggcgacacggtaacggaggtgctcaactacgtcagctacaccaaggacgacctggtggcgaagctgcgcaagttcactgaggccgcgctgcgccagggccgcatcaccctggacgaatcgcgcaacctgctgcgcatgtacgaggatggcctgtccggctacacgtacctggagcgcgaggtggacgcaagcttcggcagcagcgccagccagctccgtctggtgcccacgccggacgcctcgggcgcccggcccacgacaccgcccgccggcgcgtcgggaacgtcgggcacctga

SEQ ID NO: 4624 - DNA, 756 bp, Myxococcus xanthus
atggtcatcgacctcatcatcctcggactggtgctgttcttcgccatgatcggcgccatcaccggggcgtcgcgccaggtcgccaacgtggtgggcctggcggtgggctacttcgcctcgcgccgcctgggccccgtggcggccccacacctggccgaggccctgggcagtccgctcttcctgggcgccatcgtgggcacggtgctcctgttcatctgcacgtggctcgcggtgcgctacgccctgggcgcgttgctgctgcgcatcctctccaccggtcagcacaatgagaaccggggcgtggaccgcttcctcggcttcgtgctgggcggcgcgaagatgggcatcatcgcctgggtcgtcctcagcgccatcgccttcttcgaacagcacgtcgtcatcgcgggccgccgcgtgggcctgtccccgaaggagtcgctctccatcgaagtcgcccgccgctacaacctcttcgagatgacgcagttcgccccggtgaagaatctggtggaggtcgccaaggccgccggtgatccgaagcgcgcgggtcggctccaggacgacccggcctacaaggccctgcgcaaggaccctcgcttccagcgcctgctccaggacccgaagctgaagcaggccctggcgcgaggagacaccgccgcgctgctgcgccacgacggtgtgctccagctcatccaggacccggacgtggcggcccggttgggcgccgcggcccgcgcctccgagcgcgagccctga

SEQ ID NO: 4625 - DNA, 522 bp, Myxococcus xanthus
gaccaactcgactacttcgaagtgctcatgctggagaggaccgccacccccgcggacatcaagcgcgccttctaccgggagagccgcacctaccacccggaccgcttcttccacatggactcgaaggagctgaaggagcgcatcaacgatctctacaagcgcgtcaccgaggcctactacgtcctgcgcgacgacacgaagcgcaagaagtacgtcgtcgacgtgacgggccccgagcgcgcccagaagctgcgcttcaccgaagcctccgaagcggagaccaaggccgccgccaagaaggagcaggaagagcagatcggcacccaccccaagggacgccagttcttccagcaggcgcagaaggacgcggacgccggcaactggtccgcggccgagcggaatctgaagatggcgctcacctatgagccctccaacgcccgctacaaggagcggctggcggaggtccagaagcagtcccaggacgaggcgcgcgacaagggcggctcgttcaagatccgctga

SEQ ID NO: 4626 - DNA, 1596 bp, Myxococcus xanthus
atgcgcatccgctccgactcggacccggagggcacgtgggcgccggtgcgccaggctttctccgacggcatctaccatggcgcggcgttgagcgcggtggcggatgggaaagacggcatgcacctcgtctacaaggatgagctggagcagctctactaccggcacttcgacgggaacagcttcggttttcgggtgctggtagagagcagctcggactgggcgacccagcctgccatcacccgcatcggcgatacgttgtatgtcttctacaaccgggtgcggacgctcaacgcgaactacgagctgcgcgtgcgcacggtgggcgaggatggaacgcttgggagcgcggtgacgctcgacggggatgcgacgttcaagggttatctcaacgccgtggatgtcctgccggagggcagcggcgaggtgccctgcctctttggtgaggcggtggacgcgggctcgcggggctgggtatcgcgggtatcgctggtgctcgatgaagcgcctccgccggacccggacccggggccggggcctgggcctgggccggggccggggcctgggcctgggccggggccgggtcctttcgtcctggagctcgtgcgctcccattccacgcacgaactgctcgcggtggacggggccggcacgctgtacggcattcccgctgagggcccgcgttcgcggttgatggcgagcacggacggtgggcgcaccttttcggatcgagggcagcggggtggcaacctgtggacggtggcggcgatggagggggggacgctcctgtcggtggccagtcacagcggagagtatgtcctccagcgctccacggatggggggatgacgtgggggaacccgctgcgcctcggtacgtatcgtgcgcgggggccccagagcttcgcgcgcttggggagcacgtggttcttcctcgagtaccagacctttacctcggccgccgtgccgcttcggctatgggcctccacggacggcggggccacgtggtccgtgcgctccatgttcacggcgcaacggcacggcgatgccctggtggcggacccggcgacgggaacgctgtgggcgaccatggggagcagcgaggcgcaggcagcagtgcttcgttccacggatggggggcggacctggacgtcactgttgcgtggctatgaggccaatgcccagacgggggtggtgcacacaggcggggcactcctcttcggccagtcaacgttgttcgagcccgagcacccgaagctcctgagcctgtccccggaggggaccgtgagttcgctgatggagctgccggggccggcgtactcgctcaccgcggtgcccgggggcgggtgggtgatgggcacggcgtggtcccgccatggggacgtccatgcgtccggtgatgtgttcgcgcgactcttcatcagcgaagacggcgtgacgtggcaggagtcacgcaggttcgagcggatgagcggtgcggacctgacgcgcgcggatgtctggggcacgttgccatccggagagctggtggtgcgcgtggaggatgcaagcggcttcgggagcgcgggcgtgggcttccaggtgcttcgcgtcaagcgttga

SEQ ID NO: 4627 - DNA, 522 bp, Myxococcus xanthus
atggtctctctcccctcggacgtgctggagcggctgcgagaggacctggcccgtgcggtggcccgggtgtgtccgcctcggatggccgatcgccgcgatgacctggtgcagacggccatgatgcgcgtcatggagttgcagcggcgcgagccggaccgcagccggttgacccccgcctacctgtatcgcgtcgcatacacggcgctggtggacgagttgcgcaacgtgtcacgccgccgtgaggtccaactggaagaggtggagtcgctgtccgagccgccggtggcatcgagcgacccggagaaggccgcgggcggctcccagattgcccaggccgtgcgcgactgtctgcgcaagctggtccaggaccgtcggctggcggtgacgctgttcctgcagggccacagcgtgccggagtccgcgcggttgttgggctgggacgacaagcgcaccgagaacctcatctaccgcggcctggccgcgctgcgcctgtgcctctccacgaagggattcgagccgtga

SEQ ID NO: 4628 - DNA, 330 bp, Myxococcus xanthus
atgcgggatgagcccgagccgccgcggctgcgtggcggcgatacggcggcggtcgcctcccaggtgccagaggcggtgcctctcaagcgcgacgcctgtgtgctgcgctggagcggcggtcccgagggaacccgttggtcggtgcggttgtccacggaggacctgggttgggtccaccgcgtggactcgctggagacgcgtgagtaccgggtgcccgccgaggtgctggcgccgttgcatccgggaacgacgttgctgtggcaggtggaagcgcggttgccggacgggcaggtgcttcgcggcgccacgttcgtcaaccggttggagtga

SEQ ID NO: 4629 - DNA, 477 bp, Myxococcus xanthus
atgggagtggccggtggggcagggcaggcctggagccagtcggtccccgtcacccgcgcggtgaagacggccttcagttacggcgaggcgcgcgacctggtggtggcctcggtggtggagacgggcgtccgcacgggccaaagccagttcgtgacgctccaactcctcgaccactccggtgccgtcgtcgcgcagaccgcgggtgtggtggaccaggagacgcccctgcggctgacctaccggacccccaccgcgaccccggtgttcgcgcgcgccattgcgacggtgagcgcggaaaccctctccgcggcggcggtgacggtggagcgttggtccgttgcggagccggcctcctggaccggagccctcgtttgctatttcgagctggttccgatgcccaggcctccgcctcctccccccgggccggtgacgctcaagtgcgagcccgtcgacccgccgcctccgcccacccgctga

SEQ ID NO: 4630 - DNA, 2649 bp, Myxococcus xanthus
atgctgtccagcggcaaggaggcggaaggtccctatcttcgcgcggcgcagacgttccgccggctccaggatgcggagggcgaggtgctggcggccatcaacctgcgcgccatcctcttggctcaaggacgaaccgaggaggcctgggattggacgcggcgcgtggtggaggtggcgagcgcctccggtcggccggagctccacgcacgcgcgctcatcgtcgaggccagccagctttatgaggtggagctcgacctgggccgggccttccgtgtgctcaagcgagccgagtcgctcgtcttcccggacggcgcggaagggctgaagaagcagtacctgtccgtcatgagtacggtgagcgagcggctgggccggttggaggaggcctcggacgtcaatgcccggctggtggagttgacccggagcactggcgacctcttcctggaagcgcatgcgcgcttcacgctcgccaacgtcacgctgcggcggctcgagcgtgaccatgtgccggcggaccgggcgcgagcgttggagttggcgcggcaggccatggccgccgcggagagggcggggaacccaacgctggtggcccgggcggtgcgtctcacggcggacctgttgggagacacccccgaggatcgccgtgaggcggacgcgctcatggagcgctgcatggcgctcgcggagtcgctggattcggacgagcggcggttggcgtgtctctggacgcgcgcggagcggcgggcaggcgtggacccgaccggagccattcaggactcggaggcgtcactgcgactggtctccgaagtaaacgacccgctgttccatgcgctggcccttcgaggccgcagcacggtggcgtaccggacacagcctttgccccaggcactggagcatgccgagcgcgccctggacgcgctggaggccctgcgccagacgcagagtgacgcctccagccaggcggagctgttcgcgacgtgggcccgcgactaccaccggctcgcggggtggacgttggaggctggcggggcgacgggcaagcccgctacgctccccttcagggaggctgtgtcgcgggccttcgccgtgagcgaacggctccgggcgaggacgctgctcgatgccctggtcgccttccgagcacgcgcggactccggggacacgcccgagcgccgggcgcagcgaagcgaggtgcaatcgcggctggtggtggtccaacgccagctcttggacccgtcgctgacgagcgctggacgcgaggcggccctgaatgaactccaggagttggagcaccgcgagcgggacctgcgcccggcgcctcacaagagtgtgcaggagttcgcctcactggcgtccgtggagaaggggctgagggaggacgaagcgctgctggtcttcctcgtgggggacgacgaggacctctccggaacgtcggcgggtggtgcgtggctgttcgtggtgacaggggagggaacccacgtccatcgcatccccgagcgcacgcggctcgcggcggcggccacgctgttctccgggctcgtcgagcgcagggatgactccgagcgcggtgcggcggtggcgcttcatgcgcagttgctcggcccggcgctcgcgggattgccacccacggttcggcggctgctgttggttccggacgggccgctgcatgacctgcccttcgccgcgctgcgggagcgtcgggacgggccacccctggtcgctcgctacgaactggccctggtgccctcggcgagcttgtggcggcactggcacggggaggccccattcacgcctatcggtgatgcactggtgctggcggaccctgagtgggccctgaaacagaggggggcgcggcctgcggcgcgctctcgggctggaatcttcgacgaggccgcgcagctcggcgcgctgcccgaggctcgtcgcgaagggctcggggtggagcgggagcttcgaggcacccgcgtcgtcccccggctgctggtgggcacggaagcctctgagcgcgcgctcaagcgcgcggacctgccgctgctccgggttctgcacctggcggcgcacgccgtggtggacgccgaagcgccggagcgctccgcgctcgtgctcgccccgggctcggaggacgaggacggcattctccagccgcgcgaaatcatccagctgcgtctcgatggcgcgctggtggtgctgtccgcgtgccgcagcgcctccggagcggtgctgccgggagagggcgtgctgagcctcgcacgggccttcttcgaggcaggctcgagcgcggtggtggccagcttgtggccgttgcgcgacgaggaagcggcggacctggtggagcatttctaccggcacctggccaagggcttgagtgtctccgcggcgctgcgggccgcacagctcgaggccatcgacgcggggcttccacccgcggcctgggcagggctggtggtgctcggcgatgccgcgctggtggtcgccgcgcctcgcgaggatggtgcgcccatggtgtctggactggctggggcgcttgtcattgtcgcggcgttcctcgggctcctcgcgttgcggcgctggggccgttcaagctccgaacgttccacgccagtgaggcgcgcgggagatgcccgaggtcaccgattcagcggtcgatga

SEQ ID NO: 4631 - DNA, 468 bp, Myxococcus xanthus
atgaacgcaacccgctggtttggactcgcttccctgaccctgctgctggcctcgaacgccttcgccgaggacaaggcccccgccgcgaccaatgccgccgtcggccggtggacgaccatcgatgacgagacgaagaagcccaagtccgtcatcgccatctacgaggagaacggcaagctgtacgggaagatcgagaagctcttccgcgagcccaaggaagagcagaacccgctctgcgacaagtgcgagggctcgctgaagaaccagcccatcatcgggatgaccatccttcgcgacctgaagaaggatgatgacgagtggtccggcgggagcatcctcgacccggcgaatggcaagacctacaagtgcaaggtcgccgtcgaggatgggggcaagaagctgaaggtccgcggctacgtcggcatgtcgctgctgggccgcacccagtactgggtgcgcgccgagtag

SEQ ID NO: 4632 - DNA, 1308 bp, Myxococcus xanthus
atgaagaccgtgagcggcctgtcgacgctcaatggcctggacgacgcgatggcgctgttcggcgctggcttcgagggcgtgccgctccctgggctgcaggtgggtgacgaaggcgaggcgctgtccaccttgttcgacgcggatgaagtggacgcgcaggcggacgagttggagcggttcctgcgcgagcgcgtcttcaccgaggccaacgtggagtccacggaggacaacgccaccgtcttccgcttgaagggcgagcagatctgcacggacggcagggcgcctgcggacgcggactgtgtccgcttcgtggatgatgcgcagctgcgcgttcgcgcgacgaacctgggggacgactccctggagttggagttgctcatcggcgcgaagcgcgcggagccgctggcgctgcgcttcctgccgaaggccgtctcgctggtggtggacctgggcggcttgaagggggcggtggagcagctcgacgccgagtcggccgggttcctgccgaaggtgatggtggggcaggttgagctcaaggtgacgaaggagggcgagtcgcactggattgtcagcgcctccatcctggacgcgctgcggctggagctggcgctggaggggagcaccttcgcgttctcctccgcgcgggcggtgccgctcgtggcgttcgaggcggacggccaggcgaagcgcgcgcgcttctcgctggacctcaacaccacggaggttcgccttccttacacggggttggcgccggcgctgcgtggcaaggattggacggtgtccctggccggcatctcgtactccgtcgaggcgacggagaaccagacggacttcgtggtgaagaacctgggccttggcgacgcgcagacccacctgagcctggggaacgacaagctcttcgcgctggacctcaatgagcagtcgggtcggcacttcgacgtgacgctgacgcgcggggcggacggcgcgccgctgctgaaggtgcagccggagttcgacctggtgacgcgcttctacctggcgccgctgaaggcggaccccgcgtcggagatccccgcggcgtatgaggacgcgacctatcggctgcgtctcagcgggggcgcagggggaccgagcttgcgcgcggcgcccgccaacagcgccacgggcttcaagggcggcctgcaggtggtgacgggcgagctgctgctctccgcgaatgactcgcaggtggtcgtcgcccaggggcagtgcctggtgggggcggagccggcttcagagaacgatgcttcgctgttgtcgtacctgcggcagggcagctgcgagtag

SEQ ID NO: 4633 - DNA, 486 bp, Myxococcus xanthus
atgccgcgcctgccattcgccgtcgtcgttggggcgctcgcgctgtccggctgtgcgagcgctcccgccattccgcctctggggccagaggggcaggggacttcgcagcgcagcgggctcaagggctcgcagccgctggacttccaggtgaagcgctatcccggcggcgagccgtatgacctcgcctcggaccggggcagcgtggtggtgctcgacgtgtgggccacctggtgcgagccctgcaaggacgcgcttccctactaccaggacctcgcgaacgagtacgcagcccagggcctgaaggtgtacgcgctcaacatcgacgaggacccgcgcgccatccccgccttcctggcggagacgaaggtgacgctgcccatcctcctggaccagaacgcccaggtggccgagcgcaccctcaaggtgcgggggcatgcccaccacgtatttcatcgaccgcaagggcatggtgcgccacgtccatga

SEQ ID NO: 4634 - DNA, 924 bp, Myxococcus xanthus
cggaaacccgcggacggcttcgcgctcgcgagcatgctcgcgttgtgcgccatctggggcatgcagcaggtggccgtcaagctggccgctccccacatcccctccatgatgcagatggcggtgcgctcgggtgtgggcgcgctgctcgtggggctgttgtgctgggtgcgcggcgagcgagggctcttgcgccgtggcccctggcgtccagggctcgtggtgggcgcgctcttcgccctggagttcctcttcgtcggcgaggggctgcgccacacccacgcgtcacatatgggcgtcttcctctacaccgcgcccatcttcgccgccctgggcctgcactggctcgtgcctgccgagcggctgcggcgcacgcagtggttgggcatcgccgtggctttcgtaggcatcgcgctggcctttggcggtggctggctccaaggcgacatcagcccgggcgtgctctggggcgacgcgctggggctgctggcaggactggcctggggggccaccaccgtggccattcgcgtgtcggcgctgtccgatgcgccccccacccagacgctcctctaccagttggtgggcggcgtcgcgctcctgctgccggtggccctgctcaccggtcaggccggcccgatttcaatggcgcccattgcctgggcaagtctgttgtttcagggcgtcatcgtctgcttcgccagctacctcacctggttctggctcctgcgccgctatcttgcctccaacctgtcggtcttctccttcatgacgccgctgtttggcgtcagcgcgggcatcctggtgctgaatgagcaggcggatggcttcttcgccgtgggggccgtgttggtgctcaccggcattctcatcgttagtggttcgagcctgcttcggcatcagcccacgctgaagacggggacgacctga

SEQ ID NO: 4635 - DNA, 555 bp, Myxococcus xanthus
atgaaggcgaaccgaatcgtcctcgtgtcgggcccgtcaggtgctggcaagtccaccgtggcacgtggactcgcggagcagtctcccctggcgcgtgcggtccacctgcatgccgacgacttctattcctacatccgcaagggtgcgctggcgccctggctgccggagtcccacgctcagaacaccacggtgatgacggccctggcggcgagcgcggcgagttatgccgtggacgggtatgaggtcatggtcgatggcgtcattggcccttggttcttcgaaccctggcttgtcgccgcccggacgcatcggcttgacttgcgcctcatcgtcctgcttccgggcgaagcggagacggtggcgcgtgccacgaggcgtgtccacgcggacgcactcaccgacgccgacgtggtgcgtaacatctggcgcggattccgcgaggtggccctccccgaggggcatgtgctcgacaccagcaatcaggacgccgcggagaccgtgggcgccgtgcgccgtgggttggcggacgggcgcttccggctggagtcaccgtag

SEQ ID NO: 4636 - DNA, 702 bp, Myxococcus xanthus
atgacctacaacgtcctctactccgctcccgaggaggacgtgcagaagtcgctcgatgtcatcgagaaggaggcgcccgatatcctgtgcctgcgtgagctgacgccgagattcgccagggcctttcggaagcgactggggaagcagttcccccacgtgcggctggtgccgcgaaagggaacctggggtgtgggtatcgccagccggtatcggctgttgcgaacggagcacttcccccagacgccacacaggatgcccgcgctggaggcggacatccggctcggtgagcattgggtgaaggtggcctgtgtgcacctgatggcgccaggtgccaggcatcagcgggcagatgacctgctcacttccatggagaagaacgcggtgcttcggcatcgtcaggcggaggcgctggtgcggcgctatgcgcggtggcgaggaccggtcctggtgctgggggacatgaatgaaggccgctcaggcaaggccatgaaggccttcgcctccgcgggtttccagcacgcgtgtgacggaccggacgccgcctgcggtgccacatggcctggcactgcctccgtcctcccgagcgtcgtcgaaatcgaccatgtccttggccgcgaacttcgcctgagcggtgcgaaggtgctgcgtgcgggaggctcggaccacgatgcggtccgggcgacgctggactttccactgtga

SEQ ID NO: 4637 - DNA, 261 bp, Myxococcus xanthus
atgcaaggcaaggggtggaagtggctcacgctggtgggcctgggggcgtcgctcgcggcgttcaccgggtgcaatgagcagtccgcgcgggagaactcgcggcaggtgggccgtgaagtagggaaggcgacgaaggaggttcaggaaggcgctcgggaggccgcgaaggaaacccatggcgcggcccgggaggcggcgcaggggttcaaggaaggccggggcggctcggggaatcccgacgccggcgtcgacgctgattga

SEQ ID NO: 4638 - DNA, 690 bp, Myxococcus xanthus
aatgcgggtttctccggcgttgcacctcgagacatgagcgtgtaccccagcggcgcgccgtgtcctcgcggtgtccgattctggaggctccgcctgacgctcgccgccactgcccgccactgcccccgcgtgctcgccgatgcgctcgcgcgttcccgggcccacgacgtggcgctcgtgctcggcggcgcgctgctcacggcggggctcgcgcaggtctcaatatcggtaccaggttcacctgttcccatcacgggtcagtccctgggcgtcatcgtcgctgccgcggcgctcggccccgtgcgaggcatggccgcgcagttcctgtacctcctgatgggcgcggtgggcctgccgttcttcgcggagggcgccagcggcctggaacgcatcctgggagcaaccggtggatacctggtcggcttcgttccagccgccttcctggtgggactggcggcgcagcgtggattcgaccggcggccgtggaccgcgctgccgctctttgccgtggggcagttggccgtcttcgcggtcggcctgccctggcttgtcctgtccgcccggctcggcgtggccaaggctcttggcgtcggcttcacacccttccttcctggagggctcctcaaggccgccatcgccgccgtgctgctgcccctcgcgtggcggctggtggggccgcgcaaggtctga

SEQ ID NO: 4639 - DNA, 1485 bp, Myxococcus xanthus
atgaccgagcccgagaagcaacggcgcttcagcggcgtcaagctggtgattgccgtggcggtggccgccgctctggccgccgctggcgtcaccgcgctcctggtcaacatcatggagcgcaagcaggaggcgaagaatcccttctaccgggtggtggagctggacgacaccatcaccgaccccgaggtgtggggacggaacttcccgcttcagtacgacagctacaagcgcaccgtggaccagcagcgcacccgttacggcggcagtgaagccgtggcgcgcacgccgtcccaggcggacccacgcaccgtcgtcgcgcagagccggctcgaggaggaccctcggctggtgacgatgtggagcggctacgccttcgccacggacttccgcgaggagcgcggccacgcgcacatgctggacgaccaggtctacaccgagcgccagcacgtgacgcagcagccgggcacctgcatccactgccacgccagcgtgtacgtgccctacaagaagctcggcgacggcgacctcatcaagggcttcgagaagatgaaccagatgcccttcatggaggcgcgcaagctggtggagcaccccgtctcatgcatcgactgccacgaccccaccacgatgcagctgcgcgtgacgcggcctggcttcatcgagggcatcgccgcgctcaaggccagccagggcgtgcccaacttccgggtgaatcaggacgcgacgcgccaggagatgcgcacgtacgtgtgcgggcagtgccacgtcgagtactacttcaagggcaaggagaagcgcctcacgtacccctgggccaagggcatcaacatcgatcagatcatggcctactacgacgaggacggacactccgactggacgcacgagctcacgggcgccaaggtgctgaaggcgcagcaccccgagttcgagatgtacaaccagggcatccacgcgaagagcggcgtggcctgcgcggactgccacatgccgttcatgcgcgagggggcgatgaaggtcagcgaccaccaggtgcgcagcccgctgctgaacatcaaccgcgcgtgccagacgtgccacaagtggagcgaggcggagctgctccagcgcgcggagaccatccagacgcgcaccttcgagacgcggaacatcgccatggatgcgctggtggacctcatccatgacatcgaggccgcgcagaaggcggggcagtccgaggaggcgctcgccaaggcgcgcgacctgcagaagcgcgctcaattctacctggacttcgtggaggcggagaactccatgggcttccacgcggaccaggaggcggtgcgcatcctgagcaactccatcaacttctcacgcctgggccagaacgcgctgcgtcccagtggtggcgcctccaccagccccaccacgcggcctcaaggcgctccggcgccgctgacgcccgtgtccacggatggcgcgggtgagacgcagcagggctcgaagtag

SEQ ID NO: 4640 - DNA, 420 bp, Myxococcus xanthus
tacaccttcgcgtacgcgaagggcgcggcctacctgcatgacgacccagccgcctgcgccaactgccacatcatgaccgagcagtacgatggctggcgcaagagcagccaccacgcggtggccacctgtaacgactgccacacgccggcggcgctggtgcccaagtacctcaacaaggcgagcaacggcttctggcactccttctacttcaccaccggcaccttcccggaccccatccgcatccgccccgccaaccggcaggtgacggagagcgcttgccggaactgccacgccagcctcgtggagagcatcgaaacgccccacgcagactcgctgcagtgcctcacctgccacaactcagtggggcaccccgaaggctccgggaaccccgaactcatccatcaggaggttgaacgatga

SEQ ID NO: 4641 - DNA, 1218 bp, Myxococcus xanthus
atgtccccccgtccgccgttcctgctcgccattctgctcctgagctttccgcagatcgttgaaaccatctacagcccagccctgccgctgatcgctacggcctatcgcgtcaccccagccgaaacgggccagacgctgtcactctggttcgcagccttcgctttcggcgtggtggcctggggccggctctccgatctgtggggccgccgcccggcgctgcttgcgggccttgcgctttatgcggcgggtgcggcttgggccatggtcgccagtgatttctcacatttgctggccgcacggcttatttccgccttcggggcggcggttggatcgatcgttacccagaccgcgctacgcgatagccatgctgggccggagctgggccgggtcttcgcggtgcttgggctggcgctggctatcagcccggcggtgggcctcttcgcaggccaactgctcgcggccaaggccggtcacagtggcgtcttcgcggccctcggcctgcttgcggcgttcatgctcgggttgagtctctggcgctggcctgaaacccgccccgctactttgtctgtcgccccattctggcccaccttccgagtcatgctccgcgatcccggcatttggcgctgtaccctgctgatcgccgcattcaatgccgcgatcttcgcctggtaccagcttggccccttcctctttgccgggttggagaacccctggctctcattcggccagagcggtttcctgctcgccgccggtgcgctggcgggggcgctgatgaaccgtgccctgttgcgccgcggttggacggcggaagcgctgatcgcgctcggcgtcctcctcctgggggcggggaccgcgctcgtcatcctgctcaccgcgcttctgccgcagagcctggccttcctgagcggcgtgacgctgatctcgtccgcatatgccgtcgcgatccccaatgtgctgggcatcgccctgcgagcctatgctgatcggttcggaactgctggcgcagtcctgagtctcttctactacaacctcctcggggcgggactggtgattgccggctacgggcagcgcctagattttgccttggccgtctgcgcgctgctggcggcgatcgtcagcgtccggccaatgaggtgcagaggagcgttgagtgaggagtcgccgccggggggcaagtcccgaatcccgtgtagttcgtcaggagggggtcggagctga

SEQ ID NO: 4642 - DNA, 645 bp, Myxococcus xanthus
atggaactcaagctggccggcagccactacctggcgcccccgcagtacggcatctggcttccacccgacgtggagcaccggggcatgaaccgcttcgaggcgagccactgctcgctctacctcgcgcaggcgtggtgccggggcatgcccaagacgacgtgcgcgctggcggtgagccctctggtgaagtcattgctggagcacctccgcgcgcatgagctggcgcagcctcgcacgagcgccgagcgccgactgttccgggtgctcatcgaccagctgacgctggcccccacccatgggagctacctgcccatgtccgatgactcgctcctggagccggtcctcacggcgctcgagcagcacccggaggatgagcgctccctggccgagtgggcgcgggtgctgcacaccacggagcggacgctggagcggcgctgtcagcagcacctggggctgtcgttcagcgagtggcgccagcggctgcgcgtggtgaaggcgctcgcgaggctggagcagggccactccgtggaggccatcgcgctcgacctgggctacagcagcgcctccgccttcatcgcgatgttccggcggatgacaggcaccacaccggacaaggtccggggccacggcttcgtggcctcgtga

SEQ ID NO: 4643 - DNA, 588 bp, Myxococcus xanthus
atgacgcccgtcctgcccaacccggatgatgtgctcggtacgcacaacccgctcgtcatcgtcctgcgtgacctgctcagcgcggaggagtgcgccgcgctcatcgaacggattgaagcagaggggcccacggcggcccccatcaccacttccgcgggcttcgtgatgcgcccggacatccggaacaactcccgggtgatgttcgacgacgtccccttggcgcagacgttgttcgagcgtgtcgctccgcatgtgccgcaccggctcgaacacgagtggaccctctgtggtgccaatgagcgcctgcgctgctaccgatatgacgtgggtgaatacttcgccccgcatttcgacggcgccttcgtgaggacgcgcgacgagcggagcctcctcaccttcatggtctacctcaatgaatgtccgggcggaggcgcaacgaacttcctgtcgcttgggcactccgtgacgccgcgcacgggcagcgcgctgctcttcaatcaccgcttgcttcacgagggcgccaccgtcacccagggccgcaagtacgcgctgcgcaccgacctcatgtatcggcgcccggcctcatga

SEQ ID NO: 4644 - DNA, 1065 bp, Myxococcus xanthus
gccacactctgggacgagccgaccaccggtatcggcctgtacacccgttgcctggcctccgccctcgaggcgctcggcgtccagctcacccgcgtaggggctcagtcatccggcgaggcccctcgcgcgaaggcagggcgcaccgcctggacgctgggcggcttgccgcgcgtgctccagcgctcggatgcgctgctgtaccacgcacacggtaacttcaacctgcccctcatccgcgctcccggcatgaagtacgtgctgacggtgcacgatttgattccgctgctgatgccggagacggtgtcggccgcgttccgctggcagttccggctgtggatgtcgcgcagcctgatggtggcggaccaggtggtgtgcgtgagcgagcgcacgcggcaggacctgctggcccgctatccggaagcggagtcgcgcacggtggtggtgcccaatggcgtggaccacgtccatgcgccagtcctggacgacaccagcaaggacttcctgcgcgcgctctcactgccgaaggagtacgtgctctacgcgggctcgctcgacgtgcggaagaacgtggacctggtgctggatgcgctggagcggctgcgactgcggggccggcctgcctcgttggtgctggcgggacagagctggttcggcgcggggcgcgtgaaggcgcgcatctcccggctgcgctcggaggggttcgaggtgcgctcgctcggctatcagtccgacgccgtgttctacgagctgatgcgccgcgcggccgtgttcgtgttcccctctcgctatgaggggttcgggctgccaccgctggaggcgatgcggctggggacgcccaccatcgtctccaccgcgggctcgctgccggaggtctgtggcgacgccgcgctgagcgtggggcccgacgacgcgaacgggctcgcgagggcgttggaccggctgcttcactcgccggaggaacggcgggcgctcggggagcgtggaaaggcgcaggccgcgaagttcacctggaagcggaccgccgagggtaccttggcggcgtacgaggccgcgctgcggcgataa

SEQ ID NO: 4645 - DNA, 1080 bp, Myxococcus xanthus
atgcaggggtactccgacatcgcggcccgcaccttcatcgaggtggtgggccgctacttccgctatccggagaagtccctgcacgccctgctgtcgctcaacggcagcaacgcgctggcgttgtaccgggcgctgctggacggatacgcggccgagcgcaacggcaggatgccggacacggtggccctgctgtgccgccgcaacgacgcccaaatcacggagctgcgctggctgtgcgagcgcttccgcgagttcggcgcggacgcggacctggtccatccggacgaggtgtccggtgacgacgccttcgtggcccacggcaagaagtacgacctggtgtaccggcacctcttcgtccggcgcctggaggagtccccctccccctgggtcgaggacttcctgggcaccgtgcccggcaagaaggcggtgttcctcaatccccccgcctcgcaggtggaggtgaagctgaccttcgcccgcctgtcgcaggccctggccgagcccgcactggccgaagccgcgcgactcaccggcgacgagttggaggcggtgcgcgcgtccgtgccgtggacgcgaacgttccagcccggcccgacgcagggccccgacggtgaacgcgtggaggacctggtggccctggtcgccgcgacgccggcgcgcttcgtgctgaagcgggcctgggactatggcggccgagccgtcttcctgggccgctccgcgggcaccgtcccctacacggagcgggtgcaggtggcctatggcgcgccgatgacgtgggcggagctgtgcgcgcgcacggcggcggacacggccggcggaggcttcgtggtgcaggaagtagtggactcgccgcccgaggagcacctgctctgcgagcccaacggcaccgtgctgcccacgtccttcttcgtggactactccgcctatgcctccgtgggcctggcgcggcagcccgcgtggggcggtgtgtgccgcgggtccatgtcggaaatcgtcaacatcgtcggcggtggcggcgtgttgccgctcatcacctctgaagtcgcctccaagctcctgatggcgtggaaggccttctag

SEQ ID NO: 4646 - DNA, 93 bp, Myxococcus xanthus
atggtgcgccacgtccatgaaggcttcgccgaggagttcctcgcgaagtaccagacggagctcgaggcgctgctcgccgagcccaccccgtag

SEQ ID NO: 4647 - DNA, 1867 bp, Myxococcus xanthus
tggaagctgacactcgacggtgcctaggctctgtgcatggacctcatcgtcgagaacggcctcgtattcgatggtctgggcaatcccccgcgcaagctccatgtgggcatccggggaaacactgtcaccacgctttcggaagcaccgattccgcgcgccccacatacgcgttgtcatggaggccaccggccactgggtgacaccaggtttcatcgactgccacacgcactacgacgcggaggtggagctggcgccctcgctgtcggagtccgtacgacacggcgtcaccacggtgctgatgggaagctgctcgctcagcctcgcgctgggcacgcccgaggacctggcggacatgttctgccgcgtggaggccattccctacgagactgtccggtcgctgctggaggagcgcaagacgtggaacacgctcggtgactacctgacgcacctggagcaattgccgctgggcccccatgtcgcgtccttcctggggcactccgcgctgcgagcccacaccatgggcctgcaccgcagcctggagcccggcctgcgcccacgggaggacgagctgcgcgccatggagtccctggtgcgcgaagggctcgagctcggctacgtgggcctgtccatcatgacgctcaaatgggacaagatgggcggctcgcgcgacatccgcagccgccccctgccgtccacctatgcccgctggagcgaataccgccgcctgacgcggctgctccgcgaacgaggccgtgtattccagggcgtgcccaacatcagcaccaaggtgaacgtggtgctgttcttcctggagagcgtcgggttgttccgcccgagcctcaagacgaccgtcatctcgatgatggacacgcgcgccaaccggggcatccaccgcctcatcggcgtgctgtcccaggtggccaaccggctgctgggggcggacttccggtggcaggccctgcccgaaatcttcgacctctgggcggacggcatcgacctggtcgtcttcgaggagttcggcgcgggtgcggctgcccttcacctccaggacgcagcctcacgcgcggggctgctgcgaacgccggagtaccgcagccgcttccgccgcgagtggacgaaccgcttcctgccgcgggccttccaccgggacttcaacgagtcgcgcatcctccagtgccccgacgccagcgtggtgggcaagtccttcgcccaggtggcgaaggagcaggggcgtgacgcggtggacgtcttcctggatctcatctccacccacggagacgccctgcgctggtacacggtgatggccaacgaccggcgcgaggagctggagcgcatctgccggcatccggacatcctcatgggcttctcggacgccggggcgcacctgcgcaacatggcgcactacaacttccccctgcggctgctgcggctggtgcgcgaggcggagaagcgcggcgagcccttcatgagcgtggagcgcgccgtccaccggctgaccggggaactggccgggtggttcggcctggatgcgggcgtgctcgcggagggccgccgcgcggacctggtggtcatccagcccgacggcctggacgcgaagctcgacaaggtggccgaggcgcccatggagaacttcgggggattcgtccgcctggtcaaccgcaacgacgccgcggtgaaggcggtgctcatctccgggcgcgaagcggtgaatgaagccggcgtgtctcccgccttgggccgcgagcgcggcttcggcggcgtgctgcgcgtccaggcttgaggctcggggcacgccggacctggaatcaaggcgtggtggcccgctactgcgccaggactgctgggcgccaatctctcccaggctgcc

SEQ ID NO: 4648 - DNA, 564 bp, Myxococcus xanthus
atggtggattcggtggagccctaccaccgggccttcacggatgcgctgcgcgcgaagtacggcaaggtgctggccacgggcaggcctcgcatcacccggttcaggcccggccagagccgcttctcactgattgaccccaccggcaacaacatcatcttcatccagcgcgatgagccggaggacctggagtacggcggctccgcgaagctcacgggcctggcgaaggccatcgacaacgcgcgcatcctgcgtgagttcaagaatgacgacaaagccgccgcgcgggcgctcgacatcggactcgccaggtatgaggcggaggcgcccgtggtggaccgggttcgtgccctggccgcccggatggagctggcgattgccctgggggatgccacgacgggacgtgccttgaagcagcaactgcaggccgtgccccttcccgaggaggcacggagccagttgtccgacgagctgaaggccgcggagcgcctggaggactggctcgcccgaaccaggcccgacccggcgccgtcccaacgcacgggttccccgcggcggcggcgctag

SEQ ID NO: 4649 - DNA, 1053 bp, Myxococcus xanthus
gtgcagtacctgggccggacgtaccgttcggacaccggcgtcgtcttctcccaccccggagtgaccatccgtgcccgcttctggggagacgccgttcggatggagctccacgacgcgggccagggtggcgaggtggggaccacctacttcgatgtcgtgattgacggggcgcccgcgcgacagctcgcggtgagccgccatcagtccagctacctgctcgccaccggcctggaggtggggctgcacacggtggaactcatcaagcgcaccgagtccctggtcggccacagcgaactcgtggcgctggaggttcatggcgagctccgggagccgcccgcccgctcgggactccggatggagttcgttggggactccgtcacctgtggctacggaagcgacgtcgccctcatcccgggctcgccctcctggaccgcgcccaccttcacgtcgaagaaccagaatccccggcgcacctatgcctggctcacggcggggaacctgggcgcggaggcggtgctcatctgctattcgggccacggggtgtaccgcaacctggacatgtccacgtccggcctggtgcccgcgctctacgagctcgcggtccccggccacggcgtcgcctgggacttctctggcccgtcgcccgatgtgattgtcgtcaacgcggggaccaacgacacgttcgccggcagcggcaccgacgcctaccttccggacgaagcggccttcaaatccgcctaccgcgcgttcctcacgcggctgcggacgctccacccgcgcgcccatctcgtctgcacgttggggagcatgtcggacggccgcaagcagctcgagcagaacggcacgacgacttcggcccatgtcggtgactggctcaccgagcttgtagcagagcgacagcaacagggagacgcccgcgtctaccggcacgtgatggccgtgcagaatcccaacgtggacggcgttggcgaggactggcacccgtcggcggccacacaccagaagatggcggaggcgctgacctggttcatccgggatgtcgtgcggccctga

SEQ ID NO: 4650 - DNA, 1143 bp, Myxococcus xanthus
cgagctcgcgctgggtggtggcaacacgacaatgcatggacgtcatgggtttctccgggaagcgaagcgggtccggcgtcgcgccgtcctcgccctttcattcgccgcccaagccccgagtgcgcgcgggccctgctctttttgctcaccgcgaatccagggcccgcggggtacgacggggagcgtgtcccaggacaccgtctggggtggacatcaagaagaagcgctgcgccaacctggagaatctggcgtaagaagccgcgcatggcgcggaccctcgatggaaccgaaatcagccgggtgatgcgggcggagatggcccaggacgtcgcggcgctccaggccgccggcgtgacccccgggctctccgtggtgctggtgggcaacaatccggcgagccaggcgtacgtcgcgagcaagacacgagcgtgcgagtccctggggatgcgcggccagacgctgacgttgcccgaggacgtgtcgaaggaggcgctgttcgccgtcatcgaccggctgaacgccgacccgtccgtgcacggcatcctggtgcaactgccgctgccggcccacctgccctacaaggccgtcctggagcacatccacccggcgaaggacgtggatggctttcacccggtgaacgccgggctcgccttcgtcggagacccccgggccttcgtgccctgcacccccgccggcatcatggagatgctccggcgcgaggacatccccacccggggcaaacacgtggtcatcgtgggccgcagcctcatcgtcagcaagccgctggcgtcgctgctgatggcgccgggccccgacgccaccgtcaccatcacccaccgccacacgccggacctcgcgtcattcacgcggcaggcggacatcctcatcgtcgcggtgggcaagcagaacctcatcaccgcggacatggtgaagccgggcgtcgtcgtcatcgacgtggggcagaaccgcgtgtccgacgcgagctcaccgcgcggctaccgcatggtgggggacgtggatttcgatgccatccagcccattgccagcgccatcaccccggtgcccggcggcgtggggccgatgaccatcaccatgctgctggcgaacacgctccaggccgcgcggcagacccaggcccggtga

SEQ ID NO: 4651 - DNA, 1569 bp, Myxococcus xanthus
tgcgagccgctgaagctggacgtcgccttgtcacccgaggcggagcatctgctctccgtgctgcgcgagcatcccacacccgccgaggcggccagggtgcttggccttcccgtcgtggacgtcgagcgccaggcgctgccgctcgtgaagaccgcgttgttgctctggggcctgccgttccggccgaacgacttcagcacattcgagagcgtgcgggacgcggtggcggcgctccccgacctggaggcgcgcacacgctggctggagcggtttgagaccctggcgcgtctcaaggcggacttcgaaagtggagacctggcccagcggcgcgagctgctgccgcgcctggaggctgccttcacggaggtcacgggcaagcccgcgcgccgaggtgacggacaggtctacgcggaccggctcatcctttacgaggaggcgagctcgcctttccggttgcgcttcggcgcggccttcaccgcggagctggaggcggcgctgacgggcgcgctggagctgtcggccgcctatggcgagaaggtgcaacagggcttccgggagcaggtccgcgacgcactgggcccggatgcgggccccatggacctgctggactacgccgtgcggctgcggcccgatggcgtcacgggcagccgcttctcgcccgtgccgccggtaatgctggagtccgaggagggccgcgcgcggacgctgcccgtggacttcctgggcacgtccacgccgggcgggcgctacgccttgccggacgtgtgcctcgccgcgaagccggacggaagcggcttcgaggtgatgctggcgcgggtccaccaccacctgctgctgtggagctggctgagcgcgttccagcccgagcgggagcggtacgcctcggtggcttcgcgttggttggaacaggacgccgcggcgcgggggctcgtggggctggccatccgcaggcgcaacaagggcttctacgtctatccgggacggcggttggtgtactcggtgtcggacgtgctggacgtggacgagggggccctgacgccgggggacgtgaaggtccttcccacgcgtgaaggcccggtgttggtggacgggcagggggagcggctgagcctgtacctgccgctcgatgatttctcgtcctatccaccgttcgcggcgctggcgcattcccaggtgctgcacgcgccgctgcggacgcagggcagtcacctgccgcggctcagcgtgggtggcgcggtgtaccagcgcgagcgctggaacctggcggcggagcggctgggaaggcccgcgggcttcgagctcttcctcgccgtgcagcgggagcggcgcgcgggtgggtggcctcgcttcgtgttcatgcgcagctcgaaggagcgcaagccgtacctcatcgacaccgcgagccccttcgccgtggacctgctgtcacatctggctcgggacgcggagcgcctgtccgtggaggagatgtacccggcaccggagcagctctggctgaaggacgcgcggggccgctacacctgcgagctgcggatgcagttcacccgctggagcgaagtaccggcctga

SEQ ID NO: 4652 - DNA, 462 bp, Myxococcus xanthus
atgcccggtgaaaacgtcgtcgctccccccgtcaagaagctgaagcggccggtggaggaggttcgcgcggagctgctggccgacgcggacgtgaaggagcaggcccgtctgctcaaggtgcccgtcgaggagtacgtcgagaaaatcatcgactatgccctcaacccggagaagccaccccagatcgagatcgtccccgacgaggagctgaaggccaaggaccccaacgtgcccaccatcgaggagcttcaggggcacctgcaggacatcgtcgacggccgcgtcgtcatcagccgggcgcatcagcgggacggcttcagcgaccaggacgcggacgctcgcttcaagtcggcgctcgcgtccgacgcggcgcagacgggcgctcccgagagccgcaaggggacgtccgccagcgatctgcacgccgcggagggcaagaagccttccaccgacaagaattga

SEQ ID NO: 4653 - DNA, 402 bp, Myxococcus xanthus
atgggcggtctcaagggaatcgttggcaaggtgctgaacgtcgtcaagccgttcgtgtctgcggtcaacccgctgctgggcgcggcgatgggcttcgccagcggcctcatccagggcaagaacccgctccaggcgctcatgggcgcggcgacggacctgattccgggtggcggcgccttgaagaacacagtgggcaagttcgccagcaagttcctcatggacggcgcgggcggcaacagcctgctgagcggcgcgctgaatctggccacgggcaagagcaaggtcaccgacgtggtgggcgacctgctgaagaacacggcgaagacgggcctgagccagctgggcatgaagaacgcggccgagctgtccgcgcagcgcatgtcgcagttcctggtttcgtaa

SEQ ID NO: 4654 - DNA, 381 bp, Myxococcus xanthus
atgacgcccatcctctacgttccagagctgcacttcgctcaagtgcaggagtggctgcagttctggaacgatgccgtcacgccagagacgcttcctcagacgggcttcatcattcctggcaaggcggcggggtttctctaccggaccgacagctcgctggccatgattgaaaccctggtggccgcgccggggctgtccaaggaagagcgaagcgccgccgttgacctcgtggtggccgccatcagtgaggagtccacgaggctcgggttccaagtgctggtgggctacacccagttggacgcggtggtgaagcgcgccgagcggcacggcttcatctacgtggatggtggctttcacgtcatcgccaagcgtctcaggtga

SEQ ID NO: 4655 - DNA, 756 bp, Myxococcus xanthus
tggcgggacgccgcgagcctggtgtcgctcgagcccgcgctggaaggtacgccgctgttcggtgccttcgagacggaccagggccacctcgtggacacggatggctacgtcgacgcgctcctgaaggccgctgcccacgtgggcgtgcggttgcggctgggcgtggccgcgcgctccgtttccgaatcctccacgggggtcgaggtccagacggaaggggagacgctccgggcggaccagttgctcgtgtgcgcggggccctggtcggcgggcgtggaggggttgccttcgctgccgttgaagcccttgcgtgggcagatgctggtggtgcaccagccgggattgcacctgacgcgcgtcgtctcagggccttcgtacctggcgccgtggcgctcgggcgaaatcgtcgtgggggcgacggaggaggacgcgggcttcgtggagcaggtgacgcccgcgggcctgctgcacctcagtgccaccgtcgcgaagctggcgccgcgactgcgtgacgcccggttcgtccgcgcatgggcggggcttcgggccgcgacgccggatggccacccgtacatcggccgtcatcccggcacccggcgcacctacgtcgccacggggctgggtggccagggcatcctgaccggtgcgcataccggtgccttgctcgcggagctcgtggcgcacggccattgcgccgccgccgagccgttctcgcccgcgcgtatcaccgacggttctccgctcgcaacgcgctga

SEQ ID NO: 4656 - DNA, 636 bp, Myxococcus xanthus
atgaaccgtcgtgagaggaatacggcgcgcggttggaacaagctggaggacgggcccgtcataccgggggaaggagcagagcccatgcgcaggccacggcggatcatcggtgtcttcggttctggcaaggaggaccacgcggagcgggtcatcccgctggtccggtggatcgccgaggcgggcttcgacctgctcacgggggcgggcagcggggtgatgcggacggcggcggatgccttcgtccaggtggcgtaccggcacggcatctccattggcatcgtcccaggcacggtggagggcggcgagtaccggccccgttcgggctaccccaatcccaacgtggagctgcccatctacacgcatctgccgctcagcggagagcaggggacggagccgctcagccgcaatcacatcaacgtgctcacgccgcacgccctggtgtcactgcccgggggcgcgggcacggtggccgaggcggtcctggccctgcgttatggcaagccggtcatcctctacggaccgccggagtcgttccggcgcttcccagcggagctggagcggacggactcactggagcgggtggccgagttcctccgggccgcggtgcgtgatccactccgcctggccatgccgtag

SEQ ID NO: 4657 - DNA, 822 bp, Myxococcus xanthus
atgtcccaggattcgcccgacagcctgcgccgcaccgccgaggagggggctcggctcgctggccgcatcctcgcggaccggttcctgggcgagcgcaccatcgagttcaagggtggcatcgacctggtgacggacgcggacaaggcctccgaggaagcgctgctcgccttcatccgcgagcgccaccccgaccacgccatcctcgcggaggagagcggcgccacgcagggcaccgacagcctgcgctggctggtggacccgttggacggcaccaccaactactcgcaccgcgtgccgcacttctgcgtcagcgtggcggtggagggccccggcggcgtgctggctggcgtcgtctatgacccgatgctaaacgagctgttctccgccgcgcgcgggcagggcgccaccctcaacggccgtccgctgcgcgccagcaccgtgtcctcgttggaccgggcgctgctctgcacgggcttcccctacgacgtgcgcgaacgcccggaggggccggtgggcctcttcacccgcctcatcctccacgcgcagggcatgcgccgcacgggcagcgccgccatggacctggcctacgtggccgcgggccgcttcgacggcttcttcgagttcggcttgaagccgtgggacatcgccgcgggctcgctgctggtggaggaggcgggcggcgtcatccgtcacatctccggcgagcccttcgacgtgctgcgcggcgacgtgattgcctccgcgcccgcgctggccccggcgctgctgtccgaggcgaagcgcttcgtggacgggctgcgcgaacagcctccgcgcggctga

SEQ ID NO: 4658 - DNA, 396 bp, Myxococcus xanthus
atgatcagtcccgaccatccgctcgccagttggttcctcatcatcgccgggacgctcttcctggtcgtcttcgcgattcccctgctgctgatgcccctgacgtgggcgcgctggttcgggtggcggctgccggaggggaacaatcacctcacggtgtacttcgggcgctgccttggagcggtggcgctggccatcatcctcacggcggcccgtttcgtgtcacggccaggccccgccatcttcgacctcatcggctgggtgtgtgcgggaatggtggttgtccacacctggggcgcgctgaagaaggcgcagccggtgtcggagacggtggagattggcttctatgcggtggtaggcgtgctggccatgtggatccgcttcaacgccttgagctga

SEQ ID NO: 4659 - DNA, 4263 bp, Myxococcus xanthus
atgtctccggtggacatcgaccccatcctcgcgacgctggcgccctacatccccggcgccgtgctccggcgtctggagcgcacggaggcgcacgcgctgccgctcgtggagccggtgcgaggcgccatcctgcttctggacatcgcgggcttcacgcccatcgtcgtcagcctgagcggcgccgggccccggggcatcgatgcgctccagcggctcctgacgagctactacacggagatgatcgacgtcgtgaaggaccacggcggcgacatctaccagttcgccggtgactccatcctggcctgcttcgaggtggagccgggcgtggacgccagcggcgcggtgcagcgcgcggcccggtgtgcgttggacgtccagcagcggctgtcccgcttcgcgcagttggagttgctgggccagcgcttcagcgtgtcatcgcgcatcggcatcgggttcggcgaagcccaccgggtggtgttaggcgccacgggcatgtggatgcaccccgcgctcatcggccagccgctggcgcaggcggtggcggcggagaagcgggccaccgtgggggaggtgctgctcagcccggaggcgtgggccctgctgccggagccggcccgtcaaggcgagacccgcggcaacgcgtaccgcctggcgcccaccgtgccgttgcgcgtgcctccagcgcccggcttcgtgttgccctccgggccggagatggtggcccggtgctcgctgctgctgcacccggtgctcttcacgaaaatcacgacggcgcaccaggagttcagcggcgacttccgcgacgtcacctgcttcttcctccgcttcgacagccagcgcgcgtccgcgcggccggaggacttcacccgcgacctgaacgccttctacgaatacgtccagcgggagagcgcgcaccacggcggcgtgttgctgatgacggacttcaccgacaaggggaacgtcctctacgtcatcttcggcgcgcccacggccttgcagagcaaggaggtgctggcctgccggctcgcgtgcaagctgatgcgggagcgggagtccttccccttcgtctcatcgctgcagattggcatcgccaccggtccggcctatttcggcgacatgggctctccctggcgcaaggggtactccgcgctcggcgaagtcgtgaacatggccgcccgcctgatgacgcacgggcagggcagcggcatccacatcgacgcgcagacggagcgcaagctgcaccagggcggcttcgacaccgagttcgtggaggacgcgcggctcaagggcgtgtcacgcgcggtgcctgtctaccggctgtcggcggaggtgcgccgcagcctgttcctcaaagggaagggcgacatcgtcggccggcagcgcgaggtggcggcgctgcgccagtccgtcgacgaatcgctggagggccacggccgcatctgcgtggtgtcgggcgaagcgggcatcggcaagtcgcggctgggcgcgaaggtggtggaggtggcggaggcgcggggggcccacagcctctacggcatctgctactcgtacgagatgttcacgcccttcttcccgtggaaggaggtgctggtccaactcttcggactgcacgaaggcgacgacgtggagacgcagctgtcccagctgcgccagggcttcgcgggcctggaggacacggggccggaatggatccccgtgctcgcgggcatcctggggttgcccgtggaggagtcaccgctcacgcgcgacctggatgcccggcggaagaaccagaagctcttccagatcatcctccagctcctggagaaggtgtcgcgccagacgccggtgctgctcttcttcgaggacctgcactgggccgacaacatctccgtcgacctcatcgagtacgtcgccgcgcggctgtccccgctgcgggtgacgctgctggtgacgatgcggccgggcgagcacctcaagagcctcaaggggctgcccgggctgcgatggttggacttgtccagcctggatgacgaggacacgcgggcgctgctgcggctgcacctgcgcatggagacgccggacacggcgctggaggacctgctgctggccaaggtgcagggcaacccgttcttcaccgagtccatcgtccaggggatggtggagaagggctatctgggaccggtggcgccgggcgccgagcggttggagctcaagcgcagcctccaggggctggagctgccggactccatccaggacgtggtgctggcgcgcatcgacctgctcacggagacggagaagttggtggtgcgcgtggcctccgtggtgggccgcatcttcacgctggaggcggtggccgcgctggcgcccggctcggtgtccccggagcggattcgcgaggccatcgatacgctgacgcggctggggctcatcctcctggagttggaggagcccttcacctgcatcttcaagcacatcgtcatccgcgacgtggcgtacaccacgctgctggtgtccgcgcgcgaggacctgcaccggcgcatggcgcgcttcatcgaggcccgcgccggggagaaccccgtcaagtcggcgggcatcctggcctaccactcgctggctggaaatgacgaggtgaagggcctggagtacacattgatggcggcgcgcagcgcgcgcgagcagtacgccaacgacgacgccgtccaccactacaaccgggccatggagattctgggcggcaccgtggcgttggacccggaggaggtcctacgcaagacgcacgtcgtgatgaaggaactggcggagaccctgctcaacgcgggcaactacgcgggtgccatcctcatgttcgagcagtgcctggcggacgaggagcaggtgccgcgccgcgcggagattcacctgggcctgggccgggcccaccaggagaagggcgagtcgaagcgcgccatccaggagctggagacggcgctggagctcatggggcgcacgatgccgcggagcatggcggcgctggtgctgcgctcggtgctggccatggggctgcacctgctctacggcctgttcccctggctggtgcggccactgggcgcgcggctgccgctgtacctgaagcagttgtccacgctcatctcgctcatcaagatctactacttcgcggacatcgggaagctcacctgggccacgctggtggccacgacgatggcggagcgctcgcgcagtgagtacggcctgagcctggcgaccagctactacggctcactgctgttcggctcggggatggtggggcgctcggggcactggtgtcagcgcgcgctggagcatgcgcggcgctcgcgggatacggcggcggagggcgtggcgttgagccggctggccacgcagtccatcttcaccaacgagcaggcccgcgccaccgagtacggcgagcaggcggtgtcgctgctgcggcaggtgggggacatgtgggaggtgcagacgggcctgatgatgctggccaccagccagttcctggcctcgcgcttccaggatgcggagcgtgcgtacctcgagatgggccgcgtgggcgtggagctcaacgcgctgatgcaccagggctggtcccacgcctgggtccccatgtgtcgctacctgcgaggtgatggggatgtgggggagctgtgcgcggagctggaggaaggcctgcgcatcagtatcgacgtccaggacctggccaatcagtgcgccagcctcaatcacctggtcaacgtggcggtgcgcgagcaccaggtggaggaagccgcgctgatggcggtgcgcgccgacgaggcgctgtggcgctaccacgtgctggtgcccttcctccagattggtctcgtggacgcggcggagggcgcgctcttcgcgctggagcagggcgctgtctccgtgccgcgcgagcaactgtgggccctctaccgtcgctgcgcgctcaaggcgcgggcgttgggggcgctctatccatacctgcgcggcccggccatgcgggtgatggcgcgtgcgaaggcgctcaagcggggcgcgaaggccgcggagccgctgttcgaccgcgcgctcgaggtgctggaggccacgcccaaccgctgggagacgggtgtggcctacctggatgcggcggcggcgttgcctcaccggcgcacggcgttgctcgcccgtgcgcgtggcatcttcaccgccatcgacgcgcaggcggagctgcggcgggtggagcggatggcgtccggtcctcaggatacggcgccgatgctggcggcggcgctcacgtga

SEQ ID NO: 4660 - DNA, 582 bp, Myxococcus xanthus
cgcaccagttgttccccgcccccctcatccgccgagcgccctcccatgactgtcagcacctggaacatcgacgcttcccactcgtccgtcctcttcgtcgcgcgccacatggtggtggcgcgagtccacggtcgcttcgagcgtttctccggagtcctccgggtgaatcccgagcagcccactcagggtgaagtcgagatgtccgtggaaacggcgagcatctacacgggctcgtcagaccgggacgcgcacctgcgttcaccggacttcctcgacgccgacgccgcgcccaagctcacctttcgcagtaccaggattgaacccgcgggcggtgccagcttccggctcctgggcgacctcaccatccgcaacgtcacgcagccggtggccttcgacgcccggcacatcggcacgtcgaaggacccgtggggcaactcgcggctcatctactcggcgcgcaccaccgtcaaccgcaccgattacggcatccgctggaacaagacgctcgacaatggcggctggctcgtcagcgagaagatcgacctcgagctcgacatccaggccattcccgcgacggcctga

SEQ ID NO: 4661 - DNA, 4164 bp, Myxococcus xanthus
atgaccgagcacatcgagccgcgagctcaccgtttccccaccctggtggacgtgttgtgtcaacgcgccgagtctcaaggcgacgcgctgttgtatcgcttcctggagacgggagacgtggacggcccggtggaggagtggacctaccggcggctggattcacgggcgcggtcgctgggggctcggctgcgtgccctgggggcgcagggggagcgggcgctgctgctctatccgcccggcctggagttcgtcgcgggcttcatgggctgtctgtatggcggcgtcatcgccgtgccgtgttacccgccggaccccacgcggttggagcgcacgctgccgcgccttcgcgccatcgcccgggactgcggcgcgcgctacgtgctgacgacgagcaccatccaggagatggcggagttcctcacgccacaggctcccgagctgggtgaattgcagtggattgccagtgacgcggtgccggaagccgaggccgcggactggaagcgcccggacctgacgtccgagtcgctggccttcttgcaatacacgtcgggttccacgggcaacccgaagggggtcaaggtcagccacgccaacatcctccacaacgagtcgttgattacgcgtgacttcgggttgcaggcggagcgttcggtgggcgtgggctggttgcccatgttccatgacatggggctcatcggtaaggtgttgcagccgctctacctgggcttcccgtgcgtgctgatgtcgcccatcgcgttccttcagcggcccttgcgttggctggaggccgtctcccatttcaaggggacggtcagtggtggacccaacttcgcgtacgacctgtgcgcgcgaaaggcccgcgccgaagacgtggcccgtctggatttgagccactgggacctggccttcaacggcgcggagcccgtgcggcgcgagacgatggagcgcttcgcggagacgttcgcgcccgctggcttccggcgcgaggccttctatccctgctacggcctggcagaggcgacgctcatcgtcagcggcggcgtgaagggaacgccttgtgtgcaggagcgctacgacaccggctcgctggagctggggcgcgcgaagcccgcgtccgacgcggcggaggggcccacggcgcgcacgctggtgtcctccggtcagggcgcgccggaccagcggctgctcatcgtggacccggagacgcgggtgcctcgggcctcgaacgaggtgggtgaggtctgggtcgctggccccagcgtggcgggtgggtattgggatcgtccggaggagacggcgcatgccttcggcgcgcggctcgccaacggcgaggggcccttcctccgcaccggtgacctggctttcctgtcgccggagggcgagctcttcatcaccggccgtctcaaggatctgctcatcgtccggggtcggaacctgtatccgcaggacctggaaatgaccgcggagcgcgcgcaccgcgcggtgcgtcccggctgcagcgccgccttctccgtggacgtggagggggaggagcggctggtggtggtctccgaggtcgacgtgcgcgaaggcttcgacggcgcggcggtggtgggcgccctgcgccgcgcgctcgccgatgagcaccaggtgcatgcgcacacggtggtgctgctccaggcccggagcattccgaagacatcgagcgggaagattcagcgccgcgcctgtcgtgatggcttcctggcgggctcgctggaggtggtggaggtgtcgggcgaggaggccgctccggtgccggaggccgtgccttccacgccgtccgcgcccctgcgcgagcgcctggccctggcgtccgaggaggcccgtccggcgctgctggtggacttcctccgcgtggaggccgcgcgggtgctgcgcgctgcgcccgcgtccctggcgccggagacgtcgctggccagcctggggctcgactcgctgatggcgctggagctccacggccggctggaagaggaactcggtgtgtcgctgcccgtggccttcctctggcagcacccgacgctggggaccgccgccgcgcatctggtggacgcgtggaagggctccgccgcgcccgccgcgccgccgctgaaggccggctcgctggagggagagctgccgctgtctcccggtcagcagcgcctgtggttcctggaccggctggtgccggagagcgcgctgtacaacgtccacttccagctccggctctccggcgcgctggacgtgcccgcgctggagcgcgcgctgcaagggctcctgtcgcgtcacgcggtgctgcgcgcggccttccccgaagtggagggtcagccgcgccagctcctgccgcccctgcgtccgctggacgtggcccgcgaggacctgcgggcgctgtcgcccgccgagcgtgacgcgcggctgaatcagttggcccgcgcccagggcgaggcgcccttcaatctctcagagggcctgctggtgcgtgcggcgctggtggcgctggaggaccaggagcacgtgctcctgatgacccagcaccacatcgtcaccgatggctggtccattggcgtcctggcccgggagctggccgcgctgtaccgcgcggaggtggctggcgccgccgcgtcgctgggcgcgcccgccttgcagtacgtggactacgcacgttggcagcgcgggctgggcggcgcgctggacgggcagcgtgcctactgggcgcggaagctggagaacctgccgcgcctggagttgcccacggacttcccgcgtccccgggagccgggcttccgcggcgcgctccaccgtttcgcgctgccggccgagctggtggattcgctcaaggcggtgggccggagtgagggctgtaccttcttcgttacgctggcggcggcctgggcggcgctgctgcaccgctatagcggtcaggacgacttcggcctgggcaccatcttcgcgcagcgggaccgggccgagctgcgtgacgtggtggggttcttcgccagcacgctggtgctccgcgcggacgtgtccggcgcgccccgcttccgggagctgctgggccgcatgcgccacacgttccacgaggccctggcgcacgcggacctgcccttcgaggaagtggtgggcgcgtcgcgcgcggtccgtggcggcgacaacccgctgttccaggcgaacctggtgttggagagcctgccgccggtggacatggacgtgccgggcatgcagtggcgcccggtgctgcccgtgccggacggcgcggtggagggcacggcgaagttcgacctgcagctcgccgtcgtggagacgccgcgagggctggagggcgcgctggagtaccgctcggacctcttctcggcggagacgatggcgcggctcgcgggacacctggaggcgttgctgaggggcatcgtcgctgctccggacgcgcgtgtggaggacctgccgctgctcgacgaggcggagcgtcgttctctgctggagcgctggaacgacttcacggcgccgctctcccaggacgcttcgcactgcatccacgcgcagttccgtgagcaggccgcccgcacgcccgacgcggtggcggtggtcgccgaggacgggacgctcacctacgcggagctggcgcgccgtgcgtccgcgctggccttgcatctgaggggcctgggcgtgggccccgaggtgcgcgtgggcctgtgcgccgagcgctcggtggagatggtggcggggatgctcggcatcctcgaggcgggcggcgcctacgtgcccctggacccggactatccccgggagcggctcacgtacatgctggaggactcgggcgcgcgcgtgctcgtcacgcagtcccatctggcggggacgctgcccgtggccggcctgcacaccgtgctgctggatacggcggagccctacgcggcgatgccggcgtcaccgctggccctggggaccacgccggacaacgcggcgtatgtcatctacacgtcgggctccacgggacggcccaagggcgtggtggtaccgcatgggggcgtggccaacttcttcgccgccatggacgtgcgcgtgggccactcgcccgcgggcgcctggttggccgtcaccagcatctccttcgacatctccgtcctggagttgctgtggacgctcacccgcggcttcaaggtggtggtgctttag

SEQ ID NO: 4662 - DNA, 1884 bp, Myxococcus xanthus
atgtcgtgtctcacccccaccttgcgcccctccgaggagcctcccgtgagtccccccttcgcgcgtccccgcgagctggctgtcaccgtggagacgtcgctgcccgccgcgctgccctcgcacgccatcgaagtagacgtgggggtggccctgcctgtcgcgttcggtgggctgagacaggtccttcgcgcgtgtgaagccgccgcgccccaggtcgtccacaccctgtcccgcgcccatccctccgaatggaaccggctgtttcccggcgccatcgacggcgtgccggacctcggtgacctggcgctgacgccctccgagcgccgcctccaccgcgagtcggagcagatgttctgggtcctcaacgtggccgcgaaggccatcgtggagacgctgcgcgccagcggccggcccctggtgctccatggcgcgggcgaatgtgacctggtgagcctgcgcgcggtgatgcgggcggccgagtggagccgcttggaagggctgcatggcaccctgttgttcaccgggtggaacgtgcgccggccccatggcgcggagtccttcgagtcccggcggcaggcctacctggatgcgctgtgcgaccggatgcgtgcgccccgcgtgccgacgcccggtccggtgtcatcgcgcgcgctggaagcgccggtggacctggaggggcgctatctccaggtcgccgtggacgcggcccaggcgcccgaaacacgggtggccgccgccatcctcgccatccggagctgcttcttcaccaccaactacgaaggcgccatgctggccgccgagcaggggctgtcggtgctggcggcgaacacggacgcggcgttggcgtctcgcgtggtccaggcctgggagacgctggacacgggcttcgccacgcccgccatcgagattgaccgcgccagcctgggtgacgtcgaggagctgaaggccctgttcgcgcgcagcatgggcgtggtccatgtctacaccggcgcgcacgacgcggcgatggaggcattcgggcgagggctggcgtgccggattcctcctgaactggtggcgcggctgcacatgttccgcgcgctcaccctgacgaagcgcttcggacagcttcccaacgcgcggacggaggtggccgcgggactggccgcgctggagcgcagcacatcgccggaccgggcgctccaggagggctggctgcgcaacgtctgcgcgctgacgtggttcctggagcgcaagctggacatggcgttggtggaggagaagcaggccatgcgctgcgtgggggacctgcacgacgccagcgccacgcacctgaaaatcaacctcatctccaacgccagctatctgcaggagacggcgcggcagttcggcgatgccatctccacgtggcgccggttcgagaagatcagcgagagctggggcgtgaacttcgccaagcaccaccgctaccgcctggcggggctggagctggccgctggcgagcgtgacgcggcggtggcccacttcaccgaggcgttcgccaacgccgatgcgctgggtgactcgttccaccggcaggtgattgccgcggagctgggacgcttgttcctggacgagcagcagcccgctgtcgccgtggactggttcgctcgcgcggaggagcatgcgcgcgccattggggacccgctgaagacggcggagagcctggctggacaggccgtggcggctggacgcacggactggtcagaggcggtgcggtgcgcggaggcgagcacgacgtggccgaagcagacggaggcgctgaaggccgcgctcgcacagggagatgcgaaggcggtccacgaagcgctgcctcgcgcccggacgaagctcaaccgcccgttcgacccggtgaacctgtactga

SEQ ID NO: 4663 - DNA, 1416 bp, Myxococcus xanthus
atgcggattgccgtcatcgccacgtacacgcaccccacccggctgcgcctcaaagagccctccatcatgcagtcctccgtgccggagctcatcgccggcctgtgcccgccgcacgtggaggtggagatcttcaacgagaaggagcgcgacatcccgatggaccgccactgggacctcgtcttcttctcctacctgcactccttctacgagcacaccaaggtgctctccaccctcttccgccagcgaggcatgacgacggtcgccggcggccgccacgccagctacttcccggacgacgcccagcagtacttcgacgccgtcatcaccggcgagcccgaggccaacgttcccgcgctcatcgaggacttcgagaagggccagctccagccgcgctaccagcgcccgccgctgggccccgccgccatccggccctaccgctacgacctcatcgacttcacccacaacaagctgcgcctgcccggtatcgaggcctcacgcggctgccccttctcctgcaacttctgcgtcctcaccggcaacgagcgctaccgctatcgccctgtcgcccacgtcatcgacgaaatccagcagcacatgcactggaaccccaacttcatggggctgatggatgacgccttcgtgttcctcgacaacaacctcggtggctcaccgaaatacctgcgcgagctgtgcgaagccctcatcccgctcaagaagacgtggggctgcgccctcaccttcaacgtcctcaaggacgagtcgctggtgaagctgatggccaaggcgggctgccgctacgtctacaccggcctggagtccctcaaccccgactccatcaaggccatgaacaagggccagaacaagctgagcgaagtggacgccgtcatccgccgcgtcttctccgccggcatcctgttgtccttcggcctcatcgtgggctcggacggagacaccaacgcgtacctggagaagctccccgagtacctctccgacctccagtacttctccgtcaccttcctgggcatcgtctgcccctatccggagacgcccttcttccgcgagctccaggcagagaatcgcctgctgccaggcaccttgagccgcgactacgacggctacacgctctgccaccgtcccaagagcctggacacatcagaggtggtggagcacttccaccggctctgcgcgcagctcggcagcctgcccaacatcgcccgccactactggtccaagctcacgatgagcgacatgccccggtacaagcagaccatcctcttctccgggcccgaaatcgtgagcatccgaaacccggtgaagaacacggcacggcgctacatcgccgggcaggacgccctggagtactgggacacgcagcagatggcccagcttggccttcagccgcagcggctcacgtga

SEQ ID NO: 4664 - DNA, 990 bp, Myxococcus xanthus
atgtcacgcccccttccctctgcgtcgagggaccgcaagcgcctccgcgccgcggccctgctggccgccctcttgtcgctgtccgcctgcgaggggcgtgaaacaccaccggggccgaatgaaccatgtgtcggggctgcctgtggaccgctgcaaccgcccgacaccgcgctcgaaggcagtgtgcgcatcgcgaccttcaacgtgcagcggctctttgacacggtgtgcgactccgatgcgtgcggcggcagcaactatgaggcgctgcccactccctccgagttcggtctccaggcggaccggctcgcgtccgccatctcgcgactgaacgccgacgtggtgctgttggccgaggtggaaacccaggcctcgctcgacgcgctcacgtcacggctcccccgcttcggctattcggagctgggcgagacgggcgccgcggcgtccgtggacgtggccgtcctctctgttcaccccatcaccgacgtccgcgggcatcgggaacgcacgctgtggcgcccggatggctccgccacccggttctcccgcgagttgctggaggtccacctggacgtggacgggaagaaggtcatcgtcttctccgcgcacttccgctccaagtccaatgacgacgccgggcgccgcttcgccgaggccgtggcgacgcgggacatcgtcgcgggcgcggcccaggcggctccagacgcgctcgtcgtccttggcggcgacctcaacgacgtaccgggctcggagcccatcaccgcgctggagcgcgacggcgcgctgctgcgcgtctccagcgaccggccggccagcgagacgtggacgtacacctaccacggcgacacccaggccattgaccacctgtacctggcgcgcggcgggggcacgtatgtgcccggctcgttccgcgcggcgagggacccacggggcggctatggcgggtcggaccacgccgccgtgttcgcggacttcctgcccgcgccctga

SEQ ID NO: 4665 - DNA, 1620 bp, Myxococcus xanthus
atggccattggcgtggtcacccacggcaagaagctggcgtacacattcgactatcacgggcgcgcggagattgagattgtcggagaggaagtcgaaggcacgctgaagcctccccgcttccggccccggccgcagagccccgtcttcctgctcgacgaggcggagagcgctcgcgtgctgggcgtcggcggcgacatgtgcctggggctggtggtcgggtacgaaaagatggaggcccggctcaatccccgggacaaatccatcctcccacgccacacgggcatcatcggaacaaccggcggcggcaagtccaccacggtggccacgctcatccaccgagcccaagcggatggcatcgcgaccatcgtcttcgacgtggagggtgaatacacgcacgtggaccagcccaccgaccatgccgccatgctcgaggcgctcaaacggcgaggccagcgtccgcagggcgtcaaggacttgcacatccaccacctcaccgggcgcgacagcctcaatccgcgacaccggaacaagcacgccttctcgctcaagttctccagcctgtctccgtacgcgctcgcggagattctcgacatgtcggacgcacagcaggagcggttcctcaaggcctacgacgtcaccaagctcttgctcgaagacttcaacatctacccgcagacggaagaagagcgccgccaggtcctcgacgtggacgaattgtccacgggctttccccacatgaccatcgaccacgtgctggacgtggtcagcgcgtacatctacagcctcagtgacgaaggcaaatcggagacgcgtggaaggtcacgcgccacccctcggaagcaggcgtccctgctcgaggagaacgacgacgcggaggccgacccggacgtcacggccaaggcgccatcgcgcggactgatgctccgcaccgagttcaagagcaacttcggccgggtcatggcgcgcgtcatggcccagagcagccggcacgaaatcagttggaaggccctggccagcaaactccaccggctgcggcgcctgggcatcttcgacgtgggtaacgagcaaggcgtggcctatgagtccatgctcacacccgggcgcgtctccgtcatcgacctgtcggacacggactcaccgcagctcaacaacctggtcatcgcagacatcctgcgaggcctccaggaagcgcaggagcgacgctacgagcgggccaacgcgaaggaccaatcggtcacgccggtcctcatcatcatcgaagaggcccacgagttcctctccgcgaaccgaattgcccagatgcccgtgctcttcgagcaggtggcgaagatcgccaagcggggccgcaagcgctggatggggctcgtcttcgtcacccagcttccacagcacctgcccaacgaggtgctgggcctcatcaacaacttcgtcatccacaagatcgccgacagctcggtcatctcgcgcatgcagaaaaccgcgggcagcatcgacgagagcctctggaaccgggtgtcacggttggcccccggtcaggcactggtgtcgttcagcaacttcacccggccgctgatggtcgcggtggaccccgcaccggtgaagcggctgttggtggagtga

SEQ ID NO: 4666 - DNA, 1053 bp, Myxococcus xanthus
atggcgcggttccgaaaggaaatcgccagtgccgtggacaaggagggcgtcgtgaagaagatcatccggcaacaagtccttccgaaaatctccgcgaactctcgcggtggtgccaaagaggctggggtctacagggccacgcccgaagaattggccacggtccatcagagcctgctcttctctgggaaggtggaggccgtcaacagcatctcgacgagtcacgagagcctgccaattggaatcacccagattggaatcgccgcggtgggttacggagggacgagcggaacattttctcagcgactgttccggaaggagatgtcggaccagcgttcgaatccagttcaagaggcactcgcgtgcatcgaccagcggatggacaggtcggccagtcctcgcgagaggtcgctctccaaactggctcgtcgcggtatcaagacctacgccgagcgggccgtgctcgtggacaagtccgaagcggagtggcgtatcgggcatggcaatccatgcgcttatgaactgatcacgggctcgggttacatgagcctcctgcgcgaatccatcaatgtgctcaggcgcctcatcctccagcagaagaagttcgtgttcgtgccaagcacgctcgaggagcggggcatcctgaccattggtcatgcgctccaggctggcgagtacgtcatcttcgaaacgctcgagcgctatgggaggcgggtcatcgagcaatggaagtacggggaccgcagccagaacttcgcggcgaggttcgtgcaggaatgctgccccgaagtcatctccggtgtgtttcgcgcatccgagcgaacccctcctcgctcgttctatgcgcatcgcgaccacgtccacctcgcggcgcgagtcgccatggccgacagcatcctccggcccgatcggggattccccatgctgctcgacgtcgcggaagcgtcgtgccggagcgccttcggtgaggatgggttcatgggcctcgtgcatgacgcctatgcccaggcaggagccaacctcgagttcttcaacgagcacagcaagcgccattag

SEQ ID NO: 4667 - DNA, 1218 bp, Myxococcus xanthus
atgtccggcaagttcgtgtcacgcagtctggccctgctgggaatctgtgggggcctgagcgccctgggaggctgtggcgacgccgagccagtgcccgccgccctcgaaccggtgggccaggtggaaggcgccgccattgtcgacaccatcaccgaaggcacctacgtcatccgctcggtgatgacgaacaagtgcatcgacgtcgcctcgtcgagcacggcggacggcgccaaggtgcagcaatgggattgcaacggcacgaatgcgcagcgcttccgcgtcacgcccacgtccgggggctacttcagcatcatcaacgtgaacagcaacaaggcgctcgacatcaaggaggcgagcaccgcggcgaacgcgctggtccaccagtggggttatggcggcggagcgaaccagcagttccgcttcgtgaaggaagtgggcagcgagttcagcatccgcgcgcgtcacacggacatggccattgacgtgtactggggcaacacggccaacggcacggagctggtgcagtacccctacgagcagcgcacgaaccagcgttggacgttcgaccgcatcgacgggggcggtggcaaccccggcacggggctggccgccatcctgagcgagtccacgttcaacgccatgttcccgaaccggaaccccttctacacgtacagcagcctcatcgccgccgcgagcaccttcccggccttcgccaacacgggctcgctggagacgcgcaagcgcgaggtggcggccttcttcgccaacacggcccatgagacgggcaactacgtgtacgtggaggagatcaatcgcggtgactactgcggctcatgggggccgccgggctgctactgcgtcgcgggcaagaagtactacggacgtgggcccatccagttgtcctggaacggaaactactgcgccgccggcgccgcgctggggctgccgcttcacaccaacccggacctgctggcccaggacgccaacgcctcgtggcgctccgcgttctggttctggaccacgcaggccggcgccggaaccatgtccgcgcaccgcgcgatggtcgacggccacggcttcggtgagaccatccgcaccatcaatggctcgctggagtgcaatggtcgcaacccgggccaggtgcagagccgcatcaacaactatcagcacttcaccaacatgctcggcgtgagccctggcggcaacctgggctgctga

SEQ ID NO: 4668 - DNA, 615 bp, Myxococcus xanthus
atgaccagcttccgcgccgccctcaccgtgctgtccctgatgacgctgcccgcctgcttcggcacgtcgcagcgcccgccgccgcccgctcccacgcccgccgcggaggcggaagccgcgcgctccagtggcggcaagctggggcccggagacgtggtggaggtgcgcgtcttccaggagcccgagcactccggcacctggcgcttgtccagcgagggcaccatcgactacccgctgtgcggcaaggtgccgctgtcggggacgacgcccagctcggcggcggaccagctgcgggactgcctggcgcgctacgtgcgccgcccccaggtatcggtgctcatccgcgagtacaactcgcagaaggtgttcgtcttcggcgaggtgcagaagccgggcaccttccccgtggacaacgagatgtccatcgtccaggcgattacgctggccggcggcttcaccaagctggcggcgaagaacaacacgctggtgacgcgcgtggtggacgggcaggagcgcaagattcgcgttcccgtggaggacatcggcgtggggcgggagaagaacttcatgctccagcccggcgacatcgtcttcgtgccggagagcttcttctag

SEQ ID NO: 4669 - DNA, 1329 bp, Myxococcus xanthus
cgtgtcttcagtctcatctggctgggtcagctcatctggtcactgaggacgggactcacccagttctcggtgggtgtctacgtctaccagaacagcgattccgtcacggagtactcgctggcgtcgttcttcgggttcctcccgatggtgctgctcgcgcccgtcgcgggctccatggtggaccgcagcaaccgtcagcgggtgatgctgctggcggacctgggcgcgatgacagccatcgggttgatgtggtgctttgtcgcggcggaccgcgccgggctgtggccccttcaaaactggcacttctatccccccctggcgatgagcgccgccttcagcaccttccgcgtcctggccttctccacggccacgcccctgctggtctccaagcagaacctgggccgggccaacggcatggtggaactggccatgagcgcgggccagctcctgggccccgcgatggcgggcgtgctggtggtgcgcatgggcttgcaaggcgtgctgctcatcgacctggcgaccttcctcttcgcggtggccacgctgctgagcgtgcgcatcccccagcccgaaccggacgccgcgcggaccgagcccaggaagtcgctgtggacggacatcgcgctgggctggcgcttcatccgcgagcgccccggcctgctcggattgctgggcttcagctccgccgtcaacctgatcaccgtactggtgacggtgctcatcaccccgctggtgttgagcttcacggacccgacgacactgggcctggtggtgtcctgctccggcgtcggcatggtggcgggtggaatcaccatgggcgtctggggcggcccgaagcggcgcatcctgggcgtgctgggcgcggagctcgtcgcgggcgtggcattgctggccgcggcgctccccgccagcgtgttcgtcgtcgcctgcgccgccttcgtgttcatgttcaccgcgccggtggccatgggctgctcgcaggccatctggcagagcaaggtgcctcccgccatccagggacgggtgttcgccacgcgccggatgctcgcgctggtcgccccgcccgtcgccgcgctgctcgcgggcccgttgacggacaaggtcttcgacccctggatggcgccggacggcgccctggccaacaccttcggccaggtgctgggcaccggcccgggtcgaggcatcgccctgctctacgtcgtcctgggcctcctgctggcgggctgcgtcatgctgaccgcgtcctccccgcgcgtgcgcggcgtggaagacgagctcccagacgcgttgctgccccagggtctccccgcggcgcaacaacaagcctga

SEQ ID NO: 4670 - DNA, 771 bp, Myxococcus xanthus
cagctcggtgtccacgcggtgctcctgctcaaggcgggggcgcttcccaagacgtccagcggcaagattcagcgccacgcctgccgcgcgggcttcctggacggaacgctcgagctgatcggtgcgtggcgcaacccagccgcgcaggaggcgccgtccgaacaggtcgccgaggccccccacccgcccggcacgcccgcgtggctccgggcccgggtcgcggccctgctccgcgtgagcccggcgtcgctggacacccaagcgccactcacccgctacggtctggattcactgcagagtttggagctgcactcggagctcgagcgtgagctgggcatcgtcctccccctctcagccctgctccagggtgagagcctcgatgcgctcgcccgcagactcacggaggccacgcccgcgtccgagcccaaccccggacccgcgccgctcacgggccccctgccgctctcatacggtcagcaggcgctgtggttcctgcatgcgctggcgcccaccagcgccgcataccatgtggcgcgcgcggttcgcgtccgctccgcgttggatgtcgccgccctgcgacaggcgctgcacgcattgatggagcggcaccccgcactgcgcattcgcatcacctccgaagcgggacaaccgcggcaggaagtgatgtctcccgtggaagtgccgctgcgggtcgaggacgcgtccggacacgatgaggcgtggcttcgggaacgcgtcaccgccgaagcggagcgccccaacttagagcag

SEQ ID NO: 4671 - DNA, 279 bp, Myxococcus xanthus
atggtcgccctgctcccgaagcaggtctacctgtccttcgacatcgacgggctggaccccgtgctctgcccccacacgggcaccccggtgcccggcggactgtccttcgccgaggccgtggccctcatcgccggcgtggtccgctccgggcgcaccatcgtgggcttcgacctcaccgaggtggcccccgaccccgagggcggcgagtgggacggcaacgtcggcgcccggcttctgtacaagatgattggctggatgctgaagtcgcagcaggcctga

SEQ ID NO: 4672 - DNA, 1332 bp, Myxococcus xanthus
atgaggtggagcctgctggtgatggccctgctgacctcgggcacggcgaacgcggacatggcgcggcggcgtgacgccatcgtcgaggtcgtgcagaaggtctcccctgccgtcgtctacatcggcaccgagcaggaggtggagtcgcgcttccgtggacgccgttctcccctggaggagttcttcggtggcatgggcgcggagccggagcgtcagagaatctccggcctgggcagcggcgccatcatcgaccccagcggcatcatcgtcaccaatgaccacgtcatccggggcgcttccgccatccacgtcatcctggcggatggccgctcgttcgacgcggaggtcatcggcagcgacgcggcgaacgacctagcggtgctcaaggtcaatgccaaggaggccctccccatcgcgaagctgggcaccagctccgacctgatgattggcgagacggtggtcgccattggcagcccgttcggcctcagcaagacggtcaccgcgggcgtcgtctccgcggtgggccgcaccttccgcgccgacaaccgcgtctacaacgacttcgtgcagacggacgccgccatcaacccgggcaactcgggcggcccgctgctcaacgtggatggggaaatcatcggaatcaacaccgccatcttcggcgccggcgcgcatggcatcggcttagcgattccgcccgacaaggtgctccgcatcgtcgacgagctgacccgcttcggtaaggtgcgcccggcgtgggtgggcatcgatacggccgacctgcctgtccgcgtcgcccggcagctcgggtgggaccgggcctatggcgcgctggtgacggcggtgtaggcagggagtccggccgcggaggctggcgtgaagcgcggggacgtggtgccgtagctgggcggctcgcgcatccaggacgccgaggacttcgacacccgcgtgcgcggctaccccgcccgctccgccttcccggtggtgctcttccgcgaaggcggcctgcgcaccgtccaggtgacgccggtggagttccccgctcgcatggtcgaggggctggcgtgggaacggctgggactccgcgtgaaggagattcgcggcggcctggccgtgtccggcgtgcgccagggctccgcggcggcggacatcgggcttgagcccggagacatcatcctccgtgtgaacaaccagcccgtgacgacgaacgacgccttccgggagtccctgctcaccgcgcgacggggacgtagcgtcctgttgctcgtgcggcgcgggcgctacggctaccacgtgacgctgcccttcgagcgggaagcaggctaccggctgtag

SEQ ID NO: 4673 - DNA, 2196 bp, Myxococcus xanthus
ctcgcactaacatgcgatgtcatgagttccgtccgttaccaatcccttggtcccctgctggctggggaaggctcacgtgccttcctcggactcgccctggaggacggcgcgtctccccgtcccgtggtgctcatctgggcaccgcaagatgtcgtgcagaaccccgagctgaaggcgaccttgcgtcgcgagaccgctcgcgcgctcgtcttcgagcatccgcacatcctccgtgtccacgccctggccgagcaggatggcggactggcccgtgtcaccgagttcgccgacggcgagcccctgcgtcgcctgctggaggcccacccccgcctgccgccgcacttcgcggcgctcgtcgtggcggatgccgccgtgggtctccactacgcgcacgtcgctggcaatgacgacggcacgccctttgtgcacggtgacgtccggcccgagacgttgatgatctccttcggcggtctgacgaaggtgacgggctatggcgcgctcggcgtggctccgcgcgagcgcggtggcaagcgcgtgaagaaccggcgtttgtacagcgcgcccgagcagctcctcggtggacgcgaggcggtcaacgtccagtcggacgtgttcctcctgggactcgtcctgcacgagtgcctctccgggaagattcccttcaaggatgcggcggacccggacaaggccgtgctcacgcgctcgctgccgcccatggcgcaggacgtgccgctgaagctggacgcggtgctgcgccgggcgacggcgaagcgggccaaggagcggtatccgacggcgctcgcgttccgcgaggccgtagtcgaggccgtcggctcgctgcccacgcatgcggagttctcggagttcctgtcgaagtacttcccgcccgagagcgaggctcgcgcgacgcggcggcgggtgattgaaacgggcatcgccgaggtgatgcagaaggctggcatctctccgcccgccgtggctgagttcctcgcgcgcggcgccctgcccccgggcttgatgcccgcgaagtggccggagttgccgggacagttgcatgcctcgggctcgcccgatggttcgggtgcgcaggctgggagtggctcggcggccggtggcaacgcgcaggcggcaccggctgcgggcagcacggggcagtccggctccggttcggcgggggctcagacgcagtccggtgcaattggccacgcgcaaagtggcgcgggtgcacagactcaatccggtgcaggcagccaggcgcaggctggcgcacaggcgcaatccggcgcgggcgctcaagcgcattcaggcgcacagactcagtccagtgcaggtggccagtcacaggcgggcgcaagcgcacaggtccactccggcgcgggcgcacagcatcagtccggcgcaagcactcaggcccattcaggctcaggcgcacaggcgcagtccggcgcgggcgcacagcatcagtccggcacaggcactcaggctcatcccggcgccacgggcacgggggcctcggcaggggccactgtccccaccggcccgacgggcgcggacgcacacgcggcccccacgacgcctcccgccgcgcagaagcagtcacgcacctggatggccttcgtgggcgtcggtctggcgctcacggtgggcgcgggggccgtcgtgctcagccagctgccctccaacatcgagtccgagctcgaggacgcgggcgtcaccgacgccctgcccgtcgacgccggcgtgacgcaggatgcgggccccgtggatgccggcattcccatgggcacgctggacgtcaccgtggacccgcgcgtggaggtctcgattcctgggcagtacctgggccgcacgccggtctccgcggccgtgcccgcgggccgtcacgtgctgacgctcagcaacccggtgctcggcatccagacgacacgggtcatcaccgtgccggcgggtggccgttcctcgcagcagatcttcctcaacaagggattcgcgaacgtacgcgccccggagggcgccatcgtcacggtggatggccggctcatcggtgccgcacccatcgaggaactggacttgtacgaaggcacgcaccagctcctggtcatcgtgaacaactcccggtggcagaagacgttcaaggtggagccgggccaacgcgtcaccttcgacgtcaacttcgagaagcccgaagaggagtaa

SEQ ID NO: 4674 - DNA, 1260 bp, Myxococcus xanthus
atgaacacctccgccacggagttcgacatcatcgcctggggggccaccggcttcaccgggcgactggtcgccgaatatctcgccaggacccaggacagccaccgcgcacggtgggccctggcgggacgcgacctcgacaagctggagaaggtccggcaggggctggcggcgattgcgccctccttcgcggagctaccgctgctcgtcgcggatgcacgcgacgccgcgtcgctggatgccctggtccctcgcacccgcgtggtctgcaccacggtgggcccctacgcacgttacggcagcgagctcgtcgcggcgtgtgttcgggccggcgtcagctactgcgacctgacgggtgaagtgcagtggatgcggcggatgattgacgcccaccacgagcaggcgcggcagagcggcgcacgcatcgtccacacctgtggcttcgactcgattccgtcggacctgggcgtgttgatgatgcaggagcacatgcgggagcaccatggcgggcacctggaagcagtccgcctctacatgggtcccatgcgcggaggcgctagcggtggcacggccgcgagcatggtgcaggcgatggaagaagcatcaacggaccgctcggtgcggcgaatcatggcccacccgcatgcgctggaccccgtcccaggccgctggcgacccgagtccaaggacgcgctgggcgtccactacagccaggaactgggccagtggaccggcccgttcctcatggcgaccgtgaacacgcgcgtcgtccgacgcagcaatgcgctgctcggtcacccgtggggagagcacttccggtacgcggaggtcgccagctatggcgccgggcccaagggcctgctgcgcgccacgggcgtcaccgcgggcctgggaggcgtcgtcgccgcgatgcaggtgaagcccctacgcacgctgctggagaagaaggtactgcccgcgccgggtgaaggcccgtctctggaagcccgggagaaaggcttcttcgtcgcgcagcttcgtggcgaaggcacctccccccgcacgggcaagcaggtgcggctgaagggcaaggtggcggcgcagggagacccgggctacgcggccacgtcgcggatgctcgccgagtccgcgctgtgcctcgccttcgacgacactccgaccacgggcggcgtgctcacgccggcctccgccatgggcatgcgactggtggagcggctgcgccgtgcgggcatgacgttcgaagtggaggagctgtccacctga

SEQ ID NO: 4675 - DNA, 1374 bp, Myxococcus xanthus
atggcgcgactgctcatcgtcgaagacaaccacgagctggcctccctcatcgtcgccctggcgcaaagccggggacacgacgcgaaagccgcggccaccggcgaggccgcgctggagtcactcggccccggacaacactgggacgcggccctggtggacctgctgctcccggacatccggggcagcgaggtgctggccgcgctgcgtgcccatggcatccccgccatcgccgtcagtggtgtgtacaaaggggaccgtttcgcccaggaggccgtgcaggtccacggcgcccggagcttcttcgagaagccgttcgagctcatcaccgtcatggaggccctggagcaggccggtggcgttgcacctcaaccccgcgctcccccgcccatcgcggagagcgtgctgctggacgagctgctcgataccgaggacctcatcgtgctggaagagttcccccctgagcccagcgacgccgccgagcccctgcaggtcgtccccagtaccgacccgttgccagagcccgcggacacggagcacgccctccccctgcccttcggcaggcgcgagcaggtctggagcgaaagcaccgcgccttcgactccgccgccgcccaagcgcgcgctgcccgactggtccctgggcggcgtcctggaggacgccaccgtcgcgcggctgctcaacgcctattacgaagcccgccaccacggcgagctgaagcttcagcagggccaggtgctcaaggtcgtctacttcgagtccggccgcgtcgtgtacgccgcgtccaacctcgccgccgagcgcttcggccgattctgcgtccgccagggcgtgctgcccgaggcccggctcgccgaggtcgccgccttcgcgaaagagcgcggactgcgcaccggcgaggccatgctgcgcatgggcctgatggacgcggcccagcgagagcaactgctggtggagcaggtgaaggagatcatctggtccaccttcacgtggaaggaaggcggctacggcttcagtgccatgcgcccccgccgcacggacctggtgaagctgtccgtcttccccggtgacctggtgctggagggcgtggcgaagacggagacgctggtgacgctgcgtcggcacatgccgcgctcgcgccggctgttccccaccgccgatgcgccctacggcctgcacgagctgaagctcgagggggcccaggccctggtgctggcgtatgcggacggcagcaagacggtggaggacctgctcgccctcaccgacctgccggagcggcagacgctggccacgctgcggggactggagctcctcggtgtactggaggagcggcccgacacgccgagccgccgtcaccgcatcagcttcgggctgtaa

SEQ ID NO: 4676 - DNA, 837 bp, Myxococcus xanthus
atgatgccgcggctgagcggcgtggagctctgccgccggatgaagcaggaggcacagctcaaggacgtgcccgtcatcctcctcagcgcggtgctgccccagggcgcgccggaggcgttcgccttcctccacaagccctttgaaatcaccgacttcgaatcggtcatccacaaatcgctggccgcctcgccggagccccggatggcgcacgcggcgtcccccgtgggcgcgctggggcagtgggtggcgcagacgctccagggcccgctcgaaacggcccgcgagcagcttcgccggctggaatgcacgccctccgtggaccgcgcggcgctggacacgctggcggcgcagctccagtccatggaagccgtgggccgtcacctgcgcgagctggcgtggctgtcctcgggcgaggcgacgctggcgcgaatcgacacggacgtgggccagcacctgcgcgacgcggtggcggcgcatggcgcacacgtcacgttggaagcacccgaggagccagtccacgcgcaggtggacccgccgcgcatccggcaggtgttcgacgtgctgctggcgaacgcggtccggcagggggacgcggaggtggcgctcgaaatctcccagacgcagctcacggtgcgcgtgaaggacgtggggccgggggtggccgcggaggcgctggcccacctcttcacgcccttccggatggatgcgaagggcgtccgcggaccggagctgtacgtggcctcggagctggtgcgcctgcaagggggcgcgctgtccgtccagtcacgacccggcgagggctccacgttcagcctgatgctgccgcggagcacctga

SEQ ID NO: 4677 - DNA, 1107 bp, Myxococcus xanthus
atggttccggaccccaaggcgatggagctggtctcctcgaaccatgcggacgacaaggagtacctgcccatgcgggtggacgcgacgcggctgagcatcgccgtcgtgaacccgcacgacttctcgacgctggacgcgattgccttcaagacgggcaagcgcgtggtgccggtggtcatccccgagttccggatgaaccaactgctgcgccgttactgcaaggcgttccggccgctgcgcgccgtcgacatgaacgcggtgcggccgcgtccctcggcgggctcgcaggccgagctggccaaggccgcggagacgccgccagacttgatgagcgaggaggagttccagtccgtctacgcctccgccctgcgcggtggcgccgactccgacggggacatgggcgaggaggagatcatcaccggcgtagaggtactggaggccgcgcccgagcctccgcccgcgacggtccggccgcaggtgcccgtggctccgccgccgccaccccaggccatcgctgtcccaccgcagatggttcagccgcacgtgccacccccggcgcccgcgctgggcggctcgccaccgcctgtgcaggtgccgcgcgcaccggagccgccgccgacgccgctgaccttcgcggaagcgcaggcggagctggctcgcagctcggaccgcgaggacgtggcgcacacggtgctgcgcttcgcgctgggcaagtggaagcggaacctgctgctgtcggtgcagggcagcctcgtgacgggctggcacggcatgggggtgggggttcgcgacgcggtggtgcgccgcatcggcgtgccgctgcgggagcagagcaccttccggctcgtgcgggacacgcgctcgcactacatcgggcccgtccgccgtgatgcggccatgggcgtgttctacaagctgctgggggacgggttcccgaagacggccgtcatcctcccgctgctggtgcgcggcaaggtcgtgcacctgctctacgtggacaacggcccggaccagctcactccgcccgacgtgggcgagctgctcatcctctcgcagagcgtgggccgctcgtacgaggcgatgatgcggcgccgcaagagcgcgtag

SEQ ID NO: 4678 - DNA, 888 bp, Myxococcus xanthus
atggagggcgcggcggacctcaacgcgcgcttcaacccggacgctccgctgacgctggaggtgtcgaaccagttcgcgcgctcggaccgcacgcgcaccgcggccgtgggcgtgggcgtgctcagcctcttcaatgaagcgcgcgcgaaggccccgtggcgccccggcggcggcgcgctggagctgacgcccagcgtggcctacgcggtggagttcttccagccgctgagctcggtgagccccgtcggctgcaccgaaagcgtgtgcgacccggccgccgtggagcgcttcgactacggcaacctgcgagtgggcgcggaaggccgctggcgcttcctgccgaagacggcggtggtgctcgacacccacctggacgtgcgcagctacttcaacgacagcacgccgggcgcctcgctactgcgcgtcatcggcggcgtggcgggcctcgtgtcccccaaggtggccgtcacggccaaggcgggctggggccagaacttcggcagcaccggcggcggcaccttcctggggcagttggagggcacctacctctacagccccaccctgagcttcaaggcgggctacctgcgcaccctggagcccgtggccgcctacggcttcttcacggacaaccggggctacggcgaggtgcgcgccctcttcggcggcaagctgacggtgtccggcgggctcgccgtggacttcctgcgcttcgacggcggccggaatgacaccgtcgtcggcgtgaatatcggcccggagtaccagttctacccgtggctgacgggcgctgcaggctacatgctgggtcgccgctcctcctcggtggatggcggcggcctcaactactcgcggcacgaggggtacgcccgcctctccgtgacgtactga

SEQ ID NO: 4679 - DNA, 387 bp, Myxococcus xanthus
atggacgttcagggcttccaccacgtggccatccaggcgcgggacatcgagcgtgtcaccggcttctacagagacctgctgggctttccggagttgacccgtcatctccgcccggacggctccttgcggagcatctgggtgggcgtgcctgggggcggcttcctggccatcgaggcggcgggcggcgagcccgtctccacgccgtttcgccacgaggcgccgggtcttctgctgctggcattccggattccgaaggcagctcgggcgggtgtggtcgacaccttcacccgcgcgggtgtgccgctggagaacgagacgcggtggtcggtgtacgtccgggaccccgaaggcaaccgcgttgcgctcagtcatcacccggaggactag

SEQ ID NO: 4680 - DNA, 2502 bp, Myxococcus xanthus
atggtcgtgccgtcgcacctgaccagcgaggctccgctcacggtggacctcttcgccggaagcggaccgcatcccatcgcgttgttcggcaattcggacggcctgttccgcggacagttggacccggccgggacgaccttctccgccgtgatgttgcccgacggcatgagcgacgtccgcatcacctcggtggacgtgaacacgggcaacggcagcgtccatggcgaaggctttggcctcgcggtgggcgtggatcccagcggggagcccgtggtgctgggggccgtgcccgcgagcagcgcggacaacgcggggactcagtggcgggtccacccggtcttcgagggctcggcgcttccgggcgcttcgcaggcgacgccgctcgaggtgtcgtgcatcggctcctcgttctgcctgttcatcctggaccagccgagcttcaacgtcgtgacgtacgtcaacgccaacgcccccgtgctggacgtggggccctcgcccatcgtggtgaacgaaacggggacggcgacggctcggttctccgccaccgacgccgactccgatgcggtgcgcgtgtcggtggatgcatcgtcaacgccgggcgccgacctggttggcgtcaacatcgtggagcaccccgaccagctcgacgtgacgctcgttccgcagcggcccgtctgcaaggacgaagaggggctcctgcgggtctacgcctcggacgggctcgcgtcccacgacgtgcaggccacggtggcctaccgggtggtgaacaccaaagggcccgcgcagcccacggtgttgccctcacgggagtcgaccaccgcgtcgggcgcgtcgcgggtgttcaccgcgcagccggcgagcgaggcctgtccggcggtgcgctacgtctggtctcccgtctcaggacagtcgggcgcaccgctgctctccaccgatggcggcgcccaggcgaccttcacgccgccggaggtgctgtgccaggagtcgggtaccagctacgcgtacgaggtccgtggcgtggatgaaggcggcctgacgtccagcgccgccgccatcttcaccgtggacgtcgcgccctggggccggccgctggttcccttcgcctcgggctcggagcggacgctcacgtcgggcccaggggccagcgtggacgtggtccccgatgcgctgcacacctgcgaggggacgtccggattgccgaccgtggacacggagtggcggctgagcgcttccggttcgggcattcccgacggtgtcaccgtgaggaccgcggacggaacggccgtcacgttgcactcgccggtgtcgagcgagcgcctgcgcgtcgaggccgcggagtgcgcgtacgggacgctggccctcaccgccaggaatcgcattcccgttaccggcggtggcacgcaggacagcgctgacgccgagctccgcgttcgggtggagccttccctggaggacgtggccacgggcagcctggagctgggcgtggtgccgtcgggcgaaggggacgtggacatcgccctggacacgtcgctgaactgcgtggacgcgcgcacgctgaaggcgcggatgttcctggagaccctgggcggcgaggcgttggactcggcggtggtgccggtacccgggacgtggcgccccgcgctcccgcgctcctgcaccctcgagtcctaccgcgtgcgcggcgagctcttcgacgacagtgaggggccggtgcgagagggcggccgtgctcagacggagattcccaaccagcccctgccggcgcggctgggagcgctcgaagccggggcgctggtggcacgctgtggcgaaggcgcgagcgccacgctgacgcagacgattccggccaatgcctgcggcgaagtggccatctcctggtcccaggtggcggggcccgcgctgtcagaagtctccctggcgggcccgagcgtcacggtgagcacgcaagagacagggctggaggcgttggtgggccagtccatcaccctgcgcgtcctcgccgacgcgggcggcagcaacaccgcgaccacggattacgtgctgccgattacctccgagcgcttcgtggacgtgcgtcacgcgatggagtcgcccacggcttcggagaaggggctggtgggcgtggtggtggagctgcgcaacacctccgagtgcgaggtcggcggcctccactacctggagaacgtggacgggctggagtgggtgcccggcagcgtgaagctggacggcgtcgcggtggaggcgcgggcggtggacggtggcttccgggtggaggacatccggctgcccgcgcagagcacgcagatgctgacgtacgtgggccgctcgccgctgctgtccacgccgcggctgggcggggagatgaccctcaacggcgtgcccgtttcgggggatgccgcggtgccgcctccgacgtcgggatgcggctgctcgggagggggttcgggcgcggccgtcttcgggctggcggcgctggcgcgggtgctgcgccgccggaagtag

SEQ ID NO: 4681 - DNA, 3588 bp, Myxococcus xanthus
atgctggcctgcctgttcgccgccgcgatgctggtgccgctgagcacctgggcgcaggcgctgtcgcaggacactccatcgcaggcctccaccatcgcgggccgggtgtgccaggacgtggacggtgatgggctgtgcggcgcggatgagccgggcctgcccgacgtgcggttggtgctcaccaccggccgcgaagtccgcacggacgcgcggggccgcttccacatcaccggcgtcgatgcccgcgtgccggattcggtggggggactgcacctgcggccagggcgtcatcggctgaaggtggacacgcgctcgttgccgatctccagccgggtcagcccggaggcggcgacggtcgaggtcccctggggcgccgtcgtcctccaggacttcgccgtgcgcagcgtcacggtggaggccgcgcccgtgcggctctcctttgccaaggcaccgcccatggcggaagtcgcgccagggcagggcgtcgtgcgcttccgtgtcgcaggacaggcctccgcgggcgacgccgtcaccgtgtcgggtgtggcagcccaggtggacgagaagggcgcatggcaggcgcaggtgccgctcgtcgagggagagaacccactgtccatcaccgccacgggggcccagggcacggtgcgcctgtaccgccagcgcgtggacgtggtcccgcgtgacggcggttggttggtggcccccaggccgatgctgcccctcgccacgctccagttgcccgcgggcagtgacgcgcccgcggccagtggcgcctcccgcgtgcaggtcgaggcgcccttggggacgcgcatccgcacgcccgagggcgaagtcgtggtggggcccgaaggccgtgcggatgtcctggtggtgttgtccccggggcgcaaccaggtgcccgtgcggctgtcgccgccggatgctccgcctcgtgacgagacgctggagattgccgccgcggtacgtcccttcgccgtgggcctgctggacctggaggccacctatgcgccgcgaaatggcgacgtgcagctgcggggacgcggctctgctcacgcggagctccggctgggcgcggtggacctggtgggcgagctggacctgcgcgacacggatggtcgcacgctgaacggtgccagcctgccagactggctccgcccgcgcatgccggagcgcttcgaccgcgccgccgacccggacctcgcgcccgcggagtggggggacgactcggtgtcactgacgcccaatgcctcggaggcacgtcttcggtttgaggcgcgccacgcggagcacggccgcgcgggcctgggcacctaccgcgcgcagcttcacgaccgtgaagtgggccgttatcaccgtccgctcttcggcccctacgcggaggttcatgccggcgaggaggcgacgcgcgtgggcgtgaaggcgtttggcgggagcctgacggacccggtgcggcaggtgtccgcggtgcccgcgcacgaggagctgcgcgccacgggcggaagcctctactacctgggcgcggcctcggtggcggagggctccgagttggtgcgcgtggagctgcgggacggcgtcaccggtctgccgctgggcgagcggcacctcattcgcggcatcgactacgacatcgactacttcgccggccgcatcctcctggcgcgtccgctctccttcctcgcgggcgaagcctggctgcggaccagcgcgcccacggagtcacccgagccggtgctggtggtggactacgccgcgctgcgcatcgcggacgcgggcgacacggcgggcggtgaggtgtggggcgagtggcgcggctcgcggctgggactcggcgcggtacgcgagggccgggagggacggccgtacacgctctacacgggacgcgcgagcacggcgctcggtggttaccgcatggcggcggaagtcgcgtccagccgtggcaccgccgtggatgcttccttcttcggcgtctcggatgacggtggcctcagcttcatccgcccccggccggacatgggcaccggcgcggaggccgtgagtctccagctgtcaggtcccgggcttcatggcgagggctcggtggacgcggcgttccgcctgcgcgggcggggtttctccgatggcgcacacaccgacgctgcgcgcttccggcagtcgtcaatccgtgtgagccagccgctgggccggctccggttgacgttgctggcggacgagcggagctcggccgatccgcgtgagccattcatggacagcccgttctccgctcgcgtcctggccgcgggtgtgggttgggaagaggcacggtggggcgtgcgtgcggaggtccgtgactcgcggctgaacgcggcgcgggtggcaggagtggggcccacgctcttcggtggtcgcacctccgcgggcgtggcgggctcgctgcgggtgttcgagcggcttcagcttcgcgcagcgcaccggcaggccctggccctgcatggcgaagggcccgggcgcttcgatgacaccttcacgtccgcgggcgtggatgtcgaggtggaccggaccacgcgcgctggggtgttcggaggctggggaccggagctgggcccccgggcgtgggccaacgttgagtcgcggcgggggcaggacgtgttctacggcggttactccgtcgacgtggacggccctgacttcggcgcgggacggacgctgacgggtgcccgcacggagctgccggagagtggcaccgcgctcttcgtggaggatgtgggctcgcacgacgcgacggccgtgcggctggctcgcgccgtgggcttccagcagcaggtgacgggcggtttcagcgtgggcgcgcgctacgagcgcggcgtgcgcagcctgttggacgtggacagcccgctgcggcgcgaggcgggcggtgtcttcgggcagctcgtcctggcgcgcttgcggctggacgggcgtgtggagcttcgccgggaggagggcacgccggagcgaggcgcggccacggcggtggaccgtctgcaagcggtggtggcactggccgcgcaggcgcagttgctggaggacgtgacggcctccgggcgggtggacttcgcgcgcaccgtcaacgcggacgtgctggagacgcggctggtggaaggctacgcggcggtggcgtggcggccggggccctggctggtggtggcgcgttacggcatcacccgcgagctgttgcccggcgtccggtccgccttcggagaccgggccttacagaccctctctctcttgccagcggtgcgcctgggcgaccggctctccgtggcggcgggcctgcatgcggggcacacccgggcggaggactcggggcgttgggtgtggacgggcaccctccgtcccgcggtgcgaatcgtgggcggtctggagctgggggcagagctggcacggcgaacggcgtctcccgagggcgagcggctgaccgcgctccgtgcggaagtcgcctatcgggtcgatgagcggctgcgcttggccaccgggtacacactcctgggcttcagcggcttgggtttgtcccccgactcgtcggacaatcaggaccggctctacctgcgagccgaagtggcctactag

SEQ ID NO: 4682 - DNA, 1776 bp, Myxococcus xanthus
atggggaagccttcggtgcaggcagacggcgcggagctgcgagaggacaccgcggagccgccgctgcgcacgttcgtggtgacgccgcgtccgggcgcgcgtgacgtcgtggtccgcgcgaacgtggatggactggcggcccaggcgcgctacgtgctggggccaccggccgccgaggtgcggctggcgctggagccacccgcacccgtgaagggcaaggacacggaagcgcggctcaccgtccagttggtccggccggatggcaccgcggatgacagcggcgcgcctcccgtggtgagggtgagcgtgggccgcgtggaagggctggagcggacggggccgggcacgtatcgcgcgcgttacgtcctgccggacacgcgttaccccgaagtggccatcctggtggccttctccgcgtggcccagtccgcagtcggtgcatggggcttacgggcgcgtgctcgttccgctggccgcgtccgtgaatctgccgggaacgacggagcccgacgcggagattgccatcgacatcgcgggccagacgttcggtccggcggtggccgggcatgacggtcgcttccgggtgcccatcatcgtgccgcccggacatcgcatcgggcaggggcgggtggtggacaaggtgggcaacgtgcggcggatgcccatcgacctgaggctgccgcccaccgatggcctggcctgcgtgcttcagccgcagcggctcccctcggacggcgtgtcccaggcccggctggtctgcgcgacgagtgatgccatgggccagcccgtggacgacgcgcgcgttacgacccaggtccgccacggcaccttgcgcggccccacgcgcgcgccgggaggattgctggagtggcgctacaccgcgccgcggaagttggtgagcgacgagcgcatcgaggttgcgtggcctcagcgagggcccggctcgcgcgagtctccggcgctggagttggtgcaggggcccgtcgcgatgacccgcctcgaagtgggtgatgcgctggtgcaccacggggctcgcacgcgtgtggaagtgacggcgcgggatgctttcgaccgtccccggccgggtgcgacggtggagttgagcgcactggtgggaaccttcggtccggcggaggagccacagccggggaccttcatcagcgcctgggctccgccagccacgggggcagcgacggacgtggacctgcgtgctcgcgcatgggggccttcgggccatgagccggcgcgcatcaccgtgtggcgggccgcaggcgagctgtacgcgggcgtgtccgacctggcgggtctgccggtgccgggacagccgctgcgtgtggatggccgcgaggtgacgacgggcacggacggcacggtgcgcctggggcccgcgcgcccgggaacgctggagatttcgcacggcgtgtggacgggcctgacgcggacggttcacgtgttgggtgcggatgggcctgtgtttccgttggagcgcccgctggtgtcgtccgccgcgtcccaacgcgtgcgactggcacctgagattccggtgaacgtgcggctcaaggtgagcgggacgcgggtgacgtactgggtggaggatgcgaacgggcaggtgctgatggggcgcgaggtgttcgtctcgctcacgggtggtcagcgagccgaagagcgggtggaggaggggcgcacctccttcaccgtgcgggcgccgggaccggtgagtgtctccgtcgcggatgtcgccacgggcgtcacggcgttggcggaggtgcgcccatga

SEQ ID NO: 4683 - DNA, 1701 bp, Myxococcus xanthus
atgggtcttcatttcggaacccccgggaggtcctatccgatgctgcggacactggccctgagttgctgcctgttttccccgctcgtcttcgcctccacaccggagctccgcaccctgacgggcaccctgcacgtggtggccggcggcccgggtgaccagacggacccgcacgtcagcggaccgctggtggcctatacgaacgagtcccgtggcacgagcgagattcgctaccacgacctgcggacctccgcggatgcggccatccccaatgggggcgcgttcgacttcgtgtcggacatctcggacggcaccatcgtcttcacgcgcgtgagtacttcgagcgccatctacacgttcgacgtggccgtggacgcggcaccgcgggagctggctccggaggcgggcagtagccggcgctccgcggtgattggcggccgcacggtggcgtggcaggacttcggctacaccggcgtgacgtcgcagccggagattgccgtgtatgacctggaccagggcacgctcacccggctcacggatgacacgttccaggaccgtgcgcccgcggtgtcgccggatggctcgacggtggtctgggccaagtgcgacgagcagggcctgcgttgcgacatctggcaggcgcggcgaggcgcctacggattcagctcacaggcgctgacgggcagcgagggcgaggagtcgcagccggacaccaacggggacatcgccgtctacgccagcacgcggaccctggatggcgtgacggaccgggacatctactggaagcccctgaacggcggcacggagcagcggctggcgctgccgggcatggacgcgaatcccagcatcagcggctcgctgattgccttcgaacgcagggacccggtgaggaacgacttcgacatcgtgctctacgacttgagcaccgagacgctctacgccatcaccgagacgccggagaacgagagcctcaccgacctgagcgtggacgcggacggcacggtgcgcgtggtgtggaccgtttcggagaacggcgacttcaacgtccatgccttcaccttcaagttggatgatgagcccgggtgcaagctcgcggcggtggacacgccgtcccccgaggcggtctgcgcgcggcccggtacctggccgctgctcgcggcgctggaagtggcgcgcaccagtggtcagcccaacggcgtggcgctcgggttcgcgggcacgggtgagggcgtgttgtgcgtggacaacggctacaacggcgaggactccaccgcgggctgggtgtggatcaacggccgcgagctggtggacccgtctcgcttcaagcagggtgttccgctggtggccacgcgcgcgccgctggatgggcacaactcgctggcggcgctcatctccggcaagcccggcagtgccttccggctgcgcgtctatggtccccccgccgtgtgtcagcccgtggcggatacctccacgggagcccgcgtcattccggggcgtgcgctgaaggcggtgtcatcttcgtcctcggcggtgtcgccggcgaccttcgtgcccgaagggccggtgcatgacacagcgcttcggggctgtagcacgggcggcgggccgttgacgctttccggggtgatcctgttgctggcgtgttggctgcgtccgagcgcgcggatgcggaaggcgcttcggcacagccaccgcgccctgtag

SEQ ID NO: 4684 - DNA, 630 bp, Myxococcus xanthus
atggacccgggcacggagatttccgtggacgagctgaccgagtcgctgtcccgcatccttctctcgcgcggtatggccaccgccgtcgtgcggccggggcagcgtcacaccttcgaggtgaaggcggcgaacgcggatgccaaggccacgttgcagcaggccggtgccttcaccatgagcaacaacggcgacggcaccgtggcggtggggacgcgtgaaggcgaggtgacgctgctcggtcagggcaaggtcgtcatcgtccgcgcgggacagcaggccgtcgtccgtccggggcaggcgccgtcggagccgtcacccatccccaccagtctcctgctcaaggtggactggcccaccgagcgcacccgccgcgagcgtgagctggtcgttcgcgggcagacgtcaccgggcagccgcgtggaggtggatggcgtcagcgccaaatccgatgcagagggaaacttccagcgaaaggtggttcttcgcgaaggccgtaacaccgtcgatgtccaggcctatggcgtggggcggacgcaacagaaggacaccaaggacgtggtcgtcgacaccacgccgccgccgctcaagacggataccgagaacatctggaatcagccgcgcgacgactga

SEQ ID NO: 4685 - DNA, 1818 bp, Myxococcus xanthus
atgctcgccgcgacggtgcttcccctggccgcggtcggcttcctgttgctttcgcgcgcagaggccgagctggccgcccgaatcgacgcggagcagcgcgcgcaggcggtcgccaccgccgagtccgtgggcgccaccatgatggaggtggtggacgcgctggcccgctcggcggagctcatcgactggcaggccgcgagcgacgcggagacgcagggcgcgctgcggctgctttacggccagtctcccgcggtgagcgcggtgctgaagctggacgcggagggccgtccactgggcgcgcccgtcttccgtgcgcaggccatcgacgggcacccggccttctctctggagtccctggaccggctggtgcgctccattcccgtgcagacgctgcgaggcggcggcaagggccaggcggcgctgggcagcgcgtacgtgcactcggacgaggggcgctcggcggtcgccgtggcggtgaagctggcggaaggcgagggcgcgcccttcgccgtcgccgaggtcgtgctccatccgctggaggcggtgctgcgcaggcgcctgggcgaagggctgggccgcatcgacctggtggacgaggagcggcgcgtgctcgccagcaccgcgtcggagcgccgggggcaggcactggcgccggagctgagcgcgcacctgttggccccggcgctgccgctgacggagctggtgcgcagcttccgcgtggagtcaccggcccggcgggtcagcgtggcgcgcgtgccccatggcatgcgcttcgacgtgctggtggaagtggatgagtccaccgcgttggcgcccgtgcacggcatgcggcgcacggtgttgctgtccattggcgccaccttcctggtgctgctcgggctgggagccctcttcacgcgccgcctcaacgtgcggctggcggaggtggtgcgcggcgctgaggcctacgggcgtggcgagctggacacgcgcttgaaggtctccggccaggatgaactgagcgagctggccaccaccttcaaccgcatgggcgaggagctggaggcggcgcgtgcccggatgctgcgctggaacgacgatttgcgcgttcgcgtggaggaggccaccgcggacttgaaggcggcccaggcgcagttggtggaggcgcagaagctggccgcggtggggcagctcggcgcgggcgtggcgcacgaaatcaacaacccgctggcgggcatcctcggcaacgtgcagttgctgatgctcgaccgaggcgccgccgacccggacttggagtcgctgcggaaaatcgagcagagcgccaagcgctgcaaggaaatcacccagaacctgctgcgcttctcccagcagcgcgagcgcgcggagctgcggccggtggacctcaacgcggtggtgcgtgacgcgctcagcctcacggagcaccagcttcgcggcgatggcgtggcgctcaccagcgtgctgggagacgggctcgcgcgagtgcgtgccgacccggggcacttgtcgcaggtggtgctggcgctggtgtccaacgcgcgcaccgcgatgctgaattcacccgagaagcggctcaccctgcgcacgggcgaagtcggcggcttcggcttcctggaggtggaggacacggggaaggggattgcccccaacgtccgctcccgcatcttcgagcccttcttcacgacgaaggacgtgtggtccaacgtggggttggggctcagcgtggcctggcgtgtggtgacggaagcgggcgggagcatcgaagtccgctcggaagtcgagcagggcagttgcttcaccgtgaagctgccgaaggcgtga

SEQ ID NO: 4686 - DNA, 1650 bp, Myxococcus xanthus
ggggacatgcgggccgagatccacgccacctccagcctgccgggctacgtggtggtgtcctgctggaacagcggagaccccatctcggaggagagcctggagcgcatcttcgaccgcttcgaacaggcgcgcaccaaggccaaccgcaccgtgcgaggcaccggcctggggctggccatctgccgcaacatcgtggaggcccacggaggccgcatctggtgcgagccgtgtacggacggcgtgcgcttcatggtggtgctgcccaccgagccgccgccggagctgcgccggggagacgacgtggcggacgccatccagctcccgcgccggcaggagagccgcggccgggtgctcatcattgatggcgagcccgaggtggccttcatcgcgaaggcgctgatgaccgggcgtggctacgacgtgcggctggccttcgacgcggaagacggcctggccgccgcgcgccggtatgcccccgacacggtgatggtgtccgtgcgcctgccggacgtggacgggctgcggctggcggaaatcctccggcacgacccggagacgcgccgtgcgccgctgctggtgtcctccgccttcgacgagcgtcagcgcgccttccgcgcgggcgcggatgccttcctggtgcgcccgttggcgccggacaagctgctggccacggtggactcgttggtgcgcggccgccagggcccggcgcacggccgcgtgctggtggtggacgacgatgcgaagattgccgccatctgccgcgaggtgctggagaacatcggcttcgacgtggcgctggcgggctccatcgaggaggggcgccgctccctgcgcgagcgccggccggacgtcgtgctgctggacgtgacgctgccggacggcgacggcttcgtcttcctggaggagatcaaggcggagagcgccggtggtcacatttccgtcatcttcatctccgcccgcgcggagacgtcctccaaggtgcgcgcgctcaagctgggcggtgacgactacctcaccaagcccttcgacgcgctggagctaggggcgcgcgtggagagcgtgatgcggcgcaaggagcaggagctgtcggcctctcccaccacgcaattgccgggctcccccgccatcgagcgcgaggtgcagcggcgcctctccgcgcgccgccccttcgccttctgctacctggacctggacaacctcaaggcctacaacgactactacggcttcgcgaaggcggacggcgtggtgcgccagacgggcgacttgatgcgtgaggtgttcgcgcaggacggcgcgcccggtgacttcctgggccacgtggccggtgacgacttcgtcttcatcacctcgccggagtcggtggaccgcatctgccagaaggccattgagacgttcgaccgcatcatcccgctttattacgaccggcaggaccgggagcgcggccacatcgaggcggaggaccgctacggggagaagcggcagttccccatcatgagcgtgtccgtggtggcggtgatgacggacggaacgcaggaccacgcggagttggcgcggcgcgccgcggacatgaagaagcgcgccaaggcgattgcgggctctgtcttcctgcgcagtgaccaggagcgggtggtacgctccgtggccggatga

SEQ ID NO: 4687 - DNA, 1416 bp, Myxococcus xanthus
atgtgtgcccgggccgcctccgtcatcctgctcggcctgtcgctgatgtcgtgtcagacgccgctgcgccaccaccccagggaggatgcggcggcgctgcgctacaacctcacctacgtgcgcgagcccgagcacgtggtggacgtggaggtggtgctggtgcgaggcacgccgcgcgagttcctcttcagccagccgggcgccgtgacgacggtgtccgcgcaccgggaggatgggggcgtccagacgttgcccgtccaggagggccgcgtcctgctgccacgggggacgcgcttcttgcgctaccgctacgcgctggacgcctccattcgcgagcgcggtccggacttcttccagggctccggagacggcgatgcgcggcacgtcgcgggccgcgcgtacctcatccggccgcgggtggtgaagccgggccttcgcgtggagctgtcgctggtgggcaccgatgcattgctgccgtggcagcccggggagaatggcgtgtaccggctgcgcggcgaggacctggtggactcgggcttccacggcttcggcggccgccggtgtcaggtgcgtctgccggacgcggtgctggacgtggccatcctgggacacttcacgcacctgagcgacgcggccgtctgcacctggttgggcaaggccgcggaggaagtccgcaccgtgcggcgcgccttcccgcatccccgcatcaccgtgcgggtcatccccgcgcccgggcatcaggggcccagcgtcttcggcatggtgcgctggagttcgccgcccagcatctccatcagcgtggggcaggaggcgcggccggaggacttcgcgcgggactgggtggccgtccacgagatgctgcacctgacccatcctgtcttcgtgccccgcgtgccgtggctgtcggaggggctggccacctactacacggaggtcgcgcgtgcgcgctccggacggcaggactcgcggcgcgcctgggaggaactgctgggcggctttgctcgggggctcgagggcaatgacacgcgaaccatgcaggaggccgtgtctcaagacagcttttcgctcgctgtctattggacgggagcgctcttcgcgttgcatctggatgtggaattgcgccgtatcactggaaacacgcgcgggctggatgacgtgctggagttgctcgcggctcgcggcagttcctcgaccttcggggcattcggggccgcggtggatgccgtcgcgggacagccgctgttcaatgctctgctggagcggcacttgccgcggcctgcttttgcggagcaggccggtctgctagaagcgctgggtgtccaggaaggacccaacggcgtctcgctggtacccgctcgagacagtctgttgcgtgattcggtggtcggtcggcgcagccacggcgaaacaccctga

SEQ ID NO: 4688 - DNA, 246 bp, Myxococcus xanthus
atgaacgtcaaggcgcttgcagcggttgtcggcaccctgtccctggccgcgctggccacgggttgtgcgaccaagaaggcggcggagatggagcccgccacggccgaggagactggcgcggagagcagcggcgccacggagtcgcaggaggccgctccggccgcgaccgaggagaagggcgccgagggcagctgtggcgccggctcgtgcggctccggctcctgcggcggccagaagaaggagtag

SEQ ID NO: 4689 - DNA, 564 bp, Myxococcus xanthus
atgcgcaacgtcggaatgctcgccgtcctggccgccggcatggcgacggcacaaagcccgtcccccgccgcgccgccagcccctcccgccgccaccgcggcgctggagaaggccagcgacgtgccggactcggcgaagctggtgcgcagcacgcaggcactgagcggcatgcgcgaggtgctgcgctcggtgttggggaaggtggaggaggcccggcggaccaaggacgtggtgaagctcaactgcgccaacgagaagctcactcaaatcaagggcctgctgcgcatctccgagcaggcggacgtgtccctccaggaggcggtgtcccgccaggagtcctcgtccagcgagcacgaattcaccaaggtgatgatcgcccggcagaaggtgggacagctccgctcggaggccgaggagtgcattggccagctcgccttccgcaccgatgaaaatctcttcgtggaggtggaggagcccaacaatctccccggaggagaccccacccgtccccccacgcccgacatcgtcctggtgcgcccacctcccgccagccccgtccgataa

SEQ ID NO: 4690 - DNA, 807 bp, Myxococcus xanthus
ggcgcgggcatcgggctgcgcaggcgcttctatgcggagctgccgcgcaccgaacggacgctcgactgggtggagatcatcccggagaacttcctgtcgctgggtgggcgctcgcagcgcgcgttggacgcatgtgcggagcggtggcccgtgttgccccacggcgtggggttgaacatcggcggcccggacgcgctggacgacgactatgtccggggactggcggcgctggtgaagcgggtggacgcgcccttcttctccgaccacctctgcttttcgcggctggacggcgtgtacctgcacgacttgttgccgctgccgttcagcgaggccgctgtcgagcacgtggtgccccgcgtgcgcgaggtgatggaccgggtgggccgtcccttcctgctggagaatcccagctactacgcgcggatgcccggcggcacgttgcgggaggcggacttcctccgccgcgtcgtggagcaggcggactgtggactgctgctggacgtgaacaacgtctacgtcaacgcgcgcaaccatggctaccacgcgcgggccttcgtggatgccctgccgctggagcgcgtggtgcagattcacctggccggccacacctgctacccggacgtcatcgtcgacacgcatggcgaccgcgtctgcgatgacgtgtggtcgctctaccgctacgtgctggcgcgcaccggcccggtggcgacgctcgtcgagtgggaccaggacctcccttccctggacgcggtgctggacgaggcggacattgcgcgagcatcgctgcgggaggtcgccggcccatga

SEQ ID NO: 4691 - DNA, 738 bp, Myxococcus xanthus
atgaagccgtccctgcgcgacttcttcgacagcatgggggactacctcgccgagcccggcccggagtcactggccgcgctgtacgcgaggcacccgggatgggaggcgccgcgcgagcgggtgtcgctctacggcggattcgtgctcggccatgtgcgctccgcgctggacaaggtctttccgctgacgcgccaggccctggggcaggacgcatgggacgacctggtggtggccttcacgcggacgcggcccgctcggcaccatgagctcaaccacctgtgcgaaggctttcccgcgttcctcgcggacgcggcggcctcgcgggggttggcgcccttcgtgcccgccctggcccgcttcgagtggaccgacttcgcggtgttcgcgtccctggagccttcgcccgaacgcgtggagcggctgatggccaaccccaccctggtggtgctggagcacgacttccacctctgcgcgtacgtgcgggcccgaggcgccgcgacgtcaccggaggcaggcgcggagctggcgctgctgtggcgccatccggagcagttgaagacgctctacatggccgctacgccaccggcgctgctggtgctgaagatggcggtggaagggctggccctggcggacgtggtggcggccacgggcatggcggaagccgacctgcgcgcgacggtgacgcgcttcggccgcgacggactggtgctcctcccggacgacagcgacgggggatga

SEQ ID NO: 4692 - DNA, 1089 bp, Myxococcus xanthus
atgcgcgtcatcaacttcaacgccggcccggccggattgccactaccggccctcgagcgggctcgggacgaactgattgacttccagggctccggcatgtcggtgatggagcacagccaccggggacgggaatacgagggggtccacgacgaagccatctccctgttgacccggctgctggggattcccgacacccaccaggtcctgttcctcactggcggcgcctcccagcagttcgcccaggtgccgatgaacttcctgaggcccggggccagcgcggactacctcatgacgggcgtgtggagcgagaaggccttcgacgaggcgaagtactacggcacgccgcgcgtcgcggtgagcactgcgcggccggacaagcgttacacgcgggtgccccgccaggatgagctgcgcctcgagtcgagcgcggcgtatgtccacctgacgagcaacaacaccatcttcggcacccagtggcacaccttcccggacgtggggaacgtgccgttggtggcggacatgagctcggacttcctgtggaagggcttcgatgtcagccgcttcggcctcatctacgcgggcgcgcagaagaacctggggccctccggcgtgacgctggtggtggctgacaaggcgttcatcgcgcggggccggacggacattccgaagatcttccgctacaccacccacgcggagaacaactcgctctacaacacgccgcctaccctggccatctacctggtgcgcaacgtcctggcctggattcagtcggtgggggggctcgcgcagttggagcagtggaaccgggaaaaggcggcgttgctctacggggccgtggatcggcacccggaattctaccgcgcgccggtggagcgcgaatcccgttcagtgatgaacgttgtcttccagttgcccacggaagcattggatgcgtccttcgtcgctgacgcgaagcagcaaggaatggtgggcctcaaggggcaccggacggccggaggaatccgcgtttccatgtacaacgcggtgagcgtcgaaaatgtgcgcacgttggccgccttcatggaccacttcgtgaagacgcgcgggtag

SEQ ID NO: 4693 - DNA, 558 bp, Myxococcus xanthus
atgaaagccacgctgaccgccgtcgtgctgtccctgatgttcgccgctccggccttcgccaaggaggtcgcgggggtgaagtacccggagaccgcgtccgttgccggcaaggagctgaagctcaacggcgtgggcttgcgcagcaagctggtgttcaaggtctacacggcggggctctacctggagacgccgtccaaggatggcgccgccatcatcagctcggaccagatcaagcgtgtgcgcatgtacatgctgcgggacctggacaagaagaccatcgtcgatgccattggcgacggcttcaagaagaacgcgggctccaagctgccggagctccagcccaagctggacaccttcaacgcggccatcccggacgtgaagaagggtgacgagctcatcctcacgtacatccccggccagggcacgcaggtgtccagcaagacgggcaaggagatctccgtcgagggtaaggacttctccgacgcgctcttctccgtcttcgtgggcaagagcccggtggatggcagcctgcgtgacgggatgctcggcaaggactga

SEQ ID NO: 4694 - DNA, 249 bp, Myxococcus xanthus
atgggaatctgtacgtggttggtgctgggtggcatcgcgggctggctggccagcatcatcaagggcaccaacgcccgcatgggcatgttcgccaacatcgccaccggcatcgtcggggccatgattggcggctggattttcagtctgatgggcggcaccggggtgacgggcttcaacctctggtcactgctggtggcgacggtgggctccgtcatcctcatcaccattgtccaagccatccggaaatga

SEQ ID NO: 4695 - DNA, 2659 bp, Myxococcus xanthus
atgctggtgctgggcggctcgctcatgggcgtgcgcgaagcctggcaggcgctcggcggcgttccgcgccagctcctcgtcacgggcgctctgtggggataccacgcgggcttcatcgggctcggtgtgctcctgtcccggcgctccatgccggtggggcgcgtgctctcgggcattggcctcgcgttgctccccgtcgccttcatcgcgctgtcgtcgctgttcgccctgtcacctgggctcggtgtcgcggtggcgcttggcgccgccgcgctgggcatggtgccgctgaggtcggcgggacgcctgctgcatggcacttccgccgcggccctggggttggcgctcctgccctccctgttcgcggggcttccactgatggcgctcgaggacgcgccctggctgcgcacgctctgtgcctccgtgggtgtcatggccctgaccgccacggtatggcgcgcacggaaggcgacggagggaaaaacggcgctcgtcagcgcgagcgccgcgctctatggcgcgctgtggctcgccgtcttctgtgtggtgagcgcaccgtcgggcttcgacgccctggagccaggtagcgccctgttcgcgggcctcacgctgtgggcccaggcattggccaccgtcatcgccgtggccgcgaccaccgacgccgcgcgcgaggcccatccgcgcgtgagtccggtgctggagattgtggcctacgcggtgctcgccagtggcgcggtcgtgggcgcgctgggcgcgttctccagcgagcccggaggggacttccaggtcgacctggcctcggcgctcgcgccactcatcgcggcgggtgtcttcttcctgctggagccacggcggcgggccctggtccacctcatggtgatgacgacgctcctcgccggagccttgttcgctcgcacgcaggcgccgacggatccgggctggtgggtattcggcggcacggtggcgaccgcgggcttgatgttcctggcgcgttggagtgcctttccgggacttcgtatccgcctgctcgcctggaccctccttgggtcgctggtggcaatgcccttggtaagccaggtgggcagcgccgcctcgccgtggccccaggtgctgacggggctggtcatcgctggggccgcgcacgttgctggcggctggcgctggcggggcctgcactacctgggcggcgtgggccttctcttcggtgtgctcgccttcgtcgaggggaccccggcgttggagggaagctggggccggctggcggtcttcgcgctcgtgagtgggctctacggtgtcgcggggctcgtgcagggcgcgtgggcgcagcctgcgtcgcgaagggatgggctgctgcccctggatgacctcgccctctgcctggccgcggcgggagtcctcctggccgtggattcctctccgagcgctccggacctgctcgtgtcagtcacggggctgtcagccagtgtgctctccgcgcttcccacggccgtggttacggcctggctgctgctgcgtgtccggcgggatggcagcaggctcgtcgggttcctcgcggcctcggggctcgcgctcgcggtctcccaggtgatgggcaccgtctccgacttcgcatccccgcgagccgccctggtcgccgcgtcattggcgctcggcttcgcggccttctccgcactgcgcggccgcactccgctggatgccgcggacaccgctgccgggcgcgagaggcggaggatgttcgacctcttcaggctgccgctcggtgcgcgggggctgccgctcttcacggatggtttcgccacggcggcgctggtgcagacggtcatcgccgcgctcacgctggccgggtggctggccaggcccacggatgcagagcgcgccacgtgcctgctcgcggccggtctgctcctcctggtcgcgctggtggccttcgtgtcgcgcggattcgaggcctggcacctgcgcggctcggtggtgacgctcgcgtcgctgggcgcgttcatcgcgctcaccgctctgctcaaccgcgcgggccggccgtcgccgccggacgtcgccgctctgcggacctcgctcatcggcatcgcgctctggggcgtcgcgctggcgacacggcgcttcgggccctggatcgccgggcttctggagaagcctcgtcacggcaagctctaccactgggttccccatctgggcgtggcgctcctggcatgtgtgctcctgaaaggcgcgctcctagtcggcctgccccggccgtcccgtgcgctggccctcattctgcccctgatgttgctggggcccgcggtgttgatgttgctgctctccgtgtccgcgcgctcggggcgagtaacgagtgtggggctgtccctcgccttcccaggtgcggcaatttggaccgcgaggcagaggcagttcgggcccaggctcacgcaagcgtggtcgtccgaaggcaggtgggtccgcatcggcgccgagtccctgcactggctcgataaggacgcgtggctcgcaccaggagacacagtgttcctgctgtggcagcgggctttcgcgggcatagccgccgcggggctcgtttatgccgttgcctcgctccgggggctgcccgactccttccagcgcctgtttcagcgccattcggtcatcagtgtgggcgaggtcttag

SEQ ID NO: 4696 - DNA, 1401 bp, Myxococcus xanthus
atgcaccacccgcccgaagacacccaacgcacccacatcctcgacgccatccagaagcagaagaacgcgctggcgccgctgcgcatcaccggctcgcccaccgaggtgggacagggtctggtgaacctggccgagctgcacggtctgctggaggaccacgccgccagccggcaattctacgaagaggcgctcgagaagttccaggaggccaagtacaagcccggccaggcgcaggccctgatggggctgggcgtggtgaaggcgaacttcgaggaccaccgcggcgccatcgagcagattgcccgcgccgccatgctcttcaacgagtccaaggaccgtgagggcgaggccctggcccgcgcctgcatctgggactacctgcgctcgctgggcatggacacctgggccgcagcgcgcgaagtcgcccactgggctcgtgcgcttcacgattggcgccacgagccggccttcctcttcagccacgtcttcctccagcggctgggttggagcttcgccttcaccaagtccttggtggacatggcgcggggtgtccccgtcatctatctggtctacggcaactatgatgaggtggcccaccgccgggggccgcgctccgaacaggctcgcgccgagctgcaccgcgtggattcgtacctcgcggagctatacgctgtggcgggcgcggtggagcagccctacgacgtcgtcttcctctccgaccacggacacgtggactgtctgccctgggagcagcggaagggccagcccctggcgcagtggttgacggcgccccacggtgacggacctctctccgacgacgcagtccgcggactatgcgacgggagggctcacccggagctggacacccagcctcgagcgccattcacgcccgtggccatcgactgcggcaacttcgcccatgtgtacctgtctggtgagtccaagccgctggaagccatggccctgctcgagcgccaccccgaggtactggcccgggtgacgcggagtccagacattggccttgtcacactgagacgaggcaacagcgcggtcgcgctcgtgcgcgacggcgtctacaccgtggacacgctggaccgtgccccactgtccgccgaattcagcaagcgcgcggtggcagacttcctccgcgtactcccgaccatgtccaccgcgggcgacctggtcctcttcggcgaagccgtgcagcgcggtggcaccgtgggcttcgcctgggagttcggctcgcacggaggactgactcgcacggaggccaacagcctggtgtgctggcccgcgaaggcgcccgtggacctgtccggcctttctcactgcgtacagctccatgagcggctcgcggcggtctttctcgacaacaccccacgactccggttggtgccgtga

SEQ ID NO: 4697 - DNA, 1620 bp, Myxococcus xanthus
atgaacgacaacgcactgaacgccaacgtgggcctgaagcttcggggactgcgccttgcacggaacatcaagcaggcggacgcagccaaggacctgggcgtttcccccgcgtacctgaacctcatcgagaagggtaagcgggtgatgcccttccccctgctctggaaggccctgcgctacttcgaccaggaccccgagcagttcatgtccacgctgggcgaaggccgcgtggacgaagcgctcgcgaagctgctggacgagccgctcctcaagagcctcgacatcgacccggagtcgctccagtccctctccgcggagccgaagctcgcgggcacggtggcggcgctcttcaacctctacaagaacacccgcacgcagttggagaacgtgctggcacagctcaacgtcgaggagcgcacgcgtgcccagggcggcccgggcaacggcacctcgcccggcgtgcgcttcgactactcgcccttcgacgaggtcagcgacttcctggagaagcaccgcaactacttcccggagctggaagagcaggcggacgcgctgcgccgcgacgtgcggctggagcggcagatcaccagcggtcagctcatccggctcctggaggagcgcttcggctaccgcgtcctcttcgacgacccgtccccctccggctcgtccgtggtgcggcggttggacccggaggagcggacgctgacgctgtcgcccttcctcaccgaacagccgctgaagttccagattgccgcgtccattggcctgctggtgatggaccgagagaagctgctggagcgcgtgctggacgcgggccgcatgcgccacggcgagacgcagcggctcatcaaggtgaacctggccaactacttcgccggcgcgctgatgctgccctacggggacttcttcaaggaggtccagcgcacgcgctacgacgtggagttgctgtcgagcatcttcggttccacctacgagacggtggcccaccgcctgtgcaacctgtcggacccgaagcgccccgggcttccgttccacttcctgcgcgcggacatcgccggcaacatctccaagcgatacagcggcaccggcatccgcttcgcctccggcggcggaagttgcgccaagtgggccgtgcacctggccttcctcaacccgtcccagctgacgcggcagtactccatcatgccggacggcaccgcctatttctgcttcgccaaggtgcagctccagccgattgagggttccatcgtcaagggcaccgcgtactccatcggcctgggcacccacgcggagaacgccaagtacctggcctacggcctgcccacgacggacctgcgcaaggacgccattccgtccggcatctcctgccgcttctgcgagcgcaccgactgcaaccagcgcgcggcggccagctaccgtttcgccttcgccttcgacgagtacacgaagaaggactgcttcttctcccccatcctcgtccacgaaaaggccgataaggcggagaaggaccggcacccgggcgcccattccctggccgtggccgccaacgggactgacgggagcgagaaggacgattcgttggacaagacctcccgccgccgcaagggtggcgacgcctga

SEQ ID NO: 4698 - DNA, 2976 bp, Myxococcus xanthus
atgccctgcggcggatggacgcgccctgcaccgacgacgcgagctgccacgagttgggactgctcgaagggcgctgtgtcagcggggcctgcacggcgccctgcgcaacggacctcgactgcccgggcagccggcggtgcgtggattcatcggcgggccccatctgccaggccgggacgtgaccccgtggcgagccaaggcccccctcggctccgcctcgtcctggtccccctgtacgccgccacgttgtggggctgtgagccagctccccgccctccttcagcggctcacaacacgcctccccggctcgaagtcagccccaccctggacatcatcccgctgcgcgtgggccaggccatggagttcgcggccaccgtcgaggatgcggaggaaggcgcagcgttgggcgccaacgtgctgtgggtgtcctccgtcgaagggcaactggcccgcggcgcgcgcgccaccctcgccttccgcgaaccaggagcgcagcggctgaccgcctcggtggtggacgccggtggactggccgcgagcgcgtcactccacctgaacgtcctcgcgccgggggctcccgtggccaccgtgctgcgccccgcgccgggcagcaccttcaacctcggcgaggtgctgggcctggagtgcatggcgatgacggagcgtggcgtgcggctccagggacgcgcggtgcagtggacgtccgcgctgtccgggccactgcctgccggcgacgtggtgcgggcgaccttgtccgtggccggcgaggacaccctccgttgcaccgcggaggactccgccacgaaggtctccgccaccgccgaagtgcgcgtcaccgtccgcgccacgcgcgcccccagcgtgcgcatcctccagcccgagcccacggagatcttcgtgaagcaaggcgaggccccgccccacggcgcctccgtccgattcgcggccaccgcccaggactttcacgccgaggggggcgcaggcaacctggacggcgcggtggagtggagcctggcgccctccgggcatccgctgggccgaggcccggtcctgacacacgccttcaccacgcccggcgtctacacggtgagggcgcgggtggtggatgggcgcggcaacaccgcctcggaccgcgtgcgggtgcggctggtcaccaaccttccgccccggtgcgagctggagctccccacgaccgagaacccacgcgtgctcgtgggcgtccccagccggctgcgggcccgctgcgtggatccagagacggagcaaccggtggagcccatctggaccaccagcgccgagcccacgcccctgggcacgggtgaagccgtgagcgccgtgctgtccgtggccggtgcgcaggtggtgtccgcgtgcgccgaggacccagaggacaccgcgttgcgcggctgcgtggagcggccggtgcgcgccatcatcaacacgccgcccacgggctgctccatccaggcaccgcttccggatgcggtggtgaacgcgggtgtgccgctgacgctcacgggttcggcgtcggacgcggaggatgcgcggacgggcctgcgctacacatgggtgtcctcgcgggacggcgcactggcccagggtccgagcacgcacaccgtccgcctgtccacgcccggccaccacgtgctgacgctcaccgcgacggacccgtggggactggcctgcgcggcggccgtggccgtcaccgtgaacggcgcgcccgacgtgcgggtggagagcgtgatgcaaggactgctggattgcggcagaggcccatgcgtggaggggcaacccgtggtcctcaccggcttcgcgaggcccgcggccccccagggccacatcgcggagctggcgtggctggacaacctggcggggagcctcttgccggtcgcgctgccgctgcccaccgccaccctcgccttccccctcgccggtcgccacacgacggtgctggccgccaccgaccaggacggcgcggtgagccgcgcggcgacgtccttcacggtgctgccgctgggacgcgcgcggttgatggaggacgtcccggacgcgcagcggcccgtggtggccctggcactcaccccggacgggctccgctacgcggatggcgcctctccccgggtatatgcggaacgcgcgtccacgacggtgctggacgtgaacgccccggccctgtcgctccatgcgtttcaaggtggaggcgacaacgtgctcttcgtgggcaccgacggcggcggcgtgctccggtgcgtccagcgcacctgcacccggcacacgggcgccatgctgggggccacgggcgcggcggtgtccgcggtggccgcatgggaatccccggacgtgctgctgctgggcacccgccggggcctggtcctcacacgcgcgagcgaccccgcctccggaggacgcgcgggcaccgtgggaggccgccgcctgctggagggacgcgaggtgcgccagctcgccatctccccggactccagcccggaacgcgtgacggcctgggcggccacgtcgggcggtctggcggaaatcactctttgggcggacgacgacttcgagcccggactcgccgaagtctctgtgcggcttcacgctccgccggccatccccgatgacgacgtcctctccgtggccgtggggccggagggccaggtgttcgccggcacgagaaagggcttcagcgcgctgggacaacccggtcccgcgctgcgcgacgcgccctggagactgcaggacgaggagattcgcacgctccacttcgaacggcaggccgtggacgcgcgcacgcgagacatcctctgggccggcacgaagaacgggctggtgcgttatgacgtgtcagcagacatcgccacccacttcggaacggaagagggcttgccggacccggacgtgagcgccctgctggtggctccgggaggaccgcgctacgtgggcacggcgcgaggcctggtgacgtacccctggcactga

SEQ ID NO: 4699 - DNA, 906 bp, Myxococcus xanthus
atggcggagctcttcatcatcgccacgaccgaaaaggccgcccgcgtccaggtgcgggtattgggaggccagtccgtccaggtgcaaccagtggcgcccacgcccgcgagcttcctcgacttgcacgtgaagacgaccaacggcttccggctgtccgcggcggaggcgtccgtggagggcacgcccttccagcggctgctgctggacgcgaaggggcggctgcgcgtggggccccttccggacggctgctacacggtgacggtgacggccctgggatttccagccacccaggtccaggactgcgcgggcccgggcgagaagaaggagctcaaggtcgacctggtgctggacgagtcgctcctcggacagggctgccaagagattggctgcgaggaaggcctggtgtgcgcgccgaacaagaagtgcctggagtgcttcggcaactcgcactgcggcgagggattgacctgcaagggcaaccgctgcgagggccccggtccccagtgcgcgccctgcacgggcgactggcaatgcgccgctggaacgcactgcgaggtgctgcccgaaggaagcgccgcgtgcgccacccggtgtggcggcgacgatgacgcccccccctccgtccaggcacggccgaacgacgttgggtcggcacagtgcgcgccgggcttcacctgccagtccgggcggtgcctgccggatgccgcgaacttcgcgggctgccatgccctgcggcggatggacgcgccctgcaccgacgacgcgagctgccacgagttgggactgctcgaagggcgctgtgtcagcggggcctgcacggcgccctgcgcaacggacctcgactgcccgggcagccggcggtgcgtggattcatcggcgggccccatctgccaggccgggacgtga

SEQ ID NO: 4700 - DNA, 447 bp, Myxococcus xanthus
atggagaagctgtccgtcatcgccgcatcgccgctcttcgagatgctctcctccgcggagcttggccacctcgccgagctggcgcgggcgcggcacttcgcggccgggaacgtcatcttcgaagaaggggatttgggcgacagcctcttcgtcgtcgtccgcggccaggtggaggtcgcgcgccgtcagccccagggtggcctgcatccgctcgcggtgctgtccccacccgagttcttcggggagatgggcctcatcgacaaggaattccgctccgccaccgtgtgcgcgaagacggacgtggacctgcttcagctcagcgcgcaggacctccgcgagttccggaggacacatggagatgggttcacctttatcgtggtgaatatcgccaggagcctgtctgcccgcctgcgcgaggccaatgttcgtctcgcgacgaaggactga

SEQ ID NO: 4701 - DNA, 1509 bp, Myxococcus xanthus
atggccctgctggtgggcatcgcctcgttcgacgacccgcgctggaaggggctgcgctacaccgtcaaggacgcccatgatctgggcgccgcgctgaaggaccccgcgcgcggcgggttcgaccaggtgcgcatgctcacccgccgcgaggagacgacgcgcgaggccatcctcgcggcgctccggcagctcaagaaggaggcgagccggcccgacgacgtggtggtcgtctacttctccgcgcacggcacgctggcgcgcgatgcgaagggcgagctgcggcgctacctggtcacccgcgacgcggcctaccgggacattccccagacggcgctgagcatggacacgctgaaggcggagttcgacgggctggccagccggcgccgcatgctggtgctggccacctgccacagcggcagcggcaagtcgttgctgcccaaggaattgaaggcggagctggagggcatcaagtccggcttctacgcccggccgctggaggagtcgtcgcgcgcgtccatggtgttcgccgcctgcgactggggcgagacggcgcgcgaggacgagagcctgcgcaacgacatctacacccacttcctcatcgacggcttgagcggcgcggcggaccgcaatggtgacggcgccgtcacggccaccgaggcccatgaccacgcacgccgccgcaccttcgccttcaccgaggggcggcagcggccgtcggcggaaatcatggaagtgggcgcggaccccgtggtgctctccggcagcatcacccggacgggccgccccgagctgttctcctacaacccgcgcctggacggcttcacgctcaaggtggacggcgaggagcgcacggacctgcccggcggcgcgacggtgacgcccggcaagcgcacggtggacctgaccaagggcgacgccgtcctcatgcgccgtgacgtggaggtgggccagggggaccgtctgcccctggagcgcctgctggcggaggccttcccgcggcgctcactgtcgatgctgggcggcatgttcagcttcgcggatgcccgcagccgcacggagctgctgcccatgtcccccgaagtcgccctgtcattgcggctggaggaccagccgattcaggatttcggactgctcttcgacgtggccttcagcaccggagaccgggccctgaagctgacgccggacagcgaggtgcccttccgctacaccaccgtctccgcgggcgtggcccttccctacctgtggcgctgggagcggctgacgttgttcgcggggccgcgtgtggccggtctgcacctcaggcggtcctttgacgtagaggccgccgtcaacgggcaacggttcttcaccgtcagccccggcgtggtgggcggcatcgtgtggcgggtgggtgagcggctggagctgatgacacaggcccagttcatgctgacgtatgtcgttgtggatgggcaggggcaggccgtgggtttcacgggtggctgggccggcgcgggatatcgtttctga

SEQ ID NO: 4702 - DNA, 489 bp, Myxococcus xanthus
atgcgggcggtggatccggccagccaggaaggctccgcggcggaatggacgggtgagaagggacgcgcacgcgtcgccctggagctgtcggtggtggcacgcgacagcgcgggcgtcctgcggcgtctggacccgggcagcccggtggaggattcggatgtgttgctcctgcgctaccacgccaccgaggcgggcaccgccctgctcttcgagcaacggcagggcgcggcgccggagctgctgggccacttccccctggtcgcgggcacccacgacctgcaggggccgcaggggctcgcgggcgtgagcctcgcgggagaggaaggcccggtgacgctgtggctggtgggctccaccggtgcgccgcccgaggccgagacggtcagtgaaatgttggagggacgaaacggggcaggcccccagggtcaggacccactggccatcatccggttcgacgtgagcgtgcgaagcagccagaatcgtccttga

SEQ ID NO: 4703 - DNA, 639 bp, Myxococcus xanthus
atggagacggtagcgtccaccggccctgtggccggcgggcctttgcgagggtctggaggacaggtgggtgcgtcggagggactgacggaatgggtgcggcgggcagcgcatggggaggcgtctgcctatagcgagatctaccggcgcacacgtcccctggtgacgcggctggtgggcggcttcgcccagttggactcggatgaggtggaggacgtcatccaggagaccttcgtccgggcgttccgggcgctcccccggctgaaggagccgggggccttcgagtcatggctgctgtccattgcccgaaaccgggcccggacgcggctggagcggaagtccagtacccggcggctggaggaggacgtggcggatccggatccggaatcggttccccacattcccgaggcgcttcaactggagcgtgacatcgcggtggtgcggcgactcatcgcggagctgcccgagggcgaggagaaacggacggtgcacctcttctacgtggagggtgagctgtccgcgcgggaaattgcggagaagctgggcgtgggaaaaagcgcggtgacgatgcgggtggagcggttccggtctcgaatcaagcgcgagctgctgcggcgagtcctcgtcggccggtgggagtga

SEQ ID NO: 4704 - DNA, 1038 bp, Myxococcus xanthus
atgaaggcgcgtcccatcgacaatccgcccaacccctgggcgagcaccgcggtggagtacctggacgaaatcccgccgtccaagctggaggtcttcgaggaccacagccggcaggtgctgtcgcacaacgacagcccggacgtggggttcagttggagcgtcaacccgtaccggggctgcctccacgcctgcgcgtactgctacgcgcggcccacgcaccagtacctggacatgggcgcgggcaccgacttcgagacgaagctggtggtgaagccccgggcgccggagctgctccgcgaggccttcgagaaaccctcctggaagggtgaaaccgtcgtcttcagcggcgtcaccgactgctaccagccgctggaggcctccttacggctgacgcgaggctgcctggaggtctgcgccgagtaccgcaatccggtgggcatcatcaccaagggcgtgctcgtcgaacgggacttggacgtcctccaacggctggcccgggacgcgcgcctgtgggtcagcatcagcctccccttccacaacgcggagctggcccgggccatggagccctatgccgcctcccccatgcgccggctgttgaccatccgccgactcaccgaggcgggcatcgacgtggcggtgtcggtggcgcccatcatcccgggcctcaacgacgaggacatccaccgcgtgctggccgcggcacgtgaagccggcgccacccgcgcgcaccacatcctggtgcggctgcccggcccggtgaaggacgtcttcgcggagcggctgcgcgcgaagctgcccctgcgcgcggaacgggtgctccaccgcatccgggaaacccgcggcggggagctcaacgacagccgcttcaagcaccgcatgcgcggtggcggcctctacgcggagaccatccaccgcctcttccacacggcggcgcgcaaggtgggcatccgcgcctcttacatcaccgaggacgctccggacaccttccggcgtccggagcgcaagccgccgcctacgccgcagctcagtctcttctga

SEQ ID NO: 4705 - DNA, 396 bp, Myxococcus xanthus
atgaagaagctcaatacgttgggagttgtgggtctgctgtctctggctgccgttggctgcggtggggagtacacgccggaggaagagcaggccatgcagcagcctgagctgagcgatgtggagcaggccatggagtccgcgtggattgacgctggtcagacgcgcgatttctcgacctggctgttcggcgtgacgccgttctccatccagaacgtcggtaccgcccccacgtcgtattacgcgtactgcgggagcaacaacatctccggtaccgtcaacgtcggccagacgcacagcaacctgaacctcaactgcgcgtggcccggggcgcggctctacgtgagcaacacgagcggcaccgtcggtacccacaagctctacgtctggacctggtag

SEQ ID NO: 4706 - DNA, 1728 bp, Myxococcus xanthus
aagccgcatggcaaaccgatggtgcggtggttccacccgagcaccctggtcaagacgggggtgaaggccttcctctccgctgtcattggcaagcaggcggatcgccgccttctggacgcgctgaccaacccgaagcagccgctggagcagccctacttcgactgcaccgtggacgacgagaatcggccgcgcgacgtgctgtggctcgactacgtgtccgacctgggtgatggctggaacgccacctatgcggtggcgacagcggtgatgaacccagcactggcgctggaagatccggagggggagactcaccacacgcagggaggcgaagtgctcgtctttgggggtgacgaggtgtaccccaccgcgagcgtacaggagtactacgaccggacagtgggcccctatgaagcggcgctgaaccaccgacggcgcgtgccctccctgttcgccgtgccaggcaaccatgactggtacgacgggcttgtctccttcgttcggctgttctgccagggccggacatcggaggcgtggcggacgcgccagcgacgtagctacttcgccatcaagctgccgcatggctggtggctcctcggcacggacatgcagttggagtccgacctggacaacacgcaggtggagttcttcaaagaggtggtcagctacatgcaggacggagagcgcgtcatcctgtgcaacgcagagccggagtgggccgtcagcaagataaaggcgatcgccgggcgcaaggcattggaaggcaacctccagttcctggagcaactggtgctgggcaagaaggtgagcatcttcctttcgggagaccttcaccactacatgcggcactcgggcaaggacggacgacagaagatcatcgctggcggaggcggggcctacctctaccccacacacctgccgggcgagaaacgagagacggagggcttcgagctgcggcagtgctttccgccgagccagaaatcacggcgtctcacgtggcacaacctggcgtttcccttcctcaacccatggttcggcgtcttcatgggtgccttctacctgcagcttgggtgggggctcgcatctgacatgaacagcacgggcgtatcggacaagctctcacgcgtgcttcaccgggcgctcaaggggacagggaccttgttcctcgggggtctcaccctcgtgagcgccatcacgttcgcggacgcgcgccggggcgcatcctggcgatggcttgcgggcggactccatgggtcgactcacctgctcacggcaggactgctgactcgggcggccgccacactggtgaagcagctcggcgtgggagctcccggaagcctgcgccgagacatcgcaagctggctcctgctattcacgtctggcttcctggtcgctccggtcctggtggggctgtacctgatcagctccctcaacgtgtttggttgccacgcgaatgaggcgttctcttcactggccattccggactggaagtgcttcctgcgattgcgcatcgacgcctccggattgacgatctacccagtaggcatccggcgcgtcccgcgcgcgtggaagcgaggggcgaatggcagagacccggtgtgggtgccggaccccgcggacacacgggccacccgcccggagctcatcgagaaacccattgtcatcggccccacccgggcgcttcccgtgagggtcggcgtcggattgcggccactcgcgagcgtgccctga

SEQ ID NO: 4707 - DNA, 1782 bp, Myxococcus xanthus
ttcgacgcaatcatcgtgggctctggctttggcggctcggtgatggcgtaccgactggcagaggccggcttgcgcgtgtgcgttctggaacgaggaaaggcctatccacctggcacgttcccgcgcagtccctacgacatgcgcaacaacttctgggacccgagcaaggggttgcacggcatgttcaacctctggtccttccgggggctgggcggcgtcgtctcctccgggctgggcggaggctcgctcatctacgccaacgtcatgctgcgcaaggacgagaagaccttcgtccatgagcatccgcagaccggcggttatgagtattggcctgtcacccgtgacgacctcgaagaacactacgacgccgtcgagcggatgatgcacgtccagcgatttccgctggcgcaccctccctacgacgccacggcaaagacgctggccatgaagcttgccgccgaacgcctgggccgtgcagccgactggcagcttcctccgctggccatcaccttcgccaacgccggggcggcgcccgcgctcggcgagcccattcgcgaggcggcgccgaacctcttcggccgcatgcgaaccacctgccggctgtgtggcgagtgcgacatcgggtgcaactacggcagcaagaacacactcgacttcacgtacctgtccgctgcgcatcgcgcgggggctgacctgcgcacccgcgcggaggtgaaagagttctggcccgcggatggagggggctacgtggttcagtacgtggaccatgccgaggcccgcgaaggcgagcggcgcgaggtggcctcggaccaactccagcgggtgacgctcaccgcggaccggctcgtactgggggcgggcaccttcggcaccacgtacctgctgctgaagaaccgggcgcactttccacgcctgagcgcccggctcggcacacgcttctgcggcaatggagacctgctgggcttcctgctgcgcagcgtggacagcagctccgggacccgtctgcctcgggtgctggatggcggaagaggccccgtcatcaccagcgcgctccacttccgtggcaaggaggagggcggcaccgggcgcggctactacatcgaggacgcgggctacccggagttcatcaactggctctatgaaggctcgcagcaggccccccttctgaggcgaggcatgcgcctggcctggcgcctcgtcaagggctggatcggcctgacgcgcgacacggatgtcagcgaggagattgctgaagcgctgggggattgcctgggctcagccacgtcgctgccgctactcgccatgggccgggacatccccaacgggaacatgcggctgacacgagatgggaagctggacatcgactggcgcatgcatggttcgcgcgagtacttcggccgtgtgcggaaatccatggaggacatcgccgacgcgctggaggcgaagatggtgcacaaccccctcagttacttgagccgggtcatcaccgtgcatccgctgggtggttgccccatgggacagacgccagcagaaggggtggtgaacgcccatggcgaggcgttccactaccccggcctgtacgtggcggacggctcggtgatgcctggccccaccggccccaacccgagcctcaccatcgccgcgctcgcggaccggttctcagaccacttgattgcgcactggccacgaaccacggcgctccgcaaacaccccaccacggaggaacgcatatgacgatacgagctgccggcgggggaaccgccatcggcgccgggggacgcc

SEQ ID NO: 4708 - DNA, 651 bp, Myxococcus xanthus
atgatgcacatgacggaacccgcacccgacctcaccttcagagagcgcatgtccggccccctggcgatgggcgccacagaccccatggagggggcgacccaggccaatgccgcgcgcttcaccatgcattgcaccatcagcgtggatgacatggatgccttcacccgcgatgcagctcacactgcccggctggaggcgcgcgtcagctacccacccctgggcaaggaactccccgtgcaacagggccacttcaacctcttccgcaatgcggaggagcccggcacgaagctcatgagctacggcctgcgcttcggcgcgaagggccgcgagtacttcctggagggcaccaagacgcttcgcgatgagcctgggttcgacctctggcgggacaccacgcgactctactgctacctccacgagggcccggatgcccgaggccccgtggtgggcgcgggcgtactgacgcttggcaaacgggcgctcgtcgaactcctcggcagcatgcgctcgtcccgccatggcaccgcgggattcggcgccgtgagccacttcggcaggttcttcctggggacgctttgggacgtctatgcgccctgggcccggcaggcgggggaagcgccctccgcctcatccatggagaggagcttgtaa

SEQ ID NO: 4709 - DNA, 567 bp, Myxococcus xanthus
atgttccagaaacgccacggcctgggccagtacgtgttcgaccttcccgtcaacacggaggtctccgtgaagggaggcaagggcatctggggcatgcccaaacacctggcaaacctggacttccgtatccaggacggaacggtgagcagccgctacgacgagggcggccagcaggtggccctcatcgaaatcgaccggcctcgccgcgcgtggctgccgctgtacgccacagccgtcaattactgcgcgttccgcggcatgctcttcaaaagctacatctacttccgagggaagtttggcttccggctggggaagcgcgcgggtgcacggctcgtcatgggtgaccatccacgcattcgaccactccgggcgctaggcatctcccggcgcgcgttcttcacgagcttcctgcccacatccagcggggtgctcgacgaccacttcgagacctggttcctcagtcaggccgtgctgcccgcggagacgtacccggaggggctggagagcgtgatggggatgggccaggggaagacacctcagaagccgccagggcccccacacacatga

SEQ ID NO: 4710 - DNA, 303 bp, Myxococcus xanthus
atgtccgagtgcgtgcgcgcaggacacctggtgcctgtggagggcttccaggcgttgccagaggacctggcagtgcgtgagccggagacggacgcacgcttcgtcttccttgccggtgagcagaatcgctgcttcctctcggagagtcagcgccgcagcttcgagcacctggagcgattccgtcccggctaccacatgctgcatctggtccccggttacggccacctggacatgttcatgggccaggacgcctcccgtgatgttttccccctcatcctcgccgaactcgacaaaccggtgtga

SEQ ID NO: 4711 - DNA, 1344 bp, Myxococcus xanthus
atggccgccacctcgcagaacaagctgctccgcgtcggcgtcatccagaacggccgcatcgtcgaagagcaccacgtccgccgcgaagcggtcaccatcggccacgacgcgaagaacaccatcgtcctgcccgccaccgagggccggcccgcccgcttcgccctgctggagaaccagaaccagcagttccagctcgtcatcgcgccggacatgaagggccgcgtcaacctgggctcgtccgacgtggacttcgaatccctgcgcgcgcagggcctggccacccgccgcggcgacctgcacgtccttcccctgccggagagcgctcgcggcaaggtggagctgggtgacgccaccctcttcttccaattcgtcacgccgccgcccgacgaggcgaagccggtgcttcccacggacgtcatggtcagccggtggaagacgatggaccgcgtcttcttcggcatcctcgccgcatcgctcctggtccacttctccggcgccgccctcatcatcacctcggagacgccgcaggtggccgagctggagctggacgaactggatgaccgcttcgtgcgcgccatcatcccccagcgcccggtggaggcccccaagcccgcggacaccggccccgccgaagcgcccaagagcgacaagcccgatgccgcgcccaaggaggacacgcccgcggagaacaagcccgcgggggacgccgcccagcagcgccgcgcggaggtggtgaagaaggtctccggcaagggccttctgaagattctgggctccaatagcggcggtggccagggtgccttcgcggacgtgctcggcggcgccagcggcggcggtgacatcgccgaggccctggcgggcgcgggcggcgtgggtgtggcccgcgaggcctccgtgggcgcctccggcggtcctcgcggcggcggcacgggcacggtgacggacatcggcgccattggcacccagggcggcggcaaggtggacctgggcgacaagaaggagacggtggtgaagggccgcgtgcaggacgccacgcccgaaatcgaaagcgccgacgtggaccgcgacgcgctggcccgctacgtgcgcgcacgcaaggccgccatccagagctgctacgagaaggagctcaagcggaaccccaacctcaagggcaaggtggtggtgcgcttcaccatcaagacgtccggccgtgccggggacatcgaaatcgaggagaacaccctgggcagcgaggcggtgggcagctgcatccgcaccaccatccgcagctgggtgttccccttcaaacccgacgacgagacagccgtttcctaccccttcgtcttcgcgccggcgggctag

SEQ ID NO: 4712 - DNA, 1191 bp, Myxococcus xanthus
cgctccctgctggcgaagctgggacacggctcgggggtttggtccaatacgcgcaccctgctctccttcgcgcgcaagcagaagctggaagtggtgggcatcgaccgccgggcgcagggtgagcgctcgttggagcttcgcgacgcctacgccgccgaacgcatcgcccgcgccgcccgcgcgccggaccggccactggtcatggtgctggtgggccagtaccacgtggcgccctgccacctgcccgcgcaggtggagcgcgcgctcggcacggagacgcgcaaggggctggtcgtgtaccagaacgcggaaggcgtctggtggcggctggcgcgcgaaggccgcgttggcgccgcggaggccgtggagctggccgacggtaccctctgcctgatgaacgcctcccccgtggtgtgccagcagagcttcctggactacctggaggcggaggccggagacgccccgctgttggatcgcggcgccgccgagcgcttccgtgaaatgtccgcgctgatcggccggctcgccggcgtgcccgtgggccgttccctggacacggtggacgtggccaccgccgcggacggcgacgtcctggcgcgaatccagcggcgcgggcgcttcacccaggccgagctgacccagcttcgccgccacatcctctcccgcgagagcagctacatcccccgcgcgcgggtggcctacctggcgtcactgtcgctgaaccacgcggcggaggaagcggcgcacttcgtccggcactgcgccgtgggtgacgccatggacgcgccgcgcggcgcctcggaggccttctacgcgcgctgcctggaagaggcgctgggcttcttcggctcgaagctggtgaacccccggcgcacctgcctgggcgtggccgagtgggccaagcgcttcggcgagagccgcggcgtggagcggcagatcgccgccttcgtgctggcccacaaggccacggaggcggaagcgccggaagaagccgtgaagctcctccccctgcgcaaggaccgcctgttccacggcgtcagccacgccctgggctatctgctcggagaccggctgtaccaggccttcgacagtggccaggtggccaaggcggaggtgcaggccctgttccgcgaccccttcgtggacccgcgcgcggcctacttcgcctgggccgaacgcctgggcatctga

SEQ ID NO: 4713 - DNA, 3453 bp, Myxococcus xanthus
atgctggagcgccgggccaacggcgaggagttgctcctggccgaccgctaccagcggcacgggctcgccggccccgtcgtcatcaagcgcgtgcgcagccccgcgagctccgcgcgccgacaccggctggtggaggaagtgcaactggcctaccgcctccaccaccccaccatcgcccaggtgcactacttcaagattcaccggggcaagccgtacatcatcatggagcacgtggacgggccgtcgctggagaccgtgctggacctcatggccatgcgggggcagcccgtgtccctggccttcgcgctccacgtcgccgcggagctggcggacgccctgcaccatgcccactcgctcaaggacgcgcagggccggtccctgggactgattcatcgcgacgtcagtccccgcaacgtgcgcgtggctcgcacgggcgaggtgaagctgacgcactttggcgtggcctattcgcacctagtcggccgggaggagacggcggaggcgctgctcaagggcgacgtggcctatgcgtctccggagtacctcgcgggcaagacactgaccgccgcctcggacctcttctcgctggggctggtgctactggagctggccacggggcggcacctgttcgcggccgcggcggaggcgctggagccaccgcgtgcgaagtcgcatgagctgcgcctggaggagcccccttccctgccgctcacacagatgctgatgctgctcgaggaccatggtccccaggacgtggagcgagccgccgcgagcctgccgcccaaggtgcgcgccgtccttcaagggatgctgcacaaggatgcgacgaagcgcttcggctcggcggaggcgctgtgcgaagcacttcgggaatgcatcgtccaggaagtccgtcgcaccggccgccccttcggcagggccgacatggccgcggagctgacgcggctcatcagcgacgccagcgcggtacgcgacgaggtcgaactgctcgacgagagcctcttcccatcgggcctcgaggcccatgaactgtcggggcggggccccaaggacgcctgaagccgggccctggtgctagcgggacagggcgctcgccatcacgacgagcgccttgagcttctcttcgtccagcgcctccgaaagcgtcatcagccggcgttgcagtgaggactgcttcttcgcgcccgcgcggccctcccgggcgaggcccagcagttcatccgtggaggtccgaagcaccatggccaccttccggagcgtggccacacgcggcaacatcttcccccgctccatccggctgtagaccatggggtgcatgtccaacagcgccgccacttccacctgcgtcaaccccagccgcgctcgcgcctcgcgcacggcctttccaaaagtcgctcccagttcttcgtccatggctcgtccggaagcctaacccaaaccccggggcctcagagtggatgccgcggcgctaaacccttcaggaccatgtcaggccaagcactttcatcttccctggcagtagcgggaacggcatcctcccggtggggtcctgctggcgtctggtgacacttcaggtggggcccgccgggtgggaagcccctgggagacggcatggcggaagcgcagaggcgagaagattcgccggggacacgcatcgcgggcttcaccctgggcaagcggctgggcagcggcgcgtgcggcgacgtgtatctcgcgatgcgcgacggcgaggaggtcgcgctcaagctccagtacctccaccggatggcggggtggccggagcgcgagtgcgccatcctcctgcgcctgcgccaccccaacgtggtggcctttcgcgcctgcggcaagttcccaggcgtggcgccccggttgttctacctggcgatggagtgcgtgcgaggacggaccctgcaccagtgggtggaagaggagaaccccagcgctcgacaggtggcacggctgctgcgcggcatggccctgggattggaggccacgcacgcggcgggcgtcgtgcaccgcgacctcaaggagtccaacgtcatggtgcgggagccggacggtgagcccgtcctggtggacttcggcgtgggcgacttcgccggagccccccgactcacccagggcgtcctgccgccgggcaccatgcgctatcgcagcccggaggcgctggcgtttcgcagggccagcagcgcggccacggcccctcgataccggtgcgggccagcggatgacgtctacgcgctcggcgtcatcttctattggatgctgacgggccgccctcccttcctggaggtggtaacccccacggaaatcgaggccgtcatttccgaggcgcctcacgctccccacacggtgaatccgcgcgtgccaccggcgctgagcgaactgtgtctgcggctgttggccaaggcccccgaagcccgagggagcgcggaggtactgagcgcggacgtcgagcgggcactcgcagccgccgacgcggcgtgggacgcgcctttgtgcgagtggcggcaggacgcggaaacacccggcaccgactcccggtccgaggacgacaatgacgccgcgctggcgatgtgggtcgaggcaggtgacgcccgctgggcctcgcccaggcgtgggcccctgccccacaagccaccgctggaaatacgtgcccccgaagcctcggcgccacgaacgcctgcgcgcgaacgtgcggctcgctgggccgtggtgctcgccgggctggcgtgtgcggtgggtgcgtggctctgggtggcgacacccacgctgggtggcgggggcaatcccatccgggaagtggctttgcccggtggcccgccggaaagtgagcaggccgcgcccctgcccagtcccgggcccaccctcgcggccgtcaccgccgaggtggcgcacccgaagaaggaagagctccccgtgaagcagatgcccgacagcgtgacgactccccagcagcccgcctccagcgcgcgggccctcaaggcagcggcccggacgatggtggccgtcgccgcctgctcgggcctgggctgccccagcggcccgcaggtgcgtccggcgcctcccggcgaaccttgtccccccggagcggtggatgccatgaagcgggccggtattcgcatcggtgacgccaccagcctcgccttcgtcgacgacaagcgttttggagagcccgttcccgttcgcgaaggccgcgtccaggtcgaactcggtacaaacttcggccccctgacctcgggaaaagccgtgggcgaactcatcttcgccgaccgcgtctatggccgcttcacccaggcctacacccgtggaggtgacttcatccccgtgtgcctggagatggtcgaacagtacggagtacgcggcatccggcggaagggcgacgacccaggcccaggcatcgccacggttagcaacaccgccgtgctctacgccgtgaatcgcttcgaatag

SEQ ID NO: 4714 - DNA, 363 bp, Myxococcus xanthus
atggggcgcaccggcgtcgccgcaagagagttcctggacgtccgggagcacgcgaggaacagcctggtgctccgttccggcctgaccttccgggccaggagcattctggtggtggtgggcctgaagaacccgctgggcgcgaagccctggcaggccacgggcgcagcactggtggggccggatggcgcggagttgaaagtcgcgcgagtgtgggcacccgccagcctcaaccccggcgacgaaatggacgtcctggtggagaccgaacccgtggaaggcgcgccccgaggccccttcaccctgacgctgtgggcggaggacggcaagcgccccatcatcctcggcaacatcgaattcccgtga

SEQ ID NO: 4715 - DNA, 1446 bp, Myxococcus xanthus
ggatcccccgtggggaccaaccagaactccaagacggccggcccgcgtggcggcgtcctcctggaggacttccacctcatcgaaaagctggcgcgctttgaccgtgagcgaatccccgagcgcgtggtccacgcccgcggcaccggcgcctacggcaccttcgagagctacggcgacttctccaagctgacgcgcgcatccctcttctccgccaagggcaagaagacgccgatgttcgtgcgcttctccacggtcatccatccgacgggctcgccggagacgctgcgcgatcctcgcggcttcgcgctcaagttctacacggacgagggcaactgggacctggtgggcaacaacctgcccatcttcttcatccgcgacgccatcaaattcccggacatggtgcactcgctgaagccgtcgcccatcacgaacaagcaggacccgaaccgctccttcgacttcttctcgcacctgcccgagtcgacgcacatgctcacgcaggtgtactcggacatcggcatcccggcgaactaccgccagatgaacgggcacggcgtgcactccttcaagttcgtcaacgcgaagggcgaatacaagtacgtgaagttcaactggagctcgcagcagggcgtgaagagcctcaccgccgaggacgccgcccgcgtcatctccgaggaccaccagcacgccaccacggacctctacgccaccattggcgcgggcaagttcccctcgtgggagctgagcgtgcaggtgctggaccccaaggagctggacaagttcagcttcgacccgctcgacgcgacgaagatctggcccgaggcgcaggtgccgtccatcaagctgggcaagttcacgctcaacaagatgccggacaacttcttcgaggagaccgagcaggcggccttctcccctggcgtgcagccgccgggcatcgagccctccgaggaccgcctcctgcagggccgcctgttctcctacgccgacacccagcgctaccgcattggcgccaactatcagtcgctgcccatcaaccggtcccgcgcgacggtgagcaacaacaaccaggcgggcagcatgaacttcgccaacacgaagtcggacgtgaactacgagcccagcgtcagccgtgagacgcaggacgcgccgcagtacctcttctccaacgcgccgctcaggggcaccacgcagcagggcggcatcgagaagacggacaacttcgcgcaggccggcgccttctatctggcgctcgacgcgggcgggaaggaccgcctcatcaagaacctggccgcggacctgaatcaggtgcgtgatgccaaggtgaaggcccgcatggtgggtcacttcttcatggccaaccctgactacggcacccgccttgccaaggcggtcaacgtgaagctggacgacgccaaggccgccgtggccacgctcgccgcccgctga

SEQ ID NO: 4716 - DNA, 618 bp, Myxococcus xanthus
atgattcgcaagctgctcttgggaacgctgggcctgttgatgctgggtgccagcgtgttgacggccgcgtggatgtccctgcgcgccacgcccgcgccgcaagggcgtctgctggccacgagcgaggcggagcgctacctgctggccgccgcccgtgccggagagacggacatcgtcgccgggctcgtccaggcgggtacgccggtggaggcgcgggatgctcgcggcttctcgccgctcatcctcgccgcgtaccacgggcacgcggacacggtgcgcgccctgctctccgccggcgcggatgcgtgcgcgggcgacaacaacggcaacaccgcgctcatgggcgcggccttcaagggctatgcggacatcgtcggactgatcaatcagcaaccctgcgcggtggaccagagcaaccgcttcggccagacagcgctgatgttcgcgtccctgttcggccgcaaggaggtggtggagcaactccggcagcagggggcctcccctgacgtgcgcgatggcagcggccgcagcgcccaggactgggcacgcacgcaggagccgaacgcgcccgtgccccaggcgcccaccgcgccggagacgtccgcctcggcgcgatga

SEQ ID NO: 4717 - DNA, 432 bp, Myxococcus xanthus
atggcgcaccagaacccggattaccgccaggacacggaggacctgttcacatcggccgccttcgtcatggacctgggcatccagcccgtggacatccgccccggcgaggtggaggcccggctggtggtgcagccccgacacctgcagcaggacggcgtcatccacgctggtgtccaggcgacgctggcggaccatacggcgggcgcggcggccttctccgtcgttcggaagggccagcgagtgttgtccaccagcatcaccgtccacctgctccagacggcgtccggtgaagaactgcggtgcaaggcccgggtgctgcgcgccggccgccggctcatcgtcacggagtccgaggtccacgccgtctccggcggcacgccccggctcgtgtcgaagaccaccgtcaccctcgcagtgatggagccccgctag

SEQ ID NO: 4718 - DNA, 507 bp, Myxococcus xanthus
atgctggccacggtggaggccttcgagcgggggtccatcaatccggtggtcttcgtggaggaggatggggacctcaccgtctatgtcctccaggggactcgcgaccccatgcgcttctatctcggcggggacatccgcttccgctacagccccgacgggcgcacgcagcgagaggcggtgcggctgcaccagagcgtcttcgccatcagtctggagccggggccggagggcgagctgtaccagggctcggcccactcccacgtcctcttcggggggccgttggagacggagctggcgacgctgatgctctacccggagctgggcgcgctcacggtcatccacgccgcgtcccgcatcgcctacttcttgaccccggacggagccatccgggtgctgagcgaagtgccggagcggcagcggacgttgaggccggatgggacgttcggcccgctcgacatggaggaggaagccgcgcctccgcctccctcgggacaggttgacttgtag

SEQ ID NO: 4719 - DNA, 237 bp, Myxococcus xanthus
atggcccgcctggagcaccggatggacaaggccgtggcccaaggcaggctctcccaggcccaggccgatcagttcaaggccgagggccgccaactgcgtgaggagatgaaggcccagcgtgaagcctcgggcggcaagctctccgatgcgcagaaggacgagatgcggtcgaagatgcgcgccttccgcgagaagatgaagtcggccatgcaggcgaacgcgccgcagaagacgtag

SEQ ID NO: 4720 - DNA, 732 bp, Myxococcus xanthus
acgggcaacaggtggacgcttcccgtcagcccagaagtcatcgccgcggcacgcaagggcgagtggagcatcgtcctcacccccacgaagccggtgccgcgcgagtggttcggcgacgtgaggggcaaggacatcctgtgcctcgcgggctcgggtggacagcaggccccggtgctgccgccgccgggggcccgggtgtcggtgctggacaactcgcccgcgcagctcggtcaggaccgcatggtggcggagcgcgagggcttggagctgcggctggtggagggcgacatgcgcgacctctccgccttcgaggacgcgagcttcgacctcatcttccacccgtgctccaactccttcgtggacgcggtgcgccccgtgtggcgtgaggcggcgcgggtgctgcgtcctggcggcgtgctgctgaccggcttcaccaatcccgtgaactacctgttcgacctggccttggagaagcagggcatcttcacgctgaagtaccggatgccctactcggacttcaccagcctgtccgacgaggagcgccgccgcttcacggacgtgggtgagccgctctgtgtcgggcactccctggaggaccagcttggtggtcaggcggatgcggggctcgccatcgtcggcctcttcgaggactcgttcggtccggaagatgccctgtcgcagtactacaacggcttcatcgccacccgcgcgatgaagctcccggtgcggtag

SEQ ID NO: 4721 - DNA, 276 bp, Myxococcus xanthus
atgcgctccgccttcgccctcatcgtgctgctcgccgccgcgcccgtcctggcccaggacgccagtcaggcctcctcgtccagcagcggcgccacgtcgccgaagaaggccccgcgcaaagtcatccgcctggaagccatcaccgtcgaaggacgcatccagaagccccaggccatgtacatcctccagcgctccaacctgagcttcgacgacctcagtcgcaccgagagcttcgtgcccaaggtcgagaagagcgtggaacaggaacccttctag

SEQ ID NO: 4722 - DNA, 633 bp, Myxococcus xanthus
gaaggcgcgaaggtggcagtgcaccaccactccagtaccgagaaggcccaggcgctggcacgcgacgtcggcggtgcagcgctgcgcgcggacctgacggtggaggccgacgtggacgcgctggttcccgcggcggtggccgcgctggggcggctggacgtgctggtctgcaacgcgggtgtctggcccgccccggatgaacccgtctgggagatgtccctggcgcgctggcgccgcacgctggcggagaacctggacagcgtcttcctgtgctgccgtgccttcctgcggcacgtggccaccacgaagacgggcaacatcgtcatcatcagctccacggcggggctgttcggtgaagcaggacacgctgactacgccgccgccaagggcgcgctggcgagtggcttcctcaagagcctcaagaacgaattgggccgcatcgcgcccctgggccgcgtcaacgtcgtgtgcccgggatggacggcggtggaccgcagccgcgacaagctggcccagccgggcttcgttgaacgcgtcacgcggactatgccgctgcgcaaggtggcgcagccggtggatgtggagcgggcggtggtgtcgctcgcagtcggaccgaatctccgccacatgtga

SEQ ID NO: 4723 - DNA, 243 bp, Myxococcus xanthus
atgcaccccatggtctacagccggatggagcgggggaagatgttgccgcgtgtggccacgctccggaaggtggccatggtgcttcggacctccacggatgaactgctgggcctcgcccgggagggccgcgcgggcgcgaagaagcagtcctcactgcaacgccggctgatgacgctttcggaggcgctggacgaagagaagctcaaggcgctcgtcgtgatggcgagcgccctgtcccgctag

SEQ ID NO: 4724 - DNA, 267 bp, Myxococcus xanthus
atggaccggggtaattcagtcttcgaggaagacgcggacggccacttcctcctgagccttgacaagctggtgctcgacgaggcggtgcttggagaggttcccctcgaagagcgcttggccttccgcctcgcggagtccgtggtccacctattccatcgcaccgtggtggagaaggtgttgtccctgtctcctccccccgaaggactgcgcttcatccccttggcagagtggggggattcttccggattcaggtgcgcgaagacttga

SEQ ID NO: 4725 - DNA, 522 bp, Myxococcus xanthus
atggttggcctcatgggcgggggggccatgctggccgtggggggcgggtttggccggggcggcttgaagaccgacgtcagcggccttcaggaactcgccgcggtccaggcgcagttgctgcccctggatgcatgccacatcgagtacggagtgcgggcaggcgcgctaccgcaccgctcgacgggctcccggaagtccgcctccgttacgccgtgcagtggggcgtcggtttcctatgtttccatcagcgttccggaggagcttcagtcgtctcaagtcgcctttgacatgacgcgaagctccgtctccgcgccctggaagatcctggtcgacaaggatcagaccgcgttccccgacctcaagcagtcgctcgaacggctcgcacccctcatcgtggagaagtatcccgaggcgcttgccacggagattcagcgccgtgtggacagtgagcgcgcgtggcaggagagcaaggctgccgagcgtgctcgcaaggaagcggcgaagacctcgtatcccgagtga

SEQ ID NO: 4726 - DNA, 561 bp, Myxococcus xanthus
atgtccgtgatcaagaagaacatcatcggcttttccgttgtgacggtgggcatcgcgctcaccggggtggtgacgatgggcatccagcccatgggctggatgcggaccacgaacgtggggcgccttccggagcttgccgccgtccaggcgcagttgctgcccctggatgcatgcgaggtcgagtacgggagtcgaagaggatcgggcgggagacgttggattggctcccaggaatatgcctacgtcacgccctgcgggactccgtcctcctatcgtatctccgtccgtgtgccatcggagcgacaggtgcgcgacgtcgccttcgacatgaggcgaagctccgtctccgcgccctggaagatcctggtcgacaaggatcagaccgcgttccccgcgctcaagcagtcgctcgaacaactcgcccccttcttgctcacgcagtaccccatcgagcgccagaaagacgccgacttgaaggtgcgactggcacgcgagagacaggagcggaaggacgctgagcgcgctctcaaagaagaagcgaagaattcttatccggagtga

SEQ ID NO: 4727 - DNA, 816 bp, Myxococcus xanthus
atggtcatcaccgcggccatggtgggcgcggagacgacgcgcgagcagacgccgcacctgcccatcaccgcggaggagatcgccgaggacgccgcgcgttgccgcgaggccggcgcggcgatggtgcacctgcacgtgcgcacgccggacggcaagccgtcgcaggacgcggagttgttccgcgcggccatccgcgccatccgcaagcgcacggacgtgctcatccagacgtccacgggcggcgcggtgggcatgacggtggaccagcgctgcgggccgctgacgctcaccggcgaggaccggccggacatggccaccttgacgacgggcacggtgaacttcggcgaggaggtcttctggaatccccggccgctcgtgcgtgacatcgcccggcgcatccgggcgattggcctgcggccggagctggagtgcttcgacgtgggcatgattgacgaggcccgctacctggcgaaggaagggctggtggacctgccagcgcacttcgacttcgtgctcggcgtgccgggcacgttgcagccgcgtccggaggtgctggacttcatgattgcctcgctgccggagggctccacctggacggtggccggcgtggggcgtcaccagctggcctacgtggacgaggcggcgaagcggggcggcaacgcgcgcgtgggcctggaggacaacatctacgtgtccaagggcgtgctcgcgaagggcaactgggagctcgtcgcagaggcggcgaagcgcgcgcgtgcccatggccgcgagcccgccacgccggagcaggcgcgcaagttgttgcggttgtcgtaa

SEQ ID NO: 4728 - DNA, 363 bp, Myxococcus xanthus
atgagcagccacgacgcacattacggcggcaacctggtcgacggcgcgcggatgctgggcctctttggcgacgtggccacggagctgtgcatccgcagcgacggggacgagggcctgttccgcgcctatgactcggtggagttcctggccccggtgtacgcgggcgacttcatcgaggcggagggcgaaatcatcagcgcgggcaacacgtctcggaagatgcgcttcgaggcgcgcaaggtcatcaagccgcggccggacgtgaatgactcggcggcggacgtcctggcggagccggtggtggtgtgccgggccacggggacgtgtgtggtgcccaaggacaagcagcgggggcagacatga

SEQ ID NO: 4729 - DNA, 786 bp, Myxococcus xanthus
atggtgaagccgagcaagcagatcatccgtccctacggcgaccggcgggacgacggcgtggtgcagctgtcgttcaccctgccggtgccgttgtccgagaaggccaaggaggccgccgccgtcttcacgaagaagatgggcttcactgacgtgaaggtggccgccgccgagcgcgccgcggacacctacaccttcttcatcgtctacgcccggtcgtccgtcgcgctggactacgccgaaatcgacgtgcccgaagtcgtcgtgaagaagatgtccttcgacgacctcaacgccttcatcaaggagaaggtgaagcggcgcatcgtggtgttcggcgcctgcacgggcacggacacgcacacggtgggcatcgacgccatcctcaacatgaagggctacgcgggcgactacggcctggagcgctacgcctggttcgaggccttcaacctgggcagccaggtgccgaacgaggacctcatcaagaaggccatggcgcgcaacgcggacgccatcctggtcagccaggtcgtcacccagcgcgatgtgcacaaggacaactcgcggcacttcatcgaagcggcgaaggcagctggcatccacggcaaggtccaactgctactgggcgggccccgcgtggaccacaagctggcgctggagctgggcttcgacgccggcttcgggcccggcaccaagccgtccgacgtggccaactacatcgtccacgcgctcctcaagaaggaaggcaaggagccgaaggacgcgcactatcagggggagccccagtga

SEQ ID NO: 4730 - DNA, 456 bp, Myxococcus xanthus
atggtcctctccgcgggcggctccgcggatgcgctggcgcaggtccaggtgaagaacgtgtccatccaggttcccgcctcatggaaccgcaccgaggagggtgggaccaacaagttccaggcgcccagtggggacgcctacttcctggtggacgtgggcgccgtgcagacggcgggcatgaaggcccagacgtgcgtggacaagattgtcgcgtccattggcggcaagggctgggagcgtctgaaggtgggcgcccagccagcggcgaagcgtcaggagacggacgtggcgccggatggcagtggcgcggtggattccgtgacgtatgtgggctgcgacggaaagacgacgtggtcggtcgtcttctacctggagcagacgaagaaggagcggttcgctccgctggcccagaaggtgggctccagcgtcaagattcagcgggccggagggaagtga

SEQ ID NO: 4731 - DNA, 1521 bp, Myxococcus xanthus
attgaacatgcgcgcaagctggcggacgaaatcgtcaacccgatcttcgacctcatccgccgtaacaccactgtttcaaccgagcgcactgtgttgcgcttcttcggcctctccggagctggcgcgcggggcgtgccgctcgccaacctgatggtggacaagctgaaggccgccggggtgctcaacaagggcgccgcctactggtacggccgcgcgctgcagttgggtgcgaagagtccgctggaggccgtggagcggctgacggcgctccccacggagaagctggcccccttgtcgcccgagcaggagcacaacctccgtgaggaggtgcgcgcggaagcccgcgccgcgctcgatgacctgaaggcccgcatcgcccagcgcgaagagctccgcaagcagttccccatgcccccggcgccgcacaagtacgtcatcgtggccacgggcaacatctatgacgacgtggaccaggcgcgcgcggcggcccaggcgggcgcggacgtcatcgccgtcatccggtccacggcgcagtcgctgctggactacgtgccccacggcgcgacgacggagggctacggcggcacctacgccacccaggagaacttccgcatcatgcgcgaggccctggacgacgagagccgcaagctcaagcgctacatccagttgaccaactactcgtccggcctctgcatgtcggagatcgccttctgcgcggcctacgagaagctggacatgctgctcaacgacgcgatgtacggaatcctcttccgtgacatcaacatgcggcgcacgttcatcgaccagtacttcagccgccgcatctgcgccctggccggcatcatcatcaacaccggcgaggacaactacatcaccaccgcggacgcgtacgacgcggcccacaccgtcatcgccagccagttcatcaacgagtgcttcgccaagcgcgcgggcctcaaggactggcagctgggcatcggccacgcgtacgaaatcgatccgtaccgcgaggacacgctgctgctcgagctgtcccaggccatgctggtgcgccgctgcttcccggacgcgccgttgaagtacatgccgcccaccaagcacaaggagacggacatcttcttcagccacacgtacgacgtgatggcgaacctggtggccatgtggacacggcagggcatccagctgctgggcatgatgacggaggccatgcacacgccgctcctggcggaccgctacgtggcgctcaagtccgcggcctacatccaccgcgcggcgcgaggcatcgacgaggagttcaccgtccgcgaggacggcaagatcgccaaccgcgcgcgcgaggtgttcggccgggcggagcagttgctccaggagtgccgcgacgagggcatggtgaccgccatcggccggggccacttcggtgacgtgaagcgcgaggagaccggcggcaagggcctcgacggcgtgctggagaaggcgccggactatttcaacccgttcctggaactcctggaggcgcagtga

SEQ ID NO: 4732 - DNA, 1109 bp, Myxococcus xanthus
atggggaagaccgcggacgcggagcgctcctaccgcaaggcactggacgtggcccccgaacagcagtccgcgtgggactgcctggcgcgcctgtatggccgcaccggccgcacggcgaagctggaagccgagctgcgcgagcggctgtcctcccagccggactcggtcgcgctgcgcaccgcgctggccatcaccctgctccaggcgaagaaccacgccgccgcctcggccgaggccaagcaggcgctgaagggcgacgagcggcacgtgcgcgccatgcaggtgctggcgcaggtctactaccgcgagggcaagcacgagctggcgcgcatggtgctggagaacgcccgcgccatcgaccgaaagacgcggccacgcacaacgggctggggctggtgtacctggcgctcgactcgcgtccccaggccttggagtccttcaagacggccgcgcaactgcggccggacttcgcggaggcgcgcaacaacttcggcgccatgctcaacgaggcgcaggactacgcggccgccgtcaccgaactggaggcagcggtgcgcgccgcgccggacttcgcgtcggcccgcctcaacctgggcaacgcccaccggggccaggggaacttcgcgcgggcccgcgccgagtacgagcaggtgctgctgctgatgccgcgcgccgcggatgcgtacttcaacctggccatcctctacctcgacgtggagccgccgggcatggagccgctgaagcgctacaagacggccctcacccacttcgacaactaccaggcgcgcggcggacgcgacgaacgcatcgcccagtacatgaaggacgcgcgcaagctcatcgaccgcgaggagcggcgactggagcgcgagcagaaggaccagctccgaaaggccaccgaggcgcagaaagccgccgaggccagcccccccgagggaacaccgcccgccccttcggtgtccaacccggagccgggcacgcgcgtcgcggcgcctgacgcctcaccttccaccacctccgccccaagcagcccggcaccgtcaccggacggtgcgtccgctgccccggtgcccaccggctcgggtagactcaccgccgactcacagtaa

SEQ ID NO: 4733 - DNA, 1032 bp, Myxococcus xanthus
atgagcatcgacctctacgggctgtctcgcgtcgttggcgagaagggcgtgctgccccagcgcgcgaagcagttggatccttcgctgccgtgccgcgagtccgagctgctcatcgacgtggagagcctcaacatcgacgccgcgtccttcaagcagatcaagggcgaggtgggcggcgacgcgaagcgcattggcgagcgcatccaggaaatcgtccgtgagcgggggaagatgcagaaccccgtgacgggctcgggcggcatgttgattggccgcgtgaaggagctgggcgccaggcaccccgcgcgcgagctgctcaaggtgggcgaccgcatcgccacgctggtgagcctgacgctgacgccgctggtcatcgaagaggtgaaggcggtgcacgcggacatcgaccgcgtggacatccgcggacacgcgatcctgttcgccagcggcatctacgcgaagctgcccacggacatgccggacacgttggcgctcgcggcgctggacgtgtgtggcgcgcccgcgctggtggcccggcacgtgcggccgggcatgacggtggcggtgctgggcgcgggcaagagcggggcgctgtgtctggcgcaggcgcggcgcaaactggagagtcggggcaagctgctggcgctcgatgtgtcgcagggcgcgctggacctgctgtccggcattggcctgtgtgacgtggccctgaaggtggacgcgactcagggcgtggacgtcatggaagcggtgagccaggcgacggacggtcagctctgcgacctggtggtcaactgcgccagcgtgggcaacacggagatggccaccatcctgtcggtgaaggacggcggcacggccatcttcttctccatggccaccagcttcaccgcggcggccctgggcgccgagggcgtgggcaaggatgtcaccatggtggtgggcaacgggtacgtgcccggccacgccgcgctgacgctggacttgctgcgcaccgagccgcagttgctccagctcttcggcacgcgatacgtctag

SEQ ID NO: 4734 - DNA, 1008 bp, Myxococcus xanthus
atgaatggattgctggagtcgagtgagctgctgtcacccgcgctggagtcgaacccgctgggggacccggctcgccgcaagctcaccgtgtacctgccgccgggctacggcgcggatgagagacgctaccccgtcgtctacttcctgcatgccttcggcaacagcggcggctcgtggacgaacgcgtcgggcttcgcgcccaccgtcccccagcgcctggacgccctcgtcgagtccggcgcgattccgcccgtcatcggcgtcttcccggatgcctggacgtcgctgggtggcagccagtgggtgaacagcgacgccattggccggtaccgcgactacctgaccaaggacgtggtgggcttcgtggaccgcacctaccgcaccctgccgaaggctgcctcgcgcgccgtggtggggcacagctccggtggctacggcgcgctggtgatgggccgctaccacccggaactgttctcccacgtgggcgcgcacgcggcggattcctacttcgaatactgctacctgccggacctcccgaaggccgcggcggcgctgctgaaggccggcggcgtggaggcgtggcacgccgagttccgggcgcgcgtgagtgagacgaagatgcgcggggacgacttcccggtggtgaacgttctggcgatggccgccgcgtattctccgaagaagggcgagccgctcaacgtggagctgcccttcgacgcgaacacgggccggctgcggctcgacgtgtggaaccggtggctggtgcacgacccggtgcgcttcgtgcccaagttcatggacgcgttccggaagctgaagacggtgtatctggactgtgggacgcgtgacgagttcaacatccgctggggcacgcggatgctcgcggaggacttcaagaacgcgggcgtcgagcgcgtccacgaggagttcgaggacggccactccggtgtgtcgtaccgcttcgcacgctcgctgtccgtcctggtgccgaacctggcgcaggactga

SEQ ID NO: 4735 - DNA, 561 bp, Myxococcus xanthus
atgttggatgagattcgccgggagctgggcgactgccagcgctgcaatctgtgctcgacgcgcaagaacctcgtgttcggctcgggcaatccccgcgcggagctggtgttcgtgggcgagggcccgggggagaacgaggacctgcagggcgtgcccttcgtcggcgcggccggcgacctgctgacgaagatgattggcgcgatgggctaccgccgcgacgacgtctacatctgcaacgtcgtgaagtgccggccaccggggaaccgcaatccggagccggaggaggttgccgcctgtgagcctttcctgcgcgcgcagttggccgccatccagcccaaggtggtggtggcgctgggcaagttcgcggcgcagacgctgctgcgggacagcacgcccatcacccgcctgcgtggcaactggcgcacctacgagggcatccaactgatgcccaccttccacccggcgtacctccttcgcagcccggcggagaagcgcaaggcatgggaggacctccaggcggtgatgaaggtgctggggaagcaacccggttcgcgcgcgtag

SEQ ID NO: 4736 - DNA, 1167 bp, Myxococcus xanthus
atcgcggcgtacaaggcctgcgagctggtgcgggaactgtcgcgtgcaggcgccgaggtgcgggtggccatgacggagtccgcgcgccagttcgtcaccccgctcaccttccaggcgctcagcgggcaccctgtgctcacggactatttcgaccctgcccaggaggggaacttcggccacctggaccttgcgcgctgggccgaggtgttcgtcgtggcgccggccaccgcggacctgctggcgcgcatccgcgcgggcatggggaacgacgccgtgacgacgtcgctgcttgccttccgggggccggtggtgctggcgccggcgatgaacgtggccatgtgggacaaccccctgacgcaggagaacctggcggccctgctggcctatccgcgcttctcgcgcgtgggcccaggcgcggggatgctggcctgtggtgacgtgggggaggggcgactggcggacgttccagccatcgtccaggcggtcgcggcgcgtttcggcgctggcccactggcggggaagcgggtgctgctgacggcgggccccacgcgcgagttcctggacccggtgcggttcatctccaatccctccacggggaagatgggcatggcgctcgcgcacgcggcccggaccctgggcgccgaggtgacagtggtgcttggtcccgtgggcaccgtggagcgcggcggcttggacatcgtggacgtggtgagcgcggacgacatggcgcgcgaggtgctctcacgggtgggcacggtggatgtgttcatcgccactgcggcggtcagcgactggcgcccggagacgcgcgcgccgcagaaggtgaagaagggcgcttcgacgtcgcccgaggcgctgacgctcgtgcgcacgccggacgtgctcgcggaggcctcccgccaggtggcgggacagccgaagcggccggtgctggtgggcttcgcggcggaaacggagcgcgtggtggcgcacgcgcgcgacaagctggagcgcaaggggctggacgcgattgtcgccaacgacgtgacggcccctggcgcgggctttggaacggacaccaaccgggtgacggtgctcacgcgttcgggcgcgcagcatgaactccagggcagcaagcgcgaggtggcgcaggccctcatcgagctgctgctcgtgtctccgtcctag

SEQ ID NO: 4737 - DNA, 1395 bp, Myxococcus xanthus
agcgaccggccgtccggctcggatgggatggtcccgatgcgcgggatgcccgcgggcacgtattcgatgatggcgtcccatcccgactatcagccgtcggagcgccgggaggtgacgctgacggatgggcagacgctgaagctggaggcggagctgaagcccggagcgccgctcagtggcgaggtggtggacgggcagaacgcgccggtagcgggcgccatgttggtggtggtgccccgtggcgcggagcccgtgcagtccgacgcgagcggccgtttcgagttccgcgcgctgcggccggaccggggctaccgcttggaggtgaggcacccgggctatgaccaggtcgagcgcgccgagggcaaggcgggtggcccaccggtgcgagtggtgctcaagaagcgcgacgtctatcgcgggcgcgtcatgggcgatgacggtgcgccggtgcgccgctttcgcgtggacgagcacgatgtgaatgcaccggatggccgcttcgagctgccgttgcccacagcgggcgaccgcgtcatcgcgtcggtggacgcgtcgggctacgagccgctgatggtggatcgcccggcgtcgtccgacctgggagacctggtgctggagaagctgccgggtgtgtcgggccgcgtcgtcgacgagggcggcgggccggtgccagatgccgtggtgtcgtgcgacgtctgtgacgactccgtgctctccgggcaggacggcaccttcacggtggccagcccgccctatgtgacgcgttactcgctcacggcgcgcaaggggcggctgagcgctacccagtcgttggagcggggcgcgcgggggccggtggagctcaagctgcggcaggccacgcgcctgagtggccgggtatatcgcccggacgggagccccgcggcgggcttcgaggtcgaggccgtcaacgcggaccgcagcgaaccgctcaccatcgtcaccgggccggatggcggctacagcgtggagatctccccgggcaactaccgcttcgcgctgggcgcgaaccgggagttctctggcgagccggcgctggtggtgcaggttggcggctcggagatgtcgctggacctgggcccggcgccgggcaccgcgtcgctggccgtccaggtgaagccggagcggggccgggcgctgtgggtcgtcgcgggagagctgggggcggtgggcaatcctccggcggtggcgttgatgcgctcgcgctgggcgcagctcgtgtaccagccccggtcggagcaggtccgcttgagcggcctgcggcccgggcggtacacgctggtgtggggcaacttccacgtggagaccccaggcggaccggaggtccgcgtcgtggatgtgccttcgagcagtgacgtcgtgatgatggcccactga

SEQ ID NO: 4738 - DNA, 219 bp, Myxococcus xanthus
atggcgggcccgtactactacgcgtggtcgtcggacaacgggaagcggctcgagatctgtgccaacgacctgacggtgcaccgctccaacggctcgacctgtacgctgactcgcgggcagaccttcaccgtgtatagcggtggcagcgagtgggtttccggccacgcctggggcaactgcaacctggacggccaggtgcagaacggctggttctgctga

SEQ ID NO: 4739 - DNA, 516 bp, Myxococcus xanthus
tccgcgccactggtcgatgtggcccggtccgcgggggtcggacgggcgacacttcaccggtacttcggctcccgagaggaactcctccgcgaggcagggttggactccctggtgcagctcgaacaggcgttgaaggcgcaccgcttcgagcggctggcgcccgatgtggctctggagtccttggtgggcgcactggccccatggggtgacaggctccggtttctcctggtcgtctccgagctgagtcaggagccctcgctcaaggccatcgaagcccgggtggacgaacaaatcatgcgcatcttgttgcgcgccagggacgcaggcgtgctgcgccaggacctcccgagcgcgtggctgttcgccaccttcgaggcgcttctgtacgcggcctggacggcggtcgcccaaggtgacctcgccgcgaacgatgccgctcgaacgattcacgagacgctgcttcacggccatggcacggggcacctcactggcgccaggaaggcgcgcccacgatga

SEQ ID NO: 4740 - DNA, 555 bp, Myxococcus xanthus
atgctgtgggcgggcatctgtctgttcgtcctgtcggagttcgtctcagcggggctggtgaagctcgcgattcaaagcgcgatgggcgagcacctgggagcaaacgtcgtgatggcgctcctcggcacgcactcccttccttccatgccgctgttcatgctctccgcgctgggtatcgcctgcttggtcctggggggcagctttgtcctggggaaccacctcccgcgacgcattcgggaggcgctggtgtccacggggcgtctggcgttgacctggtatctgggccatgtgctgttgttggtggggctctccgtcgcgggctacggcaaccgcctctccgcgctagccgccatgggggtggcgttcgctggattcgcgggtgtcatcgccgtgtcgtacttgcgaggcggagcacccatgctgctggagcgaatgctccggcgcttctccacatcgagcccaggccccggtcctgacaaggcggcagtcgtgctgccccaagacgtcgctcctgctgctgctcggcggagagacggcgaggctgccaatccatga

SEQ ID NO: 4741 - DNA, 504 bp, Myxococcus xanthus
atgcgccgtcccctctgcgccccgctcctgctcgcgctcgccctgctgctgggggcatgtgaccgccaggaccgctatgaccgccccggcacgccggtgccggagagcctgtgggcggagacgctggagggcgagcgcatcgaccgggcggcgctgctgggccgcccctgggtcatcaacgtgtgggccccaggctgacacgcctgcgctcgggagttgcccgagctcgaagccctgaggagtgagtacgaggcgcgcggcgtcggtttcctcgcgctttcgctcaaccccagcgaggcgcgcaaccgcgagactgcggctgcgctgggggtgcacatgaccgtggccacggcgaagggcgaggtgctgggcccgctgcgcatctccaccgtgcccgccaccgtcttcatcaaccgcgagggcgtggtggtggcggccgtcaacggcgagcgctcacgcgggttctacgcgcggcgcctggaggcgctgctcgctgcgccgtag

SEQ ID NO: 4742 - DNA, 2097 bp, Myxococcus xanthus
gacctcgagtacgcgaagctggtcctggcagcgcgcaagcagctccggacgcagcgggagtacgtcgacgagcgccgggccaaggtccacatccacgagtaccgccgacgcatcgacggcgcgctcgcgcccctgaacgagcgcatggcgaagctcggccagggtgacccgggctccaaggcgatggacgatgcccgcgccgcggtggacgcgctcgtgaagttggcggaggagggccggcctctcaagagccaggacccgaagttctccacgtacctcaccgaggtcgaggcgaccctcgcccgtcaccagaagacgctcgacgagcggtggctgcagctgtcggcgcagaagcagcggggccttctggatgagagccgcaagaccctggcgagctcgctcaacgaggtgggcaaggcctggtcggacgagaagttcgccgccaccgacaaggcggtggccgcgctgcagaagcagcttgaggagggcaggccgctcgaggcgcaggacaaggcctatcgcgcggaggcggagaaggcccgcgccgaggtcacccaggccaggcgtcggatggatgagctcgtggcgcaggcgggtgtctcgcgggtcaaggtggagctggagcctgcccatgaagagctccgtgcgtccgccaaggcgcttcgggtgaagcggcccgcgcccgagcagctctccgaggccaagaccgcggcgttcgtcgtccggaagctggtggacaagtacgagccgcaggcggcgaggagccaggccattggccagtatctcgccgaggtgaagaacacgctcgtcgaagtggaggtggcgctccaggtccgcaccctcgacgcggcgcgcgccgaggtcgtccaggcgctgcggaacgtcgagaagcggtccgtgaccgccgagcagttcgaggaggcgaagacagcgatggtcatcctggagaagacgctcgagacggtccacgtgaagaaccccgccatcagcccggtcgccgctgacgcgcgtcagctcctcaaggacgggcgggcgacgatggagcggcgccggtacgaggtcgacctgcagcagcagcgcgcgaaggtggacgaggcccggaagaacgcggtggcgctggtctcacaggtccagaaggagacgccctcggaggcgcagctccaggcggcggagaacgcggtcaagcagattggcgtggtgctggaggcgggtaccgccctcgtcaagaaggaccgtgattacgccctgtacgccaaggagtcgaaggaacggatggctgagctgaacgaccgcatcacccggcggaagattgtcctggccgcgggggatgcccgggtccagctcgcgtcccggctggccgccacgaaggagcagctcgaggtcgacaaggcgatctcggcgaccgacgccgaggttgagaccgcctcgaagagcgtggacgagatcatgcagatgttcgagacgcacgcggcgctggagcggcaggacgcgggctacgctgcgtccgccgagcggtcgcgcgccgactggctgaagatggtcgaggcgctcgagttcgcgaagcaggtgagggcgctgcgccggctgaccggtgaggcgctggacgtcgccggcaaggcggcggcatccgccgcgtcctccacggacctgcgcaagcgcagggccctgtacacgagcgctgcggagaagctcaaggcttgccaggatgagggcgcccggatggtgaaggagaacgccggcctcgcggcggttgacgtgctcgtggacggggtccgcacccagccccaggacgtgatggcccagtgtgcccagaaggcagagaccctgcaggcgcccctgaagcgcgtcgacgtggagctccggttccaagagggccagcggaaggcctacgacgcggcgaaggcccacctctccaagggacgcaagaacgaggcgctcgcgcagctcaacgattgcatcgcggaggggcgcatcctcgagaaccgataccccgacttcaaggagcagaagttcgacatcggcggcgccagcatgagcatgttggagctggtccaggtctgcgcgaaggagcgcaaggcgctgcagccttccccttga

SEQ ID NO: 4743 - DNA, 735 bp, Myxococcus xanthus
actgccgccggctcgctgtggcgggttgacgtgaacggcacgaatgccattgagctcgagaccggcatcagcggggcatcttccgtcgcagccgacccggtaacccgtaccctcttctacacgcgcgacagcgcaatcgttcgagcggacagtgatggggcgaacccagtcgatatcgtggcgaacggaggttaccccagcgggctggcagtcgattcgacgaaccgcaagctgtactggtccgatttcaatggaagccgggtcatgtgcgccgagctggacggcagcaaccccacgcaggtcgtcggcggaatcggtagcccgtctgccatcgcggtcgatgtcccgaacggtagtgtgtatgtcattgcctacaacaacaccaggctcgtacggttcaatctggatggtaccaacctggagaccctcgcctcaaacctgggcggactgggcgtgggtctggcggtcgattcgagcggcgggaaggtgtactactcgacccgcggcaacagcatctatgtcgccaacctggacggctccgacgtcaccaccctggtgaccaaccagaccaccgtgcatgggattgccatcgatgtcacggccgggcggctgtattgggcggattggctggggaccgtgctccggagtgccaatctggccgacggcagcgatatccaggacgtgaactcaggcagcgccaggaacttgggcctggcctggatgcctgcgccgtag

SEQ ID NO: 4744 - DNA, 411 bp, Myxococcus xanthus
atgggtgccctgttgctcggggtgaccttggcagtgtgcgtgcctcacctgccggactggggaggcgtgtggatcttcgcagggctcgcggtgggatttggcgggctgctcgtggccacggaagcggttgcgctgcccgtaccgctgagaggcctcgtgtaccagaccgcggtcctctcctatggcacctatctctggttctgggtcgtggcgcgcgtgttcgagcggcgaaacctgaccttgggtgtttggggattggatctgctcgccttcatcacggtgacgcatggggtcgcatgggtgacctacgtcgcagtggagagacctgccctgcggctgcgggataggctgcttgcgtggcaggcctcgcgggcggaggcgcgtgacggggtggtggcacccggacgctaa

SEQ ID NO: 4745 - DNA, 2574 bp, Myxococcus xanthus
atggcactcaagtgcctggcggcggatgtcgggacgacgttggccatccgcgtcttgcgcgccgagccgtcgagagcgtggagtggcgtcgtgcattccatgagggggcggcccattccgggcttcatcgtgctcctcggggggagacactcgatgcgaagccgttctgctgtgctgcggtcgtgggggctgggcgtgacgctggccttgtcgctgggcgcatgtggtgtggagtccctggaggagaaggtacgtcctctggagaatggggtgtcgccagggaacggccaggcgttgacgcgtgagcgtccggaagcctcgttgacgtgggacccgtatgcggacgcggtggcatcgggcaccacggcggcggtgctcaacgcgagcgcagcgctgggcgctcccgacgggcaggccgcgacactgctgggcttgctcaacacggcgctggtgctggacctgggccagggagaggaaggcaccggcgacctgcgcgtgtactaccagggtctgtcgttggcgctggtggcgcaggtggacttcctgaaggcggacgggaccttcatcggctccagctcgttgcacctggtggagttgggcctggggacgcatgtggcggtggcgacgtacccggggaacgtgccctatcgctacgtgcgactgaggggctctgtgctcgcgctctacctggtggacgcggtggagacgtcgctacgggccgtctgtggtgatggggtgctgggcaggttcgaaaagtgtgacgacggcaatcagctctccggagacggctgtaacagtgtctgtgaggtggagccgggctacacctgcacggggcagccaagcgtttgcgacaacaactcagcgcccacggtcgaggacgtccacgcgaacacctccgaggacatcccggtggacatcaccatccccgcggtggacccggatggcgacgtgctcgacttctccttcaccctgcccggccatggaatgctcacggacacgggggcgtcggtgacgtacaccccgaacgcgaacttcgccggagaggacaccttccaggtcacggtctccgacggcaagaagcaggcaacggccaccgtctcggtcacggtgactccggtcaacgacgcgcccgtggctgcctctgccactgtgacggtgggctacaacacgtcgacgcccatcacgttggcggccaccgacgtagatggggatgcgctcgcgttcaccgtgacggatcccgctcacggaaccctgtccgggacgggcgcccagttgctctacacgccggccgcggacttccagggggaggactcgttcaccttcacggccaacgatggcgcgctgacctcccataccgccacggtcatcatcaccgtcagggggccgcctgtctgcggcgacggctacatcgattcgggtgaggtgtgtgacgacggcaaccgcgtcgcgggagacggctgccgagcggactcccgtggcgtggaggtatgcggcgacggcctggtcgacagcgtgacgggagaacagtgcgatgatggcggcacgatccccggggatggctgcgacgccgcgtgccaactggatgccttttcaaatgtgccccccacgctcatcagcggggcattggactgcaccacggccaactcgaacccgggccgtaaggccgcggtggatgcactggggcgcttctacgtcgtcatgaggtgcggtggcgccgtccatgtcagcgtgagcgtggaccgtggccacacctgggtaggtcccactcccctgggcatcaccaacgcggcggaagtcgcgattgaaggcggccccaccggaattgcctacgtcgcggccaccagcgcgggcacgctgatattcacccggaccgtcgacgcgggagcaagctgggaggcgccgcgagtcctcagcccggcggccaaccctaccgtcagtctggattccaggggtgacgccctctacatctccgtctcgcgaggctccacgggagtgagcgtcctccagaacttcgcgcgaggcgcgaatgacttcagcgtgacggatgtagaccagaacaatgccttcttcgacgtcatcgtggacaagatcagcggagatgtcttctcggtgagcgacgacccctccttccgcatccgcagcagcagcgaccaggggaccaccttcggcccgcagagttccccaccggggcaggcgttcttctcggactggacgggctccaacggcttcatctacgtcacgggctccttcggggacgacaacgtggacgtcatcccgatgtccgcgccggggacaagcacccaggtgccgggcctccccacggacatcggtcccgctcccctccgggtgattgacgcggacgcgctcggcaacggctacatcgcgtcccaacgggggacgggcgacatccagttggaccggatgctcgtgggggccgccatgattctggccacggatgccaggacagtagggccgggcgccgcgccagcagtcgcggcgctcccctcgaacggcggcgccctggtggcctacacgaacggcaccagtgtctacgcctcagtggtggtgtactga

SEQ ID NO: 4746 - DNA, 1113 bp, Myxococcus xanthus
atgggcgaggtggcgcggctcatccccgagcccgagagcgagacctccgccgcgatccgcttcggcaatgctcctcagcggtgtctgttccggctccagcgcacgaaggaggcatgggccgcttccctcttcccggatgaggcacactcccccgtggaggcctttccagaggcagttgccgccctggagaaggcactgggtcccagggacggaggggctcgcgagctcaattggtcctaccagcccaactcccgctggctgctcgctgcgtcccaggatgagtgcgccctgtgggtcatcgacagcatcaaccctgaggtgaacgccacggccagcaaggccatgacacgggagatctgcgagtgtctcgaggggaccgtctccgccgacgacccgtatatccggctgccccagacagcgtacaccatgagcaggatgggtgcgggcactgcgcttccttcgtgtgattgcacgttcgcgcagacaggtgaagcaggcgtcacgtgcgaggcgtacatgggtcgcccatactcccttccggagttcgaggagatgcaaaaggacggacggctgacggagaagaacagggtcgaaaacctgaaggagttggaggacctccgtcgtacccatcaaggcctgctcgccgcgaacgaggatgcgctcgctcagtggaaaacgggagaccagaaggcggcgctcagcgcgtggaccacgctgtaccgaacatggcttgagaacggccggcccatggctgggggaaccctggacgagttcgctgtggaggacgcaaccctgcgggaacaactgaaccagcaattggaggcaaccatcgacctccgggcggagatcctcaacaacctcggcttcgcgctgtggtcccacaaggagtggtcccaggccgaggccgtcctcgacgaatgcctggcgctgctcaccgcgacgggccacgagcgcaacgtgctcaacctgaatcggggagacctgtttcgggacatggggaagggacctgaggccatcaaagcctatcggtccttcctgctgcgcaaggtcaccgcggctcaacgcaagtacgcggagcgagaattgcggaagcttgagcagcgatcgaaatga

SEQ ID NO: 4747 - DNA, 288 bp, Myxococcus xanthus
atgagcgagcagtacttcggtccggtgctgaagacgctgggcgcgagccccatcgcgctcacgcgaacgctgatggcgcccgaggcctatctgctggaggcgctggccagcaccgtggcgcgccatgggcccacggagcccaaggccatgcgcacggcactcgtggaggcctatgcgcgctatcagcgcatctccctccgctccgcgggctccgtcttctcgaagctgcccccgtcggaggtcgcgctgcctggcgcggtagctcccgcgtcgaggtcgagcccctga

SEQ ID NO: 4748 - DNA, 1053 bp, Myxococcus xanthus
atgcgcaccctcggtgagtcgggccgcatcgccgcgcagacgggcgaggcggcggcggcgttcctctcgcgcctggcgcccgcgttcggtgtggtggccaactcggtggtggtcgcggaccacttcaaggacatggtggacgacccgacggtcggcagtgccttgcagaccttcggggacgcggtggcgtgggtgggagcgctcgtgggcacggggctcccaggcgtcgggcagattatcgagggcgtgggtctggtggtctccgcgttcggcagcctgctcgtcaacaaggagaaacaggaggcgctgaacaacgagtccgagagcattctcctggagatgggcctcgacccggacgtggcgaggacgctcggtcacggcgatgaccagcccgagcggctggcctcggacctgggcctgtccccggcgcagattcaggacctcgccaagcgctacccgacgatgttcgacgcgccgggcctgggccaggcggtcatcgacgccgccaaggcgtgcggcatgaagggccaggacgcgatgggcttcattgactcgctgtcgaaaggccgtccggacttcgcgtgggacctgctgggcgtgatgccgaacatgcagggggacggcacacacccgacggccacggacgaatcgtggcgcacctacgtccagggccgctacccggatgcatatgcctacgcacagcagcacgcgccggaccttttcggccagaccgcggagtcgcgcctcaaggcgggccaagacttcgagcattacgccgggacaatggactccccgctcgtgtacgcgaacctgtgtgagcagaacaagggcgacgaggcgtacaccagcgagttcatcaatcggatgaaggacaacggctccctggacagcttcgtgcagtacatcaaccagcacggcctggacgcgcaccgtagcggcgccaaggccgccctcgacgccgcggtgaagacgggcgtgctctccgaagcggacgtccagaactacctgaacggcagcaacggcgatgcctggcacgccatcctcggccgctga

SEQ ID NO: 4749 - DNA, 1140 bp, Myxococcus xanthus
atgggcgttggtacgccgctcccggcctgcgcgtcggggcagctccggatcgactggaacaacggcacgggcggctacaccgcgaccatcgtgatggccaacggaatgaggagccagtacctccacctgtctggattcaacggcggcgagcgctacgtccaacagggagaaatcgtcgggtactccgggggcgctgcgggtgcacccggctccgggtcctcgacgggtccgcatctgcactggcatctggtgaccgccggcggcacccgggtgaacccgctcgactacgtcggcgccggcagcggcggcaccgggggcggtctgccgctggaggaccggcgcctcgggcatctcggcaccgcggggggctgggcccacatgctcagcaacctcgtgctgccgggcaacacgacctacggggcgttctcgccgggccctggacagtcgccgcgcgccatggcgaacatcgacggcgtgatgatgctggtctacgccggcagcaacggctggaccacgatgagcagtggcctggcgatggacccgggggcgccgctcaacgtgctgcggaccccggccaatgcctcggcccaaatctttaccctcgaagacggacggctctggcacaccttcgacggcaatggctggaagaagttcccgtcgtccgtgacggtgtctggcaactgcaccttctcgatgacggccaatggaacggaccttcatggcctgttcaacgacaacggccggctgttccatgtctgggctgacggttccggctggcacaagggtgacacccaggtggacctgcagcccggctccgacctggtcgccgtgattcagccggatggaagcctgcaaggcctgtcactggagttcagccgggtgcaccacatcttcggggcaaacgggaggtggaaccggataccgaccacggcgtccctaccgactgggacgcccatcgccggccgcgccgcctatggctggccgcagttggtcgccaaccacaacggtgccatcacccacgtctggggcacctcgtcgggctggatgtgcgtgccgactggacagacgacgaacccgggacggcggctcagcctcgtcccggatgtcgcctcggcctcgttggtcggcctgacactctga

SEQ ID NO: 4750 - DNA, 663 bp, Myxococcus xanthus
atgttccgtcatgcgctgcccaaccgactcctggaggtcatcttcggcttccagacgggcgtgacgtcccatgcgtggttcctgcaccacgtgctgggccaccaccgcaactacctggaccagacccaggacgaatcgggatggaagcgccgcgacgggtccaccatgggcgaggcggagtactccgtcttcaacacgctcgtcgcctatccccgcgccttccgcgtgggccgctcatatcccaaggtgatgcgcgtcttcctggccatgggcgcgctccaggtggcactgctcggcgtgctgttctggcacgactggtacaacgccctctgggtgttcctgctgcccatggcggtgtcgctctacgtcaccgtctgggccacctacttccaccacgtggggctggaggcgacggagcacacccacgcctcgtacaacatcctgcacaagggctacaacctgatgaccggcaacctgggctaccacaccgcgcaccacgcgaagcacgggctgcactggtctcaactgcccgagcttcacgcgcagctcgcccaggacattccggccacacactaccggcagccgggcatccccttcgtgtggaccaacccggaggcgaagatcgagccggccgaggcggagttcggcgccatcacccagtga

SEQ ID NO: 4751 - DNA, 339 bp, Myxococcus xanthus
cccagccactggacggccccggagacgttcgccccggagcgctggctcgacgggggcgcggcccggaatccgcacggcagcgaccacttcttccccttcggccggggtcctcgcgcctgcgtggccggggacttcgccatcgtgtacctgcgcacggccctggccaccgtctccgcccgcgcgcgcatccacgtcgactcgacggagcccttcgaggagggcttcttctttggcgtggtgcggccccagggcgtcacgggcaagctcgtcccgcgccaggtacagacccttcaccctcccacgggagcccctcctccccccgcagtggaatccgcatga

SEQ ID NO: 4752 - DNA, 1129 bp, Myxococcus xanthus
gcgtcgctcgccgtcgtgtccatgttgtgcgccagcgtggccctggcgcacggctccatggaagtacctctcagccgcgtctacagttgcttcaaggaagggccagagacgccgaagtccgacgcgtgcaaggcgctcatccaggctggtggcacgcaagcgctctacgactggaatggcgtgcggcagggcaacgccaacgacaggcaccgcgacatcattccagacggaaagctctgcagcgccgcgaatgaaagtcaccggggcctggacctcgcacgcacggactggccctccacgctcatcacgccggacacccagggtcgcttcgagttcgacttccacgcgaccgccgtgcacgccaccggctacttccgcctatacgtcacgcgtgagggctacaacccggcgctcccgctcaagtggtcggacctggaagcaaatcccttctgctccatcacccacgtctccgcccagaacaaccgctaccggggctcaactgccccttcccctcaagggaagacggggcgcgcatgtcatctacggcatctggcagcgctcggacagcccggaggccttctacgcctgcaccgacgtgaagttcagcaacaccccgccgccgccctcgtcgtggaaggagctgggccaggtacaggcgcgtgaagacctgcccgcggggagctcggtgacgctgcgcgttttcgacgcgcagggcgctgacaccgaatcccatgtgcatcccctgaccacggccacgccggcggcccagtggattcatgcgctggcacagcgggtgaacggcgcgtccagccgcgtacaggtgggcgtgctcgacgcagcgggccgcgtgaatcccgtgcaggacgcgctgggcaaccgcgtctacgcgcgagagacgggctacaccttccaggtcgacatcatgaagccgccgcccggtggcggtggcgagcctgtctacccgtctgggattgaggactatgcagagggcaccgttgtgcggggcaccgacggactgcgctatcgctgcaagcccttcccctactctggctggtgcaagggctccgcgctgcattacgcgccgggcacgggcttgaactggcaggacgcgtgggagcgcattccctga

SEQ ID NO: 4753 - DNA, 3333 bp, Myxococcus xanthus
atgcgctcccgtctcctcgccgcgctgctcgccctggctggccccgcctccgccgcggaggcccccgccgcgcccgcggccccctacctccagggcatgggacgcacgcccgaacaggaggcgctgttccaggaggtgagcagcgcgctggagctctacgagtccgaggcgcgcgagttccaccgtgaggtgcaggagctggtggagcagcgctacgagcagaagcgtggcgcgctggcggcctcctacgagaagcgcatcaaggacctggaggctcaggagcgccgcgagcggctggacgccattgcccggttcgaggagttcctgcgccgctaccccaccgagccgcgcttcacgccggacgtgatgttccgcctggcggagctgtattacgagcgctcgtcggacgaccacctgctggcgatgaaggactacgcggagcggctggaggcgcacgacaagaacccggacgcggagttccccaccgagccgcgcgtggactacgcgccctccatcgcgctctaccgcaagctgctggccaccttcccggactaccgcctcaacgacggcgcctggtacctgctggcctactgcctggagaagcaggaccagtacggcgacagcctccacgcgtaccagcagctcatcgcgcgttacccgcagagccgcttcgccaccgagtcctgggtgcgcatcggcgagtactggttcgacaactacgaggacccgcaggccctgcccaaggccgcgcaggcctacgaggccgccacgcgcgacgcctcgcacccgctctacgacaaggcgctctacaagctcggttggacgtactaccgcctggaccgcttcgagccagcggtggcgtccttcctgacgctggtggagttctacgaagcccagcgtgtggcgaagggcgacgcgacggccggcggcgacctgcgcgaggaagccctccagtacgtggccatctccctggcggacgacacgtggggcggcatcgcccgggcggatgcgctcttcgcggagcgtggcccgcgcccctacgaggccgaggtgtaccagcggctgggcaacgtctacttcgaccagacgaagcacgcgccggccatcgaggcctatcgccgggtgctgcagaaggcgccggacgcgccggacgcgcccatggtgcagcagcgcatcgtccaggcctacgagcgggaccgcatgctgggcctgtccttcgccgagtccgaggccctggccaacctctaccagcccggcggcgcctggtacgagaagaacaagggcgacacggcggccatcgcccgcgccaacgcgctggccgagcgcagcctgtacggcagcgccacctaccaccatcagcaagccctggtcttcaaacaggagggcaagttcgagcaggcccggagcgccttcgacatcgccgcccgcgcgtacggcacgtacctggagcgcttcccgcggacgaagagcgcgggcgacatgcgcttctattacgcggagtgcctctacaacgccttccagttcgccgccgccgcgcgcgcctacgaagaggtgcgcgacacggacgcggccaacaagcaccgcccggacgccgccctcaacgcggtgctcgcgtggcagaagcagctcacgctggacatccaggcgggcgcggtgccggagaccaagacgctgcgctcgacggagcgtcccccgggccaggccgtgaagccccgccccttcgcgcccaccgagcagaagctggtggccgccgcggacgcctacgtcaccctgctgcccgctggcgagaaggcgcccggcatcgcctaccaggccgcggagctgcactactcgcacgacgacttccccgaggcgcgccgccgcttcgagaccatcatccaggcatacccgagccacgaggtggcccgctacgccaccaacctcaccatcgagaccttcctcatcgacgaggactggcggagcgtggagtccgtcagcgcgcggctggccagcaacgacaaggtcatcgacccgtccagcgacctgcacaagcagttggtgaagttcaagctcgccggccgcttcaagctcgccgaccagctcatggccgagtcgaagtacgaagaggccgcggcgaagtacatcgagctggtggacgagtcgccccgccacgagttcgcggacaaggccctcaacaacgccgcggtggcgcatgagaacacgcgccgcttcgactccgccctgaagctgtacgagcgcatctaccgcgaatacccgtcgtccccgctggccggcggggcgctgttccgcgtggcggtgaacgcggagaactcctacgacttcgacaaggccgtcgtcagctaccagaagctggtgaaggactacccggactcgaaggaccgggaggcggcgctgttcaacgccgcgcgcctgttggagggccagcagcgctacccggaggccgccgccgccttcatgcgctacgcggacctgttccccaaggcggaggacgcgcccaagaatcagtaccgcgccgccatcatctacgagaagcagggcaacccccgtggcgaggtccgcgcgctgcaggagttcgtgcgcaagttcgcctcgcagtccggacaggtggagctggtggtggacgcgcaccggcgaatgggagacgcccaccagaagctgggcagcacgcgcgacgcccagaacgcctgggcgcggtccgcggcggagttcgaccgacgcaagctccagccggacacgcacccgctggccgcggatgccgccgcctacagccgcttccagctggccgagctggagttccagaagttcgacaagctgaagattggcggcaagggcaaggcgctggagcgcagcttcacggccaagcgcaacggcgtgaagtccgtcaacaccgcgtacgcgcgcgtctacccgtacaagcagttggagtggacgctggccgcgctctaccgccggggctacgccctggagcgcttcgccaacaccatcatcgagacgcccgtcccggcggaggtgaagcggatgggcgaggaggcggtggtcgtctaccaggacgcgctggtccagcagaccaccgcgctggaggaggccgccgtggagagctacgccgccacgctggccgaggcacggaagaaccgcctcaccaacgagtggacgcgccgcacgctggagtccctcaaccgcttccggcccaaggagtacccggtgctcaaggagcccaagcaggcgctcgccgcggacgccacctacccggatgggctggtgggcagcatcaccggccccgtgcgctcgacgcagcaagagggcccgcgcctgtccggggagggagcgaagtga

SEQ ID NO: 4754 - DNA, 375 bp, Myxococcus xanthus
atgcacatcccccctgacgccctcaccttcgcccctccgaagagacgcgcccgccctttgcctgtcatcctcggcgaggccctgcgcgaggcccgcctccgcgcgggcttgcagcagacagaggtagcgacgctcatcaacatctcccgcaatgcctacagccggctcgagcggggactgatgcttcccagcgtcccgacgctataccgcctgtgcaccgccgtctgcaccacccccaacgagctgctgggcttctcctactcgctgccgccgggcacgagcgccatcgccaaggacgccctgcgacgccgcgtgcgccagctgaacgggcgccaggcccttgccctcattcagctcctgtcgggtgagcgctga

SEQ ID NO: 4755 - DNA, 291 bp, Myxococcus xanthus
atgagtctgacgcaggtccaagtcgcggagcgcgtggggctggcctctgccgtctacagccggattgagcgcgggctgatgattcccagcgtcgagacgctgaagaagctgtgcatcgagttgatggtgagccccgaggacctgatgggactcaccgagtcccccagcagcggcagtcccacacggccggacgacgacgtcaccttgcgtcggctgatcttcctcgcgcggaagctcgacgcgtcgaagctggacgccctcgtccgcatcaccaccgagctggcccgctga

SEQ ID NO: 4756 - DNA, 231 bp, Myxococcus xanthus
atggacgcgttgcaccgcatgtacgagcacaaggacaagggggacctcgacagcgcccgccaggagatgcggaacgtgctcgccgtggaagtcgtgcctcactaccgcgccattgcacaggggcagctcgaagccatggcggacgagcatcagcaaggagagcgagcaccgggtgcttccacccgggcagtgttcgctagacgcacccctttacgactccggggtcggtag

SEQ ID NO: 4757 - DNA, 651 bp, Myxococcus xanthus
atgagtggcggtacccaccccatcgcgattctgcagaaggtcctcgatgacgcctgtgaattgggcgtcttcccctcggcccaggccgtcgtgctgcaccggggcgcccaggtgttcggcggcgtcgcgggcaaggtctccggcgacacgcgcttcgacctggcgtcgctcaccaaggtcatcagcaccacctccctcttcctccgcctctggacggaagggaaggtggggccggagacgctggtgtcccgctacttcccgggcacgcccgtgggcgatgcgggcgtcaccgtggcggacctgctctaccaccgctccggcctgccgcccttcgtgcccttcttcgcgcaggcgctcaccgcgcaccccgagctgctggacgcggactgtccctccgccctgcgcgcacgcgtccgcgacgaggtcatccaggccgccgccgccacgccgctcgccgccgagccccagacgctcgccgcctacagcgacgtgggcttcatcctcctgggcgaaatcctctcgcgggccgcgggcgctccgctggacacgctcttctcccgccacgtcgccgagcccctgggcctcagcgcccgcttccaccgcctcaccgacttccccgcggacgccatgcccgcgcccaccggcgccggc

SEQ ID NO: 4758 - DNA, 903 bp, Myxococcus xanthus
cccgtgcgctggctcaagccccttccgctccgtcctcgcgacgccgtgcatgtcgtcgccccctccgggcccttcgaccgcccgagcttcgaggccggcctggccgtcatcgcggagcgctacagccccgtccacggccccgacatcttcgctgcccaccgctacctcgcgggggatgacgcgcgccggggcggggagctgtcgcgcgccctgctggaccgggacgcccgcgccatcttcagcgcccgcggtggctacggcagcgcccggctcctgccggaccttcccttcgcggacgcctcgcacgcggccttcatcggcttctccgacctcacctccgtgcatggggcgctccaggcgctggggcgcgtctccttccacgggcccgtcctcacgcagctcggccggcagcctcccgcggtgcgcgagtacctgttccgactcctcgagtcccccgaggcgccgcccccgctgacgggctctgccacctacgtgcccggcatggcggaggggcacctcgtgggcggcaacctgtccgtgctgtcgcgcctcatcggcacctcgtacatgccgccgctcgacggcgcggtgctgctgctggaggacgtcaccgagcgtccctaccgcatcgaccgcatgtggacccacctgcgcctggcgggcgtcttctcccacgtgcgaggcatcgtcctgggcgacttcaccgggtgcgaggagaagggcgcggactactccagcgccgacgtgctccgtgagctcgcgcgcgaggcgggcctcccctgcgcggcgggcttccccatcggccacggtgacatcaactaccccgtggcgctcggcacccaggtccgcctggacgcggacgccgcgcgcctcaccttcctcgaaggagccgtgcgggcatga

SEQ ID NO: 4759 - DNA, 990 bp, Myxococcus xanthus
atgcacggcctcgcgggcgtcccggctgtggagtccgccgccctcgccgggctcggggatggggcgccgcccccgttggtttcggcgccgccccccacgctcgcgctccgcgcctccctgccggactggctcgccgaccatttcgcccgggagttcggtcccgaggccgacgacttctgcgcccacctgaacgtccccgggcccatcaccctccgggccaacgtcctgcgcacctcgcgggaggcccttgccgagcggcttcgctccgagggcgtcgagacgcgcccggggccctggagcccgctggcgctccatatcgagggtccccggcccaacctctatgggctccgttccctccaggaggggctgttcgaagtccaggacgagggcagccagctcctggggctcctcgtggaggcccggcccggggagacggtgctggacctctgtgccggcgcgggcggcaagacgctccaactgggcgcggacatgaaggactcggggcggctcctggcctatgacccggaccccgagcggctcgaccggctcctccagcgctcctcccgggcccacctcacccgagtccaggtgctccggagccttcccgaaagcctggacgcggaccgggtgctcgtggacgcgccgtgctcggagctgggctccctgcgccggggccccgaccagcgcttccgcatccagccggaggtgctcacccggtttccggcgctccagcaggacattctccagcgtggggcacgcctggtgcggcccggcgggcggctcgtttacgccacctgcaccgtcaaccgcgcggagaatgaggacgtcgtcgccgccttcctggcttcgcgcccggacttccgcctcgtgcggcccggggcggggtggctttccgacgcgtgtctccgcgacggattcctcttcgtcgcgccccaccggcatggcacggacgccttcttcgcggcggtcctggagcggacggcagggtag

SEQ ID NO: 4760 - DNA, 141 bp, Myxococcus xanthus
atggaggagtcccaggtgcgcgtgggaaagcgcgtctggctgcccttcctccgggcccgccgctacctgcagtcccgccaggcgctgctggactactcgctcacgcagttcttccatgaggcggagcggtaccggtcctga

SEQ ID NO: 4761 - DNA, 795 bp, Myxococcus xanthus
atgggtggggaactcgagttggacgtgcagcatgtcctcttcggccggccgaagcagccggggcgctacaccctctcgctctccgccattcatgactggggacgtggggaggtgaagtcggccgaggtgacgctggcgcacctggacgcgacggcggtggtgctggtgcagcgcaaggggcggcgcgccctggaaatgcacgtatttgccggatggggcggccgtcccggtgcaggaggtgcctggggcgccgtggccggcgtcggtgcagacgcggtgacaccgacactggacttgcggctgcggctggaggcacgccggcagcatggaggctttcggcagggttatttcggcgcggactacgagttggcgcggttgcaggcggcgggcacctcgggcctgccgttggcccaggcgtccttcccggaagggtactccgtgtatgcggaagccatggtggcatgggacgcggtgttgctgggcgaggtattgcagcgccacctgcacctctccatgggcgccgaggccttcagttggggccgcgtggatgtggacggacggctggcggtgcaactgctgcaccgcaacctggaggtggcggtgaagggactggccgtgggcatgcgtcagccgtgggcccgctacctggcttctggagaggtgcgctggcgcttttgggggggacgactctatgcactcgggcagggcggtacactgctgtaccccacggcggaaggcccgttacgtccgggggcattcgcgtcgctcggcatgggggtggacaatggccgctga

SEQ ID NO: 4762 - DNA, 1941 bp, Myxococcus xanthus
atgggctacacggtggtgaggcaactggaccgaggtggcttcggcaccgtgtacctcgcgacgaacggcgggcagccctgtgcgctgaagctcgtggagcggcaacgcgtggaggggcgggtggagaaggaaatctccatcctcttgcgcttgacgcacccgaacgtcgtgggcattcgcggcttcacctactggcaggccgagcagcgcgactttgccctcatcttcatggagtacgtggaggggcggaagctgagcgcgtgggtgaaggaggagaacccctcggcccggcgaatcgcgaaggtgacgctcgacatggcgcgggcgctggaggcctcgcacgaggcgggagtggtgcaccgggacgtgaaggacgccaacgtcatggtgcgcgatgcggacggcctggcggtgctggtggactacggcatcggggactacgcgggagccccctccggcatcacccagtccatgctgccgccggggacgatggagtaccggccccccgaggcttggctcttcctgcagaagaagtacttcggcaagaaggtgggcgcccgctacgtgtccgccccctcggacgacatgtgggccctgggcaccgtcctctaccgcctcctcactgcgaggctgcccttcgactcggggtcggaagcggagtacgtccaggctgtcattggcaggacgcctgtgccccctcaccacgtcaaccgcttcgtcccggagcggctgggcatgttgtgcatgcggctgctggagaaggaccctgctgcgcgtcccgacgcgagcactgtctgtgctgccctggaggcgctcctgtccggggcggaaggggaggcgtgggacacgcccttgtttgacgcctatggcccgaactcggccaccaccgagaacgagggcaaggtggacaagctggcgcggtgggcgaaacggcccctgcgccagatgcgccgtggcaaggcgccggggccggagctgccggaagtcccaggcgaaggtaggcccgcggcattgccgcccgaggccccgctggtgcctgcggccacgcggcccgtggaggcgcagctgccgggcttggcgctcgaggccggggtgggggcggaatccgccatggaggcggacggcgcgctggaagcggcgctcgtggcccccgtcgtcgaggcagggcggccctcggttctcgcgcgactccggctggggcgtgtgctgggagcggggctgctggccatgaccctcgcgtcgggggcgtacttctcactgcggacggactcaccgcagccgcaggctgtcaccggccaagaagtagcgccatatatagaaaaacctcaagctgccccggccgcagctcccaccgggccggaggcaacacctgcggccgtcgcgccccctgcgacgcttcccgaggtgactgccaccgtgacgacgacgaagagtgactccccgacctccccgccagtgcctgccaagaaggccacgaggagcgtcagcagtgccctggcgacgacggccctctgcgccacgttcgcgtgcaccggcgcccaggtacgtccgccacccgagcccgaggactgcccagaaggagctgtcgagaccatggcgaagttgggagtcaaggtcgggtattcccatcctggtggattccctatcaaaggggagtcaagggtcatctccgtgcgagaggggccaacgcagatccgcatgtatgggaagtgggggaagcttggtgatggaacggtattcaccgggcgcctcatcctgggcgaccgcgtctacggtcggctgacgcgagcacgaactcgcgaagggacctttcccgtgtgcttggaggtactgtcgacaggtggtgcgcgtggcctagaactggaaagtggtggtaacgactccagcaagatccgcgtctggtctgaccttgaagtaagggcggtgcgcgagttcgaatga

SEQ ID NO: 4763 - DNA, 387 bp, Myxococcus xanthus
atgctctgctttcgcctactgcgcaatggccggcacgtcgcaaccgcgggggtgtcgggcttcggtgtcgtctccaccattctgacgtgggtgcgccgccccgatgatgagacgcgcgacaacccggaggtggacctccaccttgggggctccgtgggcagggagtaccgcgagcacctgaagtggtgttacgccaaagatatccgtgcgggcgacgtcctcacggtggaggtgcgtgaggacttggagcctgaccctccgaaggagagacgcctcgacgaggaggcggggctggatgatgtggcccgcctccaactgaggaagaaagccctggaggcgcagctcgccgatgtgaatgaagagctggcggagcgcggcgcggcgtag

SEQ ID NO: 4764 - DNA, 2389 bp, Myxococcus xanthus
ctagggccggaggccgtccgttccgccgagcccgcgcaggcgcccgcgcccccgccgcccgggcgcgacctgtcgccgcggctcgatgcggtggagacaggactgctcggcgtcgaggagaacctccacttcgtggagacgcagttcacccagcgcgccgagcccagtgacgacgacgccctctggcgccgcttctccgacggcgaaatccactacctgctgggcgactggccggcggcgtccgtcctcttctatgacctggtgagcgacccgcgcttccgcccgcatccgcgctatccggacgcgctgttctacctggcggactcgctcctggagcagcacaacgacattggcgcgcgactgtacctgcgcgagctgctggccctgcccccgacctccgggcactaccgcgaggccctgtcgcgctacctgacggtggccggccgcctcaattatttcgagggtgtcgaggcctacgtggcgcaggcccgcacgctgtccggtgggcagctgtccccggagattgcctacgtccacgcgaagtggctgttccggcgcacggacctgtctccggcggaccgcatcacccaggcccgcgccgccttcacgccactggcgcaggcacccaacggcgccttccggctccaggccgcctaccacctgggcgtgttgtccgtgcaggaaggtgacctgcccgcggccatcacccgcttccaacagttggccaccccgccctctgcccaggccgcacaggccgctccgggcaggacgggtcctcgccgctccgcgcccacgccggaggaggaagcccgccgcgtgcgcgagctggcgctgatgtcattgggacggctgctgtacgagacgggccgcttcgacgacgcgctggaccgctacggccaggtgccgcgtgacagcgagtccttccccgactccctctacgaatccgcctgggtccacgtgcgacggggccactaccagcaggcgaagaacgccatcgacatcctcctgctggtggcgcccgactcgcagctcgccgccgaaggccgcatcctccagggcaacctgctccagaagctgcgccggtacgacgaggcgaccgacacctatacccaggtcatcgacaccttccggccccccagggagcaggtggacgcgctgctgagctcgcacagcgacccggtggcgtacttcgaccggctgctggtgcgcgcggacggcccgctggacatgcgcacggtgctgccgcatctggtgctgaagtacgccaccacgccagcgcgaggtggcggacgcggtgcggacggtggaggacatcgacagcggtcgccggggccggagcgaggccgcggccattgcccagcgcatcctccacgccctggacacgcgcggcctggagaccttcccggagctgcaggaagccaacacgcgcgcggacgcggtcgacaccgccctcacccaagcggaggcggagctggtgcgggtcgagacgctcgcgatgcaggccgtgctcacgcccgccgagctggcgcggctgacggaggcccagcacgcgcgtgaagccctggagcgccgcttctccgcgctgcccacctcgttgaagacgctggaggaccgccgcgagcgcatgcagcggcgcgtggacgagttggaccgcgaggcctaccggctcgacttcgagcttcagtcgctcaacgccatcgccgcttcgatacgcaagtgggtggatgactcgcggacgcaccggcagacgcctccggacgaggagcgcgagttcctgctgcagttgcaggccgaggtccagacgctgaaggacctcaaggcggagctgaccgccacgcgcgcgcggctggcggacgagcgcaacgccgtggacaccaccctggccggcgagcgcgccatccgcgtcgcctatgccgattccctgcggcgcgagcacgccatcctgcgcgaggcggagccccgggcggacgcggaggtcctcgccacgctgcggcgcacccacggcgtgcgcggccggctggacggcctgcgcgaacgcgtgacgacggcccggaacgtggtgcgcgagcggctggagcgccggggccgcgtcatccgcgagaaggtcgtggccgagcagcaactcctggagcgctacgaggccgaagtcgccgccgtctccggtgacgccaggcagttggtgggccgcatcgcctacgacagcatccgccgcgtgcggcagcagttctacgacctggtgctcaaggcggacgtgggcgtggtggacgtggccttcaacgagaagcaggacaagacgacggccatccagacgctctcctcgcagaaggacgaggcgctgcgcgagctggacgccgagttccaggatgtcctgtccgaggtgaaggagtga

SEQ ID NO: 4765 - DNA, 1173 bp, Myxococcus xanthus
atgacgaagcgttcggaagatgaagtgtcgacggaggagttcccgccccgcccccccacaccgcccagccccagctcgccgcacttcctcttcgtcgtggatgacgttcgctacgaggcggtgggggagcttgaggtgcggtcgaatggcgagaagctcctgaaggcggagcggcgagtggcggatggagtcctggccggcccctgcctggttcgccggattgccaccccctccacgtacatgatgcgcacgcggctgattgaagaggtgcagttggctttccggctcaaccaccccaacatcgctcaagtcttccacatgcaggtggatgaggaggcggacgcccccttcgcagtcatggagtacgtgggtgggccctcgctggagacgctggtgactgcggcgttggtgcgaggcaagcccctctcggagggatttgccttgtacgtcggggcggaggtggcggacgcgctgcactacgcgcacacgctgacgtcggaggagggcgtgcccctgggcattgtccaccgcgacgtgagtcccaggaggcttgcactggggccgcatggagaggtgaaggtgctggacttcggcgcggcgtactcgctgatggtggggcgggaggagtcgccggagaatctgctgcggggggacgtggcctacgcctctccggagtacctgcgcaaggaagggctgacgccgcgctccgacgtcttcagcctgggggtgttgctggtggaagtcctcacgagcaagcacctcttcgaggtgcatgacgtcccggtggtggcgtcgaaggagacgcggtttgtcacggagtcgccgcccactttgccgctgcagcagatgcaggccctcatggagacattcactccggatgtcgtcgagaaggcggtggcccacctcagtgaggacctcaaggcggtgttgcacacggccctgcgcctcaaccccgaggagcgcttcgcgacagcggcggacatgcgggatgcgctgcgtggtgtcgcccacgcccagctccgtgcgccctatgggcgcgcggaggccgccaaggaggccgccctcgtggtgtccgaaggcggggtgctgcgggaccaggtagagttcggcgaggccggcctctacccggatgggctggagaagcacgagctgggactcccgaagaaggagtag

SEQ ID NO: 4766 - DNA, 1974 bp, Myxococcus xanthus
ggggaaggcggcggcttcgcgctggaggtcaacgccgggacgtgggtcgtgtccgcccgccgtggggaccaactgggccgcgtgccggggccgctgtccgtcgcgccgggcgagacgctgcgcgggctcatggtgacgctgggcgcggccagtggcctgacgggcacggtgtccacggtggagggtgcgccggtgcgcggggccatcctggtggcgtctcccgcgggcggccagggcgagctgggccgggcggcgtccgaggaagatggcgagtggcggatggacgtccctcccggcgagtacgacgtgacggtgcgcgcggtgggaatgacgggccgcgtgttcgaagccgtggtggtgaacccgggcggccacacgcccctggacgtgcggctggaacccgcaacggcggcgctggaaggcctggtggtggacgcggagggacgaccgctgggaggcgcgcaggtccgcgccgaaccggcgtccttctctggcgtggcgcacacggcgctcaccgacgccgagggcgcctggaagctggaggggctggaagcgaggcccacctccgtgcgcgcgcggcgcgagggctcgcagcggtggacgtcccgcatggagacgctgaaggcgggagtcgtcacccgcgcggacttcaccctggcggactccggctccgtgtggggacaggtgacgcgcgcgtcgggcgggccgctgaccgagcccgcgctggtccacgccgtgcctcggggcggctcgggcacggcctccacggagacggatgcgcagggccagttccagttggaattgcccgcgggcgtctaccaactggtcgcgctgctccaccagacgcccgccatctacttccacatggagagcgacccgttcgtgacggtgccttcgggcggcgccgtgcggcaggacctgctgttgaaggaagactccgtgttgtccggcgtcgtgctggagccctccggggtgcccagcccgctggccatcgtggccgccatccagggcggggacttccccatgacgcgcaaggagcgcgcggacgaggcgggccagttcgccatgccgccgcgcccccagggcgcccagcccctggagctggtggcccacaacgcggggcgcgtggggcggctgcccgccgcgcatgaggaccaggcaccgctcacggtgcggctggagcccgcggccaccctgcgcgggcgcgtggtggcgggcagcggcgcggctccggatggcttcaccctggagctgctcgaggccaacggtgaggccctgccctgggccggcgcctggcccaccacgcggcgcttcgctggcagcaccttcttgcttccagacgcgcccgcccaggcgctgaaggtgacggtgcgcaccgaggacggccgcacgggcgaagcccaggtgacgctgcggcccgggggtacctcggacgtggaggtgccgctcaccggcggcgtggcgtccatctccggccgcgcggtgtggagccgggggggaggccctgcgccaggggtggcggtgttcctcgacaaggccgtgggcgggcgctcggatgccttcaccgggcaggacggacgcttccgcctgagcgacgtgcgcccgggcatccacaccgtgcggctgctaccgccggagggccgcgtggagacgcgcaccgtgaaggtggcggaggcggaggccaccgacgtgggtgacgtcacggtgtccccgcgccgggccacgccgggcacgctgggcgcgggcttcagtgaggaccggggccacgtcgccttcgcgtggctgacgccggacgggcccgcggcgcgcgcgggcgtcaacgtgggggaccggctggtggcggtggatggccaggtggtgcgcgacagcacggaggcggagtcccgcacccggggggcgcccggcacgcccgtgcggctccacgtccggcgcgcgaatggtgagcaggaggtgctcgtcacccgcgcggagtga

SEQ ID NO: 4767 - DNA, 840 bp, Myxococcus xanthus
ctcgtcgccagcatcctgtccctttatattatttggggctccacctatctggccatccggtgggcgctggaaggcggcatgccgccgttccagatgtcgggggtgcgcttcgtgctcgccggcgccctgctcttcgcggtgctgtggctgcgcggggcgcccgtgcccacggcccgtcagtggggcgccagcgcgctggtggggctgttgctgctgggcgtgggcaacggggggctcgtcttcgcgcagcagtcggtgccgtcgggcgtggccgcgctggtggtgggcagccttcccttgtggacggcgctcttcggggggctcttcggccagtggccccgacgcgcggagcgctggggactggccgtcggctttggcggcatcgtcctgctcaacctgggcggtgacgtgggcggcggcctgctgccgacgctggcgatgctggtgtcgcccatgagctgggcgctgggctcggtgtggagtcgccggctgcccatgccgcgggggctgatgtccaccgcggcgcagatgctgtgcggtggcgtcgtcatgctgggcttcagcctgctgattggggaacgccccacggccatgcccacgcccaaggccgtgctcgcgttcttctacctcgtcgtcttcggctcgctggtgggctacagcgcctatggctacctgctgcgcaacgcgcgcccgtcgctggccaccagctacgcctacgtcaatccggtgctggcggtgttcctgggcggcctgctggcgggcgaaacgatgacgcccacggcttggctggccatgggcgccatcctgggcgcggtcgtgttgctgacgcgcgggaagtga

SEQ ID NO: 4768 - DNA, 669 bp, Myxococcus xanthus
atggaagagctcacggaacgccagcgcgagattctcagcttcatcgtcaaggagacggagacccggggcttcccgccgacgattcgcgaaatcggggagcacatggacatccgctcgacgaacggcgtcaacgaccacctgaaggcgctggagcgcaagggttacctgaaccggggcgagcagcagagccgctccctggtggccaccaagcgcgcgcggttgctcctcggcctgggggcgcgcaaggactccggcatggtggagattcccctgctgggcaaggtcgccgccggcgcgccgctgctggcgcaggagaacatggaggactccgtcaagatcgacagcttcctgctcggaggtgtgaatggccgcgaggtcttcgccctgcgcgtgaaggggcagtcgatgattgacgacggcatccacgacggggactacctcttcgtgaagaagacgccatccgcacagccgggtgaaatcgtggtggccctcatcgaggacgaggccacggtgaagcgttactacccggaaggggaccgcatccgcttccagccggccaacgccaccatgcagcccatctacgtgagccgcgcggagttccggtccacgatgattctgggtcaggtggtgggcgtgtaccgcaagctccagggcggccgcaccccgtag

SEQ ID NO: 4769 - DNA, 1110 bp, Myxococcus xanthus
atggccgtgggcaatgccctgtccgtccccaccgcgcaccggcccttcatggccgttccctttcccaaacaggcggaggggccctacatgaagctgatgggcggcggtccgcatgagctgcgccgcggccaggtgacagaagaggtccagctcgcggcctgcctgagccacagcctccgggccatgaagcgttacgatgccgcggacgcactgcgtcgttaccgcgcctggcagccgcacgccttcgacgtcagcgagcccatgacggaggtcttcgaggactgccagacgtcgggattcccgcccctgggcgcgggcaggcgcgtgtggctgcgtgcgtaccggaagcccgcggacccggggagtctggcccgcgcggcgccgctgggcgtgtacctggcgggtgacgcccacgcgctcacccaggcctcgctggaggactccgccctcacccacttcgacccgcgctgccagctcgcctgcgcggccttcaacgcggccattggccatgccgtcacccatggcgcgggcctcaaggccgccgacctcatccccgccgcggagtcgggcctgctgctcgccggcgcggcgctcggacgttccgccagtgactatgtgcaggaggtgtccttcgccgcgtcgctcctgcgcgaggacctggccatcgcccagcaagaggacccgatgctgtacgggccggagctgcacctgcaccgtcccctgcacgcggtgcgcgtgcgccttccggctggccttctgggagctgctccacgcccccagcgccgaggccgcgctcctggacgtcgtccaccggggcggcgacacggaggcccacgccaccatcaccggcgcgctcctgggcgccttccatggcgagcaggccctgcccgaggagtggcgaaagcaggtcctggaggccctgagcaccgtcaaggggccgctgtgggatgtctatcacccccggcacctgctggccctgagcaacgcctgagggctcctgaatgcgcgaagcccgcggggccgtcctgggaaggaccgccaccgcgggctcggggacacactggcgcggccgtcaggccgctcgccagggtcaggacagcaggtcgatga

SEQ ID NO: 4770 - DNA, 1029 bp, Myxococcus xanthus
tccgaagagctgggtgagcgtgagaaggaagtcctccgggcggtcgtccaggagtacatctccacgggcgggccggtaggcagtcagcagctcacccgcaggccggggttcgaggtgtcctccgccaccatgcgcaacgtgctggcggacctggaggagctgggcttcctggagaagccccacacctccgccgggcgtgttcccaccgaccagggctaccgcttctacgtggacacgctggtgaagctgaaggacccgacgccccgggacagggagctcatccacgcggggctcgcgcacgaggccgacctggcggagatgctgggcgaggccagccgcatcctccattcgctgacgcgtcacgcgggcgtggtggtggcgccgcggccggagtcggcggtgttccggcgcatcgagttcgtccggctgcgcgaggaccgggtgctcgccatcctggtggggcagagcggccaggtgcacaacaaggcgattaccgtggagttccccatcacctccgacgagctgctcaaggcgagcaactacctgtcggagttgctgcgggaggtgccgctggagtcggcgcgcgagcgcatccgcgcggagatggaccaggagcaggcgctctacaacgcgctgacggccaaggcgttgaagctgggcgcggcggccacggacctggcgtccacggagcggatgctcatccagggcacgggttccttctttgagcagccggagttcgcggacgtggagcgcatgcgcgcgctcttcagggccctggacgagaagcacaagctgctgtcgctgctggaccgggtgcaggtggccaacgagatgcagattttcattggcgcggagagcgacttctccgcggccggcgacgtcaccgtcatcgccagcccctacggaaaccaggagcaggtgctgggcacggtgggcgtcatcggccccacgcgcatggactaccggcgcgtgattcccctggtgaacttcaccgcgcaggtgctgtcgcgcgtgctggagaaggtgtag

SEQ ID NO: 4771 - DNA, 906 bp, Myxococcus xanthus
atgaaagccgtggtgctcaagtcctatggagacgtggatgcgctcgccgttcaagacatgcccgagccgaaggtgggaccgggcgaggtgaaggtccgcgtcaccgccgcgggcatcaaccccgtggactggaagattcgacgcggggacatgaaggcgatgatgcctctgcagttccccaccatcctcggacgggacgtggccggcgaggtcatggaggtgggcccgggcgtcagcgacttcaagccgggtgaccgcgtcatgggcgtggtgaacgccggctacgcggagaaggtcgtcgcgcccgtggagtcctgggcgaaggtccccgagtccatggacctgaaggacgccgccgcgctccccctggtcacgctcaccggcgtgcaactgatggaagaggcggtgaaccccaagaagggggacacggtgctcgtcatcggcgcgctgggagcggtgggccgcgccgccgtcttcgcggcgaaagcccggggcgcgaaggtgctggccggcgtgcgcggcagccagaaggcggaggcgcagaagctgggcgtggacggcgtcttcgcgctcgacgtcgcggatgagttctccaagctacccatgctggacgcggtggcggacaccgtgggcggccaggtggtggcccgcgtgctggagaaggtgaagcccggaggcaccctgggcagcgtcctgggtgagcctcccgaggccaaggggcggcaaatcaccgtgcgcgccatcctctcgcacccggactcgcgtcgcctgacgcaactggggcaggccgtcgccaagggcgacctggtcatccccgtcagcaagcgcttcccgctggagcaggtgaaggaagcgcagaagctcgcggagcagggcggcgtgggcaaggtgctgctcgtcaactga

SEQ ID NO: 4772 - DNA, 162 bp, Myxococcus xanthus
atggtgtacgcgttccacggtattcgtcggaccgagcgcacgatgttcacgcagcgcaacctcgtgacggggccagggggcgcgctgctcgtcgtcggcgagctgggctcgacgctcttgctgctcgtcggtgcagcgctcggcgagggacgcgcgccatga

SEQ ID NO: 4773 - DNA, 894 bp, Myxococcus xanthus
atgagcgcgctgcttcgcggtatcgtcgcgtatccaatcactcccttcacgtcgacgggacgtgtcgacgaggtgctcctcggcaagatcgttgacgacatggtgaaggcgggtgtccacgccatcgcgcctctcggcagcaccggcgtgctgccgtacctctccgatgacgaaagggagcaggttgcggaaatcgtcatcaagcgggtcgccgggcgcgtccccacgctcgtcggcgtttcgagcctcaccaccgagcgcaccgtccaccacgcgaagcacgccgagaagctcggtgccagcgcggtgatgatcatcccgatgagctactggaagctgagcgacgccgaaatcatcacccactacgagacggtggcgaagcgcatcgccatccccatcgcggtctacaacaaccccgcaacgggtggcctcgacctgagccccgacgtcatctcgcggctgctgaagatcccgaacgtcacgatggtcaaggggagcaccggcgacgtgaaccgcatgcaccgcctcgtccagctctgcggcgaggatgtggcgttctataatgggagcaacccgctcgccttggcagccttcgtggccggtgcgcgcggctggtgcaccgcggcgccccacatcatcccgaagctcaacatcgagctctacgacgccatccagcgaggtgacgtcgcggcagcgcgtcagagcttctatcggcagcttcctttcctgcaattcatcgtcgctcacggcctcccgcgtgcaatctcggcggcgctcgagctacaggggacgtctgtcgggccgctccgcgcgcccctgcaggcgctccctgcagagcgtgtcgaggagctccgtcgaatcctcgtcgggctcgaagtcattcccggcgaatga

SEQ ID NO: 4774 - DNA, 783 bp, Myxococcus xanthus
atgtcgaagacctttacgcagacgaaggaggagctggtcggaaaagcgaagaagcagatggacaccaccttcggccagggtgactggaccgtgcgtcagaagctggcgctgacctgccgaattttgttcgagggcggccacgactcggggttggccgggcagatcaccgcccgcgctacggagcccggcacctactacacgcagcagttgggccttgggttcgatgagatcaccgcgtcgaacctcctggtcgtcaacagcgaccttgaggttctcgaaggcaaagggatggccaacccggcgaaccgcttccatagctgggtctacgaggcgcggcccgacgtcaactgcatcatccacacgcacccgacgcacatcgtcgcgctctccatgctcgaggtccccctgcaggtctcgcacatggatatgtgccccctcttcgatgactgcgccttcctgaaagattggccgggggtaccggtcggcaacgaggaaggtgagctcatctccaaggcgctcggctccaagcgcgcgctcctcctctcccatcacggtcaactggtggccggcgatagcatcgagcaggcgtgcgtgctggccgagctcttcgagagggcggctcgcctgcagctcctcgcctctgcggctggcgacatcaagcccataccggagaagctgggaaaggaggcgcacgactggatcttgcggcccacgcgcagcgcgatcacgttcgcctacttcgcgcgccgagtgctgaagaagcacggggacgccctggcttga

SEQ ID NO: 4775 - DNA, 5312 bp, Myxococcus xanthus
atgacgggcatcgagctggtggccaccgcgcgcgcggagggcttcgacgtcaccgcgctgctgctcacgggatacacccacccggacgacatcatcgcggccatcaaccaggggcaggtgtaccggtacatcaccaagccctgggatgtgaacgacctgctcatcaccgtgaagaacgcggtggagtacacgcagctgcgcaaggacaaggagcggctgatccgtcagctccaccagcgcgtggaggcgctcttcgtcctgtacgaggtcagccgcgccagcgcgaatgatccggccagctacgacaacatcatcgaccgcgtgctcattgccgtggcgcgcgtgctgccgtacgactgcggcgcggcgctcatcgcaccggacgaggcgcgcagcgcgacgctgcggctgcgctgtcagggcatggtgggggagaaggcgctgctgggcgtgaaggagtccatgctcggtgcgtaccgcaagagcagcggcctcctgctgcccgaggaccgcgtcatcacccgcgtggcgggcaccaccacccaggacgcggcggcgccgtcggtgtaccccagccagctcacggtgaacctggtcgcgggtgggcgcccggtgggcatgctgtcgctgttcagccagaagccggacgccttctccgaggacgacggcgtgttgctggacgtgctcgccaaccagacggcggacgccatccagtccctgcgctcggcggaggaggaagcccgccaccgcatggagcggatggtggagtccatggccgacggcgtggtcctcaccgacgagaagaacgacatcgtggtgatgaacccggcggcgcggcggctgctacacgcgggggagaaccccgaggagcagacgacgcggctgatggaggagcgcctgggcttccagcccttccacctggtgcgcggttgggagtacgggggcgggcaggtgctgcgcgaggaggtgaagctcttcgaccggcacgtccagacgacggtgacgccggtgacggacgcgcggaacacgttgcgtggcgtgtgcgtggtgctgcgcgacatcaccgagcagaagcgactggaggagcgcaaggacgagttcgtctccatggtgagccacgagctgcgcacgccgatcaactcgctgctcatcctggccaagctgctgtcggacaacaaggacggcaacctcagcaccaagcaggtggagtacgcgaacaccatctacgcctccggcggagacctgctcagcctcatcaacgaaatcctcgacctgtccaaggtggaggccgggaagatgcaggtggagccgcgggacatcgtcctcaccgagctcaatcagttcatcgagcgcagcttcctccctgtcgcggagcagaagggcctgtccttcaccgtggaggtgggccccggcgcgccgcgccacatccgcaccgacccgcagcggctccagcaggtgctgaagaacctgctgtccaatgccttcaagttcaccgacgagggcagcgtccagttgaaggtgaagctggccgaggtaggcacgcacttcgaccacgaggttctgcggcgctcgcggtacgtgctcggcttcgcggtgtcggacacgggcatcggcatcgcccgggacaagcagcgcctcatcttcgaggcgttccagcaggcggacggctccaccgcgcgcaagtacggtggcacgggcctgggcctgtccatcagccgcgaaatcgccaagctgttgggcggtgaaatccaggtgaccagcgagcccggccgcggcagcaccttcacgctctacctgccgcctgagtacatcagtccggaggaggagggcctgccgtccattccgtccccgtacgagcctccgccccggctgccgcctcctccgacgccggagtcgccgcgcgcggagccgcctcccgcgccgccggtggcggacagtggccacgtgctggacgcggcgctgccgccgcccatcgagtcgctgctgacgcccgtcgccgtggaggatgaccgcgaccacatccgcgaaggggaccgcgtcctgctactcatcgaggacgacgtgaagttcgcccgcatcatggtgcagatggcgcgggagaagggcttcaaggccctggtggccacgcgcggcgacaccggcctgtccatggccaacgagttccagccgcacgccatcaccctggacatccagctccccgtcgtggacggctggagcgtgctggaccggctcaagcgcaacccgcgcacgcgccacatccccgtgcacgtcatcagcgtcatggacaagaaccagggcaactcacagggcgccttcggttacctcaccaagcccgtcagcaaggagggcctggagcgggtgttcaaccaactggccagcttcctggagcgcaaggagcgccggctgctgctggtggaggacgacgacgtccagcgcgacagcctggtgaagctgctgagcgaaggcggcgatgtcgaggtgacggccgtggccaccggcgaggaggtgctccatcacctggagacgggcgagttcgactgcgtcgtcatcgacctgatgctgcccgacaccgatggcatccggctggtggaggaggtcaagacgcagaaccgcttccgcgacctgcccatcgtcatctacaccggcaaggagctgacgcccaaggacgaggcccggctgcgccgctacaccggcagtgtcatcctcaagagcgggacgaagagtccggagcaactgctcagcgacacggcgctgttcctccaccggttggaccagaacctgccgcctcgcgcccgcgccgccctggctcagcgcaacgagaaggacgcggagctgtccgccaagaaggtcctggtggtggatgacgacatgcgcaacatcttcgcgctcaccagcgtgctggagaaccacggcatgcaggtggtgttcgcggagaacgggcgcgcggccatcgagatgctcgaacagcaccgcgacgtcgacatcgtcctcatggacgtgatgatgccggagatggacggctatgagaccatgcgggccatccgcaaggacctcaagtactccagcctccccatcatcgcggtgacggcgaaggcgctgaaggacgaccgggagaagtgcatggcggccggcgcgagcgactacctgcccaagccggtggacaccgacaagcttctggagctcatccgtctgtgggtgacggcttgattcgctgagtgatggttaccgtacggcgcctctcttccgggcttgggtccggtcgaggggccacctagcctcttccaccttgagaacaggtgggaccggggcagattcatccgccgacttcaatgacgcctagcgaacacatctccgcggaccgcaaccaggaaagggcttcccagccccgagcgagcatcctgatggtggacgaccatccgtccaacctgctcgcgctggaggccattctcgagccgctcgggcaggagttggtgaaggccaccagcggtgaggaggccctcaagttcctgcttcagcgcgacttcgccgtcatcctgatggacgtgcagatgccagggctggacggcttccagacggccacgctcatcaagcagcgcgagcgcacgcgcaccatccccatcatcttcctcaccgcgctcagccgcgacgcggcccacgtcttcaagggctacgcgcacggcgcggtggactacctgctcaagccgttcgacccggaaatcctccgctccaaggtcagcgtcttcgtggacctgttcctcaaggagcagcagattcagcggcaggcggtgctcctccggcagcgcgagcgcgaggcgctggagcggcagagcgagctgcgccacctgcggctcacggagtccttgccggaggtgatgtgggcggcgcgctcggacggcagcttcacctacgccaaccgcgccgcgcgggactacaccggcatccaggcggaacagccgctgtcgctcaacaccttcctggagttcgtccacccggtggaccgcgaggccatgcgcgccgcgtgggtgcaggccatccgcatgggacagcgcgtggagcgcgagttccgcctgcgccgcttcgacggcgtgtaccgctggcacctggcgcgcgcggtgccggagcgggacgagaatggcctgctggccggctggattgccgtggccacggacatcgacgacaagcgccgggcggaggaggcgctggggcgcttcaaggcgacgctggacgcgacgctggactgcgtcctcatgttctccccggactcgctgacgctcacctacgccaacgcgggcgctgccaagcagttggccagcagcaccgatgaactggtgggcctgtcggtgctggaggtggagggcgccttcgacgaggccggcttccgcaagctgctggcgccgctggtgagcggcacgttgcccagccagacgtactccaccagccaccgccggcgggatggctcggaggtgccggtggaggtggtgctccagtacgtggcggcggacggcggccccgggcgcttcatctccgtggcgcgcgacatcacggagcggcagcgggcggagacggcgctgcggctggccagcgaggcgaaggattccttcctcgcggcggccagccacgagctgcgcacgccgctggccgcggccaagggccacgcgcacctggcgctgctgaagctgggcggtgagacagaagccgggccgggcaagtcgctcaaaatcatcaaccggcaaatcgaccggatggccaagctggtggaggacctgctggacatcagccggctccaggcggggcgcctgtcgttggagctggagcgcttcgacctgagccatctggtgcacgagacgcgggaccgcatggcggtgctgtcgcaaggccatgaaatccacgtcgaggcgtcggatcagctcgaggggacgtgggaccggggccggttggaccaggtgctcacgaacctgctgtccaatgcgttgcgctactcgcccgagggcgggcccgtgtgggtgcgggtgcagggtgagcacgacgagggcgtccacctgtcggtgacggacaccggcgtgggaatccccaaggagaagcaggggctcatcttcgagcgcttcggccgcgcgcacggcagcaagtacggcggtctgggcctggggctcaccatcagccagggcatcgtggagcagcacggcggccgtatctgggtggagtctccgggtgtggcgggggaaggctccaccttccacgtctggctgccgcgcgagacggaggcgcctaccggcggcgtgcatccggacgcggcgacgcgctccgccaactga

SEQ ID NO: 4776 - DNA, 1143 bp, Myxococcus xanthus
atgttcccgcgaccgcgcgccctctccctgattgccctgctcgccctgacgggctgtgacgacgagacgcctcgcgtcaaaccaaaggaccacgcggagggcctctacgtcaaaggcaccgccgagtacctccagggccatttcgacgccgccctggcctccttcgaggccatgaagcagattgccccggacgacccgcgcctgcccgccgcgcgcggcgaggtgtacctctccatgggccgcctgacggacgccgccgccgagttcgaggccgccctcaagctggagcccaagcgctccaccaactggagccgcctgggcttcatccagacgcagttgggccaggtggtcgaagcccagagttcgctgcgcaaggccctgtccctcttccctcaggacttcaacgccctggagtcgctgggcgacctggacctgaagaagggcgaccacgacgcggccgtgcggcacttcacgctcgcgtccaacgcggcgccctctccggagcagaagtccgcgctcatcatgcgcgcgctggacgtcctgtcctcgaagcagcgctacccggagctgctggtcgctgcccagaaggccgtggatgacgggatccacaccgcggacgtgctcgccaccctgggggacgccctggtgcgcgccggcaacctcaccgaggccgccaacgcctaccgcgacgccgccagccgctcgcctcgggatcccacgctctgggagctcgtcggcgaaatccagatgaagctggacaagcccggggacgccatcagcgcgtacaaggagtccctgcgcgtgcaggaccgcgccatcgtccatgtggcgctggcccgtatctacctggggatgaaggacgccgcggccgcgaaggaggagctgtccgcggcgctggagtccgtgtccggccaggacatccgcgagctgcgggagctggccagcctgctggccaccatggaccgcaagccggacgcgctgcgcatcctcgcgaacctcagcgcggagcaggaccacgcgaaggacgccgaactgcacgtcgccactgcccaactggcgcgggaactcaaggacaccggcatcctgcaggccgcctgcgcgcgggcgacggcggctgacgccaccctcaagaagtgcccttga

SEQ ID NO: 4777 - DNA, 924 bp, Myxococcus xanthus
atgctggaggccaacgaggcgggccgcgacgcggcgccgggcgtcacctcgctcatcacctcgcggctggcggagtcgccgcggctgcgagtcctctcgcagtgggacgtcgaggccgccctggacgacgagcgccagcagcaactccagggcctcaagacgtgtgaccggggagactgtttccaggaactcgtggccctcaccggcgcccgctacgtcgtggccggccgcctggaccgtttcggcgaccagtacctgctcaccgccaacctgttggacgccgcgggcgggcggatcctggcccggcctcgcgcggaggccccggaagcggaggacctgctgcgcaccgcgaaggccgtctccgaccagctcttcgccgcgctcgccccgccggaggagtccgtggcggcccgcccgctgctgggcggctcttcgcgcacggggggtggaggcctgctgctgggcctgcgcgtcaacaacaacttcatcgagaagctctccaacgtgaacccaggtggtgacatcgaggtgggctactggttccaccccgaatgggtcggcttcctccaggtgggcttcagctacgtgcgctccacgcaggatggcgtgcgcagtggcctcagcgtgttgcccagcgtcgtgggcgcgcgccactaccacaacgtggagaagtccctgcggccctactggggtttcggcctgggcgtgcagctgtccttcggtgacttcggtatcttccagtccaccggcccgctgcccaccgtcgtgggcttcgcgggcctggagtacctcatcgccggctcggtgggcttccaggtcgagttgggcaccaacgtcgcgcaggcggtgctggggctgtcggaatcgaagctgggagacggcctcaacctggacctcaacgcaggcatcgcgtaccacttctga

SEQ ID NO: 4778 - DNA, 680 bp, Myxococcus xanthus
cgccacctcgtggcaccgggcgagacgatgtaccgcatctcccgcacctacggcctcacggtggaggagctgggggcggccaacggcatcaaggcgccgtgggcgttggcggtggggcaggagctctccatccccggtgtcgagcgcagcgtgcccgtgcgggccctggcggaggcggacccggagccggtccggacctctacgtcggctggggggcggcgcagcgtgccgacctcgggtcgccgtgaggagcccccgtcgcgcagccggtccctgtcgcgtccggcgagcgccgcgggccggcctcgtgtggccacgcaggggcagctcgactggcctatgaggggcgtcctgtacggccgcttcgggaagaaggggaaggagccgcacgacggcatagacctggccgcgccctccgggacgcccgtgaagacggcgcaggaaggcacggtgctctacgcgggcgagcagcgtggctacggcaacatcgcatcgtcgagcacacgaacaagctgatcaccctgtacgcgcacaaccgcgacctgcgcgtgcgcaccgggcagaaggtgcgccgcgagcaggtgattgccaccgtcggcgagtcgggccggacgtccgggccccatctgcactttgaggtgcgcctggacggtaagcccgtggacccgctcgactttctg

SEQ ID NO: 4779 - DNA, 771 bp, Myxococcus xanthus
cgcatcctggtttccaacgacgacggctatttctcagaggggcttcaggcgctggtcgaggccgtgagccccctgggggaggtgtgggtggtggctcccgaccgggagcagagcgccgcctcccacgccatctccctgcaccggccgctgcgcatcaaggaggtgcgggagcggtggttcgccgtcgacggaacccccgcggactgcgcttatctggcgatcaaccatctcctgaaggatgatcgcccggtactcatggtttccggcatcaaccacggcgcgaatctggccgaagacatcatgtactccggcacggtggccgcggcgatggagggtgcgctcctgggcgtgcccgccatcgccttcagcctggtggcccggcggaacttcgacttcgcgccgggggcccggttcgctcgttcgctggtgtccagcgccctgtcgcgtcctctcccgccgcggatgctcctcaacgtgaacatccctgggggcgtggaaccggagggctacgtcgtcacccgccagggccgtcactcgtacggcttcgaggtggtggagaacgaagaccctcgtggccggaagtactactggattggcggtagcgactaccagcacgaggacatcccgggcagcgactgcaatgccgtgtttcgggacaagcgcgtctccgtcactccgctgcacttcgagctgacggaccatggccggcttccggacctctccgggtggcaggtcgatggcttcaaccggcatgaaccggacggtgcctag

SEQ ID NO: 4780 - DNA, 1299 bp, Myxococcus xanthus
atgaccgagatttctcagattctggcgcgcgaagtgctcgactcccgtggcaacccgaccgtggaggcggaggtccagcttgccgggggcgctcgtggccgcgccgcggtgccgtccggtgcgtccaccggtgagcatgaggccatcgagctgcgcgacggcgacaagcatcgctacctgggcaagggcgtgcagaaggccgtgaagaacgtggtcgacgtgctcgcgcccgcgctggtgggcatggacgcggcggatcagttcgcggtggaccagcggatgctggagctggacggcaccgccaccaagggcaagctgggcgccaacgccatcctcgcggtgtccatggcggccgctcgcgccgcggcggacgcgcacgggctgccgctgtaccgctacgtgggcggcgtgcaggcgcgcaccctgccggtgccgctgatgaacatcctcaacggcggcgcgcacgcggacacccgcgtggacgtgcaggagttcatggtggtgcccgccggtgcgtcctccttcgcggagggcctgcgctggggcgccgaggtgttccacgcgctgaagaagattctcaagggccgcaagctggccacgggcgtgggcgacgagggcggctacgccccggacctgccggcgaacgaagaggcgctgaagctcatcatggaggccatcgaccaggcgggcttcaaggccggtgagcagctcttcctggccctggacgtggcggccagcgagttcttcgacaagggcagcaagaagtacaagctgaagggcgagggcaaggagtacgactcgaccggcctgctcgagtactaccggggcctctccgagcgctaccccatcatctccatcgaagacggcatggcggaggatgactgggagggctggaagaagctcaccgacgcgctgggttcgcgcatgcagttggtgggtgacgacctcttcgtcaccaacgtggagcgcctgggccgcggcatcgagacgggcacggccaactccatcctggtgaaggtgaaccagattggcaccctgacggagacgttcgacgccgtgcgcatggcgcaccgcgccggttacacgtccgtcatgagccaccgctccggcgagacggaggacaccaccatcgccgacctggccgtggcgctggactgcgggcagatcaagacgggttccgcgtcccgctccgaccgcgtggccaagtacaaccagttgctgcgcatcgaaggcgagctgggggccgcggcccgctacgctggcaagtcggtgttccgcgccttgaaccagaagaagtga

SEQ ID NO: 4781 - DNA, 426 bp, Myxococcus xanthus
atgcctggcgcctcgcgaaccatcatcgtcaacgcccccatcgagaaggtcttcgacgtcatcacccagtacgagcggtacccggagttccttcccgaggtgaagggcatccggaccgagaaccgcaagggcaacacggtggacgtccactacaaggtggatgtggtgaagaccatcaactactccatccacgtcacggaggagcggcccacccgcatgtcctggacctacatcaagggcgagttcatgaaggacaaccagggcagctgggtcctggtgcccgagggcgagggcaagacgaaggccacctacaccgtggagatggctctgggcgcgctggtgcccaagagcgtcgtctccgcgctggtggagacctcgttgccgaagatgctggacgccttcaagcgccgcttcgaggcgccctga

SEQ ID NO: 4782 - DNA, 378 bp, Myxococcus xanthus
gccaccaagccgcaggcctgcgtgaagctgctgatgggcatcggcggcgcgcccgagggcgtcatcgccgcggcggccatccgcgccaccggcggtgacatgcagggccggctcgttccccgcaaccagggcgaaatcgaccgcgccaggtcgatgggcatcaccgacatctcgaagatctacaccgccgaggagctggccaagggcgaggtcatgttcgccgcctccggcgtcaccaccggcgacttcctcaagggcgtgcgcttcttcggcggcggctgcgagacgcactccgtcgtcatgcgcagcaagacgggcaccgtccgcttcatccagtcggtgcacaagttcgacaagaagccggggtacgctttctag

SEQ ID NO: 4783 - DNA, 654 bp, Myxococcus xanthus
cgcgggagtgaacctgggcatgacggtctacctcgctcggacgcgaaggccgcgactgctgcgcgagcgcgccgaactcgaggtcgcaccgtgacgccgcgcgtgccattcgatgaagaggccctccgggccgccgtggtgtcgggcgacgccgccgcgcgagaggatgtcatgcgccacctgtacgaggcgctcagcgggaagctgtacgtgctctgccatggaatcacccgggacccgagtgatgcccaggacgccgtccaggagacgttcctctcgattcaacgggccctgccgcagttccggggggatgcgcagctgtcgacgtgggcgtatcgcatcgcggtgcgggccgccgtggccgcgaagacgcggcgcgagcgtcaccgtggcgacgcggtcgacatcgagatggcggaccctcgggcgggtatcgaggagaccttcgagacgcgggagcggaggcgcagactcgaggtggcgatgaggacgctctcgctggagcaccgcaccgtgctgtcgctcttcgccgtggaaggcctgtcacacgcccagattgccagcgtcctcgggattcccgagggcaccgcgtggtcgcgcttgcacctggctcgcaagcggctggcggcggcgctcgaatccaccgccccatag

SEQ ID NO: 4784 - DNA, 1389 bp, Myxococcus xanthus
atgaagcgctatttcatccacaccttcggctgccagatgaacgtcaacgactcgctccgcatgagcgaggtgttgagccagatgtcctacgcgccgacgccggtgccggacaacgccgacctcatcatcctcaacacctgctccatccgggagaaggcagaggacaagatgctgtccgccctggggcggtacaagccggtgaaggccagccgtggcgcgctgattggcgtgggcgggtgcgtggcgcagcaggagaaggacaagctcctcaagaaggtgccgtacctggacttcgtcttcggccccgacaacatcgcgcgcctgccggacatcatcggccgggtgtccgcggagcgggagcgggtggtggagacggccttcgtgaactcggaggagtacgtcttcccgcgcgccgacccggagacgtcccgcggcaaggtcaccgagttcgtcacggtgatgacgggctgcgacaacgtctgctcgttctgcatggcgccgcacacgcgtggccgcaaggtgagccgggcgttccccgacgtgctcgtcgaggtggcggacctggcaaaggtgggcgtgcgccaggtgacgctcatcggccagaacgtgaactcgtacgcgggcggcatctccttcgcgcaggtattgctgcgcaccgcggaggtccccggtatcgagcgcgtgcgcttcaccaccagccacccgcatgacctgtccgacgagctgatcgaagccttccgcgtccagccgaagatcaccccgcatttccacctgccggtgcagtgcggcagcgaccgcatcctcaagatgatgcgccgcgactacacggtggtgcagtacctggagcgcctggcgaagctgcgcgaggcgcggccgggcatcgccgtcaccacggacatcatcgtcggcttccccggggagaccgaggaggagttcgagatgacgatgcagctgaccgagcaggtccgctacgacaaccagttctccttcgtctacagcccgcggcccaagacgggcgcggccctgcgcgagaaggactggggtccggtgccgcacgaggtgaagattgcccgcctggagcggctgcagaagctgcagcggcgcatcagcggcgaaatcaccgcggcgctcgtgggctcggaagtggaggtcatggtggaggggcactcgcgctacgacgccaccaagcgcttcggccgcacgccggagaaccgcaccgtcaacttcgatggggacgcccccgcgggctccttcgtgacggtgaaggtggagcgcgccacgcccaaccagctcgcgggcaagcaggtggccctgctcaagccccccacggtggagccgctgccggtgcccatggccgaggcgccgttccacgtcgtcgcggaggcgtag

SEQ ID NO: 4785 - DNA, 510 bp, Myxococcus xanthus
atgtcttccttcctcttcgacgacaacggctttcaggacgtccccaaccgggagtcgtccacggacctcaccgccgccgacgaccgcaccctccgctgggccgcccccccgctggacgcggcgatgctcgacgccctggtctgctaccagcagacctaccttgcccaggcctccgggcagggaacggagaccctggccaaggcccacaccgaggccctggccgcgtccgggctggaccccaagacggcggagcagggcagcgcgctgctgcgagccttcggcgggcggcgctgggcggtccgcaagctccaggacaagctggggcagctccagggcggcgcggcggacgagctccagggccgcatccaggacgagctggccaagcaggagcgcgaaaccaatgccctggcgcggcgttacggcgaggacgcactggtgctgctccgggcccgcgaagcggagctggtggacctgcacacccgcctgacgcacctgctcagccggggatga

SEQ ID NO: 4786 - DNA, 1437 bp, Myxococcus xanthus
cccgattgcgcgcgggccatccccggacatgatggttgcgtggatgcccgcatcgtcgagttcgccgaggtccttcgccagaacggtgtgcgtgtcagtacgtccgaggtccaggacgcgctgcgcgccacgtccgaggtaggcctcaaggatcggaacctgttccgttcggtgctccgcaccacgctggtgaagcgcgagctggacgtggacaccttcaaccgggccttcgagttctacttctccggcgcggcgaggacgttcgaggacatcgacaagtcgctggcgcagcagttggaggaggaaggctacctggagggcgacctgctgaagatggtcctcatccagatgcaccagctcctcccggagatgtcccccctggcccaggccgtgctgatgggagaccgggcccggctggcgcagatcttccggatggcttcgctgcagttggacctgtcgcggatggagagcccgctccaggccgggttcttctcccggcgcatgctggcggcggctggggcggacaaggcccggaacgacatgaagtcgctcgaagacgagctgcgagcccgcggcctcaccccggaaggggtggagattgtctcgcgccatgtcgcggccgcgatgcggaagatcgaggacgccgcccgccaggaagtgaagcgccaggcggaggcccgcatccgccgccgcaccgactccgccgcggacaagccgctgcacctgctcacccaggcggaggtggaccagatggagtccgccgtgcgcaccctggcggagaagctgcgcagccggctcatccggaagcagcgctcgcaccgcaagggcgccctcaacgtgcggcgcacgctgcgccggaacctgccgtggggcggggtgcccatggtgccccagttccgcagtcgccgccccgagcgcccggagctggtggtgctctgcgacgtgtccgactccgtccgtcaggcctcacggatgatgctgctgttcatgcacacgatgcagtcgctcttcgtccgcgtgcgctcgttcgtcttcgtgtccgacgtgggcgaggtgacgcagtacttcaaggacctggaggtcgacgccgccatcgatatggccaccgcgggcaagacggtgtccctgagcgcgaactccaactacggccgcgccctggccgacttcacccgggaccacctgggcagcatcacccgccggaccaccgtgatggtgattggcgacgggcggaacaactacaacgcgaacaacgcctgggccctcaaggacctgcgccgcaaggcgaagcggctcttgtggatctgccccgaggagcgtggcaactggggcattggcgacagcgagatgctcacctacgagaagcactgtcaccaggccgtcgtcgtcacctccgtgtcggacctggcccggatcgccgaccagctcgtgcccgcgtag

SEQ ID NO: 4787 - DNA, 699 bp, Myxococcus xanthus
ctctacagcggcccggtgacggcgcgccacctggaggccgccgaggcggccgtgcgcgccctgcggctggagggcgcggtgctgacgccgaaggaaggatcggctcggcttcttggcaagccggcgctgcgctcctactcgccgctgcggccagaagtccccctgtacctgcggccggatgccttcgctcaggcccatgccgaggccaacgtggggctggtgacctcggccgtgtacgagctgggagcccgcgagtccgacaccgtgctggagctgtattcgggcaacggcaacttcaccttcccgctggccggaaccgccgcgtccgtgctgggcgtggagtcctcccccgtgggcgtcgagttggcacagcggagcgctcacgagggtggggtgacgaatgtgcgcttcatccagggcgacgcccgcaaggtgtgcgacgggctggtggccgagcagcgccgcttcgatgtgtgcctcgcggacccgccgcgcgcgggagccccgggcctggcgaagtggatgaccgccttgggggtgcgccgcgtggtgtacgtggcgtgtgatccggcatccctggctcgggacgccgccggcctggttgccgcgggctacaagcccctggccctccaggtggtcgacatgttccctcagacgcatcacgtcgaggccgtgatgtccttcgagcggccggcctga

SEQ ID NO: 4788 - DNA, 780 bp, Myxococcus xanthus
atgtccgctcgcatgtacgttgttggagcactcctggcccttctcgtcccgacgctcgcacgtgcgtggccggtggacctggtcgtccccctggagcccgggaaggaacgcttccacaagctcgacaccgtggactgggtccaggtggcggacgcctccgtggcggacgcggagctgcttcccgggagcaatgaactgttgctcaccggtcagaaggcgggacggacgctgctcctgctgtacgcggggggccgcttcgccgtgtggcgtctcacggtgggctcaccgccgccggaggaccccgcgccccggctggccgccgcccgcaaggcctgtccggacctgaacgcgacgagcggcgcggagcgctccctcagtgcttcggtgaaggactccgcgtgcaggttggcgctgctggagctgctgaagacggactccttcgtggctcgggagctggagttgaccttcgagctccccgtcctccaggagcagctcacttcactgggggaggggttgaagccgctggggctggaggctcgttacagcggtgcgggcgtggtggtgtcgggcgcgggctcgccggaggtgcaccgcaaggcgttgtgggagttgttccaccgctccgtgggccgggtgccgctggacgaccagattcaggaagtgaagccgcccgagcccaccgacgccggtgtgccggacgcggtcccgcccgcggtgcaggcgccgcgtgagattccggtggaggtgctgccgccgccgaagaagtcacgcacgcgctga

SEQ ID NO: 4789 - DNA, 603 bp, Myxococcus xanthus
atggggacggacgcggaccgcaagacgtacctcatgtccgagcttcaggtggactgtgacgtgctgcccccgggccggctgtcgggtacgccggtggcgctgcgccagaaggacgcgcccacgggctgcaagctgcgccgcgccgacgacaactccaccagcgacgagggccgcggactgcccctggagctgtcggacgtgcttcccgagcgaacgtcgtgcgaggccccggagtgccagcgcaagtgggagattttcagcagccggtgggatgacggcagcgccgtgttcgacatcgcggtgtcgtggatgaagcgtggcgggaagaaggacccctgcgagtgggccacggaggaccacaccgcgctgctgctccggccggcgggggcgctggcgccgcttccgctgcgctccggcggggccttcttcggcgcgctctatgacagcaccgggcttcgcaccgtcttcagccgcaccttgggcgtgctcaacgtccatgacgccgcgaagcccaaggtggcgccgaaggcggtgcgctacggcagccccacggaggaggagctggcgcacgggaagcgcacgttgtcaccgtgcaagaagtag

SEQ ID NO: 4790 - DNA, 465 bp, Myxococcus xanthus
atggccaatacggtcggtgtcaacaagatgtccgtggtgaccaaggactccaacggcgtgtccgtcgcatttccggatgtctgcaagacgcccagtccggcgggccccattccgctgccgtacccgaacgtggcgcgctccgccgataccgcccagggcagcaagacggtggcggtggaggggaaccccttgtgcgtgaaggactccaacttcagcaccagcacgggggatgaggccggaacggcggggggcggagtggtctctggcaagacccagggcaaggccgagttcgtcaacttctccttcgacgtccaggtcgagggaaagaacgtggcgagggccctcgacttgatgctgcacaacgacaagaacacgcctccgttcccgctgatgcagccaccggtgatggcggccggccagggctcgggcaagtgcaactgcctggtctgcgaaaaagagatgtag

SEQ ID NO: 4791 - DNA, 441 bp, Myxococcus xanthus
atgggcacggtgcaggtggacttcgagggcaaccaccatgggccgctggaggcccggctcgcggtcgcggtggatgaggccacgctgcttcgggcgatagaggcgcggcaggaggcggtgctctgtttcgagcggggcacaccgacgtgccccatcgtgctcggtttgctccagccgcgcagtgagacgcccctcctggatgccatgctcgaagcacctgatgtcgagcaccaggatggagaggtcgccatcgtcgccaacggccagcgagtccccatcgaggggcttctggacggcgcgaccgaggagctcgagcttcgctgcggcaggtccagcctggtcctgcgtcgcaatggtcagattctgcttcggggtgagcatgtgctcgtcgacgcgggccaggtgctgcgccttcgtggcggcaagacgcagatcaactag

SEQ ID NO: 4792 - DNA, 1965 bp, Myxococcus xanthus
atgaaggtgttcgtcgaggccctggggatggcctcatgcctggggccggtgattcccgcctgcgcagcgttccgggccaatctgctgcgctcctcgccgtctcccgacgtggacgtcgcccacgccggtgatgaggcacctcggcccgtgacaatctgtgcgctcccggtggcgacgttcgggttctcgggcgtcggtcggctggtggcgttggcgtgcgaggtgctcaaggatgtgggcactcgcgtggacctgcggggccttgggccggagaccggcgtctatctggcgctgccggacccgtgggagcgaggccttgacctgggcgagccggacgcgacggaggcgctgcgagtggaggcgctggggcgtcgtgtgttggaggcgagcctgcggaacatgggcctggaatggcccgggcccaggcgcttctttggcggtgggcacgtggccttcgcgagggcgctgcatgcggcccaggcggcgctgcagaacggcgggcttcgctcgtgcctggtgatgggggtggactgcctggtcgaagagccgacgctccatgcgctggcggatggacgacggttgaagacgccggagcagcccgtgggcttgacgcctggggaagcgggtgcggccttgttgctgaccaccgaggggcccgcgcaacgttcgacgggcgcgccccaggtgatgctgcacgcggtgcggctcggagaagagccgcacccgagaggctctgacaagccatcggatgggcgggccctggcggcatgtgccgaggcggtgctcgcagccgcaggggcccttcgtgcccggccgctcctggtgagcgaccacaacggagaagagggaaaggcgcgggagtggggggatggtgttgctgcatctgcgggcgttggacgcctcgctgggggacttccgcggtatcctcctcgcttgggactggggcccgatggccggacagccttggtccggtcagggactgcaacgcggcgatgcgccttcctccgtgagccttgtcttcgccagcgcggacgattccggccgaggcgccgtcttgataggaaccactgctgcgcatccgtccagaggagctctgccatgacaaccggtgacgcccggcacaatcccaatacggaaatggcccgcaggctcaatggcatctacaagcgcaacctggctcggaaggaatctgcccgggccgcggccaaggaggaggcgaagaagagcaagccgaagaagaaggcggagcccgctcctgacggacatctggaccccaacgcgccgttgaatggggtgctggccaagggcgataactatgcccgccgcggctacacctacctcaaggcccaggacggccggggggtgtaccgcaacttcgaccatgtgcacctgagcgaagtccgggacatggtgaaggagcgggcggagtttccaggggggccgaaggagaacttcaaccccacgtacacccagcagtatccgtacgcctgggaagctcaccacatgctgccgggctcggccttctattacatgatgaaggacggcaagccggccttcacgtacaagcagattcggctgttgctgatgtccgagtacaacatcaaccacgggcacaacatcatcaatcttcccgccgaggactgggccgtcccggtccattccctcatctgccatccgagcgaccacgagtcctacacgatgcgggtcatggatgagatgcggaaggtggccaacgatttacagaagctgattgatagtgggaaaccgcacggaaatttgccagaactcatctttgaagagctcaaaaagctggagaatcggttctggatatttattgtcaaactcagcggaaagctcgttgaagcaaaagtcgctggtgtccgatatgtcggccctggttcagagcacgttaggtacgccaataaagatggcggaacgcactatgagtggggcagcctttggtag

SEQ ID NO: 4793 - DNA, 111 bp, Myxococcus xanthus
atgatggagctcatcctcatctcggaccgggccaagaatgccttcgaacaggctggcttgacgggcttcaagctccatcccgctgaaggcttcgacgacatgttcgcttga

SEQ ID NO: 4794 - DNA, 207 bp, Myxococcus xanthus
atgaccttgctggtcaagtcactgccccaggacatggacgtggtttccgtgacatcgaacaaggatggcttctacgaagcctcgctggtcctgggggactatcgaatctgcacgacgttcgggcgttgcacggacttctcggtgggcatcaatgaagtggttcgccttgactacgagatgtcggtggggccggggtggtcgaggtag

SEQ ID NO: 4795 - DNA, 111 bp, Myxococcus xanthus
atgatggagctcatcctgatttcggaccggaccaagcaggccttcgaacaggcggggctgacgggcttcagggcccatcccgccgaaggcttcgacgacatgttcgcctga

SEQ ID NO: 4796 - DNA, 729 bp, Myxococcus xanthus
atgcgtcaggtcgatcccaccgcgagccgagatgtcctcgtgcggaccgtggatgagctctgtgtccacttccacgtcgtggccgtggccaccctgctcgtggatggcaacccgcagggcttcttcctgaacctgtgccgagccgccgagaactggaggcgattgctcacgcactgccgcctcaagcagtgggcgctccctgcttcgcgacacatggatcctctgctcggtgccgtcgcggcgggacattggaatctggcgcgacaggtcgcggagctctccgagacgcggtggcttccggacgaggagtaccgctccgagcacgcacgcgcccagctcttcctggcgctggtctcgcccggtaccagggacgtcgtcatcccgagggtggaggcgttggagggactggggctcgagacagagacggaccgggttgcctgtgcccgagccctgctcgatggtgacgcagacaccttctccgaggcgttcaagcacgcggtgctcgtgcatggagaggacatcgagaagcgcgcgaagctcttcacgacccccgtgacacgcttcgcgcccaagcgagccatctggttggaggggctcgcctggctcaggctctccgagcgcgcggacatcgcgagcttcgatgagcacttccaatactgcccgccgctggcccgcacgcccatgacgtcccagtacgccggggactgggtcgtttcgctcggtccttga

SEQ ID NO: 4797 - DNA, 573 bp, Myxococcus xanthus
atgccggagttcgggcatgtgaaggcgggccgcatcctcgtggtggccggtgaggcccgccgcgcctcccggggcaccgtgaagcccctgtgcttccggggtgggaagagcacggaccgtaccggacgccgcaagcccatcatccgcatcgggggcaagcggatgctgtactgcgtcacgctccggccgctcttcttccgggggtccaccgcgcaggctcgcgtggagacggtgattcacgagctcttccacctgtcgcgccgcttcgacgggacgctgcactccggccggcgccatgccgtgctggggcgcaacttctctcgcaagctcaagccgctggtgcgccgctacctcaagctgtgccccccggagctgctggccgccatggcccactccggcgaggtacgcatcctccagtggctggagcggcccggtcccgcctaccaccccggcagccatcgccgggtgcggaaggtctacaccgaggaacagctctactccggtgtcgctcgcatggtgacgcccaaggtgcgtctggctcgcgacacctccgcgcgctccaaggttcactga

SEQ ID NO: 4798 - DNA, 1977 bp, Myxococcus xanthus
atgccgtggacggcgtggggcggtggcagtgaagcgcctgccaccgaggtggcttccagcgaggcttccaccgcggaggctccgcccgatgcgcaggtggcccaggccgatgcggggccggagcccgcgttagacgcggaggcgctgccggaagcgcgcacggtggtgacggcgtcgcgttcgccggagcggctcgaggattcggcggtggccacggaggtcattacccgctcggacatcctggccagcggggcgcgggacgcgtcggagttgcttgccgcgcaccctgggctccaggtggtgcagacgttcgcgggcgccacggtgcagttgcagggcctgtcgccggagtacgtcctggtgctggtggacggtgagcgcgtggccggccgggtggccggaagcgtggacctgtcccgcctgtccaccgaggacatcgaacaggtggaagtcgtgaagggcccctcgtcggtcctctacggcagtgacgcggtggcgggcgtggtgaacctcatcacccgccgtgcccgccgtccgctgggcgccgagctgcgcgcctcctacggctccatgcagcggctggagctggacgccaccggcgaggcgaagggcgagaactgggggctgcgtctgagcggcggtctggcgcggcgggacgcgtacctcctggacccgacgagcatcggcaccacgggcagcagcctggatggcatcgacgcgtccgcgggcggtgacttgcgcatcagtgagggcacggcgttgcaggccaacgccacctatgcgcgtcgggtgcagcggggcgtggacgtgggcgtgacaggcgccatcttcgaccgcgccagccgggatgactcgctctccgttcgcctgtctccacagtggaggctgtccaacaacgcctcgctgcgcgtggatggcgcctatgcgtggttcaaccggcgctacctgagggaccagcgccgctccaacgcgttggacaccatcgaggacacgcgcgagcagcagggccggctgggcgcgcaactggacgcgaagctgggagacacccacgccttcgtggtgggcgcggagctgctcggcgaatggttgcaggcggaccggctgggcgaagacggcaccggccagcgcgcccgcgcgtccatctacgtgcaggacaactggaccctggtgccgcgcttgaagctgacgctggtgccgggtgcgcgagtggacacggacacgcagttcggtacggcggtgacgccccggctggcggcgcgcatggacccgacgtcctggctcacgctgcgcggcagctacggctgggcgttccgggcgccgggcttccaggagatgctgctcgacttcgaaaaccccagcgtgggctaccgggtgcacggcaatccggacctgcgtccggagcgctcgcgcagcttcaatctgtcggtggaggtgaagcccgcggagtcctcgctcctgtgggtgagcgccttccagcacaaccttcaggacatgattggcgtctccacggaggtggtcggtccgcagcagctcttcacctacgtgaacatcgcgcgtgcgcgcgtgcgcggcggcgagatgggcgtgcgtcagcagttgcccggccgcatctccgcggagctgggctacacgctcaccgacggtcgttcggaggagacggggctggcgctggaagggcaggcgcgccatcgcctcaccgcgcaggctacctggcgtcaccggacgtcgggcctggaggcctgggtgcgcggcgcgctcgtggggccgcgtcccttctacccggacacggacggtgacggcgtcgccaacccgtacgacgcgaagacctacgtcaccgtggatgcccggctgggttggcgcatgcgcgaggagctccagttcttcgtgctgggcaccaacctcgcgaacgcgggcaaccccaccgaccttccgattccccctcgcgccatccaggccggcatctccgcccggctctga

SEQ ID NO: 4799 - DNA, 660 bp, Myxococcus xanthus
atgtcccgcttctcttcccattcctccttcctgggccgcgccgccgccgccctgctgctggccggttccctgtccgcgtgcggcgatgacctcgagctgccatcagagaaccctccgacggatggctcccacgtgaatcacgtggccaacgatgacggctcgtacaccaccaccgtgaacgcgacgagcagcgcggactggattggcctggacctggacaagggcgcgcaggtgagtgcttctgatgacactgtctgggacctggccttcaaccgcttcaacgtccgcacccggggcggcgtgagtggtaccggcaacgtggcggtggcggtgctcctcgagacggacttcgcggcggtgacgcgggctcctgcggacggctacgtcgcggattccgaggacggcccggatcggggcgaggacccggacagcgccttccagcagggcgacgggtggtacgtctatgacatgacgacgcacgccctcacggcgcgtcgcaatgtgtacgtcgtccgctccgacgctggtgactacttcaaggtcgccatgcagtcctattacgacgatgcgggcacgccggggatgttgtcgttccgctgggcgaaggtgcctggccccgcctccagcggcagcgcggtgacgcagccgtcctcgtactga

SEQ ID NO: 4800 - DNA, 1050 bp, Myxococcus xanthus
tcccgtctgcgccagcgctggcagaccctccgcgaggagcagcctcgcacccgtatccgtgacgccgccgagcagttgggtgtgagtgaagcgcagttgctcgccacgggacttggggagagcgtcgtccggctggacctccggctggatgcgctcctgcctcgtttcgagtcgctggggcgggtgatgtcgctcacgcgcaacgcgcatgccgtgcacgagaagcgtggcacctggcgcaacatcgagctgcacggcaagcaggggctggtgctggacgaggaaatcgacctgcgcctgttcttcacgcgctggagcttcggcttcgccatccgcgagccgcacggcgatggcatccgccgcagcctccagttcttcgacgcgtcggggacggccgtccacaagctctacatggaggaggcagggcgcgaggagacgttcgacaccctggtgaaggaattcacccacgcggaccagtcgccggtgctcagcatcgtcccggccacgctcgcggtggagcccaagcccgacagtgagattgacgcggaggggctgcgctccggctggcgcgcgctccaggacacgcatgagttcttcatgctgctcaaccgcttcagtgtggcgcgcacccaggcgctccgcctggccgagccggagctcaccaccccggtggcgacgtcctcgctgacgtgggtgctggagaaggcgtccgcgacggagctgcccatcatgattttcgtgggcaaccccggctgcatccagattcacaccggcccggtgaagaacgtgaagccgatgggaccgtggatgaacgtgttggacgcgggcttcaacctccacgtccgcgcggaccacgtccactcggcgtgggtcgtgcgcaagcccacgcgggacggcgtcgtcacgtccctggagctgttcaacgaggcgggggagaacatcgcgctcatcttcggcaagcggaagccggggcagcccgagtcgcccgagtggcgcgcgctggccgaagagctggccacggcgctgcccgcgagcgaggtgtcgcgatga

SEQ ID NO: 4801 - DNA, 903 bp, Myxococcus xanthus
atgagccgcgcgttcgggctgtcgtgggtcttcatggcggtggcctcgctcgcgcacgcggcggcgccggcgcccgcgaagcctccggcggcggccgcggccaaggccccggtcaacgcggcgaagctggtcaccgtcggccccgccatcaccgaaaccgtcttcgcgctgggcgcgggcgggcaggtggtgggcgtggacgacaccagcctggcgttggaggtcgcccggaagtcgccgaaggtgggctaccagcgggcgctgtcatcggaggccatcgtcgcgctggggacgtcgcagttgctggcgtccgaggaggcgggccctccgggcgtgctcgagcagctcaagacggtgggcgtggacgtggtggtgctgccgaacaagcacaccgtcgaagccacgcgcgagcgcatccggacgctcgcgcagcgcctgggcaaggccgagcagggtgaggccctggtcaagcaattggactcggacctgcgcaaggcgcaggagcgcacggcggcgcgcaaggacgcgaagccgccgcgggtcctcgcgctgtacgcgcgcggggccaacgtcctcatggtggcgggcgccgggacggcggcgggcgagctcgtcacgctgtcgggcggcgtgaatgccatcgccggctatgcgggccacaagccgctgacggcggaggcggtggtcgaagcggcgccggacttcatcctcatgccagccagctccctggagccggtgggcggtgaggagggcctgtcgcgcacgcccggcctgtcgcaggtgcgcggctggcgcctcatcaccgtggacgacgtccacttcatggggctggggcctcacctgggcaaggccgtgagccgcttgcaggatgggtacacgtccccggctcggggccgcaaatga

SEQ ID NO: 4802 - DNA, 1089 bp, Myxococcus xanthus
atgagtgcgtcggagattgcgcccgtctccgccacctaccgcacccaggagcccatccagccagcagccccgcgtccgtggctgttgctgacggcgctgctgctgggcgtggtgctcctgtcgctcgccgtgggcgcggtgccggtgcctctgctggcactggcgggcagtctgctggaacgggtgggcctggacatcggccacaagctggagtccgtgcagcaggcggtgctgctgtccatccgcctgccgcgcgtgacgctcggcatcatggtgggcgccgtactggccacctgtggtgccgcgctgcaggcgttgttccgcaacccgctggtggagcccggcctgctgggcacctccagcggcgcggcgctgggggcggtggcggccatcgtcatggatgtggccctcagcgcccacctgggctcgctgcggatgctcgcggtgccgggcgcggccttcctgggcgcgctgggcgccacgttgctcgcgcaccggctgggtgggggcggcggtcgcacggagacggcgcgcatcctcctggcgggcgtggctgtcagcgcgggggcgggcgcgggcatcggtctgctcacgcagatggccaccgacgcgcagctccgctccatcaccttctggacctggggcagcctgggcggtgcgtcctgggacgtggtgggggcagccacgccgccgctgctcatcgccctgggcctgctgctgcgtgaagcgcgcaccctcaaccttctgctgctgggggagcgcgaggcgtggcacctgggcgtggatgtcgagcgcctcaagcgccggctcatcctcgccgcggccctgggggtgggggccgcggtgtccgtcaccggcgtcatcgccttcgtgggcttgctggtgcccgcgctgctgcggttggcgctgggacctgaccaccggcggctgctcagtgcgtccgccttgctgggggcctcgctgctggtgggcgcggacctgctggctcgcacggcggccattcccgccgagttgccagtgggcgcgctcacgtccgtgctgggcgttcccgtcttcatcgggctgctgtcgcgcaagggggccgcatga

SEQ ID NO: 4803 - DNA, 798 bp, Myxococcus xanthus
ctggaggttcgtggcatcgaggtgtggcgtggccgtgggcggacgctgggacccatggatttgacgctggagcccggtgaggtgctggccgtcgtggggcccaacggcgcgggcaagtccacgctgctgtccgccatgtcgggcgagctgcggtgctcgacgggcgaggtgcttctggacggcactcccttgttgcagtggaagccgcgggagcgggccatgcggctgggcgtgcttccccaggagtcgtcgctgggcttcggcttcacggcgctggaggtggcgctgctgggacggagtccccattcgagccgcgctgagggcagcgcggacctggcggcggcggtggcggcgctcgatgccaccgacacgcggcacctggcttcacgttcgtatctcacgctgtcggggggcgagcggcagcgtgtgcagctgtcgcgggtgctggctcagctctccgaaccgttggcatccggacaccgttacctgctgctggacgagccgacggcgagtctggacctggcccaccagcacctcgtgctggaggcggcggcgcgcttcgcccaggcgggtggcgcggtgctggcggtgctgcatgacctcaatctggccgcgcgttacgcgcaccggatggccgtgctcgccgagggccgggtggttgaactgggcgcaccggcgcaggtgctttcccaggagttggtggcccgcgtcttcggtctgcgcgtgcaggtcgtcgaatggccgggctcgcccggtcccctggtcatcccggagggccgcgcgccgctgactccctga

SEQ ID NO: 4804 - DNA, 552 bp, Myxococcus xanthus
atgctactcgtttggcccgtgtccgtgctgtggctgggggaggcggtgtcctcgtggacggtgtcgggcgtggcgatgctctgcgttgggctggcggtgatgaacctgtcccgtccatcgggggccgcaggggcgggcgtggcgtgggcggccctgtcggcggtgggaatcgcgggctaccacttgagctacaagatggcgctggggacgggcgcgcagcctcctgcgttgttcgccaccggcctgctcgtcgcgctgcccgtgctcatcctggagcggggccgtcagcaggggtgggctgccttccgccgggaggctttgctcgcaccggggcttgttctgacggcggggctcatctccgcgctgtcgttcggcctgttgttgacggcgctggcggggggaggcgcaggcgtggtgctgacgcttcgaaacacctccatcgccttcgcgttggtgctcgcggcgctccagggtgagcgcctgggccgacggcaactgtcgggcgctgcgctcgttgccgtgggcgcgttgttgctcggcgtgccggcatag

SEQ ID NO: 4805 - DNA, 1431 bp, Myxococcus xanthus
gtcccccgcttctggcccttcatgttcaccctgtttgtcgggtcgttcatgtcggtgctgagctccagcacgatcaccatcgccattcccgagctccagcggcacttcggggcggagctgtcctccgtgcagtggaccctgacgggcttcatgctcgccatgggaacgagcgccccgctcactggctatctgggtggacgcttcagcttcaagtgggtgtacgtggccagcctggtggccttcctcgtggcctccgtgctgtgtggggtggcctgggacacgcgctcactggtggccttccggttcgtccagggggcgttctgtggcgccatcatgccggtgacgatgacgctcatctatcagttgctgccgcgtgaacggcaggcgctggccgcgagcctctggaccctgtcctccatgctcgcccccgccttcggccccacgctggcgggctggctgatgacgctgggcaactggcggtggttgttcttcatgaacgtgccgctgggcctcgccgccgtggcgatggcggtgcgggccgttccctactaccgcctggaggttccgaaggcgttcgacttccccgggctgctcaccgtcatcaccggaacgctggcgctgctgatcgccttgagtcagggacgggcctggggatggacggattcgaagacggtgtcgctggccgtgctggggacggtgtcactcgtctacttcgtcgtccgccaactgaggacgcatgcgccgctgctcgacttgcgggtgctggccaacggccgctacgtggtgacgttgctcatctcgagcatcatcaccatcagcctctattcgggcgcgttcctcatcccgttgttcctccaggaaatccagggtgtgacgccgctgaagacggggttgattcttctcccggcctccctgtccatggcgctcctgatgcccctggtcggacgcatgtacggcaagctcgggccgagcacgctcatgacggcgggcgtcctgttgattgcgggtggcacatatgccttgagccgcctgacgccggacgtctcccacacctacgtgctgatgtggatgctggtccggaacgtgggcatctcgctctccatcatgccggccagcaacgcgggcatggagcagctctcccgggagctgagtggccacgcctcgtctatcagcaactggctgcgaaacgtgttcggggccttctcgattgccatcttcacgtcgctcctctccagcttcgcggcccgggaggcgcaggtgctcgcgcgggaggggatgacggagcgtcgtgacatcgagttgctctcattcgtgacgggcatcaaccaggtgtacctggtggcgactgtcatcgccctggtggccgtgcccttgagtctgatggtccggaagtacgtgagcgggctggaagcctcccggggcgctcgctag

SEQ ID NO: 4806 - DNA, 462 bp, Myxococcus xanthus
atgctggacttcagccgctacggcgaatccgcgtggctgccggtggccaccgtcgccgcgggcgcgctgctggtgggcgtgctggccacgctcatggaagtcaccatgcgcgggctggccaacggcagcccggagcgctgggccctgcggctgtcgggcttcacctcgctgctggtgacggtgctctacccgcccatgcgcatggccatggtggtgctcaacctgatggcgcgcaccttcggccggacgctgcgcttcgagccgccgccccctccgctggaggagttggagaagctgctggccgcccaggccgcgaagaacgaggtcgacaagagcgccccgcagctcatccgctccatcttcgagctgtccgacaagcgctgccgcgacgtcatggtgccgcgcacggaagtggtgacggtggacgtcaccatcacccccgacgagctgctgcgccttgct

SEQ ID NO: 4807 - DNA, 603 bp, Myxococcus xanthus
atgacgaaggacgaggccatgaccgcgctccccttccacgcccgggtcatcaacgcctggggggacgtgcacgtcgccgacgtcgtggcgggccgccgagcggacgcctactacgtgttcgcccaggggcagttggccgaggtcaccctccacttccacgcgccaggcgccgtccgcgacaacttcaacgcggtggcggagctgctcaccatgaagtacggcaagcccgcgaccagggaggactcggcgcgcgacgcggagggccgcctggcgctggcgcagatggccaacaacctctccgaggcctcggcgaactaccacgcgtggcgctccggcgtgcagcccagtggccccgccgtggacaacttcggccggcagatggaggccaacgcgaggacggacgccgccctcgcggttcacgaatacctgctgcggagcacctggaccgaaaccgaaacggagctgcggctcaccggcagccaggagcccggagcgcgcagcctgacgctcacgtacacgagccagaggctcaagccctacctatccaaggagctggccgtccgcgaccagcagcgcaaggcggagcagtcgcgggagctgtag

SEQ ID NO: 4808 - DNA, 702 bp, Myxococcus xanthus
cccatctacctgttgagtgacgagcacccggagctcttcccgcccccggagcgcgccgacaagagcggcgtcgtcgccgttggcggtgacttgcgtccggagcggctgctggccgcctacgcccgcggcatcttcccctggtacagcgagggagaccccatcctctggcactcgccggacccgcgcttcgtgctgtcgccggacaagctccacgtgggccgctcgctgcgcaagacgatggcccgcggcatctacgaggtgcgctacgacaccgccttccggcgcgtcatcaccgaatgcagccaggtgcctcggcccggacagacgggcacctggattaccgaggagatgatggaggcctacgtcacgctccacgaggcgggcttcgcacactcggtggaggcgtgggcggagggtgagctgaagggcggcctgtacggggtgtccctgggcgcggccttctttggagagagcatgttcgcgctggccccggacgcctcgaaggtggccttcgtcaccgcggcggagcgcttccagggctggggcttccagctcatcgactgccaggtggagaccgaacacctggcccgcttcggcgcggagaactggccccgcaggcgcttcctctcggcgcttgcccgagcgatgaaggagcccacccggcgcgggaagtggacggaaggcgcggcggccgacccctga

SEQ ID NO: 4809 - DNA, 831 bp, Myxococcus xanthus
atgcgcttgccctcgcccatgttccgactggcagtggtgcttttcctctgtgcggggtgtgcttccgcccccacccggccctccagtcccgccgtcctcaccgcccaacggaccgtcgtcgcgtcccagggcctcaccgacgccaccctgcgcttcgaggcccaggtgaccagccccggggagggggtgctggtgcgcgccgactacgagctcgtcgccgacggccaggtggtgaagacggacaccgcgaagctggacgtggcgctgacgcccggcgagcccacggacctctccttcgaggagcgcgcaccctatgtgaagaacgcggacgacctggcgcggctgagcgcccagggaggcacgctgctgctcgccctgcgcggcactctcgtcgtgcgctcgggagaccaggagcagacgattcccttcgccgccagccgcgcggcgcgggtgccccggctgcccacggtggtggtggaggagttggacggggcgcgctactcggatgaggaggtccagctcaacctccgcctgggcgtccgcaaccccaaccccttcccgctgcggctggaaggcctgacgtggacggcgtcggtggccggaaagacgctggacagcggcacgctggcgcaggcggacaccgtggacgcgtccgccacgggcgtgtacccggtggaactgacggtgacgaaggacacctggggcccggaggtgaaggcgctcatctccaaggggctgctgccctacggggtgacgggtgaggtgacgggcccgctgctgcgcgtgccgtattcgctcacgggcaaggtgaagctgaacgtctcccggtag

SEQ ID NO: 4810 - DNA, 981 bp, Myxococcus xanthus
cgtttgagcgtggccgagcgcgaggaggtgtctcgcggtgtgcaggccggcgagtccttgcgggccatcgcgcggcgactggggcgtgctgcgtccaccatcagccgcgaagtggggcgtgccggcaagggacgcgaaggctaccgggcgtggctgggtgaagcggcggccgcgagggcgtcgcgccggcccaagcaaacgaagctgttggcccagccccagttgcgccaggaggtggagcgacgtctgctgcggtgctggagtccccagcagattgccgccacgctcaagcgcgacttcgcccaccagccccagatgcacgtgtcccacgaaaccatttaccgcagcctctacgtgcagacgcggggcagcctgcgcaaggaactcgccgcgtacctgcgcacgggccgcccccagcgtcggccccgtggccgcgccagcgtcctgtccggccagttgccgggccgggtgatgctcagtgagcgcccgccggaagccgaaagccgcgccgtcccgggccactgggagggcgacttgctggtaggcaagcagggcaagagcgccatcggcacgctggtggagcgccgcagccggtacgtcatgctgttgcacctgcccgaggggcgcaccgcgccccacgtgcgtgaggccctcacccaccaacttggccaactgcctgacgccttgcgccgcaccctcacctgggaccaaggcaaggagatggccgagcacgtgcgcttcaccatcgacaccgacgtccaagtctacttctgcgacccccacagcccctggcaacgcggtagcaacgagaacaccaacggcctgctgcgccagtacttccccaagggcatggatttgagcggcctgtcgcgcgcccagctcgacaccgtcgccctccaactcaacacccgcccccgccagacgctcgactggcgcacccccgccgaggtattcgctcaaagcgttgcgatgaccggctga

SEQ ID NO: 4811 - DNA, 1920 bp, Myxococcus xanthus
atgaagactgccagcttcctggtgctccagctcctcaccgcgcaggccgccgagcccgactcggccacgctcgagcgcaccgccgccgtggagagcgcgcggttggccgagtcccccgacgacgcggatgccctgtaccgcctgggcaccgccttcctcgcgctcaacacgccgaagaaggccgtggcgcccctgaagaagctggtggcccaggagccggacctcattccaccgaagctggccctggcccgcgcgctgcggctgtccggtgagccggagcaggcgcgcacggtgctggacacggccatcgccgccttccctgaggagtccacgctccgggccgagcgcggcctgctggcgcgcgtgctggacgagcgcgacgtggccatcagccagtacgcggtggcggtggagctggccccccaggacgcggagctgcgcttcaacctgggcgaggccctgcagcgcgccaaccgcacggacgatgccatcgaggcctaccgtgaggcgctgaagctggacgcgaagctcaacgtggcccgcgtgaatctgggcaaggccctggcggagaagggcctcaacggcgaggccaaggagacgctgcgcgaggccacccggcagaagctgggtgacaccgaggcgcactacaacctcggcgtgctcctcatgcgggagaacgacctggacggcgccatcgccgagtaccagcgcacgctcgccgccgcccccaagcacgccagcgcgcacaacaacatgggcgtggcgttcaacgagaagggtgacccgcgcaaggccaccgacgccttcctcaaggccatcgccgcggacccgaagttcgccgaggcgcacttcaacctggggttggcgtactaccagctcggtgacttcgcccgggccacgaaggcgttcgaaagggccgtggtgctggagccgcagcggtccagcgggccgtacacgcagctgggccacctgtacctgacgcagggcaagaagaagcaggccgtcgaggccttcaagacggccatcgcgaagagcgccgaggacgggaagaagacgacggaggcgtaccagggccttgctcgcgcgtggctcagcctgggcaaggcggacgaagcggtggccaccctgaagacggccgtgggcgccttcccgaaggacgcgagcgcccgcgccgcctatggcgaggccctgcgcgccaagggtgacttggatggcgccatcgccgagtacgaagagggtgtgaagctcgcccccacgccggagaaccggctggcgctcgcggatgtgtacgcgcagaagcgggtgggcgcgaaagcacaaccgctctacaaggccctcctggacgaggaccccgccaatcgcgccgcgaagctggcgctcgcggacctgctgctggccatgggcgactatgtggcggcggaggggctgctcaagcccaaggacggcgaagaggccgacaccgcggcgctggcgcggctgggcatcgtccactcgcggcgtggtcggccggacttggccgtgtcggagctcgaggcggtggtggcgaaggatcctgcgcagttggaggctcgcgcggagctgggcttcatctacctgcgtggcggcgacggcgcgaaggcgaggaaggtgctgacgtccgtgctgtcggtggacccgcgccactcgctgggcctgctgtacatgggccacacgctgtaccagcagggcaacacgaagggcgcggagaagtccttccgcaacgccgtgcaggcagacccgaacttcgccgagccgcacaacgcactcgggcaactgctggaagcgacgaagcgcatcgacgaggcaaaggacgcctacaagatggccgtgcagttgcagccggaccacccggatgcgaaggacgcactgaagcggctgacggcgtccgcgcccacgccgtag

SEQ ID NO: 4812 - DNA, 636 bp, Myxococcus xanthus
atgaagcgctttgtcctgctcaccctccccctgctctccgcgtgcggcgccagctacaacatgcgcgtgcccgactcgatggagaagaagctcccgtacgaggcgcgcatcgagctgctggaggcagagaacaacctcgcgctcgccatcgacagggtggacgaggccgacaacgagattggccgcgcccgcgacaacatccgccgcgcccgctcccgcaaggaagccgcggaggatgaagtggaccgcgcgtcggacgaggtgtctcgcgaggtggcgaagctggccatcgccgaggccgaggcccgcgtggagtacctgcgcgcccggcagcggctcagcgtgggcctgcgggacgtggagcggctggcgctgcgctgcgccttcgccgagttcgagctggcccggctgcaggccgcccggaaggcgaaggtcgagggcagcgagcggctggacccgaaggaattcgaggagcaggtctccgagtgcaaggcggaggtgaaggaggaacgcgccgagctcgctggagacgagaaggaagagaagacggcgcgggaggcgtgggaggcgaagaaggcggcgctcgcgaagaagaccttcgacgcgcgcgcgagtccctacgtggagaacctataa

SEQ ID NO: 4813 - DNA, 270 bp, Myxococcus xanthus
atgctcccggagggctacaccggctcgctggacgtcaacctggcggaagtcctggccaacggcgcccagcgcggcgccattggccgcaacgtgctggatgagccggcgcggaccttcccggagctgcgggtgggtgggctgaaggtgaaggccctccccagtcagcagggccagcgcatctccggcgagttccacgtcacgttcgtcaacggcacccacacctattccgggcgcaccatcttcggaagcttcgaggcgacggttccatga

SEQ ID NO: 4814 - DNA, 3270 bp, Myxococcus xanthus
atgaccggccacctgacgggcctgattgccgccgcgatgctcgcggccgccccgggtggcgctggacgtcccggcccgggcatcaacccgattgtctccaaggccaaggagcgcgacgagctcatcgccaagctcaagcgcgacatcttcaaggtggaccgcgccatcggcgagacggagcgcctcatctccaagagccgcaacgcgccctacctgccggacctccagttccggctgtccgagctctacgtggagaagagccgctacgtgtactacctccaggccgagtcgcggccggagggggccagcggcgccatcgtctcccctgagacgcggctgctgaagcagaaggccgtgcagatgtactaccggctgctgcgcgagtatccggacttcaaggacggcgaccaggtgacgttctacctggcgcacgagcagcgcgaactgggtcagttcgacgagatgctcaagacgctcggcgacctgacgcgcaagttccctggcagcccgctgcgcctggaggcggagcagattctgggcgaccacttcttcgacaaggccgacctgggcgaggcggagaagcactaccaggccatcctggaggccccgccttctcccgtgcacgacctggcccgctacaagatgggctggattcgcgtgaatcaggccaagcacgcggaggctgtcaccttcttcgaggccgcggccgccagcgcgccgctgcccggcgtggacgtgaagaaggcgctcaacgtcaagcgcgaggccctgctggacctcgtgtacagctacaccgaggccaagccccccaagggcgcgctcaactacttcgagaagctcagcgacagccgcgccacgtacgcgctcgcgctggacaagctgggcaaccgctacttcatcaagcagcagtacgagtgggccatccccgcgctgcgcaagctgatggaaatccagcacgacccggagctggacctggagcgcggccagaagctctacgacgccatcaaggcctccaagggcaaggtgctgccggaccccgaggacctgcgaatcctcgtgcgcgccgcggtgcagagcaagacggaccccgagctggcggaggccgagcgcaagaagcacctggtggagctggaggagatggcgcgagacctctccaccctgctccacgtggaggcgcagaagaagaacgacaaggcgctctacgtgagcgcggcggaggcctatcaggcgtacctgggcctcttccggcccgagcagcacgtgcgcacgatgatgaagaaccgcgcggacgcgctgttctccgccaacgcgtaccccgaggccgcgcgccagttcgaggagctggcccgctaccaggtgaaggccaaggacgcgaagggtgaggaggaagcgctcaacgccgcgctgctggcgcacttctccacgctcaagccagaggaggcgcagacgcgcaacgccttcgaggtggcggacgcgcgtcaggccatgaagctgctgggcgccgacttcgtgtcgcgctacccccgcagtgagaatgccctggtggtgaagttcaacatcgcccgcgcctactacgaggacggcgagtacccgaaggccgcggagctgttcaccgccttcgcgctgagccacccgcagcacaaggaagcccccatcgcgggcaacctggcgctggacagcctgcggcagctcaacgacttcaagggcctggatgagacgggcaagaagctgctgggcgcgccgctgccggccagcttccgcgcggacgtgcagaagattctcacgcagagccgcgccgaggcgctggatgagttggccctgcagagcgcccaggagacgggcgacgtcatccagggcctggtgaaggtcgccgacgagaacaagaactccgacatcggcgagaaggcgctctacggcgcgttcaccgcggcgcgcgagaagcgtgacatgcaggcccagcgcgagctgggcacgaagctggtgcaggactacccgaagagccagtacctgtcggacgtgctgctgacgctgggccggcacgcggcggaggccgcggcgttcggcgaggcggcgggctggttcgaacaggtgggccagaagctgggtggcgacttcgccgccgtggacggctggctggccggcgcgcggctgcgcatggcgctgggcgagcacaaggaggcggcgcgtgacctggaggccgccgccgacatcgctggcgcgcgcaaggcggacatcctggtgatgctggcggagacccggctgaagcagaaggactacgcccgcgcgaagacggcggccgaggccgcgctgaagctggaccgccacagcgccgccgcggcggcggtactggccgaggtgcaggccaccacggcgcccaccgcgcccgccgacgcgctcatcgccaccctcaccaccgcggtacaaggccccaacggcggcaccgaggaggcggcgaagggcctgtggtacctgggcgaaatcctctaccgcggctacagggatttgccggcggaccaggtggaggagaaggtcgccgcgctccagagcatggagggcatctacacgcaggccgcgtcgctgggctacgccgagtgggcggtggcctcgctgtggaagctggcgctcgcatacggccacatcgcggacgtggtggagggcacggccgttcccgcgggcctctccgccgcggaggcgcagcagttccgggccgccgtgaaggagcaggtgacgccgctgaaggcgcgctccgacgaagcgttcaaggcctgcttgtcccgcgccgaatccctggaggtcttcagcgccgcggtggtgggctgccgcgctcgcacggagacggcggcgctgccggtgccgcagccgggcacgcccacgcagccggcgtcgctggaggagctgcgcaagaaggccgagcgcacgctcaacgcggaggcgctggaggcactgggtctggcctacctggacgcgcgccagtacggcatggcgcagctcaccctgggccgcgtcacggagctgcaggacacgcgggcctcggcgcactccgcgctgggcctggcgctgctccacatgggtgacgccatgggcgcacgcgaggcctacggccgcgccatggactccgaccccaccttcggcaaggcgcgcctcaacctggccgcgctgcgctgccgcttcggtgacgtcgacggcgcacgccgcgagctggccgtgctcaaggacgtggcctcgctgggcggcaacgacgtggatggcgggtggaaggcatgcaagtga

SEQ ID NO: 4815 - DNA, 870 bp, Myxococcus xanthus
gctctaaacacttctatggtgactttgtggggctgctcgaagaccaaaatcttatatctcgatgcacgaaaagagccggcgctggtgcgggcactcctgcattacgagggcagggacttccaagacgctgaggaggcgtatgaccgcgtgaagctgccccagctggacccggaccgagccaggctatacctggaggaagcgtggacccggtacaagctgggcgagccgcgcgcgtcgctgggcatcctcaccacgatggacgcgccgtccttccgcgacgaattcctgccggacaagtacctgctgcgcgcgctcatctaccgcgacttgtgccactacctgccggccaagcgcgccgccaaggagctgacgcggcgcttcgcggactcgctggaggcggtgcgcaaccgcgaggacctcacccaggatgtgcgcctgcgccgcgccgccaacgcccgtggaagcacccagcgcgccgcgcgcttcctggagacgttggagctggagggcgagcggctgggccgctacgccggcagcttcggcgaccggctcttctcgcacctgacgaagctctatgacttgtcccgcgccgaggcggtccgcgtccatgacgcgcggctggccgaggccgtccgccaggaagcggacacgctgctgcgcgccgccgagcaggtgcgcctgatggagtacgaagtgggcctgaagctgtacgagcgcgtgaagaagggcgcgcggattgtcgcgccggaggacgagcagattctgtcgcccacgcaaacggcctaccgtttcgacggcgaatactggaacgacgagctgcgctcctaccgggtccgcatcgacagccgctgcatcgaggagacgccatga

SEQ ID NO: 4816 - DNA, 822 bp, Myxococcus xanthus
ctccgaagtgtgaaggctggagacgtgttgctggtccctgggctctccgcggccagcgagcgcgccatcgaacagttgctctctcgggccgatgcggcgcgtggcatcacgttgctcgcgcgtgtggcggcgaagggcgccatggtcgcggcctcgtgctccgcgaccttcgtcctcgcggcgtccggcctcctcgcggggcggagcgcgacgacgacctggtggctcgtcccttcgttcgtgcgtcgcttccccgaggtcgccctccagccggaccggatggttgtcgagagcgacggcgtcctcaccgcgggctcggccttcgcgcatgcggacctggtgctggccatcgtcgcgcgggtcgcgagcccatcactcgcgcacctggtggcccgctacctcgtgctcgacgagcgtgtctcacaggccaggtacatggtgatggagcacctccgcgtctcggacccagcgcttcgtgccgtggagcaattcgtcgccgcgaatctgggccggcaactgacgctcgatgaactcgcccgggccggtgccacctcctcgcgcacgctcgcgcggcgggtgcaggcggggctgggcatgacgccgctcgagttcgtgcagcgggtgcgcgtggctcacgcctcccacctgctcgagacgacccatgcgtcggtcgaagatgtcgctgcccgggtggggtatgccgacaccgctgcgttccgccgcgtgttccggcggtacgtcggagagacgccacgaggaaggcgcggcaactcgcgctcccggcgctcaccgctgaacgcgcgcgattcaccggcgccatga

SEQ ID NO: 4817 - DNA, 486 bp, Myxococcus xanthus
atggagggcagctacgccgggcgtccgctcaccctggagaccgagtaccgccaccaggagaaggcgtaccgcatcgccaccatcatccggcacgagctcggcgacgactttccgcgcgaggtggtcatccgccccgaggggctgggcgacaagttcctcaagctgttcggcgtacaggacgagcaaattggcgatgccggcctcgacgccatgctggacctgaagaacgtcacccctcaggcccgcgccatcctcctcagcgcgggcatgcggcgccccctgctgaacctggcccgcgccttcgagagcttctccatcgagaacggcgtcctgtcggcggaggtgacagacgaagtcccatgcacccccatcgagttgtacggcttcctgacgcccgtgcgtgagctggccgacgccgtgcagggcacgcgcggccatacccagtggcggtcggagggcactggacaggaaggcacccagtcctga

SEQ ID NO: 4818 - DNA, 723 bp, Myxococcus xanthus
atgctgctgtacctgcagggcgacgacttcctgtcggacctcccgctcatcgccccccatctgcggccgggcatggtggccttcgacgtgggagccaacatcggctacctgtccatgtacctgcgcagccgcatcggcccgctgggacagctcttcagcttcgagcccgagccggagaactacgcggagctggacgccaacttccggaacaaccacctgcgcaactgccaggccatccagacggcggtgggctcgcaggaaggcgtcatcaccttcgccacgggcctcaacggacacgttcccgtagagggcgcggagggaatcagcgtcccggttgtcaccgtggacggcttcgtccagaagcagggcctgtcacacgtggacttcgtgaaggtcgacgtggagggcttcgagctggacgtgctggctggcatgcgggccacgctcgaacgtccggacaagcccatcctctacatcaaggtccacggacggggtgagtatgcgcgagccgaccctcgccgcgtctgcgaggtgctcgaaggtcactacaagaacatccgcgcctacctgccccccgacgacttcaaggcgaagcggagccacctgcgccggctgtggggtcgggtgtcgcctttcgatgacattgaacaggcgtgccgtgtcgacctgcgcgaagtgaagcagcacgacacccaacggtaccagttgctctgcctgccttga

SEQ ID NO: 4819 - DNA, 1491 bp, Myxococcus xanthus
ctggttcgcgcccggcggcccgacccgtgcgcgctggtgttgttcggcgccaccggagacctggcccagcgcaagctgttcccggccctcttcgagttggcgcgagcccacctgctgccgaagaacttcgccgtcgtcgccttcagccgctccgaaggagacagcgaggccttccgcgagcatgtgaaggcgtccctgctgaagttcgcccgcacccagcccctggacgaggccgtctggaacgacttcgccccgcgcctggagctcatctccggcggctatgacgacccgaagtccttcgtgcgcctgcgcgaggagctcgaccgggtcgcccagaagttcggcacccagggcaaccagttctattacctggccactccggcctccaccttcccccaaatcctccagggcctgtcggagtcggggctgctgaagcgccaggaacaggccgacccgcgcccgtggcagcggctcatcatcgagaagcccttcggccacgatttggagagcgcccgcgcgctcaaccgtgagctggcggcggtgctggacgagcggcagatattccgcatcgaccactacctgggcaaggagacggtccagaacatcctcgtcttccgcttcgccaatgccatcttcgagccgctgtggaaccggcagcacatcgaccacgtggaaatcaccgcggcggagacgctgggggtggaggggcgcggcggcttctacgacgagacgggcgtcatccgggacatggtgcagaaccacctgctccaggtgctcgcgctgtgtgcaatggaaccgcccgtgtccttcggcgccgaggacatccgcgacgaaaagaccaaggtcttccgcgcgctgcgcccgctggagggccgcgaggtgtcccgcgcggtggtggccggccagtacgagggttacctccaggagaagggcgtgaaggccggctcgcgcacgccgacctatgtcgccatgaagatgaacatcgacaactggcgctgggcgggcgtgcccttctatctgcgcgcgggcaagaagctgaagcggcgcgtgacggaggtgtccatccacttcaaatcggtgcccatcagcctcttctccggggaaggcgccacctgccagcggctgcagcccaacgtgctcacgctgcgcatccagccccaggaaggcatcgcgctctccttcgaatccaaggtgccgggcgaggatgtcaacatcgcgggcgtcaccatggacttcaactatcaggagaccttccagcggccggtccccgaggcctacgagcgcctgctgctggactgcatgcgcggcaacgccaccctctacgcgcggcaggacagcgtggagcaggcgtggaccttcgtgacgcccatcctccaagccctggagtccggcgagggcggaccggcgcacggctaccccggtggcagcgcgggcccggatgccgcggccgcgctgctggcccgcgatggccgccggtggaccggcctatga

SEQ ID NO: 4820 - DNA, 672 bp, Myxococcus xanthus
atgagcgccacgcgcacgcacgtcgtgcccaccgagtccctgccccgggaagccgcgacgtggatggcgcgcgcgctccaggacacgctcgccacccagcgtcgcgtcagcctggccctgtcgggcggcagcacgccggggcccgcgtaccgggcgctggcggcgcaggtacttccctgggagcgcgtggacgtctacttcgtggacgagcgcttcgtgccgcccgaccacgcggacagcaactaccggatggtggaggacacactgctgcgtcctcttcggctgtcgccgtcgcaggtgttccgcatggagggtgagcgcgaggaccgggacgccgccgcgaaggactacgcggcgaagctgcctgcttccctggacgtggtgctgctgggcatgggggaggacgggcacacggccagcctcttccccggccaccccgcgctggaggaatccgagcagcgcgtcctggcggtggtggggcccaagccgccgccctggcggatgacgttgacgctgccggtattgcggtccgcgcggcacgtgctgaccctcgtatcgggggcgggcaagcaggacacggtgcgccgggcgctggcgggggacctgagcctccccgccgcccgggtgacgaattcggagtggatgctggaccccgccgccgccgggcggtga

SEQ ID NO: 4821 - DNA, 1404 bp, Myxococcus xanthus
cagttcggcgtggcgggaatgggcgtcatgggggcgagcctcgccctcaacatcgcggaccacggcttccgggtggccgtgtgggacaggcatgcggagcgcatcgatgagatgcaccgcaaacacggacaccccgaggtctggggcaccgagtcgctggaggccttcgttcagcgactggagcgcccgcgcaaggtgctgctgatggtgacggcgggcgcggcggtggactccatgctggagcgcctgctgccgctgatggcggaaggcgacgtcatcatggacgccggcaactcgtggttcctggacacgcgccgccgcgaggagcagtgcaaggccaagggcatccacttcctgggcgtcggcgtgtccggcggcgaggagggcgcgcgcaacggcccctccatcatgccgggcggtgctccctcggcgtacgagctggtgcgtccggtattcgaagccatcgccgcgaatacggacatggggccgtgtgtcacctacgtgggggcggacggtgccgggcacttcgtgaagatggtgcacaacggcatcgagtacgcggacatgcagttgctcgcggaaacgtacgacgtgctgcgccgcgggctcgggctggacgcggacgcgttggcggacctgctgtcccagtgggaccacggcatcgccggctcgttcctgctggagaccaccatcaaggtgctgcgccagaaggacccggagacgggcaagccgctggtggacctggtgttggacaaggcgggccagaagggcaccggcaagtggacggtgcaggtggcgctggatttgggcgtcccgattccctccatcgccgcgtcactggacgcacgcatcctgtcctccatgaaggacgaacgcgtggccgccgcgccgaagctgaacggcccggtggggcagctcagcaaggaggagcgagcgcaactggcggcgtggacgcacgacgcgctctacgcggcacgggtggtgacgtatgcgcagggcatgcggctcatccaggcggcgtcccaggagtatcagtggaacatcagcctggcggagctggcgcgcatctggcgggggggctgcatcatccgcgcgaagctgctcacgccgctgcgtgaggccttccagcagcagccgacgctgcccaacctgatggtgtccgacgccttcgcgccggtgctggagcgcatggcccccgcgtggcggcaggtggtgggcgtggccacgcgcgtgggcatccccgtgccggtgttcagctcctcgctggcgtacctggacagctaccgcaccgcggagctgccgcagaacctcacccaggcacagcgtgacgccttcggcgcgcacacgtatcagcgcaaggacagaccggaagcgggcttcgtccacacggagtggggcaagtag

SEQ ID NO: 4822 - DNA, 1170 bp, Myxococcus xanthus
atgacgctggatgccggagcgaacctgctacatgcggtacgtgagttggcccctgccctctccgctcgcagtggggagattgagcaggcacggcagctccccttggacctcatcgccacgctgaaggacatcggcgtctaccggatgcttgtccctcgcagccatggcgggctggagctgaatcttgtcaccgggctggacgtcctctccgagctggcccgcgcggacgcctccaccgcctggacgatgatgatagccacggagagcccccaactcttcgccctcctcctccgcgaggagttcgatgccgtctacgccgccgggcccaatgccaccgtgggcggcgccttcaatgcccagggcaaggccgtgcaggtggacggcggctaccgcgtcaccggccactggaacttcgccaccggctgccgccagagtgaatggctgttcggcaactgtgtcgtccttggcccagacggcacgccccgcgctggccccgccgagggcatgcccgagacgcgcgccatgctgctccccgccagcgaggtccgcatcatcgagcactgggacgtgctcggcctgcgcggcaccggcagccacgacatcgccatcgacgccttcgtcccccagcaacgcaccttcgacatcttcaccggccagccctccgtgccgggcgccaacttcgtggtgccggtgctgcactacgccatgcacatcggcgcggtggcggtgggcatcgcccagggcgcggtggacgacctgctcaccctggcccgctcgggcaagcgccggctgtatgcgcgcacctcgctcgtggactcccctgtgttccgcaaccggctgggccgcgcggagacgggcgcccgcgccgctcacgacgccctccgccgcatgggcgaggtgttctgggacgcctgccagcagtccccgatgaaggccttcgccctcgcgccgcaggtgtccgccaccctgacgtgggccgtggagacagccgccgaggtcgtgacggcctgctaccacgcgggcggcgccacgtccgtgcgcgatggcgcatcactccagcgccgtttccgcgacatccacaccctcacccagcacgcggccgtggcggagggctggttcacccaggaaggcagcgcgctcctgggcttccccgtcctcttcgaagcctga

SEQ ID NO: 4823 - DNA, 801 bp, Myxococcus xanthus
acgctggagaagcgccgaggggtgagcccggaggagttcttcacccgctactacttcggtcaccggccggtggtgctgcaaggcttcatggaggactggccggcgatgcgccgctggtcgctcgcggacttccgggagcgcttcggagacgtggaggtggaaatcatgtccgggcgcgacgccaacccggaccatgcctcgcagcccgacaaacaccgccaggtggtgaagctgcgcgactacgtccagcgggtggagacgggcggcgagtcgaatgacttctacatggtgccgcgcaacgagaactggaagcgcgacggactggcccggctgcgcgaggacatccgcgcgcccgccggcatcatcgacccggagctgcgtccggacatgacgacgctgctgctgggaccgccgggcaccgtcaccccgctccaccacgacaacatgaacgtgctgctgggccaggtgatgggccgcaagcatgtgcggctggtgccgtccttccagcgccacctcgtctacccgcgccatggcaccttcagctccgtggacgcggcgagcccggacgcggcgcgcttcccgctctacggcgaggccaccgtcctggagggcgtggtggagccgggcgagctgctcttcctgcccgtgggggtggtggcactgggtgcgcgcactggacgtgagcgccactgtcacgttccatcatttccagctcccgggaggcaacacgcacctgaggactccgcagtagacggccgcaccgcgcggccgcttgcgctcaatatgactccacgaggatga

SEQ ID NO: 4824 - DNA, 642 bp, Myxococcus xanthus
atgcacatgcgcgtgggcggcgtgaagggcaaggtgctgtggacggccccgctcaagcgcggtgactggagcgacttcgtgttgcaggtgaagtggtcgcccaacgcgaagacgggcttcgtccagctctggcacaacaacgaggtcgtcgtgccgaagacctacgtcgcgacgcagttcggcaaggagatgaactacctgaagctgggcctgtaccgcgacgacaccatccgtcccgaggccagcgtgtaccacgacggtttcaccatggcctcgacgctggaggaggtcatgccgccgccgacaccggagcccacccccgagccccccgcgccggagcccgagcccaccactcccgcgccggagcagccgggtgaggacgcgccgtccgaggagccccccgacgagcccatcgtccggacgcccgacacgcagccgcggacccgctggggcgtcacccctcccgaggacatcctctccggggagagtccgctgggcgccgacggggcgcggggctgcaatgcctccggcggcggaacggcgggtgtgcccatcaccgccgcggtgggcctgctctccttcgccgcgctgttcgcccgccgccgcaagccagcacaggctcgcgcccacgcgaagcgctga

SEQ ID NO: 4825 - DNA, 537 bp, Myxococcus xanthus
atgaatcccattgtccatgccgaactggcctggctcgcggcacagggcctcaaggagcgcagggaccgcatcctcgtcacctgcgcgggactggcgccggacctggacggactcacgctgctcgcgggcgaggcgtattacgtccgctatcaccacgtcatcttccatggctacgtgggtgccatcgtcacggcggtggcctgcgcggcgctggcgcggcagcggctgcgggtggcggccctgtccctgtgcacctttcacctgcacctgctctgcgacctcgcgggcagcgggccgggctggcccatctactactactggcccacgagcatgcgggagtggttctgggaggggcagtggaacctcgcctcctggcagaacgcggtcatcgggctggccaccacgctgctgtgtctggcgtgcgcgctgcgcttccgccggaccttcgtggaggtgttctccgcccggtgggacgcggaagtcacgcgcactctccgtcgccggttcctccgtgaggatttcgtgcgggaaccatga

SEQ ID NO: 4826 - DNA, 1896 bp, Myxococcus xanthus
atgctcatcctcggactcgggttgatggcagtgggcgtgctgggggcgtcgctcgaagcccccgtcacgtcagtcacggtctacagcaaccaggcgcaggtggcgcgctccggcagcctcacggtttccggctcgcggcgggtgacgtttccccggctgcccaagaacgtggatacggattccatccgcgtcgaagccgagggcgcggaagtgtcccacgtcgacgtgcgcaccgtgaaggaggaggccttctcccacgacgaagcccggaagctcatcgcgcgcatggaggaaattgacgcggcgctcgctcgcatcacggctgaacgaaacgtccaccatgcgcaaattgaagcgctccggcgggttcgtccctcggcgcagtccgacagcgaggccgcgcgcgcccagactccgcccaccacctgggacgccgcggtgtccttcctcgtggacaacgtggcccggatggaggcccggctgcgagaactggaggcgcaatccgcgacgctccagaaggaacagcagcagcacaaggagcgcgccacgacgttgggcaagacgttcggtgagcccggtgtcgaagtgactgccacgctcacgggcaaaggcgccacgaaggtgacgttgacgtacctcaccaccggggcccgctggtatccccactatgagctgcagttccaacccgaaacgcagcggatgcagatggccttctacggccgcgtgagccaggagacaggcgaggattgggagagcgcacggctcacgctcagcaccgccctgcctgccaacgccacggagttgcccaaactgagcacctggaagctgggcatccgggagcgattcattcccacgccgcgtcctcatgaagagtccattcaacccgtgccggacgcttcgaacaccccgtcccagcccacgacctcagccgaggaaatgctgcgcgcgcagttgctgcgacttgccggagagcggggcctgacacagcccgcagcctcgaagccgcaggtcaccgcgcaacgcgaacaaggagggatgggggccatccggggtaccgtcatcgacacccagtcccggcagacgctctccgatgtggtcgtcaccgcgatcccctcatcaagggaggcggagcacgtgacggtgacggacgccaagggtgagtacctcctccccaggctcccctccgaagcctacaccgtgcggtacgagcgtgagggctacaagccccatgcccgccgccccatccagatccgttcgaaccgcacactccgagtcaatgcggagctgcttcccgactctctgaacgagtccgtcgaaatcgttggccacccgcccaccatcgacgtcgggtcctcgaccatgggcgtcaacatcgatcaggagttcatcaagcggatcccaggctccattcagcggtcgatgtcactgaccccaccgcctggctggcgcccccccacatttgccccggattcgccagtcgccgtcgcgggaggctacaacctcaccttcacctcacagcacccggaaaccctcctcagtaacaagggggaacgcagcctcccgctggtctccgagtcctggcccgtgcaagtggagcgcaagattttccctgcgctctcgccgaacacgtacctcgtcgcaacgcttcagggcccatcccggaacgtgtttccagggggggatgcatcgctcttcgtgggcgccgacccggccggcaccgcgatgctgacaaccatcgttcccggggagtccttcaccctgccactgggcatcgaccgcgcggtacgcagcgcccgggacgtacggctcgtcgagtcggagaaaggcttcatctccaaggatgaggtgggcacgtacgtagtcaccaggaggttcccaatccctacccctgccccc

SEQ ID NO: 4827 - DNA, 702 bp, Myxococcus xanthus
atgacgcagaacggctcggcacatcgcaatcaggtgctgctcggggtgttccagaccgaggactatgaggttcaggccttgttgcgcttcccgcagacgggcgtgccggctggggcggtggttcagagcgcgacgctgcgtttcgcggtggagacctacaccagcgacttctcgattcgaggcgcatatgtgcaggcgccctggaacctgggggccaacggactgggatggcagttccgcgacgatgggctggagtgggaccggctgggggcggccgggcaggggacggacctggtcgccggttcgtcgttcgaggtctccacgtttccgggcacggtgagcgtgcacgacgtgccactcgacgtggcggtggtgcagtcgtgggtcgacgacccgtcgaccaaccagggcgtgatgttggcgaactcgaggattgggaaggtggccaaggtcttcaccagcctggccacccagccggagcgtcggccgctcctcaccattgagtacaccgcgcctgcgccgcgcagcgataccacgcctccgtccgttgcaatcacggcgcccgcggcgggcgcgacggtgcagggcgtggtcggcatcaccgtggacgcgagcgacgacgtcggcgtggtcggcgtgcagctgcgcatcgacggccgtaacctcgactcgacgcagctcgacacccgcctgttcctttag

SEQ ID NO: 4828 - DNA, 1071 bp, Myxococcus xanthus
atggacgtggtcaccgggcagctcacgggccgcaccaagggcgaggtgctggccgccatccaggagcggctggggttgtcgttcgaccagttccgtcgctcggcgctgctggcgcagggcgagttcgcggccttcctcaaggcggatgccagcgagcgcgcggagctgctggagcggatgacgggcacggaggtgtacagccgcttgtccatggccgcgcacgagaagaacaaggcggagcaggagtcgctggcgaagcgggcgcagggattggcggcgattgccctgatgccagaggcggagcgcgcggcggctgcggctgcgctcggtgaggagtcccgggcgcgtcaggcggtggaggcgctgctcaaggacgcggagggcgcggcggcgtggcatgtcgcgcgggcggggctgcgggaggcggagctcgcggcggaggcaaaggcgaaggcggccacgacggccctggaggaggcggcgccgcgcgcggcacggctggaggcggtccgcgaggcagaggccttccgggggccggtggcggcggcggatgccgcggagcgccggtgggcggaggcggaggcggcgcaggtggcgcgggcgtcggaggtggaggcggcgctgtcggaggtctcggcgcggcgggtggggcaactggaggcggagaccgcgcgcgccgcggcgcaggagcgggaggtggcgacgcgtcccgcgctggaggaggcggcgcgactggatgcgcggctggacggtgtctcccgggaggcgggggaggcgcgggcgcgggcggagaagtcccaggcggcgctgtcggaggcgaaggcggagctggatgccgtgctcgtgcgcgaggccgaggcacgggacaagggggaggccgcgaggcactggctgacggagaaggcgcactgggtcgcgctcacgagcgagtggccgcgctggcatcgcgagctggaacgctacgagggggcgcagggcgagcggcgcaaggcgggtgaggagtccggacggctgctcggtgaggtggagggactgcgcgagacggtgggccttcagcggagggagcgggat

SEQ ID NO: 4829 - DNA, 1245 bp, Myxococcus xanthus
atgcgcctgctgcacacgtcggactggcacctgggacacacgctgtacgacgtctcgcgggatgcggagcacgcggccttcctggactggctgctggagaccctggaagcgcagtccgtggatgcgctgctggtggccggagacatcttcgacacggcgaaccccagcgcggaggcgcaggcggcctggtaccagttcgtcgcgaaggcgcggcggcggatgccccggctggacgtggtggtgattggcggcaaccacgactccgcggcgcggctggacgcgccggacccgctgttcgcggcgctgggcgtgcacgtggtgggcggactgccgcgggcccgaggcgccatggaccaggagcggctgctggtgccgctgcacgacgcgaagggacgggtgggtgcgtgggtggcggcggtgccgtacctgcgtcccgcggacctgccgcccgtgcccggggacatgggagaccggctggtggagggtgtgcgctcggtgtacgcggaggtgctggccgcggcgcggcgcaggcgtcaggcgggacaggcgctggtggccatggggcattgctacatgacgggcacggagctgtccgcgttgagcgagcggaagattctcggcggcaaccagcacgcgctgcccgtggacctgttcccggacgacgtggcctacgcggcgctggggcatctgcacaaggcccagcgggtgggcggacgcgagggggtgcgttacagcggctcgccgttgcccctgtcgctgtcggaggcgggctaccggcatcaggtgctgctggtggagctggaaggcgacgcgctgcgcgaggtgcaatccctgcccgtgccccggaccacggacatggtgcgcgtgccttcgcgggacgctgctcccttggacgcggtgctgacgcaactggagggcttgccggcgcacgacgcggacacgctggagtggcggcggccctacctggaggtgtgcgtgtcgttgccccggccggagcccgcgctgcggcagaaggtggagaaggtgctggaggggaaggcggcgcggctggtgaagctgacgcccgcctataccgggacgggaggcgcgttggcggaggtgcagccgggcctctccctgaaggaacgcacgcccgaggatgtcttccgcgcgcgttacgcccgtgacttcgaggagccacccgcactggcgctgctggaggcctttcatacgttgctgaccgacgtgcaggaggagtcgccgtga

SEQ ID NO: 4830 - DNA, 2673 bp, Myxococcus xanthus
tcttcgcccgcctgggccgcggtgccctccggcttcgtggagatgcccttcatctccaataccctcacgcaggccacggggatggcatgggcgccggacggttcaggccgcttgttcatcaccctcaagacgggcgaaatccgggtggtgtcgctgaaggacggccagcctgaaacacagccagggaacagcacgctggtgacgcaggtgttcgcgacggaggattccgtctacaccggcagcgagtgcggcctcctcggtatcgctttcgacccgaactacgtggtcaaccgctacgtttatttcttcgtcaccgtctccgcgtcggagcagcagattgtccgctacacggatgtggaagggacgggcagggcgcgcaccgtcgtcgtcagtcggctgcccacgcggggcgcgaacaatgtcggcggtgccattggcttcggcccggacggaaagctgtactgggccattggcgacctgggcaacggcacgggcgtgaatgcggacctgacgtcgatggcggccaaggtgagccgcgcgaacccggatggcacgcccgacagcgacaaccccttcaacgacggcgtggggcccaacaacgagtacatctgggcgcgcggcttccgcaatcccttcaccttcaccttccagcccaccacgggccggttgtgggtgaacagcgtgggcaccgactacgagcaggtcttcgtcgtcacccgccgaagccatgccggctacagcgactacgagaacaaccaacccagcaccaacgacttcatcactcccgtcgtcaagtacagaaccaacggttccgatacccgcggcctctccgcgggtggcgccgtacgcagcagcggggtggccaccttcaccaccgccgggaaccatggcttccgcaagggtgagcggctcacgctcagcggtgtggaggatgcgagcttcaatggcctgttgctggtggccagcgttccttcccccacgaccttcaccgtgtcgcagccttcactgccggacgcggcgagcagcgggggaacggccacgacgcaggagctcggtggctccatcaccggtggcaccttctacgacgcgaccctgttcgacgaggcgtaccaggacaacttcttcttcggggacttcaacaccggtcagttgacgcgagtcaccctggaagaggacaactcggtggctacggtggatgaatgggccaccggcttcacctcgcaggtggacatgtcggtgggcccggacggcgcgctctacaccatcggcgcgtcgggcggcgtcctgcggcgcatcacgcccgagacgccgggacagaaactggtggtgtccgggctgcagccgcgcgtcgaggagggcggacgcgctgccttcaccgtgcgcctggccgaagcgccggccttcgatgtctccgtgcgggtctcccgcgcgctgggcggctccgaggacctgagcatcgtcagcggcgcggcactcaccttcaccgcatccaactggaacgtgccccaggtggtgacgctcagcgcggcggtggacgaggacgagacgccggaggtcgctaccttcatggtggtggcggacgggctgcaggaggtggcggtggtggccaccaccatcgacaacaactcgccgcgcctggtgctgaccgagtcgcaggtgacggtcgtggagggcgggacggcgaccttcggcgtgtcgctctcacagcggcccctgcgcaacgtcacggtgaccgtggtgcgcacccgcggggacgaggacctcaccgtccagtccggggcgacgctgaccttcaccacctccgactggaacacgcccaaggacgtcaccctggccgccgcgccggacgcggacgccgaggacggcacggccatcatcaccgtgtccgccccgggcgtggacgcacgtgaggtggaggccttcgagcaggacacgactctcctgccgcccgccatcctctccgcgccggtgacccgagccgtggtgggcagtccgtaccggtatgaagtgcaggcgacggcacggcctgcgcccacgtatgcgctggtgagcacggtgccgggcatgagcatcgatgccgccaccggtgtcatcacctgggagcccaccgagacgggcacggtggaggtctccgtgcgcgtgagcaacggcgccgcgccggacgccgtgcaggacttcaccatcacggtgagcccggacgcgccgcccaccggcatcctcacgcgccccgaagatggtgagcacgtgtccggcaccacggcggagttctacggcgactgccaggacgatgtgggctgcacgcacgcggagttatacgtggacgacgtgctgcgctacaccgacgagcggaccgaaagcccctactactacggcggcgagcccagccgctgggacaccacgggcctgacgccgggctggcaccgcgtccgcttcgtcgtggtggactcgacggggcagcagggctccgccgaggcgacggtgtgcatgggcgatgccccctgtgagtcgccgctgttggatgcggggacggacgccggaaccgacgcgggcaccgagcttccgcctcccaacgagccgggcggctgcaactgcaacacgatgccgctggcgccgttggcctggggctcgcttgcgtggctcgtgctccagcggcgacggtcgcgtcgcagttga

SEQ ID NO: 4831 - DNA, 696 bp, Myxococcus xanthus
gtcgtcttcctgctcaccgccccggtgctgttcaccctgggcgcgctgctgctcatcgtcacgtacccgttcgaccgggaccggcggctcttgcactcattggtctgtcgttggtgctatggcctgtggctgcacgcgtccccaggctggcgcacgcgaatcgaaggccgtgagctcattccgcccgggccctgtgtgatggtggtcaaccaccagtccgcggcggacatcctcgccgtcatgggcctgttccgtccctacaagttcgtggcgaaggcgtcgctgttctcgctgcccctggtggggtggatgatgacgctgctggcctacgtgcccattgtccggggctcgtccaccgccatgaaccagctcctggatccgtgccggcgctggcttcgtcgtggcatgccggtgctcatcttcccggaggggacgtactccaagggcgggcagttgctgcccttcaagcggggcgccttccagctcgcgctggaggagcatgtgccggtggtgcccgtggtggtggagggcacgccagggctgctggatggagacggcccctggatgagtcccaccgcctccatccgcgtgcgcgtgcttcccgcgctgccgcccgagtccttcagtccggactcacaggcgttggccacgcaggttcgcgcgctgttcgagcagacgttggcgaagacgggctga

SEQ ID NO: 4832 - DNA, 1623 bp, Myxococcus xanthus
cctcggaacatgaaggactacgaggccacccgccgggactttcgctgggagcggcccgagcacttcaacttcgcggccgacgtcatcgaccggcacgccgccgagcgcccggaggcgctggccctgctgtggtccgacgaagccgggcaggcgcggcgcttcacgtgggaggacttgcggcggcgctcgctgcacgcggcccgcttcctgacggagcaggggcttcgccggggggaccgggtcttcattatgatgccgcgcgtgccggagtggtggttcctggtgctgggctgcattcgcgtgggcatcgtcttcatgccgggcacgcccatgctcacgccgaaggacatccgttaccggttggaggtggcggaggcccaggcggtgattgcggacgtgagctgcctggagcgcttcgacggcctggtggggacggccggcaaggtccgcacctgggtgtcggtgggcgagggcgcgccgtctccgtgggggcgctacgtgtccggcgtcgcggaggcgaacgcgggcgcggccttcgagcccacgcgcgcggatgcgccgctgctcatctacttcacgtccggcaccacgggcatgccgaagatggtgctgcacacgcaggccagctacgggcaggggcacgtgattaccggccgctactggctggacctgacgccggaggaccggcacctgacgctcagcgacaccggctgggccaagtgcgcgtggggcaagctcttcggcccgtggagtcagggcgcgtgcaacgtcgtctatgacttccgtggccgcttcgagcccgcgaagctgctgaaggtgctggagacgcagaaggtcaccaccttctgcgcgccgcccaccgcgtggcgggcgctggtgctccaggacttgaaggccttcgacctgtcctcgctgcggcacacggtgagcgcgggcgagccgctcaatccggaagtcatcgacacgtggaaggatgccaccgggctgcacatccatgagggctacgggcagacggagacggtgatgattgtgggcatgttcccctccatggcgccgcgcgtgggttccatgggcaagccgtccccgggcttcacggtgagcgtcatcgacgaccagggccaggaggtggcggacgggcaagagggggacatcgcggtgcgcgtggcgcccgagcggcccgtggggttgttccagggctatctcggggacgacgcggccaacgcggcgtgccggcgtggtgactggtacgtgacgggagaccgggccgtgcgcgacgcggacggctacttctggttcgtgggacgcgcggatgacgtcatcaagacgtcgggctaccgcgtggggcccttcgaggtggagtccgcgctgctggagcacgacgcagtggcggagtcggccgtcatcggtgtgccggacgagaagattggccagcgggtgaaggccttcgtggtgctggcgccggggcatacggcatccccggtgctcgcgcaggcgttgcaggagcacgtgaagcggacgacggcgccctacaagtacccgcgcgaaatcgagttcgtcaccgagctgcccaagacggtgagcgggaagattcgccgcgcggagctgcgcaccacgcggacgtag

SEQ ID NO: 4833 - DNA, 1407 bp, Myxococcus xanthus
atgacgacgccatgcaccaatctgaacctcttcgtggacggagagctgtccgctcccgacgcggaggtcttccgccagcacctggggcgctgccctgaatgcgaggcggggctgagggagctgcttcagttggagctgctggcctcccgcgccctggaggggagtgccagcgtcgccgagccgccgcccgcgaaggtgacgccgctgcggccgtggatgcagcggatgtctcgcacggtggtgccggtggcgttggcggcgggtttggcggcggtgggtgtgttccgtctccagacgcagccagaggcccccaccgacgtgtggctggcgggcgcggacgtgcggaccttggaggcgcggctcagccacccgatggcggaccgcttccggccctacgagccgatgcgcggcacgtccggcgccgcgaacccgctgccgctgcggcccctggcggagctggaggagcagcaggacttccgaggcatcgccgccgcctatgcgctgcgcggggactggcagcaggcggagtccttcctggcacgggcaccggcctcggcggaccgggacaatgaccgcgcggtggtggccctcagcggtcagcggtgggaggaagcgctgaacctgctcggcggagcgctgcgccaggagccgcggcatgcgcaggcgctgtggaaccgggggctggcgctgcggggactgggcctgctgaagcaggcggagacatcgttccgcgacgtcgcctcgctgccgggccaggcggcgggctggacggtggccgcggagaagcgcgcggacgagatgcgtgcgctgcgtgacgcagaggccgcgaggtggaagcgccaggtgcgggagacgtggacgcagctcaccgagaagacggcggatgcggcgtacctggtgcggcagcatcccgcggtgacgcgtgcggccctctatgaagcggtgcgtacggccacttcggtggacgcggtggccgcactgttgccgctcgcctcggcgttggatcggctgggtgaaggcacggtgctccaggactacgtccgggatgcggcatcccgcgacttcaaggtgcgtgctccgctggcggaggactatgcgcagctggtgaaggagggggcgctggttcccggactgctggagcgactgcgcgtctcccaggagacggacctgtacgtcggcgcgctgctccacacgggcgaggccgcccgggatgcggagtcgctcaaggccctgcagcgctacgcccatggctccagggacccgtggctcaacctgctggccgagcgtgagcgggcccggagcgaggaggcgtccggccgcgccgccaacgccgagcacctgctgctggccacgctccgcacgtgtggtgcgtacaacacgctcttcccgtgcgctgaaatcaactga

SEQ ID NO: 4834 - DNA, 561 bp, Myxococcus xanthus
atgtccaacctcttcaaccgggaccggaggcgcttcgaagcgttcatccgtcagcatcggcccagccttctggggctggcccgccggttgtgtgcccgctccagcctggagccggacgacctcgtccaggagaccttcgagcgggcgatgccggagttcgagcatctgaaggaccggacggactccgcggcggctgcgtggctgtgtacgacgatgacgaaccgcttcctggactactgccgccgccagcggacggagtcccgggggatgccacacctggcgctggtccaggatttggcggtgtcgccggaggagacccaggagaactgggcgctggtgagcaccgacgccttccagaaggccatcgagcggttgaagccgcacctgcgtgacgcctaccgcctgcacgcggagggcaagcgctacaacgccatcgccgagcatttcaatgttcccgtgggcaccgtgggcagttggctcaccctggcccgtagggatttgaaggaactgctgctgccccaggtggcggtagcccgggagcagggggccacgagctcatga

SEQ ID NO: 4835 - DNA, 2745 bp, Myxococcus xanthus
atgttgaagccggcgtacgacaaagtcctggtcctggcgctggccacgcccgtcttggtgttgaccgtccttcttgcccgcacgccctccaagggaagcggggcacctgtatccgcgcagttctgggcggagcgccgctccgcgtcacgcatcgaggctcggctcacgcaccccgaagcggaccgctaccggccacgtatgtcggcgggcggctgccccgtcgctcccgaacccatcccactgcgagacctcgcccggctggaggaagcgggcgacctgtccggtatcgcctccgcgtatgcccttcagggcgagtggaaccaggcggcctcgttcctggagcgcatgcccgcctctccggaccgcgacagtgatttggccgcggtgtacctcgcccgcggctcacatgagcaggccttgcggttgctggacggcgtgctgaaggcgcagccgaagcatgcgcaggccatgtggaaccgcgcgctggtgctccaggcgatggggctcacgatgaaggcggcggacaccttcgaacaggtggcgctgatgggggagccgggctggagccgcgaggcgaaggccaacgctcgcgagcaacgcgacgccacgatggagcgcgcccgccggtggaaggaagcgcgcgaggccacgctggcgctggtggatgaccctcaggcgcctcttccgctggaggcggcccgcaaggacccgggcatcgtccggcaggccttctatgaagtggtccgcgcggcgccgtcgaaggagcgcgtcctggccctgctgcccctggcgcaggagttggaccgcggccacggaggctccgcgctgacggactacgtcaagcgggtgagcggccggaacttcacgcgccgcggcgtgctgtcgcgcgagtacgcgtcgctggtgcgcggcaagctgaaccagccggacaagctgctggagcgggtgctggcgtcgggagaggacgacctcttcctgggcacggcccagcacacgcgggccacgcgccgcatgttttcgcaggtggtggagcgggcgaagcgccagaacgacccctggttcaacctctacatcgagcgtgaggaggccatccgcgagacggccgagggccagtggtggaaggccgagcagcgcatcttcaacgcgctccagcgctgccgcgagggcggtctgtccacgcgctgcgtggacctggagctgcgcctgagcatcctctacgccgacctccagcgcctcaccgagggcgagcagcatgcccgcaccgcctgggcctgggcgcgccagctccgggaatgggacatggagttcaccgccctggaggcgctggccgccatcacccgctcacgcggggacttcgccagctcgcgtgcctatgtggaggagtggtccgcccgcgggcacgtcaactgcgtctggccccgggagaacctggcccacacgtactacctggacaaccgcatggacgacgcgcgccgcgaggtggacgcgaacgccgcctgcaagaacgagccgctgagcctgctgttcgccgtcaacctcgcggagctgtcgcgcacccggccgaagccaggggacgaggcgttgctgcggcaggccctcacgtgggccaaccacagcaaccccatgcccagcgacgcggtgtatgcccgttacgtggagggccgcttcctgctggattccgacagagcccgggggctggcgctgctgcggcagaccatcaccgaggcggaggcattgcctcggggagattcactggcgcgcgaggcctgggcgctgagctattcgtcgctcgtcacggacgcgggcaaggcgggcgagtacacccaggcgttggagttgatggccgcgcagcttggcacgcccgtgccccagcgctgcgcccttgcggcggcggtgcatggcgagcgcacggtgctggtggcgcgcgggacgcaaggccaggtgctgggccactacgagacggaccggcaggggccattcatccgcgcggacacctcgcggctggtgccggatcggctgcgtgaggtgttgcgtggctgcgagcgcgtggacgtgcttgcctggccgcccgtcttcggccacacggacctgttgccgccggaggtgccctggagcttccggctcggccgcacggcccagccgcgcaccacgcccacggcccggcggctcgtcgtctccagcgtggatgcgcccgcgctgctccaactgccgcggctgccgcagtggttgccctcgcaggagccggaggcggtgccgctgcaggtgctgtccggctcggacgccacgcccgcgcgcgtgctggcggacatgcgggacgccaccgaaatcgaaatccacgcccacggcatcatggacccggcgctctcggatgcgtcgctggtggtgctgtccccggagacgagcggccgctacgcgctcaccgcggacgtggtgcggcagcagacgctcacgggggcgcccatggtgttcctggcggcgtgcagcgccggacgcgcggcgagcaccaccaccagccacgagcccttcagcctgcccgcggcgttcatcgatgcgggcgcacgggcggtgctggcctccacggtggacatcccggatgccgccggccgcttcttcgatggggtccggcgccgcattcgcgaaggggccgcgccggcggtggcgctgcgggacgagcgtcagcgctggttggagcgggacagccgtgccgggtggacccggcacgtcatcctcgtggagtcatattga

SEQ ID NO: 4836 - DNA, 510 bp, Myxococcus xanthus
atgccgcgctacgagcggctccggcgcctggcgctgcgcttccccgagctcgacgccagcgccatcgagacgtgcatcaccttgctgcgggcttcgcacgacttgtcgggggcctacgaggcgcacctgggccgtcacgggctgtcgatggggcgtttcatggtgctggtccgactgttcaccaccgaggacgacgacgtggagcgcgttcgtgggctcacgcccgcggacctcgcggagagctctggcgtcagccgggccacgatgacggggttgctggacacgttggagaaggatgccctcatctcccgcgaggaccatccggaggaccgccgcatgtacacggtgcgcctcacgcccaaggcccggcaactcatcgagagcgtgttgccggaccactaccggcggattgccgcgctgatggcgcccttgagtgaagaggagcgcaccacgctgcggacgttgctggccaaggtcacctcagggctccccctgctcaaggagccctga

SEQ ID NO: 4837 - DNA, 768 bp, Myxococcus xanthus
ctgcgcatcctcatcctgggcggcaccgcgttcctggggccggcgctggtggagttcgcgcgctcgcgcggccacaccgtcacgctcttcaaccgggggaagacgaagccgggcctcttcccggacgtggagaagctgacgggcgaccgcgacccgaacaagggcgagggcctgaaggcgctggagggccgcaagtgggacgcggtggtggacacctccggctacgtgccgcgcgtcgtgcgcgcctccgcggagctgctggcccctcacgtccagcactacaccttcgtgtcctccatctccgtctacaaggatttgtcacggcaggggctcgacgagacggccaccgtggccacggtggaggacgcgacgacggaagacgtggaggagcactacggcgcgctgaaggcgctgtgcgagcaggccgccgaggccgccatgccgggtcgcgtcttcaacgtgaggccgggcctcattgtcgggccggacgacccgtccgaccgcttcacctactggccgctgcgtgtggcgcgtggcggtgaggtgttggcgcccggcgacggcgtggacccgctgcagttcatcgacgcgcgggacctggcggcgttcatcatccgctccggggaggcccgcaccaccggcatcttcaacgccaccggccccagtcaggacctgctgatgcgggacttcctggaggcgaacaagacgaccctgggcagcgacgcgcgcttcacgtgggtggacaccgacttcctcacgaagcacaag

SEQ ID NO: 4838 - DNA, 765 bp, Myxococcus xanthus
atgcgaacggtctacgtcgccggccacggccccgccgtcatcgtcatggccgagatgccaggcatcagcccgcacgtcgcccgcttcgcgcgttgggtccgcgacgcgggcttcactgtctacatgccttccctcttcggcagggacggtgcctaccctcgcgcggaggaggggcgtgccatcatgcaacgcgcctgcgtgagcgcggagttccgagcgttcgcggcgaatgagtcgagccccgtgacgcagtggctgcgtgccctggcacgcctcgcacatgaggagtgtggcggtccgggggtcggcgcgattgggatgtgcttcacggggaacttcgcgctctccatgatgctcgaacccgcgatgctcgctcccgtcatgtgtcagccgtcgctgcccctgagcgacaccggcgcgattcaactggcgcctgacgagcttgccgccgtgaaggagcgcctcgaacgtgacgacctgacggtgctcgcctatcggttcgagggagaccgattctgcacggcgcagcgattccaggcatatacggccgcgctcggaaagcgcttcgttccccgagtgctgcctacgtccgccgcgaacccgacgccgccccccttcttcgcggaagtcgtcgggtgcgcccacagcgtcgtgacggcccatctcatcgacgcggagggagagcccactcgcgcggcgcgagacgaaatcctcgccttcttcgctcagcggctgggacgcgcgggagcacaaagcgcgacgtga

SEQ ID NO: 4839 - DNA, 1335 bp, Myxococcus xanthus
ccggggcctcgttgggccgctcacgtgaattcctccatactcaggcgattcgtggacgttcgggacgaggaagtcggcgccgtccgctggtcgttcctgtatttcttcacgctgatgtgtggctatgccatcctccggcccatccgcaacgagatgggcacggcgggcagcgtgaaggggttggactggctcttcaccgccaccttcctggtgatgctcgcggcggtgcctgccttttccgccctggtgtcgcgttggccccggcgggtggtgattcctcgcatctaccgcttcttcctgctcaacctgctgggcttcttcgtgctcttgaagctcggggtggcgcgggagacggtggcgcgcgtcttctatgtctggttgagcgtctacaacctgttcgtcgtctccatcttctggagcttcatggcggacgtcttcgccagcggacagagcaagcggctcttcggcttcatcgccgcgggcggcaccacgggcatgctggtggggcccttcctggtggggcggctcgctgagccggtgggcccggtgaatctcatcctcatctcggtggtgttgctggaggtgagcgcacagtgtgtgcgccggctgagcggctgggcccaggacgtccagcagcagcccgcggcggcgcagggcccggtgggcggcggcgtgctcgcggggttgcggctcatcgtgacgtcgccattcctgctggcgctggggctccaggtgctgctctacgcggcgacctccacgttcctctacttccaggaggtgcggctcgtcgccgcgcttggcagcgacgcggccagccgcaccgccctcttcggtgacatcgacttctacgtgcaactggcgacgctggggttgcagacgctcgtcacggggcgtgtcatctcctggctggggctgggggcggggctcgccgtggcgccggtggtgacgggcctgggcttcctggggatggccgccatgccggtgctgaccgtgctcatcctgttcaaggcggtgcgcggcgcaagccactatgcgctggagcggccctcgcgcgaggtgctcttcaccaccgtggaccgcgaggcgcgctacaagtcgaagagcttcatcgacacggtggtgtaccgcggcagcgacacggtgagcgcctggctccaggggggcctcgcgaagctgggcctgggcatgacgggcctgtcgctggcggcggtgcccctggcagggctgtggctgggcgtgtcgctgtatctcgcgcgccaccagcggaggcaggcggagccggtgccggccgccgcgcccgaggcgccggtgtccgaagaagtcgcggcccgctag

SEQ ID NO: 4840 - DNA, 1242 bp, Myxococcus xanthus
atggcgcgtggcatcgtcggcagcgaaatcctccgcatcgcggcggagattcgcgagcggatcgccaagggccagaaggtgtgcaacctcaccgtgggcgacttcaacccgcgcgagttccccatccccgacccgctgcgggagcacatcaccgccgcgctccaggcgggcgagacgaactacccgccggcggatggcgtgctggagcttcgtcaggccgtgcagcgcttctatgagcgctcgctgggtctgaagtacccgctggagggcatcgtcatcgcgggaggcgcgcggcccatcatctacggcacgtaccgcagcgtgctggatgcaggggagacggtcgtctacccggtgccttcgtggaacaacaaccactacgcgcacatgatggacgcgaagagcgcggtggtggtgacggacgccgcgcggggcttcatgcccaccgtggagcaattggcgccgcacctgggcgccgcgcgtctcttgtgcctgtgcagcccgctcaaccccaccggcaccatgattgagccggatgcgctgggcgccatctgcgagcgcgtcgtcgcggagaaccgcgagcgcgagaagcagggccgcaagccgctcatcctcatgtacgaccagatttactgggtgctgagcttcggcgcggccagacacgtcacgccggtgtcgctggtgccggaggtggcgccgtacacggtgttcgtggatggcatctccaaggccttcgccgccacgggcgtgcgcgtgggctggggcgtggggccgccgaccatcatcgctcgtatgcgggacgtgctcggccacgtgggcgcctgggcccccaaggcggagcaggtcgcggtggcgcgctacctcgacgacacggcggcgacggagaccttcctggaggggatgcgcaagtccgtggaagcgcggctggaggccttgcacaaggggttcacgcgcatgcgcgaggcggggctgccggtgcagcacatcgcgccccagggcgccatctacctgtcggtgcgcttcgacctggtgggcaaggggggcctgcgctccaacaatgacatccgcaagctcctgctggagaaggcgaacctgggcgtggtgcccttccaggccttcggactggacgcggacacgggctggttccgcctgtcggtgggggccacgtcggtgaaggaaatcgaggaggcgctgccccgggtggaggcggcgctccgtgaggtcctctcttccggcgcgtaa

SEQ ID NO: 4841 - DNA, 408 bp, Myxococcus xanthus
atgaagcggcgcccggcccagtcggtgacgctgcgctcggtgcgcgctggcacacatgccgacttcgaccgcgtggtgttcgagttcgacgggccgcaggtccccggctaccagctccagtacgtggacaagcccatcatccagtgtggctccggggacgagacgccgctggccggcaagggcttcctccaagtcatgctgacacccgcgcgtggccatgacgaccagggccgggccaccgtggccgcgctggagatgaagcccaagctgcccaccttgctggagctggtgcgcacgtgtgacttcgaggccgaggtgacgtgggtgctgggaaacaaggcccccaccgacttccgcgtcatggagctgcgcgaccccactcgcctcgtggtggacgtgaagcactga

SEQ ID NO: 4842 - DNA, 1038 bp, Myxococcus xanthus
atggacccggagcagtacttcgaaccggacgacgccgggacgaacgccgggagccgcaatgggcccgtgctgcgcttcatgaacgcgcgcatggacaagatgctcggtgaatacgacgggctgcggctggaccatccgcacgggctggtgtgcccgtgggtgtaccgcgcggacctgccggacgcgctgtggtccgtacaacatggcgcgcggctcttctcgtcaccggacctgccggaccacccggagctggcgcacttcgcgctcgtgcgcccggagcaggtggaccgcgccgtgccgcgctacgcggaccgctgggtgaaggacctcacgcccgaacaggtgcgccgctacagcgtcctcttcgacacggtggtggaggcgtcccggcgcaacgggcggcaagtgggtgacttgctcgcggaggtgctcagcacgctgccgtacccgttggagcgcgtgctggcgcagtacggcctgggccgcttccgcgtgacgcagaaggcggacctgcacaacccgtcggacgtgtaccgcagtgagaacgtgggcctggaggactgggtgatggtgggcaaccacgacacgaagtccctgtggcgcctggtggcggactggcaatggaagggcacgctgcacgctcaggcggagtacctggccgcgcgcttgtgccccgagccctcggagcgcgaggccttcgcgcgcgagctgtccacgagcccgggacggttggcgcaggcgaaggtggcggacctgttcgccagccgcgcgcgcaacgtgatgatgttcttcaccgacctgctcgggatgccggagacgtacaacgcacctggcacggtggatgagcgcaactggtccctgcgcgtgccccaggactgggcgcgggagtaccgcgagcggttgaagggagacgccgcggtgaacctgcccgcggcgctcgccatggcgctgcgggcgcagggtgctccggcgcgcgcgcggcaccagcgcttgctggaaggactggacacgctggcccgcgagctgcgggccgggtga

SEQ ID NO: 4843 - DNA, 3192 bp, Myxococcus xanthus
gtgttcatctcatacttcgccatcaagcggcccatcatcaccatcaattcgatgctggcgctggtggtctttggccttgtgtcgctgggactcctggagaccgacgagttccccgacgtccagcccccggtggtgagcgtcaccatcgtctatccaggcgcttcacccgagacggtggagcgggaaatcctcgagcccatcgaggacgccatcttcgccatcagcggcgtggacccgaaggagacgacgtccatcgccaccgacggcctggcgtccttcacggtgttcttcgacttcgagaaggacatccaggaagcgacgcaagacatccgggacgccatctccagcaagcgcgcggacctgccacaggagatggaggagcccatcctcacgcgcttcgacccggcggaccagcccatcgtgtcgctaacgctcacctcggaaggactggacgtcgcggcgctgtcgctggtggcggacccgacggtggtgggcgagctgcgctcggtgcccggcgtcgcccaggcggaagtcgtcggtgacgtggcgcgggagatgacggtgcagctcaagccggaggcgctccaggccgcgggcttgtcggtggcggaggtggtggcggcgctccaggcgcagaacctggcggcgccggtgggccgcatcaacgcgccgctgacggaggagtccatccgcctcaagggccgactggagaaggtggaggacttccggaccatggtggtggcctcgcgcaacggtcgggccatccgcctggagcaggtggcggatgtcttcgtcggcgccgaggagccgcgcacactggcactcttcaacggcgcccaggcggtgggcatcgacgtgctcaaggcccgtggctacagcaccaccgaggtcgcggacgcggtgcgtgagcgggtgcacgcgctccagcagcggctccccgcgggcgtgaagctcgaaatcgtgcgcgacgccggcgtccgcgtggagaacgccgtgcacaacgtgcagtccgcgctggtggaaggcgcgctgctcacggtgctggtcgtcttcgtctttctcaactcgtggcgctccaccgtcatcaccggcctggcgttgccggtgagcgtgctggcgtccttcatcagcgtgtgggccttcggcttcacgctcaacaccatgtcgctcttgggcctgacgctggccatcggcattctcatcgacgacgccatcgtcgtgcgagagaacatcgtccgccacgtggagatggggaaggaccactacacggcgtcgcgcgagggcacctcggaaatcggtctcgcggtttcggcgaccaccttctccatcgtcgccgtattcgtgcctgtggccttcatgtacggcgtggccggccagtggttcaagcccttcgccctcaccatcgcctgcgcggtgctggtgtcgctgttcgtgtccttctcgctggacccgatgctgagcgcgtactggccggagccgcccaggaagcagaacccgggcttcatcacccggacgctgaatcgcttcaacgcctggttcgaccggcaggcggagcgctacaagcacgtcatcgcctgggcgctggaccaccggctggtgatggtgctggtggcggtgggctcgctggtgggcgcgctggtgctccagggcaccgtgggcggcgccggcttcgtgccggtgagcgaccgcgcggaggtggagctgttggtggagacgcccccaggctccagcctggagtacacgcggcgcaaggtggacgaggtgacgcgtaccctgcgcgcccacccggaggtggactacacctacgcgaccatcggcgtgcccctggcgctcagcgcgcccggcgtggaccaggccctggtgtacgtgcggctcaagccgaaggcggagcgcgacatgagccaggacgcattgggcgtccagttccgcgaggagatgaagcgcatcggcggtgccaccgtctccgtcttcacctcgggcttcggtggggccttcaagcagctccagtacgagctgcgcggtccggaccagcgggtgctcacgcagctagcgcagcaggtccagaaggaagtggagcaggtagccggcgcggtggacgtgggcctgtccacgcgagggcagaagccggagctggaggtggagctaaaccgcgggctcgccggacagttgggcgtgacggtggggcaggtggcccaggtgctgcggccggccttcgcgggcctggacgtgggggactgggtggaccccatcggggagacgcgagacgtcatggtgcggctggctccgggtgcgcgtgacaaccccaatgacttgtcgcagttgcccatctccgtaggcgcggcgagcgggccgccccggctggtgccgctggggcaggtggcggacatccgtcaaacgttgggtccggcgcaggtaacgcacttgaaccgtgagcgcgtcatcaacgtccaggcgaacgtgcaggggcgctcgttgtcggaggtgggcgcggacatcgagaagcggctggacggcgtgaagctgccgccgggctacatgctgacgacgggcggcgagtccgcggaccaggccgaggtgttcatgcgcgtgttcatcgcgctcggcatggcgctgatgctgatgtacctcatcctggtcatccagttcggctccttcctggacccgctggccatcctcatctcgctgccgctgtcgctcatcggcgtggtgctggcgctgctcatcaccggtgacacgctcaacctcatgagcctcatcggcatcatgctgctgatgggaatcgtcgcgaagaacgccatcctcctcatcgacttcgccaagtggtcgcacgagaagggcatgcctctgcgcgaggcgctcatcgaagcgggccgcatccgtctgcgccccatcatcatgacgaccttcgcgctggtggcgggcatggtgccggtggccatcggcgcgggtgagggcggcgacttccgcgcgccgctgggacgcgcggtgattggcggcacgctgacgtccacgctgctgacactgctggtgattcccacggtgtacgaaatcctggtggacggccggacatggtccacgcgcatgctgcgcaagctcttccggatgaagcctcccgaacagcggcctcacgttccgggcggaggcggcggccgtggagagccccggcccgcccctcaggcgcggcacgattga

SEQ ID NO: 4844 - DNA, 1206 bp, Myxococcus xanthus
ctctgcgccctgtccggttgccggaagggtgaggacgcagcgcccgcgcctcgacaagaggagctggagatgacgctgggccaggagaacgtggcccgcgccgaggtgcggcagttgcgctccggtcctggcatctccggcaacctgcaggcgcgcacggcggcggcggtgcgcgcggaagtgggcggcaccatcctcgacatcaaggcccagcagggccaggtggtgaagaagggcgaggagctggcgcgcatcgaggacgtcacgctgaaggaccagctcatcgcggcgtcggcggcggtccgcacggcccgaagcgcgctccaggtagccgaggccgagcaggagcgcgccacgaggctgtccaaggcgggcgtcatcacccagcgcgacttcgaacgggcggagctctccgtggagcaggccaaggggcagctcgcggaggcgcgctcccggcatgccctggcgcaggagcagctcaaccgcgcgcgcgtcgtggcgcccttcgcgggcgtggtgagcgagcggcaggccagcgcgggtgacgtcgtccagcccagcgcgccgctcttcacggtggtggacccgcgcacgttgcgcctggaggcctccgtgcccgccgcgcagctcgaacaggtgaaggtggacacgccggtggagttccacgtgacgggctatggggaccgcgccttccgcggcacggtggagcgcatcaacccggtggtggacccggccaccggccaggtccgcatctacgtggccattcccaacacggacctccaattgctggccggcctcttcgcggaggggcgcgtggcctcgaagggtacgcaggcggtcgcgattcccatcgacgccatcgacgacacggggaccgagcccgccgtgctgcgcatccaggaagggcgcgcgcagcgggtgaacgtcagattgggcctgcgcgacgaggtggcgcggcaggtcgaggtccgctccggtctggaggacggcgacgtggtgctgctgggcgccgcgcggagcgaggtggcggagggcgggcgcgtgaaggtgtcgtccccacggccggactcgaagcccgtggaggaggcggggcccggtgttggcggctcggaggcgccgccgcccccgtcgtcgggagcgaggcagcccactccgcggcccgcgtccacgcaacccccggcggaggacgctgcgccgtcccactaa

SEQ ID NO: 4845 - DNA, 963 bp, Myxococcus xanthus
atgggtgcttggaagcagacggtggcggcgctggtcagcgcggtgagcatggtgggctgtgcggggaacgtgatggaggcggagccggtggcgcttcgctcgggcgtggcggagctggtggcgccgaacggacggaacctgaatggccgcaacctgaatggccgcaacctgaacacccccgagctgggacagctgctcgtgtccgtggacctggcgggcgcccgcatcgcggaggaggttctcggcgaggtgcggctggagggcagcgtcttccacggcgtcgcctccagcggcccggtgtccggccagtccttcctgggcgcgcgcttcatcggcaacctgagcagtggtgacaccgtggagctgcgcgttgacggcatcgagcctggagcgggcgcggacgcggacgtctgggcgtacctcgtctcctactacgacgcggcggatgccctctggaagcccgcgtgcgcggcggcggacggctccgcgctgagcgccattcccgtggcgggccggtgggactaccgccagggcgtggcgggcggcggcgcgaaggtggatgacgccgcgcgcttcaccttcgcctgtgagggggcggccatcgccaaatgcgtgcgcttcggctaccggccttggggcaccacggcggacggcttgagtctggcggaccaccaccaggcgtgcacgcgcatggtgcgcgcggacttctgcggcgacggcacgtcgcacaccacggatggccagtgggtgaaccttcatgacggcgtgaacgtgcagacggatacggaggcgtggctacacgaagccgagtgggacgccgacggtgcgcgctgcttcacgcagacgacgcgcgcggcacaggccgtgagctgcccggggcagacgcagctcacccaatgcggcaagtgggcccacttccaggccggcacgctcatcatgagcgaggtccctcccgcgcagtag

SEQ ID NO: 4846 - DNA, 3783 bp, Myxococcus xanthus
cctccccaggagttcgacgagtaccgccttgtgcgggccatcgggcgtgggcgcacggggcgggtgttcctggcccatgacacgttgctcgagcgccccgtcgccgtgaagttcatccccgccctggggcccaacgccctggcgcggtttctcgtggaggcccgggcggccgcgcgcatccagcaccccaatgtcgtcaccctctaccgggtgggacaattggaggagcagccctacctcgtctccgagttcattcgggggatgagcctggaccggctgcccaagccccaaccctgggagcgcgtgctgtccatggggcgggatttggcacggggcctgagcgccgcgcaccggcgcggggtgttgcaccgggacatcaagcccggcaacgccgtgctcaccgaggctggcgaggtgaagttgctcgacttcggcctcgcgaagctcctggaccgggccgcgggggcgggggattccgcgccgcccgcttgcgggactccgccaccggagttgcctcctgacctggacccggaggccagcccgaacctgggcgcgcgctcgctggacggagtcttccttccatcgctgccgcgcggctcgctggtggggacgccgtattacatgtccccggaggcctgggcgggagaggcgctgacggcgcgcagtgacgtgtactcactgggcgtcgtcctgtacgagttgtgcgcgggcaagggccccttccgggatgttccctggcgcgaacttccggctcaggtgcgccaccgggatgccagccccctggcccaggtggtgtccggcgtggatgccgggctcgccgccgtcatcgacaagtgtctgcgtcgcgagccgtccgagcgttacgccaccgcctcacagctgctcgatgccttggacgcactgacgcgtgacgacaccgtccaggcggtgccggagggcaatccctaccgcggcctccaggccttcgaggcggagcaccgcgccgtcttcttcggccgccgccgcgaacagcgcgcggtgctggagcggatgcgctcggagcccttcctgctcatcaccggtgattcgggcgtggggaaatcctccctgtgcctcgccgggctgctccccgctgtcaccgaagggggcctggaggacgggcgtcgctggcgcagcgtgcggctggtgccgggccgcaggcccctggcggccctggtcgcggcgctcgcgcccgtgctggagacggaagaggagaccctggccgaaaccctgcgcgccgagcccacgtccctggtgcgccggctccgcgtgaagctgggggcccaggaggggctgctcgtctacgtggatcagctcgaggagctggtgacgctggcgccgccggccgaggcggagctggcgggacaggccctgggggcgctcgcggagggcgccagtggcgtgcgcctgctcgccacggggcgaagtgacttcctcacccggctgtccgccgttcccggactgggcgcggaggtgccacgcgcgctgtatctgctgcgcgccttgtcgcccgaggagacacgggacgccgtgacgggccccgcccgcgtgaagggcgtgcgctttgaatccgacgcgctggtggatgcgctcgtcacctccaccctgtccgcagcggagggcggcctcccggtgctccagttcgcgctggccgagatgtgggatgcgcgagacgcggcggcgggtgtcatgacgcaggcggtgctcgactcgctgggcggcgtggagggcgcgctcgcgcggcacgcggatgcggcggtggcccggttgctaccggaccagcgggtggcggcccggggcgtgctcctgcggctcgtcaccgtggacggcacccgcgcgcggaagacggaccgcgagctggtgggggacgacgcccgctaccgcgccgccctggaggcgctggtgcacgcgcggctactcgtggcgcgcgaggcccaggagggcacgtcctacgaactcgcccacgaggcgctgctctccggctggggcacgctggcgcgctggttggccgaggcctccgagcgacgcgaggtccaatcccgactggaggccgccgccgcgcactgggagaagctgggcttcccgagcgagtccctctggggcccgcgtcagctggaggagacgcaggtgctcgacacgggagagctcacccgtcgcgagcgcgacttcctgaaggcctcgcgtcgcaccatggtgcgcagccggcggacgcggcatgcgctggtggtggggttcgtcgtgtccctggggctcgtctacggcgggctcaagctgagggagcgttggagcctggaccggcaggtgcgcgaggagctgggccaggcggcccaggccttgagcgccgtgcgtcaggactggggcacgctgcgcgccgagcgcgacgaggccttccgcctctacggcaccggccgccgcgccgacgcggaccggcactggaaccgggccggtgcgcaagcgggacagctgcgcggccgtttcgacgaagtggccggacggctggagcgcgcgctggcgttggcgcccggccgcgcagacgtgcgcgaggccctggcggacttcctctacgagcgcgccctgtgggccgagcaggacgaagacaccgcggcgctgcccgcgttgctccagcgtctgcggctctatgacacggcgggcacgcgctggcggcgctggaacgccgcggccagcctcacactggagacacctgtctcaggggcggaggtggagctgcgtccactgacgcgcgatgcgcagggcaggtttcagctgggagagcccctgcaagcggacccggggcgctggctggacgcagcggtggcgccgggcacgtaccagatttccgcgcgctcgctcggctacgagccggtggtgcagtgggtgctgctgcggcgaggcgagtcgcggcggctcggcgtgccgctgccgcgcatgggcagcgtgccggagggcttcgtcttcgtgccgccgggcgaggtgaagttcggcagcgcggccgaggccagcgtgcgcgagttcttcaacgccgtgcccctgcaccccgtggaagtccccgccttcctgatggcccggcacgaggtgacgtatgccgagtggctggcctacgtggagtcgctgccgcccgcgcaacgcgcacagcggctgccgcgcgtgggaacgggcggctacgcgggcctgctcacgctggggcaggtggacggcgtctggcggctgcgcttccagccggggaacgagccctacatggcgcgggccggagcgccgctgcgctacgcccaccgcacgtcgcgcgcggagcaggactggctgcgcttccccgtcagcggcatcaccttcgcggacgcggatgcctatgccgcgtggctgtcggagagcggccgcgtccccggcgcacggctctgctcggagctggagtgggagcgcgcggcgcgcggcgtggacgggcgtgagtacccgcatggcgacaccctaggcccggacgacgccaacatcgacaccacctacggcaagcagcccggaggcttcggccccgacgaggtgggcagccaccccgcatcgcgcagtcccttcggcgtggacgacatgtccggcaacgtgtgggagtggacccgctcctggctggagccgggcaaggccgtggcgcgcgggggcagcttcgccttcgcggcgacctcggcgcgcgcctccaaccgcgagctgccggagccgtccctgcgcgacgtgacggtgggcatgcgggtgtgcgcggacgtggcagccaacgcgcacccctga

SEQ ID NO: 4847 - DNA, 441 bp, Myxococcus xanthus
gtcccggcagaagacatgccaaccgccaaggagcccgcgccgggcgggaacaagaagcgcgtgctcgtggtggacgacttcgacgatgcccgggagatgtacgcggagtacctggagttcgtcggcttcgaggtggacaccgcccgcaacggcgtggaagcggtggagaaggccagcgagggcgagcccgacatcatcctgatggacctgtccctccccgtcatggacggctgggaggcgacgcggcgcatcaagcaggactcccgcacccgggacatccccgtcatggcgctcaccggccatgtgctcgcggggaacgcggagcatgcccgggacgctggcgcggacgagttcgtcgccaagccctgtctgccgcaggatttggagaacaagatccgaaacatgctcaagccgagcaaggggaaggtccggggcggctga

SEQ ID NO: 4848 - DNA, 96 bp, Myxococcus xanthus
atgacgggccccgagcaatgggtgctggcccgcatcgaggagtccgcaggcacccccagccgtcgccacctctacgtctaccgtcccaacaactga

SEQ ID NO: 4849 - DNA, 999 bp, Myxococcus xanthus
atggatctggctcgggagctgacggattttctgggggcggtggagcagcggcttggcagcaccctggtggatggcgatgccggtccggacgtgaagggcgacacgctgatggaggcggcccgccacctgtgcctgggcagcggcagcaagcgcgcgcgccccatgctggcgcggctgttcggcggcgcggtgggcgttccggcggagcggctggtggacgtggccgtggccgcggagctcatccattccgccagcctgctgcacgacgacgtggtggacgcgggcatgttccgccggggccggcccacggtgaacgcgcgctggggcaacatcgtcgcggtgatgagcggcgacctcatcctgtccacgggcctgttccagctgtcccaactggacgcgcggctgacgcgcagcgcgctgtcggtcgtctccgagatgacccgcgccgccatcgccgaggtggaggctcgcggcgacctggacctgccgctcaatcggctgcgcttcatcgccgagggtaagacgggctcgctgttcggctggtgtggcaacgcggcggcgacgctggcggagcaccccgaggcggtggagcgtttcgacggcttcgggcgtcacctgggcgtggcgttccagattgccgacgacattcgcgacatcctgggcacggacgtaggcaagccgcgttacgcggacgtgcactcgcgcacgccgtccatgcccatcctcctggcggtggccaaggatgagtcgctgcggcgcaagctgaaggacgcgtgggcgttttcggcgatcacgccagatcgcacgaaggagattggcgcggccatcgaggccacgggcgccgtggatgcctcgatggcgcggatgaacgtcgaaatcgaggcggcgctcgacaagctgggccacttcgccaaggagcccgcgggcgcggagctggtgagctgggcgcggaagctgtcggccggcatcgccgaacaagtccaggggcgcgctgcatga

SEQ ID NO: 4850 - DNA, 1644 bp, Myxococcus xanthus
atgaagaagcatctggtaatggccgtggttccgttcctggcgttcggttgtggagacgacctggttgacgcggacggagacggaatcgcggacggcgtgcgcgaaccggacactgtgacggtggtgacgccagccaatcccaagggcacggtgtccggccaggtgctgagcacggacctgcggccgctgaccgaggtcacggtggagatgaccatcggcagctcggcggagccggtgtcgaccgtctcggatgcgaagggcaacttcacctacaagaacgtcccggccggttcgcacgtgctgctgacgttctccaaggcgggctatgccacgctgcgcgcgacggcgcaggttccgtcgtccgcgggcaacgtccccatcaacaacggcaacgcgagcttcggccccatcaccctggcgcggctggacggcacgctgaacttcctggtggtgacgccgcagggccgtcccgcggcgggtgctcgggcgacgctggaggccacgccggcgggtgccatctccaacggcgatgagtcctcgtcgatggtgagctccgtggtggtggaggcgaccgcgaacgagcagggcctgctcaccttcacgggcatcccgagcgcttctgagctggcgcgcctgcgcaacggcaacggcgagtacaggctgtgggtgtcgcccatcgacgccaacggtgacggcgtcccggagaccggtggctacgtcaacacgtactatggggccgaggtggtggccaacagcaccacgcggctcatcagcctgccgtactcgcggccgcagaacgtgccgctgagcatcgagagcagcaacgtggccagcctccggggcgccgctgttgacatgcacccgctgcgtaacctggtccgcccgggcgagctcatccacctgtacttcaaccagccgatccagcagggctcgttgctcgtgcgtatgaccaacgaggatgcgcgggagtcgctgggcgtgacggcgaccgtgaacaacggtggatacagcgcgaccgtcaaccccgggagcaccgtcgagggcaaggagtacaacctggatgtgcgcgcggtgtccgccgagggtggctcgctcttcaactcccagggcttcttcttcgcgggtgagccgcgtgggccgcagaatccgacggctatcgtagaggcgcggtaccacgaaacgtcactggcacttccggcttcggggcagttgaatttcggtgaaagggtttacgtgtacttcgcgcatccgattgcgaacaaaatcgcgaatgggtaccgcgttcaggtctttttcaatattgaccttaacaacagtggcaagctcggcgatgcgcagggcgaaaagggcaacctgatgggattcgacctcattgatgacgagccgacgctcccgctgcataccaccacgcctgccgaaaccgctgtgttcccaatcatcaagtcgggatacagctcccggttctatttcagttatcctgggccggacaaccccaatctgctcgggactgagatttcggtgggcttctctaagctggggagtcgtggggccatcggaacctacgagaacatctggggccagcctcttacgagcgacattgctattacggggattggggtgcatccggcgcccccgctgccgtga

SEQ ID NO: 4851 - DNA, 219 bp, Myxococcus xanthus
atgcgcgcccagcgcgaggtgctgggcgccgaacacgcctacgccttcgccattggcgatgtgctgcgccacttccacctccacctcgtccctcgctattcgcagacgccgcagcggctctggggccgggccgccttcgacgctcccgcctccgaccacctccccgcgcaggaactggaggccgcggcgcaggcgctcgccgccgcgctggcgggctga

SEQ ID NO: 4852 - DNA, 124 bp, Myxococcus xanthus
atgcttgagcggctctacgccgcgctcgcatccggccccagcctcaacagccggccgcacaacagccgccagcgcgtggacctccccacgctgaaccggctggatgggaccgcgccccacacct

SEQ ID NO: 4853 - DNA, 966 bp, Myxococcus xanthus
atgacacacaagcggctgaagaggattggcatggtgggcgggggcgccatggggtgcggtatcgcgctcgagctcgccatcgccggcaggcaggtggtgctctacaacacgcgcgccgacagcagcgagcgggcacgcgcgaagctggagcgagacgcatcgctgctggtggagacgggcctgctcgccccggagcaggctcccgccgcgatcggacgcatccgccgcaccacagtgctcgccgaggccgccgtggagcaggacctggtcatcgagtccatccccgaggacctcgccctcaagcagcagctcttccgcgagctggaccagctcgcggcccccgacacactgctcgccaccaacaccaccgcgctgagcgtgacggccatcgctcgggactgcacgcggccggagcgcgtcctctctgcccactactatctgcccgcgcacctcatcccgctggtggacatcattcccggcgagaagacgtcccccgacgcggtggagacggtgcggcggttcattgaggagcttggcaagtcgccggtggtgttctccagggacgtgccgggctcggtgggtccgcgcctgcagcaggccctcatcggcgaggccatccggctggtgcacgagggcgtggccacgccggagatggtggaccgcgtgctcacccagggcgtcggacggcgcctgggcgcttcgggtgtcttcgaccggctggacctggtggggttggacttcatgacggccctcctccgcggcaccggccgccccgtgccgcccgtgctcgcgcagaaggtggagcggggcgagctgggccagaagacgggccagggcttctactcctggacgcccgagtccaccgctgcctacgaggagcgcatggcccgccacctcgccacccagcttcgtgaggatcgggcagcgggccgcctccgcactcccatggcggagctggcggaatga

SEQ ID NO: 4854 - DNA, 591 bp, Myxococcus xanthus
atgaggacggagaccgtcctgctggattcggcggtgctgtcagacttcctggtggacgccatccgcgagtacaccacgtgcaccccggagctcccgccccggagctgggccgtgctgctggggcgcgtcgccagcgacgccatgcgcgtggagcgtgttcgcttcgccaccaacgtccgcgagacggatgagcgcgtactccaggagttcgacaccaccatcatcccccgcttcggcgcctgctacgccaacgggcgtcgtggcttctggtgcgagccacgagagttgctgcgcatcaccacagaggctgaggcccagggactggaagtgctcggctccatccacctgcacccggactggcaccgcatcggcccaccccacgagcgcggcctgcgcgtcagccaggaacccacgcccatggaccgacacctcttccagggcagcggctggccgctcaacatgattctctacctggagagacgcgagggcagactctatcactcggtcggagcgtgggctccgcccgatggccaggaggtcggcgcgggctgtcgcgcgctggccatccgcatggagactccggagcggtga

SEQ ID NO: 4855 - DNA, 1506 bp, Myxococcus xanthus
atgattggcctcgaggtacgcgcccggattcgccagttgcactacgcggaaggctggccggtgggcaccatcgccacgcagctggggctgcaccacgacaccgtggaggcggccctggaggacgcgccggtagccagtgctgacagaagcacggcgaagcccacggtgctgggcccgtacacggacttcattgacgtcaccctcaaggcccacccgcgcctgagggccacgcgcctcttccacatggtgaaggcccgtggctacctgggcggctatgagcaggtgaagcgctatgtgcgacgggtgcgcccaggcccccaggccgaggccttcttgcgccgcaataccctgccgggcgaagaggcccaggtggactggggcagcttcggcaaggtgcgggtggggcgggccacccggacgctctcctgcttcgtcctggtgctgggccactcgcgcgccatgtacgcgcgcttcttcctgggccaaaccatggagtgcttcctccagggccacgtccaagccttcgaagcgctgggcggcgtgcctcgcaacctcctctacgacaacctgaagtccgtcgtgctgcagagggccggagacgtcattcacttccacccgcgcatattggaagccgccggccactaccacttcgtccccaagccctgcgccccctaccgcggcaatgagaagggaaaggtggagcgcaccatccgctacctgcgcgactccttcttctccgcgcgcaccttccacagcctcgacgacgtcaaccgccaactgcagcgctgggtggaggaggtggcccaccagcgccgggtgcccggcgacgcctcgggccgcacggtggcgcaggccctggaagccgagcgctccctgctgctgccgctgcccgcgcacccgctgcccaccgacgtggtgcgccccgccgcctccggcaagacgccctacgtgcgcttcgacggcaacgactactccattcccgagggcctggtgcgccggcccctcacgctggttgcctcgtccaccacggtgcgcctcctcgacggcgccgtggaagccgcctcgcacgtgcgcagctgggacaagggcgccgtcgtcgaggatgccagccacctggctgccctggccaggcgcaaggcccacgcccacgagctgcgtggcagggacttgctgcgcgcacgctgcccgcacgccgagcaactcctccaggcgctcaccagccgcggcgacaacctcggcaaccacaccgtgaagctgctggcgctggccgacaggtacggctccgccgaaaccgacgccgccatcgccgagacgctcgctcgcggcgcactcggccccgccgccgtcgcccacgtccttgaccaacgcagccgcaaaaggggcgcccctccgccgctgcccctcgtgctgccggatgacccgcgcgtgcgcgagcaacgcgtcccccagcactccctcaacccctacgacgccctcctcgggcgcgacacggagcaagtgccatga

SEQ ID NO: 4856 - DNA, 429 bp, Myxococcus xanthus
atgattgctcagaatatcgcctacaacgccgtgcaggctgggcaccccgtcctcttcaccaccgcctcccagttgctgctcgacttgggaagccaggactccgctcgcgctctcgacaggcgcctgaagcactactgcactcaggcggggttgctcgtcatcgacgagattggctacctctcctacgacgccaggaacgccgacctcctcttccaggtggtgtcgcgcaggtatgagaagaagccgattgtcctgacgaccaacctcccattctccgagtggaccaccatcttccccaacgccgcgtgcgccatcgccctcattgaccgcgtcatccaccacgcgagcatcatcagcatcgagggcgacagctaccgcaggcgtatggccgaggaatcacgcgcggagcgcaaggcaaggaagagctga

SEQ ID NO: 4857 - DNA, 1206 bp, Myxococcus xanthus
atgaacgccgccgcggtgcagcggcttgagaggtatttccagcaaatcggcgaggtactcggcgaggagagccgacgcggctcgttcgccctctacgccatgggtctgctgggagagggggagcgaaagagcgtggagcccatcgccgctcgcgcgtgtccggaccccgagcgagtggatgccatgcaccagcggttgttgcacttcgccgtggactcgaggtggagcgaccgggacgtgcggcgccaggcggcgaggtatgcgctggaggcgatgacgcggcgggagccggtggaagcatggattgtggacgacacgggcttcctcaagcagggcaagcactcggtgggcgtgcagcggcagtacaccggctcggcgggaaaagtggccaactgccagattggcgtcagcctcagtgtcgccacccgcaccgagcacctgcccctcgacttcgagttgtacctgcccgagtgctggaccaacgacgcggctcgccgccgcgaggctcgcatccccgacgatgtccccttcaagacgaagcctcaactggcgctgcaaatgattgagcgggccgtgcaggacggtgcccctccgggcgtcatcctgggggacactgcctatggcacttccagtcagtttcgtgcgcacctgcgcgcgttggggttgcactacgcagtcgcagtggaccctcaaacgactgtcagcgtgctggatgcccagggacggccccgcggcaatgtgcgcagcgtttcagccctggccttgcacattcacgagcgagggggatttcgtcggtgcacctggcggcagggcccccagagggacttgtcggcgcgcttcgccctgcgccgagtcgtcgccgcgggtgtaccccagcgcgagcaagagccgctgtggctactcattgagtggagggacggtgaggccgagcccgccaattccttcctggtttcccttccaggtttcaggacgaagaagcaactcatccgcttggtgatgcaacgctggagaaccgagcgcgtctacgaggaactcaagggcgaactgggtttggaccattatgaaggccgccgcttccctggctggcaccaccatgtttcggtagcactgtgctgctacgcgttcatcgtggctgaacgcgtgcggcgttttcccccctcggcccgaggggcggctgaagcctacgcgcagccactctcggcctga

SEQ ID NO: 4858 - DNA, 696 bp, Myxococcus xanthus
atgaacatcggaatcatcggcgcagggagcattggcgcgaccctggcgcggcacctcaatgccctggggcatgagatttcactagcaaactcacgcggcgtcgagggcgtcacgaccatcgcggcgagcgtgggtgcaaagcccgtcaccgttcgccacgcggcgcacgcgggccccatcgtcatcgtgaccattccccagaaggccatcacggatttgccgcccggcctgttcgacgacgtgcccgcggacgtcgtggtggtcgacacgggcaactactacccggagttccgcgacggccacatcggcgccatcgatgcggggcagaccgacagcgagtgggtctcagcgcaactgaagcgtccggtcgtgaaagccttcaacaacatccaggctggcagcctggacacgaagggtcttccccgtggggcaccggggcgcatcgcgcttccggtttcgggcgatgacccgcgggcgcgacagcagattcttcagctcgttgatgcactgggcttcgatgccatcgacgcgggccccttgtcggagtcctggcggcagcaaccgggcacggcggtgtactgcaccgacctcgacgccgagaagctcccaaaggccctggccgctgccgacgcgacgaaggtcgccgaggtccgccggcagaacgacctgagtgtcaaggccatgttcagccgctga

SEQ ID NO: 4859 - DNA, 105 bp, Myxococcus xanthus
atgggccgctcggagggacccgcgctggtcatccgctacgaccgagtgaagctgccggggcaggatgagcgccccgtgtgcttcgtcgtcgaggcccccctctga

SEQ ID NO: 4860 - DNA, 597 bp, Myxococcus xanthus
atgaaaggctacctgtggacggggggacccgggagccctgcctcggaggcgccgccagcggatggccggctggcgccctgggaagccatcgcggtggacgcggtgggcaatgtcattgagttctgggggttcaagcgcaaccagggacgggtctgggccctgctgtacctgcgcggtgagcccctgacggcgggagaaatcgagcgcgagctggacctgtccaagggcggggtctccatgctgctgcgcgacctggagcgctggggcgtcatccagcgcgtgcgcctgccccaggacaccgtctggcgttacggcgcggagaacgacctggtccggatggtgacgcacgtcatcgaggagcgggaggcgggcttcgtcgcgcgcattcgcgccgacctggcggaggcccggcggctggcggagacccagtcggggcttccaccggaccggcttcagcgactggagaagatggccacgctggccgagcacgtggagcgcgcgctgcggctgttcatcaagacgtcccggctggatgtgtccggtgtgctgtccgtcttccgggacgaggccactggggcgcgccggggctcgaagtag

SEQ ID NO: 4861 - DNA, 186 bp, Myxococcus xanthus
atgctgacggcgctgcaagtggccctgacggccgctggtggcttcaccatcatcaggcggattctgttcgggagcgccgccattgcccgcgccgagctggcgggcgcgattgccgcggggcaggtcgcggagaaagccgcagcgattgctgtgctggagcagctcgacacccggggcgacaagtga

SEQ ID NO: 4862 - DNA, 2736 bp, Myxococcus xanthus
atgcaggccctcctgactgacaacgggacgggcgtggtgctccataccccggtgtcgccagggtggaggcttcgtcagtacgcgcagaagaaggcgagcgtcctcgatgccgtgcgggacttggctcaacagattggctgggaggtgcgctaccgctggcgcgagtcgagcgggacattcgctttgacgttcaccgagcccaaccggacgaatccgccgctcgcgtggaccttcggccctgatgactaccgcgacgtcacgaagctcgccgtcagcaggacggacgtccgcaacagggtggaggtcgtcttctcggacactggcgacttggacgtcgcggggcacgcaaagacgaagagtgtcgtcgttgaggacgccgcgagtcaggccgcctacggcgtgcgctacatgcagattgccgagggggcttcgagcaacatcaacagcgaggttgaagcgcggaggatggcggaagcggccctgtccgacttgtgcgagccgctcgccgaccaggaaatcgacctcgacttcttccttccggtggagctgggcgacctctttcggtttcaccccaacggcgttcactactcggacgcgcagaacctggcagtcaccgggtttcgccacgtcttcacggcagagggagacgcacgcaccacgcctacaacgcgcgggaagccctccttcggcgtctccatgtggctggagatggacacgcgtcccggactgggcgagcccgcgcacacgtccccgccgcttgtcccgctgaacatcaacgtgacggccgtcgtgaatggcttctcactgtccctcgccccggctgcgagtggcccagttgcttcggggtacgagctgcacgtttcgacgtcgagcggcttcacgccgagcagctccactctgcgcgggacgttcgacacgacggcattcggtgtgtccgacctgatgccgggagcgacatacttcgtgcgcgtggttccccgagacagcttcggcaatcgaggcaacgcgtcgcctcagctctccgtcacgccgaagcagctcgaaggcgcgtcgctaagcgatgccgcggtcggcttccagcatctgctgtacccgcccaccgataatctcattccgaatggctacaacgaagcgggcattcgcgccgtggggaagtcacccgacggtgacaggctcgtcgaggaccctgtgaatgcccgggtgggccgctgggtgcgccgggtggagctgacgaacacgggggcatggccggggctgagctggacgggcgggtatggctcggcggttccaggcgggcggctcaagtgctcgcctggggacgagttcttcgccgaggtctacgtcaaggcgtcgtccgtcaccgtcgggggcatgggaaccctgcatttgctgtgggaggacggaagcggcgcctacgcgggccagggcacgagcgtctttctgggacaggtgggaacgacgtatcggcgcgtcaccgtgaaggggatgtgcccggccgggtgcacgggggttcagctcttctgggaaacccaggtggcggcggcggacgtgggcaagcggctctacttcgatgccgtctccatgcggaagatggtcaccttcgacttgctcgcggcgaacaccctcaagacgtccaactacgccgaggacggcagcggtatccctacggccggggcgaagctcgacaacgtcggaacgacgctcaaggtggcctctaacaacgtccaggtggggcgctactacctgagcgacggcttcttccgttccgtgcaggccctcgcggacacgggaagccgcatctactaccggggcaacaacgagggcgttccgaacatcgaccgactcaacatccaggtgcttgagggttacgccattgccggggcggctggtggcgcggcgagcttcacctgggctcactaccatgccgtcatccagccccaggtggtgagcgacaacctcgatgcgctgcgcttcatggaggtgggattctactgggcatatagcgatagcaacgcgccccagtggctctatgggacatcggtgccgctggccgaccgcaagtatcagaacggcgctgtagacggtgacgccagcaacgcgacgcgcgcgggcttcaccttcatgtatggcgacaggttcaaccggctgcgggacgccatggcgaacaggctgctttacctgaaggtgcggctccacaacgcgagcggctacagcgccgagcggtggttcttcccgccgagcagctacaacgtcaacatgcttcggagcgcgacggggcccgcgtcaacgccaaccggcagcggtggaggtggcgggggcacgcacggaacctgcgtcgcgccgtgggaactggtgttgctcggcgatggttcggaagtacctgccgaaatgctccggcctgggatgcgagtgctcaccatgcacgagcacgagcgagatggcggcatcttcgaggtgacgcacgtcagaaggcatcaggcagcgcgttgcacgctcaccatgacggatgggcgtgtgctcgtcgtgacgccggaccatcgctggcggacgttcgagcgcgggtggacacgcacggacgcgcttcgccccggagagacgattgatggagtcgctccgggacgagtggctcgtgttgagccaatggactttggcgacgtgatgagaatcaccgttcgcttcgcgatgacttacattgtgcaggggctccttgcgcacaacctcaagccacgagactaa

SEQ ID NO: 4863 - DNA, 762 bp, Myxococcus xanthus
atgctggtggaacagacgctggagaaactcaacgggatgaagctgcacgggatggcctcgtacctgcgcgactggttggcgaggccaggggagcgagatgttggcccagccgacctggtgggcctgctggccgacgcggagtggatgcaccgagagaacaagaaactctcctctcggctgagcgccgcgcgcctgcgccaggccgcggccttggaagacatcgactacgggcacgcgcgcgggctcgcaaagactcaggtgatggagctgtccacctcgaagtgggcggcggacaagcagaatgtcctcctcaccgggcccacgggcgtcggcaaatccttcctcgcatgcgccctgggccagaaggcgtgtcgggatggctactcggtggtgtaccgccgggcctcacgtctcttcgatgagctcgcccaggcgcgcgccgatggaacctacgcgcacgtgctcaagcgactggccaaggcccaggtgctcatcctcgatgacttcggccttgagccgctcggcgctccggagcgcaaggagttgctcgaagtcctggaggaccgctaccagctcgcgagcaccgtggtgacatcccagcttgagccgaaagactggcacgccgtcatcggcgacgcgacgctcgccgacgccatcctcgaccgtctggtccacaacgcccatcgcatcaagctgggcggagagtccatccggtacgtggagacaaatttgacgaagggccgcaagcaggccaagggatga

SEQ ID NO: 4864 - DNA, 1137 bp, Myxococcus xanthus
atgagacaggagcaccgcgcgggcgagaagctcttcgtggacttcagcggggatggagtcgaggtggtggagcgcgacaccggagaagtgcgggtagcgaagctcttcgtcgccacgctgggggccagcagttacacgtacgtcgagcccgtttactccgaggatttggccacctgggtgggctgccacgtgcgcgccatggccttctttggcggtactccggcgttggtggtgccggacaacttgaagtccggcgtcacccacgtgcaccgctacgagccggaggagaatcccacgtacgccgacctggcccggcactacggcttcgccattctgccggcgcgtcctcgccgcccgcgcgacaaggcgaaggtggaggccgcggtgctggtggctcagcggtggattctggccgtcctgcgcaaccaccgcttcggtggcctgcacgaggtacgtgaggccgtacggccgttgctcgagaagctgaatggccgcccgatgcggcatgtggggcgctcgcgtcgccagctgtacgaggagctcgagaagcctgtgctgaaggccctgccggtacacgcctacgagctggccttctggaagaaggcgcgcgtccaccctgactaccacgtcgaggtggaggggcacctctacagcgtgccgtactcgctggcgcacaagcaggtggaggcccgctacacggaggggagcgtcgaggtgttcctcgggggccgtcgggtcgccagccacgtgcgcaagcacgccaagggctacaccacgctgaaggagcacatgcccgccagccaccgggcccacgcggagtggacgcccacgcggctgctgacatgggcggagaagacgggcccttccacggccgcgttggtgcaaggcctcatggagcgaaaaccccatccggagcagggcttccgcggggccttgggtgtcatgcgattgaaggacaagtacggagaggcgcggctggagaaggcgtgcgccagggcagtgcgtcaccgggcctacagctacaagtccgtggccgccatcctccagcaccacctggaggacgcgcgggaggagcgcgaggagaagccgcccctgcccgcccatgagaatgtgcgcggcccccactactaccactga

SEQ ID NO: 4865 - DNA, 390 bp, Myxococcus xanthus
atgacgaaggcggacatcatcgagggtgtctacgagaaggtcggcttctcgaagaaggagtcggccgaaatcgtggagctcgtgttcgacacgctcaaggagaccctggagcgcggggacaagatcaagatctccgggttcggcaacttccaggtgcgccagaagaaggcgcgcgtgggccgcaacccgcagacgggcaaggagatcgagatctcggcgcgccgggtgctgaccttccggccgagccaggtgctgaagagcgccctgaacggtgaggcgccgccggaggatcacgcggagatcgacgcccgggaggaagccgccgccgacgcggccgaggcccgtggcgaggacttcgacgaagagggaatggaggacatggaagggtga

SEQ ID NO: 4866 - DNA, 324 bp, Myxococcus xanthus
gacacgtaccgcttcaagtggacgtgcaaggactgcttcacgaaggagctggcgaaggcgagccccgccaacgcgagcgcgctggagcggctgcgcacgcgctggtggcgggaggcgaagggcgacgaagatctgggcaagccccgtctggagtcgctgctgggcggcttcgagggcctggaagggctggaggccttgcagtcgctgcccggcatggacctggaggcactccagggcatgcagggcttcgaggccttccaggagatagacgcccagtcgaaggagctgctggagcagctcatccccgggctgatgggggagtga

SEQ ID NO: 4867 - DNA, 933 bp, Myxococcus xanthus
gcgcgcgccaaggtggaggccgaagccgcccgcaccctggcccagggcctggacaagacccggaaccagggcttcatggcccggctcaacggcctgttcggccagcagcgacaggtggacgagtccgtcctggcggagctggaggaaatcctcttcaccgccgacatcggcgtgcgcaccgccaaccacctggtggaggtggctcgcgagaagctcaagcgcaacgagctgaaggaccccgagcgcatcaagggcctcatccgcgacgaggtcgcccgcatctgtgacttgcccgtgccgcgctccctggaaggcggcggcccgccgcacgtcatcatggtggtgggcgtcaacggcgcagggaagacgacgaccatcggcaagctggcctcgaagctcaccagcgagggcaagaaggtggtgctggccgccggtgacaccttccgcgccgccgccaccgagcagctcgacgtgtgggccgagcgcgcccaggcccagttggtgaagggcgccgagggcggagaccccagcgccgtcatcttcgaggccgtcaagaaggcgaaggaggaaggcgcggacgtcatcatcgcggacaccgccggccggctccacaccaaggctccgctgatggaggagctgaagaaggtgaagcgcgtcatggacaaggccctgcccggcgcgccgcacgaggtgctgctggtgctggactccaccaacggccagaacgcgattcagcaggccaagcagttccacgaggccgtgggcgtcagcgccatcgccctgacgaagctggacggcaccgcgaagggtggcgtcgtcatcggcatctgcgacgagctgaagctccccgtcgtctgggtgggcgtgggcgagaaggtggccgacctgcgccgcttcgagccgcgcgagttcgtccgcgccctcttcgactga

SEQ ID NO: 4868 - DNA, 876 bp, Myxococcus xanthus
ccgattcgttcagcgaagatggcggtggtgggttgtggtctcatgggaagcgcactggcgcgagccttcgcctcggcgggccacgacgtcgcggtctggaacaggactcccggcaaggcttccgctgtcggtggtggcacccgtgccttcgacagcctcgtcgaggccgtatcgggacgcgagctcgtcgtcgtctccctctccaactacgctgccgccgccgaggtgctctcggagaggggcgtcgcggcggcactgactggaacgacgctcgttcagctcaccagtggctcacccgcggacgcgcgcgaggggctggcgtgggcccaggcccacggcgtggactacctggatgccgcgatcctcgcctacccgagtttcgtcgccaccgagtacgcgaccgtctattacgcaggggcgcgcggcatcttcgaccggcacgtcgagaccctccaggcgattgccaagaactccgtgtacgtcgacgagaagattggcgctgccgcgacgctcgactgcgcgattctcgaggcctattacggcggctccctggcgttcctgcacgcggcggccatgtgcaaggcggaaggcctggacccgaaggctctcttcgcccagaagaactccttcctcggcctgatttccgtcaccgccgacgccgcgcaggacatgattgagaagaatggcttctcaggcgaccagtgcagtctcaacacccacgtcgccgcaatcgaacacatcgtccggctgagccaggacgcccgcatcagcgcacgcttccctaaggagctgctcgacaactacaagcgagccgtcagtgcgggactgggggaccaggaactgccggccgtgttccggaccctgactcaagactga

SEQ ID NO: 4869 - DNA, 846 bp, Myxococcus xanthus
atgggcctcgggatgcccgacaccggagtggaactctgggtgagtgacggcagcgcctccggaacccgcctcgtcaaggacatcaacccgggtgccgcctcttcgttccctcggagcctgacgcaagcggagggggtgctctacttctccgcggacgacgccgtgcacggccgtgaactctggcgcagcgatggcacggccaagggcacggagctggtcgaggacaccgttcccggcccccagggctcggaagcgcaaatcttcgccctgttcaaggagcgcctctacttcgccaccttcacaccgggattcacggtgacggagattcgcaagctcgacccggacccctcctgccacccgcgctcgaatctcgtcgcgagcatccccaacccctacgccgaccttcccttcgatttcttcatcttcgtcgccacgtccacggcgaccgagagaaagctctacttcacgctcttctacgacatcggcagccccgcccccttcgacgtccagttgtggcggaccgatgccaccgcccagggaacgaagctgctgtaccagccactcatcgtctctccggacctccgaccgcccacgccggtccccaccgatgacggccgcgtcgtcttctacgccttcgatgaagcgcacggccacgagctttgggtgagcaacggacagccgagcggcaccaagctcctgcaggacatcgtcccgggccccgcctcttcctatccgcaggacctgctgcgcgcgggcgacttcatctacttcacggcactggatgggcaactcggccgggagatctgggtattgcccgtgccaaagcctcaggtcgcgagtcactga

SEQ ID NO: 4870 - DNA, 351 bp, Myxococcus xanthus
atggcaaacccggttcgtttcgcgttcacgcagaccgcccagcccaacctggagttcatcgtcgagttgtctgacgagaagacgatttcacacgcacggaagattctctctggcgaggagaagaacgaagtccacgtccacggacgcatcatcaagcgggccgcggcctacaacccgaggttctccttccacctggacccgaacaccatccgcttcttcgcgatggccatcgaggtctgcgatgccaacatgacgtatgtggaagaccacctcgacgaggcgggcggcgcattcctcccgggcggacactggtgcccgtgggactccaagctgacgcgcgaaatcacctga

SEQ ID NO: 4871 - DNA, 522 bp, Myxococcus xanthus
atggattcgcactatgatcaggtgatgaaggcgcgtgcgggcgcggacccgtcggccacgcgcctgtacttcgcgtactcgaccatcctggaccgcgccgcgttcgaggagtggcggtcccagcacagctacgacttcttcgagctgcccgaagggcggctggccgaggccgtggatgtggatctggtctatgacttcccgtcgcgctggtggggtgggcgcgtcgcggggctgacggattccgcgggccagaaggtgtacggccgcctgttcgagattcgcggccaggactggcccatcatccagcacaaggaaggcttcgtgacgagcatgtgcgtggagcggccggtgcgcgtgcgcgtggatgggcaggagctggaggccacggcgttcgtcacgaatccgcggcgtacgtcggcggacggcccggtcagcacccgtttcgtggacgcgctggtgcgcggtgcccaggccgcgggcctgccagcggcctacgtggagcggctgaagcgcggcgagtag

SEQ ID NO: 4872 - DNA, 330 bp, Myxococcus xanthus
atgagcagcaacgaatccgttctcgtcaccgctgccacggggcgtcagggcggcgccaccgcccgggcgctgctggccgaaggcggcacccgggtgcgtgtgatggtgcgcaatcccaaggcgccaaacgcgaaggccctcgcggcggctggcgccgaggtggtcgtcggggacttcgacgagcccgcgtcgttgcgcgcggcctgcgctggggcgcgggcggtcttctcgatgcagtcccccctcatctccacgaccggcgtcgactacagcaaggaactccagcaagggaggaacctcgtcgaggccttgcttgccgaatgtgtctaa

SEQ ID NO: 4873 - DNA, 105 bp, Myxococcus xanthus
atgaacgtcgccccggtgctggcgcggcccgagatcgcgcggtcctatggcctttcgcccatgagcttcgagacctgggcgcgccagcgtcgcgagatggcctga

SEQ ID NO: 4874 - DNA, 1215 bp, Myxococcus xanthus
atggacttccaggcgcgactcgaagcgctcacgcaccaactccggccctggtccccgctctggtcccgctccatcctccagggctggcccgggtccggcgccgcctatccccaggactggctggcctatgcccggtcgctcgatgaagcgggcgagcagcggctggaccagggggcgctcgcgggcgtcccgcctccggccctgtgcgcactcctgggcgcgctccaggaactgacggcgctgccctggcacgagggcattcacgcgctgactgtcgcggagacgcagggcctcagcgccaagaagacccacgagctcgagcgggtgctcgccctgctcgcgccgagaacgcgcttcatccaccaggcggtcgatattggcggcggcatgggacatctcgcccgcctctgtgcgcggacgttcgggtggaccttccacagcatcgatcgggacgccgcgctgcaggacaagggccgacggtggctgacgagaacccatccccgaggcggggacaccgtgtgtttcatccaggcctccgtcgaggacgggctccaaccacagctcgatccactcttctccggccgggaccgggcctcgatcggtctgcacacctgcgggccgctcgccctcacgcagctccgcaagagccagggggcgggcttcgtcgtgaacatcggctgctgctacgacaagctggaggtcccgcgggattaccccgtctcccgcttcgggagcgagcatccgctccccttcaccccgcatgccctggcgttgacgacgcggggacggcatcacaagaccgaggtggaattcgcgcggatgaagcgggtgtatgcgtggcgcttcgctttcgatctcctatcgaggcggcactttcccgagcgcggcttcgtgagagcaggggacgcgccccgggcgctttacgccgaacgcttcgccgtctacgcgcgcgaccgcctggagcgcctgggcctcgatcccggcatgacggacgccgagctgaatgccttcgaggtgtccgttcgcgccgagacacgggaccttttgctctgccatctgctgagggaccgcttcgcgagggcgttggaggtcgtgctcctgcttgatcgcgcgctcctccttgaggaatcgggcttccaggtcgaactcctccagctcttcgatccgcgcctgtctccgcgcaacctcgcactcatcgcgtcgcggagcgcttga

SEQ ID NO: 4875 - DNA, 462 bp, Myxococcus xanthus
  unsure (1)..(462): unsure at all n locations
atgtcgccgctctccttcggtggtcagacgttcttcccccagcactcgcaggatggcttcgtcgtagcgatcacccgtgcgaacgaggagcgctgggcgaagcaactcggttgcgaggtgctggatatttcgatggaccaccgcgacgacctggtgattgttggnaggtatgaggacggagatgacctcggcctcgggccgctttgcggcgtgcctggaagtgataccaacctcttcgccgcgaagtacgaccgggtcgacggacatccccgctggacgaggggctttcccatggcccacccgccggatgtgtcgaccgccattgaccgttatcgcgtgtcggtggacgaagcgggggcgtcggtgtttctgggaggcctcatcgcccccctcgacgttgggcccaagacgctcgtgccctctggcgtccgcgacctgttcctgctggggctgaagccctga

SEQ ID NO: 4876 - DNA, 1722 bp, Myxococcus xanthus
atgaccaatcgccacgttgccgagctgttcacgctggggctggggatgcggggactgcggttccagccggggctcgacaacgtgcaggtagacttcaagcgggagcgcggctcgagcgcgtccgcgcccttccgcgtgcggcgtgtcctgatgattcatccctactgggacatggcgctgatggaggtagagggggttgatggactgcggcccctcaccctggattcgcgccacgtggacgaggtgcgcgagcaggacgtcgtcgtcatcgggtatcccgcgcaggacccgcgcaacgatgccgcgctccagcaccgcatcttccggggcgtctaccaggtcaagcgcctgcagccgggtaagatcatgggcgcacggcgcacctcgagcttcggccggatggtggaggcgctcgcgcacgacagctcgacgctcggaggcaactctggctcggccatcttggatgcgcgctcgggcaaggtgctcgggctccacttcgggggccggtacctcgaagcgaactacgcggtgtccgcccatgacctcagccgggactcccgcgtggtcgatgccggggtgctcttcacgaagacgaacgtcggaggacagctcccatgggcgaacgcgtggaaggacaacgagggccccccggcgatgccgccttcgcctcttccgccgtctcccgtcctcttcgtcccggcgccgagcggcgagtccctggcgctcaccattccgctccacatcaccctccgcctgggggttcccgccctggcggggaatggccagaccgcgctcgtccccgggccggcagtgcccccgccagtgccaagccaactctggggaggcgtgggggctggggcaccgggcctgacacaggtcgacgtcgcggcggctgtcgcggaagcccagcggacgcgggacctcccctattacgacgccgaggcggacgcgctggaccgggagcgctactacgcaggtgtgcagccggactccgaccaggacgcgttctatgacggcctgcacggcctcctcgagcggacgcatacggtccgcccatcttacgatccgagccgctggctctatccatgggtggaccgccagaaggacctcctcctccgctcgctgtactcggcggcgggccactccttcacgctccaggagatccttcagaaggacctggaggtggagagggagcgtgcgctacggctcctggagcggccactgacagagagtctcgacgagggcttcctggagcagcttgagtccgccctgccgtacaactgcgagcacgtcgtgccccagtcctggttcaaggccagggagccgatgcgcggagacctgcaccacctgttcgcctgcgagatgcgctgcaacagcttccgcagcaacaatgcctacttcgagttccccagcaccgaggccttccaagaagactgcgggcgggccgagcagaaccggttcgagccgggcgccgggaagggagccgccgcgcgcgccacgctctacttcctcgtccgctatcccaacgccatcaacagcccggcggagctcgccgaggagcggctggagacgctgctgcgctggcaccagcaagaactcccctccgagtgggagctgcatcggaaccaggccatcttctccatccagaagaaccgcaaccccttcatcgacttcccggagtgggcggcgcgggtacgcttcgcccgcggactggggcgctga

SEQ ID NO: 4877 - DNA, 438 bp, Myxococcus xanthus
atggctggcgccaggctggaaaccctcccctcggccccccgaatcctggagccccatggcgccacgcgtttcgtgctctaccgcaaggaccgcgtccacttccaggaaggcaccagccacctccaggagcttcgcctcacgcccgaggcgaagacccgccgggtcgtcgccacctgctgcaacacgccggtcttcctcgagttcgagaacggccactggctcagcctctacggcggcctctggcccgagggaaccctgccccggctcgagatgcgaaccatggccagcgacctcccgcccggcgtggtgcttcccgaggatgtcccgaatgggaagactcaaccgttcccattcttcgtcaagctcctcggtgcgtggatcatgatgggattccgcagcccgaagctcaccttcatccacggaacgctccacttctga

SEQ ID NO: 4878 - DNA, 1119 bp, Myxococcus xanthus
atgtcgacgcgaatcatcgattccttggcgaagtaccacctgctcggccagacgggccttcgggtgagcccgctggcattgggcaccatgaacttcggtaccgactggggctggggcatcaccagtgaggacgcacaccgcttgctgacacgctatctggaagcgggcggtaacttcattgatacagcggatgcgtacacctccggctccagcgagcggatcatcggcgactacttcgcgaagcatggcgggagggaacgggcggtcatcgccaccaagttctccgccaacctgtctccgggggatccgaatgcgggcggaaacagccgcaagcacatctacgccgccctcgaaggctcgctgcgccgcctcaagatgagctacgtggacgtgtactggctgcacgtatgggacggcctgacacccgtggaggaagtgatggggacgctgaccggcctcgtgcgcgagggcaaggtgcgctacatcggcttctccgacgtgcctgcctggtacttcgcgcgcgcacagacattggcggagcgcaaccactgggaaaaggtcgccgcgctgcaactggagtactcgctcgctgaacgcaatgtcgagcgcgagcacctccccgccgcgctggccatgggggccgccctcactccgtggagccccctggccgggggcctcctcaccgggaggtacacccgcgacggaaaccagccgaagggtgacgggcgcgcccatgcactgctcgccagcggaaaccccgtggcggacaagttcctgcaagagcgcccctgggccattgtcgaggagctcgtcgctgtggcgaaagaggtggagcgctcgcccgcccaggtggcgctcaactgggtggcgacgcgtccggccgtcgtgtccaccatcatcggcgcgagcaggctggagcagttggaggacaacctccatgcgctggacttcaagctaccgcacgaactctccgcgagactggacgccgcgagtcgccccgagctcttcaatccgtacgtgttcttcgaaaaccccttcttcacgaagggaatgctcgcgggcaataccacggtgagcgcggagccgagcgggttccggggaccgctccagccccggtag

SEQ ID NO: 4879 - DNA, 381 bp, Myxococcus xanthus
atgaccttcgtggaaggcattgctgccatcgtcaaccccgcgctcgccgtgcccccgttgacccccatcccggacctcgagccgcaggtcaccgcccggctcaccacgctgctcgagcaggcacgggccgggacgatggagccagtcgagttcgcgtacgccccctggtggttctggggccaagccgtgccgttctatcagcaactgctgcaaagcctggcgccggcggggccgctcgtcctggtcaagcgggaagtggtgggtgacgaccgcctctacacgtacctggtgcagttcgggcccaagaccctccgctacagagtgtcgctcatcccggatggccgggtgtccgccttccgcctgaacgagcacatcccctaa

SEQ ID NO: 4880 - DNA, 1026 bp, Myxococcus xanthus
atgagcacgacgtccaatcgtcagtgggtgctgaagacccgtccccgggaagcggtgtccgaagactgcttcgagtggcgcgaggggcccgtgccgacgccaggcccgggtgaggcgctggtccgcgtcacctggctcgccatcgagcccacccagcgcacctggctcaatgcaaatgcgacgtacatccagcccgtcgcgctcggtgaggtgatgcggggcgcaggcgtgggcctggtcatcgcgtcccgaaccgagcggctggcggtgggtgactgggtggccgggctcaccggttggcaggactatgtactgaccggcgacgcggggctcttcggcctcaacaaggtaccggacggcgtcgctccgaaggcgatgctgaacctctatggcgcgagcgggctgacggcgtacttcggcatcaccgaggtgggccgcgttgcgccgggagagacagttctggtgtccgccgccgcgggcagcgtgggctccatcgcggggcaggtggcccggctccggggctgccgtgtcattggcatcgcgggagggccgcacaaggccgaatgggtcacccgcaccgcgcgcttcgatgcctgcatcgactacaagtctgaagacatccgggcgcggcttcgcgccctggcgcctcaaggcgtggacgtcgtcttcgacaacgtggggggccacgtcctggaagccgcgctggaccacctcgcccgaggcgcgcgggtggtgctctccggcagcgtggcctcgggatacaaggacggtgactacggcaccgcgccgcgcaactacatgcagctcggcttcaagcgagcgcggatggagggcttcatcttcctcgactacgtctcgcgctttcctgaggcttttcgcgagctggcggcttgggacgcccagggcgcgctccattgcgcggagtccatcgcggaaggcttggagcaggccccctctgccctgcgaggactcttcgaaggccgcaacgtgggcaagcagctcgtgcgcgtcacctcaatcccctga

SEQ ID NO: 4881 - DNA, 594 bp, Myxococcus xanthus
atgcccacgacttcgaccacctggaccgccttcgcgggacagcgcctgattgcctccggccctccggctgacgtcatcctcgcggcccgccgcgcgctggacaccggggagtccgcgccgctgttgctcttcgacgacaccacgggccggaccgtggacttccaccttcgtggctcgcgcgaggagctactggcccgccttcagcccgcgcctgcccccacggaagaagacaccgggcctcggagccccggcaggccgaaactgggcgtggtggcgcgcgaggtgaccctgcttccacggcactgggagtggttggcctcgcaaccgggcggtgcctccgtcgcgctgcgcaagttggtggaggccgcgcgcgcgagcagcggcgacaccgaccggcaccgtcaggcccaagtcgcggcggaccgcttcatgaccacgatggccggcaacctgcccggctacgagaaggccgcccgcgcgctctacgctgggcaccgcgcccggttcaatcagtggacccgaagctggccggacgacctcaggaatcacgcgcgccggctggccgcgcccgcgttcggaaaggtgacgccatga

SEQ ID NO: 4882 - DNA, 1872 bp, Myxococcus xanthus
atggtggagttcgacgagtccaacggcctggtgcgctcgctcaccaatccggtgggtgcgctctccgatccgcgcagcggggacccgatggccattggcctggacttcgtccagaagcaccgggacgcgctcgggctggggctcaacgacctggcgaacctcgaggtgacggaccgcgtctattcgaaggtgagcggcaccaccaacctgtacctgcgccagacgtaccggggcctgcccgtctacaacggccagcttcagatcaacgtggaccgcgacggccgcgtgctcagcgtgcacagcgacttcctcccggccctggagtcctcgctcgctggcaccacgccgcgcctgagcgccgcggacgcggtggtgggcgtggcgaagcacctgggcgtccgcctctccgcggcgccgcagtccctgaaggccgagcccggcgcgcgtcagcgcacgcgcgtggcggtggaaggcctgtccaccgagcccatcgacgcggagctggcggtgctgccggtccgccgaggcgaggcccggctggtgtggcgcttccaggtccacaccctggacaccgaccacgcctacgacgtcacggtggacgcgtccacgggcgaggtctggacccgcttcgactgggtggcggccgatgatgcctaccgcgtctatcccatgccggtggagagccccaaccacaccacgccgctgccgccagcggatgggcgcgtgctggtctccaaccccgccaacgccacggcgtcgccctacggctggcacgatacgaacggagcggccggcgcggagtacaccaccctccgcggcaacaacgtccacgcctacgaggacaccaacaacgatggcctgccgcccgccgtgcagcccgactgcacctcgctcatccactgcgacttccccatcaccctcacgggcgcgccgtccacgtacatccccgcggccgtcaccaacctgttctactggaacaacatcatccacgacgtccagtaccagtacggcttcgatgaggcgtccggtaacttccaggtcaacaactacggccggggcggcgccggcaacgacgacgtccgcgcggaggcgcaggacggcggcggcatgaacaacgccaacttcatgaccccgccggatggccaacggccgcgcatgcagatgtaccgctggaacacggtgacgccgaacaaggacggagacctggacgccggcatcatcgtccacgagtacggccacggcatctccaaccgcctcgtgggcggccccagcaacgtgtcctgcttgtcgaaccgccagcagccgggcgagggcatcagcgacttcctgtcgctcttctacaccgcgaaggcgacggacaccggcgcgcagggccgcggcgtgggcacctacgccctgaaccagcccaccacgggcgtgggcatccgtccccagcgctacagcaccagcagcgccgtcaacacctggacctacgccagcatcaacggcatggcggttccgcacggcgtgggtgccgtgttcgcccagggcatgtgggaggcctactgggccctggtcaaccaccacggcttcagcgccaacctgtacgacgccacgggcaccgcgggtaaccagcgcatgatgctgtacttcacccagggcctgaagaacacgccgtgcagccccaccttcacccaggtgcgtgacggcatcatcaccgcggccaccaccctgcacggtggcgaggacgtctgccgcctgtggacggccttcgccgcgttcggcatgggcaccaacgccgtgtccagcggctccggcggcacgacgcccaccaacggcttcgcggtgcccgccgcctgcgcggccttcagcgcgacggcagccaagctctag

SEQ ID NO: 4883 - DNA, 912 bp, Myxococcus xanthus
atgcggctgattgaaagcggccagatccgtctgacggaccgcgtcttcggcaggggcggattgcttggtgagacgttcggcgcgcagggcacctacgcggacagccgcgtcctgaacatcacggtccagcacctgctcgagcacaccgcgggcgcatgggacaacgacggcgcagacggcacgggcgaccccatgttcatgaacacgggcatgacgcacgcccagctcatccaatgggtgttgcagaacgtgccgctcgagttcgcgcctgggacgacgtaccagtattcgaacttcggctacagcgtccttggccgcatcatcgagcgggtcacgggcatgacctatgacgcctatatgcgcgccaacgtgttcacgcccagcggcgccaccagcttcgcagtggggggcgatacgttgagcgcgcgtctgccgaacgagcccgtctactaccagcttggcactggagccttcagcccgtacggcatgccggtgcgtcgcatggatgcgcacggcggctgggtcgtcacgcccatcgatttgctgcgcgtccccgtgcgcgcggatgggttctccaccgtcccggatctgctgagcgcgagctctctcaccacgatgaccacacgcacgacggcgctcgacaccttgggcaactccgtcaactacgccaagggctggtcggtgaacagccttcccaactggtggcacggtggctacatcccgggcacccgggccctgttggtgcgcaccgatgaccgctatgggcccagccgctccgaggagttcacctggtccgtcatgaccaactccaacaacagctccggttcgggcacgcccgacatcaacctcgacagcctcatgtggaacgtcgtgaatggcgtcagcgcctggcccgcgcacgacctgttctaa

SEQ ID NO: 4884 - DNA, 1833 bp, Myxococcus xanthus
atgacggcggcggggcagagcgcgctcaacgtgccggggctggacacggtcgtcatcgacgacatgcgcttcacgaacctggtggagcgcggccgcaacgtcctgacccgcgtgcacctgggcaacaacgaactcttgcagatggcggggcgcgtgcacgggcgggtggagggcgggcgcgtcttcatcctgagcgaccggccgctacacttcgcctcattgaggcccaccgagcccgagttccaactcgcgggcgagccggagcgggtggcgctcaccgccgcggccctgggcgtgcgggcggatgagttggatttgcccgtgccactggaccgcaatgcctatcgccgggcgctcgcgaagttgcaggcgcgcggcatcgtggacgcggaaggccggctgtccgactacggccgcgcggtggaggccctgcccgtggagcgtccgtgggcggagctcatcgtcaacgcggaggaggcgctgctgccgttgctcgcggtgtgcagctcggtggagtcgctgcacaggatgacgcgcgaggagcggaacctggacgggctgctcgtgcccggcagcgaccacctgaccgcgtacaacctctacgccgaggccttccgtgaagcgggcacggtgggggaggtgcaggggctgccgcgccacgtcttccatgcggagaagctcgcggcctgggcggaggtgcgtggggtgctggtgaaggccctggaggacgcggcgctcgcgatggcgagcgtgtaccggagcgtggggctggcgctgcccgcgcgcatgccctttgcggacccgcgcgcccaccggcgtttctgcgacctgctcgcacgcttcatgcccttcgacctggtcatcgacgagcgcaccgcctggggcgaggtcgcgcgcgtgtcgaagacgagcgtgtgtggcaacctgggcgcggtggcgggcacgctgcgctacttcgccgaccgcaacggcgactcgcaggccggcatcgaggggacccagcttccccagtcactgctgcgccgctacgcccgccgccatgcggcggcgccggtgtacgacgtgcgcttccgctcggtcgtgctcgaaaagcgggtggactatttcggcttcgagctcgaacgggaagtggaggtgctgcgcgcctgggggccggagctcgccaaggcggcccggcacgcgctcgccgaggcgctggcgcagggcgaagcaccccatcccgcggtggaccggcaccgggtcgccatcgccgaggtgcgcgagctgtggcgacgctcgggagggaccaccgcgccgctggggttgtcggagctgaccgcgctctacgaggcgcagttggatggggtggacacgctcgacgacttcaaggagcgcccgctgcggctcgaactggacgcgctcgtgccgcccgagatgcgtcaggcgctcctggcgctcccggacaccgtggaggtgcgcgagcaggcggtgccgctcgaatacgacgtggagagactgtcggacggagccccgcgaggcgtggtgcggctgcacctgccggagaagctcgcgcgcacgctggtggaggaggagctgccgctgctcgaccgtcccctgcgcttcagcgtggccaggggccggaggggcgtgctcgaggctcgctcgctcctcgagctccaggagctgctcgaccggccctggatgccggacgagatcgccgaggccacccgtgagcgttcactcccgcgacaggaccgggagcgcggcgcccccaggcctggggagtaccgggggcatcacggcaaggcaccccggaatggaagacgaccgggcggcggcggacggcggcgctga

SEQ ID NO: 4885 - DNA, 93 bp, Myxococcus xanthus
atgctggcgaacgcgattgccgtcgccaacgaagacgatccgctcaccgcgagccgggtgctgcgcctcgcgctcaccggcatccggccctga

SEQ ID NO: 4886 - DNA, 885 bp, Myxococcus xanthus
atgatggtgacgctcgccggtgccatgagcacggcggagctggggatctcgctcgccgagatgatccgccgcgacaaggtccacgcgatcacgaccacgggtgcgaatctggaggaggacgtcttcaacctggtggcccaggagcactacgtgcgggtgcccgatccccgcagcctcacggcggagcaggaggccgagttgcgcgacaaggggctcaatcgcgtggcagatacctgcatcccggaagaggaggcgatgcgcaaggtggaacgccccctcctcgagctctggcagagggcggagcgggacgggcgccgccactttccccatgagtacctctacgagctgctcctctccggcgcgctggccggctcgtaccaggtggatccccgtcattcgtggctcctggcggctgcggagaagcgccttccgatcttcgtaccgggatgggaggactccacgctgggcaacgtgttcgtcgccagcgtgatgcgcaaggagctggaaacctggagtccaatccgcggcggcgccgagtacatggcggccctcgcggactggtaccgggagacctcctcgtccgcgaaggtcggcttcttccagatcggcggggggatcgctggcgacttcccgatttgcgtcgtgccgatgctgcgcctcgatttggaggaggaggtcccctactggtcctacttctgccagatctccgacagcacgccctcgttcggctcttacagcggcgcaccgcccaacgagaagatcacctggcacaaggtcgacgtcgacacgcctcgcttcgtgatcgagtccgatgcgacgatcgtggcgccgttggtcttctcgtacgtcctcgactgctggggcgtgcgccagcagaagagctga

SEQ ID NO: 4887 - DNA, 231 bp, Myxococcus xanthus
atggaccacgtctggagggagttgaagctgcacatctcggccaatcgccagtaccccagcgtcggtgctcaggtcgaggccgccgtcctgtgggtgctgtcgctcactcccacccgggccatccgcaaggtgggtatcctcgcggaggcagcgagctccacggcgaggcggcggaggtgggccagggcgacggcgtcaagggagtcgtcgtcgtacagtccgaggtcgtag

SEQ ID NO: 4888 - DNA, 507 bp, Myxococcus xanthus
acgcgctcggcggaagcggccctgctcgaagaccggctggacgtggccctctgttgctaccccgtgagcactcccgggctcgtctccacgcccctcttccgcgatgagctcgtggccgtgctgcccgcgggccacccgctggccgcgcgcccctacgtcagcggaccggacctgacagagcaggccgtctacttctacccgctccccgcggaggacgaggagcgcttccgccgagagctcctgccacggaggcccgatgcactgcgcgtccgcacgcttccactcaccgaggccatggtggagctggtgcggagcgggcacggggtgtccctcatcgcgcgctggtcactcgggccgcacctggcacaaggggggctcgtcacccgcggcctcggtcgcaagggctactggcgacagtggagcgcggtgcacaagcgtcacagcccactcgccccggcgctcgccacactcgtggacctgctgcgcagcgcggtgctctccgcctga

SEQ ID NO: 4889 - DNA, 630 bp, Myxococcus xanthus
gtgagtgaggcatccggtacgcccggcaggcaggagcaggagcgcagccgcgtcacgcgccagcgtctgatggaggcggccattggcgcgctctccgagctggggtgggcgggcgcgaccatgactgtgattgccgagcgcgcgggtgtgtcccggggcgcctgtcagcaccacttccccacccgcgccgacctggtggccgccgccgtggagtacgtggggcaccagcaggtggaggccgtgctccgcaaggccgcccagttgccggccgatgctcgccgcacggaggccatcctccacatgctggccggcatctacctcagccctgtcttcaccgccgcggtgcagctctgggtggccgccgtggcggacgcggagctgcgcgcgcagttggccccgctggaggcccgcgtggggcgggagttccaccggctgacggtgcagttgctcggcgtggatgacagcgtcgcggaggtgcgcgagctgattcagggcacgctcgacctcatccggggactcgcgctggccaatctgctgagagacgacagcgcgcgcaggaagaaggtcctccaccgctgggcgctcaccctggacgaggccctgagcgcccggcgcacccgcagaggctga

SEQ ID NO: 4890 - DNA, 879 bp, Myxococcus xanthus
atgggctaccgctctctcttcgcaccgggctgtttcagcaaccgcaccatcgtcgtcaccggcggcggcagtggcattggccgctgcaccgcgcacgagctggccgcgctgggcgccaacgtcgtcctggtgggccgcaagcccgacaagctggaggccgtcgcgcgggaaatccaggaggacggcggcaaggtgtccttcgaggtgctcgacatccgcgacgaggagggcgtgaaggccaccgtggcgcgcatcatcgccgcgcacggccccatccacggcctggtcaacaacgcgggcgggcagttcccctcgccgctgtcggccatctccaagaagggctttgacgcggtggtgtccaccaacctcaccggcggcttcctgatggcgcgggaagtctatctccaatccatgagcagccacgggggctccatcgtcaacatgctcgcggactcgtggggcggcatgccgggcatggggcactccggcgcggcgcgcatgggcatgctcaacctgacgcagacggccgccgtggagtgggccgcgtctggcgtgcgcgtgaatgccgtggcgcccggctgggtggcctccagcggcatggacagctacaaggacgagggcgtgcgggcgatgattcccctcctcaagaaggaggtgccgctccagcggctcgccaccgaatccgaggtgagcgccgccatcgtcttcctgctcaccgacgctgcggccttcatcaccggcgacgtcatcaagattgatggtggcgcgtcgtgcaacaccaagattttcccgctggaggagaccaccgcctccaagccctacgagggattccaccgcgcgtcggcgccgcgcatcctcgggggtgagtcgaaggagtag

SEQ ID NO: 4891 - DNA, 1002 bp, Myxococcus xanthus
atgcagacgcgtcagaagctcgccgtgctcgtcatccacggcattgaagtggatgatccgggtctctatgacaccgccgtacgcctgctgcgccagcacttcgcgcagcacgcgggggccgggccggacacactcgccgtcgaaacggtgaactgggcctccgtgctggaaggtgcggagaaggacctgctcgcccgctacgccccggccgacgcggacacgtactggaaatccctctatgacagcgtgcgcacggtgaaccagggtcacgagtccgcgctcgtgccgatgatgctccgcttgatgcggccgtccctgcgcggcatggacctgcgctaccccggcctgcggtggatgctggtgcacttcgtgggcgacatcatcgcctaccagacgaaccccgccgacccggacgtctacacgggcatccaccgcaaggtcgccgaggccctgggccgcctgcgccagcaggccggtgacaccgctccgctctgcgtcatcgcgcacagcctgggcagcgtcatcgccagcaactacttctacgacttgcaggctcagcgactggccgggcgggacatcatcgaggagacggtgcgcgcggcccagggcagctcgcccctggagcgcggcgagacgctcagccacttctacacgctgggcagtcccatggccctgtggagcctgcgctatccccacgcggagctcgaccagcccgtgcaggtccccgcgccggagctggcacgccaccatccggggcttcgcggacggtggctcaacttccacgacgaggacgacgtgttcgcctggccgctccaggccctcagcgccgcctatcacgccgcggtcgaggaccgcgccgtgagcgtggcgggcccgctcttctcgtggacacccctggtccaccccttctactggtcggatgacgcggtgatgcgggacatcggcacgtcgcttgccggcgcgtgggtgcagctctccagcgccgcggccgtggcctcctag

SEQ ID NO: 4892 - DNA, 453 bp, Myxococcus xanthus
atgtcggacgacttcacgcttcctgaagacaaggccgagcggatggagcgctgcgcgatcttctacaccgacgtcgtgccccacaatcacgcgctggggctgcggctggtggacatccgcgccgccgaggccaccgtcgagctgccctacgcggagaacctcgtcggaaacccggaaaccggcgtcatcgccggcggcgcggtgacgacgctcatcgacgccacctgcggcaccgccgttttcctcaggctgggccgcttcgccccgctcgtcacgctggacctgcgcatcgactacctgcgccccgcgcggcccggcatcgttctcacctgcgtggccgagtgctaccggctcacccgccaggtggccttcgtccgcgcgttcgtccaccagggcgacccgggccaccccgtggcttccgcccagggcaccttcatgcggacagaggaatga

SEQ ID NO: 4893 - DNA, 1290 bp, Myxococcus xanthus
gtggagggcatgttctcggaggtcttcaccgcgtgcgcgggcgcgacggtgctcaccgcctgggccatcgcgctgaagctggggcccttcctcgtcggcgtgatgacggccctgcccttcttcgcgcagttcgtgcagttccccgcggcctggctgacgggcctcttcggccaccggcgcgtggccctcaccgcggtgtgtctgtcccgcgtggtgatgttccccctggcggtgctgccctggctgggcctgcccttcgaatcccagcagcgcctgctgctgacggttgccggcgtctccgccgcgttgagcgtggtgggcaacaacgcctgggtggcgtggatgggggaactggtgccccgcgccgtccggggccgcttcttcggacgccgcaccgcgctcaccacgctggcgggcacactcgcctccctcggcgcgggcctcctgatggaccggctgcgccccacggacggcgtgggcgtggccctgcccctgctcgcgttgggggcgtgcgtcatgggcatcgtcaccaccctgttcatggcctcgcagcacgacccggcgcccccgggcaccaccccgcccctggatctcaagggcgcgctggtcccattcaaggatgacaacgcgcgccgggtgctcacctaccaggtggcctggaacgcggcggtgggggtgtccgcgcccttcttcgcgctacacagcctccagaacctccagatgaccttcgtcatcatggcgctgcatgccgcgtcggtggcgggcgtgcgcatcctggcggcgccactctggggccgcgtgattgaccgctgcggcgcccagcccgtgttgatggcgtgctcactgggcatcgccgccatccccgccctgtggctgctgccttccgcggggacgctgtggcccctgctcttcgacgtcgtcctcgccggggcgctgtggagcggtcacggtctggccatcttcgagctgcccctgaccgtcgccccccggaagaaccgccccttctacctggcggccttcgccaccgccggcggcctggcctataccgccgcggccgcgctgggaggcgccatcgccgccgccctgcccacccagttcaccctgggcggccacgtctgggtgaacctgcacgcgctcttcgtgctgtcctcggtggcccgcctgggcgcggccctgttgacggcgcgcatccccgagcccggcgcccaccccgtgcgctccgtgagagcgctgctgtcgcgcctgctcccgcggccaattcctgctcaccgcgcagcgttggatgattga

SEQ ID NO: 4894 - DNA, 465 bp, Myxococcus xanthus
atgacgaccatgtccgagtccacgacgcctcccctcgccgagttggtgcgccaggtacgcaagacgcgcgagtacaagcgcctcaccgacgccatcccctacacgcgtttcatgggcatcggcgtggagaacctcgccggcgagatgctctgccgcatggccttcaacccgaggaacatcggcaacagcctgattcccgcccttcacggcggcacgctcggcgcgctgctggaatccgccgccgtcttcgagctgctgctgcagacgaacaccgagcgcgtgccgaaggtcatctcgctcacggtggacttccttcgctccggcaagccgcaggacaccttcgccaaggcgttcgtcacccgccagggccgacgcgtggccaacgtccgggtggatgcgtggcaggacgaccgcacgcggcccatcgccagcgcgcacgcgttgttcctgctgtcagagccgtaa

SEQ ID NO: 4895 - DNA, 720 bp, Myxococcus xanthus
atgggtggcgtggtggcgggcgcgctcgcactgggcggcggcgccctggcgcagcagaacggcacggacgacacggagagcatggtccgcatgggccgtccggaggccatcgaccaggggcaggccccggagccgttcgaggaaggcacagggggcgccggttcccagggcactccgcctgatgcgcgcggcgtggcgctgctgcggcaaggcctgctgcccatccccaccgacgaaaaggccttcctcgacgagctccaccaggccaaccagcaggaggtgaagctgggccggctcgcacagcggcaaggcagctcccaaggcgtgaaggactacggcgcgcggctggtgaaggaccacgggcaagcagaccaacgcctcatggcctacgcccggaagcagaacctgacgctggccgagccccaggcggacaccgacttcgccaggacgatggagcgcgcggaagaagcgtcgatggcgaaactccagtccctccagggccccgcgttcgaccgcgccttcctggccgccatggtgggcgaccatgacgcggacatcgccaaggtgatggcgggtcagcagcagttctccggcaacgccgggctgcaagcgctgctcggcgacacgctgcccacgctgcgcgaacaccggcagcaggcgtaccggctgctgggacaggaaactccccgccaggcacgcagggctcccggcggacgctga

SEQ ID NO: 4896 - DNA, 1353 bp, Myxococcus xanthus
atgagttggaagcagcggctggagaaggtctcagagggccattacgtcctggcgaagaccaagagcatgaaggtcgatgcggacctgttcctgtccgacaagttgctgtggggggagggccccgagcaacctggactggaggactctgtctttgaccaggtggtgaatgcggcatccttccccggggtcacccgcgtggctgtcacacccgactgtcacctgggctacggcgtccccattggcacggtggtggaaacggacggcatcctcctgcccaccgccgccggctacgacatcggctgcgggatggtgcagttgcagacgacgctcaccgccgaggacgtcgccgacgccacgaagcgccgccgctggattgaagaggtgacgaagcgcatcgccgtgggcgtgggcgccagccgcgtgcagaagcagcgcagggtgacggaccgcaccttcgcggacgtggtgcgccacggcgccaaggccctgggccggggttcgtccgtcaccgagcgcgactacatccccgtcgaggatgatcgggtagacatccccgagcgcgccttcggcaagcgtgagcaactgggcagcctgggcggcggcaaccacttcaccgagatgcaggtggaccaggacggccgcgtgtgggtgatgctgcacaccggcagccgcggcttcgggtggaacatcgccaagcacttcttcgtggagggcgccgcgcagctgggcctcaagagccgcagcgaggaccatgtctggctggacgcggagagcccgctgggccgcgactactggaacctccacaacatggcggccaacttcgcggtggccaaccggctcatcatcggtgaggcggtgtgcgcggcgctggaggacgtcttcggcggcacggccagcgtgtattacgaaatctcccacaacctcatccagaaggaggcggggaagttcgtcgcccgaaagggcgccacgcgcgcgttccccggaggacaccccgcgctgaagggcacgccctgggagaagacgggccaccccatcctcatcccgggctccatggagacgggcagcgccatcctcttcgccgagccgggcgcacagaagtccatctattcggtgaaccacggctctggccgccgcatgtcgcgcggcgaggcgcggcgcgtgctgaagcaggacgtcaccgacaagcgcatggccgaggcgggcatcctcctcaatacccgccagacgccgctggacgagtccggcccctgctacaagaacctggacgacgtcctggagacggtggagatggcggggctggcccgggtggcctaccggctcaagccggtggcctgcatcaagggcgcggactga

SEQ ID NO: 4897 - DNA, 591 bp, Myxococcus xanthus
atgcagtcactgctgcgagcccaccaggagcaggccgcgcaggtggcccgcgcggtgaccgaggcggaagcggtgctcaagcgtcaggccgaggcggccaaggcccgccaggaagccgcgtcgcgggcacaacacgaagccgccaaggcccgccaggccgagctggcgcgggcggccgccgcggcgagggcccaggggcacgcacctctcccggcagccgcggcccggcccgccaccccgccggagaacgacgcgcggcgcaacggacgggtgcggatgcacacgtccatcgacatgcgcagcgactccaacttcttcacgggtttctcactggacctcagcgagggcggcgtcttcatcgccaccgtggacgcggtgccgcgcggcacgcaggtggagctggacttcacgctgccgggcggccggcccatgaaggtgacgggcgtggtgcgctgggtgcgcgaggccaattcccgcacgccggagctgatgccaggcgtgggtgtacagttcaccgggcttccggcggaagtggccagcgccatctcctcattcatcaccacgcgcgacccgatgttcttcccggactga

SEQ ID NO: 4898 - DNA, 351 bp, Myxococcus xanthus
gtcaacctcgcgcagaagctggccctcttctccgagcactggtccccgaaggtggtgggcgagctgaacggccaacacgtccggctggcccggctccacggccccttcgtctggcaccagcacgacgccgaggatgagctgttcctcgtgctccacggccagctgcgcatggagctgcgcgagcgcacggtggacgtgggcccaggcgagttcatcatcattcctcgcggcgtggagcaccggcccgtggcggaggaggaggtccacgtcctgctcttcgagcccgccaccacgctcaacaccggcaacgtccgcgaggagcggacggccgagcatctgcagcagctctga

SEQ ID NO: 4899 - DNA, 897 bp, Myxococcus xanthus
atgcgcatccaccacctgaactgcaccaccatgtgcccgccgggcggccggctggtggacgggcgaaagggcttcacggggcccgcggcgctgacgtgtcactgcctcctggtggaaggccggcagggactcatcctggtggacaccggcttcggcctggaggacgtgaagcacccccgggcgcggctgcacccgctgctcctcaagggaatccggccccggctcaacgagggccccacggccatccgacagattgagcgcatgggcttccatgccgaggacgtgcgcgacatcgtcctcacccacctggactgcgaccacgctggcggcctgagcgacttccctcacgcgaagatccatctcttgtgggatgagtaccagcaggccctggcccaggcgacggcgagggaccggagacgctaccggccacagcagtggcctccggagacgcagtgggtgacgtatccctccctgggggacggtgagcgctggttcggcttcgagtgcgtgagggatttgacgggcctgccgccggaaatcctgctggtgccgctgccgggccacaccctgggccacgctggcgtcgccatccagaatggaagcggttggctgctgcacgccggagacgcgtacttctaccatggggagatggccccggaccggtaccagtgcaccctgggcctgcgcatcgcccagaaactgaatcagacggatggctatctgcgctggcacaacatgcgcaggctgcgcgagctggtgcatcggcacggacgggacgtcacggtgttctgcgcgcatgactcgctggagttcgagctgctggaggagcaggagaaagcgcctgagcggtcgcccctgcggaccttcgtggacacccggccgccgctgcacgcgtga

SEQ ID NO: 4900 - DNA, 868 bp, Myxococcus xanthus
atggactgcggcatcgccattgacggctgcggcggcacgctcggctgcggcgcctgtggccccggtgaggtgtgcggagggggtggccggcacaacgtgtgcggaccggcgccctgcgagcccaccacctgtgaggccctggggaaggattgcggaccagtctcggatggctgtgaagacgtgctcgactgcggcacctgcacggcgcccgagtcctgcggcggcgggggcacacccaacgtatgcggcgagcccacctgcacgccggacacctgtgagtcgctggcgcgcgactgcggcgccgtcccggacggctgtggcggcatgctcgactgtggcgtctgcgcggacggactgacgtgcgggggcggcggcgcgcccaatgtgtgtggccacggcatctgcaagcgggccacctgcgacgtgctggggaaggactgcgggccggtgtccgacggctgcggcggcatgctcgactgtggggcctgcgcaggcggcctgacgtgtggcggcgacggcgtgcccaatgtctgcggcaactcgccgtgtacgccggggacgtgtgagacgctggggaagaactgcgggccggtggcggacgggtgcggcgacatgctcgactgcggcgtctgcgcggacggccagacgtgcggcggcgccgagcccaacgtgtgcggcggcggcgtgtgcaccccgctcacctgcgagtcccaggggaagaactgcggcaccgtgcccgatggctgcggccgactccttcactgtggcctctgcccggcgggcgagacatgcggcggggggcgcgtggaccacgtctgtggccatcccctctgcacaccggccacctgcgagtcgctgggcaaggact

SEQ ID NO: 4901 - DNA, 447 bp, Myxococcus xanthus
atggcgcggcccgtcccactgaggttgcaggtcgtctcttccggagatgagcccggcgtcgagtccgtggtgggatttcccatccagggactcacggatgggttcgtggggctgggcctccatgcgctgctcgtgcaagaggccatcaaggacctgtgcatctatgcggggctcacgggagcggattctcgcttctggcaggacaccgccttcttcctgggcctctcgggccctcgagcgcccgagcaggacctgttggtggagcagcttcaagagcggctccttccggcggtcagccgtcgctgcggccttgccttctttccgaggcttcagaaggtcttggctcgtgggcacgtgtccgtgctcgcggccatggctgaagcaggcgaggccatcgcttccggccaggtccagcgggcgctcatcgtcggcgtggacagcccgtag

SEQ ID NO: 4902 - DNA, 1995 bp, Myxococcus xanthus
atggagcgcttcaagaaggtcctcatcgcgaaccgcggcgagattgccgtccgggtgattcgcacctgccatcggctgggttacagcaccggggcggggttctccgaggcggaccgcggcgcgccgcacgtgctggcggcggacgaggcggtggccattggtccgtctccggcgaaggagtcctacctcgtcatcgggaagattctggaagcggcgaagacgtccggcgcggaggccatccacccgggctacggtttcttgtcggagaacgcggacttcgcgcgcgcttgccgcgacgcgggcctggtgttcatcggcccggaggccgaggccatcaccctgatgggcaacaagcgtcaggcgaagctgcgcatgattgcggcgggcgtgccctgcattcctggctacgaggcgtccgacctggatgatgaggcgctggcggtggagggcgagcgcatcggcttcccgctgatggtcaaggcggcggcgggtggcggcgggcgcggcatgcggctggtgcacgaggcatcgcagcttcgcgcggccctgcgcgcggcgcgctcggaggcgacgaatgccttcgggagcggggagctcatcctggagaaggccgtcatcgacgcgcggcacgtggaggtccaggtcttcgcggacacgcacggcaacgtggtgcacctgggcgagcgggactgctcggtgcagcgccggcaccagaaaatcgtggaggagagtccgtcaccggcggtgagcccggcgctgcgcgcgcgcatgggtgaggtggcggtggcggcggctcgggcgattggctaccggggagcggggaccatcgagttcctcctcgctccgagcggtgacttctacttcatggagatgaacacacgtctccaggtggagcacccggtgacggagctgattaccgggttggatttggtggagtggcagctccgcgtggcggcgggggagacgctgccccggacgcaggaggcgatttccgcgtcggggcatgccatcgaggttcgcctctgcgcggaggacccggcgaagggctacgcgccccaggccgggcggctgctggcgtggaggctgccgctgcgtgagggcgtgcgcatcgaccacggcgtgcgggaggggcaggagattccgcccttctatgactccatgcaggcgaaggtgattgcgcacggcccggaccgggagacggcgcgccggcggctggtggaggcgctgcgcgagctgacggtgttcggcgtcaccaccaacaagaacctgttgttgtacgtgctggagcacgcggcgttccgttcaggggagtacgacacggcgttcatcgcgaggcacgcggcggcgtcggaggtggaagggctgtatcaggcagacgcgaaggcgcgggcgctggcggcggcgctgctcttccacgacgaaggcctgaagctggcggacacggcgggtctggatgtgtccctgctgaattggaacacgtcccaccgccaccccgtgcggatgaagctcgtgagccgtggcgcggaagcgtccgtcaccgtccagcccgtgtccggggaagggtacgaggtggacgtgggggattcgtcgttcgacgtgtccgtgttggggctgtccgcgggcgtgctcgacttctccagcgccgggacacggggccgcgcacgctacctgcgggacggggacacgctgtggctggacctgggctcgggcgcgcacgccgtgacggacgtaacgttccgtccgccgtcgaagtcggacggcgtgggcagcggacggctggcggcgcccatggatgggcgcatcctgcgcgtggacacgcaggtgggcgcggcggtgaagcccggggacgtcctggtggtgctggaggccatgaagatggagttccaggtggtggcggacgttaggggcaccgtcgcggagctcaacgtgtccgtgggcagccaggtgaaggcgaagcagctcctggtgtcgctggctgcggagaagacggcctga

SEQ ID NO: 4903 - DNA, 1617 bp, Myxococcus xanthus
atgccacgcatcacctcgcgaatcgacccgggctccgaatccttcaaggtgaaccgcgcggacatgctggcccgcgtttcggagttgcgcgccatcgaggcgaaggtccgcaacacggagaaccaggcgaaggagaagttccacaagcgcgggcagctcctgcctcgggagcggctgatgctgctgctcgaccggggctcgcccttcctggagctgtccacgctgtgtggctatggctaccacgacgacagtgacggctcgctggcgggcggcaacagcatcatcggcattggctacgtgtccggcgtgcggtgcatcgtcttcgtgaacaactccgccatcaagggcggcaccgcgtcgccgtggggcgtgcagaaggcgctgcgcgcgcaggcattggcgctggagaacaagctgcccatggtgtcgctggtggagagcggcggcgccaacctgatgtaccagcaggaaatcttcatcccgggtggggagaccttctacaaccaggcacggctgtcggcggcgggcatcccccaggtgacggtggtgcacggctccagcacggcgggcggcgcgtacctgccgggcctgtccgactacgtggtgatggtgaagaagaaggcgaaggtgttcctcgcgggcccgccgctgctcaaggcggccacgggggaagtcgccacggatgaggagctgggcggcgcccagatgcacgccacggtggcgggcaccgcggactacctggcggaggacgacgcggacgccatccgcatggcccgcgaaatcgtggcgaagctcgggtggaacgcgcagcttccgcccaccgagcgccccgcctatgccgagcccgtgtactcgcccgacgaactctgcggcgccgtgcccgtggactaccgcaaaccctacgattgccgcgaggtcatcgcgcgcatcgtggatggctcggagttcaccggcttcaaggacgagtacgacgcgcacaccgtttgcggctgggcgaacctgtacggccacccgctgggcatcatcggaaacaacgggccgatttcgccccagggcgcgacgaaggcggcgcagttcatccagttgtgctgccagaaggacacgcccatcctctacctgcagaacaccacgggctacctcgtgggcacgcagccggagcaggggggcatcgtgaagcacggcgcgaagatgattcaggccgtggccaacgcgacggtgccacagctcacggtgctgattggcggtgcgtttggcgcgggcaactacggcatgtgcggccgtccgttccatccgcgcttcatcttcgggtggcccaactcgcgcaccgccgtcatgggcggcgagcaggcggcgaaggtgatgtccatcgtcttcggggagaagctggcccggcaggggcaggtggtggacgaggagcagctcaaggcgttctgccagcccatcatcgaccagttcgacaaggagtcgcatccgttcaactgcagcgcgcggatgttcgacgacgggctcatcgacccgcgggacacgcggcgggtgctcgggttcgcgctgtcggtgtgccgtgaagcgaagcggcggcaggtccatcccaacacgttcggcgtcgcgcggctgtga

SEQ ID NO: 4904 - DNA, 2172 bp, Myxococcus xanthus
gcggagcttcaacgcgtcgtggaactgaggcacccggagccgcacgctgtcctgggtatccacccggatggggatggcgtggtgattcgcgccttccgcccggacgccgtggccatccacgtgctgccggaatccggcggtcgcgtcgcgatgacgcaccggccgggcggcgtctacgaggcccgcatcaacggcaaggaccagacgttcaactatttgctggaagtggagtaccccggcaagcgcgtcttcacgcttcgcgacccgtacagcttcctccccaccctgggggagatggacctgtactacgccggtgaaggccgccacgagcgcctctgggagcgcatgggcgcgcacctgctgcaccaccacggcgtgcgcggcacctcgttcgcggtgtgggcccccacggcggcgggcgtgtccgtggtcggtgacttcaacggctgggacggccggctgcactccatgcgccgcatgggctcctccggcatctgggagctcttcgtccccgaggtgggcgaaggcacccggtacaagttcgagattcgccccggccagggcgggcccaacgtcctcaaggcggacccgttcgccttccgtaccgaggtcccccccgccacggcctccgtggtgcacgacctggcgcgctacacctggggcgacgcggcgtggctggagcaacgcgcccagcggcgggacgtccatcaccaaccgtggagcgtgtacgaggtccacctgggcagttggcgccgggtggtggaagacggcgaccggcccatgacgtaccgggagctggccccggcgctggccgagtacatcaagttcaccggcttcacccacatcgagctgctccccgtggccgagcacccctacggtggctcctggggctaccaggttggcggctactacgctcccacggcgcgcttcggccacccggatgacctgcgcttcttcatcgaccacatgcaccaggaaggcatcggggtgctcgtggactgggtgcccggacacttcccgcgcgacctgcacgccctgggacagttcgacggcacggccctgtatgagcatgccgacccgcgcaagggcgcgcagccggactggggcacgctggtcttcaacttcggccgcaatgaggtgcgcaacttcctcatcgccaacgcgttgttctggatcgaggagtaccacatcgacggactgcgcgtggacgcggtggcgtcgatgctctacctcgactacagccgcaagcagggcgagtggattcccaaccgctggggcggccgggagaacgaagaggccatccatttcctgcgcgagctgaacgaaacggtccaccgcaagcacccgggcgtcgtcgtcatcgccgaggagtccacggcctggcccaaggtgtccgcgccggtgtccgaaggcggcctggggttcgactacaagtggaacatggggtggatgcacgacacgctgtcgtacttctccaaggaccccatctaccggcagtaccaccacaaccagctcaccttcggcctgctgtacgcgttcagcgagcagttcatgctgccgctgagccatgacgaggtggtgcacggcaagggcagcctgtacgggcgcatgccgggcgacccgtggcagaagcgcgccaacctgcgcgccctgttcgcgtggatgtgggcgcacccgggcaagaagctcgtcttcatgggcggcgagttcggccagcccgccgagtggaaccacgacaagagcctggactggcacctgacgcacgacccggggcaccacggcatccttcaactggtctcggacctgaaccgcatctaccgggacatgcccgcgcttcacgacgcggatggcgagcccatgggcttccagtggctccagccggactcggccgcgtacaacgtgttcgcgttcgtgcggcgcgcgcgtcagccaggacggcatgtggtgtgtatcgccaacctgtcgccaacggtgcgtgagaactaccgcgtgggcttcccgttccagggccgctacgtggagttgctcaacacggacgccgagcagtacggcggctccaacctgggcaacatgggccagattcacaccgagcccacgggctgggatggccagccggcttcggccaccctcaccctgcccccgttgtccgtgttgtggttcacgccgggctga

SEQ ID NO: 4905 - DNA, 1710 bp, Myxococcus xanthus
atgcctgcatcccccctgcgtgtcggcaatgcctcgggcttctatggagaccgcttctcggcggtccgggagatgctcgaaggcggccagctcgacgtcctgactggcgactacctggccgagctgacgatgctgatactgggccgggaccggatgaaggacccgtccaccggctatgccaagacgttcctgaagcagatggagcagtgcctggcgttggtggtggagaagaaggtcaaggtcgtcaccaacgcgggagggttgaacccctcggggttggccgccgccctgcgcgaggtcgccgcgaagctgggcgtgaaggtgcgcgtggcgcacgtggagggagatgacctctccgcgcaggcggatgcgctgggcctgggctcgccgctcaccgcgaacgcgtacctgggcgggtggggcatcgctgcgtgcctgcgcgcgggggcggacatcgtcgtcacgggacgggtgacggatgcctcgctggtggtgggcccggcggcggcgcacttcggctggaaggtggatgactgggaccggttggcgggggccatggtcgccggccacgtcctggagtgcggcacgcaggccacgggcggcaacttctccttcttcacggagctggacgcgcggcgccccggcttcccactggcggagctgtacgaggacggcagcagcgtcatcaccaagcacgcgggctcgggcggcgcggtgacggtggatacggtgctggcgcagctcgtctatgaaatcaccggggcgcggtacgcgggcccggacgccacggcgcgcttcgacaccatttccctggcgtcacacggcaaggaccgcgtccgcgtctcaggcgtgcgcggcgagccgccaccgcccacgatgaaggtgtgcctcaacaacctgggggggtaccggaacgaggcgacgttcatcctggtggggttggacatcgaggagaaggcgagactggtgcgcgagcaactggaggcggcgctgacgcgcaagccgaaggaactccagtggatgctgacgcggacggaccgcgaggacgcggccaccgaggagcaggccgccgccttccttcgcgtggtggtgaaggacgccgacgcgaaggtggtgggccgggccttcagcggcgcggccgtggagctggcgctgggcagctacccgggcttcacgatgacggcgccgccctccgacggcgcgccgtatggcgtctacacgcctgcctatgtcgaagcggggcgcgtggagcatgtcgccgtcctcgaggatggaacgtgcaccgccatcacgcctcccggggagacgcgctcgctggagcccgtggagccacctccgctgccgccgccagtgccgggcggtcccacgcgccgggttccgctgggacgcatcgtcgccgcgcgcagtggtgacaagggcggcacggcgaacatcggcgtctgggcgcgcacggacgcggcctggcggtggctggcgcatgcgctcacggaagagaagctgcgcgagctgctcccggaggccgcgccgctgcgcatcgagcggcacgtcttccccaacctgcgggggctgaacttcgtcgtggagggtctgctgggggagggcgtctcctcgtccacccggttcgacccgcagggcaaggccctgggcgagtggctgcgctcgcggcacatggacattcccgaggcgctgctgcgcgaaggacaggagtag

SEQ ID NO: 4906 - DNA, 348 bp, Myxococcus xanthus
atggccacgtgtgacttcatggccgccgaaccgggttgccccacgggcaccgtgtgcggcgtccagggtctgtgccaggagcaggccgtgcaggtggccagtggcttcgacttcgacccggccctcatcggcgaggagtgcaccctgggctacgcggagttctgcggcgccgagggcgcgcgcggcgtgtgtctcgacctgaacggcacgggccgcggcacctgcttcccctacacccgtgctcgctcggactgcggccctggtgaggagctgggctacgtgtcctacccgctcgcgggtggcggctacgaccgcacctacggcttctgctacccggacggcctctga

SEQ ID NO: 4907 - DNA, 465 bp, Myxococcus xanthus
atgcccgtctctgtcgtcgaaggggatttgctggaccagccggtggaggccatcgtcaatgcctggaaccggaacatcatcccctggtggctgctgctgccgcagggagtgtccggcgccatcaagcgccggggcggggtcgggcccttccgcgaggtggcgagggcaggccccatgcccctgggctcggcggtggtgacctccgccgggcggttgccattcaaagccatcatccacgtggcgggcatcgacatgctgtggcgcgcctcggagcgctccatccaggactcggtccgcaatgccctggcgaaggcccgcgagcagggatttcgctccgtcgccttccccgtcattggcgcgggctccggaagctttgatgaagcacgcgcgctggagctgatgcgccaggtcctggatgtggaagctggcgccctcgacgtgagcgtcgtgcgcttccggccatag

SEQ ID NO: 4908 - DNA, 2769 bp, Myxococcus xanthus
  unsure (1)..(2769): unsure at all n locations
atgtaccaccgcgccggcggcgagggcgtgcagctcaccgagcgcaccaacgaccagaaggatttgggcgagcccgccttctcacccgacgggcgccacgtttacttcagccaggacgtctcgccggggaagagcttcgaatacaacaaggaccccaacggacagatctacgccatccagcggttggatttggagacgaaggaaatcgagcccttcatcacgggccccggcggcgccatccgccccacgccgtcacgtgacggcaagcagctggccttcgtccgccgggtgcgcgccaagagcgtgctctacgtcaccgacgtggcgtccggcgcggagcgcccgctgtacgacgggctcgaccgggacatgcaggagacgtgggccatccacggcgtgtatccgggcatggcgtggacgccggacaacaaggcgattgtcttctgggcgggcggcaagctgcaccgcatcgacgtggccacgaagaaggtgacgcccatcgccttccgagtgcggggcacgcgcacgattttcgaggcggtgcgcagcccgcaggcggtggcccccgagcgcttctccacgaagatgctgcgctgggtgcaggtgtcccccaagggagaccgcgtggtgtaccaggcgctgggtaagctgtacgtgaagcagctgccggcgggcacgccccggcgcctgacgaagcaggatgaccacctggagttctatccgtcgttctcccgggacgggcgttccatcgtctacacgacatgggacgacgagaagctgggcaccatccgcgtggtgcccaccaccggcggcgagggcaaggtgctgacgcagcagccgggctactacgtggagcccgcgctcagcccggacggcaagacgctggtgtaccgcgcgtccggggacggctacttgatgcccgggctgtggagccggaacacgggcctgttcgccatgcccgcaggtggcggcgcgccgaagcgcctggcgcgtgacggtgagcagccgcacttcggcgcgcgctcggaccgcgtgtacttcctgcacgtggaacacaaggagaaggaggacgtccgctccctgaagagcatcgggctgagcgggagcgaggagcgcacgcacctgaccagcgcggaggccaccgagctgcgcgtctccccggacgagcggtgggtggcgttccgggagaacttcaacgccttcgtcgtccccttcgcactgggcgcgaagtcggccacggtggggcccggcgcgaaggcgctgccgctggcgaaggtgagccgggacgcgggcgagtacctgcactggtccggcgacagccagcgcctgcattgggcgctggggcccgagctcttcacgcgcgcgctgaaggagagcttcgccttcatcgacggtgcgccggagaagctgccggaggcgccggagaagggcgtggacctctccttcccggtgaaggcggacgtgccggagggcacgctggccctggtggggggccgcgtcatcaccatgaagggtgacgaggtcatcgagcagggcgtggtggtggtgcgaaacaaccgcatcgtcgccgtgggtccggtgggcaaggtgcaggtgccgtccggggcgaaggtggtggatgtgaagggcaagacgttgatgcccggcctcatcgacgtgcactggcatggggccatgggcatggacgggctgatgcccgagcagagctgggtgcatgcgtcgtccctggccttcggtgtgacgacgctgcacgacccgtcgaacacgtcggaagaggtgttcgccgccagtgagctggcccgagcgggcggcgtggtggcnccgcgcatcttctccacgggcaccatcctctacggcgcgtccggcgcgggctaccgcgcgcccattgaaacggtggacgacgcgcgctcgcacctgcggcggatgaaggccatgggagccttcagcgtgaagagctacaaccagccgcgcagagaccagcggcagaaggtgctccaggcggcgcgcgagctggacatgctggtggtgccggagggcggctcactgctccagcacaacctgacgatggtggtggacgggcacacgggcgtggagcacgcgattccggtggcgcgcatctacgcggacgtgaagcagctgtggggcaagagcggcaccggctacacgccgacgctgggcgtggcctacggcggcgtctggggtgagaattactggtaccagaagacgaacgtgtgggaggacgagcgcctgttgtccttcgtcccgcgccgggtggtggatgcgcgcagccgtcggccgtccatgcacgtgccggacgacgagttcaaccacttcgccgccgccaccgtggcgcgcgagctgagtgacgcgggcgtgagcgtgcagttgggcgcgcacggccagcgagaaggcctggcggcgcactgggaggtctggatgttcggccatggcgggatgaagccgctccaggcgctgcgctcggcgacgctgagtggggcgcgctacctgggcctggacggggagattggctcgctggaagagggcaagctggcggacctcatcgtgctggatggcaatcccttgcaggacctcaagcacagccgctcggtgcgctacaccatggtgaacgggcgcctgtacgacgcggccacgctcaacgaggtggggacgcgccagcgcacgcgcgcgaagttcttcttcgagaaggacgggaacgaaggctggagccccaaggccacggagcacacgcacacgcacgcgtgcgactga

SEQ ID NO: 4909 - DNA, 585 bp, Myxococcus xanthus
atggccgcgcagcaggctccggcgaagcctcccgcggtccggcaggacccgccacggccggcacccgacacgaaggacgccgcgcgcgacgcggcccgcgccgccgaggtagacgccccgcgtccgccgtccggtgaggccgcgcagaaggcggagaaggaagggggagacacctggaaggtggacgcgccgggcttccccgcccgccaagtgaacatcgacgtcaccgagggcacgtggatgaacgtggacgtcagcccgcgcggagacgaaatcgtcttcgacctgctgggggacatctacgtgctgcccatgggcggcggcgaagcgaaggcactgacgtccggcgtcgcatgggacatgcagccgcgcttcagcccggacggcaagcgcatcgtcttcaccagtgaccggggcggcggagacaacatctgggtggtggaccgggacggctcgaatgcacgggcggtgacggaggagaagttccgcctgctcaacagccccgcgtggagcccggacgggcagttcatcgtggcgcgcaagcacttcaccgcgcggcgttcgctgggcgcgggcgaggtgtga

SEQ ID NO: 4910 - DNA, 1416 bp, Myxococcus xanthus
ccgatgtccgcatgtccggatgagaacctgctcgcggccttcgtcagtggctcggctcccgtggggaaggtggcggtggtggaagcgcacctcgacggttgcgcggactgccgggcgttggtggcggcggtggcggccagttcctctctgccgggcgcagtcgtcgttgagcgtgaggcggaggcgcccacgcggtgggacacgggcgcggcgacgttgccggacgcgcgggaggagccggtcctgccgccagggacgcggctgggggcctatctgctgcagggcgtgttgggcatgggagggatgggcgtggtgtacgcggcggatgacctgcggctggggcggcgggtggcgctcaagctgttgaggccgctgctcgcgggcgcgcaggaccagggtcgtgagcggctgcttcgcgaggcccaggccatggcgcggctctcgcatcccaacgtgctgccactcttcgagctggggacggcggaggggcacgacttcctggccatggagtgggtggacggcacgacgctcgcggactggcttcgggaacgcgagcgtccatggcgggacgtgttggatgtcttcctggcagcgggagcggggctggccgctgcccatcgcgcgggggtggtgcaccgtgacttcaagccgtccaacgtgctggtggggcgggacggccgggtacgcgtcacggacttcgggctcgcgaggcgcggcacgggcgagtctcccgaggcgccggccggtgtgagcgagggtgcatcgaaggcctccatgctcacggagtgggggcaggccgcgggaacgccggcgtacatgtctcccgagcagcgcgcgggaagggccgtggacgcccgcggcgaccagtacagcttttgcgtcgcgctccacgaagcgctccacggtgagcgtcccggccaccttgctgcctccgccgcaccgcgaacgtcgagcgtgccgaggcatctccgcaccgcgctggcgcgggggctcgcgaacgcgcccgaggaccgcttccccagcatggaggcgctgatggcggcgctctccctgccttcgccggcatggggccgccggggcatcctggccctggcgggagcgggttccctggtggtcctgggcgtgctcctgtggaagccgtcttttctgttccagtccgacgccgccacgccgcgagccgagagcctcgggcgtatggccgcatcgctgattgtcctgcgcgtcggcgacgtgcacgaactggccgttcctggactccagcgcatcgcggtgggcgaaccgagcctcgtcgaagtcaccgtgccgcgtcagggcgtggtgcgtctgaaggggaaggaggagggcagcacggacctgattacgtggagtcacgccggggagatgaagtcccgagtcctggacgtcaccgcgcgctga

SEQ ID NO: 4911 - DNA, 162 bp, Myxococcus xanthus
atggtccgcatcgcgattgacgaaccggagattgcggacatcaaggcgctcggcaaaggggtgctgcgcatcatcggtaagcaggccggtgagacagcgctgctcgtgtgggtggggcccgagaacaagcgcagcagctaccgcatcgtcgtcaccgattga

SEQ ID NO: 4912 - DNA, 915 bp, Myxococcus xanthus
atgcgaacgcagcagagccgctcgctcgtcttcctccagcagctcggctccgggacacgcgagggctacgaggccctgtccggactggaggacacgctggtcgcgctctgcgccgcggcgcggcaggcctggccgggcgtgacgctggcggaggaagacttcctacgccaccttgcttcgtgcctgccacgggacgaggacccctcacgggtgctggcctccgtgcatgccgcggacctctatctggcgtgcgcctgtgtgcgggggaacgccgcggcgcatgtcgcgctggagcgccacgttcttcccaaggcggcggcgtccttggctcggatgcgggacacgggtgtggacccctccgaggtggttcaacacctgcgcgagcggctgctcgtcccagaaggtgaccggcccgcacgcatggcggaatacctgggcagtggtccgctcgcggcttggttgcgcgcggcagcggtgcgcaccgccctcaacctccagcgctcggagcgccggagggcccacgccgaagaggaggcggaggcgctcccgctgccaacccatgcgggcatggcggacgtcgagttggactacctgcgcaagaaccaccgcgagcatttccaggcggcgctctccgaggcactgaatgccctgcccacgcgggagcgcaccgtgctgcgcttgcacgtggtggaggggctgagcctggagcgcatcggcaccatgtaccagacgcacaagtccaccgtgtcgcgctgggtggcccgtgcccgggaagcggcgctggagggcacacgtcagcggctggcggagcggcttcggctcacctccggcgaactgcacagcctgatgcgggtggtacagggagagctggacctgagcctgccgtccctgctgagcagccctggggcttcctga

SEQ ID NO: 4913 - DNA, 2031 bp, Myxococcus xanthus
atgtccgtcgcgcgcgagcgcttcatcgccacctacgaagccctgaagcgccggctcacccaggagcccctggccactcaattggaggccgtctcccacgcggagctggagcacgaggaggccatgcaggcgctcatcatggagcgcgaggacggcgtgccccgccagcggctggagcagattttcgacggccacgtggcggacacgcgccgccgtgtcatggacagcctccggatgctccaccagcagacggagacccggctgtccgagggcattcatgagagcctggccacggaccgcagcgcgcttgggctgtccctgctcgcggggagcctgggcctcgcgggcgccacgatgctggcgtggacgctgacgcgcaagctgcggcccatccaacaggaggccgaggccagcgccgagcgctttcagctcctcgtggagggggtgcgcgactacgccttgttcctgctggatgcgcggggccgggtggagagctggaacccgggcgcggagcgcatcatgggctaccgggaggcggaaatcctgggccagccctccagcgtcttctacccgccggatgcggttgcggcggggattccggacaaggacctggtgcgggcccggaaggatgggcggctgcacacggagggctggcgagtgaggaaggacggctcgcgctatctggcggacgtcaacgtcaccgtgctccaggacgcgcgcgggctgccgcgcggcttcgccaaggtgacgcgcgacatcaccgagcggcgccgggccgagcgcacgcagcaactgctggcggaggcgggaggcctcttccaccagttccaggacccagaccagacggtggccgagctgacgcgcatcatggtgccggaggtggcggacgcctgcctgctctacctgctgtcggccagtggtgacctctggcctcgcgcggtggcgcacgcgatgccggagaaggaggcgtggctatgggacgcggcgcggcgctttccgccgccaccagagtctccatggggcatctggcaggtgatgcgcacggggcgctccgagctcaagagcgacgtgtctccggagaccctggcccgggggctggtgggccccgagcacctctcgttgatggagaaggtgggcgtgcgctcctacctcggcgtgccgctgcgggtggggcggcagactcgcggggtgtttgtgctgctgacgtccgcgccggagcgccggctgacggtgacggaccaggtcttcgtggaggaggtggcgggacgtgccgcgctcgcgctggacaacgcccggctctggagcgaggcgcaggacgcggtggagctcatcggcgtggccgcgcacgacttgggcaatccgttgaacacgctgcagttgctcctgcgaaggcttcagcggatggaactcgcggaggagcagaaggcgcgcgacgggctggcggcggcgctgaagcagacgcagcggctggggcagctgctgcacaacttgctggacctgtcgcggctgtcatcgggaaagctgatgctggacgtggcgccggtggacctgtcggacctggtgcacgaggtggtggagcgcttcgccgaacaggctgcggaggcgggctgcaagctggagttcggcgcggaattggggctggtgggccggtgggaccggctgcggttggaccgggtggtgacgaacctcttgtccaacgcgctgaagttcgggagggggcggccggtggaggtccgggtggagcacgcgggcgtggcgcgggcgcggctgtgcgtgagagaccacggcgtgggcattgccccggaggcgcagcggcgcatcttcgagcgcttcgaaagagagccctccggcggccagcatgcgggcttcgggctcgggctctacatcgtccggcagttggtggaggcgcacggcggcaccatccgcgtggagagtgcccccagcgagggcgccaccttcatcgtggagttgccgctgatgctgctgggctcggagctgcgtgagccacccgatattcccctgcactcgtga

SEQ ID NO: 4914 - DNA, 180 bp, Myxococcus xanthus
atggccgggacaaatcagtgcgcgcaggccgtgcaggaacagcgccgcgcggtggagaagctgccagccgagtggcccgctccagagcgcgagcgcttcattcgggcgctggagcattaccagcgcgggtgcatggcgccgaacgccgactccgcatcagcgccgactctgggaatttga

SEQ ID NO: 4915 - DNA, 1649 bp, Myxococcus xanthus
cggatgattcgcatccgccagcgctaccctgtcttctcgctggggaacctgcgcttcctccagacggacaatcgcaaggtgctggccttcatccgtgaatgggagggccagacggttctggtggtgtgcaacctgtcgcgctttgcccagcccgcggtgctcgacatgcgcgagtgggaaggcgccgtgccggtggagctgattggagaaacccccttcccgcgggtgagtgagctgccgtatcagctctccatgggccccttcatgtttctgtggttccggctggacaggccccagcaggtgaggagcctcgaatgacgaccctcgacttgaccaagctccctgattacctcaagcaccagcgctggttcagcggcaaggcctggcccatcaagcacgtcacggtgatggaccacgccgccgtcgaatcgggcggctgctcgttcagcctcgccgtggtggaggtcatctacgaactgggcagcccggagcgctacctgctgcctgtccatccctccaccgaaggcgtgcgagacgcgctggagagcgatgaatgcctgcgcggcctcttcgacctcatccgaaccggaggccaggtggcgtccgcgtccggccgcgtgcaaggcgagtggattggcggtcaggacggcttgctcgcgctccccgcgtcaccggaggtgcggcggctgcaggtggagcagagcaacacctcggtggtgctgggtgagaaggtcatcctgaagatcatccgcaagctggaagccggcgtgaatccagagcatgaggtaggccgcttcctcgcgaccaagacatcgttccgcgccacgcccacgctgttgggcgcgctgcatctggaaggggcggcgggcgcgacgctcgcggtggcccaccgcttcgtgccggacgcgacggacggctggaagtacacgctggaccggctgcgccaggagcgcgccgtgggtccgcgcttccagtcggagatgcgtgacctgggcacacgcctgggcgagctccacctggcgttcgcctcggcgaccgaagaagacccggccttcactccggagccgctgttgcaagaggatctccaacgctggagcgcctccatcgtcggggagctgggcgtgacgctggcggacgccagccggcagaacccggaactggagaaccggcgcgaggacctcatcgagcacgcgaagcgcctggcgcaggtgccgccctccggtcagaagattcgcatccacggagatctccacctggggcaggtgctgcgcgccaacaaccagtggatcatcttcgacttcgaaggcgagcccgcgcgctccttcaccgcccgccgggagaagtacagcgcgctgcgcgacgtggcggggatgatccgctcgttcgactacgcggaggcgacggtggcgctggagggtggcacgccccacgagcgcatcagcaccatgcgcgacgccttcgtggaaggctaccggcaggtgacgcgcggcgcgcccttcctgccctcggacgaagacaccttcgacgtgatgctgcgtgctttcgagctggagaaactcctctacgaagtgcgatacgaaatgcagaacgggccggactgggtgcgcatccccctccaggccctcttgcgtatggaggcatccaagtga

SEQ ID NO: 4916 - DNA, 1248 bp, Myxococcus xanthus
atgggcgccttccacgccatcttctgggggacggcgaagctcctcggaaagccctacgcggacatctcgctggagaccatgcgccgcaacgtcgccgatggctgggagtgggacgaggatgcgttcgcgaccaatgcgctcgggcacccctaccagggctcgttggcctacaccgcggcgcgctcgagcggcttcggcttctggggctcggtcccgttcacggtcgcgtcaagcgtgttgtgggagctgttcatggagtctgagactccatccacgaacgacctcattacaacgtccatcgggggcgtcgtgctgggcgaggtcctgcatcgcaccgcgctcgcgattctcgacgaaggcgaacccacggtggcgcgctcggtgctctcgctgcttgtcgaacccgtgggcggcatcaaccgttacctcttcggccgccgtaagaacgacttcctcccggtgcaggggaacttcctccagttgatggccggcttcacgagcaacgtcgacaactacaacgacatcgacggcacgcgcttcgatgttcccaacaagatggaggggcaccttggcgtcgaaatggtctacggccccccgctgctcaccacgggcgactatgaccagcccttcgactacttcacgctcaccgcgcgcatgggcttctcgcgtgacacgctgacggtggggttcttcagccgggggcttctctacggcgaccgcttcaagttccgctccatatcggggctctggggcttgatggcgggctacgacttcgccaatccgaacacgctgcgcgtttccacggtcagcctcggcatcggcggcgtggcgcaggttcccctcacgtcgcagctcaccctggacgtcaccgcgaacatggccggtgtgccgtttggccatggcggcggtctcacctcgccggagtccgctcgtgactaccacttcgggcctggggcgcagtcggccttcgagctgggcttggtgcggcggggtgtcgggcgcgtcggcgtgtccgtgcgcaactatctcatctcgggcgccttcctcggtgagggcgtggagctcatcacctatgccaccgcgcgagccgagctcctgctcgccggccaacacggcgtggcgctcgaagccttcgtcgccaaccgcgcgggtgagttcggcagcgattccgacgccatccgccagcgtgcaacgcaaatccgtctgctgtggacggtctcgaagggcacgggcttcggaacgcgctga

SEQ ID NO: 4917 - DNA, 207 bp, Myxococcus xanthus
atgtcgtcgtacaaccacatgaagccgccgctgatgccggcgctggtcttccagttgctcatccgggtctgcaccgtggccgggctgtcgcccgacgcgcagccgctgccattcctggaccacaagccgggggcgacagtcatgcccatggcggtgttccaactcgctgggttgttgccggcgccgccggcgtacacttgcaggtag

SEQ ID NO: 4918 - DNA, 153 bp, Myxococcus xanthus
atggcggtgtgcatcgagcggacgcgcgcccgggcggaggcgctgctggcgccgtcgaacctctcgatgcggcaccgccccagtgacttccagggggcgcccgcttcgtcttcgcgggacgcggtgcccatggaggccgcgccgcgctactga

SEQ ID NO: 4919 - DNA, 69 bp, Myxococcus xanthus
atgacgggcacgcgcacgctcatcaacgtccagtactgcctccctggctgcgaaatcgtcatcgactag

SEQ ID NO: 4920 - DNA, 528 bp, Myxococcus xanthus
atgctcgcctgcgcctatccggcggagggcaacgacaaggtgtaccgcaacatcgaggactacctcgcgccagcgctctggagcgcgtatagcaaggacgcctccgaggtgaaggtgaagaagttgaagggggacagcgagtggtgcgacgcgttcccgaacatcgcagccgaccagttcgtcgtccctccgcgaatgaagaaggagctggccgagtacgtgaaacagttcggcgccaagggggtcatcatcccggtcgcgcacatgtaccgctcccccatcatgaaggagatcctggccccggatgggacgcagatcgggagcgtggagaccgagcgcttcggcgctgacggcacggcgggcctctacgtccactacatcaacgagagcggagagctcatctacaccgggcgttcgcggacgaacggcctgggcgtgctcccggatcccattgggtacatgcgcgaccacgcgtcggactacgcacagcagatgacgcagaaggcgcctccggtcgacctgctgtag

SEQ ID NO: 4921 - DNA, 3296 bp, Myxococcus xanthus
ttccgcatcctccatgacctgcgcgtgcggctcgcgaagaagctcggcgccgttccactttcgtttttcagccgtcgtggcgcgggagaactgaagaagacactgatggacgacgtgaaccagctcgaggcgttcgtcgctcatcacttcccggatgcggtcaccgcgctcgtcgtcccgctcgcgacggccatctccctcctgtggattgactggcgcatggcccttgccagcctcgtgatggcgccgctcgccgtcatggcgatggccgtcgccatgcgcgaggtcggcaaggcccatcaacagtggaacgcgctccagagccggatgaaccgctcgctgctcgaatacctgcggggcatccacgtcatcaagaccttcggcctgtccgcgcggcgcttcagcgacctctcaagctccatcgaggaagggctctcgtggatggagggtttcatgcgcaccaacggccgtggctacggtgcgttcggcgcgctcatcggctcgagcctcgtcgtcctcgtccccatggggggttggctctacacgcgcggcacgctttcgctcgagtcgctcgtgctcttcctcgtactcgggccacagctcctcatgtcgatgatgcggctgatgttcgcgtggggcaacgctgaccgcatccaagcgggcaacgcgcgcatccaggccatcctcgcggcgcccgacctcgagactcccacgagcgccgcgcggccctcgcacgatggcgtcgcgttccgtggcgtcagtttccgttacgaggacggcggtccggaggttctccgcgacgtctccttcgaagcgcccgcgggcaaggtcacggcactggtcggaccttcgggcgcaggcaagacgacgctcgtgaggctcgtgcctcggctctgggaggcgacgaacggcgcggtggaactcggtggcgtcgacgtgcgcgcgctcccgctcgaccagctgctctcccacctctcgatggtgttccaggacgtcttcctcttccacggcaccgttcgcgagaacctgcgtctcgctcggcccgatgccaccgatgcgcaagtcgatgccgcgtgtcgcgccgcgcgtgcgtacgacttcatccaggcgcttcccgggaagtacgacacgctgctcggtgagcgcggcgcccgcctctccgggggcgagaagcaacgcctgtccatcgcgcgggcgctcctcaaggacgccccggtgctgctgctcgacgaggcgacggctttcgccgaccccgagaacgaggcgcgcatccaagaagcgctgtccgcgctatgcgcggggcggacggtgctcgtcgtcgcgcaccggctttcgaccatcgccaccgcggaccacatcgtcgtcctcgacggcgggcgcgtgaatgaccaggggacgcacgacgaattgctcgcgcgctgcgcgttgtaccagcaactctggcgcagccacaccgaagcgctcgactggtcactgggcgatccgggcactcctgacgttcagaaggaggtggtgtgatgctcagggaactcttcatgctcggcgagcggctcgcgggccgaaaggacgcacgggtccggcgcggccttctcttcgcctttgccgaggcactcgcgggcgccgcgccctacacactggtcctcttcttcgttcgtgaagcgctcgagcaccggctctcgatgcacctgacgtggtggctcaccggcggcatcgcgctctcggtgctgctgcgcctggcgttctcgatcagagcgatgtccaacatcttcgtcgccgcgcacgcgctcatggggcaagcgcgcatccgcaccgccgaccacctgcggcgcctgcccatggggttcttcacgcagcgaaggagcggtgaactggcaggcgtgctcaccaccgatgtcgcgcttgtcgaagacgtgtggtcgcacaccatcggcatcttcacggcgagcttcgcactgccgatgctcgtcggtctcggcctctgtttcctcgattggcgcctggggctcgtcatcctcgccgccctaccggtggcgctcctcgtgctggccgcgaccacgcccctcttcgtgcgtgagttcgaagccgtgctcgaggcctcggcggatgtcaacgcccgcgtcgtcgaatacgtgcagggcatcgccgtgcttcgggcgttcggccggcacggcgaggtctaccagcgcttcgtgaaagcaatggagcgcctgcgcgacgccctcattcgcgccgatgtcttgccctccccgctgctcgccgtgttcggcttcgtcgtcgagatgagctttgtcgcggtggcgtacgcaggaagcaccctggcgttgcgcggttcgattcagcccggggtgctgctcgtcttcctcatcgtgacggttggggtcgttcgccaggtcgcggatctcggagtggctctgctcatgcttcgagcgtctcagcgcgcgctcggtcgcgttgatcggctactcgcggagaagccgctcccggaaccgtccgtaagagcggcgtcgatccagaagttcgacgtggaggtcgacacagtgtccttcgcgtacgaagacgcgaccgtgctcgacggcgtctcggtgacgttccccgagcgctcgctgaccgcgctcgtcggtgcctcgggctcaggcaagtcgacgctggtccacctcgtggcgcggctgtgggacattccgcgccagggtgccatccgcatcggcggtgtcgatatccgggacattccgttcgaggaactgcaccagcacctcgcgatggtgttccaggacgtcgtcctcttctccgggaccatcctcgacaacctgcgcgttggacggcccgacgcctcgctcgaggaagtccagcgggcagcgcgggcagcgcgcgcccacgacttcatcaccgccttgccgaacggctacgacaccctgcttggggaaggaggaggaaccctctcggggggtgagcgtcagcgcttgtccatcgcccgtgccatcctcaaggacgcccccattgtgcttctcgacgaggccactgcctccgtcgacgcgtcggcggaggctgaaatccagcgcgccatcgacgaactggtcaggaagaagaccgtcgtcgtgatcgcacatcggctgcgcaccgtgcggcgggcgcaccgcatcatcgtgctcgacaaggggcgcgtcgcggagtcaggcacgcacgtcgaattgctagcgaagcgcggcgtctacgcagcgctctggcaggaacaggagcgggccaagggctgtcggctcgctgcgagtacagccgcccgcgtcaccgaggagcagacctga

SEQ ID NO: 4922 - DNA, 1449 bp, Myxococcus xanthus
atgaacgacctgcgcggctcgggtttcaccacggtcatcctgtggagcttccacatcgaggagaacggtgacctgatctacaacgacattccagtggtcaagaacggcgcctacatgggcgaccctgcctggccgacccgactggccacactgaagaccgcgccgacctcggtcaatcgcatcgaggtgtcgatcggtgcctggggtgttccggacttcgaacgcatgattcgactggtcaacggcaccgcgcccggctgcggcaccaccatcgtctgcgggaccggaagcaacagcatcctgtacaggaacttccaggcgctgaaggccgccaccggcgccgacgccgtgaacttcgacgacgaaagcgcctatgacctggccccaaccacgaccttcagccagatgctcatcgggatgggttacaagatcaccttcgcaccgtacacgcagcagacgttctggcggaacctcaggaacaacctcggcagcgccgtcgatagaatctacctgcaagtgtacgccggcggcgccggcaacaacccagcgagttggaacaccgccatgggcatgactgtcgcccccggcttgtggtccaggaatggcagcggctgcgcgtcgggcgacagcccggccacggtgcagacccggatgagcaactggaagaccagcgccggcatcagcggcggcttcatgtggttgtacgacgacatccagcagtgcagcgcgcaggggacgagcgcgcagtatgcggcggcaatcaacaccgccgtcagcggcaacaccccgccggtggcgaacttcggtgtcaccgtcagcggcctcaccgcgaccttcagtgatgcgtccaccgacgcggacggaaccatcgcctcgcgcagttggaatttcggcgacggcagcacctccaccgcgaccaacccttcacgcacctatgcaagcgccggcaactacaacgtcaccctgaccgtcaccgacaatggcggcgccagtcatacgaagtcccaggcggtgtccgtcggttcgggctacgccaatctggcgttgaacaggcccaccaccagttcagccccctgcaacagcaccgaatcggccgccaaggcggtcaacggcagcgtctcgggcggcaccaccgacaagttctgctcactgacctcgccggcgtggatacaggtcgacctcggtacggcgcagacagtcagcagcttcacgctccagcacgcgggggcgggcggtgaatcgacggcctggaacagcagggcattcaccatccagacgtcgagcaacggctccacttggagcacgcccgtcacggtgagcaacaacactggcagcacttcgacccatgcaatcacggcgacgccggcgcgttacatccggctcaacgtgacgacgccgactcagaacagcgacccagcgacgcgaatctacgagttcgaagttcgctga

SEQ ID NO: 4923 - DNA, 1236 bp, Myxococcus xanthus
tcctggaagcgcaacacagcccttttcctgggcagccaggccctctctttactcggctcctccctggtgcagtacgcgctcctgtggcaggtgacgctgcagacacgctcgagcgtcatgatgacgctctacatcgtggccggcttcctgcccacgttcatcctctcgcctttcgcgggcgtctgggcggaccggtacgaccgccgcaagctcatcgtcctcgccgatgcgatgattgcgctggtgaccctggcgctggccgtggtgttcaccttgcgcggcacggagctgtggctcttcttcctggccgcggcgatccgctccgtggggacggccgttcaacagccggcggtgggcgcgctgctgccgcagttggtgcccgaagaccagttgatgcgggtcaacagcatccagggcaccctccactcggtcaacatgttgggggcgcccgcgctcgccggcttcctcatgtccgtggcccccctgcaggtgctcttctacatcgacgtggtgacagcggccctggccatcgccctggtgacgctcttcgtccaggtcaagccgcgtccccgcgcgccggagcaggagggggcctcgcagctgacggagatccaagacggcttccgctacatccgcggccacgcgcacctggtgccgttcttcggctacctgggattcatcatggtcctcatcactccggccgcattcctcacgccgctgcagacggcgcgaagcttcggggaagaggtgtggaggttgacggccatcgaaatggtcttctcggtgggcatgatgttggggggcgccgcgctcgcggcgtggggcggcttcagcagccgcatgcggacgatggtcacatccaacctcatcatgggtgcgtgcaccgtggccctcggcgtggtgcctcacttcggggtgtacctggcggccatggggatcttcggcgtggcgctaccgctctacaacacgcccgccatggtgatgctccaggagcgcgtggagccggcctacctgggccgagtcttcagcgtgatgaccatgctctccaccgcgctgatgccgatgtccatgctgttcttcgggcccctggcagaagtggtctccatcgagcggctcctgcaggtcaccggcgtgctggtgatcctcctcggactgctcacgccgctacaccgtcggctgatgtccttcggtgagcccaagagccccccagttcaatcccaggaactggccagttga

SEQ ID NO: 4924 - DNA, 852 bp, Myxococcus xanthus
atggtgctgaagcagggatggccgcatctcgtcacgatgcagggcaccttcaacgtgtgggggaacaacatcgtcccgggcccacagtcaggccagcccgagcccgcgccgatgttcccaagcccgggcgtcaccaaccgcaacgtcggcttcgaccctgagttcgtcttcgcgggcgtgaagcccccggcggtcgctccgctcagggcgagcttcatccagctcagcctcgacggaggaaagacctgggcgcatccggcctccacggcggacttcaacgcggccgagcacaagtatggctatgaggtgacgggcggggagtccgcgctacaggtgcgcatcgccgacaagcccgtcaccgacaactccgggcgcttgaagattgtcgtggtgcccgccgaggagctgtggctgaacacccggagcgccgcccccgttcccagcaagcaggtgctccagaagggcaagccctaccgtgtcacgatgcagggcaccttcaacgtgtgggggaacaacatcgtcccgggcccgcagtcaggccagcccgagcccgcgccgatgttcccgagcccgggcgtcaccaatcgcaacgtcggcttcgatcctgagttcgccttcgcgggcgtgaagcccccggcggccgctcccctcaggatgagcgccgtccaggtcagcctcgacggaggaaagacctggaagcacccggcctccacggcggacttcaacgcggccgagcacaagtacacctacgacctgacgggagaggacgcgcccctgcaggtgcgcttcgcggactcgcctgtcaacgacaactccgggctcgtgcgaattctcgtgctgcccggagcctga

SEQ ID NO: 4925 - DNA, 2721 bp, Myxococcus xanthus
caacaaaggggcagcctgatgttccatccgtggcgtcttgcctttctcgctgcctgggcctcgttatcgatcgcccaggcacaaccagcctccgtgggacaatggacccccgtccagaagtggccgtactccgcggtccacacccacgtgctccccaccgggaaagtgatgttcttctccgagttcggggacggcgacacccccacgctctgggacccgcagaccaacgtcctcaccacgctgcccaaggcgggcttcaacatcttctgcgcgggccatgccttcatgccggatggccggctgctcgtggccggtggccacatcacgaatgactctggcctgccctacgccgccatcttcgaccccttcaagctcacctggacgcggctgccgaacatgaacgccggccgctggtaccccaccgtcaccacgctccccaatggggacatgctggtgattggcggcgccaaggaagacacgaccaagaacctgattccccaagtctggcagacgtcgaagaactcctggcgcaacctgacgggtgcgagcttggagctcatgtactacccgtggatgttcgtgacgagcacgggaaagacgctcatggcggggtactggaagcccgcgcggtacctcgacacgaatggcaccggcgcctggacctccgggcctcgcaccaactacgcccgcagccgcaacgcgggcagcgcggtgatgtatgacgacggcaaggtgctgatcaccggtggcgacaatccccccaccaacaacgtggaggttctcgacctcaacgccgcgaagcccgcctggcgcaccgtgcggcccatgcgctacgtgcgccgccagcacaacagcaccgtgctcccggacggcacggtgctcgtcaccggcggccacagcggccccggcaccgacaaccccaacttcccccgcctggagacggagctgtggaaccccgtcaccgagcagtggtcggtgctggcgcccgcgtcggcctatcgcggctatcactccaccaccgtgctgttgccggacggacgcgtgctgtccgcgggcagccgctacgtcaagacgatgcaggtcttctccccgccgtatctcttcaatggcccgcgccccaccatcacctccgcgcccgcgtccatcgcctatggagagaccttccgcgtcaacacccccgaggcggccagcatcaccatggcgtcctgggttcgcctgggctccgtcacccacgccttcgacgagaaccagcgattcatgaagctgcgcttcaccgccagcggcggggggctcaacgtcgtcgcgccgcccaacccgaacgtggcgccgcctggccactacatgctgttcctgctcaacgcgaagaaggtgccgtcggtcgcgaagatcatccgcatcggcggaggaggcacgacgccgcccccgacggaccctcctcccaaccccggcttcaccgcggtggccttcggctccgagtggaagtacgacgaccgcaacgtcgacccgggctccgcctggacgtcttcgggcttcagcgacgcgtcctggaagaagggcccggcccagctcggctatggcgagacggacgaggcgacggtgctgaagaagacgacgccggcgcagcccaccgtctacttccgccgcaagttcaccgtccacggcatggtggagcaggccacgctccaggtgattcacgacgatggcgtggcggtgttcctcaatggcacccaggtgttctccaagtatgtcggctctaccgcgcactcggcctatgcctccggcacagcttccgacaacaccttgagccaaacgaccgtctccggcgcccgcttcgtgatgggggagaacacgctggccgtcatggtgaagcaggcgaacgccacctccagtgacctgtccttcgaccttgagctgaaggtgaccaccgacggcatgcagcacgatgccctcttcatggagagccccaacggcggcgagacgctgcgcccgggcaacgtccagatgctccagtggatgacccacggcgcgggcgtcgacaacgtccgggtggagttctcgcccgacgacggggccaactggaccctggtcgaccagggtgtccccaacatcgacttctatgagtggacggtgccgaacaccgtgacgtccaagggcgtgctgcgaatctcggacgcctcgcgtccggacatcgacgaccgcacggacctgcccttcaccatctcccggacgccccaattccaggccatcgccttcggcgagtactggaagttcgatgacagcaacgtgaacccggacatgcagtggacgtcggtcaacttcgacgacgacgcatggcgctcgggccccgcgaagctcggctatggggacggggacgagcacaccgtgctcaacaagacgacacccctccagccgagcgtctacttccgcaagaagctcacgctcggcgaggccatccgcaccgccaagctccgcgtgctgcatgacgacggcgtggccatctgggtgaacgggaagctcgtctactcgcggtacgccgacaacggtctcggccatggcaccttcgccagccgcgtgttgaaggacgccgtcatcagcacggccaggttcgacggctctgccttcgtcgtgggggagaacatcatcgcggtgatggtgaagcaggccaacgcggagtcgagcgacgtggcgttcgacctcgaactgaacctcgaagcgaagtag

SEQ ID NO: 4926 - DNA, 861 bp, Myxococcus xanthus
cgggccttcatgctcggcatcggtctcaacctggccttcgtcggcgtcgaagccacgtatggcatcctgtccggctcgctcgccctgctggcggatgcggggcacaacctgagtgacgtgctggggctcgtcctcgcctggggggccagcgtcctgggccggcgcaaggcgacggagcgccatacctacggcttccggagcgccaccatcctggccgcgctgctcaacgccctgttgctgctggtcgcggtggggggcatgggctgggaggcggtgcggcggctggggcagcccgccaccgtgtccagcttcaccatcatgtcggtggcgggcatgggcatcgttgtcaacgcggccacggcgctgctcttctggaagggccgcgagcgcgacctcaacatccgaggcgccttcctccacctggccgctgacgcggccgtgtcgctgggcgtcgtcctggcgggtctcctcatctactacacgggttgggcgtggctggacccggtggtgacgctggtcatcgcgggcctcatcttcgtggggacgtgggggctgctcaaggactccgtcaacctcgcgctccaggcggtgccgggacacatcgacgtgcgtcaggtgcgcgagcggctcgttcagactccaggggtgtccgaggtccatgacctgcacgtctgggccatgagcaccaccgaggccgcgctcaccgcgcacctcgtcatgcgggagccgcggctggacgacgccttcctcgacgacgtgaagcggcggctccatgacgagttcggcatcgagcacatcacgctccaggtggaggagggagcgctcacgggttgctgccagctcgcgttcgagcctgcctga

SEQ ID NO: 4927 - DNA, 552 bp, Myxococcus xanthus
atgtccccggaggtcctcgcgctcctgctccagaaccgccagcgcttcctcgccttcctgaccccacacgtcgggagcgtcgaggcggcggaggaggtgctccaggccgcgctgctcaagagcgtggaacgcgggagcaccctgcgtgaggaggagcgggcggtggcctggttctaccgcctgcttcgcaacgcgctcatcgaccgctaccggcacgagcagcgccaggggcgcgccctgcgggccttcgccgaggagagccccctgtccaccgaggacgcggcggaactggagcggaccgtctgcgcctgtgtctccacgctcaccaccaccctgaagccggagtactccgacgcgctccagcgggtggacctggacgggcagaccctggcggagttcgcggaggcagccggcatcacccacaccaacgcgaaggtgcgcctccaccgggcccggcaggcgctgggccggaggctggagcaggcgtgcggaaccacttgctgccgcaagggctgcgtggactgcccctgcgaggaggcgggcggactgtaa

SEQ ID NO: 4928 - DNA, 1500 bp, Myxococcus xanthus
atgcgcgtcgggttctggtgggtcctggctggcctggggttggcgggtctggggtgcggtgagtccgtggatgcggcggcagtggatgcggtgaaggagacctcggaggtgccagtgcaggccctggcctgcgcgccgccgggcgccgtctacaaggtgaaggacgtcctgccgccgggtgtgccggtgccttccaacgccttgccggtccccgactggctgacgaacgcggagggcacgctcttcttcgtggtcgacctcttcgacggccccggcgtcctgtggcgcagtgacggcacctccgtgggcaccgtgcctgtgaaggagttccccgtgattgcggggacctaccgcgacttctcgccgctcgtcgcggtggggactcgcgtcttctttctggtgaaggaccccgtggtcggacgggaactgtgggtcagcgatggcactgaggcgggcacgcggctcgtgcgggacttcgcgccaggccccgccagtgacgacctgatgctcttcgcttcggtgggggatgtgctgaccttcttccgccgaccggcctcgagggggccgctggagctgtggcgctcggacgggactgaggtgggaacgttccgcttggtgaccttcggcgcgcaggactcgtttgagtcgggggtgcccccggtcgcgggagcgctgctgttcaccctgcacgacgcggcgaatggcacctacctgtggcggacggatggcacggcggcggggaccacggtcgtcaagcggctggacgcagatctggtctggacgcagggcacggccgtcactgcgacgggcctgagcgtgttttccttctacgatgaaggccccatcacggaggtgtggcggacggatggcacgccgggcggcacggtgcgcctggactccttcggcggctacgtgaggttgctgggcgcgctgggtgggtatgtctacgtggcctctggcaccgcgggcggctccgcgttgaagctctcccgcctgtcgctcgcgggcggtggcaaggcgacggcgacgtggctgcccaaccgctacgcgggccagcccgacgcgcggccctacgtcgagtactcggcggtcgcgggcgggaagctctacgtgtccatggccattggcacctcggggcccgcgccgcgcgaagtgggcctctgggtgacggatggcacggaagcggggacacgggagctcagccgggggctcttcaccggcgacgagaactactcgccgctcttcgacaccggtgccgggacgctgctcttcagcgcggacggcggcgagacggggttggagccctgggtgacggacggcacgcccggacggacggggctggtcgcggacctctctccgttggggggctccaacccacagtccttcacccgggtgggcagcaccctcttcttccgggcccgctctgacacgcgaggcaacgcgctgtgggccatgcccgccaccgtggcctgtcccacgcaggaagtccacgcccgctga

SEQ ID NO: 4929 - DNA, 540 bp, Myxococcus xanthus
gtcgaccaggaggcgctcaccgcgctcgagcaggatggcgcgttctccaacgtctggctcgcgcgcttcaagaatcccgccgcgcacgccaagcaggtcgccagcgagttcgccgagctcactgcctcggcgagcgtgaccatcggcgccgatcacttcaagccgctcgaggtccaggcgaagaagttcaaggaggtactggccgccgcggtccgggttgatcgcttccccaaggtctggtcgacgaacgacgcgaagctcaacggctcggtctccgggcaggtcaagtccttcggcggcacgctggtgaagctccgcacctccggcacgacgatggtcgagaagaacgacctcggcatcccgctcgcgcagtcgacccgtggcgcggcgctcgtgcgcgtcgcgagcgacggcgggttctgccggctctacgacgacgtgggcttctcggggacctacaagggtggaggggcctatgccccgctctcctactcctcggggatcgaagatgagttcaaggtgacggtctgctcgaagtag

SEQ ID NO: 4930 - DNA, 969 bp, Myxococcus xanthus
  unsure (1)..(969): unsure at all n locations
cgctcgatttccatgggcctgttcgcgtactccacccacgtccaatggctgccgtggttgttcgcgtcacgggtgctcgcgggagccaccgcgggaaacctggcggcgtgtcaggcggcggtggcggacgtcacggacgagagtgggcgggcagcgggcatggggctcgtcggcgcgggcattggcctgggcatggtgctggggcccgtcattggcagcctcctccatgtgcatggcgcctgggcgccaccgctggcgggcgcggtgatggcggcggcggcgatgctcggcgtgctcttcttctttccggagacacaccgcccgcaggcggagcggcaccaggagccaggccgtccccgggtgcggctgtccgacgtcctggcccggcccgggctgggcgcggtgctggctttgacgttcctggtgttcatcgggatgacgaacctccaggtgtcgctggggctgctggcccaggcgcgcttcggctggggcgaacaggagatcgggcggctcttcgcgttgatgggcctggtcaccttcgtgcttcaggccttcgtcatcggctggctgacgagccgggtccgggacacgacattggtgctggtgggcgccgcgtgcatgggggccgggctcacgtgcatcgccgctgcgggccacggtgccatgttggtgctggccatggtgctggtgggctcggggacgggcctgttgcagccgctgatggccagcctggcctccgggttcgcggggcgcgagctgcgtggcggggtgctgggcgtggtgcagtcggcgggcgggctcgcgcgcgtggtggggccggtgtggagcggcttcctctactcacggctggggcctggtgcgcccttcaccagtggggcggtggcggcgggcgtcgcgctgttggtgggggcttcgctcatgnggnggtgcgttcagnacgcgccgccgcagtcgaccttgaaagtctga

SEQ ID NO: 4931 - DNA, 1113 bp, Myxococcus xanthus
atgaatcgcagacccgagctcgacagcctgcgcggaatcctgctcgtgttgatgacgctgacgcacctgccgacgcgactgaacacgatcagcaaccagccattcggattcgtctccgcggccgagggtttcgtcttcctgtccgcgttcctcgtgggcgtggtgtacgccaacaagattgaagcggcggatccgaacgtgctgtggcgcagcctctggcagcgggcgctcaaggtctacggctaccacgtggcgctgctggccttcgcgttcgcggtcatcgggacgttgggcatggcgacgcaccgtcccgccatccacaacctgttgggcttcttccacgaggaccctttcaccgcgctgtggagcagcttgttcctgctctactgtccaccgctgctcgacatcctcccgctctacgtcgtgctgctgttgctgacgcccttcatcctgctgggcgcgcgcaaggcggggtggacgcgcatcctgtgtctgagcgggttggtgtggttgtcggcgcaactgggcttgaagcgcgcgctctacgatttgctggtgttcatcccggtgctgccgtggccaccgctgcgcatcgagctgtcgggggccttcgacctgttcgcctggcagttcctgtgggtgctgggcgtgtggctgggcgtgggccgtgccacggcgccggagaagcgcgaggtcgtttcgcccgtgctgctcagcggggcgctggtggtgagcgtggcgctgctgctgatgcgctaccaggtgggcatcttcagcatcgacctggacctgtatggcgccctcatcgacaagtggaccctggcgcccgtgaggctggtgaacttcctggccgtggccctgctggcgagctggctgagccccaaggtgttccgctggctgcgcccccgcgtgctggaggcgctgggccgtgcgtccctgcccgtgttctccgtgcatctggtgctgtgcctgctcagcctggcgctgctcaatgagaacgaggacccgctggccgactgggaagaggtcgtcgtgttggtggccacgttcaccgtgatgctgctggtggcgtgcagacaggcggccgcgctgcgcagcagtcggaccccatag

SEQ ID NO: 4932 - DNA, 1209 bp, Myxococcus xanthus
atgtgggtcctgctcgtcacactcctcgccgcggctccggcgcgagagtcccctccactcaccttcgccgagtcccagtcgctggccgcgaaagccgcgctgcccgcgagcctggcgcgcgccgtggaaacgcggcgtgtgtgggacgcgcggctgccgtggctcgccgccaaccccacgctcagcgtggtgccggggcggcgcgcccagcccgaggggccaggcttcgagctgacggtgtcggtggagcaaccgctcttcctgtcgaacctggcgggggcccagcgcgacgcggcgagcgcggagacccgggcgctggagcgggaggccgtggccgcgctgctgaaccgccggctggaggtggcgcgggcctggctgacgctctggtcggcccagcaggccgcggcgacggccgagcaggaagcgacgttggcgggtgccctgcgcacctccgtcgcggatgcgctggcgctgggcggcgccacccggttggagctggccgaagcggaagggttcgaggccgaggcccaggtcgcgctcctggctcgcgaggcggaggtgacccacgcgcggctgtcgttggcggtactggtgggccgtcagcccgacgcgcacctggtggtcgcggaggcactgccggaagtggcattgccgccgtcttccgaagaagcgcggtggctggcgcgcgcctccgagcttccagatgcggaggcccggcgcctgctgggtgtggcggagcgggcccgcgcggcggaggtccgggcagcgcggggctggcaggtgacggtgggcgcgcagggcgtgcgtgagtactacggcgggctcagtggcctgctgatggtgggcgtgacgccgccgatgttcgacgcgggtcagcgcgagcgtggcgcgctcctcgccgccgctgaacgtctggagggcgaggcccaggaagccgcgctgcgcgccgccgcggagctggccctggcgttccgtgagcgcgagcagaccgcagcgcagctctccgtcgtcgagaagtccctggcgcccaaggccgaagaggccgcgcggctggccgacgtgttgctgcgcgcgggccagagcacgctgcctgacgtcctgcgcgcccgccgcgcccgggccgccgccaacatccggctcgcgctcgctcgtggcgaagcctcgctcgccgccgcgcggctccacctcctgctctccgctctgccatga

SEQ ID NO: 4933 - DNA, 1110 bp, Myxococcus xanthus
  unsure (1)..(1110): unsure at all n locations
atgacgcccttcgtccgccgtttcgtcgctgtgccgatgctcgccctgtccggggcgtgcacgtccggttcttccaccgcggaggttcctcccgcgccgccccccgcgcgcgcctccgcgccttcggcgtgggtgcccgtgcgcgcggcgtctcgcgtggccctggcggaggcccccgcgctggtgctgtccagcccggacgccgtcgccgcgctctccgcgccgttccgcgcccgagtgcagcaggtgcgcgcgcggccgggtcagcaagtcaaggcgggagacccgctggtggaggtgctgatgccgaaggtggtggagccggcggggnccgccagcgccgcctcgctgaggctggaggcctattcgcggcaggtggagcgcctggaggcgcttcatgcccaggggctggcgaagctgcccgacctggccgacgcccagacgcaacaggccgaggcccgcgccgccctggtcgcggcgcacgcggtgttgcgcgtggcgggcatcgctcccggggaagcccggggcgtggcggagcgtggcaccgtctggctcaagagccccatcggaggaatcgtcaccgaggtgcgcgcggtgctgggggagatgcagcccgaggccagtgccgccttggtgcgggtggccgctgacggccccgcgcgcctggaggcccgcctgtccgtgcgtcctcccgaggacgccagcttcgccttcgtgtcgtcccagggcatcgctgttccggtgcggtgggtgggccagtccccggtcgtggacgccgcggatggaacgtggcgcgcatggttcgagccagaggacaccgccgccgtgctgcgcgcggggcaggggggccggttgcgcatccaggccgcggcgggcgaggacacggtgctggtcccggcgcgcgccctggccttcgacagtgcgcgcacggtcgtcttcacgcgcggcggcgaggggcagcccgtgcgccgggaggtggaggtgctggccacttccggcgcggaggccttggtgaaagggccgctgtctgcccgggacacggtcgccgctgacggcgcggcgctgctgttggagtctcaggccggtgacgccgatgaggtgacgccgtga

SEQ ID NO: 4934 - DNA, 759 bp, Myxococcus xanthus
atggccgtgcgcctgggcgacgtggccgaggtcaccgaaggcgcgctgcctcgcattggcagcgccacctccaatgggcgcggcgagacggtctacgtcatggtgcagatgcttcgggatgccaatgcgctcgccgtgacgggcgccatctccgacgcgctccccgatgtgcgagcgctgctgcccgaggacgtgcggttggacgtcgtctatgaccgcgccacgttggtgcgcggcacggtgcgcaccgtgggcaagaacctgctggaaggagggctgctcgtcgtgggcgtcctcttcctgttgctcggcagcgtgcgcgcgggtctgctggtcgcttcggccattccgttgtccatgctgggcgcgaccaccgccatggtggcgctggacatccccggcaatctgatgagcctgggagccatcgacttcggcctgctggtggatggcgcggtggtgatggtggagggcctgttccaccggttggcgcatctgtcgccggaggagaaacagcgttcgccccgtgagcacgtcgaggagacggccgtgtccctggcccgtcccgtcttcttctccgtgctcatcatcctgctcgtgtacctgcccatcttgtccctgcgaggcgtggacgggaagatgttccggcccatggcgatgaccgtcgtcttcgcgctggccaccgcgctgctgttgtcaatgaccttcatccccgacgccgcgagttggctcattgcgccccgagcacgtccccgcgcgtga

SEQ ID NO: 4935 - DNA, 1149 bp, Myxococcus xanthus
cgtgaacagctggtgcgctgctgcctggaagacatcgccatgggcaagctgcacgggctcaccattggcctggacatctgctccacgctgcacatggacgtgtcactggacgacctggactggtgcatcgagcgcatcatgccggcgaatccggcgtacctcatgtcgctgcccacgaagaacgacccgatgctgggctacctcaccaccgggttccaggaccacgtccgcatccgcgagcagttcggctacaaggtggatgaccggatgtgggccttcttccagcgcctgggcgtcatcgacgcggagggcaagcccactcgccacttcggtgacccggtctgggtctatctccagtacctgcgcgcgaagggcgacagccggccggaggcggacatccgggcggacgcggagcagcaactgtcggcgattcgtgcgcgcggcgtgcccatggcgcgtgggcacggcacgcacccgtgggacctggaacccgcgctggacgcggagttgcgccgcgtctacgtggactcgaagaagagcctgtggacggagctgacgcccgccttcatcaccgccgtgccggagggcgtgcggctggtgtcgaagtcgcaagaccggacggagtacatcctccacccggagacgggcgagcagctcgacgcctcgtccctggaggcggtgcgcgcgatgagggcacgccatgcgggacggtatgacgtgcagttgatggtgtccgacgggctcaacgcactggccatcatggacgagggacagctcgcgccctatctggagacactgcgcgcggcgctgattgccgccgggtaccagcctgctccagagcatctggtgctcacgtccggtcgcgtgcgcgcggggtaccgcgtgggcgaagcgctgtacgcgggcatggaggacgcggcccggcaccggggcctcatccacgtcattggcgaacggcccggcaccggccaccacaccttctccgcgtacatcaccgcgccttccggagccgtctggtcccagcccggcaaggtggaccacaacatcacccgcgtggtgtccggcgtcgcgctcacggcgtatgcgccctcactggctgcgccggagacagtgcggctgcttcaacaactggcgccccggggcggatga

SEQ ID NO: 4936 - DNA, 1410 bp, Myxococcus xanthus
atggtgattcaaaccacgcgtgtgcccgacatcagcctggacgcggcggtgagcgaagcgggccggatggagcgaggcctgctccaagcgattccggaggtccgacaggtggtgtcgcgcgtgggcagccccgcggtggccacggacatcatgggctgggagatggccgacgtcttcgtgtcgttggccccgagggatgcctggcggcccgggctcacccgtgagtcgctcatcgaggagatggggcaggtgctggaagcccgtgtcccaggtggagacccggccttcacgcagcccatccagatgcgcttcaacgagctgctcgggggcgcggtgacggacgtggcgctcagcatctacggcgaggacctgaccgaactcgggctcctggctcgccgggccgcggcgctgttgagccaggaaccgggtgcggtggacgtgcgtgtgctcgctccgccggaggtgccgctcttcgaggtgacgcctcgcccactcgattcggcccgcgcgggcctgggcgcggtcgatgtgctggaggcggtgagcgcggtgcgcagtggcgtggaggtgggcgccacctgggatggggcggtgcgcgtgcccatcgtcctgcggttgacgggcgcgtccgatgccttctccctggccgagctgccccttcccacggagacgggaggcctggttccgctctcccgcgtggcggacgtgcggttgacttcctcgcctgggctggtgagccgggaagggggccagcgccggctggtggtgggcttcaacgtgcgaggcgtggacctggggacggtggtggagcgggctcggagccgcgtggagcagtcgctcgctccgcctgatggctatcggctcgagtggggcggtcagtacgagaccttgacggaggcacggcaaaggctttcgctggtgcttcccgccgtggccctcctcatcttcgccgtgctgctgttcgctttccgtcgcatgcgtcctgctttggccatcttcgccaacgtgcccttcgcgtgcgtgggcgggatgatggcgctggcggcccgggacttgcccgtgtccatctccgcggcggtgggcttcatcgcgctgtccggcatcgcggttctcaacggcgtcgtgctgatgtcgcgcgaacagcggctcgaagcggacggccatgctcccggtgaggcggtggtgatggcggcccgcgagcgggcccggcccgtgctgatgacggcgctggtggcggcgctgggcttcatcccgatgatgctcgctcgcggggtgggcgccgaggtgcagcggcccctggccacggtggtggtgggcgggctcgtcacctccacgctgctgaccctggtcatcctccccacactctacccatggttcgcgggtaggacgcgcacgcaggcgcgtgcatga

SEQ ID NO: 4937 - DNA, 468 bp, Myxococcus xanthus
atgacgccggtgctgatgctcaccgcccgcggcacggtgggggagcgggtgacgggcctgcgcgctggcgcggatgactacctggtgaagccctttgccttcgaggaactgctcgcgcgcctggaggcgctgcaccgccgctccgagggccagacgcagtcctggggcggaggggccatccacatcgatgcccggcggcggatgttgacgtgtggcgaccgtgaggtggccttgacgggccgcgagttcgccctgctgggtgagctggcttcgcgcgcgggcgaagtccacacccgctccagcctgctggcgaaggtgtggggccccagcttcgatgggcctcccaacatcgtggacgtctacgtgggctacgtgcgcacgaagctgaccgaggtgggcgcggaaggggtgaccatccaggcggtgcgtggcgtgggcttccggttggtgattgagggcgctcggtga

SEQ ID NO: 4938 - DNA, 1341 bp, Myxococcus xanthus
atgtggctgtggggcgcggtggtgcccgtggtggcggtggtcgccgcgctgggcgtggctgtccaggtgttccgcgtggtgctcgaacggacgttggacgaagccttgctgtcgcaagccgccgcggagagcgtgagcctcttcgacgcgccggatgggcgcccgcatctgcacgtggagccctccccgttggcgggagaggtgcgcgccttcgtccccgcgacgcggctctatggcccggatgggacgctgctctccgtcttcccgcccgagtcacccaccgtctacgaacgggtgctacccgaggacgggcccacgtcgcggctggagacgcagcgtctgggctcgggcctgcggcttcgcgtgctgacggtgcaggtgcgctcgccgaagggcgtgccccatgtcctgcagttggtggcgtccctggggacggtggaccaggcggtgggcaccttcacctccgtcgccaccgtgctggcgttgctcctgggcggggtgctgattggcatccagggctggcaggcgagggggctcgcgcgacggcttcatggcatcgcggaccaggtggctcgctcgcgcgacggaggcatggtggccccggtgcccgtggatgagccccgggacgaaatcatggaggtgcgcctggcgctgaccgaggccgcggtgcgcgtgcgcgccgcgcgtgaagcgcaagaacgcctcatcgcgcgcgccgcgcacgagctgcgcacgccgctggccctcatgcgcaccggcttggacctggcgctgcggcgcgagcgtggcgcggaggagttgcgcaccgtgctggaggagaaccggcgcgaggtagaccggttggccagcgtcgccggtgcgctgctggagctgtcggcggcgggcggcgccctcgattttcagcagggggatttgcgcgggctgctcgacgaagccgccgcgggggcctgggcggaggcggaccgtcgcggtgtgtcgctgcgcgtggtaggccccgacgaggccgactgccggatggatgcgatggcggttcgtcgagcggtggacaacctgctggccaacgccctccgctacgcgcctcgtgggtccgaggtgcggctggagctggcgcaccgggacgcgcattgggaagtcgctgtccaggacgaggggcgcggcatcccggagacgcaccgtgaggacgtcttcacgcctttccaccgcctggagcgggacgcggggggcgtggggttgggactcagtctcgtgcgcgaggtggcgcggggccatggtggcgacgcgcgcgtggtggaaagcccgggcccgggcgcgcgggtgctgctgacgctgcctggccggtga

SEQ ID NO: 4939 - DNA, 2556 bp, Myxococcus xanthus
cgtatggccagggctcgtcgttcgaagcagcaatcagactcgtcaggtaccaccgagcaaggcttcgtggaggtgcgcggcgcccgccagcacaacctgaagaacgtcgacgtccgaattccccgcgacgcgttcgttgtgttcaccggcgtgtcgggctcgggcaagtcgtcgctggccttcggcacgctctacgcggaagcgcagcggcggtacttcgaatccgtggccccctatgcgcgccgtctcatcgaccaggcgggtgtgccggaggtcgacgccatcgacgggctgccccctgccgtggcgctccagcagcaccggggcgcgcccaccacgcgttcgtccgtggggagcgtgacgacgttggcgaactcgttgcggttgctgtactcgcgcgcgggcacgtatccgcgagggcagccgcacctggattcggatgccttttcccccaacacccccgcgggcgcgtgccccaagtgccacgggctgggccgcatctacgacgccaccgagaagtcgatggtgccggatgactcgctcaccatccgggagcgggcgattgccgcctggccgcccgcgtggcacggccagaacctgcgcgacatcctggtgacgctcggctacgacgtcgaccggccgtggcgcgagctgccgaagaaggaccgggactggattctcttcacggaggagcagcccacggtgcccgtctacgcgggcttcactccggccgagacgcagcgggccctcaagcgcaaggcggcgcccagctacatgggcaccttcacgggcgcccggcgctacgtgctccagaccttcgccaccacgcagagcgcgctgatgaagaggcgcgtctcgcagtacatggtgagcggcgactgccccgaatgccacggcaagcgcctgcgccgcgagtccctgtccgtcaccttcgcggggctcgacatcggcgagctgtcgcgtctgccgctcagtgaactcacggacctgctcgcgcccgtggcggatgggacggccaaggacgtggcggcgcttgcccgtgtgcatccggagaaggcgctggtggcccagcgcatcgcccacgacgtgttggcgcgcgtcaacgtcctgacggagctgggcctgggctacctgtcgctcgagcgcggaacgccgacgctgtctcctggcgagctccagcgcttgcggctggccacgcaggtgcgctccaacctgttcggcgtggtgtacgtgctcgatgagccgtccgctgggctgcaccccgcggacaccgcggcgctgctgaaggcgctggaccagctcaagggctcaggcaactcgctgttcgtggtggagcacgaggtggatgtcatccgccacgcggactggattgtcgacgtggggcccgacgcgggcgagcagggcgggcagattctatacagcggtccgctcgaaggcctgaaggcggtgaaggcgtcccggacgcggcgctatctcttcggcgacgcggagaagcaccgcggcacgcggcgttcgcccaagggctggctgcgcctgcagggcgtgtcgcgcaacaacctgaaggaagtggacgtcgacttcccgctgggcgtcctcaccacggtgacgggggtctccggctccgggaagtcgagcctcgtgagccaggtcctggtggagctggtggccggacacctgggccacgcggtgccggagaacgaggacgagggagaggagctggagcgcacggtcatccacaccaccggcggcaggattgcctccggcatggagggcatcaagcgcctggtgcaggtagaccagaagcccattggacgcacgccgcgctccaacctggcgacgtacacggggctgttcgacaacgtccgcaagctcttcgccgcgacgcccgccgcacgctcccggcgttatgacgtgggacgcttctccttcaacgtggccaagggccgctgcgagacgtgcgaaggtgagggcttcgtcagcgtggagctgctcttcctgcccagcgtctacgcgccgtgccccacgtgtcagggggcccgctacaacgccaagacgctggagattcagtaccggggcaagaacatcgccgaggtgctgggcatgacggtggacgcggcccacgacttcttcagcgaggacccgctggtgcagcggccgctcgccgtcctgcgggaggtggggttgggatacctgcggctggggcagcccgcgacggagttgtccggcggcgaggcccaacgcatcaagctggccacggagcttcagcgggcccagcgcggcagctcgctgtacgtgctggacgaacccaccacgggcctgcacccctccgacgtggacaagctgatgacgcagttggaggggctggtggcctccggcaacaccgtcatcctcgtcgagcacgacatgcgcgtggtggccgcgagcgactgggtcatcgacatgggcccgggcgctggggacaagggcgggcgggtggtggtggcgggcccaccggaggaggtggtgggcctgccctacagccagaccgcgcccttcctggaggaggcgctgggctga

SEQ ID NO: 4940 - DNA, 867 bp, Myxococcus xanthus
atggcgcatctggagttgatccccaagcgggacctgtcgagctttcgcaagcttgcgattggaagttggaagacggcgtacgaccccaccgtctacggaacgctgaccgtccgcatggacaaggcgatggcctacatcgaggccttccgtcagcgcacgggcgtgcggctcacggtgacgcacctggtggccaaggccatgggcgaggcgctgcgtcgctgcccggacgcgaacgccatcctccgcttcaaccgcatctacctgcgccagcgcgtgacgttgtccacgctcgtcgtccagacggacggcggaaaggtggacctcacgtcggcccgcatcgaggacgcggacaagaagaacctgaaggagatcgccaacgacctggaggaggcggtgcgccgcgtccgcgagcgtcgggacgtggccctggagaagggcaagggcaccatccagaagatcccctacctgttcctcaacacgttcacctggttgctgtccttcttcatgtacacgctgaacctggacatgagccggttcggcatgccgaaggacgccttcgggtccgccatcatcaccaacgtgggctcgctggggctggacacggcctacgttccgctggcgccgtacacgcgcgtgcccatcttcgtcgcgcccggcgcggtgaaggaggtgcccgtggtggaggacggcaaggtggtgccgggcaaggtgatgaacatcaacgcgacgttcgaccaccgcttcatcgacgggttccacgcgggcgtgctcgccaacacgctccgggagatgctggagaacccgttcgagagcttcgacgcgcttccggagaccgccgacgcggctccggtcgccgccgtggggtag

SEQ ID NO: 4941 - DNA, 492 bp, Myxococcus xanthus
atgaagctcgaaggctcctgccactgtcgcggcgtgcggttcagcgtggagacgcaccacccgtctcccttcatgcggtgctactgctccgtgtgccgcaagacgcaaggaggcggaggcttcgccatcaacctgtcgggggacgcgcgctcgctcaaggtgcgcggccggcagcacgtcaaggtgtaccgggcgcgcatccagaacccggaggacgcgaaggcgcaccagagcaagggtcagcgccacttctgtggccgctgcggctccgcgctgtggctgtatgacccgaggtggccagagctcatccatccgttcgcgtcggccatcgacacgccgcttcccgaggcgcccgagctggtccacatcatgctcgagttcaagcctgactgggtgcccgtccatgcgggcaagaaggacaagaagttccagcgctacccgaaggagtccatcgcggagtggcatcagcgccacgacgcggaagtgggctga

SEQ ID NO: 4942 - DNA, 1185 bp, Myxococcus xanthus
  unsure (1)..(1185): unsure at all n locations
ttgcccggagcgcgggttgtggcgggtgcctcgggggcccagcgtgtctctcatacgcggaggcaatcgatggcacagggcagctcgcggcgaatccggtatgcggtggtgggggcggggaatatcgcgcaggtggctgtacttccggccttccagcacgcccttgagaactcggagttggtggcgctcttttcctccgacgcggagaagcgcgacgtgctggggaagatgtacggcgtgcgccacaccgcgagctacgacgaccttgagcaggtgctgcgcgacgcggacgtggacgcggtgtacatcgcgctgcccaacacccagcatcgcgccttcaccgagcgggccgctcgcgcgggtgtgcacgtcctctgcgagaagcccatggcgacctcggtggaggactgtgaggcgatgattcgcgtcacggacgagaatcacgtcaagctgatgatcgcctaccggctccacttcgaggaggcgaacctgcgggccattgacctgctgcgttcggggcgcctgggtgagccgctgatgatgtcggcgctgctgacgcagcaggtgcggaccggggacatccggacgcgcgtggacgtgggcggaggcgcgctgctcgacgaagggccgtaccccatcaacgcggcgcgctacctcttgcgtgacgagcccaccgaggtgttctgctacaccaacgaggagcaggaccctcgcttcaagggcgtggacgccacggccttcgcgttgatgcgcttctcgaatgggcgcatcgcgcagttcggcatcagccacgccgcatcggcggtctccagctaccgggtggtgggggagaagggcgacctgctcgncgagngcgngnggggctacgagaaggagcgcaagcatgtcctcacgctggagggcaagacggaggagcgcgtcttcgcgacgcacgaccagttcgcgccggagctgctctacttctcgaagtgcgtgctggaggaccaggagcccgggccgtccggccgggaagggctcgcggacgtgcgcgtcatcaccgcgatgcaggagtccgcgaggacggggcgcccggtgaagctggaagcattcccgatgaagcggcggccgtccctggaccagctcatcgtccgccccgcggccaggccgccagcgccagtgaacgcgcccgcgccagtgcaaggatga

SEQ ID NO: 4943 - DNA, 1263 bp, Myxococcus xanthus
atggcggacgtggtggcgcggctgctcgcggacacgcagcccgccgccgtcgcgacgcctccaccggcgcctgtcgcggctcccgtactccaggtgtcgtcagcgggctcaccggtgaaggacctggaggcgcgggtccgtgccgtcttcgctcgggtgacgcgctatccggaagagctcttgacgccggaggcggacctggaggacgagctgggcatcgactcggtcaagcaggccgaggtgatggccgtgctcatcaaggagctgggcctgaccgatgctccgcagccttcgcagcggctgcggacgatttcctctatctgtgagatggcgcgcgctcggctggcggtcgcggcgcccgtgcgcgaggaccgagcgccgcgtcagtcgccgccgccagccgtgctgcccttcgcggggaaggtcgcgttcgttacgggctctgggaaggggattggcaaggtcatcgcggctcgcctggccggctcgggggcgacggtggtggtgaactcgttccactcccgtgacgaaggagagcggacggttcaggagattgttgacgcaggagggaaggcgttccacgcctggggctcagtcgcgcaggaagagcacctggaccggatgttcgccagcatcgaggcgcagttcggcgggttggacttcctggtgtgcaacgcgtccaacggcctcatcggaccgttcgaccggattactccgcgcgactgggacaaggcgttccgcacctgcatcacggggacctatgagtgcgccatgcgcgcgcggcccctgatggcccggcgtggcggcggaagcatcgtgacgatgtccacctccatgtcccagcggtacatgcacgacctcggctgtcagggcgtggtgaaggccggggtggagtccttgacacgctacctggccgcggagctggcaccggatggcatccggaccaactgcgtgtccgcgggaccggtgcatggcgagctgctgcgcatgttccccgacgccgcgagccgggtcgcgcgctgggagtcggcgacgccgggcggggaaatctgcactgccgaggatgtcgccgacgtcaccgagctcctcctggggcccaagacgcgccgggtaaacggcgccatctgggtggtggatgcggggctctccggcacggtggacgggctgctgccgggcgcgtcggaggcacggcgttccgaggcgcagcgcgggtctcaccgcagtgagcacgacctgcgagcgctcctcgcgctcgattcctga

SEQ ID NO: 4944 - DNA, 6651 bp, Myxococcus xanthus
atgggttacttcgcggtcccgtacgacattcatttcgatgacacgatggcctacgggagccatcacttcctcacgaacttcaagttccagtgtgctggacgggagcacctgctcttcagcccggacgtgttcgacgtgccggagttccggcgcgacttcgaccaggtgctgctgctcacctacgagggctactcgcgcaacctggcaccggccagcctgggagaccggttggtggtgctgacgacactggaggaggggggagcggtctccatccgcttctgctttaggaccctcaagagcgatgggacgccagtggcgtgcggcttccagacggttctctgtgcggaccggacgtcgggtgccctgtgttcgtttcccgattcgttcctgcggtgcttcgattcgttgtccggcatcttcgagcgcgcaggggcacggagcttccgggactgtgtccagcagggaggttccgcactcaaggaggtgtttccagagtccatccgggcgctggcgaagtcgctgctcgcggacccggcgtcgctggggacgtcccgcgtcgtttcgttggagggggcgcccgcggcgagtactgccgagagtcccggcgcgctggtgctgccgccgggggcgacggcatttctgttcgccgggcagggttcgtttgatccagggctctatctccaattgaaggcgctcgaccctgacctcggagacgagcttcagggggtcgccgccgcatgtcgtgcggtcggagtggaggcggagccgttgctcgccgcgcgtgatgtctcgggcgtccagcgtgcgctggaagagctgcctcagctcgaccaactgggcatctacctgtccggagtcctgggcgcccggtggatgcagcgccagggggcgagcccggacgtgttcgtggggcacagcttcggggagattgccgcgatgacggcggcgggtgcgctcgacttgcgcgctggcgcgcaggtcgtctgccaccgcatccgagcgcttcaggtccttcccgacgacttcggaacgctggcggcggtggcgctcggggagtccgaggccgttcgcgccatcgcggagtgcggcgcttcgagattgcacatcgcgggacgcaaccacgcgcggcagacggtggtagcgggagcgcgcggtgagctcgcgcggctccgcgcgctgctggaaggccgggggcagggattcaccttcgtttcgagccggtaccccttccaccatccgggcatggccccggccgcgaaggccttccgcgagatgctggaccgtgtgcccatgcaggcgccacggcgccgtatctattcgcccattgaacggcgcgcttatgtgggcgggcggccagagctggcggatgcgctcgcatcgcacctggtgcgctcgttcgacttcctggggacggtggagacgctctcccgcgcgggatgcgcgcgcttcgtcgactgcggaaccacgggcgtcctggcgcgcatcgtccagaaaatcatccccgaggagacggccgccgaggtgagcgtcatcagcaagctgcttccggcggagcggtctgccccgtcggctggcatcgagccgaagtccgtggatgccgccgaggtcgacgaaagcggcattgccgtggtgtcgctgggctgcatcctgccggggggagcgaaggacccggaaacgtactggcagaacatccggaagggcatcagcggcatcgtcgaccagggcctgttgcagcccgagttggtgacggacttcgcgggtcccgcgggaactccagaccggacgtacaccctgctcacggggtatgtgcgggatgaggacctggttccgccgccgggcttcgacccgacgcgtttccagcagtacgtccgcgagcagaagctgctggccatcgccctttcgcaggccatgcagggactgaagccggtggcatcgaagacgccggggcgcatccagtgcctgctcggttcgacggcggaagggtcggccgagtacgacgccgcgctgagcgtggaggctggagaggcgctgctgagtgcccggggggagcgggttcatgacatcgcggcgctggcgtgcgcggcgcgtgaggcacttggggtggaggccatctccagtgacctggcgccgcatcccaccctgcaggccgtggtgacggacgtggtggggcagggtgtcgccaccacgctgctcgacgctgcttgtgcgtcgtcgctctatgccatggcgctgggcatgaaggcgctggagcgaggggactcggacctgattcttgctggcggcgtgttctcgccggggcctggcaacagttgtctgttctcacagttcaacggcctgtccgccacggggagccggccctttgacgcgcgcgcggacggcgtcatcttcggtgaaggcgcgggtgtcgttgggctgatgcgcctgaaggacgcagtcgcggcggggcaccgggtccatgccgtcattcgaggcgcggggctctccagtgatggtcggagcagctcagcgaacgtgcctcggtcggacgggcaggtggcggcgatggaggcgtgctactcgggggcccaggttgacccggcgagcgtgcagtacatcgaggcgcacggaacggcgactcccgcgggggacgccaccgagctcaggtcgattgcccgcgtctttggtggcaagcgcagtggcgttcagctcgccagcgtcaaggcactgattggccacgttggctgggccgcgggtgctgcttcggtcatcaagctgtgcaaggcgatggcgcaccggatcttcccggtgcagtccaacttcgatgcgcccggtgccgcgctgcgcgccatggggcccggcttcgaggtgaacacgcgcgagcagccttggccggagaatggcgaattgcctcgtcgtgccgccaccaatggctttggctttggcggaaccaatgcccacctggtgctggaggagtaccgggggccttcatcggcgccgaagtcccgtgagggcatcccatcggaggccgaactcgtggtcgtggccacggagggcttgttcccggatggacgcggacggcccgaagcgggggttcctgtcgaggtgggagcgcgcttcgatctgcaggcactgcgcctgccgcccacggtgcgcctgctgcccgacatctccgaggacatggatgcgacgcagcacctcgggctcgtggtcgggagtgcgctcgcccagaagctgggggcgttcgacgcgcttcgttcagggacggccatcgtgctggggctggagggcaagacgcgccgtggtgtcgaggcggtccagcgtgtcctggcgttcacgctgcaacggcgcttgagtgagaaggctcgtcgcgagccagcatccgccgcggtgctgcccctggcggagcgtctttactcggcggtgatggggagcctccgtccctcggggccgtacacgcttcaggggatgatgccgaacgtcacgcccggccgtgtcgcgggagcgctcgacgtcaaggggcccaatttcgtggtggatgcgggggctgcgtcgtcctcggcggcgctccaggctgcgcgggggcttctggagagcggcttcgagctggtcctcgtgggcagtacgcacattggcaggccgggtgaagtcagaggggcgcagcagcccgaggaaggcgcggcgctcttcgcggtgacgacggcggagaaggcccgaaggctcggcttgaagcccatgtgccagcttcagctttccacccgtggcacgaaggggacaggtgcgggtatcgacctgccaccgcactcggcggcggagagcctggcattgctgcgcgccgtacacgcggcggcggatggccgtgctggcacgctgcggttccaccccgatgccgcgacaggtgtccggctcgaagtgcggctccagccgatggcggacgggctgcccgtggaatcaatgcagtcgtcgtcgcgagcccactcccatgccgcaacggaaggccggcttggcgtgtcatctcgggcagcggagcagggagggcggattgacgcctccacgtcacctcttcggacgcatcctgatgccgtgacggacggccgaagcgaactgccgtcccgaccgtcagagggagtgcggcttgcttcttcccgttctgttgaatccgcgtcgtcacccgccgacggcgcatcgggagccgagttgcaagccgcagcgggaggcttcgaccacgccgcgcccattcagtacctgtcgcccgtgctggtggagcggccggttcggaagacacggccctcgtatctcagaggccgtcgggtgctgttcatcgcggaggacgtggcgctcgcgcgcgagcttgcagctcgggcgcaggccctgtgcggggcggagcacctgattctctgtccgggaacaggttcggattcgggacgcgtccggtacgtcgacctcacgaccgacacctccgcggaggccgggctggccgcccttggcttcgagcccgaggtcatccttgcggtcagccgcatcgaggcaggggcgctcgaggccgcggtggtcgcggacacggcgatgaagcacggggccctggagctgctcttcctgaccgcccgtcgcgcgtatgagcgcctgtctcgtggcgaggtggagctggtgagtctgtgcattggcgctgtgggcccacggcggtgcctgcatccaatgtcgggactgttcgcggggatgctcaagtccatcgggcgggaagtgcctgcccggaacgttcgtgccgtctccaccacggccatgctgctccaggaggcgctcgagctggccgaggctgagctgggctcggaggtggaggggaatcactccatcgaggtgtgcttcgaaggtccggtgcgctgtgtccgcgtgttgcgggtgacggacgtcacggcggacctggcggcgacgctcgattcgcgctcggtggtcctgctcacgggcgggggccggggcgtcacggcagtcctcgcgggagccctgctcaagcggtttggatgcaaggtggtcctcgtagggcggagcgatccggatgaggcacccctgcgcgtgctccaggcccgtgaggaagacctgccggcgatggagcgggagttctacgcctcggagctggcccgcaatcggggcgtgcgcatgccagagctgcgcaagcgcttcgagcgcttcctggccgctcgcgagctgaaggccacgctggagggcctgggccggcttccgggcgaggtgctctaccgggccgcggacgtcacgcgagcggcggacgtggaccgcgtggtccaggaaatcgtcgacacgcatggacgactggacctggtggtgcatggggcgggcacgcagacgtccaagaagctgaatcgcaggcagctcggggagttgcgtacgaacctgggcaccaagctgctggggctcaggaacctgcgggaagcctgcgtgagtcggctcgctcggccggtgccgttccacatccttacctccgcgttcagctacatcgggaatgacgggcaggcggattacggcgcggcgaacgaggcgctggaccggctctgcgcctgggtcagcgacgcgagccaggaggtccgctggtgcagcgtgggctggttggcctgggacggaatcggcatgacgcggggttcggagtaccgcgtgctcggtgccagccggcatctgcgaggaatccgagcggaggaaggcgaagcgctcttcctccaactcgtggatgggcggcctcgacaggccatcaacgtccagctcactgagagcgagcgttcctactacgcactggaggtcttgcccgcggaggagacgcgttctctgtcggccgggcccgtgcagcgcgagctggtcgtggattcggcgagtgtgccgtgcctggaggaccacctcgtgcgtggcacgcccacgttgcctggggcctgggcgttggacctgatgctgcaagccgcggtgggcaacgggcggccagagctgcgcaccgtcaccatcgaggacgtccggttctcacgcttcatccgagtcaagcagggaggccgccagcacctgcgcgccgaatgctcgcccctcatcgatgagcccggatgtcatggcgtgcgggtccggctgatgggggacatcgtccatgcgtcgggtgtcgtgctggagaaggacctcgtctatgcggaggcgcggttcacgctgacggcggagccgccgcggggcacgccggagctggatgcggcggcgccgtcgggacaggcactgcgggtccacgacccacactgcgccgccggtgcacccatcgaactgcggaagatgttcgactgcctggaggaaattcgcatcgagccgtcggcccggttcgcgcggttggggctgccggccgagcctcgtcaggcgggcagcaccgtgcccgcgctcgtcctggatgccgccttgcggctgagcgcgatgcatgtggatggggagtcgagcgcggtgttcgcgcccatccagttccagcgggccacgttcgatcgcggcctggtggacgtccggggtggagcgccgcttcacctctcgttgaaggcacttcctccgcgagtggatggcgacctgctggagtgcggcaccgtcgctgcgctcgacgaggcggggcggcttcggatgttgctcgagggcggccttgcgcggcccatggcttga

SEQ ID NO: 4945 - DNA, 1284 bp, Myxococcus xanthus
atggcctccggcgcggaggagcttgcccccaccgacgcgaaggcacggatccatccccagaacgcgagggccctgttgcgcgcggagcgcctcctcgcgtccgagccccacttcctccctccgccgttgcctgactgtcctgggatgatcgaccacggcgtcgtccggctcggcgtcgcgcccgcggggcacctgaacctcccctgccccaccaacacggtctccagcggcaccttcggcacccgcacgattggcttgcgctacctgcccaccaacggcgaggccgccgcgcccgggagcgcgtgtgagggctggggcgtcgcgagcgccgacctgggcatctccggctacagctccgcggactgcggcgcgtcctccaacctcacggcggagatcaacgcgccatcgcccatctccaccatgtcggtggtgcgcgtggggaacacgttccgggtgacgcacatctacacgccgtcgccggtgacgaaccatctgtaccaggtggacgtcctcatcgagaacatcggcacggccttcatcgccgacctgcgctacacgcgcggcatcgactacgacatcctgccgaacaccttctccgaatacgtcaccgtcgcgggcaccgcgggcaacccctgggtggtgagcgcggtcgacaacaacttcgtgtcgctggacccgctggccatcaactactccctcatgggcggcacgggtgacttcaccaacgtgggccctggtgacctgggcgcgcagttcgacttccggctgggctcgctcgccgtcggacaggtccgctccttccggacgttctacggcgccgcgggcaaccaggctgacgcgctcaacgccctgtcggccgtgggcgcgagcacgtactcgctggccaagggaaattggaacggcaccggagacccgctgagccccaccggtgcacctgcggggacgttcggcgcgaccaccggccagccgaacaccttcatgtatggcttccgcccgccggagtcgccgacgagctgcacggtggagtgccctcgcgtcctgtcccacggcgtctacaccgtggaccactcgggcgacctggaccgctgcgtcgtcaacggccaatacgcgaacaacaccgtggccgtcacctacctgttcggcgaacgcgtcgagttcatctgcagcgactacggcagcccgcatggcaatccgtgcaacgtcggtcccggcgccgacacctgcaacctggcggccttccagagcctgtgcagcagcccgacgttcgcgcagtactgtctgtaa

SEQ ID NO: 4946 - DNA, 888 bp, Myxococcus xanthus
atgaaacgcgcccatctggatgagatcttcgccttcatggccgtcgtggacgcgggcagtttcgtcagcggtggccgagccatcgggctgacgcgctcggcggctggcaaggccctggcccggctggaatcccgcctgggggtgcgtctgctcaatcgcacgacgcgccacctgagtctcaccgacgatggccgtgtcttccatgagcattgccaacaagtcctggcggctttggatgatgcggaagccagcgttggagaccacacgggcacgccccggggcgtcttgcgaatcaccgtgcccgacgcattcggcagactgcatgtcctgcccgtgctgaagaaatatctgcagacctggcccgacgtgcaggtggaggtgagcttcaccgatcgcgtcgcggacatcatcgaggagggttacgacctggccgtgcgcatcaatgtcaccagcaccgatacgcgactggtgtcccggctcgtggcgcaacatcgggtgttcgtctgcgccgccccctcgtacctggccgcgcgcggcgaaccccagacattggaggagctcgcgacgcatgattgcctgctcttcagtagccgggcgcgacgacagcgctggcgactgcgcccgaagggcggcgcctatgtgaccgtggagggtcaaagccgcctacggctcgacagcggcgaggccatccgggacgcggctgtcgcgggactgggcatcgcctttcttcccagctttctggtcgacgaagacctggcgcgtggacgcctcaaggcgctgctgccgtcatgcgagacggaggtcgtccggatcatggcgttctacccgagcaaacgtcacctgccagccaaggtgcggcgcttcatcgacctgttggtcgagcaatag

SEQ ID NO: 4947 - DNA, 1863 bp, Myxococcus xanthus
atgtggctcagcatccccatccccgacggcggctggacggaccccgcgctgtacctgggcgaaatcacccacgcgctcgaggtgtacgcggacggccagcacatctacacgagcggcaagatccggccggacagctacgagattggcgagaacctgtcctggcacatcgtgcccctgccgcgcgatgcgcagggcaagcgcgtgctgctgcgcatccagtccagcaatcccaacatcggcgtggcgcaggccgcgcaggtgggctcgaagtatgacctgctggtctacgtgacgcgccagggccaggcgcccttcgtcatctgctgcctgctgctggcggtggcgctcggcgcgggtggcgccttcgcgctccactggcggcgccggatgctggcgggcctggcggtctccgcggccagcggcggcctgatcctcctgggcctgagcggcatgcccacggcgctgtggggctcgtccgccgccgccacgctgggcaccacgatgggcatcttcctgctcgtcgccggtctgatggagttcgtctcggacgcgctgctcgacaaccggcgcggctggttccagaaggcggccatggtgttctcgcccgtggcgggcgtgtgcgccctggcgacgctccttgacctgggcatcgggcagcgcatcctcgtgcccttcctccccatggcgatggtggtgctgctggtggtgctctcagtggccatcacccaggcgtggttgggcaacccggacgcgcgcctcttcgtcggtggcttcgcggggctcgtcctctccatcgtcctcaccatcctccccgtcatcggcctggtgggctggtcgctgggcaacgtcacgcactggggctacgtcgcgttgacgctgtcgctgctgggcatcgtcacccgccgctccatcatggtggtgcgcacgctcgaagcgcacacccaccagttggaggcgcgcgcgcaggaagtgcgcaacctggccgagcgcatgggcaacggcgccggcgagctcgccacggtggtgcagcagctccgctcgtccagcgacgagcagaccgagggcgtcagccgtcaggccgtggcgctccaggaggcggagcagacggtgaaggagatccgccgcagctcgcagatgacggcggagaaggccagcgcgctcgcggcttccgcggagagcgctgaacaggtgggccgcgagggaacggccgcattggagcgcacgctgtcggacctggcggccatccgcaccgaggtctccgacatggcccggcgcatcttcgcgctcgacgagcgcacccgcgaggtctccggcatcgtggactccgtgaaggacctggcggaccagtccaacatgctggccatcaacgccgccatcgaggcggcgcgcagtggagagagcggccgtggcttcggcgtggtggcccgggagatgcgcggcctggcggaccagtccatccaggccacgcaccgcatccgcgaggtgctcgacggcgtcagcaacagcatgcgtgaggccgcccgctccagtgagaagggcgacgagcgcgtgcggctgagcctcgacgccgtgcggacctccagcgcacagttccagcagttggccgacatcatcggcgacaccagctccagcgtgcggcagatcaccgccgccgtcagcgcgcaggatgcgggcacccaccagatggcgcaggccatccaggagctgtccgggcagatgcagcgcacgctgaatacggtgcaggagacgcaggaagccgcccgctccgtgcagtcgctcgcggagagcatgtccggcatggccagccatacgctcaaggcggaaggcctgtccgtgcccgcggcacaggcgcaggcgcgctga

SEQ ID NO: 4948 - DNA, 948 bp, Myxococcus xanthus
cgcgaggacgtcctgccgatgctccaggacgtgttggagcagctcaccgtcatcgagaacggcttcgtgttccgctatgtccccgcgggcacattcatcatgggcagcgacgacggcgaacccgacgagcgccccgcccacgcggtgacgttgtccgcgttctggatgagcgacacatcgctgtcatggagcgccttcgctcgcctcctggattggcccgaaccgcccgagttccccacggacgaacaactcgacggattcaccgacagcttcgcgtacttcaacgactcgaagattcgcctgcagtactgcgagaacgacaccctgcaggccagtgactggcacgcccacgccatccacacgcgatgggaaaccggcgacggcgtcatcaagacctcacaggaattgttcggcacgccagcgcgcgcgggcgagggcccgctgcgctatgaccagaagcccatggtcgcggtcgccccttcgctcgcggaacagttcgcgcggcgcttgagcacgccttccgtcacctatcgcctgcccaccgaagccgaatgggagcgcgcggcgcggggctgcttccgtggcgcggcgtacccatgggggaacgaacctccagacgcgagccgcgcggacttcgaccgcttcaacgacttctcgctccgccccatgcgcgccttcccgcccaacgactacggcctcttcggcatggcgggcggcgtgagccagtggtgccaggaccactacgacgccgagtactaccggcactcgccgaagacgtcccccgtctgcgtgctgggcgaggacatccccaagcgcacccacgtcctgcgcggcggctcgtgggcggactgcgcggacgcgctgcgggtcagcttccgctccgcgagcgacaccggggcggcgcccaacatcggcttccgcctggtccgggttccctcacggaggtga

SEQ ID NO: 4949 - DNA, 1296 bp, Myxococcus xanthus
atgccgttcgatgcccccgcggcggccgtgctcacccggctcaccgagcacaccgcggacgacgtcatcggtgatgcggaggctggcgaccgggacgccgtcatcgggctcatccagcacctgtcgacgaagggctacctccggatggatggccggctcgcggcggcccgcatcgaccgggcgcccccacccgaccacctgctgggcccgctcgccgtccacctggaggtcattggcgcgtgcaacctcacgtgcacgcactgcttcgcgggggagctgccgcgcaatcagtccccgctctccgtgaaggagatggacgcgctcttcgcgcagctcgccggattgggcagcttccggctgggactcaccggcggtgagccgctgatgcgcaaggacctgctggacatcctcgacgcggcgacgggccacggcctccatccctgcatcaccaccaacgcgctgctcatcgacgaacggtgggcgcgtgagctcggcaagcgcgagctggtgtggctgaacgtgtcgctggaaggcgcccaggcggggacgaacgatgccgtgcggggcgctggcgtcttcgaccgggtgatggagaagctcgcgctactcggccagcatgcgcgcttcaccctcgccttcacgctgacgcgcgacaacgtggcggaagtcgaggcctgcgtcgaactggcccggcgggtgggcgcgcacaccgccgtcttccgcccgctgtaccccgtcggcaccgccacccggcacccagagctgatgcccacgttcgacggctacgtggacgcactcgcgcggctggagcgcgtcgaagccgactcggacctcttcgcgttggaccccttcagtccttcggcgcgcgaggagctgcgcggcgtcgtgacggagggcccgggctgcggagccgcgaacacggtggcctccgtctccgtccagggcaacgtgaatccgtgcagcttcctgggccgggccttcgagtccggcaacatccgaacgcgccccttcgaggacatctggcgtgacgggcagtccttccagcgcctccgggcgaagcagacgggagaccgcttcaccgggggctgccgcgcgcgtgcgcagttctacaatggctccgcgttcgcggaggacccttggcaagcccagtccctgggagctgccacggagtcacatccactgcccgtgctcggcgcggagcggggacaggggggcgcatgtcggtaatccaagccgcgctggggaaagcccgggtccagcgtgccagtggggacctggaaggcgccgccgcgacgc

SEQ ID NO: 4950 - DNA, 99 bp, Myxococcus xanthus
atgctcaaggacgacgccacgggcctgggcctggcctcgagcgccacgaaggcctgggtgcggtggtccttccacgtggacgacgagggcttcaaatga

SEQ ID NO: 4951 - DNA, 600 bp, Myxococcus xanthus
atggggaccaaggagcaggaggcccgggagcgcattctccgggcgaccatcgtgtgcatcggccgggacggactggatgcgacgggcatccgggagattgcccgcgaggcgcaggtgaacagcgcggccatcagctactacttccggagcaaggagaagctggtcgccctggcgctggagcagacgctggaccaggccttcgggaacgtcctggaggacttcgatcggctccggttggagggcctgggcattcgcgaggcgttcgagacgctgctcgaggatttgatgagcaactcgctgcgctacccgtacatcgcgcacgcgcacttccacgacgcgctggcccatcagcgctacgacagttccgccatccagcgcttcaatgcgttcctcgccgaactggccgggcggctggcaccgggggcgccgcacctgccggagaaccggctgcggatggcgctcacccaggtgtgggcctccctgagcctgctgtcgatgatgccccggctgttcgaccagttcatcctgctcgacttcggcacgctcgacacgcggcgcgcctgggtgcagcaggcgtcacggctgctcttcgttccttga

SEQ ID NO: 4952 - DNA, 1728 bp, Myxococcus xanthus
cccgacggcaatacgcagtacatccccgtgaagggcgtcttcgcggacttcgacaaggacccttatgtcgagcctggcttcatgcgtccggcgctggcggaacagctcgacgtcttgattgtcggaggtgggtttggcggcatgttgtcggcagcgcggctgcgtcaggcgggcgtggacgccatccgcattgtcgagaagggcggcgacttcggtggcacctggtactggaaccgctatccaggcgccgcttgcgatgtggagtcctacatctatctgccgctgctcgaagagactggctacatgcccacggagaaatatgcgcgggcgcccgaaatcttcgcccattgccagcgcatcggcaggcacttccagctctatgagaaggcgctgttccagaccctggtccagtccatggactgggacgaggacgcccggcgctggaacgtcacgacggaccgaggggaccggctggcggcgcggttcgtcatcatcgcgggcggcatcctccacaaggccaagctgcccggcattccaggcatcgagacgttcaaggggcattgcttccataccagccgctgggactacgcctataccggtggcagccccaccagccgcatgacccggctgggcgacaagcgcgtgggcatcatcggcacgggcgccacggcggtccaagccattccccaactaggggcagtgtctcagcagctgtatgtctttcagcgcaccccctcgagtgttggcgtgcgcggcaaccggcccacggatgaggcctgggcgaagtcgctccaggccggctggcagcaagaccgcatccgcaacttctccgcgattgtctctggccgcgcgctgccggtcgacatggtccaggacggctggacgtacatcttccaggacggcgcgacccagcaggcccggacgcccgaggaagccgtcgaactccgccagttggctgactaccggaagatggaggagatccgcgcacgggtggatgccattgtctcggatgcggcgacggccgaggcgctcaagccttattacaacccgatgtgcaagcggccctgcttccacgacgagtacctggagacgttcaaccggcccaacgtccagctcgtggacaccgaaggcaagggcgtggaacggatgacgccgaggggtgtggtggtgaagggggaggaatacccggtcgactgcctcatctacgcctcgggcttcgaagtctcgggtgattacacccggatgctgggcttcgacatccggggccgcgatggcacatcgctccgggaaagctgggccgacggtcccgcgacgctgcatggcatgcacagccgcggcttcccgaatctgttgatgttcaccacgacccagagcggctgggccatcaacttcgtgcacatcctcgacgagcagtcccagcacgccgcctacatcatcgggcggtgcctgaagcagggcgtggaagtcatcgagccctcggcgcaggcgcagcagcagtggtgggatgtgattctctcccgcctcaggatggggatttccttcggcggggcggattgcacgcccggctactacaacaacgagggcgtcagcccggggccgaacgccatccgctacgcgaccttcggaggcgatacgctcgcgttcatcgatgtcctgcgtgcttggcgtcagggcgatggactcgtgggcctggagctctcgcagggcaaggtggcttcgaagccatga

SEQ ID NO: 4953 - DNA, 1650 bp, Myxococcus xanthus
atgttccgatgcgtctccaagtccctggccgccggtctgctgttgatggcggccccggccctggcgacccctcccaagtcctaccgtcaggagacggtggtggccggctcccacttccagggtgtccacgggctcgccgtggatggaaagggaaacctgctggccagcaacctgctgggccagtcggtccacgccgtcaacctgagtacgggcgcggtgagcacgctcgtggggcctccgctgggcggcgcggatgacgtcgcgctggggcctgacggctccatctactggacgggttacttctccggccagttgatgcggcgcactccggacgggaagacgcgcgtcatcgccaggaacctgccgggcctcaactcgctggcctttcgcggcgatggccggttctacgtgacgcaactcgggcgaggcgatgcgctgtgggaggtggacccgaccgggcgcaagccgccccggaaggtcatcgacgcgcccggttatctcaatggcttcgagttcggccccgatgaccggctgtatggcccgctcatcctcaaggggcagattgcccgcgtggacgtggacacgggcctcatcgagaaggtggcggaaggcttcacggtgccggtcgccgtcaacttcgacgcgcgccgggagaacctctacgtcgtcgacgcggcgacaggtgaactggtgcgggtccgcctgccgtcgggtgccaaggaggtcgtcgcgaagctgcccactgggctcgacaatctggccgtgggtccggatgaccaggtgtacgtgtccaacatggtcgacaacgacatccgcgtggtgaatcccgcggatggctccgttcgcctcctggtcgaatctcgcttgtccgtgccctccggtatcgccgttgtgccagatgaccccgaggagacgctgtacgtggcggatgtgtacgccctgcgccgggtgggcgggcgtgagggcttggtgacccagacgacgcgggtcctctcgtcgcagttgaacttccccatgaacgtgagcgtgactgcccggcatgtcgtgctgagcacggcctatctgggcagccacagcaccctccaggtgttggaccgcggcacgggagcgctcctgcggaccatccccagcccgaatggcgcgcagggcgtggtggagctggaggacggcacgctgctcgtcgccgaggccgccacgggccggctcgttcgtgtggatacctccgagcccgctgtcaccacggtgctggcggaagggctgggtgggcccgtgggactcgcggccgacacgaaggcgaaggagcctggggtgtacgtgacggaggtgcgttcggggaaggtgacccgcgtgcgcctgtcgcatggggcgcggcgcacggtgccctcggtcctcaaggcgccccaaggcatcgcgctgcatcccgatggtgggttgattgtcgcggaggtgggccgcaagcggatggtgcgcatcgacgcggccacgggccgggtgacggtgctcgccagtggcctgcgcatcggtctgcctgagagcgagggactgcctccgggctacatccccacgggcgtggcagtgggcgcgtcgggcaccctctatgtgacgtccgacatcgagagcgcgctctaccgcttcgtccccgtgccttga

SEQ ID NO: 4954 - DNA, 1194 bp, Myxococcus xanthus
atgaaggcatctcgtcggcagctccccgtctatgtgccgccgcggacggtctggattgtcggaacgcaggtcctgctgctcatcctgtgctgggccgcgctccgggcggtgtaccccgtgctcacgctgctggccgtcgtgctgctgctctccatcgcgctgagccccctggtgcgaaggctgacgcagtgggggcttcctcgcggcgcgggtgtggccatcgtggcgctggcgctcctggggatgatgggcgtcctggtgggctcgctggtgcccatgctcatccaccagctccagggcctggtccagtcgatgcccgccatgcttgagcggctcgcgcagtcccgctgggtggaggagctgagcacgcgttatggcgtagaggtccaggcggaggacctcatccgcttcgagccgacggacgtcgcgggccgcctcatcaacgtcctgtcgtcgacgctgggcctggtggcgggcggcatcaccgtggtggtcctcacggtgttcagcctgctgttcggtgaagacctctacgagagcaccatccagtgggtgtcgccacgccgccggccacgcgtgcggttgctcatgtcccggatgcgaaaggccgtggccaactacctggcggggaccctgctggtgatgaccattggcggaacggtcgccgccaccattgcgctcatccagggcgtgccgtacttcctgccgctgggattgatggtgatgatgatgggcgtcattccctatctgggcagcatcatcagcgcggtgctggtgggcgtcatcaccctggccgcggtgggcctcaaggatgcgctcatcgcggtggtcgtgttcatcgtgtaccagcagattgagtccaacgtgctgggccccatgattcagcggcgggccatcaagatgaacccgctgctcatctccatcgtggtgctctgcggcggcgcgctggcggggctgcccggcgtcgtcctggcggtgccgctggccgcggccgcgcaggtgctggtgcaggaagtgctggggcttcgccaggaagcgtggcagcgcagccatcggatggaggactcgaagcgggagcccggccggggcgcggtggaggaagggttgctcttcgcgggccccatggcagggccacgtccgtcagcgccgccgagccgagagccaccgccgccggacacgccctcggagcactga

SEQ ID NO: 4955 - DNA, 1575 bp, Myxococcus xanthus
gccatcctggccattgacctcgggacgtccgccgtcaaggtggcggccgtcacgctgaggggacggattctgggcggtgacgtggagccgctggagctggccctgctcccggatgggggcgccgagcagcagccggaggcgtggtggcgcgccatcgtcctggcgacgcggcgcctgctggcctctggggccgtgcgcgcggaggacgtcatcggcgtcaactgcagctcgcagtggtccggcaccgtcgcggtggacgcgtccggcacgcccgtgtgccccgcgctcatctggatggactcacgcggcgcgccggacgtgaagcgcgcggtgggcggcttcctctccgtggagggctacgacgtccgccgcctgatgacgtggattcgcctgtcgggcggagtgcccagcctgtcgggcaaggacccggtgggccacatcctctacctgcggcgcgagcgcccggacgtgtaccggcggacgtacaagttcctggagccgaaggactggctcaacctgaagctgagtggccgctgcgccgcctcgtatgactccatcaccctgcactgggtgacggacaaccgcgcgctgggccgcatcgcctatgacgaccggctgctgaagatggcggggctcgagcgggagaagctcccggacctggtccccgcctccacggtgctggggccgctccaggcgcaggccgcgagcgagctgggcctgcgcgaggacgttcaggtggtgacgggcgcgccggacatcctcgccgccgccgtggggtctggcgcggtgggagacttcgagccccacctgtgcgtagggacctcgtcgtggctgtgctgccacgtgccctacaagaagacggacctcttccaccagatggcgtccgtgccgtccgccctgcccgggcgctacctgctggccaacgaacaggagtccgccggcatctgcctcaccttcctcaaggacaacatcctgtatggccgggatgcgggggcgggcacggacggtgacgcgccggacctctaccgggtgatggaggcgcaggcgggcaacgtccccgcgggcagcgaccagctcatcttcctgccctggctcaacggcgagcgcagcccggtggacgacaagtcactgcgcggcggcttcttcaaccagtccctgaagacgacgcgggcgcatatggtccgggcggtgatggagggcgtggcctacaactcgcgctggctcttcacctatgtggagcagttcgtgggccggcggttggactcgctgcgaatcatcggcggcggggcacgctccgcgctgtggtgccagattcacgcggacgtgctgggccgcgcggtgcagcaggtggatgagccggtgctcgccaacgcacgaggcgccgcgttccaggccgcggtggcgctggggcggctgacggtggaggagattccctcgctcgtgccggtcgcccgcacctttcatccggattcgaagaacgcggcgctctacgacgagctgtttcgcgagttcgtcaacatctacaaacacaacaaggccatcttcgcgcggctcaatcgagcgcgaagcgcctga

SEQ ID NO: 4956 - DNA, 1530 bp, Myxococcus xanthus
atggcacttccagacctgaaggcgctgagcctgctcaaccacgtcccgccgaggctgctatccgcggcggagcgctacctcaaggctgttccgggtgtgaagggcctgctcaaccgggagacgggctcgctgctgtccgaactggagagcggcctcaagccctaccgcgggaagatgcagtcgttcgaccacctgccgccgacggggcgctcgcgcgaggacgtgctgcgtgagctccaggccctggagtcgcaggaggagtaccgctggcgggagggccgcgtgtccggaggcgtgtacaacggcgacgcggagcacatcgcgttcctcaaccgcgtctatgcgctgcattcgcagagcaacccgctgcacgccgacctgtggcccagcgccaccaagttcgaggcggaggtggtggcgatgacggccagcatgctcggcgcggacgtggcgaacgcgggccagccggaggaggcgcgcatctgcggggccatgtcgtccggtggcaccgagagcatcatgctggcgatgaagacgtaccgggactgggcccgggagaccaagggcatcaccaggccggagatggtggcgcccgccagcgcgcacccggccttcgacaaggcggcgcactacttcggcatcaagatggtgcgggtgccggtgggcccggactaccgtgcggacgtggccgccatgcgcaaggccatcaaccgcaacaccatcgtcctcatcggctcggcgcccggctttccgcacggtgtcatcgaccccatcgaggcgctgtccgagatcgcgcgcaagaagcgcatcggcttccacaccgacgcgtgcctgggcggcttcgtgctgcccttcgccatgaagctgggctacgacgtgccgcccttcgacttccggctgccgggcgtgacgtccatgtccgtggacacgcacaagttcggctatgcggccaagggctcctcggtggtgttgtaccggggcacggagctgcgctcgcaccagtacttcacggcgacggactggccgggtggcatctacttctcgcccaccttctccggcagccggcccggggcgctcatcgcctcggcgtgggccgcgctggtgagcacgggggagcagggctacctggacgccacccggagcatcctggagacggcggcggccatcaagaagggcatccgggacatcccggagctgcacgtgctgggggacccgctgttcgtcatcgccttcggttcggagtccgtggacatcttccaggtgatggagcggatgagcgagcacgggtggaacctcaacggcctgcacaaaccgtccgccgtccacctgtgcgtcacgctgcgccacacgcagcccggcgtcgcggagcagttcctggtcgacctgcgcgacgccgtggactacgtgaagtcccaccccagcgcgaaggggacgatggcgcccgtgtacggcatggcggcctccgtgcccttccgcggtctggtgagcgacctgctcaagaagtacatggacctgctctacaaggtgtaa

SEQ ID NO: 4957 - DNA, 633 bp, Myxococcus xanthus
atgaatcccgccgagaaagccgccctcttcctcgagcgcctccgggaagcccatccggatgcgcgctacgaactcaactggtccacgcctttcgagctgctcgtcgccaccatcctggccgcgcagtgcaccgacgagcgcgtcaaccgcgtcaccgccacggtcttccccaagtacccggggccacaggccttcgccgacgcggacaccgccgcgctggaggaggacctcaagcccaccggcttcttcaagcagaagacgaagtccgtgcaggccatgagccgcgcgctcctcgacaagttcggcggtgaggtcccccacaccatcgacgaactggtgacgctcccgggcgtggcgcggaagacggccaacgtcgtcctcaacaccgccttcaatctcccctccggcatcatcgtcgacacccacgtggcgcgcgtcagccagcgcctgggcctgacgaagaaagacaaacccgaggcgattgaagaagacctgatgaagctggtgccccaggagcagtggaccttcttcggccccgccaccgtcctccatgggcgttacacctgcaccgcaaagaagccgaaatgcgacgactgcatcgtgaaggatgtgtgcccgcgtatcggcgtgtaa

SEQ ID NO: 4958 - DNA, 1155 bp, Myxococcus xanthus
atgaacccggcttcgggctcgtgcgttgcgtgtggggcgcgtttcctgggaggcgtactggcgtgtccgcggagcgcggcgggggtaccccgggacgcgccggtccgccgatgggcgccagggctgtgccacccgccgctggtgggccggatcgcggtgctgaagcggctgatggggctggcggaggatgtgcggcgcgggctgggacgggcggtgtggttgatgggggaggcggggatgggcaagacgcgcatcaaggacgccttcgtggagcgcctggcctcggatggcttcgaagtctgggagggcagtggcctggcgctgccgggcgcaccggcgggcatcttccgggagctgctggacgccacgcgggcgctcagcccgccggccgggacgggccgcgtgtccagcgcggacgcggagcgaatccagcgcttcctggaaggccgcgagcgccagggcattccggcgagcctcgcctccgagcgcaccgccctcttcgactccctgtgccacgcgctgatgccccaccgccgtccgcgcctgttggtgctggaggactggcagcatggggacgcgctcagccatgcgctggtggaggagctggtgtcgcggctgtcgcacacgccgctgctgttgctggcgctccagcgccccagtggcacggcgcccgcgcctcttacggcggaagtcctgacggtggggcggctggggcccgccgagtccgcggcgctgctggagggccggctgcggaaccgggggacactgacgcccgcggcccgggtggcgctgctgcgcggcagtgccggacacccgctgcacctgctgcacgcggtgaccctgcacgaggagcagccggagcgggaggtgccactcacgggcgaggcggcacatgcgggcgcggcaggccttgctgcccccggcacagcgggaggtgctccgggcggcgtcggtgctgggcccgtcgtttccccgggcggtgctggtggcgttggcgggtggggtagggccgctggcgctgctggagacggggggctggctgcgctccgtcgcgggaggccggtacacgtgggcggtggagcccgccccgggcgtcgacgaactgccggaggcggagttgcccgcggcgcaccggcgggcagcggaagcctatga

SEQ ID NO: 4959 - DNA, 749 bp, Myxococcus xanthus
atggctgtgtatcgcttcgcgttgggactggcggatgctctcaagccagacgccgcgcgggagtggcagcgccgcctctgggaatacatgggcgacgcgcaccggctggcgggcgagcccgcggaagcggacgccgcgtggcatacggcgcggacgttggatgatgaggggttggcgtctcccgcgggggaccgggcccggcgtctgttcaagcgggcgtcggtggtgctcgcgctcggcaggtacgaggaggtgctggggctcgacagggaggggcgccgggattgtctgtccgcggcgccgctgttgtccgtgtcgctggacgcgctctccgcgttggcgctgtccgcgctggggcggttcgaggaggcgcgcgcgaggattgtcctggcccgcgagcagttgcagcgggcggtccgggatgacggccccgcgtgggcgggcgtggaggcgctgctccaccgggccatgggcagcgcgcagctcgggctgggattcccggaggccgcggcgtccgaatacgcccaggtcctgcgctggagcgagcgcgcgggggatacgtgggagcactccaccgcgctgctgaacctgggcgatgcgtattcgcgggcaggagacagggagcgcgcggcgcacttcttccagctcgcgctcgagctggactcccgcacgggagaccgccggggcatggcctacacgcaccatggcctggcgctgctgcatacgcgcgcgggcgcgcccgagctggc

SEQ ID NO: 4960 - DNA, 105 bp, Myxococcus xanthus
atgcgccgggtcctcatcgcagtggccacgctggcgagcacgcccgcgctggcggccccggattggctccagcccgtcctggtgggtgaaatcgactggggtcag

SEQ ID NO: 4961 - DNA, 894 bp, Myxococcus xanthus
atgcgcgcgcccctgttgtcccttcttgccctgctcaccctcgtgggctgctctgacaccccctccgacggtccgggggtggatgcgcccgtggaccggggccccaaggccatcccattggacggcgaccccaacgggatgttctgggacgccgagaacgaaacgctctacatcgccgacgaccagaaccaccgcatcctcaagtaccgggacggtgaaggcgtgtccctggccgtcgcgctgccggacgcgccgcccaacagcaccaacctgggtgaggtggtgcggatgccggacggcacgcttgtgacggtgcgcttcggcttcgggacggcgggcgcggtgctcttcgcgcggccggacggcaccaccggcaaggtgccgggactgcccaccaaccgccgccgcatcggcctgacggtgacggaggacgggcggctctacaactcctacttcgtccgcaacagcaacgtgaatgtgggctccatcgccctgctcaacctggacggcacggagcaggaggtggtgggtgcgctggagaagcccgtgggcgtgctggccgtgggtgactcgctctacatcgcggaccagattgccgggaaggtgtaccgctcgccgctggcgcgtcccgcggagctgaccaccatcgccaccctcaccgagccggacctgctgtcgctcgggccgggcggcgcgctgctcacgggcacccgtcagggcaccgtggtcagcatcaatcccagcaccggcgcgcagcgagtcatcgccagcggcttccagaacgtgcgcggcatcgcctacgacgccgtcaaccgccgcctcttcctcgccgaccacgacggggacgagtccaacggcaccacgcacttcctccagattgtcccggtggactga

SEQ ID NO: 4962 - DNA, 1062 bp, Myxococcus xanthus
atgacaccgctcctcacggccgtcctcggcgtcctgctcgtggccactcccgaggaagcaccggaggggcgcttcagcgtcgtccccttcgtgctgcccgcctaccagccggagacgagcttcctcctgggcggcgcggcatcgctcatctatcagcccccggcgtcgcgaggcggcagggagtcccaggtgatgctggccgccgccgcgagcacccgtggccagttcaccctcctcctccagccggacgtgaatctgctcgacgaccggctgaacctcacggccaccgccagcgcggcgcgcttaccggaccgcttcttcggcatgggcgcacgcacgcgggcggaggacgaggaggacttcacccccatcttcttcgagcttgaattgagtccgaagtggcgcatcgccccgcgcctctatgtcggccctaccgtgcgctatcagcacgcgcgcttcacctatgtcgcggaggacggggcggtgcggcgcatgacgggcgccgagggcggttcgacggttcaattcgggctcaccgccctttatgactcacgggacaacacgctcaatccggtgacaggcctggtggcgcggctcaacctgcgccgggcccgggacgcgtggagctccgactacgtcttcgatgtgctgcgactggatgtccggcgctacctcacacttccgtggggacagcgacacgttctcgcgatgcagggactcgtcgacctgcgcgacggtgaaccgcccttctatgacacggggaggttgggcgggatggagttgagccgaggctacctggaggggcgcttccgcgagcgccagcacctgggcgcgcaggttgagtaccgcgcgcccctcttctggcgactgggccccgtggccttcgtctccgcggcgacggtggcacgcagcccacgcgacttcgacatgcgtgacatcaaaccggcggctggcgcagggctgcgcttcgcccccatgacagacgttcccgtcaatctccggctcgatatcgcctacggaagtgaacccagcttctatttgaacgtgggcgaggccttctag

SEQ ID NO: 4963 - DNA, 1305 bp, Myxococcus xanthus
atgggagcggggctgtttgcgggcggcgcggcggcggcgctggggctgcggagcgcgctggcaccggtgtccaaggacgtgcagggcatcaacccccgaagcgacgcctggtacgacatccgcctcacgggggacgggctgatggacaaccaggtgctctggttcctcagccatgcaacccacggccagagcgacgtgggggacgtgctggagacggccagccgcatccagcccggggacgagcgcagttggttcgaggcgtggacccagacggcgcggcgggtccacggccacgcccagaacgccgagtccaagggtcaccggctgagcgccggccaggcctacgcgcgcgcggcgaactactaccgcgcggcgacgatgcactacacggacctggaggacccgcggacgctcgaggtgacgcggcaggcggccaccacgttcgagaagtcgaacgggctgctcggctacgacgtgcagccgctggccatcccttacgagggcaccacgctggcggcgtacttcgtgcgctcgccgcacgcgaagcccagcgcgcccgtcatcctcctccaccaggggctgcatgcctggccggaggagacgaagtgggtctgggaaggcgcggcccggcgcggctaccacgtgctcatgttccacggcccgggccagggccgctcgctgcgggaacaccggctgagcttccggccggattgggagaaggccgtcagccccgtggtggacgcggccgagcgcatcagcggggtggaccctcgccgcattctcctcatgggcctgtcgttcggcggcgcactggcgcctcgggcggcggcgttcgaacctcgcatcgccctgtgcatcgccaaccccggcgtcctcagttggtgggagtccaccagctcgcacttcaaccgcttcctcccgggctcgctggcactgctgaagtcacacccggagcagttcgaccaggccattaccgcgctcgcggaccggtggcccaccgcccagtactggctgcgtgacgtgtactggaagcatggcgcccggtcgccgtcggagctcttccgcaagctggaggagttcaccaacgaggccatcgtcgaccgcatccgctgcccggtgctcatcatggagggcgaggcggaggatgcctcgccgggccaatcccagaagctctacgacgcgctccggggccccaagcacctgatgatgttcacccacgaagaggccgcgcccctgcactgccaggcggcgtccactgcgctggccgaagcgcgcctgttcgactggctcgacgaaaacgtctga

SEQ ID NO: 4964 - DNA, 1509 bp, Myxococcus xanthus
atgctcgcggcgggcgccaacctgtgggccatggtggagatggtggataccgccgacttcgacctgctcaaggcccagctccccggcttcgacggcttcctctccaacgacgcggccttcgtctctggcggaacgtccccctacggcacgagcagccagaagctgggcgtgctgtacgacagctccctcaccttccagagcgcgaccctggtccggattggcaacatctccgacttcgcggaccgcccgccgctccgcgtggacttcaccaccgaaatcaacggggcggagacgccgctcaccgtcatcgtcgtccacatgcgcgccaacagcgccgacccgacggcgccgcgcgaagcccgggagcgcgcgtccgcggcgctcaaggcgtacctcgacgagcagttgcccacgcagcacgtcttcgtgattggcgactggaatgacgacgtggacgagtccatctcgctcgaccccacctccggcgcgccgctggccacgccctaccagaacttcgtctccgactcggctcacttcaccttcatcacccgagagctgtcgctggcgggggatgacacctccattggcttcgagaacgtcgtcgaccacaccctggccaccaacgaggcggcggaccgctacgtcgcggaatcggcccgcgtgctctacgtggacgagtggttccccgacttcctcaacgtggtcagcgaccaccgccccgtcgtcagcagctacgccttcagcgcggcaaccggccccctcctccgcctgaagtcgccccacggcgggacgtaccagggcgggagcacgctgcccatcacctggacgtcctggggcgtgggcgaggtccgcgtcgaggtctccaccaatggtggaacggattggagcgtcctggccgcgtccgtcccggcggccctggggcgcttcgcctggagcgttccggacgaggcggcctcgaacgtgtgggtgcgcgtggtggatgtctacgaaccggcgcacgcggacatgagtgacgctgcggtgaccatcgccagtggcgccgcgcgcgtgttcatcaacgaggtgttggccaatgaaggcacccaggcctccgcgcacgagttcgtggagctggtcaacgccagtcccttccccgtggacatctccggctggacgctgtgggacgccaccaacggttccgcgcggcatgtcttcgcgcaggggacgcagctgggtggtggcaaggccgtggtcgtcttcggtggcgccgcggcggtgcctgcgggacaggcgaatgcgctggccgcgtccagtggtctgctgggcctggggaacggcagtgactccgtgcgcgtccggcggcaggactccaccctggtggaccagtacgactacacgtccaccgtgcccggggtttccgccaaccgctcgccggacgccacgccggatgcgagcttcgtcgcgcatgacacgctgacgccgggggtcgccagctctccagggctgcgcgcggacggcgcggcgttctga

SEQ ID NO: 4965 - DNA, 513 bp, Myxococcus xanthus
atgaccgccgcgcgggccctcttctccacacagggcttcgccaacacgggggtgcgggacatcgcggcgctggccggagtcaactcctcgctcgtgggccgctacttcggctccaagcaggggctgtaccgggagacgctggcgcaggtgctcgatatcggcccgttgctccagatagacaggcgccagtttggagagacggtggtgtccctcttcctgggtgcacacgacgcctcggggccgttggcgatgctcatcctgtcggcgtccgaccccgaagcccatgcgaccagcgtcgaactgctccagaagcaggtcatcgcccccctggcccgctggctgggcgctccggatggcgaggggcgcgcggcccggctcaacatcctctggaatggcctgctcgtcagcgggcggctgctgcccatccaacggctctcagaagggctcgacacgtccacccagcgttggctggcggccgcaatccagtcagtcattgacgaaggcgcgacctga

SEQ ID NO: 4966 - DNA, 330 bp, Myxococcus xanthus
atgtggattgaagccatcatcatgccccggcagagcgccacgccgtaccggcccgcgccgcgcaagaagcgtggagccgatgccatcccggcatcagccccggaccgccggcccgcctaccaggccgcgctcgacgaaggacgccgcttctgggatgccgtgctcgcgttcctgaaagcccaccacttgatggacgcggtccggtggatcagcgaaccgggaacgattcccctcgtcacgctccactgcacccgcatcgtcctggagcggctccggcaagcgcccgagttcgaagcgggtctgtcgatgaacctcgaagtccccgtgtga

SEQ ID NO: 4967 - DNA, 3402 bp, Myxococcus xanthus
atgaactcgctcggcgccgacgcgtgggacgacttcttcaagcgcaatgggcgcgagttcaacgtctacatcgacccgcgcacgggaacgcccaccgcggtgcaaggcaccattcccctcatcccgggtgacggcttcaacaacaaggtcaccatggacgaggtccgtgagtccattggccgctccatcgcgaacgtggacgaggccgccgtcggtgacctcatcttcaagttcatcgcggacaaccaggccgcgttcaacgtcgacctgatgcagatgggcaacccccgggtgacgcgcatcaacgacgacctcatccaggtccacatctcccagcaggtcaacggcgtccccgtgcgccacgggcgcatcgcggccaccatcagccacggcaacctcatcctcatcggcaccgaggcctgggccaacgtgcgcatcgacacccgcccccggctggccccgcaggacgcgctggtgtccggcaacggcttcgtggggctgaacaccagtccccagacgctgtggcagcagcccacgctggagatcgcccccgtggcgctctcgggtgagtccttcaacggcgccgtcggcaccggctacgagcaccggctcgtgtacacctacggcttctccgaggccggcggcaacgagcgctggaagacgacggtggacgcccagacgggcgaggtgctcgccgtggaggacgacaaccactacttcgacgcgcagattaagggcggcatctatccgtccaccaacatcgaatcctgcacctccaacgagacgtgcggcaccatgcagcccaactcgcccatgccctgggccaacacgggcctgccggcgcccaacaacttcacggacggcgcgggcatcgtcaactacagttccggcaccgtcaccaccacgttggcgggcaagtacgtgcgcatcagcgactcgtgcggcgccatcaacgtcagctccaccacgggcaacctcaacctgggcggggtgaacggcgaccacaactgcaccgtgcctccgggcacgtcgccgggcaacaccgccgcgtcccgctccagcttctacgagctgaacaagctggccgagcaggcccgagggtggctgcccaccaacacctggctccagggccagttgctctccaacgtcaacatcaacagcacctgcaacgccttctggaacggcagctcggtgaacttctaccggagcggcggcggctgccggaacaccggtgagattggcgccgtgttcgaccacgagtggggccacggcatcgacgacttcgacgccaacggctcgctcagcaactcgtcggaaggctacgcggacatcgcggccatctaccgcctgcagacgtcctgcgtgggctacggcttcttcgagacggtcaacaccggctgcggcctgacgccggacggcacgggctacaaccagcaggaggcgcaggtctccggccagtcgtggtgcaacaccaagtgctctggcgtgcgtgacgcggactgggccgccagcgtgcccaacatccccgccacgccgcagaacttcgtgtgccccatgtgcagctccggctccggcccgtgcagccgccaggtccactgcgcggcctcgcccgtgcgtcaggcggcctgggacttcgtcacgcgcgacttgacggcgccgccgttcaactacgactccaacaccgccttcatcgtgggcaacaagacgttctaccagggcagcggcaacgtgggcacgtggcacgcctgtaactgcacggcgggcacgtccgacggctgtggcgccaccaacggctacatgcagtggctggcggcggacgacgacgacggcaacctggccaacggcacgccgcacatgtccgccatctacgcggcatacaaccggcaccgcatcgcgtgctccaccccgacggtgacgaacagcggctgcgccgccggccccaccacggcgcccgccaacaccaccgccaccccgggtgacggacaggtcagcctgagctggaacgcgtccgcgggcgccacccagtactgggtgatgaagacggagggcttcgcgggctgcgacttcggcaaggcgaaggtcgccaccgtcacgggcaccacctacacggacggcgaggtcgccaacggccggcagtactgctactccatcgtcccggcgtcctccaacgcgtgctacggcgccgccagcgcgtgcacgtgcaccacgcccgtctgcgccgcgcccggcacggacgtgctcgccgcgccctccggcggcgccaccggcgtggagctgtccgcggtgctggactggaacgacgtctccggcgcctccacatacgaggtgcaggtcgccaccgacgcggccttcaccaacgtggtggccagcgccaccgcgctgacggccagcacctggacggtgtcgccagccctggccaccagcacctcgttctactggcgcgtgcgcgcgagcaactcgtgcggtggcgtgggcgcctggaccgcggcgtccaccttcaccacgcgcggctgcgtcgccctggcaacgcccacgctgagcagccccgctgacggcgccaccggtgtcggcacgtccgcggcgctcgactggagcgacgtgcccagcgccgccacctacgaggtccaggtggccacggactcggccttcaccaatgtggtccgctcggccaccgccctgacggccagcgcgtggacggtgacgccagcgctgagcagcagcaccccgtactactggcgcgcacgggcggccgactcctgcggcaccagcgcctacagcacggcgaggagcttcaccaccaccaacatctgcacgccggtggccgccacctacaacgccacgctgcggacaccgtcctgcggcaacgtgtgcgggtgtgacaccgggacggtgctcgtcaacggccgcggcaccctgtccggcggcgccgagcccaaccagcccaacaccctcaacgcctcctgcgcggacggaagctccggcacctaccacagcgatgagagcatcgaccgtgtggtcctccgcacggtggaccacagcgccttctccgtcggcaagcaggtgacggccgaggtgacggtgtggtgctggggcaccacggaccgcttcgacctgtactacacgaccaacacctccgcgccgtcgtggacggcgctgaccacggacgtggcctgtacgggcagcggtgcgcggaccttcacgcacaccttcaacctgggcgccaccgcgggcaaccacgccatccgcgcgcaattccgatacggcggcaccgcgagttcgtgcacctccggcagctacaacgaccgcgacgacctcgtcttcggcgtggcggccgcggtggcctccgcggcgccggagaagacgcgcagcgtgcagggacgctcgacgcaggcggcccgttga

SEQ ID NO: 4968 - DNA, 648 bp, Myxococcus xanthus
atggacagcatcgggcacctgggagacaaccccgaatcccgcgcggcggcggcgcgcttcttcacgcagcacgcgaacgcgattctcgccgcggcgagcgacgcctcgggctccattggaagcgcgggcgcgggcaagctgtccgagttcttcacccggacgctcttcaccgagccttccttcgagggacaggaggcgttccactcgttcatcacctcgaagctgggtgacatgcaggcgcagttggaggcggaggcgcacgccaatccgccgtcgcaggatgcgcagcgcctggcacggtccatgggcagcctcgttggcgccatcgagggaggcttcctcctctccgtcgaggagctgaacaagcgcaacgaggccgccgagggaatggcggggctgatcttcaagctcaaggatttgctccccacctcgagcatcccggggctgggccagttgcagaacctcaccatcgaccagatccagaactgggtgacggaggcgctcaagaagaagccagatgatccgcaggatgccattccgttccaccagctcttcggggaggccatctccaaccctgccctccgcagcgtgtacgactccgcccggctgacgtcgctggagaatcgcgagctcggcctgaaccactga

SEQ ID NO: 4969 - DNA, 1329 bp, Myxococcus xanthus
atgcccaccgccccttcctccgatgcctccgcaccgcgctccgaagcccgtccggtcgaggcaggtgagcgcctggagctgctcgacgcgctgcgtggcttcgcgctcttcggcattctcatctccaacgtgcagatgtggttcagcggcagggtgttcccgtcccgggaacaattcgaggcgtccatcgccagtgcctcgctcctggacaccatcacccggtatgccttcgaggtgctggtctccgggaagttcatcaccctcttcgccttcctcttcggcctgggtttcgcggtgcagctcggccgggtcgaggcgcgaggtggcggcttcgtcccgctctacgtgaggcggctgacagtcttgctggtggtgggggtcctgcacctgttcctgctctggtacggcgacatcctctcctcctatgcgctgatgggcttctgcctgctgctcctgcgtcggcgttctgagcgaacgctgctcatcatcgcggcggtgctcgtcctggtgtggccgctgctcatgagcctcctctggcggctgccgcaactcctggcggactcacccgaggccggtgccgcggtcatggccgcggcccgcgagaagacctccgccatccacgcgcggatgctgacggccatcaccgggggaagctggtgggacgtgacaaagacgagcgccgggttctaccgcgatgagttcttcacgatgatgctggccggactgctgacctgtctgggccgcttcgcgctcgggctctgggcgggacggcgcggcatcttccaggacgtcccctcgcacctgggtttctttcgccgcctgcttggctgggggctggtgtccgcggtggtgggctccgtaccaggcgtggtggtgacggtgctcatgcagaagaaggtgctcacgccggagacgatgcccgtgtggctgcccctggtgctggcgccgctgcgcaacctggcacaggtggggctcgccggcgtgtatctggcgggcatcaccctgctcttccagcgcgccacctggcagcgggcgctgggactgctcgcgcccgcgggacgcatggcgctgacgaactacctgtcgcagacggtcatcagcctgctcatcttctacggctatggcctgggacaggtgggcaagcggggccccttcgcttgtgtcgtcatctgcgtgggcgtcttctgcgtccaggtgctgtggagccacctgtggctgtcacgcttccgcttcggtccggtggagtgggcgtggcgctctttgacgtacgggaaggctcaggccatgcggcgcgccgcgtccgacacgcccgcccccctgacggcgtga

SEQ ID NO: 4970 - DNA, 975 bp, Myxococcus xanthus
atgggcgccgtgctgctgggcgccgtcatgggcctgggctcgctcacccgcgccgaacacctgtacctctggcccttcctcctcgcctgggcctggctctaccgaggcggcatgcccccgcggacactggccctacgttggggcgcggccctgctcgtcaccgccgtcgtgctggccccctgggcaatccacaacgcgcgcgtgctgcgcgaactcaacgcccggacgccgcacctggagccgctgcccgtgctggcccccgtcaccgtgtacggccccatcaacttcgccatggccaaccacgccacggccaccgggggcttcacgcccgacagcgtcaaccagatgggccaggagggcttcctggacgtggccaactccgcccagcgccacctgttgctgcacgggtacgcggaggggctcgcgtggatgcgggattacccggcggacgcggcgcgtctgtggctggccaagctggaccgctggctggacggcttccggctgggtttgggggcctccaacctgcccgcgggactgaacggcgcccgggcccccgtggacgtcttcgtgccggagagcgcgtggctgaagtggccgctcaccctgctgctgctcgcgggcgccgcgctgtccttgcggcccgcgtggcgcggcttcgcgctcttcaccgcggtgctgctgcaccgggccctcatcaccgtcgccttcttcggctacacgcgcggcctgctcgctgtctttcccgcgctcatcccattgctgttgcttccgctcgtggtgctcgccacacgcgcctccacacagcggtgggccacgcggctgcccgccgtcgccgccgccgcgttgctcttcttctgggtggaggccggtgtgctcgcgctgaccgcgccccggcgcttcatggccagcgggagcaccgaccgcgccagcggcaagctcatccaggatgactgggtgcgcatctggccggactga

SEQ ID NO: 4971 - DNA, 564 bp, Myxococcus xanthus
atggccgaagtccagcagcccttcctcacggatatcaccgagattcgccgccgagcccgggagcacctggaggaaggcgccatcaccgaagactacgagggcgacgtcaacgccaccatcaagctgctcaacgacgcactggcgacggaaatcgtctgcgtgctgcgctacacctaccactacgtcgccgcggtgggcatccagagcgagtccgtgaaggacgagtttggaacgcacgcccgcgaggagcagcagcacgcgcttcgcatcgccgagcgcatcaaccagctcggtggcaaggcggacttcaaccccgaaggactgctgtcccgcagcgccagccaatacgccgaagggcagaacctggtggacatgatcaaggagaacctcatcgccgagcgcatcgccatccagacgtaccaggagatggtgcgctacttcgccaaccatgacccgacgacgcgccggatgatggaggacatcctcgccaaggaggaggagcacgccaacgacatgcatgacctgctggtggcacaccagggcaagccgcccctgcggagctga

SEQ ID NO: 4972 - DNA, 1131 bp, Myxococcus xanthus
cgcgtcgtcttcggcccgggccgcctggccgaggcacccgaaatcattcgcggcctcgggggctcccgggtgctgctcgtcaccggcgcgaatccctcccgcgcacggcccctccacgacgcattggagcgcctgggcctgggggtgactgtcttctccgtggacggcgagcccaccgtggagcgtgctcgtgaaggcaccgcgcgcgtcgcggaagcgggctgtgatgtggtggtggccctgggcggaggcagcgcgttggacgcgggcaaggccattgcagcgctcgccgccaacgggggcgacccgctggactacctggaagtcattggccggggccagccgctcacccgcccgtccctgcccttcatggccatccccaccacggccggcacgggctccgaggtgacgcgcaacgcggtgctgggctcgaaggacgcgaaggcgaaggccagcctgcgcagtccacacatgctgccgcgcgtggcgctggtggacccggacctgctcacgggggcaccggccgccgtgcttgcatccagtggcatggacgcgctgtcgcagctcatcgagccctacctctccgcgcgcgccaacccgctgacggacgcgctggcacgcgagggcctgcgaaggtcggcccgctcgctgcggcgcgcggtgctggacggtccggatgcgcccgcccgcgaggacctggccctggccagtctcttcggcggtctgtgtctggccaatgcgggcctgggcgcggtgcacggcttcgccgcgcccctgggtggcatgttcgacgcgccccacggcgcggtgtgcgcggcattgctgccagcggtgttggacgtcaacctgcgcgcgctgcgggcccgtgcgccaacgcatccatcactgccccgggtgcaggagttggcggcgctgctgacggggcgggtggatgcaagggccgaggacgccgtcacgtgggtggacgaacttcgcgcggcgctgggcgtaccggggctgggacgctacgggctgacggaggcccaggtaccagcgctggtggcgaaggccaaggaggccagcagcatgaaggccaaccccctggtgctcaccgacgcagagctggcggaaatcgccagccggtcgctgtag

SEQ ID NO: 4973 - DNA, 318 bp, Myxococcus xanthus
atgtcccacagtctcctcgtcgttcacgtccaggtccacgtcaagcaggagcacgtggacgccttccaccaggccacgctcgccaatgcgcgagaaagcgtgaaggagcctggcattgcccgtttcgacgtcctgcaggacgccgaggaccccacgcgcttcgtgctggtggaggcgtaccggacgccgcaggcccccgccgcgcacaaggagacggcgcactacctcacatggcgcgacaccgtggctccgatgatgtcagagccccgcaccagccggaagttcgtcaaccgcttccctgaagacgccgggtggtga

SEQ ID NO: 4974 - DNA, 1239 bp, Myxococcus xanthus
ggtgcccctgaagatgatgtttcatctgaagccggtgcgtcccccatcgaattcgatgccctcgacaactccgcggtcagcgccgcggcgttgaccacccccgggtgcaccgcactgacggcccggtcggtgatttccaacggcgacgacgggaacgtcgcagccaataccatggacgacaacctgggcacgcgctggagccggagcggccggggctcttgggttgactatgacctgggctccatccagcaggtcgccggggtctccgtcgcgtggcaccagggcaatacccgcacgaatgagttcctcgtctctgtttcaccggatggctatacctatacacaggtctattcgggcaagagcagcggcaccaccgccgccgcggagacgtacagcttcaaggccgtcaacacccgccgggttcgcatcaccttccagagcaacaacgtcaatgaatgggccagcatcgccgaggcgcgtgcctgctcgtccacgacgtcgactcccaccgaccccaccccgaatccggatcccacgccggagcagccgcccccgggcaccggcgccagcgtggtgtgggtcggtgacttcgagaccaacagccgctcccagtggagccacacgcagatggtgagcgcggaccggctggcgctggtgagctcccccgcgcggcagggccgctacgccctcaaggccaccgtgcgcaagggcgacgaccccatcaactccagcggcaaccgcaacgagctggtgcgcatgacgcgcgaggccacgggctccgagtactactaccgcttcagcaccatgttcgactcgagcttccccagcgcgaagacgtggcaactcttcacccagtggcaccacgagggcaactccggttcgcccccggtggagttctacgtctacggcgaggagattcgcctcaacatcggcggcaacccgggcaccatcgtctggcgcacgccgctggttcgcggccgctggctggacttcatcttccacgtgaagtggtcgccggactccaaggtgggcttcgtggagctgtacctgaacggcaaggtggtgctgcccaagcgctacatcgccacgcagtacaagggtcagctcaactacctgaaggtcggcctgtaccggaatgacaccatcagccccgtgggcatcgtctaccacgacgggtggaccatggcccgcaagctggaagacgtcatcagcccgacggcggtcctcaaggccccgtag

SEQ ID NO: 4975 - DNA, 1494 bp, Myxococcus xanthus
ctgcccgttcagctcttcaccctgcaggctttcggctacagcagcgtggtgcacctggaggtcagcgaggcgcgcgaggagtccggcctggtgctgatgccggtgccccgggagctcgttcgttaccgccaccgctggctgcggcgcgcgccgccgagccgtgcctgcacgctgtccttcgaccatccgctgtggccgcaggtgcacgtgcggcgtcaggtgttggacctgtcctatgagggcatcgccttcctgacggagcccggcgaggacctgctgtacccgggcctgcgccagccggtgctggaggtcgcgacggaaggaatggcgccggtgcggctgcgcgccgaggtgcgcaacatctccagcaccgcggcgggccgccgctgcggcatgtccgtgcgtcccctggatgcggcgggcgcgcaggcctggcgcgcgctggtggaggcgcagatgcacccggccacccaggtggagggtgactggggtgatgccacctggaagctcttcgacggctcgggttacttccggctgccgggcaagtcgccggaggacttcgaggacgcgcaccccagcttcgacgccacgctggcgcggctggagggccggacgcggctgggctaccgggtcgtgcacccggaggggcagtccgtgggcgccacgctgtcggtggtgaagccgtacgaaggcagctggatggcgcaccaactggcgcgtcagccggtgaagggcagccgcacgtcggcgcgcgaggcgctgcgtgacatctacctgcgcggctacgagcccacgcaggtggacccggaggtgaagtggttcttcgccttctgcgaggcgcgcgtgcgctgggtgcgcttcaccaagttcgacttcgccacctggtacgagcacacgggccagacgtgcctggtgcccttccagctgatggaggcggaggtggacggggcctgggaaatccccgcgggcatcgaggtgggcacgcccaccgaggccgagcgcgcggccttcttccagcaggtggagcgcacgcgcccgctggcctaccgcgaggcgctggacctggtgccggagcgcttcgacctcaagcgcgccaaggagcgctggggcgaggcggggatggggcgcgagcgcgagctggtggtcgcgcggcacgagggccgccccgtcgtcctggcggtgctggagacggcgcagccgggcctcaacctcttcaacgtgctggacggcgtgcggctggtgccgctggtggacgacgcgacgaaggaggcccaggacgccatggtggcgctgctggcccacgcggcggactggtaccgcgcgcgcgagcgcaaggtgttcatccactacgtggaagcggcctgcgtggagtacgtggagcgcgcgtcgctcgcggacctgggcgaaggcaagctgtgggtcatctccgccagcctgctgcccgagtttctcgagcacctccacgaggccaccacgcccccggcgggggcgtag

SEQ ID NO: 4976 - DNA, 285 bp, Myxococcus xanthus
atgctgccgggggcccgttggatgctggccgcggagcacacgaaggggaagcggtcgtccacctgggacaagcacacgaagacgcgctcgggcggcaaggagaagaaggacgaccgcatgcgcttcagccacggcgcggacgacagcaacaaggagaagaaggaagaagcgaagcggaagaaggaggaagagaagcgacagaaagaagaagcgcggctgaagaaggaggaggagcggatcaagagggaagaggaccggcggaagaaagagtccgcgaagaaatga

SEQ ID NO: 4977 - DNA, 300 bp, Myxococcus xanthus
atggcgcgcgggaacgcggacgacgcccggaagctcttcctgtccctggcccggcagaagccggaggtgatgggcactcgcgagtgtggtgaaggcgtccggtgggcacggggcctcatcgcggatgcgaacttccggttgggccagctggaggaacgggcgggcgcgagggccgcggcccggcgccgctaccaggtctacctgcgaatcctgcagcgcccggcgctctcccttgagagccggcgggaggcgaacacccgccttcgcgccttgagtctcaaggggcgggccgacggttga

SEQ ID NO: 4978 - DNA, 441 bp, Myxococcus xanthus
atggtaccggtggctgtcctggcccgtgaacccgtcaacatcccgaatgacggctccggcgctggcaatgtgcccagacaggagggccgggaccggaacttcaccaacttcggcgcgaccatgtccattgatcgctccagcagtggcagtcagcgcaacctgcgcgtgggccctcaggccaatggcgtgggcatgcccatccgcgaggtgacgccggaccaggaggagatgaagcgcctgtccggcaaggtgctgaagctcaacgggcagatgctctacctggagacggagcccggcgccgtggtgcccctggacctgagcgcgctgcgcatccgcaagcagccggagaagggccagcatgtggtggccgtctaccaggtggagaacaccacggagaacgtggcgctggcgctcgccggcgaggtgcagccgaaggactga

SEQ ID NO: 4979 - DNA, 324 bp, Myxococcus xanthus
atgcggggcgttctggcgacctactcggacaagagccgcttcggcgccgccgggctgatgctcctgctgggcctgggcgtgctgctgggggcgggcagcctggccctctccgccgagcccctcatcgacgacgagtggctggcgtggcccgtgggattgctggcccccttcgtcgtgggcgccgtcgtggccggcttccagaaggtgaagctgtgggactggaagttccggttcgacctggagcgcttcggcgcggccttctgcgtcacgacgggcttcgtgctggcccgcttcgtcggcgtcccgctgctcgccgggggctga

SEQ ID NO: 4980 - DNA, 1491 bp, Myxococcus xanthus
atgttcgtccgggccggcaccctggcccccgtggacgtgcgcctcgtggaggcctcggggcgtgaggtgaggacgcggaccgtcacgacgtctgaaggcacccgggtggagttcgtctccacggaggaggcccctcgattcatcaccgtggccgctccgggaggaagcggtgcgtcggggacgtatgcctaccgattggaggacctgggccgggatgcgcacggcgatacgctcgccacggcaacgccgctcgcgctgacgaacacccccttcccgctcgcgatcgagttccaggacgacgcggatgtcttcaccttccgcaccgagccgaaccagggcttccggttctcctgcgagggcgagaacgtctcggtgcacctcatggatggcgagggcgccccggtgaatggcggggcgacgaggaactcgtcacgcgtcagcgcgggccagctgagcccggtcgcgaacacctggttcgtccgggtctacagcagttccgacgcggccttggccacccagtgccagttggacgacctgggccaggatgaccacgccaatgcgctccagggggcgactccgctgacggcgggcctccccgtggccgtacgactccacggccccaacgacgtggacgtcttctccttcttcgccaccgcgggacacatctacgacatccgcttccaccccgccgtctatgagcggcgcttcaggctcacggacgcggacggcaagacgctggcggagactcagtggaaccgaatcgtccatgaagcagcgtcgacagggacgtactacgtgcacctgctgccgaattcatcctgggggagcgacatcgaggtgcgggtcgacgacctggggacggatgaccatggggctaccccccaaacggccaccctcgctgacgtgggggaaaccgtcaccggactcatccacaagcaggcggacctggacgccatctcggttccgctcgacgcggatgtgttctaccggctgtcctgcacccgggcatgtacgctgacgacgcgcacttccggcgcccccctctacatgatgaatatcgaggacggcttgtggcacgtccatacgccggcttcggggctcgtcacgttcatcgtcagctcgaggtccattccctacgacttcacgttcaagttggaccaggcaagcaccgatgaccacggcgacgacgccgaacacgccacaccgcaggtcgttcccgtgaacgcggccggcgtcttcgagttgggctcggacgtggacgtcctttccttcgagttggaggcgggccggacctacgtcgtgcgcggcagcagaacgaccatccggatccttgatccccttggcgcgcaggtcgccctggcgtacgagagggaaacggggaaccagaccttcacagccccatcgtccgggacgcatgtcgcggagctcaagtctgagaatccctacctgccgcgtgagacggcctggagtttctccctgcgcgagcagtga

SEQ ID NO: 4981 - DNA, 1086 bp, Myxococcus xanthus
atgaaggccgtggccgtcttcccccagaagcgcgaggtgcgtgtcatcaccgacgcccccgagccccgcatccagtcccccacgcaggtgaaggtgcggacgcgggaaatcggggtgtgtggcacggacaaggaaatcatcgagttcgtctacggctccccgccgccgggctcggaccacctcatcctgggccacgagtgtctgggcgaggtggtggaggtgggcgaggccgtccggggtctgagccgcggggactgggtggtgccccgcgtgcgccggccgtgcccgcatgccacctgtccgccgtgccgcgggggccatccggacttctgcatcaccggcgattacaccgagcggggaatcaagggcgcccacggcttcggcgccgagtccttcgtggaggacgtggcctacctgcaccgggtgcccgcggagctgcgcgaggtggcggtgctcaccgagccgctcaccatcgcggagaaggccctccgccaactggagcgcttccaggaccggctgccctggagggcgggcccgggccgcgcggtggtgctgggtgcggggccggtggggttgctgggcgccatggcgctggcccgccggggttatgccaccacggtgtattcgcgcagccccaagcccaacgtgaaggccgaggcatcggaggcgatgggggtgccctacatctcctcgaaggaggtgcggccagaggagctggtccgcagggtcggcgccgcggacgtcatctacgaggccgcgggcgtggcgaaggcggcgctggagacgctgaaggcgctgggccccaacggcgtctgcatcctcacgggtgtgccgtcgaaggaggagcccttcgacgtgtcaccggtgctcaaggacgtggtgctgggcaaccaggtgctggtgggcacggtgaacgcggcggatgtcgacttcgacatggcgctggaggacttgcggcacttccaggcccgctggcccggggggctggagcggctcatctgcgccaggcactcgcccgaggacttctgcgacgtcgtcactggcaagaagtccggcggcatcaaggacgtcatccgcttcatctga

SEQ ID NO: 4982 - DNA, 1827 bp, Myxococcus xanthus
ccggtggccatcgaggaccacggcgtcatcggcgacctgcggacggtggcgctggtgggccatgagggcaccatcgactggttttgttttccgcacttcgacagtcccagtgtcttcgccgcgctgttggaccgtgagaagggaggccactggggcgtcgcgccggaacccgacggggtgatgaagcggcagttctactggccggagaccaacgtcctggtgacgcgcttctacacgccggatggcgtgggcgagctggtcgacttcatgcccatgtcgggcaggaaggggatgaaggaggagcgggaaatcctccggcgcgtgcgggtggtgcgcggacagatggtcttccgcatggagtgcttcccggccttcaactacgcgcgggatacgcacgagacgaagctcatccacagcggggccaccttctcctccgacacgctccagctcacgctgtcctcgtcggtgtcgctgaagaagacggagcggggcgtcaccgcgtccttcaccctgcatgagaaccagtccgccgtcttctccctgcacccgggcgcgcgcacgtcctgcgaggcggtggtgcacaaccatgagtcctccgaggagctcttccgggagacggtggagtactggcgccactggctgtcgggctgccagtacacgggccggtggcgggagacggtgcagcgctcggcgctggcgctcaagctgatgaccttcgcgcccacgggcgccatcgtcgcggcgcccacttgcagcctgccggagtcaccgggcggaacgcgcaactgggactatcgcttctgctggctgcgcgacgcggccttcaccgtgtacgcgtttctccgcatcggcttcaagcaggaggcggcggccttcatgcgctgggtggaggcgcgctgcgcggagtacgacgaagggccgctgcccctgatgttcggcatcgacggcaagcgcgtgcccgaggagcaggaactcctgcacctgtcgggctatggcggcgcgcgcccggtgcgcatcggcaacgcggcggcggaccagttgcagctcgacatctacggcgagctgatggattcggtgtacctgtccaacaagtacgcggcccctatctcctatgacttctggcggcacctgcggcggctggtggactgggtgtgtgacaactgggagctgccagacgagggcatctgggaggtgaggggcgggcagcggcagttcgtgtactcgaagctgatgtgctgggtggcggtggaccgggccatccggctggcggacaagcgcagcttcccggcggaccgggcccgctggcacaaggtgcgggacgccatcttcgaggacatcatggacaagggctggaacccggagcggggcgccttcgtccagtactacggcggccacgcgctggacgcggcgaatctgctgatgccgctggtgttcttcctgtccccggtggacccgcgcatgctccagacgttggacgtcatgcgcaagccgccgtcccaaggcgggctcgcgtcggacgggctggtgttccgctacgacgtggaggccacgttggatgggattgccggcagcgagggcaccttcaacctctgcagcttctggctggtggaggcgatgacacgcgccagcgtggcccggcccgacttgctggaggaggcgcggctcatcttcgagcggatgctgggctacgccaaccacgtgggcctgtacgcggagcagacgggcatgtccggcgaggccctgggcaacttcccgcaggcgctcacccacctggcgctcatcagctccgcctacaacctggaccgcacactgggccggcgcgactga

SEQ ID NO: 4983 - DNA, 1095 bp, Myxococcus xanthus
atggcgtcgtcgctgggtgggctggtgcctgcctcggcggcgttccgtgcgggcatgtcctggccctcggcggcgccggacttcgaggtcttcctgaagggcgacgaggcgccgagccccgtcaccgtgcacgcggcgggagaagccacgctggggttctcgggcgtggggcggctggtggcgctgttggcggaagcgctggtggacctggggacgtgggtggacgtcgcggcgctggggcccggcgtagggctctacctggtgctacccgacccggaggcacggggcttcacgacggggaaggacccctacgaggaagacccggacgacgcacgcgagcgcatcgcgcggctggtggaccggctggtgaaggggacgtggcaggcgctgggatggcctgcgtggaaggggctggtgcgcgcgttccccatggggaacgtggccttcgcccaggcgctggccgcggcgggagaggacctgcgggcgtccaaggtggagcgtgcgctcgtctgcgcggtggacagcttcatctccccggagacgttgacgttgctgcaccagcagcagcgcctgaagaccccgggccggcccacggggttgatggcgggcgaggccgcggtggccttgctgctcacgcgcgaggaaaccgcggagtcctccatggccgtggtgcgggtggcgcagggacgcgacgcggcgccgctggatggggagcagccaccggacgggcaggaactggcgcggcaggtcctcgcggctttggggcccttgggacaggacgcgtccgcgccgttgatggtgtcggaccacgacgggcaatacgcgcgcgccttcgagtgggggatgctccaggtccggctcagggagacggacgcccgcttcgagcaaggcgcggtgtggatgccggccaagagcttcggacacacaggagtggcctcgggagcggtggccacggcgttggtcttccgagggctggcgcgaggctacgcgcccacgtcgtcggtgctggtgctctcctccgcggaagcaggggagcgcgccgtgattcacctcacagctccaggccgttccaaccctcggctacgtagaccttga

SEQ ID NO: 4984 - DNA, 591 bp, Myxococcus xanthus
atggcggagaacggccgccgggtgcagcgcctcctcgcggaccggggccttccgccaccgcccgcgcggcgcaacacgcctctgctcggcgcgctcgccgccggtcacttctccctcgcggaggccgtggccgcgagctccgccacccagtggcagcagggcgccgaatacgaggatgagtttctctgggccgccgccctccagcacctcacccgcacgccgtccgcgccgctggagtccatcctcgccccgttggagaaggtgggccaggagccctacgccagccgggtggccatggcccgggccctggtgtccagggacgcggccgccttcgccgaggccttcgccgccgcctgcctggaccacggcatcgtcacggagaagcgcgcccgctcgctggccacacccgtgacgtccttcgcgccgcaccggttcgtctggctcgaaggattggccctcctgcgcctcgccgagcgcgccagcatcgcacccgaggacaccagcttccgctactgcccgcccctggcccgcgtcccaatgacgacgacgtactcgggcgactgggccgtcgacacggcgccgacccgataa

SEQ ID NO: 4985 - DNA, 390 bp, Myxococcus xanthus
atggccccgccgcacgaggagttgaagcgcttccacgaccacaaggacgtggacctcttcgtggagcccgcgcgcttcccggagctcatcgccgtgctcaccgctcgcggctaccaccgcatctggacgcgcttcgacgccacctccacgcacttctaccgctacgcccggcacgatgagggcggcaaggtcctgctcgacgtcttcgtccggcgcgtgccgtccgtggacgccggggggattcgcgtggtggacccggccacgctgctcaccttctacggcgacatccacagcacggatgactgcgtgtcggtgctggcggcgcggcggctgctggcgaagggccacagccccctgggccgggtggagctcgtcacgcaggcccactga

SEQ ID NO: 4986 - DNA, 936 bp, Myxococcus xanthus
atcgccctcttcatcgatttcgagaacctcgtcaccaacacgggcatcagctccgcgagcttcgacctgcagccctcgctcgaccggctgctggagaagggcaaggtcgtcttccgccgcgcctactgcgactggtcccgcttcgccgaggccaaaatccggctgcacgagttcggcgtggagctcatcgacgtgccgccctccacgcgcgccggcaagaatggcgcggacatgcgcctggtcatcgacgcgctggagctgtgctacgcgcgcgagagcatcgataccttcgtcatcggctccggggacagcgacttctgcccgctggcctacaagctgcgtgagaacgggcgcaccgtcatcgggctcgcagtgaaggagtccacgtcgccgctcttcgtgaaggcctgcgacgaattcatctacctgcgcccgcgccagtcacgctccgacaagggcgacaaggagaagggccggcagagcgtgtccgccgaggaggcgggacacggcaagcgtggcggccgccaggggcgcgacgagaagggccggggagacaaggagaagacaccgcagggtggcggcaagtcccagccgaagacggaggtgccggacatcgcccgcgaggtggtgcagagcatgctggcgcgcgccaccgggccggtgaacccgtcgctcatcaaggaagccatcgtccgcaaggagcccgacttcgacgagcgcgagcacggcttctccaccttcgcccggctgctggccgcgctggagcagcaagggctgctgcgccgcatccagcagggccgccagtggtacgtggtggcggcggacttcgacgtcggcgggggcgacaccaagggcaagaagcgcggccccgcgcacgccgccgaggaagacgacgagctggagtcctacccggacccggacgaagacgagggctga

SEQ ID NO: 4987 - DNA, 765 bp, Myxococcus xanthus
atggagcgtgtagaggagacgctggagcgcatccggttggaggccgagcgtgcccccggcggggtgctggccttcgacggcgatggcacgctgtggagcggagacgtcggagacgacctgttcctggccctgctggagcacggcgacatccgcccggaagcgcacgccgccctggagcggctggccaccgcacatggcttcgagaaaagcctgcccgcgcgcgagctggcacaccagctcttcgccgccttcgaggcggggcggattccggagaaggacatctacgagatggtggcgtggctcttcgccggttggcgcgtggacgcggtgcgcgccttcgcgaaggacgtggtggcccgccacgcagtcaaacagcgcatccacccggagagccgccgcgtcgtcgagtgggcccgcggccagggcatcccctgctacgtggtcagcgcctcgccgctcgccgtcgtggaggccgccgttcatgaagtggggctggaccccttgaatgtgctggcctgcacgccgcgcacggaggatgggacggtgctggccggcatcatcgagcccattccctacgcggccgggaaggtgcattgcctgcgctcgcgcacgtcccagccgctctacgccgccttcggggacaacgtgttcgacctggagttgctggcggcctcccgcgtgccggtagccatccggcccaagccgcggctccgggcgagggcagcggaactgccctcgctcgtccaactccacccggaggactga

SEQ ID NO: 4988 - DNA, 1011 bp, Myxococcus xanthus
atgcgtgtcttccactccctgttgcctgtcgtggtcgctggactggcggtgctcggcgcgggctgcaagcgcgagtccgccgcgcgcggcccggacgcgccgctgcgcctgggcttcttccccaacatcacccacgcccaggccctggtgggcaacgcggagggcacgttcgcctcgcagccgggtgtgggccgcctggaggtgatgcagttcaacgcgggccccgccgccatggaggcgctggtggccggttcactggacgtgtcctacgtgggcagcggtccggccatcaacacgttcctcaaggccgggcgcgagctgcgcgtcatcgcaggcgcggtgaacaacggcgcggtgctggtggtgcgcacggtgaagacgcccgcggagctcaagggcaagaagctggcgtcgccgcagctgggcaacacgcaggacatcgccctgcgctactggctcaagcagcaagggctgacgacgcacctggacggcaccggggacgtgcagatcttcccgctgagcaacccggacatcctgggccagttcctgcgcggcggcattgagggcgcctgggtgccggagccctggggcgcgcgcctggtggccgagggcaagggccgcatcctggtgaatgagaaggacttgtggcccggtgggcgctttcccaccacggtgctggtgacgacacgacaggtgctggagacgcagcgcccgcgcgtggtcgccctgctgcgcgcgcacgtgcgactcaccgagcgctggcaggaggacccggccggcttcaccaccgcggccaacgtcgccttcggccgcctcacgagcaagcccctgcccgccggcatcctccagcaggccttctcccggctggagcccagcctggacccggtgccgcaggcgctcgccaccgcggccgagcacgcgaagacgctgggcttcatcaccgacgccaacatcgacgggctggtggacctgagcctcctggacgaggcacaggcgggcgccgcgaagtga

SEQ ID NO: 4989 - DNA, 762 bp, Myxococcus xanthus
atgaaacaccatgcccagaagctgctggtgattgcgttgctgattggcctctgggagctggtggcccggatgggcatctggtctccccacctcctgccccggcccctgacggtggcccagagcctggtggccatggtcaccgacgggcgactggtgggcgcggcggggcgctccctggggcggctgctgcgcgcctacctgatgtcagtggccctgggtgtccccctgggcctgctgatttcccgcatccccttcttccgcaacgcggtgaagccggtggtgatggggctccaggcgctgccgtccatctgctggctgccgctggcgctgctgtggttcgggctgacggacggcgccatcctcttcgtcgtcgtcatgggcagcgtgctgggtatcgccatcgccaccgaggacagcgtcaacggcgtggacccgcagctcacccgcgtggccagcaccctgggcgtgcgaggcctgcgcttccagttcggcgtgctgctacccgcggccctgcccggcatcgtcaccggcctgaagctgggatggagcttcgcctggcgcgcgctgctggccggtgagctgctcttcgtctccggcggcctggggcagttgctcacggtgggccgcgagttgatggacgtgccccaggtcatggccgtcatggtggccatcgtcatcatcggcaccgcggtggaccgtgtcctcttccagacggtggaggtgcggctgcggcggcggtgggggctgacggcgacgacgtga

SEQ ID NO: 4990 - DNA, 774 bp, Myxococcus xanthus
gccttgcagaacgtggacctcaacgtccgctcgggcgaattcgtgtgcctgctgggcccgtccggctgcggcaagtccacgctgctctacgcgctggcggggcacgtggtgcccacggggggctcggtgtccatcgaccggcatcccatccacgggcccgggccggaccggctgctgatgttccaggaggccgccctgttcccgtggctcaccgtgcgcggcaacatcaccttcgcgctggccgcccggggcgtgccccgcgccgagcgccgcgagcgggcggacacctatatccggcgcgtgcagttgggcggcttcgaggacgcgctgccccaccaactctccggcggcatgaagatgcgggcctcgctcgcccgggcgctggcggtggacccggccgtgctgctgatggacgagcccttcggttcgctggacgcgcagacgcgcatccacatgcaggagctcctccagtccatctgggtgcgcacaggcaagacggtggtgttcgtcacccatgacgtccatgaagcgctgatgctgggcacccgcgtggtgctgatggcgccccggccgggacgcgtggtgcgggatttggaagtccacctgcccatgccgcgccagccggaggacgcggcgctcaatgaaatggtgcggcacgtcggcggcctgctgcgtgaggtggagggccgcgcccacacacgctcgctccagccagcgcccacccgggcccccgcccagcccgtgctccgtccgcaggtgattcccggcccgtag

SEQ ID NO: 4991 - DNA, 831 bp, Myxococcus xanthus
  unsure (1)..(831): unsure at all n locations
gattggacccgccaactggcggagtggtcgcgggacgatgttccgttcgccgtggcgaccgtgacggtgtgtcagggaagtacccccgccaagcctggcgcgaagctgctcgtccgcgcggacgggacgttccacggcaccgtgggcggtggccacctggagcaactcgtcctcgcggacgcccgcgcctgcctggagaaaggggaaccccgtgcgtaccggtatccgctgggctcgaagctcggccaatgctgtggcggcgtggtggacgtcttcatggagccggtgaaccacggcccgcgcctgtatctcttcggcgccggccacgtgggtcaggccctgtgccgcacgttggacggcacccccttccaggtccacctcgtcgacgagcgccccgaatgggtccacggcgagcgcatcnccgcctcggtcatccgccacgaggagccgtgggacgtcttcgcctcgcgcgctgtctgggacgcgcgccgcacgtacatcgcggtgatgacgcaccggcatgacctggaccaggacatcatcgccttcgccttggagaagcccgcgcgctacgtgggcctcattggaagcaacaccaagtgggcccgcttccgtcagcgcctggaggcccggggcgcgacggcggcgcagttggcccgcgtgcgctgccccatcgggctggagattggcggcaagtcgccccaggaagtcgcggtgagcatcgccgccggactccttcagctccatcaccagggcgcagacaccgaaactaccgccgaggccccgccctcggagacgccccgcatgcgcgggggctcgtcaggagaatga

SEQ ID NO: 4992 - DNA, 345 bp, Myxococcus xanthus
atgaaggatgtgcagggcgtcaaggtggaccggacccgcgccgcccgccgcaaccgcgtgcccatcttccggcccacgctggtgacggtgcacggcgagtaccccctcttcttccagtgggccaccgaggaagcggaagccacgcgcgtgaaggcgcagttggaggcggccttcgcgaaccccggcggaaagacggtggagttcgtccgggatgaccgcaacgcctccctgcgcgtgggcggcgccttcagcggcgtgggcatgctgctgctcgtcttcgctacgtggctgggcttgcgaacccggacgcacctgcgcaccgaaggggcgagccgcgccgcctga

SEQ ID NO: 4993 - DNA, 1608 bp, Myxococcus xanthus
atgcgctccaccgagggccgcgcccaggtgctcgaatggctgaaggactgggagtcgcaggtgtctcacctctccgacgccgcggacctgctctgggatgacctctacgcggagctgggtctgtcgcgtgacgaacgcatcccgctgacccaggtgtacagctcgaaggaggtcccacgcctcgagcccgtccgcgcggagctcaccaccaccgagcttcccgaggacctctctcttgaacctcttcctcgccgccgggccttccaggatgccgcccggcggaagcctcgacggaagcccccagcacccgagttggagccaggggccctctatgccttcaagctgggtcccatcgacgtcggcgtggacggacgcacctccgtctacgtcgcggtgacgtccgaaggtgaggcgctgccacccgtgttcgggcgtcgcgacgcggagggcctggaaggcctggcgagggacaaccccggactcaagcgttactgcgaaagccggctggcgcgtgctggagccggccacggcttcgcgtcgcggcccattcctgactccgtcacccggttccgggcggcgctggccctccagatgcactgggcctcggtggagccgggcttgatggtgatgccagaggtgacggaggcgctccttgacgccacggcggcgctcatccgcgcggagccttgggagagctggacgaacgaagaggtcttcaccgtgcatctggagggcaccgtgcggggcacccgggagctgtccgtcatggggagtgggggcagcgagttcggcttcgccctcttcgaccgggccggctccgtggagcggatgagcatgtccggtctgccgggcggcaacgtcgacgtgctcatcccggactcgctgggcgtgacgctggaggacgcgccggactgggtggtgaagacggtcaaggacgtcaccggcctgcccttcgtccccgacgtgatgcgcgtccagcacaacacaccgcgcctgggcaacgccgaggagctggtgctggcggcggcggtggcccaggcgctcgctctggcacgtcccgaggagcgcgaggtgaacgtggagctgaaggttggagacctccacgttcgggtgcggctggaaatccccctgccgctgctgacgggaagctacgtgggacagctcgacctgctgtcgctggccacccggcggcccaaggcgacccacgcgcccacgcgctcgctccccacgaagaaggtctccgaaacactgctcgagttcgccaaacccatcctggaggacgtggaggactcggaggatccgcaggccgagctcttcacctgcctggcgctggccctgagcgcgtggaacgccgtggtgcaagacacctgggagccggagaagggctgggtggagcgggcgcgcgccacgctgaaacggatgccccgagacgtccgggagatgatgctccacgatttcgagctgctggtggagcgcaagcggcgccacttcgcggacgacccccggctgctcgacgccctggacatcgtccagcggccggatgacctcagcgtccgcctggccggcgtggtgacgccaggcgcctggtccgaattcgtgggcgtgtag

SEQ ID NO: 4994 - DNA, 780 bp, Myxococcus xanthus
atgcagacaggggatgctcggctgtcacgcgccctgagccacgcccatcccaccgtgagcaccgccgccctggagaccgggttgctgctgggctcgcgtgaagcctgggagcacgcccgaggttccgcgtcgcgcggcgggctcctcgcgctcgccgtggcgggtgagtcgaaggacctcacgggcctcctcgcgcgcctgaaggatggctccgcaccggcggaggtcatctgggcggtgggcttcagtggcaggctcctggcggccgaggcgttgctgccgctgctgcgcgatgaggcccagggcccgctggccgcggcctccttcgccgccatcaccggactccccatggtgcctcctttcctcgtggaggcacccgctgacgaggaggaggacgcggaggaggccgaacccgaggccgaggacctccaggcgtggctccccagcccccgggtgcttcccggcgaggtggacgcccaggccgtggaggcctggtggacgcggcggcgcggcggcttcacggaaggcgcgcgtttcctgaggggcatacctctcaccgtggaggtgctggtcagggccctggagaccgagcccatgagacggcgcccctcgctcgcctgggaggcggccctgcgcggcggaggcacgccccagatggagtcccggcagtggacgcgggtgcagcgcgagcaggcgcttcccctgcgggggcagcgcccggaatggctcgcccgggcagggagctggccgcagggccgccgaggcgacactcccgcctga

SEQ ID NO: 4995 - DNA, 507 bp, Myxococcus xanthus
atgagcgcgaccgttggcgtcaacaagttgtccgtcgtccacaaggacaccggagggaccaccatcgccttcccggacgtctgcaagacgcccagccccgccggtcccgtgcccattccctaccccaacgtcgccatgtcctcggacacggcgaagggcacgacgaaggtttcggtggatggcaagccggtgtgcgtcgaggactcgaacttcagcaccagcaccggcgacgaggcgggcaccgcgggcggtggcgtcgtctccggcaagacgaagggcaaggccgagttcgtcaactactccttcgacgtgaagttcgagggcaagagcgtggcgcggaccttcgacctcatgctccacaacgacaagaacaccccgcccgcaccgctgctccaggggccggtcatcgcgctcggcaagagcgacacgaaggccaagtgcctcgtctgtgaaaaggagctgtgaggcccttgtcgccgccccgtccaacggttcgctgggagctgc

SEQ ID NO: 4996 - DNA, 210 bp, Myxococcus xanthus
atgaacgccatcgccaaggaccagattggccgcgtgaagaagctggccctgaagtacgacgccatctccccgcaggcgaagctgttccgctgcaccatggagcgccgcctcatcctcatccgcgaggacgtgcacgctgccttcgtccaggcgggcctcaccggcttcaaggtctacgtagccgagggttggaacggcctggagctgtga

SEQ ID NO: 4997 - DNA, 393 bp, Myxococcus xanthus
atgagtgacctgctcatctcgggacgtgcgcgtcagttcatcgaatcgctcggcatcaccaacgccgaatggcttccggtcgtggtcaaggaccatgaaggtgcagtggtcggtcccgactacgccttcctcaacctcctcggtgccgaagacgccatcgacatggcccgttcggtctacgagatgaatcacatctccaaggaccaaatcgggcttatcgaacaactggctctcagccccgacagaatcagccctgatgccaagatgttccgatgcaggacgtatcgtcggctcatcctcgttcgcgaagacaccctcgcggcattccaacgcgcgggactgacaggtttcagaacctacgacgccgagggatgggacggcgtggaactctga

SEQ ID NO: 4998 - DNA, 183 bp, Myxococcus xanthus
atgaaggacctggtccgcccaggcaaggacatggccatgtactgcgtccaggtcagcctgtctgatgaaaaggatgccatccgcttcacggacgaagagggagagccagtgctcgccttgatcggcgccatgcgtttcctacgttggcttgaagaggacggcgaggtcgacgaggaatcatga

SEQ ID NO: 4999 - DNA, 393 bp, Myxococcus xanthus
atgagcaacctgctcgtctcgggacgggcacgcaagctcatcgagtcgctcggtgtcaccaatgccgaatggcttccggtcgccatcaaggaccatcagggcaaggtcgtgggtccggactacgctttcctcaatctcctgggtgccgaagacgccatcgacatggaacgctcggagtacgagatggactcccttgagaaagaccaaatcgggaatattgatgcgttggctctggacaccagcgccatccgtcctgacgcgaagatgttccgctgcacgaaggaacgccgtctcattctcatccgtgaagacgtccacgctgctttcgagcaagcgggcctgaccggcttcaaggtctacgaagctgaaggctgggacggactggagctctga

SEQ ID NO: 5000 - DNA, 1275 bp, Myxococcus xanthus
atggacactcccgtcaagaagcacccttccctgcctcgtcccatccagggcgagctgaagctcgaccgctccaaccagctcctcgccgaggcgcggcggctggtccccggcgtcacgcagtccatgatgaagcgcccggagatgttcgcgctcggcgccttccccgtgttcctggccaagggcaagggcgcgctggtggaggacgtggacggccaggagtacatcgacttcatcggcggcctgggcgccaacatgctgggccacaatgacccagccgtggtgaacgccatccgggagcacctggaggaaggggtcctccactcgctgcccacgcccgtggaggtctccgccgcccagacgctggtggacctcatccccggcgcggagatggcgcgcttcttcaagacgggcgcggatgccacgtccgccgccgtgcgcctggcgcgccacatcaccggcaagcagaagatcatcaccgtcggctacaacggctggcacgaccacttcatgttcgacacgccgggcgtcccggccgcgctggcggcgctgacccttcggatgccgctcttcacgcccccggacgaaccggccctgctggccagcatcgagaagaacgccagcgagctcgccctggtgctgttgtcggtgccctacaaccggcccctcaccccggccttcctgcaacaggtgcgcgccacgtgcaccgcgaacaacgtcctgttcgccctggacgaagtcgtcaccggcttccggctcgccgtgggcggcgcccaggagttcttcgacgtccgcgcggacttcgtcacgctgtccaagagcatcgctggcggcatgccgctgtcggccatcgccggtccggcgaagcacctgagccgcctgagcgagctccaggtgtccaccaccttcggcggtgagctgctgtcgctgtacgtgtgcgacgcggtgctgaagggctaccgggatggcgcctacatccagcacctggcccacctgggccgcaagctgcgcgagggcgtcaacgcccaggcggaggccgcgggctcatcgttgcgcgtgattggctacgacgcgattcccttcttcctgttcgccaaggacccgacggagcacgcgaagcagatgcagcccttccaggcgggcatggcccgccggggcatcctgctgcgccgcgacgtcaccttcctcagcacggcgcacacggaggagcagattgactacgccatcgagatgacgggcgaagtcctccgctccctcgcgcagccggcggcggcctag

SEQ ID NO: 5001 - DNA, 1317 bp, Myxococcus xanthus
atgtgggagccctgtgggaccagcgtgcgcaggctcgcggacatccaccccggcccccaggaggcagccatccaggaaggcctccacggggatggcttgctcttcttcaccgcggatgacggtcaacacggcgccgagctgtggacgagcagcggcacgcagggcgaaggaacccggctgctccgggacatcgcgccgggaccggagggctccaaccccaccgacctcacacgcgtgggagaccggctcttcttcatcgcggacgatggggtgaatggccgcgccctgtggaccagcgacggcacgtccgaaggtacgtccctggtgaagcgcgtgcttcccattggcgccggccagggagagggacagacgctggtcgcgtacaagggccggctctacttctccgccgccgcgccgggtggcgcgcacggcaacgagctgtggaccagcgatggcacggacgcgggcacccatgaggtcgcggacctcgtcccaggcgaggacagttccttccctcgtcgcttcaccgttcacgacggctcgctctacttcgtcatcagcgtgggcgaagagaactggctcgtgcgaagcgaaggcggcgcggccttcacgcccctcctcaaggtcttcgaggacacggtcatcttccgcatgaagtccgtgggcggaaggctcttcttcctcgtggaccccgacgaaggcgaggccacgctctacgtcacggacggcacggcggcgggcacacgtcgcctgcgcttctttccgggccggtacccgcacgacctggtgccgttccagggccggctctatttcagtgcgggctcggacgcgccggagggcgaggaactgtgggtcagcgacggcacggtgtccggcacgcggcgggtgaaggacatccggcccggagcggagggctcggcgccggcgttcctggccgtgcttggagatcacctctacttcgcggcggatgacggccagcacggccgcgagctgtgggtgagcgatggcacgtcgaaaggaacgaagctcttcgcggacctggtgcccgggacggagggcgcatcccccaccgaggtgactgccatccagggctggctcttcttcggcgcgacgacggggcatggcgcggagccctgggtgagcaacggcactgtgtccagcacccggaagctcgacgcggggaccgcgcgagccccacgcgccttcatccgctccggctgggacgtgttcttcaccgccgaggacgaagccagcgggcgcgagctctacgccctgcccttccgtcccgccaacgagtgcactcagacgaaaccctga

SEQ ID NO: 5002 - DNA, 720 bp, Myxococcus xanthus
atggtccgcatcacccttgcgggcgaggacctggagggcttctacagccccggcgcggacgaccacgtgaagctgctgttcccggaggagggcaagcgcatgcctgtcatccccacggtgacgcccacggggttggtgctgaaggaaggcgagcgcaagccggacgcgcgtgactacacgccgcgccgctatgacgccgcggcaggcgagctggacatcgacttcgtggtgcacggcacggggcccgcgacgacgtgggcgagcaaggcgcaggtgggtgacctgctggccgtgggtgggccgcgcggctccacgttcgtggcgcaggatttcagttggtacctgctcgcgggcgatcagtcagcgctgccggccattggccgcatcctggaggagctgccggaggggacgcgcgccatcgtgttctgcgaagtcccggacgcgtccgaggagcagcacttcaccacccgcgccaacgcgacagtgacgtggctgcaccgcaacggcgtggaggcggggcactcggacgtgttgcagcaggccatccgcgggctggagttccccgcgggggactacttcgcctgggtggcgggtgaggcgcacaccgtgcgccccatcaaggaccacctcatcaacgagcgtggcgccaacaagagctgggtccgggtgacgggctattggaagcgcggcacctcggaccaccacgacgcgaagggctag

SEQ ID NO: 5003 - DNA, 1746 bp, Myxococcus xanthus
atgttcgccgaggaggcgttcggcggtggttggttccacggcaagcacaacggctccctggtgagctgtgacggtggctttccggagagcgaccacgcgcgcgttcgcatggacctgggctccatgctcaacgtgtgccccaacgcaggcggaatcaacctgagcggcgtgccggtgctgtcgcagatgttcggggtgggcggcgcggtggcgtcggaaatcatcggcgaggtcgaaggaacggagggcgacaccggtctccacctggggcggatgagcgtgcccacgcagtggccgcgatgggacaccatcgcgcatcagcaggcctgggagggctggctgcagcaggcgcatcagggtggcatgtccctggtcaccatctccctggtgagcaacgagttcctctgcagggcgctgccgtaccagaacatcaagcgtccatgtgacgagatggtggacgtggacgtgcagttgcagatggcgcgtgacttcgacgctcgcacgccgtgggcggagatcgcgctgtcgccggcgcacgcgcggcagatcatcgcctccggcaagctggccatggtgctctccatcgagtcgagcaagctgttcggcaccaagaactggcagtccgagctcaaccgcgtctactcgctgggcgtgcgctccatccagccggtgcaccaactggacaaccgtttcggcggcgcggcgccccacaacgccatcttccaggtctcgcagttcttggagaactgccacgtggacaccgactgcggcctcacgggcaacggcttcacgctaggcttcgatgtggacgccaactgcaagaacaccaagggcctgacgtccgagggccgggcgctggtcgccgagatgatgaacaagggcatgctcgtcgacgtggcgcacatgtccgagcgctccgtggacgacacgttcgccatcgcccagagccgcaactactaccccatgtacatctcccacggtcatttccgtgaggtgatgcacccggggctcgccgccaacgagaagacgacgcccgcgtccatcatccgcaacgtgcgtcagacgggcggcatgttcggcctgcgcaccgcgcacgatgacacgcgcgactacacccgcacgccggtcgccaacaactgccagggctccacgcgctcgctggcgcaggcctatgagttcggccgcctgggcctcaaggtgaacatgggctttggcgcggacctcaacggcttcatccagcagacccgcccgcggttcggcccccacggcgcctgctcggccggcttcgccgcggaggcggcgttccaggcgcagcagcagctcaccgctggcccgccgccgctgggcacggacttcgacaactacggcctggcccacgtgggcctgctgccggacgtggtgcgtgacctgaagcagctcggcgtcaacaccacgggcctggagggctcgtccgagacgttcatccggatgtgggagcgggccaccggaacgcgcaccggcatggcggacagcgcggcgaacatcgacaccagcggtgtggcggcctacgtgccgaaggagacccgcgcggcccagtatccgaccagctccacctgcaccaacgacagcgactgcgccagcacccagtactgcggctgggggctcaacgccggcaagtgtcagaacaagaaggccaagggcgccatctgcggcagcgcgcgggagtgtctgtccaacaactgccggtggaccctgacctgcggctga

SEQ ID NO: 5004 - DNA, 24459 bp, Myxococcus xanthus
tggtggtgtgcgtggacacgagtgggactcgcagattgcccatcacccgcaaccacgccgaagtgccaacgtgggcggcggaaaccttgcgtacgtatgttcacgtcagggagcacgggaaagccgaagggcgtaggcgttccgcaccgagcggtgtcacgcctggtgctggggacggacttcgcgcacttcgggccagaggaagtgtggctgcaactggcaccgatttcctttgacgcatcgacgctggaagtatggggcgcactgctgcacggcgcgaagctggtggtgtacccggcagggacgccgtcactagaggaactaggccggaagctggagtcttcaggcgtgacgtcgttgtggctgacggcggcgctcttcgagcagatgcaggcccggcagccgaaggcgctggccaatgtccgccagttgctggcgggtggcgacgccttgcctgtgtctcgtgtgaaggaacgactggcggcaggtggcctgctcttcaacgggtatggcccgacggagaacacgacgttctccagcacgtaccggatggaaaagcccgaggaagtcggggtgtcggtgtccatcggccggccggtgaagaacaccgtggcttacgtgctggacgcggggatgcgcccggtgccggtgggcgtgccgggtgagctgtacgtgggcggagacgggctggcagtggggtacgtggggcgcccggaactgacggcggagcgtttcgtaccaagcccattcggcgaaggagagcggctgtaccgcacgggggatgtggtgcggtggctggggaacgggacgctggagttcctgggccgagcggacacgcaggtgaaggtgcggggttaccgcatcgagctgggcgaagtggaagcggcgctggcccagcatggtggcgtcaacgaagccgtagtggtggcacgggaggatggaggtgaaggcaagcggttggtggcctatgtgacggcgcaggaaggggcctcgctggacacaggtgcgctgcggagccacatgaagcagcgactaccggagtacatggtgccgtcggcgtatgtggtgctggaggcgctgccgctgacgccgaacggcaaggtggaccgcaaggcgcttcctgtcccggatgcccagggcccgaaggcagcgcacttcgaggcgcctcgcacggcgactgaagagaagctagcgtccatcttcgctgaggtactgaacgtcgagcgcgtcagcgtcgacgaagacttcttcgagctgggtggccactcgctcctggccacgcagctggtctcgcgcgtccgcgaagccttccacgtcgagttgcctctacgggacgtctttgaggcgcccacggtagagaagctcgcccagcggctcgagacggaaccgaacggcacgcaggtgcttcatgtgccgccgccgacgcgagttgaacgaaccgggtcgctgcccctgtcgttcgcgcaacagcggctgtggttcctcgaccaactggagccgggtagttcgtcctacaacatccctatcgcagtgacgctgacggggacggtgcaggtggacgcgctggagcaagccttcaaggcgctggtgcttcggcatgagtcgctgcgcacgaccttccagagcagcggtggtgagccggctcaggtcatcgccgaggagtcagaggtccagctgcgagtggtggacctgcgcgacctgtccgaggctgaccgggccccggaagtccaacgcctgatctcccaagaggcagcgcatcctttgaacctggcgcgcggcccgatgctgcgaacggtattgctgaagctgtccgagcaggagcacgtgctggtgctggtgatgcaccacatcgtgtcggacggctggtgcatgggcgtgctcgtgcgcgaggtcacctcgttgtatgacgagtgctcgcagggcctgtcgtcaccgctgccggagcttccgctccagtacgcggactacgcggtgtggcagcgcgagtggctccagggagaggttctggagtcacagctcgcctggtggaaggggcagcttcagggggcctcgcaggcactggaactgcccacggacaagccgcgtcccgcggtgcagaccttccatggcgccagccgggatgtgcagtgcccgcgcgacctgtgggagtcggtcaaggtgctcgcgcatcgtgaaggcgccacgccgttcatggtgctgctcgcggcgttccagacggtgctgtcgcgctactcagggcaggatgacctctgcgtgggctcgcccatcgccaaccgcacccgggccgagacggaggggctgattggcttcttcgtcaacacgctcgttcttcgtgctcgactcgatgggaaccccacgtttcgggagttgctggctcaggttcgcgaacggacgctcggcgcgtatgcgcatcaggacatcccgttcgagcgactggtggaggaactcaagccggaccgcgacttgagccgcagcccgctcttccaggtgatgttcatcctgcagaacacgcccaccgtggagctgcacctgccgggcctgacgctggcgggaatggatggtgactcgcgcacgtcgaagttcgacctcaccctggagctgaccgagacgccgcaggggttgtcggtcagcgccgtatacaacagcgacctcttcgagcccgtgacgatggaccggctgatgggccatctgcgcgtgttgctggaggccgcggtccagacgccggatgctcggttgggcgaactgccgttgctgggcgcagtggagcagcgccggttgctcgtggagtggaacgacacccgcagcgacttcgttcccaacaccatccaggccctcttcgaggctcaggccgcgaagacgcctgaagcgctcgcggtcgtcgccgaagactcacggctgacctacgaggcgctgaaccagcgggccaatcaactggcgcatcagctgcgttcgctgggcgtcggtccggatgttccggtgggcttgtacctggaccgctccgccagtgcggtggtgggcctgtggggcattctcaaggcgggtggtgcctatgtgccgctggacgtcacattccccgtcgagcgcatccgaagtgtgctctcggacgcgggtgcccaggtgctggtcacgcaggcggccctggcggaggtcctgcgctggggcgcgggcggggtggtccgtctggatgcggacgcgtcttctctattggaacggagcgagcgcaacccggagccctcggcggcgccggagaaccttgcctacgtcatcttcacctctggctccacggggcggccgaagggcgtggccatcgagcaccggcaactggttcattacgtaaagggcgtctcgtgccggctggacctgccggaaagcgcttcgtttgcttccgtgtccacgctggcggcggacctgggccacaccgctgtcttccccacgctctgccaaggcggcgcgctgcatctcgtgtctcgtgaatgcgcgtcggacccgtccgccctggccgagctcttcgagcgcgaggccgtggactgcctgaagatcgtccccgctcacttgcaggcgctcctggcctctgggaatcccgagcgggtgttgccgcgtcagcgtctggtgctgggcggtgatgtctcggattgggcactgatggaccgggtgcacgaactgtcgccggacctggaggtgttcaatcactacgggccctccgagacgaccgtgggtgtgctcacgctccaggtggagcgtgggcctcaggggcgtgtgtcggcgtcggtgccgctggggcggcccattcccaacgcgcgcgtctacgtgctggatgcgtacctgcgcccggtgcccgtgggcgttccgggagagctgtgcattggtggaaggaccgtgggccgcggctatctgggccgggtggacctgacggccgagcgcttcgtgccggacgcgtacgcggaggatccgggtgcgcggatgtaccggacgggagaccgggcacggctgctcgcggatgggcgggtggagttcctgggccgaacggatgaccagctcaaggttcgcggctaccgcgtggagatgggcgaggtggaagcggcgctggagcggcacccctcggtgcgtgagtcggtcgtggtggctcacgagagcgggacagatggcaagcgcctggtgggctacgccgtgccgaagccgggccacacactggaggtcgatgcgcttcgtgacttcctgggccagacgctgcctgactacatggttccgcaggccctggtggtgctggaggcgctgccgctgacgcccaacggcaaggtggaccgcaatgcgctgccagcgccggacttccagtccgtggatgccgaggcttttgtcgcgccacgcacggccacggaagaactggtggcggggctgttctccgaggtgctggggctcgaccgtgtggggatccacagtggcttcttcgagctgggagggcactcgttgctggcgacgcaggccatctcccgcattcgtggcgccttcggtgtcgagctgcccctgagagacctcttcgaggcacccacggtggctgcgctcgccgagcgggtggaccgttgggtgcgcgccggagcgggcttcgctgcgcctccgttgaagccccgggcgggactgacgagcgtcctgccgctgtcgttcgcgcagcagcgcttgtggttcctggagcagctcgcgccggggagtgtcttctacaacgtgccggcggtggtgaaggtgtcggggccgcttgacgtggccgcactggaacgcagcttcgacgcgctggttcgtcgccatgaatccttgcggacgactttccacgccgacggtgggacgcccgtgcaggtcatcgcgcctgtggggcaggtggtgttcacggtcgaggacctgagcgggctccctgatgcggagcaggaggcacagcgccgagcggacgtcgaggcgcttcggccgttcgatctggccaagggacccttgctgcggaccatgctgcttcgcctcggggagcgcgagcacctgttggtgctgatgatgcaccacatcgtgtccgacggctggtccatgggtgtcctcgtgcgagaggtcgcggcgctgtacgaagcgttctcccagggccgtccatcacccttgcctgaactggcggtgcagtacccggactatgcggtgtggcagcgggagtggctgaagggcgaggtgctggaggcgcagctcgggtactggaagcaacgtttggaaggggcgcccgcggcactggagctgccgaccgacaaggcgaggcccgccgttcagacgtatggcggcgttttgcggcacgaggtgtggccgaaggcgctctggcgcgacatggaggcgctcggccgtcgtgaaggtgcgacgccgttcatggtgttgctggctgcgtaccagtgggtgctgtccaagtacgcggggcaggaggacgtgtgcgtgggggctcccatcgcggggcgcgcgcaaggcgagacggaggggctgatcggcttcttcgcgaacatgctggtgctgcggacgaaggtgtccccggcatcaaccttccgtgagctgctcgctcaggtgcgggaggtgacgctgggtgcgtatgcgcaccaggacgtgccgttcgagaagctggtggaggagcttcagcccgagcgtgacctgagtcgcagtccgctgttccaggtgacgctgacactgcagaacacgcccgtgacggaggtgaagcttggggacggcctcacgctgtctggcgtggagtcggaggggcggacgtcgaagttcgacttctccctggtggtggaggaagtgcagggcggcgtggtggtggcggcgaactacaacaccgagctgttcgaagcagagacggtgcgccggctgctccaccatctgcggaccctgctggaggcggccatcgcagagccggcgaagcggctggccgagctgccgttgatgggcagtgaggagcagcatcgactggtgaaggaatggagcgggatggcgtcggagtacccgcgcgatgccagcctgagtgtcctcttctagcagcaggtgcagcggacgccggacgcggtagcggtggagtacgaggaccggcgactgacgtacgcggagttgaatcgccgtgccaaccagctagcgcatcatctgaagggcatgggcgttgggcccgaggttcgggtggggttgtgcgtggagcgctcgctggagctggtggtgagcgtgctgggcatcctgaaggcagggggcgtgtacgtgccgctggatgccagctatccgctggagcgactggcgtggatgaagcaagaggcgggcgtcgcggtgctggtggcgcaggagaagctggcggacgaggtagccacgggtggcgagctggtggtgtgcgtggacacggagtgggacacgcagattgccctgcaaccggaggtcgcaccgagcacgcatgtgggagggggcaacctggcgtacgtgatgttcacgtcgggaagcacagggaagccaaagggcgtaggcgtgcctcaccgagcagtgtcacgcttggtgctgggaacggacttcgctcacttcgggccggaggaagtgtggctgcaactggcgcccatttccttcgatgcatcgacgctggaagtgtggggcgcgctgctgcacggcgcgaagctggtggtgtacccggcggggacgccgacgttggaggaactgagccgcaagctggagtcgtccggcgtgacgtcgctgtggctgacggctgcgctcttcgagcagatgcaggcgaggcagccgaaggccctggccagcgtccgccagttgctggcgggtggcgacgcgctgccggtgttgcgggtgaaggagcggctggcagcaggtggcctgctcatcaacgggtatggcccgacggagaacacgacgttctccagcacgtaccggatggagaggccggaagaagtaggtgcctcggtgtccattggccggccggtgaagaacacggtggcctacgtgctggacatggggatgcgcccggtgccggtgggggtgccgggcgagctgtacgtgggcggagacggcctggcagtggggtacgtgggacgcccggagctgacggcggaacgcttcgtaccaagcccattcggtgagggagcgcggctgtaccgcactggggacgtggtgcggtggctggggaacgggacgctggagttcctgggccgagcggacacgcaggtgaaggtgcgtggctatcggattgagctgggcgaagtggaagcggcattggcccagcacggtggtgtcaacgaagcagtcgcggtgacacgcgaggacgggagcgaaggcaagcggttggtggcctatgtgacggcgcaggaaggtgtctcgctggaaacgggtgcattgcggagccacatgaagcagcggctaccggagtacatggtgccgtcagcgtacgtggtgctggagtcgttgccgctgacgccgaacggcaaggtggaccgcaaggcgctgcccgccccggatgcccagggcccgaaggcagcgcacttcgaggcgcctcgaacggcgactgagcagaggctggcgtccatcttcgccgaggtgctgaacgtcgagcgcgtcggactggagggggacttcttcgagttgggcggacactcgctgctggcaacgcagttggtgtcgcgagtgagggaagaactccaggtagagctcccgctgcgagacatcttcgaatcctccacagtggggaagctggccgaacggattgacgcatcccgcgggacggcagcggccgaggttcgagcaccacccctgacgcgcgcttctcggagcgatgcgctaccgctgtcattcgcgcagcagcggctgtggttcctcgaccagttggagccaggcagtccgttctacaacgtcccctccgtggtgaagttgactgggcgtctgcaaacgaccgcgttggaggccagcttcagtgaactcgtgcggcggcacgagtcattgcgcacgacgttccgtgtcagtggcggtgaacccgtgcaggtcatcgcaacggatccgcttcagcctttccagcagctcgacttcagtgaactggaaacggagcgcgaatccagggtgcggatctggatcgaagaggagattcagcgcccgttcaacctggagacgggcccgctgttgagggcgacgctgctgaaggagggggaagaagcgcacgtgctggtgctggtgatgcaccacatcgtgtcggatggctggtcgatgggcgtgttggtgagggagttggtggcgctgtacgaggcgtactcgcaggggcgcgagtcaccgctggcggagctggaggtgcagtacgcggactacgcggtgtggcagcgagggtggctgaagggtgaggtgctggaagagcagctggggtactggaggaagcagctagcgggtgcgccagcggcgctggagttgccgacggacaaggcgaggccggcggtccagacgtaccgaggagacacgcgagggctggagtggccgaaggggctgtgggagggagtgaaggggctggcgcagcgggagagcgcgacgcccttcatggtgctgctggcggccttccaggtggtgctgtcgaggtacgcgaggcaggaagacgtgtgcgtcgggacggcgatagcgaaccggacgagggcagagacggaggggctgattggcttcttcgtcaacacgctggtgctgcggacgcaggtgtctgcggcatcaagcttccgtgagttgctggcgcaggtgcgtgaagtgacgctgggtgcgtacgcgcaccaggaagtgcccttcgagcggttggtggaggagctgcagccggagagggacttgagccgcagtccgctgttccaggtgatgttggtgctgcagaacgcgccgggaggagcggtgagcctgccggggctgaagctggaggcggcggagtcgacggggaagacgtcgaagttcgacgtgacgctgggcttgggagagtcgagcgcgggagggctatcgggcgcgctcgagttcaacagcgacctgtttgaagccgagacgatggagcggcttttggggcacttgcgggtgctcctggagactgctgtgagcgccccagagctgccgctggctgagctgccgctgatgggccatgaagagcagcagcggttggtgaaggagtggagcgggacggcttcgacgtatccgcgcgatgccagcctgagcgccctcttcgaggcgcaggttcagcggacgccggacgcagtggcggtggagtacgaggaccagcgactgacgtacgcggagttgaaccgacgctccaaccagttggcacaccacctgagaagcatgggcgtggggcccgaggtacgggtggggttgtgcgtggagcgctcactggagctggtggtgagcgtgctgggcatcctgaaggcgggaggcgtgtacgtcccgctggatgccagctacccgctgaagcggctgacttggatgaagcaggaggcgagcgtcacgctgctggtggggcagcagaagttgctcgagtccatgatgctctccgacaccgagtccagtgtgtgtgtggacacggagtgggacgctcagattgtgcatcagccagaaagcaacctgcgttccagtgtggccggtgggcatctggcgtacgtgatgttcacgtcaggaagcacggggaagccgataggcgtgggcgtgccccaccgagcggtgtcacgcctggtgctggggacggacttcgcgcacttcgggccggaggaggtgtggctgcaactggcaccgacttccttcgacgcatcgacactggaagtgtggggcgcactgctgcacggcgcgaagctggtggtgtacccggcggggacgccgtcactagaggaactaggccggaagctggagtcttcaggtgtgacgtcgctgtggctgacggcggcgctcttcgagcagatgcaggcacggcagccgaaggcgctggccagtgtccgtcagctgctggcgggtggcgacgccttgccggtgttgcgggtgaaggagcggctggcggcaggtggcctgctcatcaacgggtatggcccgacggagaacacgacgttctccagcacgtaccggatggagaggccggaagaagtaggtgcctcggtgtccattggccggccggtgaagaacacggtggtctacgtgctggacgcggggatgcggccggtgccggtgggcgtgccgggtgagctgtacgtgggcggagacggcctggctatggggtacgtggggcgcccggagctgacggcggaacgcttcgtaccgaatccgtacggcgaaggagagcggctgtaccggacgggggatgtggtgcggtggctggggaacgggacgctggagttcctaggccgcgcggacacgcaggtgaaggtgcggggttaccgcatcgagctgggtgaagtggaagcggcgctggcccagcacggtggtgtcaacgaagcagtcgcggtgacacgcgaggacggcggtgaaggcaagcgactggtggcgtatgtgacagcgcgcacgggcacgagcctggagtccagcgcgctgagaagccacatgaagcagcggctaccggagtacatggtgccgtcggcgtatgtggtgctggaggcgctgccgctgaccccaaacggcaaggtggaccgcaaggcgctgcctgctccggtgacgatgctgggcacgccaggttccgattatctggcgccgcgtactcctacagaggaactgatcgctgggatcttctcgcaggtgctgggcgtggagcgggtcggttcgaaggacaatttcttcgaactgggcggccactcactgttggcaacgcagatggtgtcgcggattcggagcaccttccgaatcgagctcccgctccgcgacttgttcgaggctcccacgctgtcggtcctgtccgagcgggtggaccatgccattcgcacgggggcgtcgatcaccgctccgcccttgacgccacgagcggatgggagctgggtattgcctccgtcgttcgcgcagcagcggctatggctcctggatcagatggagcaagggagcgcctcctacaatgtgccggccgtccttcgggtagaggggccgctccaggccgaggtgctcgagcggagcttcgtggagctcgtgcggcgccacgagtcgctgcggacgacgttcagcactcgggatggaaaacccgttcaaatcatcgcagccgagccggtgctggccttccgaagcatggggctggagtcatcggcggaggccgtgcgcacggcggaagtcgcgcgtctggtcgaacaggaggcacaccagcggttcgatctcgaacgtggccctttgctgcgcgtgacgctcctgaagctggcagagcaggagcacgtgctgatcctggtgacacaccacatcgtgtctgatgggtggtccatgggcgtcctcgtgcgggatgtaaccgcactctacgaggcgttcttgcaggggcgcccctcactgctaccggaactgccagtgcagtacccggactacgcggtgtggcagcgggaatggctgaagggcgaggtgctggagtcgcaactcgcatactggaagcggcagctgaagggggcaccccaatcgctggagctgccgacggataaaccgcggcccgcggcgcagagcttccgaggaggacatctcgaccagtcctggcccctggccttgtgggagcgggtgaaggccctggcacagcgtgaaggagcaacgccgttcatggtgctgctggcggccttccaggtggtgctggcccgctacgcgagacaggacgacgtgtgcgtggggtcgcccatcgcagggcgcacgcaaggcgagacggaagggctgatcggcttcttcacgaacatgctggtgctgcggacgaaggtggccccggcatcaactttccgtgagctgctcgctcaggtgcgggaggtgacattgggtgcgtatgcgcaccaggacgtgccgttcgagaagctggtggaggagcttcagcccgagcgtgacctgagtcgcagtccgctgttccaggtgacgctgacgctgcagaacacgcccgtgacggaggtgaagctcggagatggcttgaggctctccggtgtggagtcggaggggcggacgtcgaagttcgacctatctctggtgatggaggaggtgaaggacggcgtcatggcgatggtcaactacaacagcgacttgttcgaggccgggacgatggaccggatgctcggacacttgagggtgctgttggaggccgccgtcgccgcgccggagcagcggctggccgagctgccgctgatgggccgtgaagagcagcagcggttggtgaaggagtggagcggggcggcttcgacgtatccgcgcgatgccgacctgagtgccctcttcgaggcgcaggttcagcggacgccggacgcggtggcggtggagtacgaggaccagcgactgacgtacgcggagttgaatcgccgtgccaaccagctggcgcaccacctgagggggatgggcgttgggcccgaggtgcgagtgggcttgtgcgtggagcgctcgctggagctggtggtgagcgtgctgggcatcctgaaggcgggaggcgtgtacgtgccgctggatgccagctatccgctggagcgactggcgtggatgaagcacgaggccggcgtcgcggtgttggtggcgcaggagaagctcgcggacgaggtagccacgggtggcgagctggtggtgtgcgtggacacggagtgggacacgcagattgcccatcatccgcaaatcacgccgagtgccaacgtgggcggcggaaacctggcgtacgtgatgttcacgtcagggagcacggggaagccgaagggcgtgggcgtaccgcatcgcgcggtgtcacgcctggtgctgggaacggacttcgtgcacttcgggccggaggaagtgtggctgcaactagcaccgatttccttcgacgcatcgacgctggaagtgtggggcgcactgctgcacggctcgcggttggtggtgtacccggcggggacgccgtcgctggaggagctgggccggaatctggagtcttcaggcgtgacgtcgttgtggctgacggcggcgctcttcgagcagatgcaggcccggcagccgaaggccctggccaatgtccgccagttgctggcgggtggcgacgccttgccggtgttgcgggtggaggagcggttggcggcaggtggcctgctcatcaacgggtatggcccgacggagaacacgacgttctccagcacgtaccggatggaaaagcccgaggaagtcggggtgtcggtgtccatcggccggccggtgaagaacaccgtggcttacgtgctggacgcggggatgcggccggtgccggtgggcgtgccgggtgagctgtacgtgggcggagacggcctggcagtggggtacgtggggcgtccggcgctgacggcggaacgcttcgtaccaagcccattcggtgagggagagcggctgtaccgcacgggggacgtggtgcggtggttgaggaacgggacgctggagttcctgggccgcgcggacacgcaggtgaaggtgcgtggctatcgcatcgagctgggcgaagtggaagcggcgctggcccagcacggtggcgtcaacgaagccgtggtggtggcacgcgaggacgggaacgaaggcaagcggttggtggcctacgtgacggcgcaggaaggtgcctcgctggacacgggtgcattgcggaaccacgtgaagcagcggctgccggagtacatggtgccgtcagcgtacgtggtgctggagtcgctgccgctgacgccaaacggcaaggtggaccgcaaggcgcttcctgccccggatgcccagggcccgaagacagctcacttcgaggcgcctcgcacggcgactgaggagaagctggcatccatcttcgccgaggtgctgaacgtcgagcgcgtcagcgtcgacgaagacttcttcgagctgggtggccactcgttgctggcaacgcagttggtgtcacgcgtccgcgagtccttacaggtggaactccccctgagggacgtcttcgaatctccgacggtggagcaactggccctcaagctgggccacgaacaggtggggggcttgatgccccaggcgccaccactgaagcgggctctgcgccagggggcattgccgctatcgttcgctcagcagcgactgtggttcctcgaccaactggagcctggcagcgccttctacaacgtgccggtcgcagtgaggctcaccggcgtcctcgacgttgcagcgttgcgccgtagcttcgatgagttggttcgccgacacgaatcgttgcgaaccaccttccgtgctcaggacgggatgcccgtccagattgtctccgacactgcatcgaaccggttggaagtcttggcgcgcggaactccggacgatggtgaaggagggctggagacaaaacgcctcgcggagcaagaggcgcttcgcccgttcaacctggagacagggccgctgctgagggcgacgctgctgaaggagggggaggaagcgcacgtgttggtgctggtgatgcaccacatcgtgtcggacggctggtcgatgggcgtgctggtgagggagttggtggcgctgtacgaggcgtactcgcaggggcgcgagtcaccgctggcggagctggaggtgcagtacgcggactatgcggtgtggcagcgagggtggttgaagggtgaggtgctggaagagcagcttgggtactggaggaagcagctagcgggtgcgccagcggcgctggagttgccgacggacaaggcgaggccggcggtccagacgtaccgaggggacacgagagggctggagtggccgaaggggctgtgggagggagtgaaggggctggcgcagcgggagagcgcgacgcccttcatggtgctgctggcggccttccaggtggtgctgtcgaggtacgcgaggcaggaagacgtgtgcgtcgggacggcgatagcgaaccggacgagggcagagacggaggggctgattggcttcttcgtcaacacgctggtgctgcggacgcaggtgtctgcggcatcaagcttccgtgagttgctagcgcaggtgcgtgaagtgacgctgggtgcgtacgcgcaccaggaagtgcccttcgagcggttggtggaggagctgcagccagagcgggacttgagccgcagtccgctgttccaggtgatgttggtgctgcagaacgcgccgggaggagcggtgagcctgccggggctgcaactggaggcggcggagtcgtctgcgaagacgtcgaagttcgatttgacgctcggcttgagtgagacggatgagggcctttctggaggcctcgagttcaacagcgacctgtttgaagccgagacgatggcgcggctgctggagcatctgcgggtgttgttggatgcagccgtcactcggcctgagacgcggctggccgaactgccgctgatgggcagtgaagagcagcagcggttgatgaaggcgtggagcggggcgactgcgcattacccacgagaagcgtcgttggcgcagttgttcgacgcacaggcgcagcggacgccggacgcggtggcggtcgagtatgaggatcggcggctgacgtacgcggagctgaaccgacgtggcaaccagctggcacaccacctgagaagcatgggggtggggcccgaggtgcgggtgggcttgtgcgtggagcgctcgctggagctggtggtgagcgtgctgggcatcctgaaggcgggaggcgtgtacgtcccgctggatgccagctacccgctggagcgcctggcatggatgaagcaagaagcaggcgtcacgctgctggtggggcagcagaagctgctcgagtccatggggctcaatgacaccgagtccagggtgtgcgtggacacggagtgggagacgcggattgcccatcagctgcaaaccacgcccagcgccaacgtgggcggtggcaacctggcgtatgtgatgttcacgtcgggaagtactggtaatccgaagggtgtgggcgtgccccaccgagcagtgtctcgcttggtgctgggaacggacttcgcgcacttcgggccggaggaggtgtggctgcaattggcgcccatctccttcgatgcatcgacgctggaagtgtggggcgcgctcctgcacggagcgaagctggtggtgtacccggcggggacgccgtcgctggaggagctgggccggaagctggagtcgtcaggcgtgacgtcgctgtggctgacggcggcgctcttcgagcagatgcaggcgcggcagccgaaggcgctggccagtgtccgccagttgctggcgggtggcgacgccttgccggtgttgcgggtgaaggagcggttggcagcgggcggtgtgctcatcaacgggtatggcccgacggagaacacgacattctccagcacgtaccggatggagaggccggaagaagtaggtgcctcggtgtccatcggccgaccggtgaagaacacggtggcttacgtgctggacatggggatgcggccggtgccggtgggggtgccgggtgagctgtacgtgggtggagacgggctggcagtggggtacgtggggcgtccagagctgacggcggagcgcttcgtaccgaatccgtacggcgaaggagagcggctgtaccgcacgggggacgtggtgcggtggctgagcaacgggacgttggagttcctgggccgagcggacacgcaggtgaaggtgcggggttaccgcatcgagctgggtgaagtggaagcggcgctggcccagcacagtggtgtcagcgaagccgtggtggtggcgcgggaggatggaggcgaaggcaagcgactggtggcgtatgtgacagcgcgcacgggtacgagcctggagtccagcgcgctgagaagccacatgaagcagcggctaccggagtacatggtgccgtcggcgtacgtggtgctggagtcgctgccactgacgccgaacggcaaggtggaccgcaaggcgctgcccgccccggatgcccaggggccgaagacggcgcacttcaaggcgcctcgcacggcgactgaggagaagctggcatccatcttcgccgaggtgctgaacgtcgagcgcgtcagcgtcgacgaagacttcttcgagctgggtggccactcgctgctggcaacgcagttggtgtcacgcgtacgtgaggccttccgggttgaactgccactccggacagtcttcgagtctcggtctgttgagacactggcgaggtggctggacagtgcctcgggagtcgctgctgggctgagagcccctccgctggttcgagcttcacgcgatggcgcgcttcctctgtcattcgcgcagcaacggctgtggttcctccaccagcttgaccccgacagtgccttctacaacgtgcccgtggcggtgaagctctcgggggcccttgatgttgcggcgctggagcggagcttccattcactggttctccgtcatgaggcgctgcgcacgaccttccgttccgaggcaggcgttcccactcaggtcatctctcccgcgggaaggggcgcgttggagtttgtggacctgagtgcactccagggctcggagaagaccctggaggtccagcgtcgaacggaacttcaaacccttcgtccgttcaatctggagacgggcccgttgctgagggcgacgttgctgaaggagggggaagaagcgcacgtgctggtgctggtgatgcaccacatcgtgtcggacggctggtcgatgggcgtgctggtgagggagttggtggcgctgtacgaggcgtactcgcaggggcgcgagtcaccgctggcggagctggaggtgcagtacgcggactacgcggtgtggcagcgagggtggctgaagggtgaggtgctggaagagcagctggggtactggaggaagcagctagcgggtgcgccagcggcactggagttgccgacggacaaggcgaggccggcggtccagacgtaccgaggggacacgcgagggctggagtggccgaaggagctgtgggagggagtgaaggggctggggcagcgggagaacgcgacgcccttcatggtgctgctggcagccttccaggtggtgctgtcgcgctatgcgcgccaggacgacgtctctgtgggctctcccatcgccaatcgcacacgagccgagacggaggagttgattggcttcttcgtgaactcgctcgtgctacggacacggctggatggcaatcccagcttccgtgagttgctggcgcaggtgcgcgaagtgacgctgggtgcgtacgcgcaccaggaagtgcctttcgagaggctggtggaggagctgcagcccgagcgggacctgagccgcagcccgctgttccaggtgatgttggtgctgcagaacactccgggaggcgcggtaagcctgccggggctgaagctggaggcagcggagtcgacggggaagacgtcgaagttcgacttgacgctcggcttgggggcgtcgagcacagacggactgacgggggcgttggagttcaacagcgacctgttcgaagccgagacgatggagcggctgctagggcatctgagggtgctgttggaggccgccgtcgccgcgccggagacgcggctggccgagctgccgctgatgggcagtgaggagcggcagcgactggtgaaggagtggagcgggacggcttccacgtacccacgcgatgccagcctgagtgtcctcttcgagcagcaggcacagcggacgccggacgcagtggcggtggagtacgaggaccagcgactgacgtacgcggagttgaaccggcgtgcgaaccagctggcgcaccacctgaggagaatgggcgttgggccggaggtgcgggtggggctgtgcgtggagcgctcactggagctggtggtgagcgtgctgggcatcctgaaggcgggaggcgtatacgtgccgctggatgccagctacccgctagagcgtctggcgtggatgaagcaagaggcgggcgtcgcggtgctggtggcgcaagagaagctcgcggacgaggtagccacgggtagcgagctggtggtgtgcgtggacacggagtgggacacgcagattgcccatcatccgcaaaccacgccgagtgccaacgtgggcggcggaaacctggcgtacgtgatgttcacgtcagggagcacggggaagccgaagggcgtgggcgtaccgcatcgtgcggtgtctcgcttggtgctggggacggacttcgcgcacttcgggcccgaagaggtgtggctgcaactggcgcccatctccttcgacgcatcgacgctggaagtgtggggcgcactgctgcacggctcgcggttggtggtgtacccggcggggacgccgtcgctggaggagctgggccggaatctggaatcgtcaggcgtgacgtcgctgtggctgacagcggcgctcttcgagcagatgcaggcgaggcagccgaaggcgctggccagtgtccgccagctgctggcgggtggcgacgcgctgcctgtgtcccgcgtgaaggagcggttggcagcgggcggtgtgctcatcaatgggtatggcccgacggagaacacaacgttctccagcacgtaccggatggagagtccggaagaagtaggtgcctcggtgtccattggccggccggtgaagaacacggtggtctacgtgctggacgcggggatgcgcccggtgccggtgggcgtgccgggtgagctgtacgtgggcggagacggcctggctatggggtacgtggggcgcccggagctgacggcggaacgcttcgtaccgaatccgtacggcgacggagagcggctgtaccgcacgggggacgtggtgcggtggttgaggaacgggacgctggagttcctgggccgagcggacacgcaggtgaaggtgcgtggctatcgcatcgagctgggtgatgtggaagcggcgctggcccagcacagtggcgtcagcgaagccgtggtggtggcgcgggaggatggaggcgaaggcaagcgtttggtggcctatgtgacggcgcaggaaggggccacactggacgcgggtgcactgcgaagccacatgaagcagcggctaccggagtacatggtgccgtcggcgtatgtggtgctggaggcgctgccgctgacgccgaacggaaaggtggaccgcaaggcactgcccgcgccggacacagcgggcacggcgagcgagaaatatgtggcgcctcgaacagcgaccgaaaagacgttggccgcaatcttcgtcgacgtcctgaaggtcgagcgggtcgggctcgacggagacttcttcgaactgggcggacactctttgctggcaacgcagttggtgtcgcgtgtgcgggaggagctccaagcagagctcccccttcgagacatcttcgagtgtcccacggtggagaagctcgcccagcggctggaccacacttcgaaaacagatggcggcgcgcagccaccaccgttggtacgggtttctcgcgacagggcgcttcccctgtcattcgcccagcagcgcttgtggttcctcgcgcagttggagcctgacagcaccgtctacaacgtcccggcgtcggtgcggttgtcgggcgccttgaacgttcccgcgctgaagcagagcttcgacgcactggtccatcgtcacgaggcgctgcgcaccacgttccggaccgagggcggttcgccggtacaggtcatcgacccacggggcggcgcgcggctcgacatcgtggacctgcgctcactgccagccgcgcagagggaagaggaggcgcagcggatcgcgcaagaggcgtcacagcgcccgttcgacctggaaagcggtccgctgctgcgactcgccttgctcgcgctgtcggagcaggaccatgtgttggtgctggtgatgcaccacatcgtctcggacggttggtccatggggctcctggttcgcgagctgaccgagttctatgcgtccttctcccagggacagccgtcgcacctgccggagctgccgcttcagtacgcggactacgcggtctggcagcgcgagtggctccagggggacgtcctggacgcgcagctcggctactggaagcaacgcctggacggcgcgccccggttgctggagctgcccacggacaggccgcgtccggcggtccagtccctggaaggggcgtacgtgcccttctcgttgggccgtgagctgtccgaggcggtgcatgcactcgcccgccgtgaaggcgtcacgccgttcatggtgctgctggcggcgttccaggccgtgctggcgcgttactcagggcaggacgacgtgagcgtcggttcgcccatcgccggacgcactcgcgcggagacggaggggctcatcggcttcttcgtgaacacgctggtgctcagaacccggctggaggggagcccgtccttccgtgagctgctggctcgggtccgggaggtcacgcttggcgcctacgcgcaccaggacgtgcctttcgaaaagctcgtcgaggcgctgcgtccggagcgcagcctcagtcattcgccgctgttccaggtcatgctcaccttcgacagcacgccagatgctggaggcgacgcacaggccggcatggggatgaagcacgtcgccgtggagcatcgggtgtcgcggttcgacctctcgctcggcttcgtggaaggcaaggacggcttctccggtggactggagtacagcaccgtcctcttcgagcccgagactgcagcacgacttctggcccacctgaagacgcttcttgaaggtgccgtgacggagccggaccggtccgtgttcgcgctgcccttgctggacgcggatgaacagcggcggttgctggtggagtggaatgacaccggctccggcgacgtcgcggagacgagcatccacgccttggtcgaacggcaggcggcggccactcccgacgccgtggcggtggtggctggtgaagaagtgctcacgtaccgcgagctcatgcagcggtcggaccggctggcgcggaagctccgcactctgggcgtcgggccggaggtccgcgtgggcctctgtgcggagcgcaattcggacctgctgatcgcggtgctcggcatcctcaaggcgggtggcgcgtacgtcccgttggacccggcatacccgagccagcggctggccttcatgatcgaggactcccagcctcgcgtcctggtgggccagcgcgcgctgctcgacgcgctacctcacggggacgtggcacggttggcgctcgacgatgcgaatgggctcgtggcggaagccgaggcggcgccggtgctcaggtccgctccggaccatctggcctacgtgctgttcacgtcgggcagcacgggccggccgaagggcgtggccctggcgcatcgcagcgctgtggccttcctgcgctggacgacgcgggccttctcgtcggacgaactggcgggggtcctcgcctccacgtcgctcaacttcgacctgtccgtgttcgagatgttcgcgccgctcatccgtggcgggtccgtggtcatcgctagtaatgccttggagttgccgtcgctcccgggggcacggcgggtgacgctcatcaacacggtgccctccgcgatggcggagttggtgcgtgcccaaaccgtgccggactcggtgcgcacggtgaacctggcgggagaaccgctggcccaatccctggtggaatccatccaccagtccgcacccggtgtgcagcgcgtgctcaacctctacggccccaccgaggacacgacgtactcgacctggaccgtggcccctcgcggcgccacgcgggagcccaccgtggggcggccgattgaggggactcgtgcgtacgtgctggatgcgctcggtcaacccgtgcctcagggcgtggcgggcgagctgtacctgggcggggctgggcttgcccgagggtatgtcgaccggcccgagttgaccgccgagcgcttcgttcccgacgcgttcagtccgcagcccggagcgcggctgtaccgcaccggagatagcgcgcggtggttgccggatggcgtgctgcagtacctgggccgaatcgaccagcaggtgaaggtgcgtggcttccgcatcgagctgggcgaaatcgaggcggtgttgcgaaggcatccatacgtgcgcgaggccgtggtggttgtgcgcgacgaccggagcgaaggtcggcggctggtggcgtacatcgtgccgcagtcggacagggtgcccgatgccacggcgctccggcgcttcgtgaaggaagggctgccggacttcatggtgccctcggtggtgatggtgctggcctcgctgccgctgacgcccaacggcaaggtggaccgcaaggcgctcccggcgccggacgcactccgtccggagtcgacgcgggcctatgtggcgcctcgggatgcgctggagctccagctcacgcgcatctgggaggagttgctgggcaccggccccattggcatccactccgatttcttcgagctgggagggcactcactcctggccatgcggatggtgtcgctcatccgcgagcgcctgggacgcagcctgcccgtggtttcactgttccaggcggggacgctggcggagctggcctctcggctccggcacgcacccggacacgtgtcctcgctggtgcccatccagagtggtggttcgcagcggcccgtcttctgcgtccaccctgtcagcggcaacgtcctgccgtatttggaactgtcgcggcgcctggggccggaccaaccgttctacgcgttccaggccccgggcctcgaaggcgagcgggctccgctggggaccgtggaggcgatggcctccacctatgtggaggccatgcgcggcgtccaggccagcgggccataccggctggcggggtggtccttgggaggtgtggtggccttcgaaatggcgcggcagttggagcagcagggggagcaggtggagcagctgacgctcatcgacgcctacgccttcgatcagcggccagtggaacccgtgggcgcggagtggattgccgcccggttcgtggagttcacgggtcagctcctgggcctgcccctctcggagttgatcgcggatgcgcatcccgcggacgaggcttcgctgctggaccgcctgttggagctggggcggcgcaccggcgttctggctcagggcgttggatccgaacaactccacgcgctgtaccgtgtttacgagagcaacctccgcgccctctgggattatcaacccggacgatacggtggccgcgtcactctgctgcgcgcgagcgagacgcgcgtacccacgggcacggatggcggctggggtgcgctggcggcaggaggggtggaggtgcacgaactctccggtgatcaccactccatcctcagggcaccagcggttgacgtgatcgcggagacgatggcgctgagctagacggagccgaac

SEQ ID NO: 5005 - DNA, 156 bp, Myxococcus xanthus
atggcgcgcagcatcaccgacgcgggcgccttcaagatattcatggacgagcccatggagttgggtggccgcaatggcgcccccagtccgctcgacttcatcctggccgcacacgcgggctgcctgaccttgaaggccgctacttcggaggcgtga

SEQ ID NO: 5006 - DNA, 1290 bp, Myxococcus xanthus
atgctccgaacagtcatcgcctcgaccgccgcgctcggactggccgccggctgtgcgcccgattcgaccgcgcccgtcaaggtcagtgccctggtgctctccagcaatggccagtacgtcccccaggaggtggagctgaagaccatctccgacatcgtcggcctcaagggcacggtggccgacctccagggaggcgcgcgcatcgtcatcgactcccaggacccggacctgaacaacgccaccacgccggagggctacgccaacgcgctgctcaagaacgccggccgtgacgtcagcgccaactacatctcccagggcggcgtcctctggccggcggacttccacacctggaacatggtgacggcgtactacagcatggagcgcgcctacgattacttccgcgtcgtgggcaacatccccgcggcggacttcaaggaccccgtcaccacgtactacttcccggagttcgtgctcgcggacgtggacaaggacccgctgagcgacaacgccatgtacttctccgtgctggagtcgttcctgatgctgcccttcgacaagctccagcgcgccccgctggccatcaacgccggcatcatcgcccacgaatacgcgcaccgcgtcttcaacctgaaggcctacaacggccagcagttcccggaggcgctctcgctgtggcagcaagccggcgccagcccgggcgccaacatcctcaagtccttcgacgaggggctggcggactaccacgcgtacggctccacctgccagacgacccagggcggcaagggctgtgacacgcgcttcttctccacgtccttccacggcaacctgtacgggcaagtcaccgaggaccgggacctggcccgcgtggaccgctgcatggacgcgtccctgctgaaccagttgtacaaccagaacctgagcgcgttcagcggcaacgagtaccgggtgggcacgctgctcgccagcgcgctctaccaggccggcgaggccaccggtcaacgcgacgtgctgctgcgcgccatcgtcgcctcgtacaacgacgagagcacgacgacgcccgggctctaccagttggcgcgcgccacgctggcggaccagtcccgcttcaccctggccgtggccgccagcgccatcatcacccacatcaccgacctgcgcctgaaggaggccgtctgcaacgagctgatggaccacctccagattccgcgcgagcagctcgtcggcaacgaccccaacatgtgcccgcccagcgccgcgggtggcaccacctgcccccgcctggacctgtga

SEQ ID NO: 5007 - DNA, 807 bp, Myxococcus xanthus
atgctgacgcaacccggccccgtggagctggagacggtcgtctcctgcgactgggccgtggagcgcggcggcctcatcaacctggaccaccccaccgcgaagcgcgcgggcctggaggacggggatgagccggtccaggtcttcttccacgccctccgccacccggagaaagggctcttcatcgtcgacaccggcgtggagacggcgctgcgagacgcgccggagaaggccgccatgcgcgggctcgtcgccagcgcgatgaacatggagaagatgacggtgcacgccccactgggggagtggctggcgaagcagcaacagccgctggcgggcgtgttcctcacgcacctgcatctggaccacatcaccggcatggcggacgtgcccgccgggacacccgtctacaccgggccgggtgaggcctccgaccgcgccttcgtgaacctcgtcgtccagggcaacagcgaccgggccctggccggcaagccgccgctgtcggagtggacctacgcgcgggaggacgccggcctgttcgacggcgcggtggacatcttcggggacggctccgtgtgggcgctctggctgcccggccacacgcccggcaccaccgcgtacctggtgcgctccacgaagggcccggtgctgctcgcgggggacgtcagccacacccgctggggctgggagcacgacgtggagcccggctcgttcaacaacgacgcggaccgggccacggtgagcttcaagaagctgcgcgcgttcgcccaggcacaccccgaggtcgaggtgcgcatgggccaccaacactga

SEQ ID NO: 5008 - DNA, 618 bp, Myxococcus xanthus
acggccgcccgtctcccccccacgggggcggccccccccgaaggcacgcgccgacgcatcctggagacggccctgcagctcttcgcgagccgcggctatcacgacacgtccattcgggacctggcgtcggccctggagctgcggcccagcgcgctgtacgcccacttcgcggccaaggaccacgtcctcgcggagctggtgcgcattggccacgaggcccacttcgaggcgctggagaccgcgttccagggcgcgaagcccacgccggcggaccaggtgcgcgcgctggttcatgcgcacacgcgcgtccacgcggagcatccgcagctcgcgctggtggtgaacgaggagttctacgcgctgagcctggagctggcggcgcccgcgcaagcgctgcgggacaaggccaacgccatgttgatagacgccatccaacgcggcatggcccaggggcagttctccccgctccatccccaaatcaccgccgcggcgattgtgggcatgggctctcgcatcccccactggttcgaacccggcggccccatcgcggtggagaccctggcgaagacccacgccgagctggcgctgcggatgctgggaagtgtctccggcgcgtga

SEQ ID NO: 5009 - DNA, 717 bp, Myxococcus xanthus
atgaccactccccgcacgctctggaagctcacgaccctctccctcatgttgtccgctcccgccttcgctgccgacgaggtcgaacaggcccaggaggaccgaggcttcgcgctgggactgcgcgcgggctacggcgtcccactggggcacgccgcgggctccgatctcggcgaaacccccaagatgagcgaggtgttcaagagcgccatccccttgcaggtggaggcgggatacttcttcaactcgaatgtctacctgggggcctactttcagtacgcgcccgtgctgatcgccgaggactgcgactcggacgtcagttgctccgccaaccagatgcgcttcggcatcaacgcgtcctaccacttccgggcgggagagaagctcatgccctggatgggcctgggcatcggctacgagatgctcaagttgaatgtgtcctcgagcgaggacggcgtggaggccaccattggcacgggcgtccgcggcatcgagttcgccgccctccaggccggcgccgactatcgcatcaacgacacgttctccatcgggccctacctgtcgctggcggccggcgtctaccagtcgtcgacctccagcattgagatgaagaacgtgcccatcattggtgatgtctccgagtcggagtcggagagcatcgacaacaagacggtccacgcctggctgtccggcggcgtgcggatgcagttccgcttctag

SEQ ID NO: 5010 - DNA, 1497 bp, Myxococcus xanthus
atgcggctgcactacgtggcgggcgaccgcatggccgcgctcaacgccttcgagcggtgccgccgcctgctgcgcgaggagttggacaccacgccgctgccgcagacggtggccctggcgcgcgaaatcgagcggggcccgcccgcccccaagcaggtgcccccacccacgagccggctgcccctctccgtgctccggccacccgtcctcgtgggccgcgagaccgagtgggcgcggatggaggccgcgtgggaggcggggcagaccatcttcatctccggcgagccgggcgtgggcaagacgcgcctggcccatgacttcgcggcgtcgcggggcaactacctgctgctggaggcgcggcccggcgaacagagcgtgccgtactcctcgcacgtgcggctggtgcggcagatgctggcccgggtgcctgatccaaacctgccgcgctgggttcggcgcgagctggcgcgcctgctgccggaccaggccgggcaggaaggcctgcccccgcccatggcggacgaggccgaccgcagccgcttcctggaagcgcagtgccagctcgtctaccagctcgcggccagcatggacgccatggtggccgacgacctccagttcatggacagcgccaccgcggagttcgcggtgctgatgctgtcgcgccgccacgcgcccgagcccggcggccgtttcccgcgcttcatcgacacctaccggacggatgagctgtcgccccaggccaccgtcttcgtccagcagttggtgaccgcggggctggccatcctggtggagttgcagcccctgggctccgcggcggtgggcgcgctgctccaaagcctggagcttcccggcgcggagaagctggtgcaggacgtgacgcggcacaccggcggcaacccgctcttcatcaccgagacactgaagtacctgctggagaccggcggcctggaacgcggctggcccgaacacgtccccgcctccggccggggccagcagctcatccagcagcggctggagcggctgtccccgtccgcgctgctggtggcccggctggcggcgctggcgaagacggacttcacactggagctggccagcgaggtgctggagatgaacccgctggcgctcgtcacgcatgtggcggagctggaaggcgcgcagattctgagaggcgagcgcttcaccaatgatttgctcttcgaggtggtgcgccagggcgttcccggcgcgctgggcacgctgctccaccgccggctcgccgtggccctggagcagcgcggcgccgcgcccgtcgtcgtggcccagcactggctggacggccacgagccacgccgcgcggcccccttcctcgtctccgccgccaacgcggaagccgccgccctgcgccacctggaggccgccctgctctatcaccgcgccgccgcgctgctggacgagacgggccacgccgacgaagcggcgctcgtgcggggccgcgtgcgcaacatcccgaccgcgtag

SEQ ID NO: 5011 - DNA, 1053 bp, Myxococcus xanthus
ctcatgattcccgttcgcggctatgccgcccaggacgccaagtcccccctcgccccgttccagttcgagcgccgcgagcccggccccagcgacgtgcagattgaaatcctctactgcggcgtctgccactccgacctgcaccaggtgcgcgacgaatggggcggctcccggttccccatggtcccaggccacgaaatcatcggccgcgtggtccgcgtgggggaccaggtgaagaaggtcaaggtcggggacatggccggcgtcggctgcatggtcgactcctgccgcacctgccccagttgccaggagggcctggagcagtactgcgagaagggcaacgtccagacgtacaacggcaaggagaaggacgggcagacagcgacccagggcggctacagcgaggccatcgtcgtggacgaggccttcacgctgaagattccggagaacctggacccggccgccgccgcgccgctgctgtgcgccggcatcaccacatactcgccgctgcggcactggaaggtgcagccgggtcagcgcgtgggcgtggtgggcctgggcggactgggccacatgggcgtgaagctggccaaggccatgggcgcccacgtcaccgtcttcagccacaccgacagcaagaagcaggacgccacgcgcctgggcgccgacgccgtcgtggtctcctcgaacaaggaggagatggccgcgcagacgggtgggttcgacttcatcctcgacaccgtctccgcgcagcacgacatcaacgcgtacctgcggctgctgcgacgggacgggcacctggtcctcgtcggcgccccggagaagcctctcgacgtccgccccttctccctcatccccacgcggcggagcttctcgggctcgatgattgggggtatccaggaaacgcaggaaatgctagacttctgcggcaagcacaacatcgtctccgacatcgagctgatttccatccagcaggtgaacgacgcctacgagcggctgctgaagggagacgtgaagtaccggttcgtcatcgacctcgcgagtctgcggaagtag

SEQ ID NO: 5012 - DNA, 294 bp, Myxococcus xanthus
atgactacgacgattgcgcaggccggtttcgtgcaggtgacgtccccgtaccccgaggaacaggagttgttggatccggcgctcgccgcccccacgccccagaaggcagcccagcttcgccagaaggcgagccattggctcagccgcgcacagaaggagctgcacgacgccatcttcgcgcgggacggctcggaggccggactggaccgttatgccagcgcccgcgcggagctcgactcggcggagacgtgggccctgcgcgtcgcggaagccttcgccattcgccgtgattga

SEQ ID NO: 5013 - DNA, 591 bp, Myxococcus xanthus
atggtgctggcaggtgcgcccccgtccgacacggaccgggagcggacgttgctgcgccgggcgcgcacgggtgaccccgcggccttccgctggctgtttgaacggcacgccgcgggggtgtggcgcttcttgaaggacttgctgcgcgatgaggccgcggcggacgaagccacgcaggagacgttcgtccgcgcccatgcgcggctgggcgcgcttcgcgacgaagaccggctgggggcgtggctgctgggcatcgcccggcacgtgtacctggagtcgctgcggcaccggggcgcccacgtggacatggacgatgaagtccatggcagccaggtggaggcgatgctgcccacgcccacgccggaggacctgctcctggaccgggaactggaaggattgctggcgggcgcgctggggacgctgcgcgaggaccggcgcgcggcgctgctgctgcgcatcgaccacggcctgccctacgaggagatttcagcggtgatgggctggtcgctccagaaggtgaagaacgaaatccaccgcgcacggctccaactgcgcgagcacctggccgcacacgttggaggccactcatga

SEQ ID NO: 5014 - DNA, 324 bp, Myxococcus xanthus
atgccggcgcggcccgccctggacttcgccgcgttggagtcccggctgcgaaagcccgtggtacccgacgccccgaaggtcaactggatgcactgggggaagatgctgaccgcggccctggcgtcggtggccttcgtgggcatcaccacgctccaggtgacgcgcctcccaagcgccgacgagccctggccccggaacgacgcgctcaccaccgccacccgggccgtcgactggtgtgacgacccttcacgggaagccgtggcggcgctggaagcccgcgtgggggcgtgcctggtggcctcccccttgataaccctgcgctga

SEQ ID NO: 5015 - DNA, 105 bp, Myxococcus xanthus
atggcggcggtgctcggaggcctgggcatgtggcgcgcggagcgggcggctcagccggtgctcgtggaggtgccctttccggagttcgcgcagctccccgcccgc

SEQ ID NO: 5016 - DNA, 69 bp, Myxococcus xanthus
atgcaggtggtgacgttcgagaacggccgcctcatcgacgtgcagagcgcgggctacggcagcgagtag

SEQ ID NO: 5017 - DNA, 774 bp, Myxococcus xanthus
atgaggactgcttccgtgaagacgtggctcttgcgttgcgccctgggcagcctcgccctgtccgcccccgccctggcccaggacgaggacgacccctacgcctacccggacgaggagcccgccaacgacgcctccgacgcctatgaccgtgtccgccccaaggtcgacgaggcggacgacttccgccgcgtctccgagcaggagtacgacgacggcgaggacggcttcaagcccctctccgggctcgacgacccgaacctgggcgtggccgtggagttcatcaccggcgccctcttcctggacagcccgcgcggccgggccgcggagacgcgcctgggcctgggcgtgcgcgccacgtgggagtacggccgcatcctcgacaacgagtcgcttcgcgaggccctctgggccgacgtgcgctggacgttcggcggcaccagcgacggcaccgacttcatccggggcaagacgcacttccactacttcaccattgccccggcctatgagctgaagctcggcaagtccgacttcggcttcttcgcccaggcaggtggcggcatcgcgtacacgtcgtcgaccatcaccatcgacacggtggagacgaaggtgagcggcagcaagccgctgcttcagtacggcgtgggcttccgcggccggccccggctgacctcctccggtaacttccgcctcgccttccggctggaggccatgggctaccgccggggctaccacaacgacttcttcctgggcggcagcctcggcaccgccttctga

SEQ ID NO: 5018 - DNA, 1093 bp, Myxococcus xanthus
atgagcagcgacgtggcggaaacgaaagacggagtggttcttctcgactatgcgcagctcgtggcgggcgcggacctgagcgccgccatcgagcgcgcctacgggcatgacggcattggcctgctcgtcgttcggggcatccccgggctggccgagctgcgcgacaacctgctgcccctgggcttccgcttcgccgcgctgcccaccgaggtgaaggaccgctacgtccacgcgcgcagcagctactcgttcggctggagccacgggaaggagctgctgcgccccggccagttcgacgagttcaagggctcgtactacaacaacccgcagtacgacgtgccgcacaccgacgcggagctcatcgagaagcacccggagaactaccaccccaacgtgtggccggacgcggacttcccggagctgcggcccgccttcatggcgctgggccagcggatggtggacgtgggcgtgctggtcgccgggcagtgcgacaagtacgtgcaggccaaactgggcagccgcctggcaccggacgcggcgctggcgaagacgattcgtgattcgcgcacgtgcaaggcgcggctgctctactacttcgccatcaacgaggacgcgacgccgcgcacgcgcgactcgtggtgcggctggcacagcgaccacggctcgctcacggcgctgtgcccggccatgtacttcgaggccgagccgggcgcggcggagccggcgcgcaaggacatcccggtgccggacccggaggcgggcctgtacgtgcgcacgcggtccggcgaggagcgcaaggtcgtcatcccgaaaggacagcctggccttccagattggcgaaagctcccagattgtcaccggcgggctgctgcggtccacgccgcacgcggtgcaggcgctggcccatccggccagccgcaacatctcccgcgccaccttcgcggtgttcatgcagccggacaatgacatgcacctgcgtccgccggagggcgtggaccccgccgagcagaaggtgggcgccttccagcctggaatgactttcggcgatttcgccaaggcgacgttcgcgaagttctacaacccctacgcgtag

SEQ ID NO: 5019 - DNA, 1235 bp, Myxococcus xanthus
atggacatgcggcacctccgaatcctcctgctgtcggcgctggggcttctcgcctcggcctgtccgagccccacccgcgcccccgtcaccaggcccgaggacgcgctcatccgcctgtctcgcaagatggagccccgggacgacggtgacgtcgcgtccctgcggaccgccgtcgccgagagcctcgtgtggctgcggagccgtccgtccgaccaacgcttcatctacggcgcgcggcaggtctccatcgccgagctgcggaccgccctggagcgcctgcacgcgcggcttcgcgaggacctcacgccggaggcgctgtgggccctggttctggaggacttcgagccgctggaggccgccggaggcgaggacggccaggtgctcttcaccggctactacgagccgaccatcgaggcgagcctgacgcgcacggacgtgtacaacgtgcccatccacgggcctccgtccgacttgattgaggtcccgctggaatccttcgcggagcgcttcaagtcagagcgcgtcttcggccggctcgacgggcggaaggtggtgccgtactggtcgcgcggggacatccgtggggggcggctcagcggacggaagctggagctggcgtgggccaaggacccggtggcgctcttcttcctggaggtgcagggcagcggttcgttgctcctgccggatgggagccggcgccgcatcggctacgccgcgtcgaatgggaagccgtaccgcagcatcggctcgctgctcatccaggagggcgccatccccaaggaggagatgtcgatgcaggcgctgcgcgcgtggctggccgcgaatcagcagcaaagccaccgggtggtggaccagaacgagtcctacgtgctcttccgcttcctcacaccgcgtcggtggggtcgctcgggcggccggtgacggcggggcgctccatcgcgacggacgcgcggctgtttcccaagggcggcctggccttcatccacaccgagcgcccggtgcgcatggcggacggctccgtgcagtggaagccgctgtcgcgcttcgtgctcaaccaggacacgggcggggccatccggggcgcgggtcgggtggacgtcttctggggcgcgggcccgcaggcggagctggcggcggggatgatgaagcagaaggggcggctgctcttcctcgtcccccggcccggccgcgccgcgcccctggtggcgccggtgtccgtcacgcctccgaagtag

SEQ ID NO: 5020 - DNA, 3573 bp, Myxococcus xanthus
atgcacgagcctcgcctctccgagttgcgcgacgagctgtccggtatccaccacgatgcccgcgtccgcaggatggtggagctggggcgcctggcgccgacgaaccctggcgtccgcgagttgcttggggtgctgtctcaaggggatgccttcgagcggtacctcgccctgtgtgcccagttcacctggcgcgatggggggcaggtgctctccgccaccaccgatgcgtccgctcgtgttcgttctctggccttccgactggtgcccctggcctgtgacgacgcccaggcgctggagaccctgaagatggcgtgcgccgttcgccgccaggagggactcctctgggggttcatgaagacgcggcggcaggccgtcatcgatgcgtatctcgactggctggccacctgcacgggcgtgcctgacttcgctgatgccgtccccttggcgacgtccgagggcattcgccgtcacctccccagcgcactggcgcgccccagtgtgcgcttctggagtcggatggcgcacaacgcccccggcatcctcgcggaggtcttcgccgcacgtttgagggccgtgacgggcgaacccgatccggtgacgcgcatgtacctcaacgcgtacctgcatcgcatcgctgaccaggcccccgacgcggccttggagttgttcgagctgctgctctcccgccgcatccatcccgatgcctatgactggcattgcctggtgctccatcggcccgaggccgccgtgtcgctgctccagcggcacgagcacgcgttccccttcgaggggcagtttgcccgcgccgccgcgcggttgagcatggactcgctcgtgtggctcgttcgtcatgctcccagctcactgggggatgcgaagacgctgctcccccggctctccgagaccgcgcgccgcgtcgtcgtcgaggcgtggtgcgccacggtggatgtggcgccggtctgggggacggagctgctccgctccatttccgatgtccgcgaacgggagcgcgtccatgcccgctggagcgtcgccgcgaggaacagcgatggcgtcatcgcactggagacggtgaccgcgctgcccatcgatttgcgtgagcgcgaggcgcgccggcatctccacgaggtggtggccctgggctcccggcccgagcaacgcatgaggtacgcatgcctgctgccgtgggatgaagcggaggcggcgctcaagggatacatcggtcacccggatgccagcgtgcgaggcatggcgttggcgtcgctgttggccatccccgggctgcgtccggacgagcccgccttggtggaccgtgccctgccgctggcgttggcgcgcaagaacgagcaggaccccgtgcggatgctgatgctgggcgcgttcgtgcggtggcctcgccgcgtgtggcgccgcgagcacaccgaggcggtgggccggatgttgcgcgacgcgctggacgcggccgacctgtcctatcagacggcggagttcgcggagacgttgctgctgcgcaccttcgccagggcccccgaatggggggcgacgtggctggccaccctcctcaaggagcgtggtcggctcttcaacgctcgcgtgggcgagtacctcaccgatgacgaggtgcgcgccgccgcgccccagctcctggacattgcccggggatgggctcagcgcgagcggggcgggccgctgctcgagttggtgaacagcctgggcgctcgtgtgagtctggtcgcgggactgcaggaactcattgtgtccatgcgggaggagacgccctggcccttgctggcgctggggatggcccagtggcagtccaagcacgaccgcgcgggcttcgaagccaccgtgggcgccacggtccggcggttcctcgacctggggtggttctccgaagtcatcgcgttggcccactcggaggatgcggcgcgaccgctgcatcccgagctgagctccggactgaagcgggtcgcgcttcgcctgggaaaggaggcgcactccgccctggtggtgctccggcgacaggcgtgggccgccttcgacggcttcctgcccgagctgctcaaggccgatgccagcgtcatctgcttcccggtcgtgaacacgtacctgcatcggcgcaggcaggagctgctgacgccctacctgagcgcgcccgtcatcaccggtcgtttctcgacggagaagacgggttggttgctggcgttcgatgaccgcggtttcttccggtggaccgcgcggcagagcgccctctactcgcacgcggtctgccggctggtcgaggacccggagcgagacacgccgacgttgctctggggtgtctcgacactcgcggcgttgacctgggggacgatggagggactatgcacccgggtggacgacgcgcggcccgtggtgcgggagagggccatccgggtgctgggccggtgcgaccaggggcaaggcgtgaccacgctgctgcgctgcctggaggatgcccgtgcgcgcatcgccatctatggcctgcgccgtgccttcaacggcatgcctcccgcgcgcgtgctgtccctgctggcgggcgtccccctcaccaaagtcaccgtggccaaggaggtcgtgcgcctgctgggggagctgcgcgtggaggccgcctacgagcggctcctggagttgggcggaatgagcctgcatcgggacgtgcgcatcgccctgctgcgcgcgctctgggaccacctggagcgcgagcccacctgggccgtcttcgcccgcgctgcggaggaccctgattgggtggtggcttcacggctgggagacatccccgcgaaccgcctcaccgagacctccgaccgcaagctgtccgcgctgctcgggcgggtgctggctcgccccgagccggaggcgcgcattggcctgctttcgcgcgcggcgtatctccccgtcagggatgtggagcgcgccttccttgatgcctgtggggctcggctgacgtcgccatacgatgaagaggtgagctgggcgatgagggccctgctccatcgctccaacgaacgcgacctggagcggctggagggcatgttggaggcggtggctttggaccgacgcgcactgaacaccgcggtgacgcagttgctggcggtggaggtgaagtcccgcgccagctacatgcaggcggcgcgcgcggcagagcgggtcctctcccgggacagtcgtctggcgccgctgtacatccaatgtgtgatggcggcacggtcaccgctggagttggctgaaacgctggtccagatgggggaggcaggcctcctccatgcggatgccctggaggcgtgccgtctcgtcgtgagcatgttgcccaagggtgagctggaggcgatggaggcccggttgagcgcgagcgcgagcgcggaggctcggcgcgtggctgtctggtgcctggtgcacgacgcggcgccggggcgcggatggacgcccgagcggctgggccggctggcgcggctccagcaggacgcctcgccgttggtctctggcgccgcacaggccatcttcccgccacgggagcaggccttttcgctcaaggtaccttccaagtccaagtag

SEQ ID NO: 5021 - DNA, 822 bp, Myxococcus xanthus
atgtccaatctccagggaaagacgctgttcatcaccggtgccagccgtggcatcggcaaggccattgccctccgcgctgcccgggatggcgccaacatcatcatcgccgccaagacgacggagccgcaccccaagctccccggcaccatctacacggcggcggaggaaatcgagaaggccggtggcaaggcgctgccctgtgtcgtggacatccgcgacgagcagcagattgccgccgccgtggccaaggcggtggagaccttcggcggcatcgacatcctggtgaacaacgccagcgccatcagcctcacgggcacgctcgagacgccaatgaagcgcttcgacctgatgcacggcatcaacacgcgcggcacgtttgcgtgttcgcaggcgtgtatcccgtacctgaagaaggccagcaatccgcacatcctcaacaactcgccgccgctcaacatggaggcgcgctggttcgcgccccacgtcgcgtacaccatggcgaagttcggcatgagcatgtgcgtgctgggcatggcggaggagctgcgctcggacggcatcgcggtgaacgccatctggccgcgcaccgtcatcgccaccgcggcggtgcagaacctgctgggcggggaggagaccatccgcggctgccggacgccggaaatcatggcggacgcggcctacgccatcctcaccaagccgagccgcgagttcactggcaacttctgcatcgacgaggaggtcctccgcggcgtgggcgtgacggacttcgacaagtaccagctggtgcccggggcggagctgctcccggactacttcatctga

SEQ ID NO: 5022 - DNA, 1641 bp, Myxococcus xanthus
acgcacgaagtcacgaaccagcctccgccgctcgagtacgacgcgtggacgacggacaccgtgctccgcgaggtggtggcccgggagggcggcggctgggcggaggccgacctggcgaagtacggccccgtggtgggcggggagatgcagcagttggcgttcctcgccaacgagaacaagcccaagtttcggcccttcgaccgctatggcaaccgccgcgacgaggtggagtttcatcccgcgtaccaccggctgatggagctgggcatggcccacggcgtgtcgggtttcgcctggcgcaacgaggacaagcccggcgcccacgtggcgcgcatggccctcttctatctgcacaaccaggcggacaacgggacgagctgcccgctcacgatgacgtacgcgtcggtgcccgcgctgcgccaccagccggaggtggcgatggagtggctgccgcgcgtgagctcggcgtcctacgacagccgcttcatccccgccgcgcagaagtcaggcgccaccattggcatgggcatgacggagaagcagggtggctccgacgtgcgcaccaacaccaccaaggcgcaccgcttgggtgaaggccgcgggcccggtcagccctacgcgctggtgggccacaagtggttcttctccgcgcccatgagcgacgccttcctggtgctggcgcacgcggaggggggcctgtcgtgcttcctgatgccgcgcttcacgccggacggcgcgctcaatgccatccgcgtccagcggctgaaggacaagctgggcgactggagcaacgccagctcggaggcggagctgcacggtgcctacgcggtgatggtgggcgcggagggccgcggtgtccccaccatcctggagatggtcgcgctgacgcggcaggactgcatgattggctccagcgggcagatgcgtcaggcgctggtgcaggccatccaccacacgcgccaccgcgtggcgtttggcaagcggctcatcgaccagccgctgatgcgcaacgtgctggcggacctggcgctggaactggaggcccatgtcgcgctcaccgggcgcgtctcccgcgcggtggacgccacgcctcgggacgagaaggaggccgcgttctgccgcatcgccacggcggtggggaagtactgggtgtgcaagcgcacgccgtccttcgtcaacgaggcgcaggagtgcctgggcggcgcgggctacgtggaggagacgaacctgccgcgcctgtaccggcaggccccgctcaactccatctgggagggcagcggcaacatccagtgcctggacgtgctgcgcgcggcgtcgcgcgagccggccagccgggaggccctcttcgctgagctcctggccgcgcagggcgggcaccccgcctacgacgaggccaccgcgcggctgggcaaggagttggccaacacggactcgctggaggtgcgctcgcgcaccatcgtggaagggctggcgctggcgctccaggcgtcgctgctgattcgcgcgggcaacaccgccgtgtcggatgccttctgcgagtcccgcctgggcggagcgcatggacagacgtttggcacgctaccggcccacgctcccatgcagatgctcatcgagcgcgccttctccgagggcgcgaagtga

SEQ ID NO: 5023 - DNA, 885 bp, Myxococcus xanthus
atggatatctcctgggatgacgcgcggctgttcctcgccatcgcggagacgggcagcttcagcggggcggcgcggcagctccgcatcggtcagcccacggtgagccggcggctggcggcgctggagtacgcggtgggcgcctccttgttccgccggggcgtggacggcgcggtgctgacggccgcaggcgagcggctggtgctaccggccaagaagatggcggagtgggccggagagctgcaccgcgcggcggagtcgtcggacacgtcgcctcgcggcctggtgcgggtgacggcggcgccgtacatgtgcttcgacttcctcgcgcccttctcgggcgcggtggcgaagaagcacccggggctgcgcttggaggtgctctccgggattcagtacctggacctggggcgcggcgaggcggacctcgcgctgcgggcccggtgcccgccgaacgcggacttgaagcgcgtgtatggggtgcagattcgcaacgctgtcttcgtggcgaagtcgctcaaggcgaagctgcccaagcggcccacgctccagcagattccgtgggtggcctgggcgccgccgttcgatgcgacgccgcccaatccccagttggagtccatcatccccggcttctcgcccgtgttcaccgccgacaactacctggtgatgctggccgccgccgaagcgggcgtgggggccatggtgctgggcgacctgcggcaccgcttcgtgcgggagcggagcctcgtgccgctcgacctggacctggggccctatgccaccagcgagctgcacctggtctgcgcgaagtccgcgctcgacataccgcgtgtgcggaaggtttcggagctgctggtcgaggagctggagcaggcgaagaagcggtga

SEQ ID NO: 5024 - DNA, 852 bp, Myxococcus xanthus
gtgcccacgggttaccaggcggacacgccgctgcccctggtggtggcgctgcacggctgctttcagaacccgagccagttcgccggcctctcgcgcctcaacgagaaggcggacgccgagaagttcctggtgctgtacccgaaccaggcgacgttcgcgaaccccacgcagtgctggaacttcatgctggtgctcaaccagacgcgaggccacggtgagcccgcgctcgttgtgggcatggtggagcaggtgaagcggcactacgcggtggatgcgcgccgcatctacgtgggcggcgtcagctccggcgcggtgctcacggggacgctgctggcctgctactcggacgtgttcgccgcggggatgattggcgcgggcgccatgtacaaggcggccaccacgatttcgggcacgggcttcgcgatgctcttcggcagcatctaccacccggatgaccggggccgggacgcgtgggtgtgctcgggccgtccgcgtcacacggtgccggtgctcgtcgtgcacgggacgaaggacagcgtcgtcgacatcgtcaacggccggcaggcgacgcggcagttcctccagaccagcgactacggcgatgacggcgtggccaacgacagcatccgtccggtggccacgcaggtgacgcgcgcgacggtgcccggcgggcgcgcgtacacggtggaggactacgtctacggcggctcgctggtggcgcggcacatcgaaatccaggggatggaccacgcctggcccggcggggattcgcgctatcccttcgccgacccgtccgggccggacggcacctccatcatgtgggacttcttccggcagcacacccggaactga

SEQ ID NO: 5025 - DNA, 816 bp, Myxococcus xanthus
atgccgttgctccagctcgaggagctctccctctacttcgaggaatcgggtgagggcacccccgtgctgtttcttcacgggcttggctcctctggccgggactgggagtccgtggcacccagactgacgggccgccatcgcgtcatcgttccagatgcgcgggggcatggccgcagcggaaagccgccgggcgcctatggcgtgccgcgcttcgcccgggacatcgccgggctgtgtgacgcgttggggctcaccggcgtccacgtggtgggcctgtccatgggcgggatgatggggttccagctcgcggtggaccggccggagctggtgcgcagcctggtcatcgtcaacagcgggccggagctggtggcgcgcacgctgcgccgcaagttcgagttcggcctgcgcctgacgctgctgaagctgctggggccctcggtgctggcgaaggtcctggcgcccaagctcttccccaagcccgagcaggaagcacttcgtcagcgcgcgctggagatattcagcgccaacgacccggacgcgtacctgcgcgcgacgaaggggttggtggggtggagcgtcatgcggcacctgggcggcatcacctgcccggtgctggtgctcgcgtccgacagggactacacgcccgtgtccacgaagcaggcctatgtggacctgctgccgaacgcgcggctccaggtgttgagtgattccggccatgcgtcaccgcatgaccagcccgacaaggtcgccgacgcagtggaggccttcctggccggagtcgaggacgccgcggcggatgcgcggcagccgggctga

SEQ ID NO: 5026 - DNA, 603 bp, Myxococcus xanthus
atgcatccaagaggcacccgggccgccacgctggccctggcattcgccacgctgggcaccgcgggttcggcggccgcgcaggagcggcgcgacggaaagcgcggtgacctgaatgtgttcctccgcggcggcgtgggcgactacaccggaggcctgggcgacctgacgagcacgggcccggcctggggtgtgacgctcaacatccagcccaccaccttcctcggcttcgaagtgggctacgaaggctcacgcaacggcctcaccgacagccgcttgctggagcagccctcgctcgtccggcagggcggtagcgcgctggtgaaggtgtcaccgcccttcctcaccaccgtccggcccttcgtcggcgcgggcctgggcgtctcccatatgaacgtccgcggcccggtggaggacctctaccagtcggacacgatgccggaggtccccctggcagcgggcgtggagttcaaccgcggcgcgctcacggcgggcatccggaccacgtaccgcgtcctcctcagcgaaggctgggcggacagggccgtggaggacacccacggcggcctgctggacgcctcgctcacgctgggcgcgcgcttctga

SEQ ID NO: 5027 - DNA, 903 bp, Myxococcus xanthus
atggcctcgctccaggagctggcgtgtgacgaagcgctggtggccactggccgggcccaggcgcaggcctatgcgcggtgcctgctccaggcggccttgtcggtgcggctcgagtccccccttcccgccggtgtcaccggcatgtcccatcccaccacccggagaatccagatgctcttccagccccgtcccgcccgtgcccagggtgtttccgcgctcctggccgcgctgtgtctcgtcctggttccgctcgccgcgttgtcgcaaggcgtggcgcagggccgcgcggtgacgctcgcggaggcgcaggcgctcgcgacatccagccagcgggagggggacttgccggtggtggtggacgcgcacgtgctggcgcggctcaacgcgctcaccggttcggagaagggccgcgcgttcatgaagcgcgcgctggcgaacctggtgacgcagcgggaggcgctctccgcaccgctacgtgacaaggggctgcccgagggactgctggccgtggccgtcgtcgaatccgcggcgacgaacatgccggagacggatggccggccctcgctggcgccgggcatgcgtggcgcgggcgtgtggatgttcatcccggagacggcgcggcgctacgggctggaggtgagtgaggcgcgcgacgagcggctggacgtggcgcgcgagtcccaggccgccgccgcgctgctgtcggacctgcacgcgcgttacggcgactggcggctggcgctcgccgcgtacaaccagggcaccaagagggtggatgccgcgctcaccgcggggggcagccgtgacgtgacggcgctcatcggcgccgggcacctcaacgactacgccgccaccgtgcaggcggggttgctcatcctgcgcaacccgcacctgctggactga

SEQ ID NO: 5028 - DNA, 339 bp, Myxococcus xanthus
atgcacatcgtctggcgcctcggtgaggtgagtgtggcggacgtgctcgccgcgctgccgccggagcgcgcgctggcgtacacgtccgtctccacggtgctgcgcatcctggagcagaagggcgtggtgcacagccgcaagcagggccgtggccacctgtactcggcggtgttgccgcgcgacgcctatgaggcgcagagcgtgcgccacctggtggagacggtgttcgacggcgcgccctccgcgctggtggcgcggctggtggaggcggtgcccctgtccgcctcggacgtggaccagctccgcaagctgctcgacgcgaaggggcgcaagccgtga

SEQ ID NO: 5029 - DNA, 1581 bp, Myxococcus xanthus
atgggttgtgacagtcagcagacggacacgcaggtggacgtcatcatcagcggatgtggtccggtgggcgcgttgacgggcaacctgctgggtctcatgggtgtacgcaccttgctgctggagcgggacgtggcgccgcacggcgagccccgggccttttcgtgcgacgacgaaggcctgcgcatctaccagtccaccggactgttggatttattgcaaagcgacatgcgggaaagccgtttcgcggagtacgtgggcggcacgggcaagcgcttcgcggagattcacaccggcgagacggacttcggcttcggccacacgccgctgtggttcttccaccagccgctgctggagggcgcgctgcgcgacgggctcaaccgcttcgagcacgtggagttgcgcaagggcgtgagcgtggaggccgtggtgcaggactccgacggggtgacggttcgctaccacgactcgttcacgggcgagcagcgctccatccgcgcgaagtacctgctggcgtgtgacggcgcgcgcagcaccgtgcgcaaggcgctgggcatcccgatgtcgggacgggcctatggcgagccctggctggcggtgtccggcaccgtggtggaaggggaggtgccggaaatctgccgcttcgtgtgcgacccgaagcgtccggccttcgtggccaccggcgcggtgaaccagattcgctgggagttcatgatgatgcccggcgagacgcgcgagcacctggagaagtcggagaccatctccgagctcatcgcgccgtacgtggaccccaagcgcgtgcgcatcgagcgtgcctcggtctacacgttccactgcctcaacgcggcgcgttggcgccacggcaacgtcttcctgctgggcgacgcggcgcacaccatgccgcccttcatgggccagggcctggtgtcggggatgcgggatgcgtccaacctggcgtggaagctgaagcgcgtgctgcacgggcagtcctccgcgtcgctgctggatacctatgagcaggagcgccggccgcacgtggaggcggtgcagaagctgtgtgtgcgggtggggcacctgttcctggcgcgcaaccccctggtggcctcggcgcgtgacgcgctgctgcgcacccttcagcgcatcccgcgggtgcgcaagttcatcgagggcttcgagttcaaggaggccccggcgcacgcgagcggctactacttcggcgacaagggcgagtacttcatccagccgcgcgtgaagctgccgtcgggtgaggaggtcctgctggacgacaccctgggcaatgaattcacggtgctgtgccggggcaacgcgccgtcggcggagctggaggcggcgcgcgagctggctgagtcgctggggggccgcatgatgacgttccatcctccggcggaggcggtggacgatgcctccgaggatgcacccgcggtggtggacgtcaccggaaagctggcggactggttctccaagcacgccgcggacgtggtggtgctgcggccggaccggttcgtctacggcgcggtgcggtcgcggcgcctgccggagctgcgggaggcgctcggtgtgtag

SEQ ID NO: 5030 - DNA, 906 bp, Myxococcus xanthus
atggccttcacgccgctcaatgccctgaatgccttcctggtggtggggcgcaagcgcagcttcgccgcggccgcctcggagctgggtgtgtccgcgtccgcgctgagccagtccgtccgccagttggagacgcggctgggcgtggtgttgctcacccgcaccacgcgaagcgtgtctctcacggacgcgggccgccgcctgctggagtccgcggggccgcctgtggagcaggcgctcgatgccctgaagactgccactgcccggccgggcgaggtgtctggttcggtgcgtctcaccgtgcccaccgtcgccgtcacgcccgtggtgacgcccatcctgacgcgcttcctccggctccacccgcgcgtggaggtggacttgcgcgtggaggaccggctcgtggatgtggtggcggaggggctggatgccggcatccgcatgtcggaggcgctggagcgcgacatggtgcaggtgcgcctgtcgagcagcttccgcttcgtcgtggtgggtgcgcccgcctacctcgaccggcggggtacgcccgagcggcccacggatttgctgacgcatgactgtctctgcatccgctccgagacgacgggctccatctaccagtgggagctggagcgtgggcagcgcagctggcgcgtgccggtgcgcgggccgttcgtcagcgcgcattggaaggcgcacgtggagctggcggaagccggcctggggctcgcctacgtgttcgagccgtccgtggcggcggagctggcgcgcggcaccttgcgtctggtgttggagccctacgcggcgcgtgtggagggtttctttctctacttccccagccgcgcgcaggtgtcgcccgccttccgcgccttcctggacgtggcgcgcgaggtgacggcggcgcctcgctga

SEQ ID NO: 5031 - DNA, 1215 bp, Myxococcus xanthus
cgtgtggatgcacccacggcgcacgctccgcgcctgcagggtcacctgcccgtgctggacggtgtgcggggcctcgccgtcctgctggtggtgttcttccacacgacccacctgagcgaccagagcgtggcgggacgcgtgacgtggtggctggctggcgccggatggacgggcgtggacctgttcttcgtcctctccggcttcctcatcaccggtatcctctgggaggcgaaggggcagccgtacttcttccgcaacttctacatgcgccgcttcctgcgcatcttcccgctctactacctggcgttggcggtgtcgttcctggtgctgccatcgctggcgggccgactgggcctggacgagcgcatcaccaccgacggcgccgtctggtacctgctgtacttctccaacttctaccagctgtgggtggacaccacgcaccccatcctcggcgtggtgtggtcgctggccatcgaagagcagttctacatcgtctggcccttcctcatcgccgcggtgtcgtaccggggcgccatccggttgtgcctgggcaccatcgccatggccatcctggtgcgcgtggggctcacgctgtacggggccagcatcgagagcacctacgtggtgacgttctgccgcgtggactcgctggcgatgggcggcctgctcgcgatggcgctgcgccacccggaagggctgggcctgaaggcgttcccgtggatgcgctgggcggtctgggcctcggtgccggtggtgctcgcgctggtggtgctgccggtgggccccacgttcgagctggtgaagcgcacgggcggctacaccgccatcgccgtgctctacgccgtgtgcgtgtacaaggcggtggccgtctccaagggccacgtcctgtaccgcttcctcacgatgcggctgctcctcaccttcggcaagtacagctacgccatctacctcatccactcgccgctggacgccatcctgcgccgcacggtgctgaagacgccgctgaagacggtggcgggctcggacatgcccatgcagttggtgttctacgtggtggccgcggggctctcgctggggctcgcgctggtgagctggaacctcttcgagaagcacatgctgaagctcaaggactacttcccctacggccagcgccccgctccggtgccggagggcgcccaggccgaacggaccgaggcttccgcccgggtggcgtga

SEQ ID NO: 5032 - DNA, 1549 bp, Myxococcus xanthus
gtcgtccagaccctgaacatgatgtccctcagggtgtctcccgaggcgcgcgcggcgctcgccaggaattcggacgaggtgtctgtgtcgcccaaccgtccggtgtacgcgctcggcatgtcgcggccaccgctgcccgcgcaggcgtggctgggcgcggagccgcggccgccccccaacaccgtgggctccgtgggggagtacaccgacggcctgaagatggtgcgcgccaacaaggtctgggatttcaacgacgacggtgtcctcgacgagggccggccttcgggcacgggcatcaaggtgtgcgtcatcgacagtggctgggacaaccgccacccggagctgcaggccgccttcatcggaggcaaggacttcatcagcgggtccgccaactcgctggcgctggacgcgaaggtggactcgaagggcaacgtgctgctgtggggcggcggacacggcacgcacaccgcggccaccatcgccgcgcagctgggcgggggtggccgggtgcggctgggcgaggaccccaacggaacggtgggcgtggcccccaccgcgtcgctgctgatcgcccgcgtgctgaacgagcgcggcacgggcgacaccctgaatgtcatcgccgcgctccagtggtgccaggagcagggggcgaacatcgtgtcgctgtcgctgggcgccgtgtcgaagaacgaggccgaggagctggccttcagccaggccaaggcgaatggcgtgctggccatcgcggcgacgggcaactccggcgcgggcgaggtgtccttcccggccgggtacgactccgtggtgggcgtgggcgcggtgaccttctcgggggagtgggctagcttctcccagtacggccagggcatcaacctggtggcccccggcgtgggcgtgttgagcgccaccatcatcggcggggcgccgtatggagaggtggccgcgagcggccagcagttcgcgtccaaccccctgtagttctcggccgtgggcgcctattcggggcggatggtgaactgcggcctgagcagcagcatctccgactgtgagagagaggccgccacctgtagatggcttcgtcgcctatgttgaccgcggcggcggcatcctcttcgaggagaaggtgcgcaacgccgtccgcgccggagcgaaggccgtcatcatcggcaaccacaccgccgaggagggcacgggcaacttcacgctcaacgggccgtccaagctgtgggtgcccactgtctccgtgtccttggagtcggccaacgtgctccgcgagctcatggggcaggacgtgacgttggacgtcaccggtctggactacacgctgcagacgggcacctccatggcgacgccgcacgtggccggggtggcggccctggtgtggagcgtgagtccccagcagctcgatgcggagaaggtccgcaatgccctgctcgagacggcccgggatttggggccggctgggccggatctgaactacggcaagggcctggtggatgcggtggaggccgtcgagcacgcagagcgccagctggccccggcgccgtag

SEQ ID NO: 5033 - DNA, 1197 bp, Myxococcus xanthus
atggacttcgcacgggagctccgcaacaagaaccccgaaatcaccgccgaggaggtccgcttcgccatccaagacaagctgcgattggagcgggacggactggacgcccattcgccggcgaacactgacaggttcatctccgaggccatcgcgtgggtcaaccagtgctacgacgaaaaggcgccccctcccacggaggcggacatgcagcactggcgcgccttcgccgccgacctgatgagcaagaatccaaagacgaccccggaggagctcaagtacgccatcatcgacgccgtccgggcgaaggtgacgggaacggacgcggtgacgccggagaacatcgacaagttcatccaggacgccgtcaagtgggtcacccagtgctacgaggacaaggagcgcgaggccacgcccgcggagctgaaggagtggcgcgccttcgcccaggagcagttgaagaaggacccggaaatctcgccggagcacctcaagtacgccatcaccgacgccattcgcgcgaagatgacggggaccggtgaggcgacgccgctgaacatcgacaggttcatcgaggacggcgtcaagtgggtcacccagtgctacgagggccaggagcgcaagcccaccgccggggaactggcgcactggcgcgacttcgcccggaagcaccagaaggcgaacccggacatcacgccggaggcgctcaagttcgccatccaggacgccatccgcgtgaaggcgacgggcatggacggcacgggcagcaccaacatcgaccagttcatccaggacgccgtcaagtgggtgtccttctgctacgaggggcaggagcgcgacgccacgcccgaggagatgcagcgctggcgcgccttcgccaacgagaagaagaaggagaacaaggacatctccccggaggagctcaagttcgccatccaggacgcgatgcgcgacgagaagatggggacggacgctcccgccagcaatcgcatcgaagaccacatccgggcggcctacggctggctcatctacctcaaccaggccgggccctcgcagccgtcgagcgagccgacgcccaacgagctgcacgaatggaagaagttcgccgaaaagaagttgaaggagacgcctgagatgacgagcgaggagctccggtactacatcctggacagcctccgcaccgccatggccaacagttga

SEQ ID NO: 5034 - DNA, 456 bp, Myxococcus xanthus
atggcggcggtgaagttcggcctgcccaccgacgaagacatgacggcggtggcggacctgcgcgccggctctgagccctggaagagccggggtgagacgcaggaggacagcctcaaggccctgacgcagctcaagcccttcatccatgtggcgaagctgcaaagccagcttgtcggctatgtcacggtggagcgggacggcccggttccgggcgcggcatacctgcgcaacatcgtggtgaagcccgagctgcgccgcaagggcctgggcaacatcctgctggagcaggcgctgaaggcggcccgggacatgtaccggaagaccatcgccctgcgggtggatccgtccaactcgcccgcggtgagcttctaccggaaggaaggcttcaccacggtggccacggtggtctccaagaagtccgggaagcttcgcctcctgatgtcccgcgagctctag

SEQ ID NO: 5035 - DNA, 2755 bp, Myxococcus xanthus
atgatccgcggcgccaatggctatgagccggtggaccccaccaacgccacggccgaggacatcactcgcgccctgcaggccatggtgggcgtggcccgggcctccaccgtcacggagacgccggtccagtggtccgtcaacgccaccggcctgggctcgctgtccatcgccgccatgcggcgaggggacctcatccacctgcgcctcagccgggccgccgacgcgggggccgccgcccaggccgccaccgcgcgtcccgcagcgcctgcgcccgcgcagcccgcgcgtcccgctgccccagcgcccgtgcacgccgcggcaccgtcctaccgcacgcccgagcccgcccctgctccggcataccgcacgcccgagcccgctgcgtcgcagccctaccgcacgcccgagcccgccgtggcccaagtagcccgtgcgcccgagcccgcggcggcccgtccggtggccgcgccggcccggaccttcacgggcgcggggcgcgagctggccgtgttgctggaggaaggccgccggggcctggccagcgacgtgcacatcatcgcggagcgcccgcccctcttccgcttcgcgggcgagctgatggcgcagggcccggtactggacgcgacgacggtggagaagctgctgctgccggtggtgccggagcggctgcggcccgtgctggagcgcgagggcagctgtgacttctccctggagacgccggagatggggcgcttccgggtcaacgtcagccgccagcgcaccggcctcaagggcaccttccggctgattgcgcgggaagtgcccacgctggagtcgctgggcctgcccgcggacatcgccaaggccacgcaccaccaccagggactcatcgtcatcaccggtccatccggccacggaaagacgagcacgctggcggcgctcgtggacctcatcaaccgcgagacgtcccaccacgtgctcaccgtggaggacccggtggagttcgtccacccgcgcaagcgcgcgctcatcagccagcgcgaggtgggctcgcacaccaagacgttcgccagcgcgctcaagggcagcctgcgtgaagacccggatgtcatcgtggtgggcgagctgcgcgacacggagacggtgcgcatggcgctgtccgcagccgagacgggccacctgctcatcagcaccatgaacacgccgagcgcggcgaagaccatcgaccggctcatcgacctcttcccgccgggggaccagcagcaggtgcgcctgtcgctgtccagcggcctgcggctcatcgtcagccagcgcctgatgccaagcgcggacggcaaggggctggtggccgcggcggaggtgctgccgggctcagtgtcgctgggcaacctcatccgcgacaacaagacgttccagattccctcgctccagcagcgcggcaagagcctgggcatcatccgcttcgaagactcgcttgcggacctggtgcgcgccgggaaggtgaagctggaggtcgccaagggcttcgcggacaacccagacgagttggaggcggtggtgacgggcaggcgggccggcgccaccgtggccgcgccggagacgcagcaggatagcgcgaggctgctcagcaagatgggctcgctgatgggaaggaagggctcctgaaatgacgacgccccgtctggcggtcctgttcgatgtgctgctggagcagaagggcagcgacctgcacctgggcatcggctacccgcccatgggccgcatccgcggcgagctggtgccgctgcgcgagcagcccctcaccgcggcggagatgcaggcgctgctcttcgaaatctgctcgccggagcagcagcggcagattgtcgaggacctggacctggacttcgcctacagctacgggacgaaggcccgcttccgcgccaactacttcaacaagatgacgggcctggcggccgtcttccgcaccatccccagcaaggtgctgtcgctggaggacctgaagacgccggaggtggtgcgcaagctgtcggagcgccgcagcgggctggtgctcgtcaccggccccacgggcagcggcaagtccaccacgctggccgcgatgatcaaccacatcaacaagacgcggcccgcgcacgtgctcaccatcgaagacccggtggagttcgtgcacgagtccatgcgggcgcaggtgacgcaccgggaagtgggcccgcatgcgtccagcttcgccaccgccatccgctcagcgggccgcgaggaccccaacgtcatcctcattggcgagctccgcaccaacgagacgatgaagctggcgctccagttggcgagcttcggcgtgctggtgttcgccacggtgcacaccaacagcgcgccggccaccatcgaccgcatcatcaacgccttccccgcggacgagcagcagcaggtgcgcggcatgctggcggagagcctggcgggcatcgtcgcccagcaactcatcaagacggcggacggcaagggccgcgtggccgcgctggaaatcctggtgggtgggcccgccatcgcctccatgattcgcgagggcaaggtgttccagattgcctcgaagatgcaggcgggccagggccagggcatgcagacactggacatgcacctggagcggctggtgaaggatgacgtgattacgcccgaggccgcgctggagaaggcccaggacaaggagaacctggccaagatcatctcccgcctcaagccggactggcaggtgccggagtccctgaagtcgctgggctag

SEQ ID NO: 5036 - DNA, 147 bp, Myxococcus xanthus
atgctcgcggacgcgctcgagcgccaggacgcgaagttccccgccgcgctggctccggtcgtggagacgtgccgagagctccagacgctggcgccccaggtcgccacgggcttggaaacggcggagcgggaggcccgcgcgtcgccc

SEQ ID NO: 5037 - DNA, 390 bp, Myxococcus xanthus
atgaagaagccagcggtggggagcgtgggttggatggacctcacggtgaaggacgccgtggcggtgagggacttctacaaggacgtggcgggctggtccgccaccggcctggacatgggcggctacgaggacttcgtcatgatgcccccgggcggcggcgagacgcccgccggaggcatctgccacgcgcgaggcaagaacgcggacatccccagtgggtggatgatgtacatcaccgtggcggacctggagcagagcctggagcgcgtcactgcgatggggggccgggtgctcgggacgattcgcggctccgccaagacgggccgcttctgcttcatcgaagacccgtccggcacggcgtgcgcgctctaccagtcagggagcgactga

SEQ ID NO: 5038 - DNA, 2286 bp, Myxococcus xanthus
atgacgcagccgggcttggtgcgtgcgttcagcatcggacggacagtcgccaccttcggcggcgtcatccgcccgacgacctggaaccggggcgtcgggctgctagagcgagcatcgatgcccgacctcctcgtgactcatcggagtcctcacgtgcgccgcatccgggtgctcgcgcccctgctctgggccctcgcctcctccacggtgatggcggcgccggctcctgagacccaggaggttcccgacacgaacgggcagccgccgacggatgcgcccacgcgggagcggacgaaggcagaggacgctgggcggaccgtcgtcacgggctcgcggcgtccccggcccgcgagggacgtgcccgccaccaccacggtcctcccccgtccggaaatcgaccggagccccacgctgacgcaggactcgctggtccgcaccgtgccctccgccgccaccttccgccgcacgcccagcctcgtctccgacccgacggcgcagggactcaacctgcgcgggctcgcgccttcgggcgtggcgcgcagcctcgtgttgctcgacggcattcccgtcaacgacccgttcggtggctggattttctggcgctcgctgccacggctcgggctcgagcgcatcgaggtcgtccccagcggaggctccgccctctacggcagcggcgcgctcggcggcgtcgtacagctcgtgtcgcgcgacatcaccggaacgcagctcgacgcggatgccacctatggcaacgcgcatacgggcatgctcgcggcacgcggggcggagatgtgggggcccgtccgcgcctcgctggaggcagagctgctcgacagcgacggctactccatcgtcagtgccgcccagcgcggcgccatcgacgcggacacgcccagcagccacgccgtcctcaacgggcgcgtcgaagcggatgccaccgattcgctcaccctctccgcccgcgccggtctcttccgcgaggaccagaacggcggcacccggctcaccaccgcgcgcgtggagctggcgcacttcggcgcgggcgcacggctgcgcaccgcgcacggcggcacattcacgctggacctcttcggccgcgtgcaacgcttcgaacaggaccgcgcgcgcatcacccaggaccgctcctccgaggcgctggccgccagccaggatgtgcccgccaacgaccagggcgcgtccctcatctggaccggcccgtcctggacagccctgggcacgcacgtcctcaccgccggcctggatgtgcgccgcatggcgggcacgtcccgggagcagctcttcccgccctcgccctcggagacctcccttcgcctgcgcgacaccggaggcacccaactgtccggcggtgtcttcatcgaggacctctacacgccctcgcccgtcctggagctcagcgccgcgctccggatggacgtgtggcgcaaccagaacggtgagcagcgcctggagcgcgccaacggcgcggtggacacgacgcgcttcgacgaccgcaccgagcagcagctcagcccccgtctgggcctgagagtgcgtccgctggaggggctcaccctgcgcgcctccgcctaccgtgcgttccgcgcccccaccctcaacgagctgtaccgccccttccaggtgggcaccatcctcaccgccgccaacgcccacctgggcgcggagcgactgtggggcgccgaggccggcgtggaagccgagtcctcctcgctgggcctcaccacgcgcgtgacgggcttctggaacgtgctcgacgaccccatcaccaacgtcacgttggagcagccgcttccggatggctccacgcgccagcgggagaacctgggacaggcgcgggtgcgcggcgtggaggcgagcgtggactggaagctggcacgccagtggacggcgctgctcgcgtacaccttcgtggaccctgtcgtgacgcgctcgcccgggcagcccgggctggtgggcaagcagctcgcccaggacccacgacaccggggcaccgccatcctcaccttccacgaccccgacatcgtgacggccacggtgcagcttcgcgtgacgggcgcgcagttcgaggacgacctcaacgagcgccccatgggtggctacgccgtggtggacgtgtccgccagccgccgcctcttctggaagctgcacgtcttcggcgcggtggagaacctcttcgaccgcgagtacctcgcgggccgcgccggagtggacacgttgggcccgcccctgctggcgcgcatcggcctgcggctgcgcgacgcgccctga

SEQ ID NO: 5039 - DNA, 141 bp, Myxococcus xanthus
atggatgagaaggcgctgaaacagctcctgggcagtgtgaagtccggccgcgtctccgtggacgacgcggtgggcaagttgaaggacctgcccttcgcggagctggggtacgcgacgctcgacacgcaccgcaacctgcgc

SEQ ID NO: 5040 - DNA, 582 bp, Myxococcus xanthus
gacgcgcaactcgacgcactgcgcgaggtggccaacattggttgtggccacgcggccaatgcgctctcccggctgatggggggacgcaaggtggacctctccattccccgcgtgttgctgacaggcccctccgacgccgccgagcttctgggcggagccgcgccggtggtgtcggggtggctgggcatccagggcgggctgcggggtgccctgttgctggtgctgccccagcaggacggagccgcgctggaagcgctgctcctggagggtcagcccgcgattcatcagaccgaacgggacagcgtgatggcggagacggcgaacatcgtcgccagtgcctgcctgtccgccatgggccggctgacgggctggaagctggtgcccacggtgcccacggtgcggcgaggccgcgcgcgggacgtggtgtccgacgcggtggggcaggtggagggcgacgccagcagcgtggtggtgttggaggcccgcttcctcgcgaccgcggcacccccggtgggtgggcagttgctgttggtgctggcgcgcgacagcatccgcgacctgctggcgcggctgggcgtgtag

SEQ ID NO: 5041 - DNA, 2574 bp, Myxococcus xanthus
atgacgatggacatgtcccgctacctcgggctcttcatctccgaggcgaccgaccacttggaggcgctcgggcgtgacctcgtggagctcgagcgcgagggctcgtccagcgcggtggattcgatgttccgccatgcccactcggtcaagggcatggcgtcgtccatgggcttcgagcccatcgccatcgtggcgcaccgcgtagaggacctcgtggacgccgtccgtcaggaccgcggccgcctggaccgcgacctggtggacctgctgctcaccgccgccgacaccatgctcgcgcaggtgcgcgcggtggcggagggcaagcagccggatgattccgcggcgctcctgacgcagctcagccagcgcgtcaccaccatgacgggtcaagccccggccgccacgcgcgtcgcgaaggtgacggcgctgaagccagagggcggcggctcggatggcacgggcggaggctcggatggctcgggcactgcgggcggctcgggcactgcgggcggctcgggcactacgggcggagcgggcggctcgggcactacgggaggaggctcggatggctcgggcacgacgggcggaggcccggatggttcgggcactgcgggcggagctggtggaagctcgggcactacgggcggagctggtggaggctcgggcactgcgggcggagctggcggctcgggccctacaggcgccggtgccagccctgcctcaacgcacggtggcggagctgctggcagcggcacccggagctgcgtcgacggaggctcgggcgccgcgggtggcagtgccagccccggcgtagccagcggcactggtgttgacggtgcggggcccggcccggccagccccaatctgatgaacggcggacccggtacctccgccacctccagcgcgccgaatggagcgcatggtaccagcgccccattatccccggacggagccaccggaggcgtggtggtgccgctgtccacgcgccgggcctcggacgtgcctggcaccgacgccggatccgcggctccaacgcccgacctggccaactccctgaaggccgcggccagcgcgccgctcccggaaacgctggcccagcgctgggcggtgcggctgcgcatcgcgcccacctgtcaggtgcccggcgtgcgcgccttcctcgtccacaagcgcctcaccaacctgggcacgctggtggaactccggcccgcgctggaggaactgaaagccggccgcatcccagacggcaacatccaactggagctggagaccccggcgggcgaagcgggcatccacgcggcgctgaagaacgtggccgaagtggaggtcctctcggtgaagcccgcggtggccgcgcccgtggtgcagcccaccctggtgcctgtccccgacggcgcccgagcgtcctcggacacggcgtcgcgcacggtgcgcgtgcgcacggagctcctcgactacttcctcgacaccgtgggtgagctgatgcttgccacggcccgcctgcgcgaggtgggcaaggtgctgccggagaacacgcgccccgcgctggaagagggcgtctaccggctgcacacgttggtgaaggacctacacgacaaggtgatgacggcgcgcatgacgccgctgtccctcatcaccgaccggctgccccgggcggcgcgagacatcgcccgccgcaaggagcgcgaggtcgacctggtcatcaccggcgcggaaatcgaactcgaccgggccatcctcgaggagctgtcagacccgctgctccacctgctgcgcaactgcatcgaccacggcctggaggcgcccgaggatcgcgccgccgcgaagaagggcccacgaggccgggtgctggtggcggtaaagcgcgccagggaccgcgtcatcatcgagttggaggatgacggccgcggcatggaccccgcgaagctgaagaacgccgcggtgtcgcgaggcctgctctcggcggaggccgcggtgcgcctgacggaccgcgaggccttcatgctgtcgtgccttccgggcgtctccaccgccaaggacatcaccgacatctccggccgcggtgtgggcatggacgcggtgaagcgcgtggtggagaacgtcggaggcacgctcgaaatcgacagcgagcgaggccgaggcacccgcttcaccctgcgacttccactgacggtcgcggtggtgcacctgctgctggtggaggtgggcgaggaggtcttcggcctgcccatcgccaaggtggtgggtgcgacggaggcggacggggagtcactcagccggagccgcgagacggccctgctgccccatggtaattcgctgctgccggtccattcgttggatgcgctggtgggcgtacctgccccccggagactgggagcccggcctttcgtggtgatggacggggattccggccgggtggccctggcggtggaccgcctgttgggacaggaggaagtggtgctcaagccgctgtcgcggcccctggacttgctgcccggcctgtccggcgtcaccatcctgggaagtgggcgtccggtgttcatcctggacgtgccgaggttactgtccgcgtga

SEQ ID NO: 5042 - DNA, 369 bp, Myxococcus xanthus
atggctaagcgggtcctggtcgtcgacgatgccatcttcatgcgcaacatgatcaaggacatctttgcgtctggggggttcgaggtcgtcggtgaggcggccaacggcctggaggccgtggagaagtacaaggagctcaagcccgacctcacgacgatggacatcgtcatgcccttcaagagcggcatcgaggccacgcgagagatcatcaaggcggacagcagcgcggtggtcatcatgtgctccgcgctcgggcaggagagcctggtgatggaggccatcgaggcgggcgcctcggacttcatcgtcaagccgttccgggccgaggacgtgctggccgtggtgaagaaggtcctgggcgagacgtga

SEQ ID NO: 5043 - DNA, 738 bp, Myxococcus xanthus
atgagccagacgccctcggacaacgtcgacgcgaagctgaaggccgcggaggaccacctgcgcgaggtgatgctcgcgctccccgaggtcaccgaggagttcccctggggccaccgcacggccaaggtgaaggggaagatgttcgccatcctcgtgctggacaacgacgggctgggggtcaccaccaagctcccggagtccaacgaggccgcgctcacgctgcccttcaccgcgcccaccggctacggcctgggcaagagcggctgggtgtcctcccacttcaagccgggcagcgaggtccccatcgggctgctggcccagtggattcacgagagcttccgcgccgtggcaccgcagaaggtgctcaaggcgctgatggctccgggcgcggcgcaggctccgaaggcgaagccggcggcacggaaggcgaagtcggcagcacggaaggcgaagccggcggcgaagcccgcggcccctgcaaggacgtcggcggcggcgaagccgggggccggtgctgggaagggcggggcggcgaagcggggtgtggcggcggggcgggccgtggcacggacgtcagcggccggaaagaagcccgcatcgggcaaggcggcggtgggcgggaagaaatccgtggcgaagccggcctcggcgcgcgaaggtcccaccaggcgggccggcgcgaagcagacgtccacggcgaagcggggcgcggcgggttcgtcccggtcgaagcggtag

SEQ ID NO: 5044 - DNA, 1242 bp, Myxococcus xanthus
atggggctggcgctgacgggttggatgtacgcgtcggacggcctcatcaacttcgtcttccctgccctcagcgcgggagggaaggacgccgtgcgcatcggcgtcgccatcatcatcaccggggccgccgccgcgctgctgccttcgtggctcgcgcgcgtcacccgcgtgaaggtgctcagccgctccgcatacgaaatctcgcagggcgacctgtccaagccggtggccgccgagggcggcagcaagcgcgacgagattgacgagctgacgggcgccatcacccgcatgcaggagaacctgcgcgagctggtgggcaagattcaagagacggccaagagcgtggccgacacggccatcgacctccagcgctccgcggagaacgtcaacggctccaccgaggaggtgggctcgtcgatggagaagattgctggcggcgccgagtcccagtcgcagttggtgtcgaaggcgtccaaggtcatcaccgagatggccggcagcatccagcgcaccacggccagcgccgaggacgcggcgcggacgacggcggagacgagcagcgcggccgaggacggctccaaggcggcgcggttggccggcgacaaggtgaagaaggtcttcaaccgcatcgagtccgccagccagcaggtgttcgccttcggcgagaagacgcaggaaatctcgaagatcgtcgacgcgattacgcaggtggcgcagcagacgaacctgctggcgctcaacgcgaccatcgaggcggcgcgcgcgggtgagtacggccgcggcttcgcggtggtggccgatgaagtgcgcaagttggccgagagcgcgggccgctccgccgagcagatctccaagctggcgcgcgacatctccggacagtccacctccgtcgtgagcgccatgaaggaaggcatcgcggagctggccgagggccgtgaggacctgaccaacatcgtgcgctccatgggcgccatcaccgacaccatccgcaagggctccgagaaggtgcacctcatctccgagagcgcccgcgagcagctcaagggcagcgaggagatggtgacggccatcgaggaaatcaagctggtggcgcgcaacaacgcctcctccacggaggccatccaggccgtcatccaggagcagaccgccgccgtgtcccgcatgacgtcgctggccagtgagctgaccaacctctccgtcgagctgcagagcgtcgtgcgcagcttccgcctgggcccatga

SEQ ID NO: 5045 - DNA, 948 bp, Myxococcus xanthus
atgtctggtgagttcgatttcatccgccggttcctcgcgcacttcccggccgcgcgtgtgcccgtggggcccggcgacgactgcgcggtgctgcccccctcacgtggggcgcagtgcgtcaccacggacgcggtggtggaggacgtgcacttcacgcgcgccgcgttctcccccgcggacatcggccacaaggcgctggcggtgaacctgtcggacctggcgtccatgggggccacgccgcgctggttcgtctgcgcgctcgcgctgccgaaggactatcccttgcgggagctcacgggcctggcgcgaggcatggccgcgctggccaccgcgcaccgcattgcgctggtgggtggcaacttcacctccgcgcgcgagctgtccgtcaccatcaccgcagcgggcgagctgtcacgcgcgccccttacccgcgcgggggcccggcccggggacctcctctatgtctccggcacgctgggtgatgcgcgcctgggcctggagcaccttcgtgcggggctgcgccggggtgccgccgtgcgccgtcagcgccgccccgagcctcgcgtggcgctgggcctgctcgcctcgcgccatgcatctgccgcgttggatgtttccgacggacttgcacaagacctgggtcatctctgcaccgcctcgggtgtccgcgcggagctggaggtggagcggctgccactgtcggcggcggtgcgcaaggccctggggcccgaaggcgcgctggcggggggcgaggactatgagttgctgctggccgttcctccgggacgcagccgggcattcgagcgcgcgtgcgctacaggcgggcacgccatcacccgcatcggccacttcacagaggggcgcgggtgggtgggccgggacaggacaggccgcgttctcccaccgccagaggggttcgaccacttccgacctcgggcgatggattga

SEQ ID NO: 5046 - DNA, 552 bp, Myxococcus xanthus
atgcccaccttccgcctcaagcaggaccaggccgcgttgctcgtcgtggacatccaggagcgactgtgcgccgccatggaccgggacgcgctggaccggatgctcagccgcaccaccgccgccatcgagggcgctcgcgcgctggggctccccatcctcctcaccgagcagtacccccagggcctggggcccacgcattcgctgctgcggatgcgggtgctgaaggacgtcaaggcggtggagaagctggagttcagcgccgccgtgccagacgtgctggccgcgctcggcgggcgcacgcaggtgctggtggcgggcatggagacgcacatctgcgtcttccagacggtgcgcgacctggccgaacgcggtctgtccccgttcctgcttacggacgccgtgctgtcgcgcgcgcaggaggaccggcaggtgggcctccagttgtgccgtgacgcgggcgcgcacgtcgtcacggtggaggccgcgctgttcgacctgctcgggcgcgccggcacgcccgagttcaagcaggtctccgcggcggtccgctga

SEQ ID NO: 5047 - DNA, 165 bp, Myxococcus xanthus
atggcagtcccgttcatctccgaggtcaagcgtacccacacttgcggtcagctcaccgcgaccaacgtcggcgaggaagtcgtcctcttcggctgggtgcacaaccgccgagaccacggcggcgcggtgttcatcgacctgcgagatcgggatggcctcacgcag

SEQ ID NO: 5048 - DNA, 1398 bp, Myxococcus xanthus
atgaaggcatcgtggtggttgacggccctgctgctcacggcgggagctcccaggcaggagagcggcgcacccgcgccgggcgcggccgtctcggaggtgcccgggcgcccggacgacgaggctctggcggggggcggcaccacggtgtttgacgtctcgcacaatgcctatggccgcgcgctgggaaacctggcgcccacgcgctggtaccagatgcgcgaaggcaaggtgttgttcatgcgggactgggccgcgcatgaagaagggctggcgggcccgctgacgaacgccgccgggtgtggttcgtgtcacttcaaggatggccggggccgcccgctgcccgagatggggccggaggcgccgctgctcgtccggttgagcgtgcccgcgaaggacgcgcccgcggggcatcacgaacccgtctacggcgtgcagctcaatgaccgtgggaccgcggatgtcccggccgagggcacggtccaggtcacctatacggacgtgaaggggacgtacgcggacgggacgccgtacacgctgcgtcagccgcgctaccgcatcaatcaactgggctatgggaagctggctcccgaagtgatgctctcgccgcgcatcccctcccagctcttcggcctggggctgctggcggccatcccggatgaagccatccacgccctggcggacgcggatgaccgtgatggggacggcgtctccggccgtccgaaccgcgtggtcagcgtccactccggcaaggtggagctgggccgcttcgggtggaaggccaatcagcccacgctggagcaacaggtcgccagcgccttctccgaggacctgggactgacgtcaccgctctatccggagagcaactgcacggcgaagcaggaaggctgcatgacgcgagtggccgccaagggccccgcgttgtcgcgccacgtcctggagcggacgacgctgtacctgcggctcatcggcgtgcccgcgcggcgcgacgtgttggagcccaccgtgatgaagggacagaccctcttccagaagacgggctgcgcggcgtgccaccagcgggagttcatcacgggcacggtcgaggatgtcccggagctgtccaaccaacgcatccgtccgtacacggacctgctgcttcacgacatggggccggagctggcggacggccgccctgacggagaagcgaccggcaccgagtggaggacgccgcccttgtggggactggggttgctggagacggtgaaccgtcaggtgcggatgctccacgacgggcgcgcgcgcagcttcgaggaggccatcctgtggcacgggggcgaaggcgctcgtgcccgcgagcgcttcaaggccttgagcaaggcggagcgtgaggcattggtggccttcctgcgctcgctctga

SEQ ID NO: 5049 - DNA, 363 bp, Myxococcus xanthus
atgctccccaccccgggctggacgccgaactgccgcccgcgcacccagacgtatgcccagtgtgagtcggcctgctacgcgaacggctactccaactgcaactactgcaacacgctgtgctccctcaccgtgggcttcgcgagcgctcagctcagcagcgcctgcctgtggcagtacaacgtcgcggagccgggggtccggctgccgaacggccagattgttcgggctgaccagatcgtgttgcaggaggagacctcgggcccgtccaactacccgtacctcaacttcaaccgcatcgacgtgcagaccaccgcgcgctcgacggtcatcaccggcgagtccctcatccccgccggcaagtag

SEQ ID NO: 5050 - DNA, 588 bp, Myxococcus xanthus
atgctctccggacgcccccccgcctcctcctacgtactcatcgacgccgagaacatcgactgggctgtgtccaacgtggtggggcgcaagcccgagtcccaggaccgcgtccagttcgaccggctcgtgtccttctgtgagacgaacttcccggcgcccgtgcgctgcgtggtggtgctcaacgcccgcggagagcagctgccggacgtcatgattggcttcgtgcgcgcgctcaagtccgccggctgcgacgtggccctgctctacggccgccccgaccagaaggtggtggacctgggcatcctgaagctgctggagaacatccgcacccagcgccccggcgcggcggtggtgctcgccagccatgacggcgcggacttcgcggacgcgctcaagcccatgctggaggagaaacgccaggtggccgtgctcggcctgcgtgaatacgtcagccagcgcttccgggagctcgtcccctccgggctcaagattctggacttggagttgaacgccaaggtgttcaaccggcccctgccgcgcatgctccctgtcaacgtggacgagttcgacccggggctgttcttgtag

SEQ ID NO: 5051 - DNA, 1419 bp, Myxococcus xanthus
atgctggacctgccctccttcgtggaggtggtgcggagcttcagtgagttgtaccgcgtgggcatcaaggtgatggacaccgcgggcgacaagctggccgacgtgaaggtgggccacggcgacttctgctcgtacgtgttcggcttcccggagggccgctcgcgctgcaccgccacggtggcccgcgtgaaggacggaccggtggccctggtgcagggcgcccggcccgcgcgcggtgatggcgcggaggcggcgggcatcatcgcgctgccgtgcttcaccggcctgcgctacctggtgatgccggtgtgctgggagggcgacacgttgggccgcgtcatcctgggccccttcacgccggaggagctggcggacttcccgccgtcgctgacggacatctccggggtggacctgtcgcgcgcgcatgaactggtggcccgcgtgcggcgcgtgcccgagcgcaccgccgcgcaggtgctggtgcacttcgggcaggtgctcgccgccctggtggccagcgggcagcgcgccttcctggcgacgcagctccacatcgaggcgatgctggagacgcaccgggatttggaggcgaacaacgcccggttggcgcaggccaacatccgcctgaaggagctggaccggctgaagtccaccttcctgggcacggtgagccacgaactgcgcacgccgctggcttccatcatcggctactcggagatgctggctgagggcctggccggcgcgctcaacccggagcaactgctctacgtgcgcaccatcgtggagaagggcgagtcgctgctcaacctcatctcctccatcctggacctgagccagattgaggccggacggctgcgcctggtgatgggcccggtggacctgggcagcgtcatccagacggcggtgtccagcgtggcgccccaggcgcagcgcaagggcgtggagctggaggtgcgcctgccgccgttgcctcagccgcgcctggccgcggacgcggacaagctgcgccaggtggtggtgaacctgctcgccaacgcggtgaaattcacctcgtccgggggccgggtgtcggtggtgatgtcggaggccaccgcgcagcatgagctggccgcgccgggctaccgtgtgtgtgtggaagacaccggcatgggcatccgcgaggaccagttcgagaacatcttccagagcttctatcaggtggacggcagctccacgcgcgagcacggcggcgcggggctgggactggccatcgtgaagagcctggtggaaggccacggcggccgcgtgtccgtggagagcgagttcggccggggctctcgcttcaccgtggtgctgccgctccagccgccgctgtcggagcacggcggcttctccgcgctggcgcccacgccgtcgcccagcggacacgaccgcttctga

SEQ ID NO: 5052 - DNA, 846 bp, Myxococcus xanthus
atgagcatcgcctccacgcctggcaccctgccggccttccgtgtcgggccgcttcccactataaaacccgtagtcgggcgcgaaggcgtcaaactcctccgctcgaccgtcagccagagccccaccttgcaactcaaccatgcccagcgagagctgacgctcaagatcgtctactacgggcccggcctcagcgggaagacgaccaatctgcgtcatctccacgcgaaggcgtctccggaggtgcgggggcggttgctgaccgtggagacccacgacgaccgcacgctcttcttcgacctgctgcccgtcttcttctccacgtcctccggcttcaaggtgaaggtgaagctcttcaccgtgccgggccaggtcatccacaacgccacccggcgcatcgtcctgcagggcgcggacgcggtggtcttcatcgcggacagccgccgcagcgccacggcggacaacaacgcctattggcgcaacctccaggagaacatgaaggagaacaacctggaccccagccaggtcccggtggtcatccagttcaacaagaaggacctgccggacgcgcgcacggatgccgaaatcgaggagtcgcgccggcgaggcggcgaggcggtggtgggcgcggtggcgctgcggggcgaaggcgtactggagaccttccacgcggtggcgcaggcagcctaccggcggctcgacatgcgcgcccacctggcgcgcaacctgggcctgacggaggcggagttcctggggcagattttccggcgcatggacctcacgggcacggcgttggcctccatgtacgggcgcgcggcgggtgaagcgcgcagcggagaagggcgatga

SEQ ID NO: 5053 - DNA, 1458 bp, Myxococcus xanthus
atgcgaagcgggctgaagcggaactgggcggcgttcgcggtgggcggcctgctcggcgcatgggtgctcggctgtggcggctcgacgacggaggggctggagtcgttggagcaggggaccgcgccgcccccgtccgtctccgtggacctgtcgagcgtggacctccgcacccggctggagtccatcgccggcctcacggtgctgaccgatgtcgaggtcaacggcttccgcttcttcacgatggactacgagcagcccgtggaccacctgcgtccctggggcacgcgcttccagcagcgggtgacgctgatgcaccgctcggagacggcgcccatggtgctggacacggaaggcaccgccatcttcgaggagcccatccccgccgagcccacggacctgctccagggcaaccagctcaccgtggagcaccgcttctacggcgcgtccaagccggccgacatggactggcggaagctgacgatgtggcaggcggcggcggacgcccaccggctcgtcgaagccttcaagccgctgtacggcgggcgctggctgtccaccggcgtcttcaagggcggcaccgccgccctggcccaccgcttctatttcccgaacgacgtccacgccacggtgacctattcggcgcagcacaaccggggcctccatgacgcgcgacacgggcgcttcatcctcaccaaggtgggcgacgcggcctgccgccagcagctcgcgtccctccagtacgccgcgctgacccgccgcgacgagctgctgcccttcatggatggctacgacgcccagggcttcaccttcaacacgctggggaaggaccgcgccttcgagttcgccgtcatcgaggtgcccttcatcttctggcagtactacggcatggcggggacgtgtgaggggctgccctcgccggaggcgagcgcggaggagctcttcgccttcttcagctacgtctccacgctggagttcaccttctccgaccaggcgctggaggagtcggcgccgctctactaccagggcgccacgcagctgggcggcccggggtacccggaggttcacctgcggccgttgctgcgctacgccggtgagcacctccccacgcgcttcccgcccacgggcgtgcgcaagcagtacgagccgtggacggtgggcctgctggaggcgtggacccgcttcgaggccaagcgggtgctgctcgtctatggagacctgagcccctggtccgccagcgccttcagcaccacgacgggcaacgacgcgtaccgcgtcatcgccgatgacagcatcggcttcttcggcacgctgagcgcgctgccggagccgcagcggagcttcctgctcgggcgcctgtcggagtgggcggacgccccggtgcagctcccgacggggatggatgccctgcggcgccgcgaggcgagcgatgcccgcatgaaggcctaccgcgcccggtag

SEQ ID NO: 5054 - DNA, 423 bp, Myxococcus xanthus
atgggctgccagatgaagtgctccgagccggtccccgacgccgggcatgccttggcatcgcttcaacgcgagagcccgtgtgtccaggtctggcgcgcggcccaggtggacgtggcgttcaaggaagagcccgaggacgccgtgcagcagcgcacggacacgcggctggagcgtcgcttcaccgtcgcccggcagttgcgcggtgcgtaccggcaccaggaccggtgggcctcggtgctggagtacgaggcggggccggtgcgcggcggcgtgagctacagcctccaagtgccggacgtgctgtcggacctgacggggcaggtcgttgagtggaccagccatcgcgagcccgcgtcctgtcctacgaaggaggatggtgaggttcccgtgctgttgtcagtagacacctgtcggcacgcgtag

SEQ ID NO: 5055 - DNA, 1518 bp, Myxococcus xanthus
atgggcgacgactgcgcgggcgaggcgcgttcctgcgtgacgttcaccgcgccggactccgggctctaccgcgtctgggtgcgcgcctatgcggaagggcgcggcgggacggccagcctgtatcgcaacggagcgcttctcctgagcaaccagcccttcggcggcgtgccgctcagcttcgcctggaacgtgaaggacacctttcgggccacgtccacgacgccgggcgcgggggaccacctggtcttcctgctgcgctccaacgcggagtacctgcaacacgacgatgacagtgggcctcgctcctacccgctggtcgtcgcggcgagcacacagaacgcgggcgcccagcgcgtggtggtgggccgctttcccgggagcacgggcacggccagcttcgtccacgacgacgcgctgtggtccaccatcttcagcgacaacgacgaggatgaagacggcatctccaatgccctggagccgctggtggggatgaacccggactcgaaggactcggacggagatgggataccggacacgctggagttgttcggcaatgacggcttctccttctccgagtggggcagccccacggtgaaggacctctacgtggaggtggattggatggagcaccccaccaatccctatctcacgcggaagccctatgccgggctggtggcggacgcggcggcggtgttcgcgcgggacgcgggcgtgcggctgcatgccttcgtcgacagcgcgctgccctggcatgaagtggtgtgcttcggcgcgtgcagcggcggcgtggacttctattcgttgaagcagggcgggttctccatcgggtacccggagcggcggccctacttccactacgcggtgtgggcctaccggcagggcagcagcacgtcgtgctcatccggcaaggcggaggtgctgggcaatgacctcatcatcagcctgggctgctggagcagcccgagcatccaggaacagcgtggcaccttcatccacgagctgggccacaacctggcgctgggccacaacggcaacgacgtggcggggcagaccagcgtggtgcacgccagcgtgatgaactaccgctaccagatgctcggcgtgggctcgccgggctcgcacacgtactcgtttggaggtaatgcgtgcgcggcgtgtagcgcgtcccccaagagcaagtgtgtctcctgccggaacggcttcttgggatgcggcttccctgggtgcggctcgtgcgactgcgatgtgaatgagtggggtgccgtggagctggacttcctggacgacggcgacgcggacgacggcactcaccgcgtgctgctggcgaagtacgctctggacgacaagggagggccggtgcggttccagccgcgcgtgccccacgcggagccacccgtcgcggcgcgtcgcctgaaggtggagcgcacgcgggagcggctgcgggcgcgggggcaggtggaggggcaggacttcttcgtgtcgaccgacggcacgacgctgtacgctgagtgcccatga

SEQ ID NO: 5056 - DNA, 225 bp, Myxococcus xanthus
atggagaaggaacggcgctatctggcggcgctgaacctggtggcgaagctggccacgccgccggagccctcgaccgaggacctccgcgcgggcgaagtggacgcgcgctaccaacaggcgctcaccgtggagcaggtgaagtggcggtcgcttccgccagaggaaaagtcgcgtcagcacgacgccttcaaggaagccttcttccgcgcggaggagacgcgatga

SEQ ID NO: 5057 - DNA, 645 bp, Myxococcus xanthus
atgctgttgtacgaactgcacccggcactggtgcacatgccactggccttgcttcccacggcggcggtggcggacctcatctcagtgacgacaggcgaaggtgcctgggcccgggtggcgcgccgcatctgggtggtgggctccattggcggcctgctcgcgggcgtgtcgggactggcggcgagccaggaggtccggctggagacgccgcgtgcccgggacatgacgttcctgcatggcgtgggcaacgcctccgtgctgctcggcgccttgggggtgacggtgtggcggctgcggcgcgagcccaccgcggccaccgtggcgctggggctgggcgcctgtgggctggcgctcggcacggcggcgctcggcggaaagatggtctacgaactgggcgtgggacagcccgcttcaatgagcaatgcgaacgcccccgcgttgctgtcgcgcgacgcgccgctgctgctggtgcgtgacgcgcttcgtggagtgcagtggctggtgacgcgtgcgcgtgaggtgctcgccggtgggcgtccgctcgcgaagggcgccgcgggcacggcgcctgaggacgagtcgctcaggttgccctcgcccgtcgccgtgttccacggcccgggccgtcccatgcctcaggcgtag

SEQ ID NO: 5058 - DNA, 1708 bp, Myxococcus xanthus
  unsure (1)..(1708): unsure at all n locations
tggttgcttccagatgtggtcgagcaggaagtggcgtccctcgcgggggagttgtcactgcacccgctcgcggcgaaggtgctcctgcaccgtggctaccgcacccccgagtccgcgtcggcgttcctgtcggaccggttggcggacctgccggacccgttccgcatgaaggggatgccgggagcggtggaccgcatcatccgggcgattcgttcgcgggagaaggtgacgctctacggtgactacgacgtggacggcgtctgctccacgtcgctgctgtacctcttcatgaaggagctgggcgcgccgcccgcgacgtacatcccccaccggctggacgaaggctacggcctcaacgtcggcgcggtggagcgcatcgccgcggagggcacgcgggtgctggtgacgctggactgcggcatcacctcggtggcggaaatcacccgcgccaaggagctgggcctggacgtgctggtggtggaccaccacaccgtgccgcccacgctgccgcccgcggtggcggtgctcaacccgcaccagcctggctgcgagtacccgacgaaggcgctgtgcgccgcgggcgtggccttcaacttctgcatgggcatccgcaagcgcctgcgcgacgagggcttcttcgccacccggaaggagcccaacctccggtccatgatggacctggtggcgctggccacggtggcggacgtggtgccgctcaccggcgccaaccgcatcctggtgacgcatggcctccaggagctgagcgcgggccgccggccgggcgtgcgggccttgaaggaagtggcgggcatggacccggacgcctccgtcaccgcgggtcaggtgggtttccgcctggggcccccgcatcaacgcggcgggccggctgcatgacgcctcgctgggacttcagctgctgtgctcggagtcaccggagacggcgcgctcactggccgcggtgttggacagggccaacgcggagcgccagggcatcgagagcagcatcctcacgcaggcgctggcccaggcggagtcgctgaaggacgcgcgcggcctggtgctgtacgacgaaggctggcacccgggcgtcatcggcatcgtcgcctcgcgcgtggtggagcgcttctaccggcccaccgtcatggtgggggtgaagnacggcgtggggaagggctcggcgcgcagcatcgaggccttccaccttcatgacgcgctcagtggctgcgcggagctgctgacgcgcttcggcggtcacaagcacgccgccgggctcaccatcgacgcggagcggctgcccgccttccgggaggcctttgagaagattgcctaccagcgcctcacgccggaggacctcatcccccggtgccgcgtggacgcggtggtgaatcccaacgagttggacgctcatgccgttgagtcgctccagcggctgggccccttcgggcagggcaatccggagcccgtgctggtgctgcgccggcaagtggctcgcccgcgcgtgctgcagcccaagtccggcacgggcagcggccatctcaagctcgccctggcggacgcaccggagctggacgccatcggcttcaacatggcggaccgggccacgctggtggatggcccggtggacctggcgtttcaggccggcttcgacacgttccgaggccagcgcaagctgtctctgcggctcaaggacctgcgcgtggccgcctag

SEQ ID NO: 5059 - DNA, 783 bp, Myxococcus xanthus
atgagcattcccttgttcaagggcacggacgtcgaacgtctgcgccgagcgagtcaggccgccgccggtacgctggctttcgttgcctcgaagctgacccccggtgtcaccacggcggacatcgaccagtgggttcgcgaggacacggcgcgccggggtggcaagcccagccaactggggttcaagggctacccggccaccgtctgtaccagccgcaaccacatcgtctgtcacggcatcccgaacgaaggcgagcaactggtccgtggggacatcatcaacgtggacgtgacgacgtgcctggacggcttccacggggacacctccgcgaccttcctcattggcgaggtgtccgaagacgctcgtcgcatcgtggacgtggcgcgccggtgccgtgacgcgggcatcgccgtcgttcgccatggcgcgcggctgggggacatcggcgctgccatcgaggaactggcgaagaaggagggctgtagcgtggtggaggagttcggcgggcatggcatcggccaccagatgcatgggccgcccaccgttccccataccggcaagcgaggctcgggcatcaagcttcgctcgggcatggtcctcaccgtggagcccatggtgaacctgggacggccggacattcgcatgctggccgatggttggacggtggtgacggaggacggcagcctgtccgcgcagttcgagcacaccatcctggtgacccctgacggctgcgaggtgctcacccagcccgagctcgccctctcgctcgaaatcgcctgctga

SEQ ID NO: 5060 - DNA, 1545 bp, Myxococcus xanthus
tgctctaaagccggcgaccgcagcgagctggacctgcccgagtccttcagcgcctggtcgcgcctgtccaccacgtccgagacgtgcgtgggcaccaggtgcccgcagtacgagacgtgcttcgtcacgcgcatgcgcaagcgcgcggagcaggcggacctgctggtggtcaatcaccacctcttcttcgcggacctggcgctgcgcagctccggcaagcgcaccgagggcgtgctgccctggtacgaggccgtcatcttcgacgaggcccatgcgctggaagacgcggccagcggccacttcggttgcagcgtgtccaactaccggctggaggagttggcgcgggacgcggtggcgtcgctgaaggaggacgacgcccgccacgccatgctgcgcgcgctggcggcccggttgcgcgcgggggcggatgcgctcttcgcgcaggcgccccgggcgctggggctgtccggccacgaggcctccgtggcgctgcgcgcggaggtcatggcgaagctgtccacgccgctggagggcgtgcgggacgcgctggccgcgttgtccgccttcacggtgggcgagcgcgaaccggagctggccgccatcacccgccgctcggacgagatggaggagcagctctccttcctggagaaggccgagtcctcggaccacgtctactgggcggagcagcggggcaagggcctcttcctgcgcgccagccccatcgacgtggcgaaggagctgcgcgagcggatgtacggcgcgctggacacggtggtgtacacgtccgcgacgctggcggccgacagccgcttcgacttcttcgccaaccgcatgggcctgtacggcgaggacggccagccggtgacgcgcgtgcggacgctggcggtgcccagccccttcgactacccgtcgcaggcggcgctgtacctgcccacgcacctgccggacccgtccgcgccgggcttcatcgaggaggcggcggaggagattgaacgcctctgcgaagtcacgggtgggcgcgccttcgtgctcttcacgtccctgcgcaacatggtgcgggcctatgagctggtggcgccccgtttgccctatcagtcgctgctgcaaggcgagcgccccaagcagcaactgctggaggccttccgcgagacgccgagcgtcctcttcgcggcgcacagcttctgggagggcgtcgacgtgccgggcgacgcgctgagcctggtcatcatcgaccggctgcccttcgcgtcgccaggagacccgctggtggccgcgcgcatcaatcagctccagcagcgaggcgaggagcccttcgagcagtaccagctcccgcacgcggcgctggcgctgcggcagggcttcggccggctcatccgcacgcagtcggaccggggcatcgtcgcgatgctggaccggcgaatcgtgacgaaggcgtatggccgtgtcttcctcgacagcctcccgcccgcgcgccgcatggaggacgtggtgtcgctgagccgttggttcaacggcccggtgcggccggtgcgcaccatccgctga

SEQ ID NO: 5061 - DNA, 513 bp, Myxococcus xanthus
atgctgtcgcgcggcgccgccgcgctcctcgtggtcgccgcgctgtccctcaccaccactggttgcgccggccgccgccgcgaagccttcctgctggagaaggcgcgcaaccacgtctaccgcaagcccgtggcggaggtgtatccgcaggcgctcgccctgctgaaggagaagggctactccttcaagacgggccagggcggcttcgaggccaccaccgagtggttgatgcagggcgccccgtcgtcgctgggcaccacccaggtgcgttacctggtgcgcggcatcgagaagggcccgggccagtcctcggtggagttcacccggcagctcgtcacgcagtccgcgggcgccgccaacacctccggccgcgcgcctgacgtctccgagcccgccgtacgcgccgacggcggcaacatcacccgggacgaggcgctggagtgggagctggtccagcgcgtggacgccgagtccgcgtcggccctgcgcgccgagtccgagaagattcagtag

SEQ ID NO: 5062 - DNA, 147 bp, Myxococcus xanthus
atgcgcatcgcccgggtgaagggcgcccggcgggaggtgcgccgggagctggcggacatctcccgcgccgtgctggacctgcaccgccgcgatgtcccccacgggccctccgcgtgcccgctgtgcaccgcgctgtcgcggacctga

SEQ ID NO: 5063 - DNA, 732 bp, Myxococcus xanthus
atggcccgtcccgccgaccctcacgctcgcagtgcgctggtgtccgcggcccggcgggagttcgcgcgccgggggctgaagggggcgcgcatcgaggacatcaccgccgcgtgcgggctgtccaagggcgccttctacctgcacttcccgtccaaggaggcgctgttcggggaggtggtgggcgcgttcgagtccgggctgatggagatgaacgggcgtcgcatggcgcgcatggagggcttcttccagacgcacggcatcccgggagcgcaggaccgcatcgagcgcagcgatcgctacctgcggttcctccaactggagaaagagcacgacctggaggccctggattgggtgtgggagttccgggacgtgtccctggtcctcaccagcggcagccagggcacggagttcgaatccctgctgtggcgcgtgacggatgcccaggtggagcgcatctcccacgacttccggcggctgcaggaggctggcgccatggacccggagttggacgcgcgaatcttcgcctccatcatcgtcgggtccttcctgctgctctccacgcagatggcgcggctggatgagaagccggacctgaacgcgtgggcgaacacgctccagcggctgtgccaggagggcacccgtccggcgtcgcccgccccgtccaagcgtgttgcgcgccggccccgggccgccgccgagaaaccccgaaagaccccgaggaaacgctcgtga

SEQ ID NO: 5064 - DNA, 1059 bp, Myxococcus xanthus
atggccaccgccgtgctgtcgctgaccgcatgccagaaggcggatgcctcgtcgtcgccgcccgccaaggggtcggcgcaggaggtggtgcccacggtgaaggtcgtctccgcgcggacggtgcgggccgcgccgagcgagtcggtgacggggacgctgttccccgcgcagggattgatggtgggcttcgaggtgggaggccgcctgtcggtcgtccgggtgaagaaggggcagggggtgaagaagggtgacgtgctggcgcaactggacccggagatcgccgacgcgcaggtggcccaggccgaggccgcggtggccgccgcggaggccgcctccaccatggccgccgacgtggccgcccgcaacgagaagctccagcagcagggtggggtgagcgaggtggcccaccgcaccgccagcgccaatgcggcgcaggcgcaggcgcagtggatggccgccaaggcgcagctggctcaggcgcgcgcgtcccgccgccggcacgacctgcgggcgcccttcgacggcaccctcatcgacgcaccggagcagacgggcgcgacggtggcgccgggcacgccgctgttcaacctggagcgcctggacacgctactcttgaagacgacggtgtcggaggccctgcgctcgcagttggagcccggcgccaaggtgcgcgtggagtcggtgggcgcgcgcgtgtcctcggacgaggcggtggtgcgcaccatcctcccctccgcggaccccgccacgcgccgcatcccggtggagctggccgtccccaacgcggatggccgcttcgtggcgcacacgctggcgcgggcggtcctctcgctggggcaggtgcaggacgcccaggtgctgccgggcaccgcgttgtcggccctcaacggggaccatgtctgggtggtggcgtccggtcaggtgcgtcgcgtggacgtgcgggtgttggagcggcgcgagcagggcgaggtggtggtgctggcgtcctcgccgctcgactccgtcgttgaccaccccactccgggcctgtcgcagggcgcccgcgtctccgtgaagtag

SEQ ID NO: 5065 - DNA, 3099 bp, Myxococcus xanthus
tccatccgcaggcccgtcttcaccgcgatgttgtcgctgtgcctcgtcgtgctcggcctcatgggcctgggccgcctgggcaccgacctctatccggacgtgtccttcccggtggtggtcatcaacaccgtctacaaaggcgcgggtccgggcgaaatcgaaacgcaggtcatcaagcccctcgaagacgccgtcgctggcatcagcggcgtggacaagattcactcctacagccgggagaacgtgggcatcgtggtggtgcagttcaagatgaccgccccgctggaccgcgcggtgcaggacgtgcgcgacaaggtcgccggcatcgtcagtcgcctgccccaggacgcggacgcgcccgtcatcggccgcgtggacctgggggccacgcccatcctcacctacgccgtctcggcggagctgccctcgcaggagctgcgccggctcatcgatgaccgcgtgaagcccgcgctcgcgcagttggaaggcgcccccgaggtgcgcgtcacggggggagacacgcgcgaggtgcaaatcgacatcgatttggacaaggcgcgcgcggcgggcgtgtccccgctgggcatcgcccagcgcgtggcgtcggagaaccttgacctgcccgcgggccggctccagctgggcgcctccgagatgacggtgcgctcgctggggcagttccagaacgtggatgaaatccgcgacctgccggtggcacgcagcgcgacgggcgcgcaggtgcggctgggcgaaatcgccagcgtgacggacggcgtggcggagcggcgcaccctggcgcgcctcaacgggcaggacgccgtcatcctggaaatcgtcaagcagccgggctccaacaccgtcgcggtgagcgaggcggtgcggcaggtgatggcgcagatgggctcggtggtggggcatggcttccaggccacgctgctcatcaaccagtcggacatcatccaggagaacgcgcacgaggtctgggtggcgctcatcttcggtggcgcgatggcggtgctcatcatcctcatcttcctgctggacgtgcgcggcaccttcatctcggcgctggcgctgcccacctccgtgctgggcaccttcttcgtgatgtacgtgctggactacacgctcaaccagatgacgctgctggccctctcgctggccatcggtctgctcatcgacgacgcggtggtggttcgcgaggcgattacccaccggctggagaagggcgaggacccggtgagcgccgcgtccaacggcaccaaggacgtgggcctggcggtgctcgccaccacgctggcgctggtggcggtgttcgtgccggtggccttcatgcccggcatcgtcggccagttcttccggcagttcggcatcaccatctccgtggcggtgctgatttccctgttcatctccttcacgctggacccgatgatgtcagcgcggctggcgaagcggcgcgtgccgggcgaggtccgccaggagaacgcggtggccgcggcgctgcgccgcttcctggacggcaccgagcgcgtctacgagtccatcctccgctgggtgctggcgcacaagtggacgacggtgggcctcacgctggtgctgctggtggtgtccttcggaggcgccagccgcctgggcatggagttcatgcccgcggaggaccgctcacagttcttcgtggacctgacgctgccggactcggccagcatccgggagacggaggcccgcaccgccgacgcggaggtgttgctgcgccagcttccggaggtgacggacgtctactccatcgtcggcaaggacggcgatgtgaacaagtcccgcatgcgcgtgctgacggtgggcaaggacgcgcgcaccaagggcatccaggtgctgaaggaggacgcgcgagcgctgctggagccagggctggtgggcacgcgggtgaacctgagcgacccgcccatcctggagggcatgggcgactactaccccatcatggtgcgcatcaccggaccggacctggcgcgcgtcaacgaggaggctgagcgcgtcgcgggcatcctccgcgagctgccgggcaccgcggacgtgcgcgtggagtccaacccgcccaagccggagatgcaggtgctcatcgaccgcgcgcgcgccagcgacgtggacctgcacgcgggcgcgctggccacgcagttgcggctggccattggtggtgacgtggtggcgaagttgcgcgagggcatcaccgagacggacatccgcgtgcgcctgtcggagaaggaccgcgccacgccggagcgcgtgcgccaactggaggtgtacacgcccagcggcctgcgcccgctgacggacgtggcccgggtggagatgaagaacggccccagcctcatcgagcatgagaaccgcgagcggcaaatcgccgtgtactcacagttgggcccgggcgcggcgctgggcgacatcgcccgggagctgaaggcgcgcgtggcggcccagccgctgccaccgggctacgcgctcatctacgacgggcagatgaagaacctggacgagcagaacgacgccttcggcgcggcgttcggtctggccttcgtcttcatctacatggtgctcgccagccagttcgagtcctacaagcacccgctcaccatcatggtgtcgttgccactggccctggtgggcgcgctgctgggactggtggtcacgggcttccacctgtccatgggtgccatgattggcatcatcctgctgatgggcctggtgacgaagaacgcgattctgctcatcgacggcgcgcttcagaacctgcgggaaggcgacacggtggacgaagcgctgctcaaggcgggcccgcgccggctgcggcccatcctgatgacgagcgcggccatggccatcgccatggtgcccacggcggtgggctcgggcacgggttcggagttccgcgcacccatggccatctccgtgattggtggcgtcatcacctccaccttcctcacgctgctggtggtgccggtggtgttcgccggcatggagcgcctgggcttcaagcgccgccttccgcgcgacgatgctgctgcgccgccgcaccaggtggagcccaagcccggtcaggcggcctga

SEQ ID NO: 5066 - DNA, 558 bp, Myxococcus xanthus
atgccggagaagctcgtcttcgagcacaccttggagggtctcttcgtgcgaggactgggggcccgcgtcacccccgtgctccgcgagcggctgcgggaggtgggggtggacctggagcgcaagctgcagcccgcctacgcctttgaaacatggtgcttcgccgtgcgcgtggccgcgcgcgagctgcacccggacgtgcccgacgacgtgggctacgcgctgctgggtgagcgcctggtggacggctaccgggagacggtgctgggccgcgcggccttcggtgtgattcagctcctgggcccccgccggtgcgtgagccgggcccggcagatgttccgttccgggaacaactacacggagacacgcctggacgacgtgtcccccaccgaagtggacctgtggatgaacgaggccggggccatccgctacttcacgcaaggcgcgctacgcgcgggcctgcgcgccgtgggagcgccgcatgccgaggttcaggtgcgcgccttcaccgacgaaggcgtcacctaccggctcacgtggcgcaacggccacgaggcctga

SEQ ID NO: 5067 - DNA, 462 bp, Myxococcus xanthus
atggaccggagcgccgccgctggcatcatctcccgtccgctcctggggcggctgccgttgcgccggtgggtgccccaggacctgcactcgctcatggactacaagggcgggacggcctcggtggtggcgggggtgttgtccggagatgccgtggcgaagtccgcgggcattgccctggggtccaccatcctcggtgtgtcattgttgacggactaccgcatcagcttgaccaagctcatccccatcgaagcgcatgaaatcgccgactatgcctttggcgccgcgtccatcctctcgcccttcgtgctgggctatgcgaagcgcagcccgctggccgcggccatccacgtggcggtgggcgtgacgaccgtgctcgcgtcgctggtgacggactaccggtgccagacgggcatgcacctgggcggcgagctggcgacggacccgggggcgattggcgcgtga

SEQ ID NO: 5068 - DNA, 456 bp, Myxococcus xanthus
gttgccacggcgatgatgatgattcgccgtcccgtggcggacgtcttcgcggccttcgtggaccccgcaatcaccacgaagttctggttcagccggggcagcgcgcggctccagcccggcggcacggcgcagtggttctgggacacctacggcgtgtcggccaccgtgaacgtgttggacttcgagcccggcgcccgcctgcgcatcgagtggggcgacccgggtgcgatgaccttcgtcgagtggaccttcacggcgctgtcgccggaccgcacgtttgtccgcgtcgtcgagtccggcttccggggtgacgacaaggccgtcgtggcgcgggcgctggacagcaccgggggattcaacctgctcctcgccggggccaaggcctggctggagcacggcatcgagctcgcgctcgttccggaccatgtccccgaggacgcgcggcacctcgtctga

SEQ ID NO: 5069 - DNA, 294 bp, Myxococcus xanthus
atggggcgcgtgacggcgtgtgagccgccgcacctgtttgcctatacgtgggcggagaaccacggggacccgtcagaggtccgcttcgagctgaccgagcgcgaggacggcgtcctgctgaccgtcacccacgtgcgactcgatggccgggactccctgcgcagcgtggcgggcggctggcatacgcacctcgacctcctggtcgaccggctgaatggacagcgctcgccggacttctgggaagcctacgagcgcgtccacgccgaatacgtcacgcgcccgggctttgagtaa

SEQ ID NO: 5070 - DNA, 363 bp, Myxococcus xanthus
atgaagtacctgctgatgatctacgagaacgagaaggccgccgaggcgatgtcggaggcggacgtccagcgcgtgatgggggagtacggcaccttcgaggtggccatccagcagagcgggcacttcatctcgggcgaggaactggagcccacgacggcggccaccacggtgcgcatccgagacggcaagcgactgacgaccgacggcccattcgcggagacgcgggagcaactgggcggcttctttctcgtggaggccagggacctcgacgaggcgattggcatcgcgtctcgcattcccagcgcgcgcagcggctccatcgaggtgcggccggtgcgggaattcgccaggccccaggactga

SEQ ID NO: 5071 - DNA, 1221 bp, Myxococcus xanthus
tccattctcgaacgggcgcaccgtgaggattacgggcgcatagtggccacgctcatccgcgtgctggacggcgacttcggcgcggcggaggaggtggtgcaggacgccttcgccgcggccttgaatcagtggccgcgcgagggtgtgccgcgcgagccggccggttggctgatgcgtgtcgcgcgcaacaaggcggtggaccgcatgcggcggtccgctcgcctggaggcgcgcgtgggcgagttggaggcggtggcgccatccgtggacgacgccgaatggcagacgttgccggacgactcgctgcggttgctcttcacctgctgtcaccccgccttgtcacccgaggcccaggtggcgctcgcgcttcgttgtctgtgtgggttgacgacggagcagatcgcccgcgccttcatcgtgtcgcccgccacgctggcccagcggctggtgcgcgcgcagcggaagatacgcaccgcgcgcatcccctacgtcatcccggagcccgaggcgctggcggagcgcaccgagggcgtgctgcacacgctctacctcgtcttctcggagggctacgcggccacggacgggccggcgttgctgcgagtggacctttgcgaagaggccctgcgcctggcccggctggcgcgctcgctgctcccaggcgacgcggaggtggcgtccctgcgggcgttgatgctgcttcaccactcccgccgccgggcacgcgtggcggcggatggcgggctggtgctgctggaccggcaggaccgttcgctctgggatggcgcgcagcgggacgaaggactggcggagctgggagccgcgctcgccatgggggctcgggggccgtacacggtgcaggcggccatcgcggcgctgcatgcccaggctccgcgcgccgaggacaccgactgggcgcagattgccgcgctgtatgcgcggctggtggtgctgacgccggggcccgtggtggcgctcaaccatgctgccgccgtggcgatggcccgcggccccgagcacggattgtccctggtggatgacctggaggcctccggacggctggcggactaccacctgctgccggccgcgcgcgcggacctgctccggcgtctggggcgcaaggacgaggccgcgagtgcctaccggcgggcactggcaatggtccgcaccgcgcccgagcggcgtttcctggaagcgcggcttctcgaactgctggcggagtga

SEQ ID NO: 5072 - DNA, 1443 bp, Myxococcus xanthus
atgctgggctgtggtggtgtcgaggaggaagtgagcgccgccaccgaggaagcgcgggtccaggcacaagcctgtgctcccgggggcaccgtctacaaggtgaaggacatcctgcctccggacgcgccgctcccgtcccccaacgtgccggtgcccgactcgctgacgaacgtgcagggcacgctctacttcgggtcggacctctacggggaccgcgccaccctgtggcgcagtgatgggacctccgtgggcaccgtgcccgtgaaggagttcatcgcgccgggaccgggctaccggggactgagcgagttcacgccggtgggcgcccgcctcttcttcatggtgaatgcgtcgccatttggaagggagttgtgggtcagtgatgggacgggagcgggcacgcggctcgtcaaggacctcgagccggggacggccagttcctcgctgtcctacctgggacaggcaggggacgtgctgaccttcttccggaacccctccgcgggagccggggtgtcgctgtggcgctccgatgggacggaggcgggtacgttccagctcatggcctacggaccggaccaggaggtgtcgtcacggccactggaggtggcgggggcgcgcttgttcaccatgagcagcacgggggcgggcacctggctgtggcggacggatggaacggccgcgggaaccaggcgggtcaaacgtctggacgcggagcggatctatatctccggctgggagcacaccgagacgggcgtgggggtcttcaccttctgggactcgggggccatcaccgaggtctggaagacggacgggactccgggcggcaccgtgcgcctggagtccttcggtggcgatgtccggctgctgggggccctgggtgggcacgtctatctgtcgtccgtggtcgggggagggacatccttgagggtgtcgagggtgtcgctcgcgggcggtggcaaggagacggtgaccacgctgcccaaccgctacgcgggccagcccggcgcgtggcccttcgcgcagatggcggtgcgcgcgggcgggaagctctatctgtccgtgggcatcggcacgcccgggcccgcgcctcgtgaggtgagcctctgggtgacggatggcacggcggccgggacgcgggagctcagccggggcctgtcgacgtccgatgagtgggcctcgccgctcttcgacaccggcgccgggacgctgctcttcagcacgaatgagggcggcacgggtctggagccctgggtgacggacggcacgcccgagcggacaggtctcgtcgcggacctcagtcccctgggcggctcctcacccgaggacttcacccgcgtgggcagcaccgtgttcttccgcgcctactccaacgcctggggtgacgcgctgtgggccatgccgaccaacgtggcatgccccacccaggagctcctcgcgcgctga

SEQ ID NO: 5073 - DNA, 271 bp, Myxococcus xanthus
atgcaggccaatggtgcgagcctggtggtcgaactcaagacggtgcgtgacgtcagcgcggtggtcgtcaccgagtcgtctccggtggcgttctggcccttccagaagaacgacgtcatcgtgcgcatcaacacgaagcagatctcccgcccgtcggacatcctcttcgtctggcgcaccggagcgccctcgtccttcgagttcgagggcctccgaggcggaacgcgtctggtgttcactggcacggcggcggagtttccggtgctggccc

SEQ ID NO: 5074 - DNA, 171 bp, Myxococcus xanthus
atgattcccatcagcgacgacaaccccaccctccgcactcccgtcgtgacatacctgctgctcggcaccatcggcttcgtctgggtcttcatccagggcgcgggcctggacgcctaccggctggccgccagcgtctgcaacctgggcatggtgccgggcgagctgacgggc

SEQ ID NO: 5075 - DNA, 915 bp, Myxococcus xanthus
ctcaggctcacgttccttggtacatccgccgcgcagcccacgctgcaccggaacctgtccggactcgcggtgaaggcgcactcagacctgctgctcttcgactgtggcgagggcagccagcggcagatggtgcgctacggcaccggcttcaccgtggacgcggtgttcttcacgcatttccacgcggaccactacctgggcatcatcggcttcctgcgcacgctgggcatgacggggcgctccgagcccatccacctgtacggcccgccctccgcgaagcgcctgctccaccaggccgtccacctgggcgtggagtccatgtccttcccagtggagattcacgaactgaaggacggtgacgtggtgccacgcaagggctacgcggtccacgcggtgggcgtggaccaccgcatcaacgccctgggctacgcgctggtggaggacgaccggcccggacgcttcaacctggacgtggcgcgctcactgggcgtgccggagggccccagcttcggaaagctccagcggggcgagccggtgacgctggaggacgggcggacggtgaagccggaggacgtgctcggcgcgccacgcccggggcgccggctggtcatctccggggacacgcgcccgtgcccggcgctggtgaaggccgcgaaggacgcggacctgctggtccacgagtccaccttctccgacgacgaacaggagcgggccgtggagacccggcactccaccgcgcgggaagcggcgcgcgtggcgcgagaggcgggagcacggcggctggtgctcacccacctctccagccggcacgacaccgacccctcgaaactgctcacgcaggcgcgcgaggagtaccaggggccggtggaggtggccttcgacgggttcaccgtcgaattacccctccgggactga

SEQ ID NO: 5076 - DNA, 756 bp, Myxococcus xanthus
atgaaagccacgccgctgccggggaagaagaacttcctggcggaggccggtatcgccacaccggtgcccaccatccgagggtcgattggcgcggtggcgcatgaacccttcatggccttcgacaccaagcggctgatggacctgctggtggccttcaccatcggagacttcccggagcgggccggttgctccaactacttcaacccgcacagcccctggtacaacgtcttctacggcgcctacggcatccgctcgtacaagcgggatggcagcccgtggggattcacccgcgacggccgcccggacctggacgagatgctggagattccgcggctcgactacaacttcctcacggccggggagctgggctgccccgcgtcgaagatgtgcttcgaggtgctggacgtgcgccagggccgtgaaggcccgtggcacatggcggaggtgggctgcatcatccccagcggactgcaccgggtgcaggacgcgcaggcgccggacctcacgtactacgccgtgttcggcgtgccagaggaggactacctcgtgggcggccgggagagctacgagccggtccgcatgcgcgggcgaatgtacttccgcccggtggccgaacgcctcacgctcgtctggggtggactctgcccggacacgcccgacggccagcggctgatgggcgccatcctggatacaatggcgccgctgtacgcgggggggatgaacgccccccgagcctgtggacctcaggccgcctga

SEQ ID NO: 5077 - DNA, 279 bp, Myxococcus xanthus
atgcgtgggctcaggaccctggagccggagtccgccagcctcttcggagaggtggtggcctacggccggcagatgggctgcgtcatgtgcgcgcacgtctcggattccaccatcgcccggctgcagacggcgcgggtggcctcggcggcggcggcggacaacaacatcacggtggactgcgtgtcgctggaggaagcgcactcgcagctcgccaaggcgcgctcgcgctacttcctgggcgcgacgccggaagacgcggtggagcacgcggcgcgctga

SEQ ID NO: 5078 - DNA, 567 bp, Myxococcus xanthus
atgcgcctgccccgcttcccgcgtgtcatcggcttcgacgacggccccttcgcgcgccgccccggcgccgccgtgcccctggcgggcgtggtgtgtggaggcacgcgcttcgaagggctcgtctggggacgggtgcgccgcgacggctggaatgccacgcgggaggtgtgccggctgctggaaggcgggaagttcctcccgcagctccacctggtgctgctggatggcattgcgttcggcggcttcaacgtcgtggacctgcccctgctggccagccggctgaagcggccgtgcgtggcggtgatgcggcggccaccggacctggacgcggtggagcgcgcgctgcggcgtctgcctcgcgcggacgcgcgctgggcgaagctgaagcgcgcgggtcccatccaccaattgggaggcttcaccttccaggtgcagggcgcggagcccgcctgggtggcggaggcgctggcgcgcgtgacggaccgcggcctcgtccccgaggccctgcggctggcacacctcatcggctccgccgtcgtgaccggtcagagcagtcagcgcgcctga

SEQ ID NO: 5079 - DNA, 2975 bp, Myxococcus xanthus
atggaccgcggctggtggtggaagttcggactcatcgtcgcggtgacgctgggctgcatctggttcctcatcccgacctactactcgctcgtcgttctcgaccgggagcagcgcaacaacctggccgtgctcgaggagcggatgcccgcctgggcgcctcccgcgaagtaccgcctgaacctggggctggacctccagggcggcatccacatggtgatgcgggtggacaccaagacggcgctccagaagcggaccgagcgccgcgcgcagcagattgtcaattacgtcaatgacaagaagctgggcgaggtgtcggcggacacggacccggagaagctcgaggtcaccctgacggcgaaggacccggggaccatggacgccatccagaaggaggtcctggccaccttcactgacttcaaggaagtcagccgcagcggcgcctcgctgacgctggtgcaggacgagagtcaggccaacgtcttccggaccgaagcggtggaccaggcgatgctcgtcatccgccgccgcatcgacaagtggggcgtggcggaagtggatgtgcgcaagctgggcgccgactccatccagatttcgctgccgggccgcagcaacccggagcaggcgaaggagctggtggggaccaccgcgcagctcgagttccggatggtggatgactccaacccgcagttcttcgcgcagctgctccaggccaccccgccgccggctggcagcgaaatcacgctgacgacggagggcggcttcccgcagctccaggcccccacgcgtgaggccatcaccgagtacacgaaggacaaggtgccggagaaccgggtggtgctcaccgagtgcatcgccaacccggtgaagaagaacgagtgcacctcgtaccgctcctacctgctggacaagaacgtgccgctgaccggcgagagcctggcgagcgcggacgcgaacatcagccagctcaacgagccggaggtgaacatctccttcgaccccgcgggcgcgcgcgagttcgagcggctgaccgagcagggcgtgggccgccgcatggccatcgtgctggacgagaacgtccagacggcgccgaacatcaacgagaagatcagcggcggttcggcccgcatcaccatgggccgcatgggtggccgcaccttcgaggagtggctgggcgaggcccagacgctggcgctggtgctcaaggccggcgcgctgcctgcccctgtgacggtgggtgagattcgtcaggttggcgccagcctgggtgacgagctcatccggaagggtggcatggcggcggtgctgggcctgggcctggtcatcctcttcatggccatctactacagggcctccggcctcatcgcggacctcgcgctggtgctcaacggcctgctcatcctggcgggactggccttcttcaacgccacgctgacgctgccgggcatcgccggcttcgtgctgacgctgggggtggcggtggatgccaacgtgctcatcaacgagcgcatccgcgaggagctggggcatggcaagtcggcccgggcggcggtggaccagggctacgaccgggccttctggaccatcttcgactcgcacgtgacggcgctcatctccgccttcatcctgttcttcacgggaaccggaccggtgcgaggcttcgccaccacgctcatcatcggcctgctggcgtcgctgttcacgtccatcacggtgacgcgagtcatcatgacctacttcgtccacggtcgtaacgcgaaggtcgtctccgtctgaccggccggagtccgggaaccgtcatgcagattttcaagaacaagacgaacatcgacttcatcagcaagcgcaagcccgcgctgtttatctccacgctgctgaacctggcgatcatcgtcggcatcgccgccttcggcttcaacttcggcgtggacttcgcaggtggcacggtggtggaggtgaagttcgaccaccccatcaccgccgaggaggtccgtgagcgcgcggacaagggcggcctgccagacgtcagcgtgcagaacatcggcgcggcggaggagaacaccttcctgctccgcatgggcggcgtcacgcagctcaacgaggagagcggtgccaagggcaaggaggccctggaggcgctggggggcgtgcgcaacgtctactcggatctgcccaacggcatcatccgcttccgcgcggcgcagcccatggactccgacgccgtcaagaaggcggtggagtcggcgggcatcggcgtgcaggaagtgcgtgacctgggcgaggcccagggcggcacgggctacgactaccaggtggtggccagcggcatggcggaccgcgtgttcgccgcgctcaacgccggactggagaagccggacttcgagcagcgccgcgtggactacgtcggtccacaggtgggcaagcagctgcgcaaccgcggcatcatggcgctgctgtactcgatggtcgccatcctcatctacgtggcgttccggttcgacttcaagttcggtccgggcgcgctcttgtccatggtccatgacgtcatcatggtggcgggctactacctggtgagccggcgcgagttcaacctgacggccatcgcggcgctgctgacggtggtcggctactccgtcaacgacaccatcgtcatctacgaccgcatccgcgaggacatggccaagtacaagggcaagcccttcgcggaggtcatcaacatcgccatcaacgacacgctgggccgcaccatcctcacgtccggcaccacggcgctgtcgctcatcggtctgctcatcttcggcgtgggcgaaatcttcgacttcgccatggcgatgctggtgggcatcgtggtcggtgtgtactcgaccatctacatcgccagcccgctgaccatctggctggacgagcgcgccgcggcgaaggacgcccgtctgcgcgccagcggcaacgtggaccaccagcagccgaacgccgcgtga

SEQ ID NO: 5080 - DNA, 204 bp, Myxococcus xanthus
atggcaaccggtaccgtcaagtggttcaacgatgcgaagggctttgggttcatcgtgcaggacggcggcggtgaggacgtgttcgtccatcacagcgcaatcaacatggatggcttccgcaccctgcaggaaggccagaaggtggagttcgaagtaggccggggccccaagggtctgcaggcgcagaacgttcgcgcggcctga

SEQ ID NO: 5081 - DNA, 342 bp, Myxococcus xanthus
atgctgacctcctgcgggcccgtgcccaccgaggagcagacccagggagggaacgacgtcaccgccgaggaccacttccgcacgcaggaggccgcgctgaccggtgactgtttcgtgcagatcgagtgcgagggcgggaatatcaagtcgtgctccggcacgggcttcgcctgttcggccaacagcgccaacggcggcaccgtgacttgcaacggcaaatcccagagctgcaggcccatcatccaggagcccatctgcagctgccgggcggatggctgctgcaatcagctgtgcgccatcagcgacccggactgccgcttcgtccccgaagggccgaagtag

SEQ ID NO: 5082 - DNA, 972 bp, Myxococcus xanthus
atgaagtacacgcaattgggccgctcggggctctccgtcagccggctgtgcctgggcaccatgaacttcggttggacggccgaggagccggagtcccacgccatcatggattccgcgctcggccacggcatcaacttcttcgacaccgccaacgtctacggcttcggggagaacaagggccgcaccgaggaggtcatcggcaactggttcgccaagggcgaccggcggcgcgagcgcaccgtgctcgcgaccaagctctacgcgcccatgggtgactggcccaacgagggcaagctgtccgcgctcaacatccgccgcgcgctggatgccagcttgaagcggctgcgcacggactacgtcgacctctatcagttccaccacatcgaccgcgccacgccctgggaggagatctggcaggccatggaggtggccgtggcgcagggcaaggtgctctacgtcggcagcagcaacttcgcgggctggcacatcgcccaggcccaggccgtggcggcacggcgcaacttcaccggactggtcagcgaacagtcgctctacaacctgatggcgcgcaccgtggagctggaggtgttgccctccgcgcagttccatggcgtgggcatcctcccctggtctcccctccagggcggactgctgggcggcgtgctccgcaaggagcgcgagggcaagcgccggctggaaggacgcgccaaggaagccctccagaagcaccgcgaccgcatcgagcgctacgaggcgctcgccgacgagctcgggcatgagcccggtgacgtcgcgctggcgtggctgctgcaccagcccgctgtcaccgcgcccatcatcggaccgcgaacctccgcccagctcgatgccgccgtccacgcggccggtgtcacacttgatgcgaaaacattgtcacgcctggatgacatcttcccgggccacaagcccgccccggaggactacgcttggtga

SEQ ID NO: 5083 - DNA, 810 bp, Myxococcus xanthus
atggctaagtttcgctccattgcgcttctggcaggcatctccgtccttggctccgcgtgcggcgcccctgagtccgagacgcaggatacgcagcaggtctcgttcgaggagttccgcgccggcgcgtatcaggagcccgagtccggcggcttcgtcgtcgacggtgacatcttcctgccgacggagtcggagctgcgcgagttctacgagcagtccgtcggcggcattggaacgcagcagggcgcgctggccgtgtattacagcggtggacgcgacatcaagtggagcgccagccaggccctcaacctcacgtactgcgtgagcaccaagttcggcggcaactacacgcgcgtggtcaacgcgatgaagagcgccgcggcggagtgggaggcggccgccaacgtcaagttcgtccacgtcagcgctgaagactcgaagtgcaccaaccgcaacaacaacgtcgtgttcgacgtgaaccagaccaacacgtcccagtacctggcgcgcgccttcttccccaacagcgcccgccgcagtgccaacgtcctcatctcgaccacgtccttccagaacatctcgccctggacgctggagggcgtgcttcgccacgagctgggtcacgtgctgggcttccgccacgagcacacccgcctcaccagcaccggctgctacgaggacaacgcctggcgcgcgctgacgccgtatgacgccagctccgtcatgcactacccgcagtgcagcggtacccagacgggcgacctggtgctgaccagcaacgaccgcagcggcgcccgcgcgctgtacccgtaa

SEQ ID NO: 5084 - DNA, 615 bp, Myxococcus xanthus
atgcggcgggagcatgaaggggcagcggtccggcgcgagttcttccgctcggcatacctgctgggcgcaccctgggacatcggacggccccaacaggccttcgtccagttgtgggaggccggcgcgatttccggcgaggtgctcgacgtgggctgcggcttcgcggagaacgccctctttctggcggccaagggcctgccggtgtgcggcgtggacatgatggagccggccatcctgcgagcacgcgagacggcctctctgcgcgggctcgacgtggacctgcgtgtgggcaacgccctggagctggccacgctgggccggcgcttcgacaccatccttgattcggccctgctccacgtcttcgagcctggagaccggcccgcgttcgccgccagcctcgcgagcgtgctccggcccggcgggcactaccatgcgctgtacttccgcgacggaccgcgcgccgttccaccggaggcactgaacgcgaccttcggggaaggctggcgcgtgaagtccatccaggaggcgcactacgagcagaccgacccggagggcgcgcaggcctggctcgccaccatcgaacgggtgcctccttcgtcatcgacagaggactga

SEQ ID NO: 5085 - DNA, 1338 bp, Myxococcus xanthus
cttccgccggggccccagggccacttcattgctggcaacctggtggagttctccgaggacccgctggggttcctcacccgctgcgccagggagtacggcgacgtggtgcgcctggggaagcgcaacttcctcctcaatcacccggacctgattgaacgcgtcctggtcaacggcgacggcaactttgtgaagctcgccggagtgggccaaggcaagcgtcacaaaggcggctttcccgaagcgatgatgaacagcgagggcgaggactggctgcgcaagcggcgcctcgtccagcccgcgttccatcgcaagcacgtggccgcgtgtggtgacaccgtggtggccctcaccgaaacgatgctccagacgtggcgcccgggcgacgcgcgggacgtgcacgcggacgtgtccgcgctggcgctcgacatcgtcagccgattcctcttccacacgcccatcgacgacgaggcccgccacgtggccgacgccgtggacgctgtcatgcggcacaccgacagccccctgcggccgcccatctgggtgcccacgcccaccaacctccgcctgcgccgcgccctgggccggctcaacacgctgctcgcgacgctcgtgcgccgctatcgggagcaaccggagtcgcgcacggacctgctcgccctgctgctgtccgctccggtccccctctccgagaatcaactgcgcgatgagctggcgacgatgatcatgtccgggcacgagacgacggcggacgcgctcgtgtgggcctggtacctgctggcccagcacccggaggccgaggcccggctggtggcggagctggagacggtgctcgggggccggctccctggcgccgaggaccttcctcgcctgcgctacacggaggcggtggtgaaggaggccatgcgcctgtactcaccggcgtggatcaccagccgggaggcgctgcgcgactgtgagctcggcgggttccacgtcccagcgggaacgatgctggcggtgagccagtgggtcacccaccgcgacgcgcgctacttcgacgcccccgagtccttccgtccagaccgctggctgtccgaggacgcccaacgcatgcaccggtacgtctacttcccgttcggcggcggcccccggttctgcatcggctcggcgctggcgatgatggagacggtgctcatcaccgcgtgcgtggcacggcggttccggctggagctggcaccgggctgcgtggtgcggccccggccggcgctcgcgctccagccgctcggggtctggctgattccgcggcatcgctctcacacaacacaggaaggcgaggtgcggcatgcggcgggagcatga

SEQ ID NO: 5086 - DNA, 759 bp, Myxococcus xanthus
atgatcgaggcgaagaacgtcagcaagcgctacggtgaaacgctggtggtggatggcgtcaccctgagcctgcccgtgggcggcgtcacctccatcatcggccccaacggcgcgggcaagtcgaccctgctgtccatgatgagccgggtgatgcccatgtcatcgggcaacgtttgggtggacgggctggacgtcaccaccacgccgggggacacgctcgcgaagcggctggccatcctccggcaggacaaccacatctccgcccggctgacggtgcgtgagctggtgaccttcggccgctatccgcacaccaagggccgccccaccgtgcaggaccgcgaacacgtggagcgggccatcgagcacatggggctgagcgcgctcgccgaccgcttcctggatgagatgtccggcggccagcgtcagcgcgccttcgtggccatggtgctctgccaggacacggaccacgtgctgctggacgagccgctcaacggcctggacctgaaacacgcggtgtccatgatgaagcggctccggcacgccgcggacacgctgggcaagagcttcgtgctggtgctgcacgacatcaacttcgcctcctgctactccgaccacatcgtcgccatgcgcgacggcaaggtcgcgttccagggccgcccggaggacatcatgcgccccgacgtcctgcgcgccatctacgagttggacatctccgtgcagcagattgaaggcgactggattgccacccactaccggtga

SEQ ID NO: 5087 - DNA, 912 bp, Myxococcus xanthus
gtggccgtggccttcatggccctgttcatgctcgtcgacgtgagcggcccgtgggacttcgtgctgcccttccgcgggaagaaggtcgccaccgcgttgctggtgggctacgccgtcgccgtctccacggtgctcttccagacggtgacgggcaaccgcgtgctgacgcccgccatcatggggttcgactacctgtacgtgctcatccagacgtgcctggtgttcttcctgggctccaccaccgtggcggggctggacccccggttcctgttcggcgcggaggtcatcatcatggtggccttctccgccatgctgcacggctggctcttcggcatggcccggggcaacgtccacctgctactgctcactggcgtggtgatgggcgtgctgttccggagcctgtcgtcgttcgtccagcgcgtcatcgaacccaacgagttcatcttcctgcaggaccgcttcttcgccagcttcaacgacccggagcacgacctgctgctgctctccgcggtgctgacgctgggggtctccgtgctgggcctgcggctgctgcgcgcctgtgacgtcctggtgctgggccgggaggccgccatcaacctgggcgtggactaccagcggacggtgtcatgggtgctggcgctggtggccatcctggtcgccgtgtccaccgcgctggtggggcccgtgacgttcctggggttgctggtggccaacatcgcctacgcggtgatgcggacgtaccagcaagcgtttgtcctccccgccgccgcgcttattgccgccatcgccctgatcgccgggcagttcatgctggagcgcgtcttccgcctggacaccaatccacgggtcatcatcgagttcgtcggcgggatggtgttcatcgcgatgctcatgagaaaggccacgagatga

SEQ ID NO: 5088 - DNA, 903 bp, Myxococcus xanthus
attggcgccagtgacgtgtcctggcgcgccctcttcgctcccgagccggatgagcgcgccctccaggtgctggtcatcagccggctgccgcgcctgttcgccgtcatgctggcgggcacatccctgggcgtcgcgggcctcatcatgcagatgattgcccgcaaccgcttcgtggagcccaccacagcgggcaccgcggagtccgccagcctgggcctgctgaccgccaccctgctggcgcctggccttccggtgctcgggaagatgatggtggccaccgtcttcgccctcgcggggacggcgctgttcctgctggtgctgcggcgcattcccctgcgctcggccctcatcgtcccggtggtgggcctgattctgggcggcatcatcgattcggcgacgaccttcttcgcctaccggtacgacctgcttcagacggtcaacgcgtggaccacgggtgacttctccaccgtgcttcgcggccgttacgagctgctgtgggtgacgctgggcctcacctgcgccgcctacactgccgcggaccgcttcaccgtggccggcatgggcgagacgttcaccaccaacctggggctgaactacccgcgcatcgtcgcgctggggctggtcatcgtcgccctggtcaccgcgatggtggtcgtcacggtgggcatgattccgttcctgggactgattgtccccaacctggtcagcatggtcatgggcgacaacgcgcgcaggtccattccctgggtcgcggtgagcggcgcggccttcgtgctgctctgcgacatcgtgggccgcgtggtgcgccacccgtatgagattcccggaggcaccatcgccggcgtcatcggcagcgtgctcttcctgtacctcctgctgaagcgaggcgcccgtgccggctaa

SEQ ID NO: 5089 - DNA, 837 bp, Myxococcus xanthus
acggtgacgcacggacaaggcaccaccgtcgtcccgctgaagccgcggcgggtggtggtgttcgacctggtggcgctggacatcctccaggccctggaggtggacgtccacggcgtggcgggcgacatgttcccccagcacctgacccggttccgggacgcgaagtacccgcgcatgggcaccctgttcgagcctgactacgaggcactccaggccgcgaagccggacctcatcatcaccgggggccgctccagcgcgaagtactcgaacctctcccgcatcgcgcccaccatcgacgtgccgatgagcggcaaggacttcatcgcctcggtgattgccaacacggagatgctagccagcgtctttggcaaggaggagaaggcgcgcggcctgattgaggacctgcgcaagtcggtggcggacctccaacagatgacggcgacacgcggcaaggggctggtcgtgctcgtcaccggagggcgcatgagcgcctatggcccgggttcgcgctttggcgtcatccatggtgacttcggcgtgcccgaggccgtcgagggcctgcgcacctcgctgcacggcgagtccatcagcgcggagttcatccgggagaagaatcccgactggctgttcgtcatcgaccgggacgccgccaccggtcagaaggaaggcaatgcccggcaggtgctggacaatgaattggtgcggcagacgacggcctggcagaagaaccaggtcatctacctggaccccggcgtcacctacctgaccggcggcggcatccagtccgtcaagcagctccgcgaccaggtcgcgagcgcctacacgcaggcccagtag

SEQ ID NO: 5090 - DNA, 1392 bp, Myxococcus xanthus
cgtgccgtggtcatgggcggcagcatggcggggctgctgagcgcccgcgcgctcgcggaccacttcgagaaagtcgtcatcctggagagggactcgctccccggcatgcacgcggcgcgcaaaggtgctccccagggcacacacgtccacgtgatgctggacgcgggtcaccgcctcctggagcgcttcttccccggcctcctccaggacctccaggaccagggggccgcgctcatcgattcgagccgggacgtcgcgtggcaccacttcggcgtctggaagtcgcgcgtcccccaaggccttcccctgctggtgtgtacgcgtcccttcctggaatggcacgtgctgcgccgggtgctggcgctgcccaacgtcgagtttcacggcggcgtctcggtcgaagggctgctcacggacgcctcccaccagcgcgtcaccggcgtgcggttgaagaaggccggcgtggaggaaccgctggaggccgcgctggtggtggatgccacgggccggggctcgcgtgcgccccagtggctggaggccctgggccatgcacgtcccgacgaggaacaggtgcgggtggacctcgcgtacaccacccgcctctacgaacctcccgcgcaccgccaggaggactggaaggtgctcatgcagtacccgtgtccgcccgtgaactggcgcgccggcttcatctcccgcgtagagggggaccgctggattgtcaccctcaatgggtacttcggcgagcacgcgcccgcggacgacgaaggcttcctcgcgttcgcccgctcactgccccagccggacctgtacgcctgcctgcgggaggcccggccgttggggccgctcaccctgcacaaggtgaaggagagccgctggcggcactatgaacgcctcgcgcgcttcccggagaactggatcatcctcggtgacgccgtgtgtgccttcaaccctgtcttcggccaaggcatgtcggtggcggcccagggcgcggcgcagctcctcgcctgcatcgaagagcaggccaggcgcttccccacgacgctcgacggactcgcccagcgcttccgcaagcgcctgtccgacaccatccgcctgccctggttcatgggcacgaacatcgacctgcagtacccgaaggccgtcggccagcggaagcccggcgtgggagtgctgcactggtacatccggcggatgatggagcgcagctcccgggacgccgccgtgcaccggcagttcaaccgactcctgcacctccaggcggggctgggcgccgtcctccagccttcggtggccctgccagtgctcgcggacggcgcccgcgcgctcttcatgcccctgcatgcgcgggcgaacacggacatccgcccggccccgccctcctcatctccatga

SEQ ID NO: 5091 - DNA, 324 bp, Myxococcus xanthus
atgaagacctcccgtctcatcgcctcgctgaccgcgtgtctctccttgtcgctcatcgcctgcggtggcggagaggccaacctggacgtccccgaaggtgaggcccccgtcagcgtcgagcagggcctgggctacccgccgcactgccccaatggagacctcatctactggctcgagaacgtgcaggcctgtacggcgaagtgcggaaacacgcgtcagaacggccagcccgcgacccagtacgcggcgtgtcagtccaacatcacgggcacgcgcacgctcatcaacgtgcgttactgcatccccggctgcgaactgctttga

SEQ ID NO: 5092 - DNA, 1083 bp, Myxococcus xanthus
ccgccagcgcccgaatccgcacgcagcccttcgacagcggcctgcgctgacaacaaccccctcgcttcgttgccaaccatgtgggcacttcagaataagacaccctacgcggccgagcggacgtgggtccgcgacaaggacggccaccaccactgggttgtcgccgtcaaggccaccttcgacgtcgacgacgcgggccgcctccgccctgccgacgagcaggagcctccactgcccgcgcccgtctactggggagaggcgggccactccagcttgcgcttcgaggccgagctcgtcgcccccaagccccacacagacgtcctcgtcaacgcgtgcgcccatgcgcccggtgaacggcccgcgcccagcgtcgaggtggccgtccgcatccacgacgtggacaaaatgctcgtggtgcacggggagcgctactacacgcgcggcctgacgggcgtgaagccctcgtcccccaagcccttcgtcacccagcccattctctacgagtgggcctggggcggcaccgacacgcacgacgccgacgcgcgcaagcacgtcagcgacatgcgaaaccctatcggccaaggggtggccagccgcgaggcgcgcctggtggaccagcccgcccaccgtatcgaatacctgcggggccacccggcgaagtccgggccggccgggtttggccccatcgccagctactggtcgccacggctcgagctggccggcaccttcgacgaagcctggaggaagacgcgacacccgctgctgccgcgaaacttcgatgagcgcttcgccctatgcgcccctgctgaccagcgtccctcacgccgcctcgtgggcggagagaaggtggccctggtgcacctcacgccgaagggctcgctccacttcacgttgccccgcctcagcttcggcttcgccacctacttcggcgccgtccgacgcttccacgaggccaccctgggcaccgttgtcatcgagcccgaggtgaagaaggtgcgcatggttctccagacgggattgagcgtcggcccccgggacgtcgaccgcctcgacttcacagccattacggaaaggacggactga

SEQ ID NO: 5093 - DNA, 1092 bp, Myxococcus xanthus
atgagcggtgaggcggtacttgtggcgtcgggagcacgtgctccggtggggacgacagcggagagcgtcgcggcggcggtgcgtgcgggcatcagccgcgtgcgactcctccaggtgccggagctggggcggcaggcggactccttcatcgcgagggacgggctcctggacgcgcaggagtggtgtggcgtgacgcgcatggccgcgctgggggccgcggcgttggacgaagtcctcgccaagctgacacccgccctcccgccgaggagtctcgacgttccggtgctggtgggccttcccgaggagcgcccgggctggagggcatcggacgcctcgcgagtcgcctccgccctctccgccctcggaagtgcgcgcctgaacctccaggtggagccgcggttgacgggccatgcctcggcgctggaggcgctacgagacgccgtgactcgggttggccacacctctcgctgcccactggtgattgtgggaggcatcgacagctaccacgacgtccagacgctggcctggcttcgcgagcggaaccagtggctggaagaagggacgcgcatgggcttcgcccccggcgaggccgcggccttcgtcgcggtgatggccacgccggacacacgtcggtggagactggctccccacgccacggtgcgcgccgccaccacggcccacgagacgaaactcatccacagcgacgacctcaacttgggcgaggggatgacggccgccgtggccgaggcactcgcgccactggaaggcacgcgtgaagtcgtggaggacgtccacagcgacctcaatggcgagcgctaccgcgccgaggagtggggcttcgtcgccctgcgccttggggccgcgttccgcgacgccgccgccgtccacacacctgtgagcagctgcggcgaggtgggtgccgccacaggggcgctgaacctcgtcatctgcgcgcaggcctggcagcgccggtacgcgagcggcccacgtgcgctactctggggcagttcggaagccgggttgcgcgccgccgcactgctggaagagccactttccggaagtgaagaaggagcgaaaccatggccaaggtaa

SEQ ID NO: 5094 - DNA, 348 bp, Myxococcus xanthus
atgtacgtggggctggaggaattcctctactacgaagccttcaaggagcttcgcctgccacaactacccttccggcggaagttctcgtcaccggatgacgccgctgccgcagctcgctaccgggccgacgcggtgactgcgctggccgaggagaagggcttcaagcggctccctcctgtcgagcactgcgcgctgtacgagcgaggagacgcagcgctgctgctctaccgacatccgacgcagcccaccttctcgttcatcctgggctgcgaggactcggcggagatggagcgactggcccaggatttcgagacacgaacggggctgaagagcgtcatcacgcggtag

SEQ ID NO: 5095 - DNA, 1768 bp, Myxococcus xanthus
atgctgttctcgcgacagcgtcagctcctgcagctcctcgacgccctcggtgggacggctggcaagctcgacttccagaagctcctgttcctctactgccaggagcagccgacgaacgcaccctacgacttcgtgccctacaagttcggtgcgttctcgttcacgtcgtacgcggactgccgcaagctggtcgcacacggcctcatcgaggacgacgatggatggcggcttaccgacgcaggcaggaaggttatcgggcgcactcccgaccttcaactctccgctttcgcgcgcagtcatcggctacgcggcgacgagttggtcgtcgacacgtaccggcgctacccgttctttgcgacgcgcagcgagatcgctgagcgtgtgctcaagggcgacgaagctgcgctcgctcgcatcgaggtggtccgcgcggcgcgctcaaactccgcgctgcatacgatcggctacgagggccactcagtcgagagctacttgaatgagctgctccagaacggcatcacgatcctctgcgacgtgcgtcgcaaccccatcagtcggaagtacgggttctcgaagaacacgctcgcacgcatctgcgagaacgtcggaatccgctacgagcaccttcctgagctcgggattgcatcggagcagcgccaggggctcgacactcaggcagactacgacgcattgtttgatgactacgagcgtacatggctccccaagcaaggcaccgttcttgagaagatccgcacgtgggtaggcgagaaggagcgcgtagctctcacctgctacgagcacgctccgaaccagtgccaccgccactgcgtggccgaagcgctcgaagacaagttcggcaaggattacaacgccaagcatttgtgagagggcggggccaaaatggaaaagcagcgcgttctcattaccgtcaagacgtaccccacgctctctcggaagtacggcgagacggtgtgcacggcaggcgtccgcaaggatggcacttgggtgcgcatctatccggttcccttccgccgccttgatgagaaggagcagtacagcaaattcgactgggtcgagtgccgccttcagcgaaataccgtcgacgtgcggcccgagacctaccggcccgtggatcagcacgagctcgtgcccgtcggcgagatggacacgagccacaactggagtgagcgtcgggacctcctgctcaaaaagtcccgcgtctacgacaacctcaaggaactgatcgccggcgcgaaggcgaaccagatttctctcgccgtgttcaagcccgcgcgcatccacgactttatcgtcgaagaggacgagcgcgactgggatatcaacaaggtgcgcgagatgcgcgaggcatcgaggcagcacgaactcttcgaagacaacacctggcgcgagaccttcagagtgatcccgaagttgccctacaagttctcgtaccggttcgaggacgcttcggggaaaaagagcgagcagcagatcctcgattgggagatcggcgcactctactggaactgcctcaatcgcgcgaacggcgacgagcgcaccgcaatcgccaaggttcgccagaagtacatggacgaattcctcaagaaggacctccatctattcctcggcaccacgcagcagtggcaccaagtggctccgaatccgtgggttatcatcggcgtcctgccgataccccacgaaaagcagctcggccttttctgaggctccaaaacctagtgcgcctaccccatactcgctcgccgcgtca

SEQ ID NO: 5096 - DNA, 240 bp, Myxococcus xanthus
atggtccgcatcctgcgggaggcggagacgcctggggccagcgtggtggaggtggcccggaagcacggcgtcgtcgagcagacgctctaccggtggcggcagaagttcggcggcatggaggcaggcgacgcgacgcggctcagggagttggagaaggagaacgcgcgtctgaagaagctgctggccgagagggacctcgaaatcgaggtcatgaaggaaatctccacaaaaaaatggtga

SEQ ID NO: 5097 - DNA, 696 bp, Myxococcus xanthus
aaaggcgtgtcgcagcgccgggcgtgcgcgctactccaggtggcccgcagtagcctgggctacgccagccggaaagaggcaaaggacgcgcctctggtggcgcagttgcgcgacatcgcccgggcacgcccccggttcggctaccgtcgggcctgggccctgctgcggcgcgaggggcccgcggtcaacgtgaagcgagtgcatcggctctgggggaaggagggactggcgctctctcggagacggccaaggaaacggcttcggctggggcagcaacgccaacccaagccggagggcgtcaactcggtatgggcctgggacttcgtgcacgacatgtgcgcaaatgggcagaagctcaagtgcctcactgtcgtggatgaacacagccgagagtgcctggccatcgacgtggccgggcgcatcagtgccaggcgcgtcatcgaggtgctctcgcgcctggtagcagtgcacgggccgccgaagtacctcagaagcgacaacggccccgagttcatcgccaaggccctgcgcaggtggctggaggccaatggcattcagacggcctacatcgctccaggcaagccctggcagaacggtaccaacgaaagcttcaacggccgcttccgggacgagtgcctgtcagcggagtggttttccaccaggaacggcatcagcagcgccgcaggactctcgtaa

SEQ ID NO: 5098 - DNA, 486 bp, Myxococcus xanthus
gacgacgagctgcacgactattggaggcaactcatggagcagagcggggcgatgctcttcgggcgcaacacctacgagctgatggagggcgcctggcccgcggtggcacgcgacgaaaaggcgccgcgcgcgatgcgcgagtgggcacagaagctcgaggcgaaggcgaagtacgtcgtgtcgggctcgcggagcgactttccgtggcagaacacgatcaaggtggagggtgaccttcgtgaggcgatctcggcgctgaaagcgaagaccgagcggggtgtcctcgtcggagcgcccaagctcgcggctgcgctcgaggagttggggctcatcgacgagtaccgcatcgtcgttcatcccatcatcagtggcagcgggccgacgttgtttcatggcctgtcgagtgcgcggcatctcgagctcctctcgacgcagcggttcaagtccggcgtgcaggcgctccacttccgtcgcaaagcgggatga

SEQ ID NO: 5099 - DNA, 345 bp, Myxococcus xanthus
tttctgattctggcgcaggccggtggtggcaatcccctgggcaccctgggcttcctggtcatcctggtgggcatcatgtacttcgtgatgatccgcccgcagcagaagcagttgaaggagcaccgtgcgctcctctccgcgctgaagaagggtgatgaggtcgtcacttccgggggcatcctcgggaagatccatctcgtggatgagcgcaccgtgacgctggaggtctccagcggcgtgcgcatccgcgtgctcaagacggccgtcagcgccaagggcgcggtggcggaaggcacgcccgcggcccccgcgacggcggccggagagaagaaggaggagaagtga

SEQ ID NO: 5100 - DNA, 1341 bp, Myxococcus xanthus
aagcttgaccgggagctgagcgagttcctggactcgatgaccgagggaatgggccggaccgagagacgtcgcgccctcggcggctacctcaccggactgctgctcgacggagaacgcaagagcatcgagcccatggcggcccggctcgtcgaggcacccgagcagacagaagccatgcgccagcggcttcagcagtgtgtgtcgggcgcggcttgggacgactccgaaatgcggcggcgcctggcgcggcagcttgagtgcgagctaccgggcttggaggccctcgtcattgacgacacgggcttgccgaagaagggcgtgcattcggtgggtgtggcgcgccagtactcgggcaccctggggcggacggagaactgccaggtggccgtcagcctgcatgttgctggagagaagggcagcggctgcatcgccatgcagctgtacctgcctgaggagtggacgcgcagcaggaagcgctgcaaggccgccggtgtcccgtctggagtgaagtttcaaaagaagtggcagatagcgctgagccaattggatgacgcaatggcgtggagcgtgcgccgacacctcgtcctggctgatgctgggtacggcgatgcacgggagttccgcgacggcgtgcgcgagcgaggcctgcactacttgatgggcgtgcagggcacgcacaaggtgtggccgcccggtgccaagccgcgtcagccccagagggcgccgggccagaacggccgcccgcgcacgcgctacgtggccgagggcgtgcaaccatgggccattgaggagttggcgcttcaacttcccaaggaggagttccagacagtctattggcgcgagggcagtcggggcgagcagtcctcccggttcgccgccgtgcgagtgcggacggcggagcggcacgtccagcgagctccaccgagtgaagaggtatggctgctcatcgagtggccccaggaggagaaggcgccgacgaagtattcgctttgctcactgcccgcgaatacgccgctcaaggagttggtgcgcttgtccaagctgcgctggagagtggagcgggactaccaagaactcaaaggcgaggtggggcttgaccacttcgaggggcgagggtggcgaggcttccaccaccatgccaccctctgcatggtcgctcacggattccttgcgctccgccgggcgcttttccccccggaggagagcacgctggacactgcccgaagtgcgccgccgccttcagcacctgctgctgcgccgcattggccactgcccactttgcctgcgccacatcggcgcccgcgcacctcctcgggggccgtcacgcatgtgaccgggtag

SEQ ID NO: 5101 - DNA, 333 bp, Myxococcus xanthus
atggtcgagccgatcaacgacgcggcaggcaagacgctcgttgccgcgggctcggaggtggacggcacgatgaccgagttgcagccgtcgacccgcgcggacaagccggcggcgatccgggtgaacttcgacaggctcaccacgagaacgggcatggagccaatcgccgcggaggtggtcgaggcgaagccggaggtgaaccagagtcacgggcgtgcggagatgggcgcggcgatcggcgggctgggcggcctcgcggcgggcgcgattctcggccacccgttcacgggggcggtcatcggcggcgtgctcggcgctgggggctggcggtga

SEQ ID NO: 5102 - DNA, 576 bp, Myxococcus xanthus
aacgtggagatcaccatgtacttcaagcgcgtgagcgactcggggatcaactggggtgggatggtctccttcgcgcgcaccaaccacggcacgaccggctccgagaaccgcgacaagtgcgatacccgcggcatcggcgcgcgcatgcgctacgacgggaagatcgacttcgagaaggagacgaaccatcccgactcgaagtacgtcgtgcagaagaagtactggtcgtcctcgctcccgaagaacacgtggatcggccacaagcacgtggtctacgacctgccgggcggcaaggtgaagcaggagctgtggatcgacctcaccgacggcgtgaacggcggccagtggaccaagatcaacgagttcatcgacgacgggacccagttcggcaagggcggctcgccttgcgcctcggggatcgatcccgccctgccgttgaccgccgggtcgagccgggtgggctcggagagcggcaagccgaacatcaccgtctacttccgcagcgatggcgtgagcactgatggcctctggtatcgctgggggagtgttcgcgaaatccaggcgccgagcacgtag

SEQ ID NO: 5103 - DNA, 138 bp, Myxococcus xanthus
atgcccgagccacccgtcgaggagaacgtgtgcatcgaggagacggcggcggagacgatctgcccgccggggaccatgcccgccatcgcgcccacacccgtgcccacggcgctggcggcgctgttgagaccattgtga

SEQ ID NO: 5104 - DNA, 615 bp, Myxococcus xanthus
atgaagaagctcgttggcgtcttcgccaccatcgccatgctcggaacgggtaccgccctggccaacaacgacgggaacaagccgaaggactcctcggcggcccagggtggctcgggccaggtggggcagagcgaaatccagcaggacaccaccatcggacgcgggacgaccaccacgcccactgcgccgggccagggcggctccggcaccatgggccagaaggcccccatgggccagaaggagctcaacggccgcgtggtgaaggcggagagcgacaagatcttcgtcgacatgcatggcgcggtggtccccctggaggtcgaccgcagcacccgattcagcgacccgaccctgaagaaggccaaggacctgcgccccggccaggagattcgcgccagctacgaggtgaaggagaccaagaacgtcgccaagagcatctccctctcggggacgggtggcgcgggtgacccgacgctgacgccggactcgtccatcaaccaggacaacaacaagggcggctccggcatggagcagcacgagggcaccggtggcgcgggcgacagcagcaccatgaacccggacacgggctccaatacctcgcccgacacgtactga

SEQ ID NO: 5105 - DNA, 456 bp, Myxococcus xanthus
atggggctgtacttcgagcggcgggggggcacgcgcatcggcgggcgcatctacgcgctgttgatgcttgcgggcaaacccctgtcgaacaagcgcatcgccatgctgctcaacgtgagcgcggcgtcggtgtccaccaacctgcgagcctgcacggacatgggcctggtggaacccgccagcgttccgggggaccggcagcactactacgtcatccattcacagggctgggaaggcaagctgcgcgtcgccgaggagtccctgagcgccttcggccgcctctgctccgaggccctcgcggttccgcgtctcgcaggaaatcgcagcttgcgagaggcttctgctttctgtgatttctacaaggctgagctcacaggcatcgccgagcggtggcgcgcagcgaatgccccccgtccgccacgccccgtcaagacttcgaaaggacgtaccgcatga

SEQ ID NO: 5106 - DNA, 744 bp, Myxococcus xanthus
atgaatcccaccgcttcgcagtcctccatcgtctccatcacgaacgtgaccaaggactacaccctggggaaggtggtggtcccggcgctccggggcgtggacctggaggtccatgccggtgagttcatctccatcgccggaccctccggcagcggcaagacgacgctgctcaacctcatcgggtgcgtggacaccgccaccggaggtgtggtccgggtggccgggcaggacaccaagcagctcacggagcgccagctcacgaacctgcgcctcaacaccattggcttcatcttccagagcttcaacctggtgcaggtgctcagcgtcttccagaacgtggagtttccgctgctcctccagcgaaagctggacaaggcccagcgccgtgagcgggtgatgcaactcttggagcaggtgggcctggcaagccacgccaagcaccggcccaacgagctgtccggaggccagcgccagcgcgtggccgtggcgcgcgcgctcgttacgcggccccagttggtgctcgcggacgagcccacggccaacctggactcggtgacgggccagaacatcatcgacctgatgaaggaactcaaccagaaggagggcaccaccttcatcttctccactcacgacgcgaaggtgatgagccacgccaacgcggtggtgcggctggcggacggcaagttcctggaccgcatcagcgccgccgaggccagccgcgccatggcctctggaggccactga

SEQ ID NO: 5107 - DNA, 3415 bp, Myxococcus xanthus
atgggacaactccgtttgctgctgcaggtagccttccgcaacctgttctccagcaagatcaacctgctcatcggcggcatcatcttcttcggcaccctgctcgtggtggtgggcggagcgctgatggacagcatggacagcgcgatgagccgcagcatcatcggcagcgtcgcgggccacatccaggtctactcggatgactccaaggacccgctggccctctacggcagcatgagcggcgagccggacctggccgcgctggacgacttcagccaactccggcccttcctggagaagcaccccaacgtgaagacggtggtgcccctgggcaccagcggcgccatcgtcacctccggcaacacggtggacctgacgctgtcgaacctgcgcgcgctctacaagaagcgcgacgaggccggtgagacgcccgagctgcgggagagcatcgacagcgtcaaggggcacgtgcggcagatggtcgacctgatggccgaccagacggccaagagcgagcaggagctgggcggcgcccagaaggaccccgcggaggtggaagcactcgcccgggcgcgcacggacgcgttctgggacgccttcgaggaggccccgtacaccgcgctggagctgttggagaaccgcatcgccccacagattccggacggggacatgctggagctgcgctacgccggcacggacctggacgcgttccagcgcaccttcgaccgcatggagatcgtggacggacagccggtgcccaccgggcagcgaggcatgctgctgtccaagttcttctacgaagagttcctcaagatgaagtcggcgctccggctggaccacatcaagcaggagcgggacctcaaccagaaggccatcgccaccgacccggacctgcagcgctgggtgaaggagaaccagacgcagacgcgggaaatcatcttccagttggaccccgtcaagacgcggaagatggtggagcggctgcagaagctgctgggcagccaggagcccgcgctggacaagctgctgacgcagttcttcaccaccgacgacgccaacttcgacacccgctacgcccagttctactcggagctggcaccgctgctggagctctaccggctgcgcatgggggacgtgctcaccatcaccgccttcacgcgcaccggctacatgcagagcgtcaacgtgaaggtctacggcacctaccagttcaagggcctggagaagtccgccatggccggcgcgctgagcctgatggacctgatgtcgttccgggacctgtacgggtacctcaccgcggacaagaaggcggagctggcggaaatccagaagcagagcggcctggaagccctcagccgggacgaggccgaggaggccctcttcggtgaggccagcgacaacgagttggtggccgaggccacgtccagcgacgtggacgaccaggccgccttcaccggagaccagggggcgctcacgcgtgagaacctgctccagcgcgtctacacccagcaggaaatcgagcaaggcgtggccctgagcgcggcggtgatgctcaaggacccggagctgctggaacagacgatggtggagctgcggcaggcggcgaaggatgcgggcctgaagctgcgcgtggtgtcctggcaggaggcggcgggcatcatcgggcagttcgtgctgctcgggaagctggtgctctacttcgccgtcttcatcatcttcgtggtggcactggtcatcatcaacaacgccatgatgatggccaccatgcagcgcgtgcgcgaggtgggaacgatgcgggccattggcgcgcagcgctccttcatcctgggcatggtgctggtggagacgctggtgctggggctcgtgttcggctcggccggctcactggtgggcagcggcatcatggccctgctcaacagcgctggcatccccgcgggcaacgaagcgctctacttcttcttctccggcccccggctgttccccacgctgagcgccagcaacctggtggcggcgttcgtgatcgtcctgggcgtctccgccatctccaccctctatcccgcgttcctcgcgacccgggtctcgcccctccaggcgatgcagacggacgagtgagaacatgctccagctcttcctcatcgcattccgcaacctcggcacccaccgcaggcgcaccctgctgctgggcggcgccatcgccagcgtcaccgcgctgctcgtcatcctcatgggcctgtccacgggcatgaaggagtcgatgctccgctccgccaccacgctgtccaccggccacgtcaacgtggccgggttctacaaggtgacggcgggccaggcggcgccggtcgtcaccggctatccggccatcctggagcagatccgcaaggacgtgccggagctggacttcgccgtccagcgcggccggggctggctcaaggtcgtcagtgagacgtcctccattcaggtgggcgtgggcggcatcgacatccagtccgagcccggcctccgtcaggtgctgcagattcgcgcgggctcgctggacggcctggccgagtccggcacggtgctgctcttcgagaagcaggcgaagaagctcaacgtccaggtgggcgagtccgtaacgctggccgcccagacgctgcgaggcgccagcaacacggtggacgcgcgcgtggtggccatcgcggccgacatgggcatgctgagcgacttcggcatcttcgtgccgtcggacacgctgcgctcgctgtaccagttcaagagcgacaccgcgggcgcgctgctgctctacctgaaggacatccagcatgtgccagcggtgcaggcgcggctgcgccagacgctgacggacgcgggccacacggtgatggaccacgacccgcgcgcgttcttcatgaagttcgagaccgtcaaccgtgaggcctggacgggtcagcggctggacatcacgaactgggaggacgaaatctccttcatcacctggacgctcaccgcgctcaacagcctcaccggtgtgctcatcttcgtgctgatggtcatcatcggcgtgggcatcatgaacacgctgtggatcgccatccgggagcgcacccgggagattggcaccctgcgcgccattggcatgcagcgcacccgcgtgctgctgatgttcgtgttcgaggcgctcctgctgggcatgctgggcacgctggcgggcgccagcaccgggttggtgctgtgcctggccgtcaatgccatggccgtgcatgtcccggaggtggtggcggtcttcatcatgtcggacaccttgaatctggccgtgcacccctcgtccatcctgggtgccatggccttcatcaccgcgtgcaccaccgccatctcgctcattccctccttcctcgccgcgcggctcaagccggtgacggcgatgcaccacatcgggtga

SEQ ID NO: 5108 - DNA, 768 bp, Myxococcus xanthus
atgctgtccgccgcggcgctggccgtggcgctgctgtccgccccggccgccctggccctggagcaggccgagcaggtgaagctcctggccaccatcgacgaccgccagcgaaacggcggcgactacaaggcgatggtgtacctggagcagaaggagaaggggaaggcggacctcgtctacgagctggtcgtctaccgccgcgacgaggacgacaagctgatgatgctgttcaccaagcccaagacggaggcgggcaagggctatctgcgcctggacaagaacctctggaactacgaccccaacgtgggccgctgggagcgccgcaccgagcgcgagcgcatcgcgggtaccgacagccgccgcgcggacttcgacgagtcgcggctggccgaggagtatgacccgtcctacgagggcgaggcgaagctgggcaagtacacggcccacttgatgacgctgaaggtcaagcccggcgtggacgtggcctaccccgtcctcaaggtctgggtggacaaggcctccggcaacatcctcaagcaggaggaatacgccctgtccggccggaagatgcgcacggcgctctacccccgctggaagaagatgttcagcgagtccaagaaggacgacgtctggattccggaggagatgcgcatctacgacgaaatcgagaaggggaactccaccaccatcctcgtcaagacagtggacctgcgtccgctggaagccaacctcttcaccaaggcgtggctcgagagcaagagccgatga

SEQ ID NO: 5109 - DNA, 1200 bp, Myxococcus xanthus
atgggcgagcagcaggaagcgaagcagtcaggtggcaagggcgatacccgcgtggagccggggatggtccgcttcgagctccttcacgaggacacgtcgggaacgaaggcccgccgggggcgtctgcacacgccgcacggccccgtggagacacccatcttcatgcccgtgggcaccgtgggcagcgtcaagggcgtggggccggacgacctgctcacgctggacgcgcagatcatcctcggcaacacctaccacctgatgctgcgccccggcgaagcgctggtgggggagatgggcggcctgcaccgcttcgtgtcgtggaaccggcccatgctcaccgacagcggcgggttccaggtgttcagcctgtccgagaagcgcaaaatcaccgaggagggcgccgccttccagtcgcacctggacggctcgcggcacttcctcacgcccgagcgctccatcgacatccaggagacgctgggcgccgacgtcatcatggccttcgacgagtgcccgccctccaccgagaacagggcctacctggaggcgtcgctggcccgcaccacccgctggctgcaccggtgcgtgaaggcctggagccgggagcgctcgtcgctcttcggcatcgtccagggcggcctgcacgaggatttgcgcaagcgccacgccgaggaggtgtgcgcggtggacctgcccggctacgcgctgggcggctactccgtgggcgaggctccggaggccatgcatgacggcgtggcctactccgcgcccctgctgccccgcgacaagccgcgctacctgatgggcgtgggcacgcccgtggacctggtcacctgcgtggagcacggggtggacatgttcgactgcgtcctgcccacccggtgcgcgcgcaacggcctgctcttcacctcggagggcaaggtcgtcatccggaacgcggcctacgccagggacaaccggccggtggaccctgcttgctcctgctacacctgccgcaatttcagcagggcctacctccggcacctcttcgccgcccaggaactgttggccatgcggctcaacacgattcacaacctccactacttcctgggactgatggcagaagtccggcgcgcggtggcagaggaccggttcgccacttttgcccgggaattccgtgcccgtgccaaggcgcaggaggccgaacggacccgcggtcgctga

SEQ ID NO: 5110 - DNA, 1617 bp, Myxococcus xanthus
atgaccccgcgcacgctcaccctggccgcggcgctgtccgcggccctcaccggtacgcccacgtgggcccagtccgaggagcggcccgacgaggacgcgctcttcggaggcgggcaggagaagacgcccgcggaggcacccgcgggcgaggaatcgggccggcctgacgaggatgcgctcttcggcggtgacggctcggagccgacggtggacgtggcccctggcaccaccgggggcgccacggagcggcagccgccgctgaccgcgcctgacgaaaaccgggacgcggacgtgttgaacggccctgcgacccggagcgccttcgacaccgaggacgtggtggacgatccgctgaagattggcggtcagttctacctgcgcggcttcatggcgggtagcgagaacacctcgctccgccagacgtccttctccgcccccacgctggtggacggctacctcgacgcgcgcccgtccgaccggatccgtggcttcgtcgtgggacgcttgaactacgaccccgccattccgccccggaccacggcggacgccccggcgaacccgcgcgtgctgctggaccaggcgtggctgcgcttcgacctggagcgcacggtgttcttcaccgtgggcaagcagcacgtgaagtggggcaccgggcagatctggaaccccacggacttcctgtcgccccagcgtagagacccgctggccttcgtggacctgcgcacgggcgtgtccatgttgaaggtgcacgtgccctgggagtccaagggctggaacgtgtacggcatcctcgtcatggatgacctgggcacggacgtgggcgccatcaccgacccgagcggaagtcccacgtcccaggccggcggcagtgacccggtcaaccggctgggccgcctgggcggcgcgctgcgcgcggaagtcctgctggggcccgcggagctgggcgccagcgcggtggcgcagaatggacgcaagccccgcttcgggctcgacgtgtcctcgccgctggggccgctggacgtctacgccgaggttgcgctgaaggaaggcacggaccggccgctgtaccgcattccggaagggacgacgctcgaggacatcgcgcagaacggcgtccaggtggaagcctacattccctcgcggctcacgccgcagatgacggcgggcgcgacctacagcttcccgtatggggagaacgacctggccgtgctgggcgtggagtacttcttcaactccacgggctacaccggctcgttcgggtatccgtacctgctgctgaagggcgccttcaacccgctctacctgggacggcattacggcgccgcgtacctcttcctggaccggcctggtccattggagcggacgtccttcaacctgttcacgctgggcaacctgtcggaccgctcgttcaccacgcggctcaacgtgatgcaccgggcgctcacgtatctcacggtggaggcgtacggctcggtgaactacggacggcgcggcggtgagttccggctcgccgttgatgtgccggaggggctcgtcgtggatgggcagccgattccggccttctccatacccgcgccaacgttccaactgggagcggggctccgcatcagcctctga

SEQ ID NO: 5111 - DNA, 1335 bp, Myxococcus xanthus
atgcgcctctggattgccatcgctgcagggtggggcctcggccagttgccgaacgcgccggtcatgattcctcccgaggacccttccatccgggacccggccgcagcggcgctccaggacgcgaaccagcaggcggcggaagagattgaagggctgaggcccccggcgggctacgtctatgaggcgccggaggatgcgtcaccgcgcgacttcgtgctgacgcccgtcctgcccgacggcgcgccaccgccgatgccgggacaggtcgccaccgaggaggccgcgcagcgctacgagccagttccctcgcccctggaggcgctgcaacaggaacaggccgcgatgggtgggagcggacagcagacgggggctgacggcacctcgacgggccaggccaccacgggtgggacgacgagcggtgcgggtggttcgggtgtgacggggcaggacgtgagtggatccggcacgagcaccggcaacacaggcacgggtggcgccggcacgacgggcccgcagcaagacggcagcggaacgccccctgaaaacaccgtccccgcggaacagcagaacctcggcaacacgggcgcgaccgccgcccagacggcaccccagcagggaacccccacgggccagagcggcacaggcacgaccagcgcagtcccctcccctgcccccgcgacgccggctttcattggccgctcggaacccatcggccgctccgagcccattggccgctcggaacccatcggccgctccgagcccattggcacgccgcccaccgtagcgcccgcgaacaacccgatgggcactggcggcgcaggaacgccgaacacgaatcagccgacgcccgcgcagcagatggaacaactgaatgagcgggtgaagcagctcgaaacccagctcaacgagcgcgacgccgacctcaccgtgagaaaccaggccgtccagctccaggtggacacctacggcgaccgcgcggtcgacgtggagcaggcacgacaggaccggctgacccagattcagaccgccagtcagtggatgctcgcggcggacacggcgctggaacagggtgagctggacgtcgtcaatgcgctcgacatcgccgacaacgccttcgtcgacttgcgtgacagcgcggaggaggacggccagggcacggtcgtcgtccacgcggagcgcgtgcgtgcgctgctcaatctcgcccgtaacttcgtcaacaaccgcgacggatacaatgcccggctcgccctccaggaggcaggcgtccagctgagcatcctccgcgccgccaacctcgagcgacaggccaccggcaacgtcctgctcaatccgtga

SEQ ID NO: 5112 - DNA, 3270 bp, Myxococcus xanthus
atgggtgaagacgggggcgtcccggagagtggcctggcggccgccgacgggggcgcggaggacggcggtgccctggccgcggccgatgcggggacggaggatgggggcacgctcgcggccggtggtaccgacggcggagagcaggacgcgggcgccacctacctgatggccagcgacgccgatgacgacggcgggacggtgctgggcggcggtcagtcggtgttcgcgggcgcggacggcggcttcaactacacctacgcgaagtcgctgggggacaagtcgggcggggtgcgcttctacttctatgagcgtgagcgaatggtggccgagcgcgccgcgccgctcatcgaggaggcctaccggtacttggtggaccagttcaagtacgtccccaccaagacgttcccgtacatcctctacagcagctaccaggagttcctgcagaccaacctcttcgccgtgtccgagggcacgctcggcctcaccagcaccggcgaggacctgaagctgacgctgccgtacctgggcgaccaccgcctcttcgaggaggtcagcacccacgagctggcgcaccagttcaccatccagaaggtccgcaccgtggccgagcaggccaagatgttcggcgatccgctgcaagccattccgctgtggttcatcgaaggcctcgccgagttctacgccaagcgtggcatggacccggaagcggagatgctggtgcgggacctgttggtgaacccggacctcttcaagggctacgccttcctcgacttcttctcccccgggccctacggctacctgtggatctacaaggtgggccaggtccgcgtgtccttcctcgaagaggagtacggcgccggcttcatccagcgcgtcctggaggagtcgccgcggctggcgggtggctcgcgcgattcaccgtcgctcaagttcgaggagttgctggagcggctcaccggcgacaaccccaagcgcatctccgcgcggttcgagaactggctgaagcgccgggccttcaagacgtacctggcgtccgagcagtccgcgccggcgctggacctgctcgacaaggcgcccggctacaccaccgccatggcgtcttccccgtcgggcaacgtgctggggctgcgcaccatcgtcccggagacgggtgagagccggctgtacatcatggatccgcgcgtgccggacaagacggtgaaggtcgcgggtgacggcgtgccaggcgtggagtcgttgcaccccatctccggacgcagcttcgcgctgacgaacgacaagctggccttcatcgccgaaatcaccgggcgcgacgtcatctacgtgcaggactacacgcacaagtcggagcggcgcggcgcggacgtactggtgcgccgcaacgccatccggaccggcatcgaccgggaggtgggcctggtggtcgacctgagcctgggcggacgcaccgcgtaccgcatcgaccggcacgggctgctcgcggcgtactcgccggccttctcgcccgacggccggtgggtggccttcatcggcatcaacgacgcgggtctgcgggacatctacgccatcgacctgcaggcgggcccggacgccccgccgctgcagctcaccgacgacgtgttctccgagcgcgaggtgacgtgggggccctcgggcatcgtcttcacgtcggacgcgacgtcccaccgccagttcaacctcttccgcgtgcggccggacgcgccccggcaggtggagcgcctcaccagcgaggagcgggaccacacggccccggtggccctggcagacggacgcctcttcttcaccgccttcaacaacagcagctccgatttgcacgagctgacgaaggacggccgcatcgtgcggcgcacggacctgacgacgggcgtcttcgagcccggccccggcccggacggcagcctgtggatgctgttccacgtctccggtgagcgccggcccgcggtgctgcgcccgccgcgcatgctggcgctggacgtccccgccgaaccgccgccggagccgcccaacccgctggcggtgcggcccctcacggacgcgcagaactacgagcccttcacccggcagaacctggagttcggtcccttcttcggcttcgcgggcgcgggcggcggcggcttcgtgggccagctcttcgcggcggccagtgaccgcatgaaggaccatcagttcctgctcaccctggcggtgtacggcagcttcgacctgacggacggatacctgctctacgtcaacgacaagtcacgcacgacgtggggtggcggcatcttccagtccctgcgcttccgcgtggaccgcaccttcgaaggtgaagagggcgcgcagaatgccttcttcacgtcgggtgagcgcttcttcggcgcgctcggcagcgtgcgctacccgctgagcaccttcctgttcgtgcagggcgacctggccattggtggtacccggtacttcctggacgactacacggagttcgagctgttcttccccgagcgcaacgcggccaaccgggagctgctgacggcctggaacgcgcgaaaccgcgccatccgcttccagacggagctgagcgggcagattggctacgacagcctgaagtaccactacgccaccggcccgctgtcaggcagcgcggccatgctggagacgacggtgggcgtgcagcccttcgacaaccaggcctacggcaatgtgcgcgtggacgcggagcgctacttccccatctacggccgcgccaacatcttcatccgcggcggcctgggcaccacgttgggaggccggtacgcgcgctcctacttcctgtcttcgttcgacacgctgcgcggcgtgaacttcggcgacatccagtggctgctcggccggcactacgtctactccaccctggaggcgcagctgccgctcaacgacatcatccgggtggccttcctcagcgacctggaagcgattgccgccatcgacgcgggcggcgtcggcgagggccgggatgacttgtggaaccaccgcgtggtgaacggcgtcgtcggtttcaacctcgcgctgggccccctgctgctgcgcctgcacttcgcccgcccgttcgacgtcggcgccgctgccggccggccggacccgggctgggtgacgaacttctcgctgggcatcgccggcctcaatggcttcttcgaccaggcgaacaccgggaagagtgtcggcccatcgccgacgcccatgtccccggccctgatgccctccatgggaggcggctacaccgcgccgcgccgctga

SEQ ID NO: 5113 - DNA, 1554 bp, Myxococcus xanthus
atgccgcccgtgcagacgtcggtgccgcagtacgagctcatcatccccgaagagacgatgcggatgttcgaggcggacccttggacgccggagcaggacggcctcttcaaggcgaacgggacgacgtaccgcgtgcaggtgcgcctgcggggcgcctccgcgcgcttcttcccgaagaagagctggaacgtgagcttcgaggacggcgtgcgcttcgaggggaggacgtcactcaacctcgtggccgagtatgcggacgcgacgctgctggcggagaagattgccttcgacctgctggaggccatgcgcgtccccgcgtcgaagggcacgctggtgcggctcaacgtcaacggcgcgtaccagggcgtgttcctggaaatcgagcaggtgaacaaggcgttcctgcgggcgcactcctacgccgacacggatggaaccatctaccggtgtggctggaaggactgcgaattcaagatggcgaaggtgccgtaccagggtgactgggcgaagaagacgaacgagtcccagccggacgacaagctctgggagatggtgggcgccatcaaccacacgcccgagccccagttcgtcagtgaaatggagaagcgcttcgagctggagcactacctgcgcgccatggtgatggacgcgctgatgtccaacaactacgtggaggactcggagagctacttcatctacgaccgcgcggtggccaggtggtcctacgtcccgtgggacctcaacaacgtggactcgcgctggtggtaccccatcagcgtggaggagatgagccagagcacgcgcaacatgcgccatccgctgttcagcttcaccctcaccgacgcctgggtggcgaagatgtacgagcagcgcaagctggagacggcctcgtaccccggctacctgccggtgttctccaacctggccacccgcgtggtgatgaaccccgtgctgcgcgagcggctggaggcgcggctggacaaggcgatggacgagctcttcaccagcgaggtgatgggcgcgcacatcgacaagctgcacgcgctcatcgacccgcacatgcgtgacgaccccttcatggactacggccgcttcaccgcgggccgcgcctatctgaagcgctacgtgcgcgagcgccgcgacttcatcttcaaggagctggagcggctcgcgcagcagcaacccacgttggtgctggaggccgtccacccgcgtgaaggctgggtggaggtgggcaaccgcacctcggcgcccctttccctggcgggcatggtgctgacgacgcaactgcgcatcagcctggcgcagagccccagccacctgcacacgcaggtgcgtgcccccttcggcgcggtgctgccggagctgacggtggcccccaggcagcgcgtccgcctcaacgccgcgcagttgggcatccagatgcccgccaacggcgagattggcctcttcgacgggcgctccgtggtgggcgtgaaggacctgctcttctacggcgacctgggcgcgggcaagcgctacgagcgcggctcgcggggctgggaagtgcgctga

SEQ ID NO: 5114 - DNA, 411 bp, Myxococcus xanthus
atggccattgacctctcgcggtacttcgacctcatcaaggaagcgcaggtcgtgcgcgtgcgcggccgcgtcacggagctgacgggcctcatcatcaaggccagcgtgcccaacgtccgcgtgggcgagctggtgctcatcaagagccgcaaccgcggcgcggtgaaggcggaggtggtgggcttccagggggatgaggtgatgctcatgcccctgggcgagctgcacggcatcggtccggacagcgaggtcatccccaccggcaagccgctgagcatcaagtgcggagaggcgctgctgggccgtgtgctcaacggaatcggcgagcccatggacggccacccgttgccggaggagggcctcatcgactggtccgtggaccgcgactgcccggaccccttcacccgccag

SEQ ID NO: 5115 - DNA, 594 bp, Myxococcus xanthus
ccccgcgcgggagtgatgaacgccgaggtcttcgaggcccgacagggcgcgtcggccatcctggaggaggcgcagcgcgagaaggagcgcatcctcgcggaggcgcagcgcgagcgcgaggacctcctcgccaagacgcgtgagcagggccgccaagaaggcctggcgcaggccaccgaaatcatccttcgcgcgaagatgcaggcgggggaggtgctgaccggccacgagcaggacgtcatcgcgctgtcgctcaaggtggcggagaagatcatcggccggagcctggagaaggacccggagctgatggtggagctgtgcgccgctgccatcgagaacctgcgcagcgcccgctccatgattctgcgggtccacccgaagacggccgccgtgctccgcgcgaagaagccggtcctgatggaactcatcggccgcgcggtggatctggccatcaaggaggaccccgaggtggcccccgtgggctgcatcgtccagacggagttcggcacggtggacgcacagcttcccacgcagttggagatgctccagaacatcctgttgccggacaccgcgcgtaaggaagggccggcttga

SEQ ID NO: 5116 - DNA, 2184 bp, Myxococcus xanthus
atgctgctcctgacggccgtgacgttctgcggccaggagagcctcggcgccttggagcaccttcccgaagaggagggggcgcttctgcgtcatcgcgcgcaggagctgcttcaggttccgcgcgagaagcgcatccccgcgctggtgcaggaaatcaagcggctggtgaaggaccgccgtggtcagctctggagcgccgaaccggagcggttggctgcgctgctgcaacgtgagcggggcgcgttggtggaagtggtgctgcgcgcgctgccgggcacgctggcggaggcggtgcgcgcgcatctgccgccctcgcgcgtgaagctgacccgcgaagtgcgcccgcaggtcctggacatcgtccggtggaagctggaggaactgctcgcgcgcgaggtcgctgggcagcaggccgcgggcttcaagttcgcggacgtgcttcagcttcagcaacgggagctgctcaccatgtgcgaccggttgggcgcgcgggtgctggggccggcgctggcgggccttccggacgcggagcgcgaggccatgctggagcaactgccgccggacttgaagctgctggccaccaaggccgtggccgccaacgctccgcgcaagctgccggaggaggatgcccgggcgcagttggagccgcacgagggcctgacgcggccctcggtggcgctgcgcagcgcgggggctcagcggctggcgcgcgcatgcgtggcgcagtctccggagttcgccgcgcgcatgctggagaagtaccgcggtgagttcggaagcctgctggcgaagtgggtgcgcgaggagcgcgtgcgtcccaccgcgcgaggcgatggcggccggaccgacatcgtgatggacctggagcggctggccacgcgtggcctcattgagcggccggttcgcctggcgacaccgccgcctccgcgtcagtccgccgttcttcctccgcctccgggagcccggaaggcggctgccgcggcggcgccacccgcggccaaggcggcggcgcccggtggggctgcgcctgctggggcggcacctgccaaggctgcacctgctgctggggcggcacctgccaaggcggcagctgctggccgggatgtaccgacacgaccgccggcgcgggggcaggccccgggtgcggctcgccagggcgcgggagcaccggcccggcgggacttcatggcggagcgagcggcgcgaaacgcgggtgtgttgtcctcgcgtgagccgtcccgcgtggccacgcccgcgaagcgacaggatggctccgcggtgcagcggatgccggcccggcgtgagcccgcgaacgagggcggcgcgggggctcgccgtgagggtgaggggcccgatacgcgtccgcctcgcgcggatccagagggcgcgcgcatcggtccgccgccttctcggctggggcagcgcggcgcacggcctcgcccccaggaccccgacacgctgtcagagcgggaccgcgcgcgggtcgccgagggttcccgggtgcattcgcgtccgcccgacgagcgttcccgtgtggcagagggctcgcgggttcaggctggaggccagggcgagcgctcgcgggttcaggctggcgcgcaggacgagcgctcacgcgtggccgagggctcgcgggtccacgcccgacctgcggatgagcgttcccgtgtggcggagggctcgcgcgtccatgccaacgttccagacgagcgctcacgcgtggccgaaggctcccgcgtccaatccggagccccagatgagcgttcccgggtggccgaaggctcccgcgtccaggcgcgcccagcggatgagcgctcccgcgtcgcgtcccgggggcagcagcgtccggcggaggagcctccccgggccgctcggatgaagttcggggccgcggaaccggagcgggaggtctcagaggtctcccgggtgttccgctcgcgcgcatccggtacccagggaggccagggaggcggccgggccaagccccccgaggcggagccggagccggagcgtcccccccgggtgctggtggggcgggccatcacctcgccggccctggcgcccatgcccaagccccggggggagggcacgtccgtccagcgtcgtccccgctctccgtcgggtaccgaccgtcctgtgcctccgggtgcagggggacgtggaaccaagggcggaacgcgctag

SEQ ID NO: 5117 - DNA, 762 bp, Myxococcus xanthus
ggctgccacattgaactccagcacgcgctgagcgaagcggacgccaacgaaatctacgtcctgctcagcaagaacggcatcaacgccaagaaggaaaaggaagaaggcggcaacgaggtgcggttcatgatcaccgtgcccaaggcggatgccgcgcaggcggcggagctgctcaagctcaattcgctgccgcggccggtggagaagggcctggcccatttcgccaagggcagcatggtgcccaccgcgacggaggagcgcgccatgctcctcaaggcgatgggcggcgaggtctccaatgcgctgaatcagatcgacggcgtgctggaagcgcgcgccatcgtgatgattccggagaacaatgacctcacgcagccggagaacaagccgatgccgtccgcgtcggtgttcatcaagtaccgcccgggcgaggggggcaagccgcccatcgacaccgccgtggtgcagcagttcgcggccaccgcggtgccggagctgaaggccagcgcggtgacggtgctgatgacgcaggccctgccgccgtcggcggagacggacgcggagagccgcctgcaggacgtgctggggctgcgcatgacggcggccagcgccagccagttcaaggtgatgttcgcgggcgccttcgtgctggtgctggcgatgctgggcctgacgatgtggaccttcatgcgcggcggctccagcagcgcccctgccacgcgcgctggagcgcgtacccgcggtcgtcctcccgaggcttga

SEQ ID NO: 5118 - DNA, 213 bp, Myxococcus xanthus
atgatgacgcagatcgtcggtgacctggagaagggccaggtcaacctggagcacatcatcaagcaggcctccagcggcaaggcgttctccaacgcggagctgctgtcgctccaggcctccatgtaccagtacacgcagcagctggacctgacgagcaaggtcgtggagaaggcgaccaccggcctgaaggacgtcgtcaagacccaggtgtag

SEQ ID NO: 5119 - DNA, 339 bp, Myxococcus xanthus
atgggccacttcgacaaggcgaaggagatcttctccggggcggccgcgctgatgccccggagcgaggtaccccagctggcgctgggcgccgtggagttctcgcagggccgtcatgacaaggccctgcaggcctaccgcgtcgcgcagcgcctggccccgcagtccgggctccctcgggcgcatgcgggcgaagcgctgctgttcatggggaaggttcccgaggcgctcaaggagctgaaggccgccatggacctggatccggacggggacggtgcccgcctggcgcagtccctcatccaggccaaggaggcgggagtcctgcctccggcgaagacgtag

SEQ ID NO: 5120 - DNA, 1080 bp, Myxococcus xanthus
cgtctctctgattacgacttcgcgctgcccgaatcccagatcgcccaggctcccctggccgagcgggacgcgtcgcgcttgatgaccatcagccgctccagcggcacctggtcgcaccgccggttcgccgacctccaggagctcctgcgccccggagacctgctcgtcctcaacgacgcccgcgtcattcccgcgcgtctgctgggccagaaggccggcactggtggccgcgtggagctgctcgtcgtgcgcccggccgcccagaacacgctgacctcggcggcgctcggggcggcccccgagtcgctcgactgggtctgtctggggcaggcctccaaggggctcaagcccgggcagcgcgtgatgttcgccagcggcctggaggccgaaatccaggaggcgctgggaggaggggagtaccgcgtgcggttccacgcacccccgggcgcctcgctggccgcgctgttggacgcggcgggccgcctgccgctgccgccctacatcacccgggagccggacgccgcggacgcggagcgctaccagaccgtgtacgcacgcgcctccggagccgtggccgcgcccaccgcgggcctgcacttcacccaggagaccctggccgccctggctgcgcgtggcgtgcaccgggcgctggtgacgctggacgtggggccaggcaccttcctgccggtgcgtgaggacgacctggacaagcaccacatgcacccggagcgctacaccgtcccggaggccactgcgaaggccatcaacgcggcgcgcgcggaaggccggcgcgtggtggcggtggggaccaccgtggtgcgcaccctggagtccgccaccgacccggagacggggcggctgcgcgcgggccccggcgagacgaccctcttcatccgtcccgggttcgccttccgtcaggtggacctgctgctcaccaacttccacctgccgcgttcgacgctggtggtgctggtgagcgcgctgctcggacgcgagcgcacgctggaggcctacgcggaggcggtccgcgcgggctaccgattcttcagttacggcgacgccatgctggtgtcggagtga

SEQ ID NO: 5121 - DNA, 333 bp, Myxococcus xanthus
atgggcgcgccgtacgcgggcgtgatgaacaccgcggtggcgggcaacctgggcggcgcggtggcgccggccggcggcggtgtcgtcgcgggcggtctgggtggcgcggtggctggctccggctcgccgctgggtctgggtgcgcagggcagcggcagcaccacggacaccgtcaacggcaacttctcgctgaacaagatggccgaggagaactcccagctcctgaacctgcaggccgccattcagcaggaatcgcagactttcaccgcgatctcgaacgtgatgaagtcgcggaacgatacgatcaagaactccatcagcaacgtccgctaa

SEQ ID NO: 5122 - DNA, 276 bp, Myxococcus xanthus
atgcccccgaccgccaagccgtcccagaccgcgcaggacctccccgcgccctcgtttcccgccatcgagtcactgctcgaggcggcctccgtggaagaggtccgtggcttcttcgatggggtgaagacgggcctcaccgaactcaagggccccaaggtggagcagggcaagaaggcccaggccgccattggccgcgcggaggagctgctggagatgctggtggagacccgcgagcggctgatcgccgaatcgaagggtggcaagggtcggaaatga

SEQ ID NO: 5123 - DNA, 708 bp, Myxococcus xanthus
accacgcacttccagcccatcgtccatgcgcaggacacccgctgcatcttcgcgcacgaggcgttgatgcgaggcctggagccggacggcacgctggtgctgcccggacggatgatgcagacggcgcgcgaggcggacctgctgttccaactggacctggcggcgcgtaccacggccatccggcaggcggtgaagcacgggctggacacgcacctcttcatcaacttcacgcccacggccatctacgacgccacggtctgtcttcgctccacggtggaggccatccacgcggcgggcattgcgccggagcgggtggtgttcgaaatcatcgagacggaccagacggcggacgcggagcatctgcgcggcatcgtggacttctaccgcaagtcgggtttccgggtggcgctggacgacctgggcgcgggcttctcgtcactgaacctcatccaccggctgcgtcccgacatcatcaagctggacatggagctggtgcgtgacgtccacctggacccgtacaaaggctccatcgtggagaagctcctggagattgcgcggacgctgggcatccgcacggtggcggagggcatcgagacgcacgaggagctgcgctgggtccgctcgcacggggtggacttcgtgcagggctacctcatcgcccgtccgcagagtccccccgtgggggcgacgccgtcgttcacggattga

SEQ ID NO: 5124 - DNA, 1215 bp, Myxococcus xanthus
atgctgatgggcctcgccgccacggagcggcagagcaccccggagtcgttcttcctggccagcgagttccagggctccaacaacgtgacgatgcgcttcgccgtcgccgggtgttcctcgtccgggcccgggcagatgtcgggcatcttccggcgttgcgccaatggcaccgcggacatgaagggcaccttcgaggccatccggctgggccgccgcgcgggtgaagcagaggcgtccggcgtggagctggtcagcgaggtgaagctgaccgaggccacggccacgaatgtcgcggtggcccatggccacgcctacgtgacggcgggggccaagggcctcatcaccttcgacctgagcgacccctcgcagccgcgccaggtccgccagtacgagctgtccaacgactactacacggacgcgctggtgaacgggaacacgctctatgtggccagccgccgcagcggcatcgccgtgttcgacatcaccaacccggcggtacctgtccgcctgcgctccgtgcccgagtccgtggtggaggtgaactccctcgcgctggacggaaacgtcctgtacgcggcgtcgcccgcgcccaacgcggaggtgtacgtctacgacgtcgccacgcccgcggagccgaagcagctcaggcggtacttcgtcgagggcgcggagccccgggcgggggaggtgcccctgcacgtcgcggcgatgggcggccggctctacgtgagcaactggtccttcggaatgaccgtctcggacgtcaccaacccggcgagcccgaagctgttgggccgcttcgccaacggcatgtcggccgccacggcggtcggcatggtgggagaccgcgtctacgcattcgacgcgggcgaggactggggcgcgcacctgagcgtgctggacgtgagcgcgccggccacggtggcccggacgggtgagttccggacgcgcccggaggtgtccatccgctcggtggcgttctccgggacgaaggtctacctggcctatggtcaggatggcctgcgcatcgtgcacgtgtccgtccccggctcgccccagcaggtgggttactacaacacctggcggcagacgcatgcgggccacggcgtcgtgttcctcgaaggcctgagcaaggtgcacgtgccgggcgacggattcgtgtacgcgacggattcctcgcgaggcctgctcatcttccgcgagacgacggagtag

SEQ ID NO: 5125 - DNA, 195 bp, Myxococcus xanthus
atgctgctccagcacagcgtgtccggcttcagccccctgtctgagctgctgcgcgtgcttggcgtgcgcacccgccgggaaatcgacctggagaagttcgccatcaaggcgctgcgcggcgacttcgagcgcatccccatggagggcgggcccatggcccgagccaacgccgccctcgtcgccgcgcagtcctga

SEQ ID NO: 5126 - DNA, 1818 bp, Myxococcus xanthus
acagcggccaacctgagccccgcggagattgccacgctgctggcggtgccgcagaacccgaaccggcgcttccccacggcgcagaacacggcccggttgaagtcggcgcgggacggcgtggcgcgaaggctgctggacgtggaggcgcttccccgagggcccgaggcggcccgcgtgtcggcggagacggtgctgcgtgaggtgcgcgacacgcctgtgcccaccgacctgaagccctttccccgtgaggcgccacacgtggcggtgtggctgcgcacgcagcggccggcgaatgcccggctgcacaccacgctggatgcaggcacgcagcggatggtggagcggttgatgcgggacgcggcggtggggctggcgccgcgaggcatctacaacgggacggcggtggtggtggaccggcagcaggcggaggtgctcgcgctggtgggcaacttcgacttcttcgaccagaagcacggcgggcagattatcggcttcgccacgccgcgctcgccgggctcggcgctcaagcccctgctgtatgccatgggcatcgacctgggaatggtgggaccggagcagttggtggcggacgtgcccacggcctacggcggctatgcgccgcgcaacttcgacggccgcttccaaggtctggtgcgcctggagtacgcgctgtcccagtcgctcaacatgcccttcgtgcggctcttggagcgcgtgggggtggagcgcttcctgggcgccctgcaagcggcgggagtcacgagcctggtgcaggagcccgggtactacggcctgtccgcggcggtgggcggcatcgagctgacgccgctggagctcgcgggcgtctacgtcgcgctggcgggggatggacgcgcgccgccgctgcggctcctgttggacgagaaggcggccgcgccggtggaggtgctgtccccgggcgcggcctggctgacgcgccaggcgctgtcgctgagagaccggcccgatttcccggcacgccgtcggctgacgggcatgccggcgcgcgtgcactggaagacagggaccagcttcggccaccgcgacgcgtgggcggcgggctcggggccccggcacacggcggtcgtctggctggggaatttcaatcacaggcccagcgtgcacctggtgggcgctgacgcggcggggccggtgctgttcgacatcctggagggcgtgggcccgcgcggcctcaacctgccggatgagagcgtgaatccgcccgatgacctggccgtggtggaggtctgcgcctattcgggccacctgccgacggacgcctgcgtgcagcgcaagcacgtctacgcgcggcgctcggcggtgcccaccgcgcgctgcccgtaccaccagcacgtggaggtggacgtggccacggggctgtcggtggggcccatgtgccggacggggcggaagacggagccgcgggtgtatgtgacctggccggccaccatccgccgctggctggaggagcagcaccggcgcctgccggagccgcccgccgccgcgcctggctgcgagcccggaggggcgcgcgcggccccgtccattgtctcccccgcgccgggacatgtggccgtgctgattcccggtgtcccggcctcgcaacaggaggtgccgctggaggcggaggcctcacacgagcgggcactgacgtggttcgtggacggggccctgctggggacggcgcgcgccgatgagcgcgtgtggtggacgccgtccgtgggctcccacgagattctcgtcaccgatgaccggggactgagcgcgaagcggacgctggaggtccgcatgcgaccctga

SEQ ID NO: 5127 - DNA, 255 bp, Myxococcus xanthus
atgcggaaggcggccctgggccgtacgaactttctcttcgtcggccacgaggtcgcgggtgaaaacctcgcgggcctctacgcactggtggccacctgcgaggccaaccaggtcaaccccgaggagtacctggccgacgtgctgctgcgtgtacagacgcatcccaactcacgcatcggtgagctgctacctcacgagtggaaacgtcgacgcgtcgccgagccgcctgacacagtcctccagcccagtccctga

SEQ ID NO: 5128 - DNA, 597 bp, Myxococcus xanthus
atgtcggcaagtgacgcgagctactacgcgtgggccagccggccggagtccgcgcgcgaggcgaaagacgattcgttgacgaaggtcgtcgccaccgtccacgaggcgagtcgacgccgctacggcagcccgcgcgtgttccaggagttgaaggcccgaggctcccgcctcagcaggaagcgggtggcccgtctgatgcggcagaagcggctgcgcgcccggcctcgacgccgcttcgtgaaaacgacggactcggctcatccgcaccccatcgcccccaacgtgcttgcgcgcgacttcttcgccgacaagcccaacagcaaatgggtgggcgatatcacctatgtctggacggcagagggatggctgtacctggccgtcgtgctggacctcttcagccgcaaggtggtgggctgggcgatgagcgaccccatcgaccgtcagctcgtgctggccgcactgagcatggcactgctcaaccgccccgcgcaggacctccaccactcggaccgaggcagccagggtggattcaacgggtcgtcgcaacactcgacgttgaggagttgcgatggggaacaacaagagtcgacgggctga

SEQ ID NO: 5129 - DNA, 393 bp, Myxococcus xanthus
gcgacggcaggacatggttccgaagcggtccgaggtgccatcacctcctcgctcacaacgttgccggagcggatgcgccggacactcacgtgggaccaaggggccgagatggctcagcatgccctcctgcgcgccgacacgggcttggccatctacttctgtgacccgcacagtccatggcagcgaggcacgaacgagaacaccaacggactgctccgtcagtacttcccgaaagggacggacctgtcccgctactctcgtgcggagttggccactgtcgcccttgccctcaacagccggccacgcaagacgcttggctggaaaacacctgccgaggctctcagttcttatctatacttacttcaaccaaacggcgttgcgacgaccgcttga

SEQ ID NO: 5130 - DNA, 153 bp, Myxococcus xanthus
atgtcaaggaaggagtggcccaagaccctgcgcccccgtgtcccgcccattctgttcgccccgtggcggctgggcgtgaagtgggccctgaacttccccaagctgcgcaaggtgctcgaagaggacgtgtacccgcacttcccgcgcaggtga

SEQ ID NO: 5131 - DNA, 936 bp, Myxococcus xanthus
tcgggacaggcgaacgtccgccgcaaggggggccgcatcgaggtcaacggcacgcccgtggagggcgactccgtccgcttccgcgctggcatgtcggaggcctcggccgcgcctggcaccgagccgctcaaggcgggcgcggcgcaggtccgcggcgatgtggtggtgcgcctgcaccgcagtgggctgcagctcatcaacgtcattcccttggaggactacctcgccgccgtgctgggcagcgagatgcccgtgtcgtttcccccggaggccctcaaggcccaggcggtggctgcccggacgtatgcgctccagaagaagctggatgcctacagcaacgcgttccacctgggcagcagcgtgctccatcaagtctatggcggcgtcaaccgcgaggaccctcgcaccaaggccgccgtcgaggccacgcggggacaggtgctcacgtacgagctggcgcccatcgaggcgtacttccatgcctcctgtggcggccggacggagtcggggctcgatgccttgcagcgcgacctgccgtacctccagcccgtcgactgcccctgcggaaagctccccgccagccggtggacggcgacgctctccgacgcggacatcaaggcggcgctccgccacccggcccaggggctcaaggtggcggcccgcacgcggacgcgccgggtgacgcgcgtcaccctggcggacggcgcctccatggacggcgtggagttgcgccgcaagcttggctacacccggctcaagagcctggacttcgaggtggaacgcaccgagcgcggttacgtgttcaccggtcgcggctatggccacggggcgggcctgtgtcagtggggcgccaaggcgctcgccgacaaaggccgggagtaccgggagatcctctcccactactaccccggggccgagctgcagcagctctactga

SEQ ID NO: 5132 - DNA, 276 bp, Myxococcus xanthus
atggtgaacggcgatggcgtcatggtccgcgccaacacgctcaaggtgggcgacaccctgctccgggtcgacggccgcaaggtcgatctgacccaggtgtctgtcttccgctacacgggcaaggtctggaacgtcaagccccagagcaaggtcaagatggagaacgttctggacgtggaggggctgatgaccggctccgtccgtttccagaatgagtgggccaatgactacttccggttgacggttcgcgaagcgctcgacgtcgacggactctga

SEQ ID NO: 5133 - DNA, 753 bp, Myxococcus xanthus
atgcatgagatcatccatcagtgggcgggcaaccgcatcaccatggcgcatgccacggacttctcctggaaggaaggcatcgccgagtacctcacctacgtctacgagctgtcgaagtggcctgcggatgccgccaagacacgcgcgcactgggatcgcctggcgcgcaccgcgatgtactacccggggacgtctgacaatccggtgccgttcctgacgttcgcgggagagacgtatggcaccggctccatgatcttcttcgttcagctcgaggacctgctgccaggcggtcaggagaccatcgtccgcgccatcacggacttcttgtccgggcccccccgtgcacgcagcgtggcagagctgcaaggcgcgctggagcaggcctccggagaagacctgggcgactacttccaggcctgggtctacggaacgggagacgccgattggcccaccttccagacggatgcagttcgagccaacggagagctgagcctgaccgtgacgcagtccgccctgcaacctgggaagctctacccggcgaaggtggtgatccggctgaagggcgacacccaggagctggacgtgcccatcgactttggtctgcaccccacgacgggcaccatcaccgtgtccgtgccgttcgaggaagacgtcaaatcgattggcgtcgaccctgagaaccgggtcgtgagctggaacgccaatgccagcctgtctccccttgaagccccccctcaacactggatcttctag

SEQ ID NO: 5134 - DNA, 246 bp, Myxococcus xanthus
atgcttgccctcgcgacctcgcccatcgacccttccttgtcggacgtcgccaagaaggggctcgtgggtgagaagtacgacctcttcttcaaactggcccagatcgaccggcaggccgcggtcgacgccttcgggcggctggacaacccgaagcttcgaagcctgctacgcgaagcgctgctcgcggggcttcatgagtcgggcgcttcgtatgaagaggtccagcgactgacgcggcacctctga

SEQ ID NO: 5135 - DNA, 1032 bp, Myxococcus xanthus
atgaagtcgatgggaaccacccagttggtgtacttcctggatgcccagggctcactcttcctggcctacgagctcgtccgcgagggcgagcgtggcgacgcccccgcgcgcgacaccgtctatgtggaccccgccacggggagcgtcctggacgttcatccgcagtaccacgccgcgcagaaccggcggatccactcggcgggcaacggcagcaacctccccggtacgctgcgacgccaggagggcggcgccgccaccggtgatggccacatcgacgacaactacgaccacgtcggcaccacgtaccgctgctactcgaccatcttcgggcgggattccttcgatgacgctggcgcgaccatcaccagcaccgtccactacggcagccgctacgtcaacgccttctgggatggccggcagatcgtcttcggcgacggggacaacttcaactcgggcgagctggggcgcgatctggacgtcgtctcccacgagttcacgcacgcggtcacgcagtacgactccgggctcgtgtaccgcaatgagtccggcgccctcaacgagagcctgtccgacatcgccgcggccatctgcgagagctgggcgcgcggcaccgtggacgcggacgtctggaagattggcgaggacatctggaccccgggcacgtcgggcgacgccctccgctacatggacaaccccacccgggatggctcctcccgggacttctacccagagcgctacgtcgggactgccgacaacggcggcgtgcactggaactccggcatccccaatctcgcgttcaagctgctcgtgacgggcggcacgcaccctcggagcaagacgtccatcaacgtgtcaggcgtggggatgaaccgcgcagcgcagaccttctactacgcgaaccagttctacttcacggccaacaccaccatggcccaggcccgagccctgaccatccaggccgccgcggaccgctaccccactgacacggtcaacgccgtgcgcgatgcctggagcgccgtgggcgtgcagtga

SEQ ID NO: 5136 - DNA, 276 bp, Myxococcus xanthus
atgctcctcgccgacggcaccatggtgaaggcccataccctccaggagggagacatgctcctgggctcgaacggcctcaccctcttcctgtctcgcgttaccgtcttcaacttcaagggccaggtgtggaacgtgcggcccgcgagcctcaacaagaccgagaacgtgatgagcgcggaaggcttcctgacggggtccgtgcgcttccagaatgagtgggcggcggacgcctatcgtctgtccatccgcgaggacgtggacgtcagcggtctatag

SEQ ID NO: 5137 - DNA, 1971 bp, Myxococcus xanthus
atggagggcggcgccaacagtccctccttcccgtcgggcgacgcgtgtagcggcccagcactccccccgcgctgccactgcgcctcgtgcgtggaaccaccacgtccacagcccccgctgtcgtcaccaacgtgcgcaggtagttgccattgcgcacgcccacgcgccccaccatcggctggtcggattgcaccgcttcgtgcgcggggggactcacttatcgggacccgatcgcgccacgaggctggcctcgcgagtaggttgtgtgcgttggtactcctagacccaagctccgagacagacatgcaccgaagtcctggctccatcctcccgtcccggggggcctctccgcgtcctttcctccccgtcaacgtcctgctggtgtccgtactgctggcccttggctccggctgtggcgactccgaacccgacaagacgaacgactgtccgaacccgtccgtcggctgcggccagcaagactccgggacgcccgacgcgggcgcccccgacgccggcaatccggacgcgggcatccccgacgcgggcgaccccgacgccggcaatccggacgcggggcatcccgacgcttgcaaccccgacgcgggcaatcctgatggcggaggccccctgcccaccgtccccaccctcatcgaaagctcgcagtccgcccaccaggtatcggccgggcagacggtcaccttccacgtcaccggaagggatgacctggcgtgcccgcttcagttctcctgggacgccagctcgggcaccctggggagtccggagacctccgccgcgacgagtgatgtgacgtggacagctccgcactgcgtgctctggagctccgaggtcaccatcaccctgaccgtcacgaacaacgcccggctctccacctccaagtccttcacggtgtccgccccgcgatgcccgggccccgtggtctcgggtggtgtctcacactcgctggccattcgtggcaatggcaccctatggagctgggggcacaactccttcggccagctcggcgatgagacgaacgccacgcgccacgcccctgtgcaggtgccggggttgaccgacgctacggccgtggcagggggccacgcccactcgctggcctcacgcgccgacggcaccgtctgggcctgggggctcaacggcggcgcgctcggtgatgggacgacctccacccagtacgcccctgtgcaggtatccgggttgaccggcgccatctccgttgccgcgggctccagcttctcgctggccctggacgccgacggcaccgtctgggcctgggggatgaacgggagcggcgagctcggcgacgggacgaccaccgatcgcctgaccccggtgcgggtgtctggcttgagcaacatcaccgcgctcgccgcgggcaccggccattcactggccctcggcgccgacggcaccgtctgggcctggggactcaacttccatggcgagctcggcgacggaacgaccgtcagccgccccctccccgtgcaggtgcccgggctgaccggcgtcatcgccgtggccgcgggcatgtaccattcggtggccttgcgcaacgacggcaccgtctgggcctgggggtggaacctgaaaggtgagctcggtgatgggacgaccacccagcgagagagccccgtgcaggtgcccggagtcacaggtgccatcgccgtggccgcgggtggctaccattcgctggccctgctgagcgacaacaccctccgggcctggggcaagaacgaagatcgccaactcggcgacgggacgaataccgaccgacataccgccgtgcaggtctccgggctgaccggcgtcacgtccgtcttcgcgggcggcggccattcactcatcctgcgtaacgaccaggcagtgtgggcctttggctccgatgtttccggccagctcggagacgggaacacgccgtccggccacggtcccgtccaggtctccctaccgtga

SEQ ID NO: 5138 - DNA, 1611 bp, Myxococcus xanthus
atgctgggtgcgttcctgctggcgggagcagcctcggccgagctaccggactacacgttccagttgcaagcgcgcaccaacctggccgtcaacacggaggagggctcctacaacgtcgaattgggcagcctcacctccgccggcagcttcttcattcccgtcaccgcggaccggcaggtggccttccagctcgccatcacgcgggagggacgtccgggcgtctggtacggccagaacggccagggcggccgcatctacctgctccctgacggcctgggagcggatgcacgccttggcgaggtcagcctcaactcgcaccggcagttggtcttcgccgtcaccgggacgaatgacgcgtcgaagaacggcatctacgtgctgaacgcggacgaaccagacgcgccgccgcagatcgtccgctcgccgctgggctcctccagttggtccagcctggtcatgaacgaggcggggcagatggccgcccgagtcacgctgagcacgggctacgcctacgtgctgtacacgcccaatacgacgggtggcttcgacgcgaaggttctcgctgcggagaagtacgtcgacccgggctacccctacacgttcctctactccccgggcgcgaacgacctggggcagatcgccgcggcggtggacctgcaagcgcccacctccagcgcctggtaccaggagctgcgcatcttcaacccggatgggacgtcgcaggtcatcgcggacacgcgcgggcacaacccggactccaacatcttccgcttcgccgccgtgcagcccgccatcaacaacctgggccaggtggccatccaggccacgctgctggaggcggctgggcggcagagcaccgccatcctcctgtgggatggcaacgagctgaaggtggtcgcgcagaacggaatggacgtgccgggcgagcccggcgaagccatcgggacggtggaggtattcccgcccgacatcaacgaccgcggacacgtggtcttccgggccacgcgcaagtcggacgggttccgcgcggtgtgggtgagtgacggcgagaacttgaagcgcgtggtcaccgagcacgacatcctcccctcggacaagggtgacgcccgggtggatcaggagaccccctccaacccggtgttctccggcatgccgagcatcaaccgccacagcgacatcagcttcggcgtgggcctggccccgccggagacggaccaggtggaatggggcaccgccctctacatcgcccagtcctcgctctggacgccggacgccccggacgcgggcaccgaccccgagcccgacgcgggcaccgagcccgacgcgggcaccgagcccgatgcgggcaccgaccccgagcccgacgcgggcaccgaccccgagcccgacgcgggcaccgagcccgatgcgggcaccacgcccgatgcgggcaccaccccgccggacgcgggcccgggcacccccgagccgcagcccaacccggagtcggacagcggctgcggctgccagtccacctcggccgccggcctctggcccttcgcgctcgcgggcctggcgggcctgacgcgccgccgctcgctgaagcgccgcgagcagcccccgcgcgactga

SEQ ID NO: 5139 - DNA, 1008 bp, Myxococcus xanthus
atgtacttccaggccatcaagaccgcgggccttgcccaaatcacctacatcctgggcagtgaaggcgaggcgctcgtcgtcgacccccggcgtgatgtcgacgtctacctggacgtgttgcggcggcaggagttgcggctgcgctacgtgctccagacgcaccgccaggaagacttcgttgagggtacttccgcgcttgcccgccttgcaggcgcgcaggtggtggctggccggcaccccatcaccggccatgccgacgtgcggatgggcgagcgagagcggctacacctgggggccttgacgctggtggcgcttcatacgccgggccacacgccagagagcatgagctgggccgtctacctggatccccaccatgcccaggcttggggcgtcttcacgggcgacgcgctcttggctggagagacagggcgcacggacctggctgcgccagagcgggtctacgagaatgccgcgctcctctttgattcgctccatcagaaggtcctgcccctgggcgaccagacactggtcttcccggcccacggagcaggctcggtgtgtcgcagcggcatcgcggacagggagttgacgacactgggcttcgagcgcctgcacaaccccgtgttcacctccagccggagcgacttcatccagcgcaaggtgcaggagcggcttcaccggccttcgtatttctcgcgcatggaggaggtgaacatacgcggtggcgtgccactctccgcggattcatccgccatccccttcctggagccgaaacgctttcagtgggaaagtcacagtggccttgtcctggacgtgcgtgagcccgagtccttcgctggggggcacatcccgggctcgctgaatgtctggatgcaggggttgtccgtgttcggtggacagatggtacagccgggcacgccgctgttcctcgtcctgcctgcgcacgtggactcgaaggaggccgtgctggccctggcccgcgtcggcctcgaccagggcttagagcgc

SEQ ID NO: 5140 - DNA, 2438 bp, Myxococcus xanthus
atggcaaacattaccgttttctacaacgaagatttcgggggtaaacaggtcgatctgaagcctgacgaatacaagcgggacaagctggaggcgctgggcatcgagaacaacaccatcagctcggtgaaggtgccgcctggcgtgaaggctatcctctacaagaacgatgatttcaccggcgaccagatcgaagtggtggccaatgccgaggagctgggcccgctgaacaacaacgtctccagcatcaaggtcatgtccgtgcccgtgcaacccagggccaggttcttctacaaagagcagttcgatggcaaggaggtggacctgcctcctggtcagtacacccaggccgagctggagcggtacggcatcgacaacaacaccatcagctcggtgaagccggagggcctgaaggtcgtcctattcaagaacgacaacttctccgccggcgacacgctgtccgtgacttccaacgccccgagcctgggcgcgatgaacaacaacacctccagcatcagaatcaccccctgacgctggcgcgccggcattccaggtgacggtcgctgccgcggggaccgccaccctttcgagccccagagactctcgaatcacctgcatccacgacggcagggggcggccccacccccactcggtgaccccattcacgctcacggccgagctagtgccctgagcgtctgcacgcgctcgtccctccagtcgaagacggcgagcgcacgcgctcgcctgcgtgaggtgtggaggcaggctcaaggcacttggcgtacgtgatggggcccccggggtgcgggcaattctgaagcacctggccttgcccacggcatgtgcgaggagaccgggtttgggagtagcccgcatgacccgccctcaggcggatccgctcgaggtcggccaccgaaccccgcaccctgctggatccagcccaggttgagcccgagggcgaggttccacggtcggtttccggtgactggcatcggcggccctcctccctgggagcaacgatgcgcacgccgctcggacagggacaggcacacggaggggcccaactccggctcaggtggtcaagagtgacggagggctctggcgcgttgagagatgagcccccgcgcgaaggcgctgccgtcgcccggccaggctccctgtggccccctgcactgggccaaccagctgctgaaggacccgtcccgcaggacggagctggtgcagcgctggagcctgggagcgaactggcgctcccaggcccgcccgcgcggtactgtgtcaccgtccggtgggcgtcgtgccgggaggcttgattgcggacgaggaccctgttcggcgagcgccgcgaagagcgagctgttcagggactgggctggaggactgtgtcaggcggctcggcgacgcgtcgacgtttccactcgtgaggtagcagctcaccgatgcgtgagttgggatgcgtctgtacacgcagcagcacgtcggccaggtactcctcggggttgacctggttggcctcgcaggtggccaccagtgcgtagaggcccgcgaggttttcacccgcgacctcgtggccgacgaagagaaagttcgtacggcccagggccgccttccgcatcacgccggtacacccacgactgcaacgtgctcaaccgcacgcctcgatgctgggaaaactccttctgcgtcagtccgctcgcctcgaaggcttcagcgacccggaaccactcctgcttctccaccggctttgacattcccgccagggcctcggcgccgactcctcactcaacgcctctcagcacgtctttggccggacggatacggtactgtagacggattgcatttccggagcgcggtgcccaatgcttccggcggcttctggcaacgaatgggccggggccgctcaacggaggagcactgcaatggcaaacattaccgttttctacaacgaagacttccagggtaaacaggtcgatctgccgcctggcaactacacccgggcccagttggcggcgctgggcatcgagaacaacaccatcagctcggtgaaggtgccgcctggcgtgaaggctatcctctaccagaacgatggtttcgccggcgaccagatcgaagtggtggccaatgccgaggagttgggcccgctgaacaacaacgtctccagcatccgggtcatatccgtgcccgtgcagcccagggccaggttcttctacaaagagcagttcgatggcaaggaggtggacctgcctcctggccagtacacccaggccgagctggagcggtacggcatcgacaacaacaccatcagctcggtgaagccgcagggcctggcggtcgtcctattcaagaacgacaacttctccggcgacacgctgcccgtgaattccgacgccccgaccctgggcgcgatgaacaacaacacctccagcatcagaatctcctga

SEQ ID NO: 5141 - DNA, 1701 bp, Myxococcus xanthus
gtgttcatcgacttcgagggaattgacggaagcggcaagacgacgctctccaacctgctggccgcgaagctgaagcggctgggctaccgggtggcgcatgcgcgggagggcggcgagctgcaggcgcccgcggcgcggcgcatccgggagctgacgcgagactcccggctgctggagatgtctccacgcacggagttcttcctcaacctggcgcgggacgcccaacaactggatgaagtggtggcgcccgcgctgtcccggggcgaggtgtgcatcaccgaccgctacctgtactcacaactggcgctcagcggtggaggccgcgggctgcccatggacgagctgcgacccgcgtgcgagctggcctcgcagggcctgtggccggacctggtcatcctggtggacgtggatccggacctcgcccggctgcgcaagcgcctgggcaagctccaaagcaagcgcgtcagtgatggggacagccggaagggactggtgggcgcgggcctggcggtgcgcgtgcgcgagtccttcctggagatggcgcggaaggatccgcagcggtggatcatcctggagaacaacgacgtccctctgcgcgtgttggagcagcggctggtggacgccgtcgtcgcccggctggaggggcgcgagcagcaggtgcagcgcatcgtcccggcgccggcccggccacggaatgccagccccaccacgctcgagaacctggaagagcgattcttccagacgctggacaccgtggagcagcgcgaaccggcgctcgcggtgtggatgttgagcggaatcccgggcctggccgcgcaccagaagcgcctggccttcgcggagcgcttcccgggcctcaccgcgcgcggcatggcgggcctggctgacgtaccggccatgggcctgcgcgaggtgctggcggacctggcgcccgcggaggtggccttcagcctcacgggccgcatggactcgcgcgcggccatgttgcggcagcggctgtacgcgcaggcccccacggaggtgctggcgagcctcaagaacgatggctcgaccccggcgtgggccctgcgcgagcgcgccatgcgggacgggcggctggcggacgtgctcgcggggctcgccggccaggactgcgaggagtcctggttggtgcgcgaggcgggcatgcagcgcaagctgttctcggaggtggcgagcagcctcaccagtgtcccgggggcgcgggcggatgcgctgcgcgaagtcctgctgccgcatgaccggctggcggtgctgcgcagcaccctgggcctggacacaccggtggcccgaggcctgcgagaggccctggcgggcaaggcgctgaagctggtgctccgctcgctgacgggcctggacaccgaggaagcctggacgctgcgcgagcgcggcgcgccgcaaacgaaggaggcgctggattcggtggacggcatggatggcacgcgggcctggaagctgcgtgtggaccatctgggccggtggcccaccaccgcgctgtcctccttgaagggactgcccatggggccgcacgcgcaggcgctcatcgagcgtgtgctggcggaacagccagaccggctgccggtgctgcgcaacgcctacgccgtagcggcgaccgcacgggcgctcgcgcagcagcccgcgcgcacggtccgcgtgggcacctctccccgaatggaagcctag

SEQ ID NO: 5142 - DNA, 654 bp, Myxococcus xanthus
atgctcgagcgcctctcggatgccgcggagcccttcacccgctgggcgcgggcgtcggcaccgggcaagccgttctcctcgagcgtgggcgtcaatacgtaccaggcccttttccgccatgccctggagggcgccttgccgggcgacaccatcgcccacgttgcacctccggcctcgcaggcgctccccccgcacgaggtgctcgtgcgcacgcgcctgggccagagcggtttcacggttgtcaccaatggcttcggctgggtgccgcaggcgagcggaaagcgggattcaggtgccgcccatgtggagctggcggcgtggatggactcgcacagcccggagcgcgccctggccctgtcggcgctggggacgctgatgcaatcgaacgagggcagccagtcagcctgggcgccgggcgacatcgccgtcgtctccgacccgctcctggggctgcgccacttcgtcatcgcacaggggcccgccgtaccgctgcctccaggctcgcccgtgaacctgttctgggtcatccccctgctcgcggccgagttcgagatggtgcggcgggccggccccctgcactgggccaaccagctgctgaaggacccgtcccgcaggacggagctggtgcagcgctggagcctgggagcgaactga

SEQ ID NO: 5143 - DNA, 750 bp, Myxococcus xanthus
atggccactggttttacgaccgagcgtgtgctctcggtgcaacactggtctgaccgtctcttctccatcgtctgcacgcgcgacagcggcttccgattccagaacggtcagttcgtgatgatgggcctcgaggtcgaaggtcgcccgctcatgcgcgcgtactcgatggcgagcgcgaactacgacgacacgctcgagttctactccatcaagctccaggacggcccgctcacctcgcgattgcagaaggtcgctccgggcgatcaagtgctcgtgggcacgaaggcggtgggcacgctcaccgtcgcgaacctcaggccgggtcgtcacctgtggatgctcgccaccggcaccggcctcgcgccgttcctgagcatggtgaaagaccccgagacctgggagcgcttcgagcgcgtcaccgtggtgcacggctgtcgccacgtgagcgacctctcgtactcgaagttcttcgaagaggtactgccgaacgacccgtacctgggtgatctcgtgcgcgagaggctgacgtactttccgacggtcacgcgtgagccgttccgcaatcagggccgtatcaccgacctgcttcgcgcgaagccgctctcacccgagcacgatcgcgtcgtcatctgcggcagccacgagatgatcaaggagaccgcgaccattctcgaaggcttcggcttcgaggaaggcgactcacacgagcgcggcgacttcctcatcgagaaggccttcgccagtcgttga

SEQ ID NO: 5144 - DNA, 1008 bp, Myxococcus xanthus
atgggggaactggccaacggcatcgggctgacgccgacgatgtactcaccgcagccgacgtaccgcggcaacttcaacaactttggcgacccggcgttcccggacccggcgcgcatccgcctggacgtgaacacggcgcccggcgtgtatgacctgtccgtgggtggaggcaacaccttcacctgtgatcgctgcgtcttcggctaccaggatgagggctcgcccgcggagaagttcttcgtcgccgacgcgggcacgctcctgctcgccgtgaaggtgtcgccgcagcagacccttggcgcgctgacgaacgtgacgctgcgtgagtcggtggatgccccgcccctcaacgcgccgtactggggcagcgcggtggttccgggcggcgagtgccggtggattcgcttcgcgacgtggaacacggtgcgccaggacgggtgcgaccctcgccagggctcgctgacggcgaacctgccggacaccacctgcgtcccgaatgactacgtcgcctccgacggcacgctggagcgcgcgctggggacccaggtccagggagaggcctgcacgaagaccgcggcggcgagcgagtccgaactggcctcgacggattgcgagcagggcttcgcctgcaccgacctgctgtcggagaacgcccagtgcctcaagacgtgtgacttcatggcgcccaaccccggctgcccctccggcaccatgtgcggcgtgtacggcctgtgcaccgagcagtccgtcctcgagcagaacggcttcacgttcgaccccgcgctgactggtgagatctgcagcctggaattcgcgcattactgtggcaccgagggcgcgcgtggtgtgtgtgccgacctgaaccgcgacggcaagggcgagtgctacccctaccaccgcgcccgctccgagtgtggcccgggcgatgagctgggttacatgaactacgcgctctccggtggcggcttcgaccgcggccacggcttctgctaccacgacggcctctag

SEQ ID NO: 5145 - DNA, 714 bp, Myxococcus xanthus
acgcgccgcttcttccaggacatcgacgaggcgcacctgcggcgggcgctgaacgcctttccgggcgagctgctggtgctgcatgcgccggcggaccggtacgtgccgctcgagcacgcccggcggtggatggccatggcccgccgtccggccagtctgatgctgctggagggcgcggaccacttcctgtcccacgacgcggacgcgggccatgccgccgacgtgctgggggtgtgggccgcgcggcaggtgacaccggtgcgggagcgtgaggcgcccctgcccccgggcgtggtggaggtccacgaggcgggggagggccgcttcgcccaggacatccgcgtgggggcgcaccggctgcgctcggatgagccgctgtcggtgggcggcgaggacaccggccccacgccctacgggctgctgacggccgcgctgggggcgtgcaccgcgatgacgctgcggctctacgcggcgcgcaagggctggccgctggagcatgtccacgtgcggctgagccacgagaaggtgcacgcgaaggcgtgcgaggagtgcgagacgaaggacgggaagatggaccggctgcaacgtacggtgaagttggagggcccgctgacggacgcgcagcgcgcgacgctggtggccatcgcggaccgctgcccggtgcaccggacgctggcttcggatgtggatgtccatacggacgtggagcaatga

SEQ ID NO: 5146 - DNA, 552 bp, Myxococcus xanthus
atgatttcgagtgagcagcgcttcgtgtggctggacctggagatgaccgggttggacccggagacgtgttccatcatcgaggtgggcgtcatcatcaccggtccggatttgcggcccatcgcggagattgagcgcgtcatctggcagccggaggaggtgctcctgcgcatggagcccgtcgtccgggagatgcacacccgcaacgagctcctggagaaggtgcgtgcctccaacacctcgctgcgcgtggcggagcgggatgtcatggcgctcgtcaccgagcactgcgccctgggcgagggcatcctcgccggcaactccatccacaccgaccggcgcttcctcatccgctacatgccgctgctggagcgctacctgcactaccgcatggtggacgtgacgagcctcaaggtgttgacgcgcgcctggtatccgaacctggtggagccgcgcaaggcgcccagcgggcacaccgccctggcggacgtgcgcgccagcatctcggagttgcagtactaccgcgacaccctctttcgcgggacgccggcctag

SEQ ID NO: 5147 - DNA, 1080 bp, Myxococcus xanthus
atggtgcgccaggtgaagggcgcgggcacgctggtgccggagtacatccgctggctcaccgcggacacggcgggccgggtggagcgcatccacgtgcgacctggggccacggtgacggcggacacgctcctgttggagctgtcgaacccggacgtgcagctccaggccttggaggccgagcgtcaactggccagcgtggaggccgacctcatccaggtgcgcatggagctggagacgcagcggctggcccaggaggccatggtggcggcgctcatcaacgagtccgccgaggcgggacggcgctccgacgcgaacgaggcccttcaccagaaggcacatatcggcgacctggagatgcagcaggcgcgcgagaaggccgcggagctgagccgtcgcctggagctggagcgcaagaagctccaggtggtggcgtccagcatgaaggagcagctcaccgcgcagcagggacaggtggagcgcctgaaggcggtggcccgcttccgccgcgcgcaggtggagtcgatgaaggtgctcgcgggtgaggatggcgtgctccaggacctgccgctggagctggggcagtgggtgacgccgggcgtgctgctggcgaaggtggtgaagccggagcggctgaaggcggagctgcgcatcgcggagacgcaggcgcgcgacatccagcctgggctgaaggcgttggtggacacccgcaacggcgtggtggagggccaggtggcgcgggtggcgcccgcggcgagccagggcacggtgcgcgtggaggtgtcgctgcccgcggagctgccccgcggcgcgcggccggacttgacggtggagggcacggtggagctggagcggctgggcgacgtgctgtccgtggggcgcccggctggcgcgcagcccaatgccaccatggccctcttccgcttgatgccgggcagtgatgaagccgtccgcgtgccggtgcagttgggccggggctcggtgaacgcggtggaggtgctgcagggccttcaagaaggtgaccaggtggtgttgtcggacatggccgcgtgggacgccgtggagcgggtgcggctgcgatga

SEQ ID NO: 5148 - DNA, 2433 bp, Myxococcus xanthus
atgatggacgcacttcgccgtgacgtgcggcacacgctgcgctcgctgcgccagagccccggcttcgcgctggtggcggtgctcgcgctggcgctggggattggcgccaacagcgccgtcttcagcgtggtgaacggagtgctcctcactccgccgcccttctcggagcccgagcgggtggtgcacctccaggggaacatcgcgcaagccgggctcgaggacatctccctgtccgtgccggagtacttcgacctggcgacgctgtcgcgcgccttcgaatcggtggcggcctaccggggcggcaacctgacgctcacgggcagggacatcccccagcagctcgccgcggtggcggccacaccgtccttcttcgccacgctgggcgtgtcgccggtgctcggccgcgccttcacggaggcggaggccgtccaggggcgtgagcgggtggtggtgctcaccgacacggcgtggcgcgtgcacttcgcgcgggacgcgcaggtgctgggccagacgatgcagctcgacggcgagccgtacacggtcgtgggcgtgttgcccgcgggagtggcctaccccgcctgggcggagatgtacgtgcccttcgtgcccaccgagacacagcggcaggaggaccagcgcggcgcccggttcctgtcggtggtgggacggttgaagcccggcgtgacgcaggacgcggcgcgcacggacctggcgcgcgtggcgctggagatggaggaggccgtcccctcgcggtaccggaaggtgggttggtccttctcggtgacgtcgctggacgaaaaggtcgtgggcaacgtgcgcggcacgctgtggctgttgctgggcgcggtgggcttcgtgctgctggcggcgtgcagcagcgtggccaacctgctgttggcccggatggcggcgcgcggacgcgaggtgtccatccgcgccgcgctgggggcgagccggggccggctggtggcgcagttcctcaccgagagcctggtgctgtccctggcgggcggggtgctggggatgctgctggcgttgtggggcacggacgcgttggtggcgctggtgggagaggcgctgcctcgcgcgagccaggtgcggctggatgcgcggccgctggtgttcaccatgggcgtgagcctcctcacgggcgtgctcttcgggctcggtccggcgctgcatggcagccgggaggatttgagcgtcgccatgcgcgagggcagccggggcacggagggccatggttcgggccggatgcgcgcggggctggtggtggggcaggtcgcggtggcgctggtgctcctggtgggggcggggttgttcaccaagagcttcctggccctgcgcgcggtggacgcgggcttcacgcccgagggcgtgctcacgggcaagctcgtgctgccctccgcgcgctacccggacgcggcacacaaggtggccttccagcgggagctgttggggcggctccagtcgctcccgggcgtggaggccgtgggggtcaccaacctgctgccgctgggagggcgctcggacagcagcttcgacatcgagggacggccgcaggcgccggatgaggtctggcccgcggtggagttccgctccgtcagcccgggttatctgcgcacgctgcgcgtcaccccgcgcgaggggcacctcctggagggagacgggacggaggggccggacgcgccctggcaggtggtcatcaacaagaccttcgcggacctctactggccccagggggatgcgctgggccagcggttgaagctgcactgggacacggcgcagtggaccaccgtggtgggcatcgtggacgacgtgcgcgaatggggcctggatacgcccgcgcggcccgccgcgtactacccggcggcgaaggtgcccacgcccttcctggcgctcgcggtccgggcgaagtccggcggcagcccggaggcgctgcgcaccgccatcgaggcggagttgcgcgccgtggatggcaacctggcgttgtacgcggtggcgccgctgacgcgattggtggatgagtccatcagctcccgccaggtgtcggcgctgttgatgggcctgttcgcgggcacggcgctgctgctggcggcgctcggcatctccggcgtcatcggctactcggtggcgcagcgcacgcgggagatgggcatccgcatggcgttgggggcctcgcggacccgcgtgctgacgctggtactggggcagggcctgcggctcaccgcgctgggcgtggtgctgggcctggggctgtcgctgggattggcgcggctgttggatgcaatgctgtatggggtggcggcgtacgacgggtggaccttcgcgggcgtagcgttgctgctgggcacggtggccgtgctggccgcctggcttccggcgcgccgggccacgcgcgtggacccggccatcgccctgcgagcggagtag

SEQ ID NO: 5149 - DNA, 759 bp, Myxococcus xanthus
atgacgaacgacacgaagacggctgcttccccggaaggcgcggtggcgcaggaggacgcgggcgcggagcccggcaaggcgctcatccacctggacggactgaccaaggtcttcgagaccgaggacgtggagacgcacgcgctctccaacatccacctcaacgtgcgcaagggcgagtgggtggcgattgtcggcccgtcgggctcgggcaagtccaccttgctggcggtgctggggctgctggacacggcgacgcgcggggcctacctgctggacgggcgcagcgtgttggacctgtccgcgacggaccgggcgctggtgcgcaaccggcacatcggcttcatcttccagagcttcaacctcatcggcgacctgacggtgttcgagaacgtggagctgccgctgacgtaccggggcatgcccgccgccgagcgaaagcagcgggtggagcgcgcgctggagaaggtgggcatggcgcaccgggcccgtcacatgccggggcagctctccggcggtcagcagcagcgcgtggcggtggcgcgcgcggtggcgggcgacccgctcatcctcctggcggacgagcccacgggcaacctggactcgaagaacggcgaggcggtgatgcagctcttgacggaactccacaagggcggcgccaccatctgcatggtgacgcacgacccggcgcacgcgcgcgtggccacccgcacggtgagcctcttcgacggccgcatcgtccaggacgaacagcgccgctga

SEQ ID NO: 5150 - DNA, 603 bp, Myxococcus xanthus
atgccatctccgctcatctccctgaggaacgtcgagaagtcctaccccctggctggcggccgggcctgggtgctgcgccgcatcgacctggacatccagccgggcgagttcgtcacgctgatggggccgtcgggcgccggcaagtccacgctgctatccatcctgggcatgctggacgtggactggacgggcgagtacctgctggatggccaggcggtacatgccatgaagcccaaggcgcgcggggagctttcccggcgcaccatcggcttcgtgttccagcagtaccacctgctcgacaacctgacggtggcggagaacctggaggtgccgctgtcctaccgcgacctcaagcgcggcgagcgcgatgccctggtgggcgacatgctggaccgcttccagctcgtggggaagaaggacctcttcccctcgcagctctccggtgggcagcagcagctcgtgggcatcgcccgggcgctcatcgccaaccccaagtgctgctggcggacgagcccacgggcaacctccactcacagcaggcgaagcaaatcatggaggtcttccagggcctcaaccgggacggcaccaccatcatccaggtga

SEQ ID NO: 5151 - DNA, 126 bp, Myxococcus xanthus
atggaggtcttccagggcctcaaccgggacggcaccaccatcatccaggtgacgcactcggaggcgaacgccgcctacggccaccgcgtcatccagctcgcggatggttggttgcagggcgcctga

SEQ ID NO: 5152 - DNA, 1629 bp, Myxococcus xanthus
ctggggcacgcgcacctgggcgtcaccaccaccaggccccaggcccaggcctggttcgaccagggcctgcggctgttgcacctggggtggggcggtgaagcccgccgcgccttcgcgcaggccacgcgcgaggattcatcgctggccatggcctggtgggggctcgccctcacgcgaggctccggtgcccgcttcgccaccgcccgcgcggaggccatgagccgcgcgctggccctgagcgagggcaccacggaccgcgagcagcgctacatcgtcgcgggcagtctgctggcggagaaggggccggccaatgggcgcaacgccttcgtgcgtgacatggagtgcctcatcgaccgctatcccgaggacggcgacgcgcggctgctgctcgcgggattcctcctggacggctacgagccggatggccggcccggacaggggcagccgtatgcacaggccctgctgcgcgagctgctgcgctcacacccggaccacgcgggcgtccaccatgcatgggtgcaggccatgctgaacagcggccggcccgaggctgcccgtgacagtgctcaccgcctggtggcgctggcgcctcgtgccggccccgcgctgctctccgcggggcgcctgcttcagcgggttgggctggtggcggaggcccggcgcgtgctggaggccacggtggccgcggacgatgcgtacctggccgaggaaggactgcacaccgccgacgcgccgagtgccgaggcggccatgcggctgctcagtcagggctgcgccgaagcgggccagtacggcgagtcccaggcgtgggcccgtcgcctgcggcagcgggtggaaggtgctggaggtgacgaccaggcgctgctgttcgccgcagccacgatggtgtccgcgcacctgcgcttcggcttctggcgtgcggcggcggacgtgcccatggagctgtctgatacggccagccctgcggagcgggcgctgcgggacgggatgcgccagtacacgagaggactcagcctgctcgaggccgcgcggctgggcgaggtggagcgggtatgtaactcactggatgcgcagcatgcgctcctggcggaggctcgccgctcggaggacctggccctgtgtccacgagatgtggcgcgggtggtggaggtggccgctcatgagctgcgtggcgcgctggaggttcgcaggggcgaggtgggccgcgccgaggccacgctgacgcgtgcgtggcggctggagcggcggcttcgggccgcagggccggcggccttctcccggcccgcgcgcgaggcactggtccggctgcgtctgcgcacggaacgcgaggacaaggcggtggggctggcgaagacgctggtggcggagcggcctgggtgcgggcacttgcgactgctgtccgcggagtcccaggtggcgctcggcgcttggagcagcgcggtggaggacttcgccgcgttcctcgactgctggcgtgacgcggacccgcatcagccggagcttcgccgcgctcgggccttcatcgccgggcgggggcgcctgctgcggctcgtgcgcccgccggagctccttgccctacgagagaccggggccccggccctcgctgcgcatgggacggtgtcctgctga

SEQ ID NO: 5153 - DNA, 708 bp, Myxococcus xanthus
atggacgcatcattctcagccctgttcgagggcgcgaaagcggagctcagcgcgctgtccgtcaccgcgattctgccgcggatgctggccgcggcgctcattggcaccctgctgtcgctgcggccctggcgcctgctcatgaagcgggcgctgcccaaggtggacatgattcaggcgcaggtgctgctgtgcgcggcggcggcggtcatcaccgccgtcatcggtgacagcctggcgaaggccttcgggctggtgggcctgggcggcttcgttcggttccgctcgggactcaaggacccgcgtgacgcggccatcctcttcctgatgattggcctgggcatggcgtgcggccacggcagcctggggcttgcctccgtcgggacggtgttcgtgatggtcctgctcttcgtgctggattgcttcaaccgcgaagaggcgcacgccactgcgaagcagcggctggtgctgtcggcgcagtcggatgacctggtgggcgcggaggccacgctgcgccgggtcctgggtgagcggaacgtcatggtgaagagctgcgcgctcgacttcgacgggcggcggctggagttggaagtcgaggagccggagccgggctccctcgccgcggcgctgggccgcacggagggagcggccctgcgaggcttgcggtggacggcggtgaattcgagaagcgcacgggaggagcggatatga

SEQ ID NO: 5154 - DNA, 1362 bp, Myxococcus xanthus
gtccttgtcgccgacgaccaggcggacgtcctggaggccctccggctgctcctcaagcgggatggactcaccgtcgtcacctcgcagtcgcccgcgggtgcgctcgccacgctggaggccgaggacgtggacctggtcctgatggacctgaactacgcgcgcgacaccacctccgggcaggagggcatcgacctgcttggccgcatccgcgcgcaggatgcgtccctgccggtggtggtgatgacggcgtggggcagcgtggagggcgcggtggaggccatgcgcgccggtgctcgcgactatgtgcagaagccctgggacaacacgcgcctgctggccacgctgcgcacccagttggagctgcgccgggcgttgaagcgcagccgccggctggaggaggagaaccagcacctgcgccgggggcagggcaatcagctcgccatggtgtccgagtcgcggtccatgcagccggtgcggcggctcatcgagcgggtggcgccgtctggcgccaacgtgctggtgacgggcgagcacggcacgggcaaggaggtggtggcgcggctgattcatgggggctccacgcgctccgagcgggccttcgtggcggtcaactccggcggcctgtccgagggtgtcttcgagagcgagctgttcggccacgtgaagggcgccttcacggacgcgaagtcggaccgcatcggctgcttcgagctggcggacggcggcacgctcttcctggacgagattggcaacatgccgctgtcgcagcaggccaagctgctgcgcgtgctccagacgggcgagctgcatccggtgggctcgtcgaagacgcggcgggtggacgtgcgcgtggtgagcgccaccaacgtggacctgtcgcgggcggtggcggagggccgcttccgggaagatttgctgtaccgcctcaacacggtggaggtgcagcttccgcccctgcgcgagcgtcgcgaggacatcccgctgctggccgcgcacttcctggccgaacagggccggcgctacggcaggcccaacgtccggctgtcctcggaggcgctggaggccctgctggcctatgcgtggccgggcaacgtgcgcgagctggagcacgcggtggagcgcgcgatgctgatggcgtcgggtgacgaggtgacgcaggaggacctgctgctcaagcgggccggccgcgagggcatggcgcggctggaggagatgacgctggaggaggtggagcgctacctcatcgagcgggcgctggcgcggcacgaaggcaacgtgagcgaggcggcgaaggggctggggctgtcgcgcagcgcgctgtaccggcggctccagtactacggcatcaagggcgctcggtga

SEQ ID NO: 5155 - DNA, 1152 bp, Myxococcus xanthus
gtgatgcggccgctgcacgcggtggccaacctgctggccgccctgcgcgaaggggactactccgtgcgcggccgaggcgcgcgggcgggggatgcgctgggcgaggtgctgctggaggtgaacgcgctgggggacaccctgcgcgagcagcggctgggagtgctggaggcgggcgcgctcctggagcaggtgatggaggagattgacgtcggcgtgctggctttcgacgtggcgggcacgctgcggctggtgaatcgcgcgggcgagcggctgctgggcgcgtcacgctcgcagttggtgggtaagggcgccggagccctgggcctgacggacctgctggagggcgacgtgcctcgcaggctgacgcgctccttcgcggaggagggcggcccctatgagctgcggcgaggctccttccggcagggcggcctgccgcaccagttggtggtgcttgcggacctgcggctggcattgcgtgagcaagagcgcgaggcctggcaacggctggtgcgggtgttgagccacgaaatcaacaactcgctggcgcccatcggctccatcgcggaggcgctgcgcgacacgttgctcatggcgccgcgtccgtccgattgggaagaggacgcgaagagcggactgggcatcgtcgcccgtcgctcccaatcactggcgcgcttcatgtccgcctacgccagcctcgcgcggttgccgcctccgacgccaggcgccgtggaggtggacgcgtgggtgcgccgggtggccgcgctggagaagcgccggaaggtgggtgtgcgcgtgggccccggtttggtgctgcgcggcgacgtggaccagttggagcagctgctcatcaacctggtgcgcaacgcggtggacgcggtgctgtccgctccggaggccgcaggggatgtctgggtgtcgtgggccgtgttgtcgccgggcgcggtggaggtctgggtggaggacgagggccccggcatgacggacacgggcaacctcttcgtgcccttcttcaccaccaagccgcagggcagcggcatcggcctggcgctcagccggcaaatcgcggaggcccacgggggcagcctgcgcctggagaatcgccccgagggcaagggctgccgcgcgcgcttgaagctgcctcagggcgcgtga

SEQ ID NO: 5156 - DNA, 2421 bp, Myxococcus xanthus
atgttggacgtggagcagcgcaaggtgacgcacttccgcgagcacctgttcgccaccgaggagcccgtcatcgacgcggcgggcaatgacatcttcgagaatggccagccgaaggtgattcacgcccgcgacctgctcttcgacgcgttcttcgggctgcgctccgggggcacgcagcgctggctcagcacgcaggaggcggaccgggacgccagcggctacgcggcatgggcgccggagaagacgggtggtacggggctgggcgcgctggtgcagcgggtgggaacgctggaggcgacgacgttcgtcttcgcgccgcagggcctgccgcacgcgtccttcgtcatggcgctgcgcgtgcgcaacaccggcacgtcggccgtcacgggcgtgagtgccttctcgctccacaacttccacctgggcttcggccgtccgggcgtgatggcggacgtggatgagaatggcgagacggtggagttgagcggcgacgacttcgtggagaagggcttcgcgggtgtgttggtggcgcggccgctgggcgcggtggcccggaagtcggcgtggctgtccacgacgacgggcccgcagaatgcctacgcggtggtgaatgggggcggcgggcaggacctgcaggacttcacggcgcagccctcggcgggcacgggctgggcgacggcgtaccagttcaacctgggagacatcccggcgggcgcggagcggtgtgtgggtgtggccttcgcgcgccacggtgaccccgcggccggggccacggtgcggcagtggctgacggagtacgcgggcgcgtccagcgcccaggcgctggtggacgcggaagtggcgcggtgggcggcattccagacggacacggtgaaggtgcccgcgggcatgtcggcggacgaggagtccctgttgcggcactcggcggtggtgctgcacatggcgcaggtgcgttcgcgcgacgtgtacctgcgcgagttcctgtcgcgggatggcgagccgcgccgcacgcgcttcaaggcgcctgacggaacgccggcgtcgctgccaggcgtggttcgccacgcgggctacggcgcggtgctggcgagcctgccgcccgggcagtggacgtacgcctggattcgggacggggcctacgcggtggcggccatggccacgttgggcatgcagagcgatgcgcgcgacgcgctgtcctattacctcaacgcggacagtggccgcttccagcactggcgtgagctggagccgtattcgatgccgccgtacatcatcaccctcacgcgctaccacggcttcggcgtggaggagacggacttcaacgaggcggggccgaacatcgagttcgacggcttcggtctcttcctgtgggcgctgcggcactacgagcggacgacgggcgacaccacgctggtggaccagacttggcccacggtgtccacgaaggtgggggacgcactggtggcgctcatcaacccggtgacggggctcatccgtccggactcgtccatctgggaaacgcactggaaggggcggcagcggtcgtggacgtacaccagcctcacggcggcgcgcggcctgtgtgacgcggcagagctggcgcagcgggtgggcgacacggagcgcgcgcagcgctaccggcaggcgggcgagtccttgcgccgggcgatggcggagaagctgacggacagcaagttcgcgctggcctcgaacctggaggaactgaggaagggcaggggctactgggacgcggcggtgttcgacgcgttcgccttcgagctgttcgacccggcggggaagattgcccaggcgacctatcatggactggacctgcgcctgtcctcaccggcgggggcgggctggcagcgcaacgatgaccggtatgaccacccggatggcgcggatatgagcccttggggtggcgagtacgacagcgcggagtgggtcatcgtcagcctgcgcggcgcgatggccaagcgcatgggcggcgatgcggcgcgtgctgaccgcgtgctgaagtgggtgacggaccagtcgctgaagaactacctggccgtggcggagacgtatgacgagctgaacggcacgtataagtacaacgcgcccatggcgggcttcggcgcgggcgcctatgcactggcgctggaccaccgcgcggccggtgtgagtgacccggcgtgtggcgcgtacttcgatgagagcacgctgacgaagcagccggacgcgggcacgggcacgctggatgcgggcactcagcagccggacgcggggccgcagacgcccgatgcgggcactccgccggatagcggcgcggacgtgggcggtggcggctgcaacgcgacggggccgggcgcggtggcgctgtgggtggtgttggcgttcgcgggactggccgtggcgctgcgtcgtcgcggagcctga

SEQ ID NO: 5157 - DNA, 525 bp, Myxococcus xanthus
atgacggaagcatccctggaggacttggcgcgacaggcgctggagcggtgtcgtgcggcgggcgttcgcctggcgttggtggaggcctgcacgggaggactgctgggcgcgacgttgacggaggtgcccggcgcctccgcggtagtcgagcgtggcttcattccctactcgtatgagtccaaggtggagcagctcggcgtcccgttggcgttgctgcaagcacatggctccgtcagcgctgaagccgtggaggccatggcccatggtgctttggcgcgctccacggcggactgggttctggtggagacaggcatcgcggggcccggaggcggcacgccgcagaagcccgtgggcctggcctacctcgcggtgctccagcggggtggacaggccacggtggaacgacacgtcttcactggggaccgaggtcagatccggcgcgccatcgtgggccggagtctggcgctgctggtggagcggctgggcgtgggtgacctgccgcccacggtgtcagcaggcggctga

SEQ ID NO: 5158 - DNA, 153 bp, Myxococcus xanthus
atgcgtgatccagggcaagcactgttggtgtgtggcgactccgtgctggccgagtgtatcgagcacaagcgcctgcagttccgggagcgcgtcatccttctgcagcagggcgggaaggctcgaaagaagtgctggaaagggggcgagtcctaa

SEQ ID NO: 5159 - DNA, 621 bp, Myxococcus xanthus
atggggcggctggttcgtgagcgagggatagtgagatacttcgagattgagacgctgggagacatcaacaactcggagttgctctttctggaccaagagcccgaggtgctggggctggatggttactgcctggcggcaggcgaacccattgggacggactatccgtctgaggtgaaggtcaagccaagcgaggagcatgccggaatccaactgtcttccttgctgggtaataacttcaactacctcattgcttctgcggcagtgaaggaggctgtctcagagcactgtgtggaggcggccatcgagtacctgccgttcacgctactcgaccaccgcgagcgcgtccgcagccaggattacttcttcatcaatccgctggggagcatcgatgccgtggatgcggctgccagtgatatcaagtaccaccgcagcggtgccgtcgttgcgatccggaagctggtgctggatccgcagaagttgattggggcaccgggactgttccgcctgaagcaagacccgcagcgctacatcgtgagcgagccgttggttcgtgcgttcaaggagcgtggcttcacaaacctggtactgcgggagattgcagtctcggctgtgaaggcttga

SEQ ID NO: 5160 - DNA, 231 bp, Myxococcus xanthus
atgatggaggagcgcgaagtccgctaccggaggctggctgagaaggagaccgaagcggaagaggtgctcgcgaccgaggcctatgtgtccattgaaggccttgcgctggtccgccttgcggtccgagctggactgaagccgcaagaggactacctcttcattccatccaccgcgctggagttaccgcgtctgcgttacagggccgattcctggaagcacctgatgctctag

SEQ ID NO: 5161 - DNA, 156 bp, Myxococcus xanthus
atggccgccatcgtggtgacgggcagcgtgctggacgtcgcgctgggttgggggctgaagcggcagaaggtcgtccccctgagcgcgtacatctcctgctgctcgctggcgctgctgctcaactactcgcattcgagctggctgctcctgctcccg

SEQ ID NO: 5162 - DNA, 369 bp, Myxococcus xanthus
atgaagcggcttctcatcgtggacgacgagctggccatcgtcgaggcgctccaggacatcctgtccgtggagggctacgacgtcgacaccgccttcaacggcgccgaaggcctgcaccgcatggcggacgcgaagccggacctggtgctgctggacttgatgatgcccgtcatggacggccgggagatgctgcgccgcatgcgcgaggacgacggcctgcgagacatccccgtggtggtgatgagcgccggccgcatctccgacgaggagcgccgctccagcgcgcgcttcctcgccaagcccttcgaactggacgtgctgctcgacaccatcgccgagctgctcgtcgagccccagcccaacgcctag

SEQ ID NO: 5163 - DNA, 1545 bp, Myxococcus xanthus
gtgacggacacctctgagcggccggacgaacccgacgcgcgggttcccagcggcgtgccagggctggacgcgctcctgcgcggcggctttcttcgcggaggcacgtacatcatcacgggggcaccggggacggggaagaccatcctcggcaaccagttctgcttcgccaccgtggcccagggtggccgtgccatctacctcacggtgctgggggaatcccacgcgcggatgatgctgcacttgcggagcatgcgcttcttccacgcggaagaggtcggccgcgcgctgagctacgaaagcggatccgccgccctcaaggcggaagggctggcgggcctcagcaagctcatcttccgcgcggtgcgcgagcacggcgccacggtgctggtggtggacggcctggtggccatggaggagcgctccgaggacccgctgagcttccgggagttcctccacggcctctgcgtccacaacgcgctcgcgggctgcaccacgctgctgctcaccgggcagcgcggcgacccgtccgacccacgctacgccatggtggacggcgtcgtcgccctggcccaggagcgcgtgggcgtgaagtcggtgcgcctggccgaggtgacgaagttccgcggcggaccccaggtccccggccgtcacggcttcgagatttccgacaacggcctgtccatccatccccgcatcgaagccctctacacgcggctgcccacgcgcacgccctcgacggacgcgcggctcaccttcggcatccccgcgctggacgagatgctctccggcggcctggtgcgggattcgtccacgctggtggcgggcccgcccggctgcggcaaaacgcagttggggctgcacttcctggcggagggcgcacgccggcaagagcccgggctgtacctcggcttcgtggagccgccggcccggctggtccacaaggcggagcggctggggctggaattgggcgcgcacgtggaagcgggccgggtccacctggtgtcgcgcgtggcggcggagacgcaaccggacgcgctggccgaggagctgttcgggtgggtgaaacaacacggcatccagcggctggtgctggacggactggagtccttctgtcaggaactcacggactccgagcgcacgccccaattcctcgccgccctcatgcacgaactgctcaacctgggcgtcaccccgctggtcctccagcagacgcgcgcgctcgccacaccggaggcggacgcgcggccggacgtggaggcgctcgtcgacaacgtcctggtgctgcggatggtggcgctgcgctcgcggaactaccgcgtgctctccgtgttgaaggcgcgggagagcgaccacgacacggcccagcgactgttctccatgacgcctcggggcatcgaagtcgcggcggacagcgagagcgcggaggccctcttcaacgggcaggccccgtcccacgcggcgcccccgcggaagccgaaacgcaagacagggagcaaaccggtccggcgcggcaagccatcccggcgtggggggcgtggcgtatga

SEQ ID NO: 5164 - DNA, 786 bp, Myxococcus xanthus
atgaggcgcagctgggtggccgtgttcgcggcggggtggttggtggcgtgtggcggcaacagcctgcccgcgggagattcacaggacccgacacccggcggcggactgccgggagagccggtgcagccgggaggaccagatgatcagggcaacggagaggagcccaccgggtcgcagtcgctgtggccgctgaccgcgggcagcacctggacctacgacatccaggaccccgtcgagggcaacttccagaagcaggtgacggtggtgggccccggcgaagtccctgaccagccgggcatcaacgccgtccaggtgcacagccgccaggaccgcgtgcgcaacggcaccctctatgaggagtattcgtggcaggtggagctcaccaacgggctcgtcgtgcgtctgcgcgaggacgactaccgcaatggccagcaggtccgctccaccacctggtctcccgccacggtgaagtccgtggcgagcgttccggacgccctgccctggacgtacaagagcgacgtgctcgagcacatcaccctgggcgacggctcgaaggaccagaaggacccgacgtacatctggaaggtgctcgaatccggcgtgacggtgacgacgcgagctggaaccttcaccaacgcggtcaagattcagcgcgacaaggtcaacaacaacggcgaggtgaagccagacaagacgcgcttctactggctcgtcccgggcatcggaaaggtgcgtgaggaaggcgaacgcaccgaggacctggcggcctacgacatcaagccttga

SEQ ID NO: 5165 - DNA, 1560 bp, Myxococcus xanthus
atgtcggcctcccttctcgaagtgttcctggaccatgcacaccgcgcgcccgagcggcccctgctgacgttcgagcaggagcgcttcacctacggacagttcgccacgcacgtcacggccttcgcccggggcctcaagcagcgcgggctccagccgggggagcgggtggcgctcttcctggagaacagcgcccgcttcgccatcacctacctgggtgtgcaggccgcgggcggcgtggtggtgctggtcaacaccgcctaccggcaggtggagctggcccacatcctgtccgacgcggaagtctgcggctgcgtcaccggcgcggcgggcgccgcggagctggtgccgctgcgggcccaactgccctcgctccagtggttcatcaccggggagcgccccaccaccgcgctgcccgagtcgctcacggaggtccccttcgacacgctgctcgcggagggcacctccgccaccgcgccgctggtgatgccgcgtccggaggacctggcggtgctgggctacacctctggcaccaccggccgctccaagggcgccatgctgctgcaccgcaacctgctggccaacgtgcgggccgtcaccgaggcgtggcggtggacggagcaggaccggctgctgctcaccctgccgctgttccacacccacggcctgatggtgggcctgcacggcacgctgttcaccggcgccagcgcggacctgcgccgccgcttcaacgccgccgagtccctgaccgcgctgcgcgatgacgcctcgcttacgatgttcttcggcgtgcccaccatgtacagccgcctgctggaggaagcccgcgcgtcacgtgtgaagccgcgcgcgctgcgcctgtgggtgtccggctcggcgccgctcagtccccagctcttcgcggacatcgaagcggagctgggcgcccgcatcctggagcgctacgggatgacggagaccatcatgaacaccaccaacccctacgagggcgagcgccgctccggaacggtgggcttcccctaccccggccaggaggcccgcgtggtggacgtgcgcacgcgccaacctcaaccgtgcggtgagacgggggaaatcgaggtccggggccctcacgtcttcgccggatactggcgccgtcaggacgccaccgccgagtccttcgacgcggacgggtggttccgcacgggcgacctgggggatgtggacgcggacggctacctgcgcatcaccgggcgggcgcgcgagctcatcatcagcggcggcttcaacgtgtacccgcgcgaggtggaggaggtgctcgccatgcacccgggcgtcgcggaggtcgcggtgctgggcctgccggacgcggacctgggcgagcaggtggtggccgtggtggtgcctcaccccggggcgaccccgccggagtcccagtccctggtggactggtgcaaggaccggctcgccagcttcaagaagccgcgccaggtcgtcttcacggatgcgctgccgcgcaatgcgttgggcaaggtgcagaagcacctcctccgggcggcactggtgccacctggcacgcgatga

SEQ ID NO: 5166 - DNA, 531 bp, Myxococcus xanthus
atgacttcgctcgcccggcccgcgaggctgacctggcagaacggcggcaccttccttcgcgtcctgctgacgcaggtgctctacgtcgccccgctcttctggttcatggagctggcgcagaacgtggcctggcggtggatgaatggggactggggttgggtgttccccaagtcgccgtaccactggttctccttcgggagcctcatcctgtgggccggctgcgtggcgctcctgtggagcctgcacttcttctggttctacccacgccgcgtgaaggtctggccgcggctggccattggcgccggggtgtgctgggcaggcgaatgggtgggcggctacgtcgcggccaatgtcttcaaccatccgctccaggtgtggcccggctcaccgctcgtctacgtccactacagcgccctgttcttctgggtgagcaactgcatcgtctatcacctgctcaccaacgacgtggtggacctcacgcccgaatacgacgcgcctccgacgacgacgcgccgcgcccaggtggcctga

SEQ ID NO: 5167 - DNA, 627 bp, Myxococcus xanthus
atggtgcgcaccaagcccttccggaactttgaaggggagtccatgggtgacaccacgttgaggcaggtgttcgcccactcgtgcaacaccgcgttcgtgacgctcgcgacgggaatcggcggtgatgcgctgagtgccgcggctcgccgcttcggctttgatgtgccctacttccccgggctgacatccgccggtgcatcgttccccgcgcccgcggatgcgattgagctggcggccgccgccatcggtcagggacgggtgcttgcgacgcccttgcacatggcctcggtcgcggcggctgcggagtccggcgagtggcgcgcgccctatctcgtggaggggctggacggcggaccgagcagcttgctctcgaacggcgtccgggcgcctttgtccgcgctgatgcgcgccgtcgtgatggaaggctccgggaaggccggccggcaggtgcccgggctcggcggcaagacaggcaccgccgagttcggcaccgtggcgccgctgcccacgcacgcgtggttcatcgggtttcgaaagggcgtgggattcgccgtcctggtggaaggcggtggcgtgggcgggcgcgttgcagcgcccatcgccgcgaagttcgctggtgcgctgtaa

SEQ ID NO: 5168 - DNA, 321 bp, Myxococcus xanthus
atgcgcccctcgggcaagacgcaggtcctcttccacttcgagggtgatccgggagcgcccctgtccaccacggtgcgccgcgaggttcaggcccccgcggagtccgcgctcgacggtgtggcccaccccgcggccctagtccccgtggacagcgccacgggggccatcctcgctgtggccagccggccgctctcgcagccggtgcaccgtgccctcaccggccgctacccgcccgggtccacgttcaaggtcgtcaccacggaggcgctgctcgcccataggcatgcgggtggactccacctgtcgcgtgcccaccgatga

SEQ ID NO: 5169 - DNA, 780 bp, Myxococcus xanthus
atgggcccggtcgccgaggccgaggcctatctgcgcgcctgggccgcgggggatgtcgcctccatgcggcgcgccgtcgtcaacccgcccgcgtacttcgaggtgatgcaccagcagttccgcgacgggctgcgcatcgtctcctcccagttcgagctcgggccgttccagcgcgatggcgacgccagggtggccacctaccgcgccgtgcacctgctgcgcgggctcggggaatgggagctggacggagcgctgcgcttcgtccgtcaccagggccagtggcgcgttcagtggactcccgccgcgctgcaccccgaggcccgcgagggtgacctcttctcccgcacccgcacggccccgctgcgggcggatatcctcgacgcgcaggggacaccgctcaccctgcaaggcgaggtcatcaccatcggcgtcgaccccacccgcgtccggagccgcgcggacgtggcggcggcgctccaggcacacgccggcgtgagcaccgcacagttcgacgcggcgctgagcgcggcgggcacggcgacgagccgcttcgtgcccatcatcgacctgccccccgcgcgctaccaacaggtgcgcccggcgctggcccccgtgcccggcatcttcttccgccgcaagagcgcccgcaccccggcggacggcttcgcggcgcacaccctgggccgcgttggcgaggtgacggccgagctgctgccccagataggccccacctatctgcctggagacctcgtgggcctgtccggtctggagcgggcataa

SEQ ID NO: 5170 - DNA, 465 bp, Myxococcus xanthus
atggcggtcaataccggtgtgaacaagatgtccgtggtgacgaaggacagcggcggcgtcaccgttgccttcccggacgtgtgcaagacgcccagcccggccgggcccgtgcccatcccctaccccaacgtggcccagtcctccgacaccgacaagggcacgaagaaggtctccgtcgctggcaacccggtgtgcgtgaaggactccaacttcaagacgagcaccggcgacgaagccggcaccgcgggcggtggcgtggcctccagcaagaccaagggcaaggcggagttcgtcaacttctccttcgacgtgaagttcgaagggaagaacgtggcgcgcgccttcgacctgatgctccacaacgacaagaacacgccgccgttccccgtcatgcaggggcccgtcattgccatggggaagagcgatgaagcacccaagtgcgcggtgtgcgacaaagacctatag

SEQ ID NO: 5171 - DNA, 1038 bp, Myxococcus xanthus
atgggccaccctaccatcgagaacgaaacccccttcgccttcgatatgatgggcctcgccgacgaggacgggaggccactgcttctactcgtcgtgaaggccacgtacgacttcggaacgtctgggctcaagctcgcgggcgaacagttgcccgtgacgtggggcggcgagtcctggggcaagcccggagagtccagcgacaagtacgaacccgagagcgccttcatcaagctggccacggacgtagcgctgattggacatgcctacccgccacagaagggcgccaccgaggcactggtggctcttcaggtcgggccgctgaagaaggccgtgcgcgtcgtgggtgagcggacctggttcaagagcatgggacatgtcgcggccaccaagccgctccccttcgacaaaattccgctcacgtgggagcgcgcattcggcggctgggaccggacggacaccgtgaagccggccttcgagccgcgcaaccccgtgggagtgggcttccgcgccagtcctcgccacttcgaggagggactgaagctgcccaacctggaggatcccgccacggagcccctgcgcgacttcggccagaaggtggtgcctgctggcttcggcttcacctccccgcactggcagccgcgcgccaggtatggcggcacctacgacgagtcctggaacaagtcgcgcaagcccttgctgcccaaggacttcgaccggcggttcttcaacgccgccgcgccgggcctcatcgctcccgggtacctgaagggggacgagccggtcatcatcgccggcgcttcccccaagggccgtctgtccttcgcgcttccgggccaggccgctccgatcgtcaccgtggcgctcgcaggaggcgaggacgcgacgccccccatgcacctggacaccgtgaccctggataccgacgaagagaaggtgacgctcctctggcgcggacatgtcgccctgggagagggcctccacgatgtgcggggcctgaaggtcaccgcccagggagtgaccgcgcccaaggcggcctga

SEQ ID NO: 5172 - DNA, 804 bp, Myxococcus xanthus
atggaagcccgcctcccgccgaagcgcgtcgccgcgcgcgtgcggagcgtgccccgtggagcgcgccctgtccaatcaggtcaagggcttgcaagagcccctcctgtccatgcatccatgccatgcccgggacattgcaaactccgggcacaggtccttcagcacgcgcggtttccgatgccctctccgcacacccgagcccttctcgccatcctggccgctgtctgcatcgtggcggcggccgggttccgtcacgcgcagaatgtgaagggctcacgaggcggacgcatctccggccccaagctggcgtggctcttctacgcggtgttcctgtggttcctcgcgtgcccgctggtggcgctggacgtggcggtgccggaggaggcgcgaggcgtgctgggcgcgttcgccgccttcatgtggctgcgaggcgtggcggagctgtacctgctctacggcgtgaagcgctggcggcctccgtatggcgtggcccatgacgtggcgtgcatcgccctggtgctcggcggcctgttctggggccgggcgcggtggctgggcgtgctcggccccgaggacctgtgggccctggccttcctgggcctggtgctcgtgagcctgttcgtcgaggtcgcctacgcggccctgttcttccacgccgtggagggccgcaccacgggcgaggacggcatctggttcgcggacgaagagcaggcccggttccgccgcatcaaccggctgacactggcgctcaacgtgcccctgtacgcgggactggtgggcctgctggcggtgggggcgtggtag

SEQ ID NO: 5173 - DNA, 1437 bp, Myxococcus xanthus
gggggagggagactggtggacttcccggaggtgaaggaggtgctcgtcgagcaggggcgcccggaggacggcacggacaacgaggccgtcaacatgggcaagacgttcgtccgcttcacgcccgaggagacgtggcgcaagggctgggacaaggagcggctggtgcgggagatgcgcgcctcgctgctggagattccgggcgtcagcttcaacttctcgcagcccatcaaggacagcgtggaggaggccatcagcggcgtgcgcggcaaggtggtgctgaagattttcggcacggacctggcggccatgcgcggcacgctggagcaggccgtcacgtcgctgcagaacgtggagggtgtggtggacctggggctctaccgcgactccagcgtgccgcagctccaggtggtgctggaccgtcccgcgctggcgcgtgccggcatcgacgtgtccaccgcgcaggacctggtggagacggccctgggcggccgggtggtgacggagctgtgggagcaggagcggcccgtcccggtgcgcgtcatcctgccgggcacggagcgtgacgacgaggcgcgcatcggcggcatcctggtgcccacctccagtggcggacacgtcccgctgcgcgaggtggcgcggctggagaaggcgctgggccgcgcgagcatcaaccgcgaggcgaacagccgcaccctggcgctgaagttcaacgtggaggggcgcgacatgggctccatcatccaggaggccatggccaccgtggagcgcgaggtgacggtgccggagggcacgttcctcaagtggggcggcgagttcgagaaccaggagcgcgcactgggccggctggcggtcatcgtgcccatctccttcctggtggtgttcgcgttgctctacgcggcgctgggctccatgcggagcgcgagcgcggtgctggcgggggcgcccttcgccatgtgcggcggcgtgctggcgctggccgtcacgggcatcccgttgtcggtgagcgcggcggtgggcttcatcacgctgctggggcaggtgtgtctggcgtcgttgctggtggtgagcgcggtggatgaccggcggaaggcgggtgagtccctggaggcagcgctgccggcgggcgcgtccagtcgcttccgtgcggtgctgatgacggcgctgctggcgatgctggggttgatgccggcggcgctctccagcggagcgggcagcgagacgcagcggcccttcgcggtggtcatcatcggtggactggtgacggcggtgctggtgtcgctgttcgcgttgccggccttctactccgtcatcgtggggaagcacgtcgcgtccacgggctcgcgcgacgacgaggacgaggacctggactccggtgtggagcacatcgggccgaaggggcacggcccggagcagggcaccgcgggggtggcggcgtga

SEQ ID NO: 5174 - DNA, 1161 bp, Myxococcus xanthus
atcacgctggagcaggcgctgtcgttgctggacgagcgcagcccgtgggccgcggcggagcgctcgcgcattgacgtggcggcggcggaccgcgtcgaggcgagcatcctgcccaacccctcgttcagctacggcacgcagctcctggctgcgggcgtgaacaccggttcgtcggtggtgcacgagctgtcgctggagcagcccctgatgattttcgggcagcgcggcgtgcgccgcgagctggcggagcgcaacgtgtccgccgagcaggcgcgcgtgaaagcctcactggcggagcgcgcgctggccgtgcgcgaggccttcgcggcgctgctgacgaaccaggaggaactgcgcgtgctggaggagacggcggtggacctggggcgcgtggagaaggtggtgaagggccgggcggcggcgggtgactccagccggtatgacgtggagcgcatcgaggtggagagccgcgcgctggaggtggaggtgctgaacgctcgcgtcaacgtggccgacgcctccggacggctggccgcgttgctcggcatggaagggtggcacccgaaggcgcagggctcgttgcggaccaccgaatccctgccggacctgccactcctgtgggagtccgcccagcagcgtcggccgtcgctggtggcggcgcgcgcgcggcaggccgtggcacgaggcggtctggacgtggcccgcagggagcggctgccagtgccgtccgtggcggcgggtgtcatgttcacccggaacgagcagagcaccatcgccctggtgggcgtgggactgccgttgccgctcttcgaccggaaccagggcgccgtcgcccgcgcgtccgcggagatgcaggccgaggcccgcgcactggaagcggagctggccgaggcccgcgcggagctgtcccgggctcacgccgtcctggagggtcgcaagggcgcgttggcgcggctggagcacgacgtggtggagcggctgcccacggtgcgccggatggccgaggacgcctaccgcgaggggcgcggaggcatcctggagttactggacgcgttccgctcgctcaaggacatgcgcgtgcttcacctgaagcagcaggagacggtgaagctcgctgaagcctcggtgctcttcgcggcggggctggatacagcgccctga

SEQ ID NO: 5175 - DNA, 1455 bp, Myxococcus xanthus
ggagcagccaaccagtcggctgtctcccaggacggcgggaagttgcacgcggtggtgttgaccgggctgaagccaggcaccgagtacacgtacgaggtgtcggcctgtggcctgcgcacgcagctcaatcgattccgcaccgcgccggtgccggggacccgcagcgtgcacttcgtggcggtgggcgactttggcacgggcggctcgaaccagaagaaggtcgccgcggccatggtcaagcggcaggcggggctgttcgtcgcgctgggggacaacgcctacgccggtggcaccgaggcggaaatccagaacaacctcttcgtgcccatggaggccctgctggcccaggtgccgttcttcgcggcgctcggcaaccatgagtacgtgacgaaccaggggcagccctacctggacaacctctacctgcccaccaacaaccccgagggcacggagcgctactactcgttcgactggggccacgtgcacttcgtggcgctcgactccaactgcgccgtgggactggcgtcggcggaccgttgcacgcgggatgcgcagaaggcgtggctggagcgggacctcgcggggtcgacgcagccgtggaagattgtcttcttccaccacccgccctggtccagtggcgagcacggctcgcagctcgccatgcgccgccacttcggccccatcatggagaagtacggcgtggacctggtgctcaccgggcacgaccacaactacgagcgcagcaaacccatgaagggtgacgccgtcgccgggtccggcgaaaagggcatcccctacctcgtggtgggcggcggcggcgcgacgctgaggaagctccccggcagcaagccggactggagcgtcatccgcgacaaccaggcctatggcttcctcgacgtgacagtggtcgacggcacgctcaccgcgcagttgctcggggtgaacggagaccccgtggaccgcttcacgctgcagaaggagctgcctccgcaggagcagcttcccgagggtgcgatgacgctcgtcgtggagggcgagcggggcgtggccccccaccgcgccttcttccgggccacgccgtccctcgaggccgccacggtgacctgggatttcggcgacggcggcacggccgagggcgaggccgccgagcacgtcttcgccattcccgggcagtacacggtgacggccaccgccacccagggcacggtgaagcagacggccaccgccctggtccaggtggcggagactcccggtgaggagccccagacgccggatgacggcacgacggacccgggctcaccggagccccgccctgggcttccggactctcccggccccccggatgacggcatgagcagctcgaacggtggctgcaccgcgggccccaccgccaccctcctcccggcggccctggccctgctggccgcgggtctgctccaccggcgccgcaagtag

SEQ ID NO: 5176 - DNA, 731 bp, Myxococcus xanthus; identical to SEQ ID NO: 3085

SEQ ID NO: 5177 - DNA, 1176 bp, Myxococcus xanthus
atgctgggcttgttgctggcacgggcgggagtggaggtgacggtgctggagaagcacgcggacttcttgcgtgacttccgcggcgacaccatccacccctccaccttggaactgatgcacgagctggggtggctggatgagctcctggccctgccgcatcagaaggcgccggtgttgcgcctccagcgcggtgcccatgacgtgatcgtcggagacttctctcacctgcccacgcgcgcgcgttacatcgcgttcatgccgcagtgggacctgctcgacttcctcgcgcggaaggccgccgagtacccgggcttccacctgcgccggtgtgccgaagtgacggaggtgttgcgtgagaaggggtgtgtcgtcggcgtccaggctcggacgccggagggctcattggaggttcgtgcgtcgctggtggtggcggcggatggccggaattccatcatgcgtcagcgcgccggcctggaggtggaggtcctgggcgcgcccatggacgtcctctggttccgtgtctcgcgcaagcccgaagaccccgaggaccccatgggccgcttcgagcagggacagattttcgtcctcatcaaccggggcgactcgtggcaatgcgggcgtgtcatcgcgaagggcagcttcgacgccttgcgcgaggccgggctggtgtccttccgcgaggacttcgcccggctggcgccctttctggcggaccgggcccacgaactggcgacgtgggacgacgtgaagctgctcaccgtgcgggtggatcggctgcgcacctggtaccaggcgggcctgctctgcattggcgacgcggcgcatgccatgtcaccggtgggcggggtcggcatcaacctggcggtgcaggacgcggtggccgccgccaacatcctcgcggggccactgctggcccggcacgtgacgcccatggacctgcggcgcgtccaggagcgccgggagtggcccacgcgtgtcacccagcgggcccaggtcctcatccagaatcgcgtgctcgggcccgcgctgcgaagcccggcggcgtccaccgcgcttcccttgccgctgtggctggtccagcacgtccccttcctgcggcgcattccggcgcgcctggtgggcatgggcgtacggcccgaacacgtgcgcacgccagcggcgccccccagggcctga

SEQ ID NO: 5178 - DNA, 411 bp, Myxococcus xanthus
gacagcaagctgaagcagtacaccggaggatgtctttgcggagcggtgcgtttcgaggccgagatggatctgtcggagcccgtgagccgctgcaattgcagcatctgcaccaaggtcggcggcacgcaggcctacccgaagccgagcgccttccgcgtcaccgcgggcgcggagcacctgggtgagttccggaagggctcgagcccgaacttccgctcgttctgcaagcactgcggcatccattgcttctccgccgggttcgtcgaggagctcggtggagagttccggtccgtcaacatccagtgcctggacgacgtcgaccccggtgagctcaaggtcgtgtactgggacggccgccatgacaactgggaggccgggacgcgtgacaggccctggcccatccggagctga

SEQ ID NO: 5179 - DNA, 540 bp, Myxococcus xanthus
atggcgggcaccaggagcgaagagcgtgatgcgttgcgccggacggcgattctcgacgcggccctggagtgcttcctgcgcttcggctacgcgaagacgtccctggatgacatcgcgaagcgggcgaacctgtcgcggccgctcctgtatctgaagttcaagaacaaggaggacatcttcgcggccgtcttcgaatccctgttcgaagcgcgctacccgcgcgtggagcaggtgctggcgcggccgggcgccgcgggcgacaaactgctccaggtgtacgaaatcatcctcctggagccgtgggagttgatggccggggcgcccatggcctccgagttctacaccgcctgcgagcggctgttgccggaggtggaggcgagacatcgccgacgctggctcaagtacacgcaggccgttctggagtcgcggccgctcgccgaggtgttcatgctggccgtcgacgggctccagtccgacctgcccacgacgcgggtgttgcgtcagcgcctggagttgctcgtcgagcgcttcacgggctga

SEQ ID NO: 5180 - DNA, 1815 bp, Myxococcus xanthus
atgttgatgaacctgggttggagtaatgcgctcaaggcgcccgaggcgaacctggcggagtccgggcggctgacgcggaagttcgacgaaatcagccagcggacggggcagttccaaatcaatctggacctgtcggacgagcgcgactggaagttcctgcaggggcgcctgcgctccgcagggaaggacgcgaagaactcccctgaactcttccgccggctggacgcaggccgtgagcgggcgctggcgcgtcaaggcgtcgccaatcaggtggagacggagcgggcctggtgcaaccacttcctcaagtacagccagccgcacgtcgccaccaacaatggctacaccaccttcttccccgtggtggaggtggtgtgcaaggacggcgcggattacatctacgccgacctcttcaactacgacgtcaacgaggatgagacccagacggtgctcgtctcctctgatgcgggagaagagtacggcggtggaatgggcttcgatgacgtgaaggctcccgccacgattgccacgggcaaggggcgcacgctccgcatggagtccctggtaatggccatggggcccaacatcgaccagacctcgtacatcgtcgagcgcgcggcggcgctgaacgcgcccacgacgttgaccttcacgcacccgcgcaaggtgttggagcaggcgtcccgcgccgaaatcgtggcctgtcaactccgtggtggcgcggactgcgactacgcggtcgccggctaccagaacggcacgctggcgccctatcctccgtcgcccaccggcgtggcggcgtcctattccaaccagccgggcgtgctgaacgcctcggacttctgggccttcaatgcgccctacaactaccagaacctctacgtcccggtgcgcggcacgctgagcgctggcgcggaaggcggcttccagtgcgtagtggcgcagattgaccgggcgcgtgtccagctcatcgccgcgcagacggggcgcacgtgcctcaatgagacgttcttcgccaactccatccccattggcgggaaccagagctacatcaacgtgctgacgaacgtgaactggctgttcaacctcccgggacagggctcgggcaccagtccggattcgtgcgcggcggagaccatcatcaatgagctgacgcgcttcaacatccacgtcgccggcaaggtgcgctgcaacaccaaggtgaagtccttcttcgtcacctacccgatgccgaccacgggcgtcacgccgaacatctacttctggaatagctgcatggcggagggcacccaggtgaagctggcggacggcacgctcgccccggtggagagcgtcaagctgggtgacaaggtcatcgccgacgccaagggcacggtgctgaccgtcaccgacgtggcgcggggtaacgaggccaagccgctcttccgtctgcgcgacagcgtggggcatgacgtgacgctcaccgagatgcaccccgtcatcatgagcaccggcaaggtggtggcggccaagaacctgaaggtgaaggaccaggttcgcaccgtgaagggtgtctccaccctgacgtccatcacccccgtgtcgcctgacaagatgcgcgtctacaacctgcggctgggcacggacccggagctgctggcggtgggcaagaatggccgcaccctctacgcgggcggcttcctggtgggggacatgaccatgcaggacgaactgcaggcgccgaagcgcgagccgcaggtgtcgctcctcaatcgcctgcccaaggcctggcacacggacttccgcaacggcgtccgctccacccagtcgcgctga

SEQ ID NO: 5181 - DNA, 216 bp, Myxococcus xanthus
atgatggcactcgacgagtcctccgccgcgggttcgctgcgagaagggctcgccgccttgctgggggacgggtcgctggtgccagcgctcgccagcctgctgtccgccgccttcgaccgcgcggccctggccatcagcaccggcggcgatgcgaaggcctaccgcgaggcgatgctcgcgctcatcgagcgcgtcaccgctggcgccggttgttga

SEQ ID NO: 5182 - DNA, 1416 bp, Myxococcus xanthus
atgtacttccaggggtacggcgtcaatcccaccatcaacacggaggaggagcgcttctccaccttctccgtcgacacggattccgcgtcgtacacgctgacgcgggcctacctggagcgcggcagccttcccaacgagcaggccgtccgggtggaggagttcgtcaacaccttcgactacggctacgcgcaccagggcagcgcgcccttcagcgtccaggtcgaaggcttcccgtctcccgttcgcaagggctaccacgtggtccacgtcggcgtgaaagcgcgggaggtcagccgcccgcagcgcaagccgagccacctcgtcttcgtcatcgacgtgtccggctccatgaacctggagaaccggctgggcctggtgaagcgcgcactgcacctgctcgtgaacgagctggatgagcgcgaccaggtctccatcgtcgtgtacggctccaccgcgcgcctggtgctggagcccaccagcgccgtgcacgcacacatcatccgcgcagccatcgacagcctgcacaccgagggctccaccaacgcccaggcgggcctggagatgggctattcgctcgcggcctcccacctcgtggagggcggcatcaaccgcgtcatcctctgctcggacggcgtggccaacaccgggctcacggatgccaacagcatctgggagcgcatccgtgcgcgcgcggcgaagggcatcaccctgtccaccgtcggcttcggcatgggcaactacaacgacgtgctgatggagcgcctgtcccaggtgggtgagggcaactacgcctatgtggaccggattgaagaggcgcaccgcatcttcgtgcgcgacctcaccggcacgctccaggtggtggccaaggacgtgaagctccagatggagttcgacccgaaggccgtgtcccactaccgcctgcttggctacgagaaccgcatgctcaccaaggagcagttcgccgatgaccgcgtggacgcgggtgaaatcggcgcgggccacgccgtcaccgcgctctacgaggtgaagctgaccgagccctccgcgtccttcggcacgctgcgcatccgctacaaggcgccggagggtggggactcgaagctcatcgagaagcccctgccgtcgagcgtcctccgtcccgcctacggccgcgcagcgccgcccacgcggctgtcctatgtggccgccgccttcgcggagaagctgcgcggttcctactgggtgcgcccgctgacctatgacgccctgttctccttctgggaggaaatcggtcagccgctgaaggcccgcgatgacgtggcggagctgggcgccctcatccagaaggcccgcgccctggaccaccgcgaggaccgcttcgaggccttcgcgcccgtgagcaccatggacttcgaccgcgtgcccaccctgccctga

SEQ ID NO: 5183 - DNA, 1704 bp, Myxococcus xanthus
acgagcgacctgcacacgaacatcttcccgtgggactacttctccgggaagcccgacgcgaagcgcggcgtcgccaaggtggccacgctcgtcaagcaggagcgggagaagaacccggactgcacgctgctcgtcgacacgggcgacaccatccagggctcaccgttgggcacctactattccctggtggacaacacgccccagcatcccatggccgccgccatgaacgagatgggctatgccgccatggccctgggcaaccacgagttcaacttcggccaggacgtcctcaacaagttcaagaacgaggtcaacttcccgctgcttggtgccaacgtgcgcaacagcgcggacggctccgaggccttcacgccctacatcatcaagacggtgtgtgacgtgaaggtcggcatcctcggactggtgacgcctggcgtgacgacgtgggagcgcgcggagaacatcgccggcctgcgcttcgatgacccgctgcagacggcgaaggactacgtgccgcggatgaaggaagccggcgcggacgtggtggtggtggccatccacagcggtcccgaccggcagccgaccggcagcgcgagcaaccccgaatcgtggctggccgactacgcggatgattcgaagtgggcggaccggggcaacctccctggagagaaccaggccgtccagattgcccagcaggtccccggcgtggatgtcctcctcacgggccacacgcaccagcccattccgaagatgctgctgcggaacgtggacggtggcgaggtcctcctcacgcagcccaaccgctgggggagccacctggccgacgtccagctccaggtcacctgggatggcgagcgatggggcgtgaacacccatgacgcccaactccacgtcgtggacgacacggtggcggcggatgccgccgtcacccagagcacccaggtccaccacgacacgacggtcgcctacgtgaaccagaagattggcaccaccaccggcgtgttcccgggcggcttcgccggacgctacgtggacggcccgctgggggacctcatcaacatcgtgcaggagcaggccgcgctcgaagccggtttcgccgtggacctgtccctgggcgccatcttcaccaacgatgtctcgctgcccgagggagacgtcaccctgcgcgatgcctacagcgtctacatctacgacaacacgctgtacgtcatggaaatcaacggctccatcctccggcgcgcggtggagatgaacgccaactacttcaccaccattgacccggccaacctgccccagacgcccgcggaggcgaaggccacctcgccctccatcgcggactacaactgggacctctactcgcacatcgaatacggctatgacctgacgaagcccgcgggttcgcggaccacgcacctgcgcttcaagggcaatgaagtcactgacgaccaggtcttcatcgtcgccatcaacaactaccgcgcgggcggtggtggcgggtacagcatgttcaaggaaggccgcgtgctgtggacgtccgcggatggcgtgcgggactacgtcgcgcgctacctgcaggagaaccaggggctgtcgccggacgcggtgaacacctgcaacttcacgctcgggcccgacctctacacgccgtactacgcggccacgttcggcccggcgaagtgcctgaccgtggagaccgtggactag

SEQ ID NO: 5184 - DNA, 1188 bp, Myxococcus xanthus
gtgctgcccttccggaccaacagctacgtcgtggacgagctgatcgactgggccgccgcgcccgccgaccccatctaccggctcgtcttcccgcaggcggacatgctgcccacggaggacgtggctcgcatggtggacctgctgagctccggtgcatcccccctggagctgaacgcggccgccaacgagattcgcgcgcggctcaatccgcaccccgctgggcagatgcagctcaacgttcccaagctggccaacgaagagcccgtcccgggtctccagcacaagtacaaggagacggtgctcatcttccccaagcagggtcagacgtgccacgcgtactgcacgtactgcttccgctgggcgcagttcgtcggggacgcggacctgaagttcgcctcgcgggaaatcgagccgctggtgaactacatccgcgcgcaccccgaggtcaccaacgtgctgttcaccggtggcgacccgatgatcatgaccgaggccgtgctggccaagtacatcgagccgctgctggacatcgagcacctggaggccatccgcatcggcaccaaggcgctggcctactggccgcagcgcttcgtcacggattcggacgcggacgacatcctgcgcctgttcgagaaggtggtcgcctccggcaagagcctggccttcatggcgcatttctctcatcccaacgagatggtccccgagattgtccaggaggcggtgcgccgcatccggggcaccggcgcggtcatccgcacccaggcgccgctcatccgcaccatcaacgacaccccgggcacctgggagagcatgtggcgcacgcacctgcgccacggcatggtgccgtattacatgttcgtcgagcgggatacggggccccaggactacttcgcggtaccgctcgccgaggcctacgacatcttccgcaacgccttccagagcgtgtctggactggcgcgcacggtgcgcggcccgtcgatgtccgccacgcccggcaaggtgtgtgtggacggtgtggcggagattgccggcgagaaggtcttcgtcctccacttcatccagtctcgcgacccggagctcgtcggccggcccttcttcgcgaagtacgacgagaaggcatcctggctgttcgacctcaagcccgcgatgggcgccacccacttcccgtgggaggagccgtccgcgtag

SEQ ID NO: 5185 - DNA, 1284 bp, Myxococcus xanthus
atgagctggttcgacaccaccctctcccggctcaaggggttgttcagccgtcccgtgacacgaagcaccaccgggctggacgtgccgctggatgcccacggacgtccccaggacgtcgtgacggagacggtctccacgtcgggccccctgaagccagggcacctgcgacaggtccgccgggatgcgcggctgctccccaagggcgtccgccgctacaccccgggccggaagaagtggatggaggccgccgaggcccggcggctgttctccgccacgctgcgcacgcggaaccggaacctgagggacttgctgcccgacgaggcacagctggcgcgctacggcctgccggtctggcgcacggaagaggacgtggcagcggccctgggcgtctcggtgggcgtgctccgccactacagcatccaccgcccgcgcgagcgggtgcggcactacgtgaccttcgccgtgcccaagcgctccggaggcgtccggctgctgcatgcgcccaagcggcgcctgaaggccctgcaacgccggatgctggcgctcctggtgtcgaagctccccgtgagtccacaggcccatggcttcgtgcccggccgctccatcaagacgggcgccgcgccgcacgtgggccggcgggtggtcctgaagctggacctgaaggacttcttcccctccgtcaccttcgcgcgggtgcgagggctgctcatcgccctgggctacggctatcccgtggcggccacgctcgcggtgctgatgacggagtccgagcgccagcccgtggagctggagggcatcctcttccacgttcccgtgggcccacgcgtctgcgtgcagggcgcccccacgagccccgccctgtgcaacgcggtgctgctgcgactggaccggcggctggcgggactggcgcgtcggtacggctacacgtacacgcgctacgcggatgacctcaccttctccggcgacgacgtcacggcgctggagcgagtccgcgcgctggccgcgcggtacgtgcaggaggaaggcttcgaggtcaaccgcgagaagacccgcgtgcagcgccggggcggtgcccagcgcgtcactggcgtcaccgtgaatacgacgctgggcttgtcacgcgaggagcggcggcggctccgggcgatgctgcaccaggaggggcggtcggaggacgtcgaggcacaccgcgcgcacctcgacggcctcctggcctacgtgaagatgctcaacccggagcaggcggagcggctcgctcgccggcgcaagccgcgcgggacgtga

SEQ ID NO: 5186 - DNA, 1419 bp, Myxococcus xanthus
atggccacccaacgcaagtcccgcccgcactcgcggtcggccccgaagaagtccggcgctccgtccgggaagaagccctccccctccgagcggcccgagcggcccctgcgagaagacctggtccttcaggcctgcctggaggcgtacggctcggtccggcacgagggccgcatggccgaccgcgcgctggacttcaccctgcgccgcaaggccaacctctactccaacgagcgccgcgccgtggccgagcgcgtctacggcctgctgcgccgccagcggacggtggacttcctgctgtcccgcgcccacccacgcttcgacagcctggagacctcgcgccaggacgtgctccgcctggccgcctcacgcgtcctctacggcgagccccacggcctggtggcccgccagtccgcgctggcgcccccggatgcgcaagccctgggtgcccttcccgaagccgccgccgccctggaggccctgcccgcccgcgagcgcttccccatcgccgcgtcgctgccggacttcctcgccgaccgcttcctccagacgttcggccgggacgccgctcgcgccgcggaggcgatgaacgagcgcgccccgctggtcgcccgcgccaacctcctcaagggggaccgcgacgcgctggcgcagcggctgaaagcggagaccgtggacgtcaagcccacgccgctgtcgcccatgggcctggtgctggagacgcgcatcaacgccttctccctggagagcttccgcgaaggcatgctggagctccaggacgagggcagccagttgctcggcatgctggtggacgcgccgcccacgcgcgtggtggatgcgtgcgcgggtgccggcggcaagacgctgcagctcgccgcgcagatgaagaaccggggtgacttgcacgccctggacatcgatgagcgccgcatggaggacctgaagaagcgcgcgcgccgcgcgggtgtgcacaacgtgcgcgcccagctcatcccccacgagggcccggaggccgacgccgcgctgacgcccctcaagggcaaggcggaccgggtgctggtggacgcgccgtgcagcggcaccggcaccttccgccgcaagcctgacgcgcgctaccgcctcacgccggaggatttggagatgcacgtgggccggcagaaggccctgctggcgcgcttcgccacgctggtgaagcccggtggccggctcatctacggcacgtgcagcgtgctgcgggaggagaacgagaacgtggtggaggacttcctcgcgaagcaccccgagttcacggtgaagccggtggcggagctgctgggggcggagctggccgagaaggtcggccccggccccttcctccggctggcgcctcacacccacgggaccgacggattcttcggcgccgtcctcgtccgcgcgaagtaa

SEQ ID NO: 5187 - DNA, 1458 bp, Myxococcus xanthus
atggcgctccaggcgctcggcgggctcatctggcaatcggacgcgtggaacgagacgtggggcggcgggctgctggacccgctcatcaccgtgcaccccgaccgcgtcttcttcgaggccttcagccaggaccagagcgcctacgggctcgtcatcgtggaccgcggcctcttcgagcccgagggcgcggtgcgctgcggcaccaccaacgtggacttcaccgcctggctgtgggcggcgctggccgagatgcgctccacccgggagacacacctgcgcatcggcccggagggactcgacgtgcgcaccaccggcgcgggcggtcgcttcgagcagaaggtggacgtcccggagccctgggtgcgaggcctgctccaactccagggcggaatggcgatgcccggcacccgcctgacggcgcggccggtggacctgctcgccgcggtgcgcttcctcagccacaccaaggccaaggtgtcaccgcgcgcgctgcgctacgaactccacccgggcgaggacgcgcggctgatgctggagccttgggagcaccccgtgcccttgaagggcgcggcccacggctacacggcgcctcgcatcatccggacctggggccgccggcggctgcggctgctggagccgctgctgccctacgcggagcgggtggacatctacctgaagggccgcgcgctgccgcacttctacgtcgcgcacctgcccggcggcgtgcgcttcctgctgggcctgtccgggtggacggcgaatcactggacgaacaccgcgggcatggacctgctgctggagccggcgcgcgacagcgcgctggcggagcgtgtgctcggcgtgctgcgcgagcgctttcatgcctcgaccgaggacgtggccaccgccctgggcgtggacacggcgcgggccgcgggcgccctggcggcgcaatgcgcggccgggcgcgccatcttcgacgtggaggcgcggcgctggcgccaccgcgagctgttcgccacgccggtggacctgggccgtctgtacccgcctgacgcccgccgtgaggaagcggagcgcctggaggccgcgggcgaggtggaggtgacctccgcggcgccgcgagagaagcgcaaggtacgcacgctgcccacgccggaggggcccgtcacgcgcgaggtggttcaccgggactgggtggtccatggccgcgcgggcccgcagtcgggcgtcgagttggtgatgaacgacgaggaccgtgtcctcttcggccggtgcggatgcgagtacttcggcgagcacctgctgaaccagggcccctgcgcacacctgctcgcgctcagccgcctggcgcgagcgcagcgccgcgaactccgcagctccgagcccgcctccgaggacgcgctcgcggcccgggcggcgggggcggacgcgcggcggcggcccacggagacgcttgacccgggagacgacgaatga

SEQ ID NO: 5188 - DNA, 1446 bp, Myxococcus xanthus
atggacatcggctggggccggctggacgagcccaccgccctggccctggacgcgctggacgcggaggccgcccgccccttcatcctggagcatctgccgtggagagggccccgcgagcgccagcccatgtggaacacgctgcgcgagcgggcccaggcgcggggtgatgcggccctggcctccgcgctctaccggcgatgcgtggatgagcccacatggtgccgtgatgccctggcgctcgcacgcaccgtccagtccccggccgaactggtcgccgcgctgaaggcgcaccacccggaggcgcccatgcccggcgcggcgcggctcttcgtggagctggcggaggcgcgcggacgtgacgtggtgccctacctcctcggccacctgcaggcggtggctcctcgctggagcgcgctgggacgaaaggacgcgaagggcttcccggagctgctggcgctcgcgcgggcgcgggactgggacgatgtatggggcgcgctcctgcgcacctcggccatggcggagacgtatgacgcggaggtgctgcggctggtgcaggacgacgcatcgctcccggcccggactcggcgccggctgctccaactggcgggcgcgggcggcgaatggaatctccccggcctgggcctggcccgggtgcagccgctgacggacgccaccgccaccgccctgtacgcgcgctttccggagctggtacgcggccccttccgcatgcacgtcgcttcgggctggcgcgccgcgtaccccaagctggtgatgcgcgcgctggaagcgaacgacgaggacctgctggactacctcgccagccgcgccgccatgcacctcccggcgacggggagcgcgaaggagtgggagaaggtgctcgacgcgctggccgcgcactacgagcccctgccaaaggaggggggcgtcttcgcccgccgcgccgccaacgcgctgggcgccctgcccgcccattccatctggaccttcgacgcgctgatggagaagaaccggctggcgcggctgttcttcctccgctcggacgacttctacctggccgagccccgcgccgtgcgcgacctgctggaggcgccgcagattcacgtccaggcgctggccttccggctgctcggccgcaactccgcgaaggcccgcgaggtggccgcgcagaacctggacctgctccaggccaccctgctgagacccctgcaccggcgcacgcgtcacgccgccttcgacgcactggccaacgccgccgcccacggcgtggaggccgcccgcgtgctggtgccgcgcgtgcgtgacgccttcgcgctgccggactcgcgctatcccaaggagtcgctgatggcgctgctggcccgcatgctggcgcgctggcccgagctgcgagacacagcggaagtcccccacgtcttcggcctgcccgcgaaaggagacggcgcgtga

SEQ ID NO: 5189 - DNA, 420 bp, Myxococcus xanthus
atgaagacggtgggcggactcgccggcacggtgggcgcgacgctcctgtccgcgcaccgccatggccgcgtcacgccggagctcaggaagctgggcatctggagcgcgctcacgctcctggtggtcgacgtctccacgtacaccacgaaccggaagcggcgctcccccgtcttcctggccgacgcggccattcaggccgcgctgctcgcggcgcagtggcgcgcgcgcagccgcatgccggtggtcatcgacgcacgcgcctccagccttcgcgacccgtcgcggtacggtgcgggcgagcacggacggtggaacatcctccccggcgagtcacgcgacgcggcgggcaatcgcgacatcgtcgacgaaggctccatgtcttcgtttcccgccagcgacccgccttcctacatgggttga

SEQ ID NO: 5190 - DNA, 1128 bp, Myxococcus xanthus
atgggaacggcggcgctgctggccctgctgctgacggtggtcaccatccaggcctggccggcgctgggtcaggccgcggacggcgcgcggcgggcacgcatggagcgctcgccccagtggcaggacgggcacttcgacaacccgcagcccctgcgcaacgacacctggggctccatcgcgagcatgttcagcgccagtcccgacgtgagccctgcccagggagcgctgccctcggtgacgctggacgggagcgcgttcggcgcgccgcccgccaccggccttcgcgtcacatggttcgggcactcgacgtcgctcgtggagctggacggtcagcggattctcatcgacccggtgtggagtgagcgcgcgtcgcccctgagctggataggaccgcgccgctggtacgccccgcccctggcgctgacggagttgcccgccgtcgacgcggtcgccatctcccatgaccactacgaccacttggaccatcgaacgctgttggcgatgaaggactgggacacgtccttcatcgtgccgctcggcgtcggtgcacacctggtgggctggggtatccccgagtcgcgcatcatcgagctcgactggtgggagcgtgcgcgcgtgggagcgctggaggtcgtctgcacccccgcccggcatgcctcgggccggacgggcatcgacaaggacgcgacgctgtgggcgggcttcgcgttcctgggccccaagcaccgcgtgtactactcgggcgacacgggcctgttccccgcaatgaaggacattggcgagcggctggggcccttcgacctgacgatgattgaggtgggccagtaccacagcgcgtggcccgactggcacatcggccccgagcaggccatcaccgcgcatcagtgggtccgggggcgcgtgctgctgccggtacactggggcctgttcaccctcgcgctccacggatggacggagcccattgaacgcgtgctcgcggcgggtgaggccacgggcgtgagcgtcatcgtcccgaagccgggtgagcgcgtcgaacccggtgcgccgtcctccctcgaacgctggtggccctcgctgccgtggaacacggcggcgcaggaccccatcgtctccacccagttggactga

SEQ ID NO: 5191 - DNA, 501 bp, Myxococcus xanthus
atggaaatctacagttcctcgcagaacaagcagaagacgctgaagccgcgcgaggtctattactcgcgcacgaagctcatcatcggtgtggtcatctggacggtggcctcgggcctctgtggcatcctcaccttccggctggcgaacagtctcggcgcgatggcgctctgcggggcggtcaacctctgcatggtctggatgctctacggctgcatcaggccgctgggcaacctggacaagcccgcgctgatcatcggtcgggatggcatccgcttcgaggatggcctgctgattgaatgggccgacatgaccgagaatacctattacagccagtcctacatgggcatccccacgctcaagatgattcaaatcaagaccacgctggacaagcccaagacgaagaagatgcgggtggcggcgctcgacatcgacagcgacgaatacctggagctctgcgacacctacagcaagcgcgcggcgctggcccccgcacgggcgtag

SEQ ID NO: 5192 - DNA, 171 bp, Myxococcus xanthus
atgcgctgggacgacatcgagagcatccgcttccaggacgagttcggcgacggtgtctccacccgcgagctgatcatcgccgcccagggcaagccgctcaagattgacgaggcccgcatcgtcaacgcgcccgtcctcctggcctacctgtcgcaacggctggccagctga

SEQ ID NO: 5193 - DNA, 429 bp, Myxococcus xanthus
atgaaaatcaccagttactacccggtcatcatgacgaacgacgtcgcgggtacggcggcgttctacacggcgcacttcggcttcagcccgcgcttcaccagcgactggtacgtccacctccagtcggacgatgcagagcatgtcgcgctggccatcctcgacggccggcacgaaacggtgccggcggtggcccggggcacggtggcggggaccatcctgaacttcgaagtggaagacccggacgccgtctaccgggacgtgcaggccgccggcctgcccatccacctcccgctgagggacgaggcgtttggccagcggcacttcatcaccgcggaccccaacggggtgctcatcgacgtcatcaagcccattccgccgagcgaggacttcgcgaagcagtacgaggccagcgcgcttcccgtcgggtga

SEQ ID NO: 5194 - DNA, 396 bp, Myxococcus xanthus
atggccctggccgaaatcttcgttccgctggccgtgggcatcctccagggcatcctggtgatgaagttcgtcaggccgctgctcatggaacggctgggcgggctcgccggcctggtccgctcccgggccaacaccttcttgggcatcgtccagatgttcctgctcctgggcgtggtggcggcctgcaacgccgcctacgcgccgcagacgctcgcctggctccaggaacgcgacatcctccctttcgagcccacgctgctcgtgctgcgcatctccgccatcatcgcctcctacctgagcggaaccaacctggtccatctggcctcggccctgtcggacgacacggagtcgaacacgctggagccgctgccgctcaacaaccggcgccagcggtga

SEQ ID NO: 5195 - DNA, 2843 bp, Myxococcus xanthus
atgtcgaacatcatcaagccgggcagtgacgccgagaagtcccagttgagcttgggcacggccgccgcgcgccagctggccacgacgaccaagtccgtcccgcagatgcagggcatctcctcccggtggctgctcaagctgctgccctgggtgcaggtgtccggtggcgtataccgcgtcaaccgccggctgagctacgcggtgggcgatggccgcgtgacgttcaccaccaccggcgccaaggtgcaggtcatcccgcaggagctgtgtgagctccccctgctgcgcagctacgacgacgtcgaggtgctgacggcgctggccaaccgcttcgagcagaagacgtacaaggccggcgatgtcatcaccgaggtgggcaaggaagcggactgcatcgtcctcatcgcccacggcaaggtgaacaagattggcgccggcaagtacggtgacgccaccgtgctcggggtgctggcggacggcgaccactacagctacgaggcgctgctggagtcgcaggactactggaagttcacggccaaggccgccacggcctccaccgtgctggtgctgcagcagtccgacttcgaggccgtgatggcccagtcgccctcgctgcacaagcacgtcgagcagttcaaggcgcgctcgaagaagaagcaggacaccacgggccaggccgaaatcgagctggccgcgggccacaccggcgagccggtgctgcccggcacctacgtggactacgagacgtcgccccgcgagtacgagctgagcgtggcgcagacggtgctccagattcacacccgcgtggcggacctcttcaacgagcccatgaaccagacggagcagcagctccggctgacggtggaggcgctgaaggagcgcaaggagcacgagctcatcaacaaccgcgagttcggcctgctgcacaacgccgacctcaagcagcgcatccacacccggcgcggcccgcccacgcccgacgacatggacgagctgctggccaccgtgtggaaggagccgtccttcttcctggcccacccgcgcgccatcgccgccttcggccaggagtgcagccgcaagggcatctaccccaccagcgtggacttcaacggcaacatggtgcccgcctggcgcggcgtccccatcttcccgtgcagcaagattcccgtcagcgactcgcgcaccacgtccatcatgctgatgcgcgcgggtgagaagaaccagggtgtcatcggcctgcacccgggcaccatccccgacgaaatcgaggccggcctcaacgtccggttcatgggcatcaacgagaaggccatcatcaactacctggtcaccagctacttctccgcggccgtcctcgtgcccgacgcgctgggcatcctggagagcgtcgaaatcggccgcggcgactagccctccttccgctcggatgacctgagggaatccacatgacgaaattcgtgaagacgggcgacgacaccccgcggctgagcctgggcacggccgcggcgcgtcaactcgcgacgacgacgaagaccgtcccgcagatgcagggcatcaccccgcggtggctgctgcgcatgctgccctgggtagaggtgacgggcggcacgtaccgggtcaaccgtcggctgagctacgcggtggcggatgaccgcctcgtgttcagcaacatcggcgcgaaggtgcaggtcatcccgcaggagctgctcaagctgccgctgctgcggggcctgagcggcgacgacgaggtgattgcggccctggccagccagttcacccaggcggagtacaaggcgggcgacgtcatcgtcgaggcgggcgctcccgccgagcacgtgttcctgctggcccacggcaaggcgcgcaagctccgcgcaggcccgtatggcgcgcccgtcaccctggacgtgctggcggacggcgaccacttcggcgaccaggcggtggtggagtcggatgacgtctggaccttcaccgtcaaggccaccacgccatgcacggtgctgtccctgccgcagcaggtgttcgagggcctgattgcccggtccgccacgctgcgcgcccaggtggagcggtaccgggagcgcctgaagaagccccaggacaagctggggcaggccgccatccccctggccgccggccactccggtgagccggacatccagggcggctacgtggactacgagctcacgccccgcgagtacgagctgagcgtggcccagacggtgctccgggtccacacgcgcgtctccgacgtgttcagcgaccccatggaccagacggagcagcagcttcggctgaccatcgaagcgctgcgggagcggcaggagcacgagctcatcaacaaccgggacttcggcctgctccacaacgccgacctcaagcagcgcgtccacacccgcaacgggccgcccacgcccgatgacctggacgagctgctcagccggcgccgcaagtcgcgcttcttcctggcgcacccgcgcaccatcgcggcgttcggccgggaatgcacccgccggggcatctacccgacacccatcgaggtccagggcacgccgtgcatggcctggcgcggggtccccctgctgccgtgtgacaagattcccatcaccgagcagcgcaccagctccatcctcgtgctgcgcaccggccaggaggaccagggcgtcatcggcctgcgccgcaccggcctgccggacgaagtcgagcccggcctctccgtgcgccgcatggatgtgacggacaaagccatcacgaactacctggtcagcacctacttctccgcggcgctgctcatccccgatgcgctgggcgtgctggagaacgtggagcttggcggctga

SEQ ID NO: 5196 - DNA, 1671 bp, Myxococcus xanthus
atgccggtgtggacgcccggcagctacatggtgcgggagttcgcgcggcaggtgcaggacatgacggcccatgcgccggacggaacgctccttccggtgcggcgcgcggacaagcgcacctggcgggtggacgcgaagggcgtggccgtcacgctgcgctaccgcgtctatgccaacgagctgacggtgcgcaccaaccacctggacggctcacacgcctacttcaacggcgccgccacgttcctctacacggaggacacgcgcgggctggagcaccacgtcacggtggacgcgccctccggctggcggaccttctgcgcgctgggccaacgcgcgaacaccttcgtcgcccaggactacgacgagttggtggacagccccttcgaggtcggtccccacacgccgctcaccttcagtgtggagggcgtgccacacgaagtcgtggtgtggggcgacacggtgcaggacccggagcggctgtgcgcggacctgaagcgcatctgcgaatgccaggcccgcgtgttcggcggcctgcccatgccgcgctacctcatcctgctgtacctgacggaccggggccgaggcggcctggagcacaaggccagcaccgcgctgttgttcccccgcgtcggactttccaccaaccgcggctgggaggacctgctcaccctggtggcgcacgagtacttccacctgtggttcatcaagcgggtgaagccgcgcgcgctggtgcccttcgactacgcgaaggagaactacacctcgctgctgtgggccttcgagggctccacggcgtactacgacaacctcttcgtgcggcgcgccgggctgatgtccgcgcagcgctacctcacgcgcctgggcgaaacactcaccgcgctgcatgccacgccggggcggcgcgtgcagacgctggcggaggcgtcgctggtgagctgggtgaagcactaccgcccggacgagaactcgcccaacagcgccatctcctactacctcaagggcgaggtcgtctccgcgctgctcgacctggagatccgccgcgccaccggtgacgcccgtggcctggatgacgtcgtgcgcgtcttgtggcagcgctacagcgacggctccggcgttcccgaggacggcgtcgaagccgtggccagcgaggtggccggcgtggacctgacgcccttcttcgaccgggcgctacgcaccacgcagccgctggactactccgtcttctcccacgtgggcctggagctgaacttccgtccgcgcgaggccgccagcgacaagggaggcacgccgccgcgaaaccgggcgggggaagggaagcccaagggctggctgggcgtcaccacgcggggcagtggcaccgtggcggtggtgatggatggctcgcccgcacaggacgcggggctctacgtggaggacgacctggtcgcgctgaatggctggaaggtggacggcgccaccctgctgtcccgctgcgaggagcggaggcccggcgagacggtgcggctcacggtgttccgccgcgaccggctgctcgaaatcccggtggtgctggggacgaagcccgcggaggcggcgtggctgtcccgcgtggagcgccccaccgacgcccagaaggccgcctatcaggcgtggctcggaagcccctgggaagagtcccctgggcagtcgtag

SEQ ID NO: 5197 - DNA, 2250 bp, Myxococcus xanthus
aagcagccattcgaactgccagacttctacgttccctggccggcgcgcttgaatccgaacctcgaaggcgcccgggtgcattcgaaggcctgggcacgcgagctgggaatcattggccgcccgaaggatggcagcgctccggaaatctggagcgaggcgaagttcgatgccatggactacgccctgctctgcgcctacacgcatccggaggcgccgggcccggagctggacctcgtcaccgactggtacgtctgggtcttctacttcgatgaccacttcctggagctctacaagcgcccccaggaccaggtcggcgcgaaggcctacctggaccgtctgccattgttcatgccggtcgacccggcggccacgcctccgccgccgaccaacccggtagaggccgggctgctggatttgtggaaccggaccgtccccagccgctccatggcatggcggcgccggttcttcgagagcaccaagcacctgctggacgagtcgagctgggagctgtccaacatcagcgaccgccgcgtctccaaccccatcgaatacatcgagatgcgccgcaaggtcggcggtgcgccctggtccgcgaacctggtggagcacgccgtcttcgccgaagtcccggaccgggtcgcggccagccgcccgatgcgggtgctgaaggacacgttctccgacgcggtccacctgcgcaacgacctgttctcctacgagcgggagattctggaggaaggcgagctctccaacggcgtcctggtgatggagaagttcctgaacatctccccgcccagcgccgcgcacctcgtcaacgaggtcctcacctcgcgcctccagcagttcgagaacaccgtcctgacggagctgccgtccctgttcgtcgagttcggcctgaacccggtggagcaggcccaggtgctcacctacgtccgggggctccaggactggcagtccggcggccacgagtggcacatgcgctccagccgctacatgaacaagggctccggcggcgcgggcggcttcttcctgggccccaacggcctgggcacctccgcggcgcggctgccacagtcgcccacggccctggggctcacccgcctcaagaacttctcccatgtgccgtaccagcccgtgggcccggtgaagctgccgaagttctacatgccgtattccacgaagccgagcccccacctggacgccgcgcggcgcgactccaaggcgtgggcgcggcgcatgggcatgctggacgtgctccccggagtccccggcggctacatctgggacgaccacaagttcgacgtggcggacgtggcgctctgcggcgcgttgattcatccccacgccaccgccgcgcagctcaacctgtcctcctgctggctcgtctggggcacctacgcggacgactacttcccggccttctacggtcacaccaaggacatggccggcgccaaggtgttcaacgcccggctggcgctgttcgtgccggaggacgccggcgcggtggttccgccccccaccaacccggtggagcgcgggctggcggacctgtgggcccgcaccaccgaaggcgtgacgcccgcctcacggagcctgttccgcaaggccatcctggacatgacggagagctgggtgtgggagctggccaaccaaatccagaaccgcatcccggaccccatcgactacgtggagatgcggcgccagacgttcggctcggacctcaccatgagcctgtcccgcctggcccatggcgacgcgctgccgcccgaggtcttccacacccgtcccatccgcagcctggagaactccgcggcggattacgcctgcctcatcaacgacgtcttctcctaccagaaggagattgagttcgaaggtgagctcaacaacggcgtgttggtcgtccagcgcttccttgacctggacccggcgcgggccgtctccgtcgtcaacgacttgatgaccgcgcggatgcagcagttcgaatacatcatcgccaacgagctggagccgctggcgcgcaacttcaacctggacggcaaggcccaggacaagctgaagcagtacgtccagaagctgcagtggtggatgagcggtgtgctcatctggcaccagacggtggaccgctacaaggagttcgagctgcgcgcgtcccgcaagctggcgccgcggctctcgtcgggccccaccggcctgggtacctccgccgcacgcatcacctccctgttcgccaacctgcgctccggcgcctga

SEQ ID NO: 5198 - DNA, 1035 bp, Myxococcus xanthus
gcggctcagtcgcgccccggtccggtagccggagtgggccccgtcgtgctcggcgccagcgcgggcgtgcgcatccgctccacggagaacgagcccgggcgcgactacggcaccgagctggagcaaggcatcgtcgtgtccacgcgcggcaagggcctgcgcggcgaaatcgcgctgcaagccgcggagtcgctggtggagccggacttcgcgctggagctgctgggcggcgtgcggctgcccgtgggcggcggcttcgaggccttcgccatcgccggacatggcttcacggacatcccgggcacgccgtccatccgcgcggccgcgggcatcgcctgggcccatcagccgcccgcacgggaggacgtgtgccggagcggccggagccacacgccggaacagtgccccgcgctggatgacgacggcgacacggttcccaacgggcaagaccgctgcccgctcgaagccggcccgccagagaacgacggctgcccggacaccgacgcggatggcgacggcgtcgtggaccgcgaggacgcatgcccgaacgaggccggtgtcgccgcccaccgtggctgccccgaacccaagcaggagcccacgccgccgccgcccgctcccgagcccgcgccccaggcgcccgctcccgagctcgcgccccaggcgcccaccaccgaagcgccgacgcggctgccgaccgagcaccacgttcagttcccggtgggtcagtcgacgctctccgactcggagcgtcggaacctggacgccatcgcggactacctgaaggccaacccgggcgtgtcgctgcgcatcgaaggacacacggacaacaccggccccgaggagctcaatcgcacactgagccaggaccgcgcagacgcagtgcggcaatatctcatccagcaaggaattgagagttcgcggctgactgcgaagggctacggccccgcccaacccattgcgtccaatgatacgcccgagggacggagcgccaaccgccgcgtggagttcgtcaccagtactactggtgaatga

SEQ ID NO: 5199 - DNA, 1263 bp, Myxococcus xanthus
gatccggccaccaccggggaagaagcctgtgcccggcagatggtggagtcgctcgcgaaccgcgcctggcggcgtcccgcgaagccggacgaggtcgcggagttgatgagcgtctacacgctcgtgcgggagtcgggggacggcttcgagctggcggcgaagttcgcgctccgttcggtgctgctgtcgccgcacttcctcttccaggtcgtggagacgcaggcgccagggacgggcaagagcgagctgtccgcgcgcgagcttgcatcgcgcctgtcgtacttcctctggagcagccagcccgacgcggagctgacgtcactggcggacgcaggccggttggccgaccccgaggtactggaggcgcaggtgcgccggatgctgaaggacccgcggtccgaagcgctggtgcagaacttcgccggccagtggctgggcctgcggaaggtggacggcatcaccgcggacccggcgctgttccccggcatggattccgagctcaagcgcgccatgcgcgaggaaggggagagcttcttccgcgccttcctcaacgaggaccgcagcgcgctggagttgctggacgcggacttcacctacgtcaacgaccggctcgcggactactacggcctgcctcgcccgggctccacctccgtcacgcgcgtgagcacgggcgacggacggcgcggcggtgtgctgggccaggcaggtgtgctggcgcaggcgtcgctggccacgcgcacctcgccggtgcttcgcggcaagtgggtgctgggcaagctgctgtgccaggagcctcctcctccgcctccgggtgtggaggcgctgcccacgcaggtgccgccgggctccacgctgcggcagatcaccgagctgcatcgcgcgaacccccgcctgcgcgggctgccacgacacgctggaccccatcggtttcagcctggagaactacgacgcggccgggggccctggcgggagacggacaacggctctccggtgcacgccacgggcaacttcaagggcgtgtcgtttcagggtccgcgtgagctggcgaccatcctcaagggcgacccggccttcgcgacgtgcatgacgcggcaggcgctggcctatggcttggcccgcgcgctcacgtacgagtacgaggccaccgtgcgctacgtgcacacgcgcttctcggcgggtggacaccggctccccgagatgctggtggccgtggcgctcagcgacagtttccgcaaccgctgcccggtaccggccgcggagtag

SEQ ID NO: 5200 - DNA, 174 bp, Myxococcus xanthus
atgggcgatgacccctgccagccggggcagtactgcgcggacgccacgctcagctattgcgagcccggctgtaccagcgacgtgaactgcgcctccaaccaggagtgtgtgaaggagtacagagagcaggtggggacctgcctcaacatctgcacgtcgtgcgcatacgattga

SEQ ID NO: 5201 - DNA, 702 bp, Myxococcus xanthus
atgcgcgcggtggtgttccagcacgaggagcacgaagggcccggcctgctggggccggtgttgcaagcggcgggcttcacgctggtgaaccgcttccgcaccgtgcgccgggaggacgtggacgcggaactgctggtcgtcatgggcggtcgcatggccgtctacgaatccgagcagcatcccttcctgcggcaggagttgggcatcctcatggagcggctcgcctatgagcgcccgtgcctgggcttctgcctgggcgcccagatgctcgctgcagcggcgggcgcggacgtgttccccgggaagaatggcttcgaggtgggcgtgggcccggtgcgatggacgccggaggcgcagaaggaccccgtgctgtccggggcccgtccgcgcacggtggtggcgcactggcacggtgattcctatgcgcccgtcccggacgccacgttgctggcgtccacggaccggtacacccagcaggccttccggttgggcacgtcctacggcttccagttccacctggagctgaccgccagcgagctggggcgatggattgacatcgaggcggacagcctccagcaacgcggaaagaacctccaggagctgaaggcgcagttgcccaagctcaaggcggccgaggccgacaacacggaggtgctgcaccgcctcgcgcaccacttcgcgcgcgtggcggcgggccgctga

SEQ ID NO: 5202 - DNA, 1452 bp, Myxococcus xanthus
atgctcctgggcgccgcaggttgtggcaccgaagtcgaggatgctgacttcacgagtcaggagtccgccctgagtcagaagtgggagttgtgcgggaaggaggccgttcgattggcggacatccaccctggccccgtggggtccaatccggccgatctgatccacggcgaccgagtcctcttcttcacggcggacgacgggacacatggacgcgagttgtggcgaagcagcggaacggaaggaagcggcacgtcgctggtgaaggacatctacccagggctggcggggtcggagatctcgaatctcactcgggtggggaaccgggtgttcttcgccgcggatgacggcgtccacggctacgagttgtgggtgaccgacgggacgtcggccggcacgtacctggtgaaggacatctacccggggccggaggatgggattcgccgtccggaccccttctactggataaacgatcccatgctggttgagttcggtggtgtcctgtacttcggcgcgaacgacggcgtgcacggatacgagctgtggcgcagtgatggaacagacgcggggacgtacctcgtcgaggacatcgagcccggacccgctaactccttcccgcgaaggctcgttcgcgtgggtaacgaggccttctatttcgtcgcgtccaagcggggcccctggagcgatgagattcatctctggcgtagcaccggagtgccaggggccattcccgtcctcagcctggtaggagataacgtcatcttcgacttgctggctgtgaagtcgcgcctctatttcctcgtggataacgacgagggcgaagccagcttgtggaagacggatggggccgcctcgaacacgcacgagctgcggtacttctacggagagtatccgcacgacctggtcgcactgggctcgcgtgtcgtcttcagcgccggggcaggtgagccagagggtgaggagctctggagcagcaacggctcgacctcaagcacgaagctggtgaaggacatctggccagggcccatgagctcctcaccgagctctctggcggttctgaagtcgcgagtcttcttcgccgcgaatgatggctccggagagggacgtgaactctgggtgagcaacggtaccggttcggggaccaggctcttcaaggctctggcgcccggtggtggctcatcggatcccgaagcgctggcctccattgaaggcacgctgttcttctccgcgagcgatggggtgcatggacacgagccctgggtgagcgatggcacccgttcgggcacgaaggcgctgcgaggtctggcgcacgggagcgcttcctcgtcgccgcgcgacttcgtgcgctcaggctgggacgtgttcttctcggcggatgacgggaagactggacgcgagctgtgggccttgccgttccgtccgaagggggagtgcaagcagcaccacgcctactga

SEQ ID NO: 5203 - DNA, 3954 bp, Myxococcus xanthus
gggaacatggcgccgacgtacgacgcgctggtcattggcaccggctttgggggagcggtggcggcttgccggctggcacaggcgggcttgaccgtgcgcgtcctggagcggggcctgcgctaccagaaggggagctttccccgcgactggagcaacccgctcaacggctggctgtggcggtacgaccagggcctcttcgacgtgaagctgctgccggggatgagcattgtccaggccgcgggctacggcggcggctcgctcatctacgccaacgtccacctgcgcccgcccgcggagaccttcgacgccgactggccggagggctacagccgcgccgcgttggatccgtactacgacctggtcgcgtacatgctggacctccagcccatcaccgcgtccgcacgtggcctgcccaccaaggcgaagcggatgcgggaggtcgcgcgcaaactcggccgcgagcagcagttcttctacccggaccttgccgtgcgcttcgcccccgccggcgagccgatgcccaacaagttcggcgtcgcccaggagggctgcaactactgcggcgaatgcgacatcggatgcaacgtccgcgcgaagaacacgctggacctgaactacctggccgtcgctgaacagcagggcgcggagatgaccacccaggcggaggccacgcgcatcgagccgctgtctcccatgggctatcgcgtcacctataccgaccatgccgcgggcggcgccgagcgcaccgtggaggcccgccgcgtgttcctgtgcgccggcacggtgaacaccacggagctgctgctgcgctgccgcgaccagtggggaacgctcccgcgcatcagcgaccggctggggtgccgctattcggccaacggcgacttcctggccttcgccttcgagacgcgcgaggtgtgggacccgtccgagggccccaccatcaccaccagtctggtggtggaccaggggcagggcgcggacaagacgtggttcctcttccaggagggcgggcaccccgggaaggcggcggggctgcttcaggtgctggacatgggccgggacttccgtgtccccgcggacctgctccagaagcaactcgtccgcgccctgcgccggcgctcccagcctgaaaccgtcatgggcaaggagcgcgggcgtttccaggccgtgttcctggccatggggagggatcgcgccaacgggcggctcgcgctgcggcctttgactcgggacatggaggtgcgctgggacgtgccttccaacctgccgctgtaccggacgcaggagcagatctgccaggacatcgctcgggcgctcggggcgcgcgccgtcttcaaccccctgtgggatcggcttcacatccccgtgtcagtccacaacctgggcggctgcaccatggcggaggagccggcctacggtgtgctgaacccggacggtgaggtgcacggccaccctgggctgtacgtgctggatggcgccgcgctgcccgcgagcaccggggtgaacccttcatccaccatcgccgcggtggcggagcgcaacgtcgaggccgccatccggcaggtgctggggaaccccacctggaccgcacctgagcgggccggaacggcttcgggccgggcgtcggcggaaccgttccgcgcgtcgatgcggatgagcacgagtgtggcacccacgcgggtggtgccaagagaggatccgatgcggagcgtggtgattccagagggaggcacagtgctgtcgccaacgcccgtggtggggctgcgcttcaccgagcggatgcgcggcttcatcaaccacggccacctgccggacacggattacgcgggcgccgaggaggagggcaagtcagagggcagggtggccgagttcatcctcaccatcaccttgcccaatctggaccgcttcctcgcggagaaggcccattcaggcatcgcgcaaggcaccgtccacgtccacggcctcacacctcctggcggagcgaaggtggaccacggcgtcttcaacctcttcgtggacacggacagctactacgagcgtcggatgctctacctgctgcccttcaccggcatggacggccagcagtacctgctggatggctacaagcatgtccgggacgacgacggcttcgacatgtggtccgacacgtccacgctctacaccgtcattcgccggggcagcgaccggcacgcgcccgtggtcgccagcggcatcatccgtctgggcatgccggacttcctgcagcagctcacgaccttcgccgtgctgggaacgacgtcaccgctggcgaaggcccaggccctgaagcgttttggcagcatgttcatgggcaacctctgggacgtcttcgcgcgaaccaagctggaataagagaggcgcatcgtggcgaaggcatcgcggtacgacgtggtcgtcgtgggctccggctttgggggctccatcagcgcgctgcgcctggcccaggcaggcaagtccgtgctggtcctggagcgcggcaaacgttaccggcccggtgactttccccgggacgtgacgcgaacggacgaggtgctctggcgccatgccacgcggcgcaaggcgcagggcctctatgacgtgcgcttcctgtccggcatcggcacggtgacggccagcggcgtcggcggcggctcgctcatctacgccaacgtccacgtgcggccggacgccgaggtgttcgaggacccgcgctggccccggacgtaccgccgggactcgctggagccttacttcgacaaggtggcgcgggagctgcggttgaatccggtgccgccctcgattccgctgcgcaagcgtgacctcttccagcgcgcggcccggggcatggggcgcgagacattcgacccgcccgtggccgtggccttctcggagccgccgggaccgggccggcgcgtgtgccagctctgcgccgagtgcgagttcggctgccagcacggcgcgaagaacaccatggacctgacgtacctggcgcgggcggaggcgctgggggcgctggtcctggcccgcacgctcgtctcccacgtggagccggtgcgggatgggtaccgcgtgcactgccaggacctggtgtcgggggcgcggcacaccgtggagagctcgcgggtggtgttggccgcggggacgctgggcacggtggagatattgctgcgcagccgggacgtcgcgcggacgctgcctcgggtgagccggcggctgggccatggctattcgggcaacggggacttcctggcgtcgatgcagggcgcgcgcgaggacatccagccctgggtgggccccgacgtgtccaccgtgatgcgcttcaccgaccggcagccgcgcttcacgctggtgacggccacgttcaaccagcccgccacggaggtcctcgcgggcctggggcagccgaacctcggacggctccagggcctgggggcgccgctgtggacctgcctgggcccagccgttcacgcggcgctcaagaaggggctgatgagccggcccctgcgtgccgacgtggatgcggcccgcacgtccaacctgtttggcatcggccaggacaacgccaacggccggatgcacctcgatgacgggcagctcgacgtgtcgtgggacttcgccggggagaacgcggagttggtgcggcggatgacggacgcgatgcgggacctggcggcccagtacggtgccagcttcgcgccgctgatcacctggcagctcttcaagcggcctttcacggtgcattcgcttggcggtgcccatctggcggaagctcccgagcgcggcgtggtgtccaccgagggagaggtcttccactatcccgggctgcacgtggcggacggctccgtcatcccgacagccatcggcttccaccccgtgatgaccatcagcgcggtggccgagcgcatcgccgaggccgtggtgcacggattctcatcccattcgaggagcgcttcatga

SEQ ID NO: 5204 - DNA, 906 bp, Myxococcus xanthus
atgcttcccacggtgcgggagaacttcgtgcagcacctggtgcgccacggctacgacacctggcttctggactggcgcgccagcgtggagctgccgctgcggcagttcacgctggatgaggccgcccgccacgacatgcccgccgccgtccgactggtccgcgagcacagcggcgcggactccgtgcaggcggtggtgcactgcgcgggctcggcgacgttcttcatggcgatggcggcggggctgcttccggacgtccagagcgtggtcgcctcgcaggtggcgctgcatcacatcgtcccgccttcaacgcagctcaaggcgatgctgcggttgccggacgtgctggacatcacccgcgactacctgacgccggacgaggacccgagcagccccttgttccaggccgccttcggcgccttcgtggacctgtggcgtcatgaatgcgacagcaccgtctgccgccgtctgacgttcatgtacgggcagctcttccggcacgcgcgcatcaatcgggagacgcatgaccggctcgacgagcagttcggcccttgcaacatgctgacgttccgtcatctggcgcagatggcccgctcgggctacgcggtgggcttcgaccatggccgggaggagaacctccggcgctatggccgtgagcggccgccgtcgtacctgcgcgcggagcacctcaagcgtcccatcaccttcgtgtccggagagcagaatggcacgtacatgcccgcgtccacggagctcacctacgagtggctgcgcgaagagaacggtgcgtcgtattaccggcggaaggttctggcggggtacggccacctggacaccttcatgggaagcactgcgtcgcaggatacgtatccggtgatacgcgacgcgctggaggccatggcctga

SEQ ID NO: 5205 - DNA, 195 bp, Myxococcus xanthus
atgaccgaagtgaacgcaacctcgcgtgactacacgcttcccgaggggtgccccgtctgcgcggcggacctgcccgtgcgcgtcaccgccgccggtcccagcgccgtgtgccgccattgtggctggctgggccgtcccctcatcaccgtgacccatcgcggcctgcgcgtcagctacgacggcgcgcaggcttga

SEQ ID NO: 5206 - DNA, 951 bp, Myxococcus xanthus
atgcccgcgttcctctacgtcaccgtggtgcgcccgctcctccaagaggggcgttcggcgctcggcgcgtggattcggggcctggacacccccgggctgctgacagtggatccggtgctgatcggcctgctgctgctcggcgtcctctggctgcccgcggcgctcctcatcaccgccgcgcgccagccactgctgaccttgttcgacgtgcccggaacccttcgcatcgtccgccgcctgggccgggactacacgctggtcgcgggaacgctggtgggcctgggcgtcctccacctcatgacgcacggggtggcgttgctgctgcgcatgctggacctcttcgtcatctcacgcgtactggccgaagccgtcacgctggtcatcccattcaccgccgcgcacgtggtggggctgctgctgtacacgcggggcgatgcgctggggtatggcctcgagcaagactacctgacccctgtgctgggcgacgcacaaccgagccgcatggcgccgcccctgcgcgatgccggtcccattcccttcaccggagcggcggccagggccatcgagacgggaagctccaacgacgacaccctggaggcgctggcggccgcggtgaacgcccgcgatgttccactcgcgatgtcgctgtatgccacggtgcggcagcaaccgcggctgcgtgtgcccccagagcaccacctgttcgtcggacaggccgcggccgtggaaggaaatttcccactggcggtagcggcgttggaatccgcggcagacacggcgcccgatgagcccaccgcgccccgtgcgttggtacttctggcgcgtgtgttgggtgaacggatgcacgacgcgccgcgcgcggaagaagtctaccgctacgtgctccaccgttacccagacacggcagcggcacgcttcgcgagtgaacgcgtgtctccgacttccgactga

SEQ ID NO: 5207 - DNA, 729 bp, Myxococcus xanthus
atggccttctgcggcgcgggctatcactacgcggccgaggaggagctgaatgcgttcctgtccgaagccgaggcgatgcccgccagcgactttccagcgatgcgggaggccgcgccggcacaggttcgcgagacgctgctcgccacgggctacttcctgcgggcctggaaccgcatgggtctcaagcgcgagcgtgcggcggaggacgacctcgagcggggcctgggctccctggagaagcttggcatcgagaatgagctgacgtggtggggctgggccttcatccacttccgccgggagcgctacgacgaatccgcgcgctacctcgacaccctggcgaagagtccgtacctgggcgagaccgagcggcgtgacctccaggccagcgcggacgcgatgcgcaagcacggcgaacggctccccatcttcctccaggcgcgggccgccgccatcctgggacaggcgctcgtggcgagggcagggggcccggagaagatcctcgtcacgctcctgggaccggagcgggcagggcaggtcctggcgcccatcctgtggatggaccgggtccgtcaaggcctcgcgcagcgctccatggacgacatcgcccgcgcggcgggggattccttcgagggcgttcgggccgccggtagcaagggcctgagcgcattgaaggagaagctgctgggcggtggaggcgacacgaagaccgcggcggagagtcctccgtag

SEQ ID NO: 5208 - DNA, 612 bp, Myxococcus xanthus
atgagtccgacgaagaaggccgccgcgaagaaggcccccaccgctgagctccccacgattgccttcgcgtcgcccgcggaatgggcgtcctggctcgaagcgaaccatgcctcgtcgcgcggcctctggttgaagctggcgaagaagggctcgggcatcgaatccgtcacctacgccgaagcggtcgacgtcgcgctcgagtggggctggattgacggtcagaagaacgccttcgatgacaccgcgtggctccagaagttcactccccggggcgcgaagagcgtctggtccaagatcaactgcgagaaggtagaagcgctcatcgccgcaggccgaatgaagccgtcgggcatggaggtcgtggcgctcgccaggcaggatggccgctgggacgccgcctacgagtccccgagcaaggccaccgtgcccgaggacctggcccgcgccctggccgcgaatgcgaaggcggccgcgttcttcgccacgctcaacgcggcgaaccggtacgccatcctatggcgcgtccacaccgcgaagaaggcggagacgcgggctcggcgaatcgaacagttcgtcgagatgctggcccggcacgaatcgctgcacgcatga

SEQ ID NO: 5209 - DNA, 1338 bp, Myxococcus xanthus
atggactcgcggacccagcgctacttcgaggacatccagctcaagcacttcgggcgcctcttcggccggctcgttcgtgtccgcctgttcctgtcgctattgctgctgctgtccgccgtgtgtgtcgccgtcatcgacggcgcgccctggcgatgcgtgttcatgagcgtggtgggggtgggcgcctttacctacttcttccatgagttccgccgctttcagcgcgacggcgttgacgcgcgcagcgtgccgctcaatctgtggatggggcagatcatcctgacgagcatcatcgtggggacaggcggcatcgccagccccgtgctgcccgccgcgctgcccctgggcttcttgtcgagcctcgcggcgacgccccgggatcgctcgcggctgttgatggcgcagttgtccacgctgatggccgtctccttcttccagatttccgggctggttcaggggctgcccctgtggttcctcggcgcgccgtcggccgtcctgctcgtcgcgggcgccctcgtcaccgccatcatgctctgcgtgtgcagcgccgcgggcggcgccatccggacgaccttcgacaacatgctgagcgaggcgctcgccagccgcgacgaactgctggccacgcatcgctcgtatgcgggcgccctggaggccatgtccggagagattgcccacgagctgaagaacccgctggccacggtgaagggcctcacccagctcatggcacgcgaagcaggtcgcgcccagcccgccgaacgcctgcaggtgctgtcgggcgaggtggtgcggatgcagggcatcctggaggagttcctcaacttcactcggccgctggtgcctttgacggtgagccccgtggacctgggcgcgttgtgcgacgaagccctggtgctgcacgaaggactggcggcgggccacggcgtgcggctggagcgcaagggcacggagggcgtggaggcggtgtgtgactcgcgcaaggtgaagcaggtgttgatgaacctgctgcacaacgccatcgaggcctgtcccacgggcgggcgtgtcaccgtggaggtccgcgcgctgcccgtgggcgaggcccgcgtcttcgtgcgcgactcagggcctggactggcctccgatctcgaggcccgtgtgttcgacgcgggcgtgacgaccaaggccaagggctccgggttgggcctgacggtggcgcgagccctggcgcgacagcacggcggagacgtcacgctggcgaatgcggtaggaggcggatgcgaggcggcgttgacgcttccgcgagagctgccagcggagatcctgcggccactgcacggagtcgcgaatgtgggatga

SEQ ID NO: 5210 - DNA, 1434 bp, Myxococcus xanthus
atgtgggatgaggccaaggagggtggcaccacgcgcgtcctggtggtggatgacgacgcgggcgttcgcttcacgctgcgggagatgctcaagagcctctccggcgtcgaggtggatgaagccgtggatggcgaggacgcgctggagaagctgtcggccaggccctacgagttggtcatctccgacctgcgcatgcctcggatggatggcatggaactggtgcgccggctgagtctgttctcccggtcacctcgtgtcatcgtcatcaccgcgcatggttccgagcgcttcgcggtggaggccatgaaggcgggggcctacgactacttccgcaagcccttcgatgtggatgagctgctggcggtcgtctcccgcgcgctggagtcggtacggctccgcgaggagaacgcacggctttcaggtgagctgaacctgtcccgctcgttggtgttcgtctcggagcccatggcccggctcgcgcagctcgtgcaacgggcgggctcacgggatgtgacggtgctcatcaccggcgagagcggcacgggcaaggagcgggtggcggatgcgctcgtccgcgcctcgccgcgcgcgaaccggcccttcctgcgcttcaactgcgccgcactcaccgaggaactggcggaggccgagctgttcggccacgcccggggcgccttcactggagcccaccgcgcgcggcctgggctcttccgtgaggcggatggcggcacgctgctgttggacgaggtgggcgagctggcgcccacgctccaggcccggctccttcgcgtgcttcaggagggcgaggtgcgcccggtgggggaggaccggccggtgacggtggacgtgcgcatcatcgccgccacccacagggacttgcgccgcctggccctggagggggcgttccgcgaggacctctactaccggctcaacgtcgtccagctccgggtgccgccgctgcgcgagcgccccgaggacatccccgtgctggcgcgggtgttcctggaccgcttcatcgaccggttccacaccggcccgctgaaaatccccgacggcttcttcgagcagctccgtgccttgccgtggccgggtaacgtgcgcgaactggagaacacgctggagagcctggtcgcgctgtccagcgaggggcggctggacctgggtcagttgccttccgccgagccggcaggagcggatagtggtttcccgggggcgtcatcggacccggtccgtccagggccgcaggacggggctcccggcgcggggctcaaggagcgcgtggaggcgtacgagcgcggcctggtcctggacgcgctgcgcatcgcgggcggaaaccgcagtgaagcggcgcggcggctgggcattggccgggccaccctgcatgacaagctgcgcaagtacgggctggacgacggcggggaagagcggagctga

SEQ ID NO: 5211 - DNA, 1800 bp, Myxococcus xanthus
tacaccaagttcgagtaccgcattcccatgcgggacgggacgcgcctgttcacctccgtctacgtccccgcggacgcgtcaccggggaagcgctatcccatcatcctggtgcgcacgccgtacagcgtcgcaccctatggcgtggaccggtatccccccgcgctggcccccaccgaggcgttcgagaaggacggcttcatctttgccttccaggacgtgcgcggccgaaacatgtccgaaggcgagttcgtcaacgtacgcccctacaagccgaagaaggccgggcccaaggactttgacgagagcaccgacacgtacgacaccatcgagtggctggtgaagcgcgtggcgaacaacaacggccgcgtgggccagtgggggatttcgtaccccggcttctacgcgtcggcgggcgccattgattcgcacccggcgctcaaggcggtgtcaccgcaggcccccatcgccgactggttctgggatgacatgcaccgccacggcgccttcaacctggcgctggcgttcaacttcttctccacgttcggcaagccccggccccaccccacggacaacgaggagtggcagcgcttcgagcacggcacgccggacggctaccagttcttcctggacctgggccccctgggcaacgcggacgcgaagcacatgaagggggacgtcgccttctggaaggacgtcaccgcgcatcccaactacgacagcttctggcaggcgcggaacctgctcccgcacctgaagaacatcaaggcggcggtgctcacggtgggcggctggtacgacaccgaggacctctacggccccctgcggacctacgccgccatcgagaagcagaaccccggcatctccaacagcctcatcatgggcccgtggccgcacggcggctggcagcgcggcggtggcgagtccctgggcgacgcggacttcggcttcgccaccagcgagacctaccagacgttggcgctggacttcttcaagcaccacctcaagggcggcgcgaagccggacgtgccggaggccatggtgttcgagacgggcgccaaccgctggcgccgcttcgacacgtggccgcccaaggggctgcgcgagacgcggctgtacttccagcccaagggtggcttggccacgacggcgccgaagacgacgggcgcatccttcgccgagtacgtgagcgaccccgccaagcccgtgccgtacacgcaggagatgatgacgggctggagcaaggactacatgacggaggaccagcgcttcgccgcgcgccggccggacgtgctggtgttcgagacggagccactggagcgcgacctcacgctggcgggaccgctggaggcggagttgtgggtttccacgacgggcaccgacgcggactgggtggtgaagctggtggacgtcaacccgggcaaggtgcgcgggtggcgcaagggcgatgaagagaaggggcagaagaaccggggccatcagcagacgctggtgcgtggcgagcccttccgcggccggttccgcgacagctatagcgagcccaagcccttcaagcccaacgaggtgacgaaggtgcgcttcgtcatcaatgacgtgttccacaccttccagcgtgggcaccgcgtgatgattcaggtccagtcgagctggttcccgttcatcgaccgcaatccgcagacctacgtgcccaacatcttcgaggcgaaggaggagcacttcacgcgcgccttccatcgcgtctaccactccgcggcgaaccctagtttcatccaggtgggcgtgctgccctcgttggacgagtag

SEQ ID NO: 5212 - DNA, 1083 bp, Myxococcus xanthus
atgaccggcacccaggggcccgacaccgggctggtgcggctggatgggagtgagggcgaagggggcggccagattctccgctccgcgctgtcgctgtcgctcatcaccggccgcccgttccacatcacgcgcctgcgcgagcgacgtgatccgcccggtctgcgtccccagcacctggcctgcgtacgcggcgccgatgccctgtgtggcggtgccgctttttccgagggcgccaccgtcggcgcctccgagctctccttcaccccggcccccgtgcgcgccggcgactacctgctggaggtgggcaccgcgggcagcacgccgttgctcttccagtgcctcgtctatccgctggccctggccggcggaggacggctgaccttgcgaggcggcacgcacctgccccatagccccagcttccactatgtggccaccgtctggcagccggtggcgcatgcgtatggcctgccggtgctgctgtccctggtgcacgccggcttctacccggagggcgcgggggagattgtcgcggaggtggggccaccgcaggagccgccccggctggtggagctgcccgcgcgaggcatgttgcgcgaggtccgcgtgtcgtccttcaccggcgggctgccgttcaccatcgccgagcgtcaatccagggccgccgtgggggcgctgcgtgagcgcggcatcctggcggaggcggacaaccgcccgctggcggtgacgcgctcggtggggaccgtcactttcgtcctggcccagttcgagcacaccatcgcgggcttcaccgcgctgggagagcggggccgccccgccgaggacgtgggtcgcgagggcggagaagccctggcgcggttcatggagacgggtggggcgctcgacgagcaccttgccgatcagattctcctgcccgccgcactgctggccgccggacgcctggggccggcgtcaccgggcaccacgcgcttcacggcggcgcgaatcaccgaccacctcaccacccacgcccgtgtcgtggagcgcttcctgcccgtgcgcgtcacggtggatgcgggaggctccgtggaggtccggcccgcctga

SEQ ID NO: 5213 - DNA, 1665 bp, Myxococcus xanthus
gtccgcttccggctgacgggggatccgccgtaccgcgagcgacgccggcgccggttgcagttggggggcagccgccccgagccgtcggatgtcacgtccgtggagcgcctccgcgagtcgttggagctcctggccaaggacggccgggtgaagggcatcctcctggaggtggaggacctggccgtgcccgcggcgaagcgggatgcgctggtggcggtgttgagggccttccgagcccaggggaagcgggtggtgggctgggcggtccacgtggacaacgagggatatgccctcctgtgctcggcggacgaggtgctcctgccccccatgggccgcgtggagctggtgggctacgccgccgagtccaccgccctgggcgtgggcctgtcgcgcgtgggcatccggccgcaattcatccggcgcggggattacaagacggcgccggagctcttcaccaggcccgtcgtgtcggacatccagacgcggacggtggagtcgttcctggatgagcgctacgcggacctgttggacgtagtggctcgggggcggcgcaagacgccggaggaggtccgggcgctgatcgaccaggggcccttcagtgctcgccgggcggtggacgcggggctggcggacgcactggtgagcgaggcgaacctgcccgcgtacctcgggctggcgaagccgggggacggggaggaggagacggagctggagccgatggagacctatctctccacgattccgttcccgccggtccgttggaagcggctgcggcggaacccgcgcgtcgcggtggtgcccgtgtctggaatcatcatcccgggcaagggggccagcgggaagatggcgacctcggagacggtggtgaaggcgctgcgcgccgcggggcgggacaaacggtcgaaggcggtggtcgtctacatcagcagtccgggcgggacgccgctggcgtcggaacagatgctggaggcagtgcaacgcgtggcgcggaagaaacccgtcatcgcgtacatggaccgggtgtgtgccagcgcggggtacatggtggcggtgggcgcgaaggagatctggtccgcgccgcacgccatggtgggctcgattggtgtcttcgcgggcaagttcgacatgtccgggctgatggagaagctcggggtgcacaagacggtgctggtccgggggcagaacgcggccatgctctcgttctcgcgtggcttcacgccgcaagaggaggccacgctggaggccgaggtggaggagatgtaccaggccttcctcgacatcgtcgcgaaggggcggggacggacgaaggaggagatccaccagttggcggaaggccgcgtgtactcgggcgtgcgaggcaaggccgtggggctggtggaccaggtcgcgggcttcgaggaggcctgccgccacgcgctgtcgctggcgaaggtgccggcggcggagcggttcgaaatcatgacctatggtgcgcccaagcagcgggtgaacctgctgaagctgttgatgggggcatcccatgcgcagacgtatgcgctgtgccccacggccttgagcctgaatgggttgggcggcacggaggcgtttgaagatgccgcgcgcttcggggtggccgacgtggtgggtagagtgtttcctgatgaccagtggccattcgggggctga

SEQ ID NO: 5214 - DNA, 1074 bp, Myxococcus xanthus
atgctgaaggcactcgcgctgctgaccgcatcctgtctggcccaggcggaggcttcttccgccgcgaaggtggaggagaagctgccgttcgtcacgagccttcacttcgagaatgacgtgttggccaagagcgaccggctctacacgaacggcgtccgcatcgagcacttcggggagtacgacgggtgccgttccatcgcgcggacgctgcgacttccggacggcgtgcagcaccggtacctctgtggcggctcgctggcgcagaacatgtacacgcccagccgcatcgttccgctgccggagcaggaggtgttcccggacccgaacgaccggccctacgggggctggctgcacgggggcatcttcttccagcacatctatgcggggagggcgcccgcggattcgtcgaggctgacgctccaagccacggtgggcgtcacgggcccggcgtccggggcggcacagacgcagcgctggctgcaccggacgctgaacgacatcttcgggcacacggttgcaaggattccggtgggttgggagaagcagttgcccaccgagcccgcattccacttctccgcgctccgcgagcagccgctgctctggagccccgtggtggacgtgacatggtccgccggggcgatgctgggcacggtcttcgtgaacgcgagcctgggaggaacggtccgtgtgggctatctggcccggccgtatggcctggcgcccatcatgccgtctgtggtcaaggaactggaggctcaacggactccaggggaggcctcctcggagctgatggccattcgagatgaacgcgcctgggaggcctacctgtacgcccgggggcaggtgagggtggtcgcgaggaacctgttcctggatggcacgctcttccggccgagcatcagcgtccggaaggcgcccatcgtcggggacagcgagttcggcgcggccttccgcacgggcgggttccaattcggcttgagcatggtcttccgctctcaggaaatggccgacccgccgaacccgctcctgtcaggccatcggttcacccagattcagctttcgtatctccactga

SEQ ID NO: 5215 - DNA, 1066 bp, Myxococcus xanthus
atcctcgctgcgatgtcgaaggtgatggatcccgagcttcacatcgatctggtgaaggcgggaatggtgaaggacatccacgtcagtggggacaccgcgaaactcaagatcgagctcaccacgcctgcctgccccatgaaggggaagatccaggccgactccgaggccgccctcaaggccgtccccggcctcaagtccttcgacatcgagtggggcgcccgggtccgcccggccggcgggggcatgcccgctggcgcgctgcttccccaggtcaagaacatcatcctcgtcggcgcggggaagggcggggtgggcaagtccaccgtcgccctcaacctcgccacggccctggcccagcacggcgccaaggtgggcctgctcgacgcggacttctacggcccctccgtccccctgatgaccggcctgggcgacaagcgccccgtcagcccggacggcaagtcgctcaacccgcttgaggcccacggcctcaaggtcatgtccatcggcttcctcgtggaggccgaccaggcgctcatctggcgcggccccatgctccacggcgcgctgatgcagctcgtccgggacgtgaactggggcgagctcgactacctcgtcctcgacctgccgcccggcaccggtgacgtggccctcacgctgtcccagtccgtccgggccgcggggcgcggtgctcgtcacgacgccgcaggacgtggcgctcgccgacgtggttcgcgccaagcagatgttcgacaaggtccacatccccgtgctgggcatcgtggagaacatgagccagttcgtctgcccgaactgctcgcacaccacggccatcttcaaccacggcggcggccgcaaggccgcgcagatgttcgggattccattcctcggtgaaatcccgctggacctgaaggtgcgggagtctggagactccggcgttccggtggtcgtgggggccaaggacagcccggaggcgaaggccttccaggaagtcgcgcggaacgtcgcagggcgcgtgtctgcccagagcatcaagagcgttccgctgccggtgatgcaggcccgctaa

SEQ ID NO: 5216 - DNA, 312 bp, Myxococcus xanthus
atggagcgcgcggtggacgactgccaggcggagcaggtgtcgttgaaggtggaggtgctgtcggcggagggcgcgcgcgtgcgcggggcgacagtcaccggcaccaacgtgacctccaacgtgagcatcaccggcgtgacagacgaccagggcgtcagcaccgccatcaacgaatcgctcgcgcccagcgcggtgcgagtcgtggccaccgcgggcgccaaggtgtccgacgcccagcaggtggaatgggtgtgtgacacctgcaactgccagccagagccggccaccctccaacttcagctcaatccgtag

SEQ ID NO: 5217 - DNA, 510 bp, Myxococcus xanthus
atggccccggccggcaacgacgacttcccgcccgatccgctgctcgacgaagatgaacggcaggaccgatccagtggctccaacgggcccgcgggcttcgttccggagttcgtccgccgcatggccgtggccggcctgggtgccctcttcatgacggaagagggcatccgcaacctcgcaggccagctcaaactccccaaggaagccctgggcttcatcctcggtcaggccgagaagaccaaggacgaggtgacgcgcgccgtcaccgaggagctccgccgcttcctccagtccgagaagctccgcgacgagttcctcaagctcatgtccggcatgacggtggagatcaaggcgcagatccgcctggtgcctcccgagaaggaggagaagccctccgggtcggaagcccccgccgagcccaccaggtcccgccggtccgctacgcccagcgtcgtcatctccgagctcaacgcgaagcgccccagcgcgaagcgcaccaagaaggagtaa

SEQ ID NO: 5218 - DNA, 429 bp, Myxococcus xanthus
aacgctcggcgtcgtcacgttcgcggatttacgctgattgaaatcatggtcgtcatcaccatcctcggactcatcgccgcggcggtgggcgtctccgtgatgtcgaacctggaggaggccaagcagaagaccgccgccctggacatcaagacattggagacggggctcaagctccactacatgaagaccggcagcttcccggagacccaggccggcctggaagaactcctccaggcgcgctcgctggagcgactgccccaggacccgtggaaccgcgactacgtgtacatgaatgagggcggcaaccctgtcatcctgtcgtacggcgcggacggtgtcccagggggcgacggcagcgacgcggacatctcctcccaggtggcgtcaccgtccgcgagcgcggcccgccgccccaaggggctccgttag

SEQ ID NO: 5219 - DNA, 369 bp, Myxococcus xanthus
atgctgctcacacgcctgcaatcgcctcggccgggtgagttgtgcttccaggcccgctcggccaccgtggccgtgaagggccgcgcgtggtgcgatcccaagacactggtgggctacgtctaccgggacccgacgggctgggacgtccacgtggcccagagcgacgtggccacctgtgagctggagcgcttcacccgcccccatcccttcgcggcgtggagaccggacggacggctcacgtccaccgtgggcgccctggagttccacgcgcccgagcccctggagggcgtgcgctacatcggatgggatgagacgtctgtctcggatgcaccgggcgaggcaccgcccgcggtggccgaaggcgcgtag

SEQ ID NO: 5220 - DNA, 294 bp, Myxococcus xanthus
atgggccgcgccctgctcggggtgatgaagctgctggggccctggcggatgctgtcgaaggcacagcacggattccggacgagcaacaactacaccgaggtccgcatcacggagacgggcccgacggaggccgaggtctggctcaacgagcccgggatgctgcgctacttcaagcagggcgtcatgctcgccatgtcccgggccgccggtggcgtggccgcgtcggtggatgtccgcgccttcgacgaacactgcgtcacgtaccgcgtctcctggaaggactcgggccgctga

SEQ ID NO: 5221 - DNA, 975 bp, Myxococcus xanthus
cttgcccgggactggttcctgccggggatgttcgcggccgtcatcctggccgcgctcttcccggagttcggtacgtcgggcggaccgatgcacgcggacgtcgtcgccgacgtgggcatcttcgcggtgttcctgctccacggcctgggcctgcccgcggctcagctccgcgcgggcgtggtgacgtggcgcgtccacgtggtggtccaggccttcacattcgtggtgtttccgctgctgtggtggctgggcgacgtgttggtgggccgctggatgccagcggacctgtcgctggggctgctctatctctgcgcggtgccgtcgaccatctcctcctcggtcgcgatgacaggcgtcgcccgaggcaacgtgcccgccgccatcttcaacgccagcctgtccagcctgctgggcatcgtgttgacgccgctcatcatcggcctgttcgccagcgccaccgggcactccctgtccatgggccaggccatcctcaagctatcggccctcctgctgctccccctggcactggggcaattgctgcgcccgctggtgggcggctggttcgcccgctaccggccttacacgaatgccttcgaccgggtggtgatcctggtcctcgtctattcgtcgttttgtgactcgatcgcctcgggcctgttctccgactacggcgcggcggtgctcggcattgccttcgcgggcgcggtgctcatcctggccatcgtgctgatgctgaccacgcggacggctcgggcgctgggtttctccaaggaggacgaaatcacggtggtcttctgtgggtcgaagaagacactggcctcaggggtgcccatggcgcggctgctcttcggcgccaatcccgcactggggctcatcgtcctaccgttgatgttctatcaccaggcccagctcctcgtgtgctcgctcctggcggaacgctacgcgaagcgcccggcgggacaaccttccgcgtag

SEQ ID NO: 5222 - DNA, 1461 bp, Myxococcus xanthus
atgacgcgtaccaagaggcgtgaagccgagcgtggtgtggagacctggttcaccccgtccttcgcgtccttgttcatcgggaaaggaaggtatcacggcgaccttggcgtacccatgcccctgccgccctttgggaggcgacacagtcagacggtggcgcgcgacgggcccgtggattacagcgccgccagcatgactcatcaggctgcggcttccgggctctccatcttccaacatcgagacttccgcttctatctgctggcgcgcctgtgcgcggtgctggccgtccagattgagtcggtggccattggctggcaggtctacgagctcacgggcagcgcgctcgcgctcggatacacgggtctggcgcagttcctgccgttcctgtcgctgtgtctggtgggcggtcaggtggcggaccgcgtggaccggcggaccatcctggcggtgtgtcagacggtgatgctggtctgcagcctgctgctgctcgccttcaccttgggccatatccgcgacgtgcgattcgtctatggcgtcctggtgctcttcggcgcggcgcgcgcgttccatgccccggcgggctccgcgctcactccgcatctggtgccgcccgagcacctgacccgcgccgtggccatcaactccaccacgtggcaggtggccaccattggcggcccggccgtgggcggcatcctttatggctggatcggcgccgcgggggcctacacggcctccgccacgttgtgcgccctctccgtcatctggattctcatcctcaaggtgcggaccgggcgcgcgtccgccgagcccctctccctgtcgaccctggtcgcgggactcggattcgttcgacggcagcgcctgctgctgggcagcatcaccctggacctgttcgccgtgctcttcggtggcgcggtggcgctcctgcccatctatgcgcgggacatcctgcacacggggccatggggcctggggctgctgcgctgtgcgcccgcgttcggcgccgcggtggtggccgtcttcctggccatgcggcccatgggcggcaacaccggccggaagatgttcatcgcggtcgccatcttcggcgcggccacgctcgtcttcgggatgagccgctcgttgcccctgtcgctggcggcgctggcgatagcaggcgccgcggacatgatcagcgtcgtggtccgccacacgctggagctgatggccaccccggacgacatgcgcggccgcgtgggcgcggtgaacatgatggccattggcgcctccaacgaactgggcgagttccgagcgggcgggttcgccgagtacttgggcgccgtacccgcggtggtcgcgggcgcggtgggcacgctggcggtggtcgcgctctgggcgtgggcctttcccgaactgcggcgggtggaccgcctggagtccttcgcgaggacgaaggagcctccagcgacgcccgcgagttga

SEQ ID NO: 5223 - DNA, 237 bp, Myxococcus xanthus
atgaccgccgaggagcgtgaggccgccaagcagcgcgccatgggcaacaacctcaactcctacggcaaggacgtccagctcaagcagaagccgattccgtggatggccatcggcctcgcggggctcgtgttcgtggtcgccgtgcctttcggcatccgcgcctaccggaacacgtccaaggacatcgccgggcagaacaccttcggagccaaccgcggcgacgacgaagtggcctga

SEQ ID NO: 5224 - DNA, 45 bp, Myxococcus xanthus
atgccgctgcgggtgcagacgcaccccaactcgcgcatcggttag

SEQ ID NO: 5225 - DNA, 546 bp, Myxococcus xanthus
gatgcgcccgtgctgctgttcgccaacaagagcgtgctggagttctacccgcgcttcggcttcgagcctcggcgccagacgctgttctccgcctcccacgtggcgcggccgggagagacggcggcgccgcagctcgacgtggcggaggcggacgtgcgggcgcggctccggatgctctctgacgaggggctgccggtgacggagcgcttcggcgcgcgggggacggccgccattgccagttggtatgcggcgaacgggttcgctcggccgctgcgagccctgagtgacgatgcctgggtgttcacggaggtggagggcgagacgctgttcatcgacgacatcttcgcgcgtgcgccctttgatttacgggcggcgctgccgcggctcatcgaccggccgatttcgtccatccagttcggcttcacgccggagcgctggtggcccggcgcggtggaggcgggcgaggacatggaggccgacctgttcgtgcggggagtgccgtccccacgtgaggcgaacctctttcccgtcatggcgcggacctga

SEQ ID NO: 5226 - DNA, 768 bp, Myxococcus xanthus
atgttcaagccgttcgaggacctgctcgtcgaagctgtccaagcccgcggcgcgcgtcaggtgctcgacgtgggctgtgggacgggcagcacgacgctcgccgtcgcgcggcggctcggtgcccaggggcactgcgtcggcatcgacatctccgcgcccatgctcgcggcggcgcgggcccgggccgaagcggagcatgtggccgccagcttcatcgaggccaacgcggagcatcacgctttcgagcgagggcgcttcgacatggtgatttcacgcttcggcgtgatgttcttcgacgatgccgtccaggccttcgtgaacctgagacgttccgcaagggagaatgccgggctgagcttcgtcgtctggcgaagcccctcggagaacccgttcatgacgaccgccgagcgggccgcggcgcccctccttccaaacatgcccgcccgccagccgaacgcgccgggccagttcgccttcgcggatggggaccgggtccatcgcatcctggagcagagcgggtggatggacatcggcatccaccccattgatgccacctgcaccctgcccgagcaggggttgctgcagtacgtgacccggcttgggcccgtcggccgcgttcttcacgaagccgacgagaggacccggactcgcgtcatcgaaaccgtccgcgccgccttcaacccctatgtgcacggcgacgaggtgcggttcaccgccgcttgctggcgggtcgaagcgcgcgctcccgctgaggccctctcggcgtga

SEQ ID NO: 5227 - DNA, 882 bp, Myxococcus xanthus
atgtccgcagacacggtggaacagttgcttcagtgcgcgctgtccgagctgaccgcgcgcttcgtcacccaggccacccccgtccccaccggcttgctggaggcgttggacgcggacccgcgcgcgggcgctcatgcgctcgcccggcgcatccgttcgcgccaggagaagaaccgcgcggagggccagcgcatgcgcaagctgctccgtttcgagacggagctctgggagcagggccacacgcacatcgcgggtgtggacgaggcgggcatggcgcccctggcggggcccgtcgtggccgccgcggccgtgctgcccaagggtttccggctcaaggggctggatgactcgaagaagattctcgacgccgagaagcgcgagtcgctggccgaggccatcaagcgcgacgcggtggcatgggccgtgggccgcgcggaggtggaggaaatcgaccgcatcaacatctaccacgcgggcctgctggccatgcgccgcgcggtggaggggctgtcggtgaagccggaccacctgctggtggatgctcgcacggtgccggagtgctcggtgccgcagaagggcatcatcaagggggacgcactgtctctcagcatcgcagcggcctccatcctggcgaagacgacgcgcgaccgttggatggcggagctggatgaccagtacccgggttatgggctcgccgcgcacaagggctacccgacgccgcaccacctgcaggtgctgcgtgaaaagggcgtgctgcccatccaccgacgcagcttcgcgccggtgcgcgaggccctgggcctgccgaccggctcaccgccttccgccctccaggcggagctgttccccgaggccccttcccgaacaggggtgaagtcatga

SEQ ID NO: 5228 - DNA, 2481 bp, Myxococcus xanthus
atgagtgagaagcgttggtcggagcggttcgagggcgtcatgggccgcctggcggtgcggaaccaccggaagcccttccaggcgctgctcctggctctggtgctcaccgtgctcggcgcgtacttcgccaggacgctgacgctcaacgcggacttcgtgggactgctgccgaagaacttccccagcgttcaggacatcgagaagctgcgcaagcgcttcggcggtcagggcaacgtggtggtggtggggatgcgcgcggatccggaggtgctcaagcgcttcgcggacgacatggcgccgaagctcggggcgctgtcggagattcgctacgtctcccaccagcggccccggtccttcttcgacgagcattcgctctactacgtggacgtcgacgacctggagaccatccaggagcgcatcgacgcgcgcatcctctgggagaagcagcaggccaatccgctcttcgtctcgctggtggaggaggaccctccgtcagtggacttcgctgacatcgagcagaagtacaccggccgcgccaaccagcgcctctccgggcagggcgacctctattacatcaaccccaccgagcgcatggtggtgctgatggcgaagccccggggcagcgccgcggacctgaactactcgaagaaggtcgtgggccaggtggaggacttcctggcgcagcaggacctgtcgaagtacgggcccggcttcaagacggccgtcaccggcaccttcaagaagaagattgatcagcagcgcgtcatcgttggcgacctggcgagcgcgtccacgctggccatggtgttgctgctggcgtacctggccttccacttccgcagcgcgttgtcggtgggcctcaccatggcgccggtgatggcgggcctgggctggacgtacggcttcgtggggctggcctacgggcaggtgaacctcctgacgggcttcctggcggcggtgctgggcggcctgggcgtggagcacggcatccacctgctggggcgctacacgacgctgcgctcggaggggatgaactccgaggaagcggtggatgagtccttccggcacaccggcttctcctcgctcatcgcggcgctggtggcggcgctgaccttcctcagcctggccatgtcggagttcagggcgttccgcgagttcggcatcatcgccgcggtgggcatgctggtgagcatcttctcctacgtgctgctgctgcccgcgctgctggggctggccacgcgcttcggctggtcgccgcgggtgcagcaagagggggcggctgggccgctgagcctgctggcgcgctggttgccgcgctcctaccggggcgtgggcatcgtggtgggcgtgggcgtgctggcgctggtgtcacaggcgtaccgcatctcgttcaactacgactcgcgcacgctggaggactacaagcaggcgtcggcggtgctggaccagaaggtgaacgacatcctgggctactcgcagacgccggtggtggtgctcaccgattcgcaggagatggagcgcgaggtggtgcgccagttggaggcgcgcaaggtggcgcggggcaaggagtccaccatcgacttcgtgggcgcgctggatgacctggtccccaagcggcaggacgagaagcaggccatcctccaggccatctccgcgaagttggagaagctggacccggagcggctgcccgaggacacgcgcaacacgctggtgcgcgcgctgaacatggcgaaggcgaagcccttcacccaggaggccctgcccaccagcgtgcggcaccagttcgaaagtctggatggcagcacgggcggcgtggtgctggtgtacgccggtggcgtcagtctgtcggatggtgagggcacgcggaagttcgccaaggaagtgcgtggcctccagatgccggacggcagtcaggtgtcggcggcgggggaggcgctcatcctggcggacatcctggacatggtgtcgcgcgaggggccgcgcatcctcgcggcggcggtgctgagcgtgctggtggccatgtggctgacgctgggcaagctgcgcaccgcgctcatctgcatgttgcccacgctgctgtccgtcgtcggcctggtggggctgatgtcgctgctggggctgcagttcaactacctcaacatcatggtgctgccggtgctggtgggcaccacggtggacgcgggggtgcacctggtgcagcggctgggcgagcgcggcgcggacttcgtctccgtgtacgcggagacaggccgggcgatcatgggcggcctgctgacgagcgccatcggcttcgtcgcgctcatcctggcgaagcatccgggcctcaactccattggtgacctggccaacctgggcttcggcatcaacatggtcatcgtgctgctgggcttcccgtcgctgctgctgctggtggagcgctggcgccgcaagcacagcacgtcctcggaagagcagaccgagcagcccgcgccggaggcgtga

SEQ ID NO: 5229 - DNA, 930 bp, Myxococcus xanthus
atggagcgcaaggacgtgaaggacgtggtggtggtgggtggtggcccaggcggtttgagcgcggcgctggcgctggggcgtggccgcaagaaggtcctggtgtgcgacggggggacgcctcggaacgcagcagcagaggaggtgcacacctacctcacgcgggatggcatcccaccccgggagttccggcgtgtcgcctgggagcagatgcgcccctatgacgtggagctgcgcgaggcgcgggtgctggacgtcgagcgtgcggggacggtgttccgcgtggcgctcgaagggggcgacgtggtggaggcccgccgggtgctgctggccacggggatggtggacgtgatgcgcgagctgcccggttacagcgacttgtggggcaaggccatcttccagtgcccgttctgccatggttgggaaatccaggaccgggcctggggcgtgctggccacgaacgcggtgtcgctcgacttcgccgtgatgttgacggggtggacccgcgacctggtggtgttcgccatggacggtttcgaggtgccctccgacaagcgtgcgctgctggagaaggcgggggttcggctcgagacgcggcgtattcgcggcctcatcgcggcaggggagaagctggatgcggtggagctggaggacggtacccgggtgccccgggagattctcttcgaccgtccaccccagcggcagtcgtcgctcgtgcagcggctggggctcgagctgaacgaggagggcttcgtgaagctgaagggcccgggcgagacgtcggtgccgggcatctacgcggcgggggacctcggcacccgggcgcaggcggccatcgtggccgcgtccgcggggatgctggcggcgggcatgttgaaccatgacctgaacctggaacgggcgggcgccgcgcatggacctgctcagggttga

SEQ ID NO: 5230 - DNA, 462 bp, Myxococcus xanthus
atgcgcctgctgtcggaggaggtggcccggaacgagccggggggggaggaagccgcgcgctcgctgctgcggctggtcctcatcgaactggagcgcatgacggcccaaacggggacgagcgagccgccgtccctggggctgagccgcaaggcgctcacgtacatcgagacgcactgtctggagccgctgtcgctcgcgcaggtggcgaaggcgctggggcgctcctccgcgcacgtcgcgggcgtggtgcggcaggagacgggccgcacggtgggcgagtggattctggagtgccggatggcggaggcacgccgccggctgcgtggcacggacgagcgcgtggacatcatcgcggagcgcgtgggctacgcggacgtgacgcacttcatccgtcagttccgccgcgtccacggggtgactccggccgcgtggcggcgcaaggcgacggctggggctccatga

SEQ ID NO: 5231 - DNA, 1398 bp, Myxococcus xanthus
atgaagaaggcgctggtcatcgtggttggcgcagccgtgctgctgctcgtgttcatgttcgtcgccggtgagcagccgccggggcagccggaagccagcggtggtggacgccagttggacctgtcgggcttcgacccggcccgagtctccgggctggagctctcgggcgtccgccgcgccacgctgcagcgggacggcagtgggtggacggtcgcggacccgggctcgccggagagccgcttcctggcggacgaggcgatggtgaagggcgcgctggagtccctgacccgggtggccggggcgaagttcgtcaccggcgaggccggccggctgaacgagttctggctggatgacgcgcgcgggctgaaggtccgcatcctccaggagggccgccctccgctggagctggtgctcgggaaggatggggcgccgaacggtggaacctacgtgcgcaaggcggccaacgcggacgtcttcgagcaccccacgttgttgggctggttgtggcgtcggcgcgtcatggattggcgtgacgcgcggctggtgcggggggcgcccggggacatcacgcagttggtgtttcgagtcggggacgaagcgccggtgacggtgacgtcgaatggcgcgcccggcggctggcggctcgcggaggggacgcaggtgccggagggcttccggttcagcgcgcacgtggtcgaacaggttgtgcgggacttgttggaggtcgaggcgcaggacgtgctcgcgggggaggccgccacggaggcgaaggccgcgctcgcccaggcgcatgacacggtggaggcgcgcctcaagaatgggaagtcggtggtgctgcggctgagccgtgcgtcggagtccaaggacaccgtcttcgtccagttggagggagatgcgcggatgtacgaggtgtccgcggtggcggcatcgcaggtgcgaaagcggctggtggacttccgcgacctgctcctgctgcggttcgcgttggagcaggtgagccaggtgcgcatccaggccggtgacacgacggtggtggtggcgaaggaagcgcacggctgggtgctgattgagccgcagtcgccgccggagtccttccggttcgacgcgtcacaggtggaggcgcatctcatctggcttcagcggctcgaggcctcgcgcctcctcgacgcggcggtgcaggacgtacaggcgggcctgtctccgcccgtggcctccgtggaggtgagcgaggagggcggcgccgtgcagacgctgcggctcgggaatgcggtgccggacgcaccggcgggctaccaggaggtgtacgcccgaggctcgcgcgacggctttacgtatgccgtggaggacagggctcgcgcctggttgtcgcgtggcctcgcgctctttagcgggccgtag

SEQ ID NO: 5232 - DNA, 231 bp, Myxococcus xanthus
atggaggacttcctgcctcccggaacgaagccccccaagaatgcggatgccatgacgcagtgtctctatcgcatcgagacgtatgacgcctggctccagcggggagagaagatgaccttcgttcacttcacgcccagggagcaggaacgctgtggcctgcggccggaagtcatggaccctggcgcgagctatgccatcagcgatgacggcgtcatcttgaagcgggactga

SEQ ID NO: 5233 - DNA, 495 bp, Myxococcus xanthus
atgctgaagacggcgtggaacgagtggagcctcaaggcgctgcagttggagacggcggtgctggcgctggaggagatcgacctgcccgaggagatgcacgcgctccaagaggcggcggaggagaagctgctggcgctggcgcgcgcgtggaaggcccgtcagccgcagcgcgagccgcgcacgtgggagcgccagacgctgcccgacggcatgcctcgcgacgccgagctcaaggacctggtggagggcttcaaggaagacggcaagtcgtggacgctgcttcgcgccaccagcgacctcaaggaagtggtggagacggtggtgtcggaaggccgcgcctgcatggccgcgggcggcgagtactacctgggccagtgggacgcgaaggagtccgtgctggaggtgggccgcgacgacgacgcggacgagcccggcacgggcctggtgctggagcccacgggcgagctccagtacacgccggacccggagctgtag

SEQ ID NO: 5234 - DNA, 1569 bp, Myxococcus xanthus
atgaatcgcaaggtctcggtgtgcgcggggatgatggcggcggtggtggcgttctcggcctccgccgaggagacggcgggcgggccgtcctcgagcgccgcgagcggagcggcgtctgtcgattggccgggcgtggcgcgcgagctgtccgcaccgccgctggtggccgcggcggagcagccggtgaaccacgccttggccgccggggcgcccgcggggagcgcgccagcgtccgacgctgtgaaccctgtggcatcgtcgaatggcgcgtcctccatgcccgtcgtgcctgacggtgccaatgcgccttcggcaggcgcgcccgaggcgaaggcggaggccgacgcgaacgaagtgcacattccgttcagcctcaccctggtgccggggctgagtacgtcgggtttccacaccggcaacgtggtcaacaacgtgtccatcggcctggtggcgacgcatgcgaagcgggtggacggcctggcgatgtcgctggcaggcaactgggtgggggagggcgggctgagcggcgcgcagctcgcggtgggcgccaacctggcccaggggccggtgacgggcgcccagctctccgtgggcgccaacgtggccggcgcggacctgctgggcctccagtccacggtgggcgtcaacgtggtgcgcgggaacgcggaaggcgcgcagctcgcggtggggggcaacatcgcgtcgggcgaggtgaatggcacgcagatggccgtggccgtcaacgtcgcggggaagagcctgctgggcgcgcagctcggcgtgggcgccaacgtgtcgggcggcccggtgcgcgggttccaggctgcggtgggcgccaacatcgcgacagggcgggtccacgggctccaggccgccgcgggcctcaacgtggcggggcagatgacggggctccagatgtcctcgggtgtcagctacgtgcggaatctctccggcgcccagctctccatcatcaacgtgggcggcgaggtggatggcgcgcaggtgggcatcgtcaacatcgccagcaacgtgacgggcgcgcaggtgggcatcctcaacgtggcccgtgagttggacggcgaggcggtaggcatcctcagcttcgttggtggcggtcaggcgcatgtgcaggcctggaccagtgacgtggcgctcaccaacgtgggcgtgaagctgggcggccgtcacatctactcgctgttcacggtgggctacagcccctccatcgacgaggaccgccgccgcttcgtcatgggcgcgggcctgggcggccacatccccgcgggccgcttcttcttcgacatcgacgcggtgagcagcaccgtccacacgaagcgactcttcgacgactcgaagcatgtcctggcgcagctccggttgacggcgggctggcaggtggcgcggcacttcgcggtgttcggtggcgtcagcgccaacacgctcgtcacctgggatgacagcgacccgtggaaggagctgggcatcgggccgcagtggcgccacgtcgcggacgagggccgcaccaccgtgcgcatgtggccgggcctgctcgcgggggtgcagatttga

SEQ ID NO: 5235 - DNA, 990 bp, Myxococcus xanthus
atggtgctgcgcgaggtcgggcagcccctgcatgagacgcggctgcccattcctcgccccggcccggaggagctgttgcttcgcgtgcgcgcctgcgcggtctgccgcaccgacctgcacgtcgtggacggtgagctgccgaagcccaagctgccgctggtcccaggccatgaaatcgtggccacggtggaggcggcgggcgagcgggcgacggccattcccgtgggcacgcgagtgggcgtcccctggctcggctggagctgcggccactgccgcttctgtctggccggccaggagaacctctgcgagcaggcacgcttcacggggtaccaactggatggtggctacgcggagttcacggtggcccaccagcgcttctgcttccccctgccgcccgagtacaccgacgtccacgccgcgccgttgatgtgcgcgggcctcatcggctttcgcagcctccgcatggcggggagggagcgtcgtctgttgggtttctacggcttcggcgccgcggcccacctgctcatccaggtcgcgcgccaccaaggccggcgtgtcttcgccttcacccggccgggggacgtggagggccaacggttcgcgcgggagctgggcgcggagtgggccggggattcggacaccgtgcctccggagcggctggacgcggccatcctcttcgcgccggtgggcgcgctggtgcccgccgcgctccgggcggtggacaaggccggcgtggtggtgtgcggcggcatccacatgagcgacatccccgcgttcccctatgcgctgctgtgggaggagcgggtggtgcgctcggtggcgaacctcacccgggcggatgcgctggacttcctcgcgctcgcgcccaaggtgccggtgcgcaccctggtgcaaaccttcccactgtccgccgccaacgacgccctcaccgcgctgaggcgaggccaggtgcacggcgcggcggtgctggaggtggcggccctgggttga

SEQ ID NO: 5236 - DNA, 336 bp, Myxococcus xanthus
atgaaccgagcgctgcaaatcacctatcggggcatggagacgagcgaggccctgagcgagcacatccgcgaccacgccggcaagctggagcagttctacgacggcatcgtggggtgccacgtggtggtggaggagccgcaccggcacaagcagcacggcaggcatttccacgtgcgcgtggatgtgagtgtgccaggaaggaacatcgtcgccagccgggatccgcaggcgcgcaccgggcacgaggatgcctatcaagcggtgacggaggcgttcgacgccgccaggcgccagctccaacactacgcggacgcgctcaacacgcaccacgggtga

SEQ ID NO: 5237 - DNA, 369 bp, Myxococcus xanthus
atggcgaaggcgcaggggcggctcgacgccttcgtgctcttcctcaagcccgagggcaccggcgaggattgggagcagggcgagctgtggcgttccgcggcggcgattccgggcgtcaccgccctgcgcgacgagggcggcgtccaggcggagcgcttcggcgccgtcacctccggccaggtgctcttctacgacgcgggtggagcgttgcgcttcagcggcggcatcaccacggcccggggccacgtgggcgacaacgccgggcgcgccgcggtggaggcgctgctgggtgacgcgccggcggaagcgctggccgggcacgccgtctacggctgtgagctggaagacccccgcgggagcgtgccatga

SEQ ID NO: 5238 - DNA, 409 bp, Myxococcus xanthus
atgagcgccgaccgggacatcgacgagtggatggccgcgcgaggcatcaccctgcccgaggcccgcgctcgcacccgcgcggtgctggaggaagtgggcctcacccgccccggccgccagcgcatgagcgagcccaagctgctcaaggcggcggagctgctggcggggcgcttcttctccgtgtgcgcggacggcgcgtgcctcaaggtcgcgcaggccagcgggcgtgagccgatgcgtatcgagccacggctgcactgtgagcgctgtggcggctcggccaaccgccgcgcggaggtggccttcgtggaggcctgccagcgctacggcgtgcgccgcgtggtggtggtgggtggctctccggccgtgcgcgaggagctggaggccaagctgggccaccagattgact

SEQ ID NO: 5239 - DNA, 1365 bp, Myxococcus xanthus
atggcgctcaaggagcgcgccgcgcggctgttccgcgagcacctgtccgcggtgcgggtccgcacggaccggctcttcgcggggctgatgctgggccagtgggcggtgggcatcgtcatcgcgctgtttggtccgcggggcagcggcgcgcagctccaggcggccgtgctggtggggacgctgctcagcgccttcccgatggtgatggcccgctggcgcccgggctccatgcccacccgtcacgtggtggccgtatgccaggcgctctggtcctcgctgctcatctacctgacggacggccgggtggagacgcacttccacatcttcggctcgctggccttcctggcgctgtaccgcgacccgtgggtgctgctctccgcgagcatcaccaccgtcgtggaccacgtgatgcgcggcaccctgtggtcacactcgctctacggcgggcttccgccggagctgtggcggttcgtggagcacgccttctgggtggccttcatcgacgtggtgctggtgtattcgtgccggggcatgttgcgcgagctgcgcgaggtggcggtgcgccgggcggagctggagctggcccgcgaacgggagcacgcgaaggcgcgcgagctggaccgcgccctgcgcgagctcagcggcttccaggagcacctcatccgcgtggagaagctggccgcggtgggacagttggccgccagcgtggggcacgagctgcgaaacccgctggccgccgtgcgcaactcccacgcctatctctcccggaagctcacgagggacccagcaggggccgcggatgacccacgggtcccccagttcctggggctgatggagcgcgagctgaacgcctgcgcgaaaatcatctccgacctgctcgacttcgctcgcgagcgtccgcccgcgctccagccgtgtccgctgcgtccgttggtggacgaggccattggcgtggtgccgcagcgggaaggggtgcgaatcgtcaatgacgtgccggagtcgttgccggtgccgcacctggacaaggagcagttccgtcaggttctggtgaacctggtgcagaacgcagtggaggccatgcccgtggggcgcaatggagtggtttcagtcgtagcggaaggtggagacgcgagtccctggcgcatccgggtcatggatgacggcgcggggattcctccggaggtgttgcccaagattttcgaaccgctcttcaccacgaagacgcgtggcaccggcttgggactggccattgtcgccaacatggtgcaacgtcatggcggcacaatctctgtgcgcagcgaagcggagcggggtagtgagttcctcatcgagctccccgcggcagcggcggcccaggccgcatga

SEQ ID NO: 5240 - DNA, 765 bp, Myxococcus xanthus
atggaggacgtcgcagtggcccccgcgcgcatcctgctggtcgacgacgaggagtcgcttcgcatcaccttggccgcgaacctggagctggagggccacacggtcctcgaggcggccaatggtgaggaggccttgcgcctcctggagaagcaatccgtggacgtggtgctcacggacatccgcatgcccggcctgcacggcgtggagctcttgcgccgcatcaagcaggagcgccccgacatgccggtggtgctgatgacggccttcacggcggaggagctggtggatgacgcgctcgccgagggcgccttcaccgtgctgcccaagcccttcgacgtgacgcacgcgctggacacggtgctgcgcgcggcggcggcgccgcaggtcctggtggtggacgacaccgaacaggtggcgcgcggcatggtgcgcgccctgagcacggtggggctgcgcgcgcgcgccgtgtacagcggcgaggaggcgttggcctcgttgcgttcgggggaatacgacgtctgcgtgctggacctggtgatgccggagatgagcgggccggagctggtgtccaaggtgcgcgcggcgaacctgtccgtcgccatcatcgccgtgtctggccacgtggtgccggagatgctccgcagggtggcggcgcaaggcgcggtggtgtgcatgaccaagccggtaccgttgcgcgagctggtgcaggcgattgcacgggtgcgaggccggcctcaacaagggctgcaaggcgcgaggatttga

SEQ ID NO: 5241 - DNA, 729 bp, Myxococcus xanthus
atggcaggcagagacctccaggcgcgtgagcgggcggcggtggcggacgtggtggcctccaccctgcggcacgacctgcgcaacaagctggccagcatccgcaacgcctcgttctacttgatgcggcaggtgaagaagacggacctctggagcgcggacccgcgcgtggagaccttcttccagctcatcgaaaaagagctgacgtccgccgaggacgtgctctccaagcgcgcgccgccgcccaccggtggcacgcgtccccggtgcagtgcccgcgaaggcgtggagcgcgcgctcgccgaggcccaggtgccgccgtcggtggaggtggtgcgcgacctgaaggagcagggcggcgtcccgttggaggtggaggacctggcgctgctggtgcgctgcctcgtggacaacgcgctggaggccatgccgcgcggcgggacgctcacggtgcgcacgcgcgacgccgaaagcggcgtgtgcctgcgtgtggaggacaccggagagggcctggcggcggaggcgtactcgcgcgccctggagcccttcttcaccacgcggccccaccacgccgggctggggctgagcatcgtccaccggacggccgtgcggcacggctggcagttggacctgggcgcgggcccctccgggggcacctacgtggaaatccaattcacgggcctggaggcgggggcccatgaccggaatgacgtgactcgggggagcaagtga

SEQ ID NO: 5242 - DNA, 381 bp, Myxococcus xanthus
atggagacgaactggacgttcgggcgttgcctgctgctcgtggaagacgacccttccaaccggatgacgctgtccgcgcttttggaggatgcgggcttcgcggtcgtcaccgccggctcctattcggaggccgcgggattattgaaccggcctcgggcgtatgacgccgtgctgttggaccagagcctgggtgacggctttgggacggggctgattccgctggtgcgccaccacatgccgaagaccaaggtcgtcttcgtcaccggtcatgacgggaaaatcgacatgccggtggacgccgtcttccgcaagggcggccacttcgacgacctgctggccttccttttcaagctgttgccccagcgcccgctgggtgcctga

SEQ ID NO: 5243 - DNA, 1272 bp, Myxococcus xanthus
ttcccttttcgggcgtcgagccacttcctctacctcttcaggctcgcgacgccggacggcgtgggtctgtatgacggccagggctggacgctgtacctgcccgagcccggtcccgacgacgcgctgtgggacggcgcggtgcccggcttcgctgaaatcgcggagcggacgggctgcaccgtgcgttcgcgcgccgagctgcccgcggcgctgaagggccgcgacgtggcggcgctgcccacgccggacctggagacgtgcctggacgtggccgcgctgctgggccgcgaggtgcgtcccggccacctggcggcggtggacgtgccgctggcggacgcgatgattgcgctgcggcttcgccatgacgacgccgcgcaggcgcagcttcgtcaggccgcggaagtcacggtgctggcccacatggcgggcatgcgcgccacgcggccgggcatcctggaggccgcggtgcgcgccgcgatggaggcggagttcgtctcgcgcgacgtgcggccggcgtatcagcccatcgtcaccgtgcacggcgaggtgctgcacaacctgcgctatgaccacacgctgcgcgagggagacctgctgctggcggacgtgggtggtgaaagcccggccggcttcgcctgtgacgtgacgcgcacgtggccggtgacgggccgcttcagcacgacgcagcgcgagctgtacgacgtcgtgctgcgcatgcagaaagccagcatcgacgcggtccagccggggacgcgctaccgcgacgtgcacctggccgcgcaccgggagatggcgcgaggcctggtggcgttgggcatcctccgtggggacccggaggagttggtggtggacggcgtcaccgcgctcttcttcccgcacggcgtgggccacctgctggggctggacgtgcatgacatggaggacctgggggaccgggcgggctatgcgccgggccgcacgcgctcgccggagttcggtcaccgctcgctgcggttggaccgcgatttggagcccggcatggcggtgacgattgagccgggcatgtaccaggtgcccgccatcctgtcggacgcgcggctcatggcgcgcgcgaaggacaggctccagcgcgacgtgctggcgcgctacgcggacgtgcgcggcatccgcatcgaggacgacgtgctcgtcacttcggatggcaacgaggtgcttaccgccgccatccccaaggaggcctcaaacatcgaggccgtcatgaccaactctgcccgtccagctccgggaaggtga

SEQ ID NO: 5244 - DNA, 1056 bp, Myxococcus xanthus
atgggcgcggcggccgtgggcgcgttggcggcgggcctgctgctggtcgcgggactctacgtgcgtggtggtgactccacggggacgcaggcgagcgtcgatgatgccatccggcgcacggcgcacggcgctgtccttggcacgagcggtgacgcccaggcgggcctgtcgtcggctggcgccggcgccgcgatgcgcaccgccgcttcgtctgggcacgccattggagcgagcacgtccacgcaggccgccgtgagcggttcatcgccggacgcggcgctcgctgcctcgtcgcacgtctcgggtgccgcgtcgtccatggctgtctccagcacgcagccgggcattggttcggcgcttcttcgggatgcggcgaagggactgcgcgcctccgtgcctgcctcggagccggcgcgaagcccgggcacgcccgtggcggagtcgctcgcggtggtgagccccgcgcccttcaagcgcaaggccccggcgaagccagacgaggcggcggctctgcctcccgcgcccgtcgagctcgacttcggagacacgggtgcggcaggcgccgcgtcccaggacgccatcgcgacgtcaccgggtgatgtcgccgcggaggccgtggaggaggacacgtcggagaaggggccgtacgcggacctcgatgaggccttcgcgcgcgagctgggcttcacggaagacgcggacgcggagctctcgaaggcggaggcgcccgcgcgcaccgtctacgtgccgccggcggtggacgtgaaggagcacctcacgccggaggacgtgaagcaggtggtgctgacgaaccagcccgccatcaccgcgtgcctgcgttcacacgcgcagggcacgccgatggaggccggtggccgcttcatggtgcagtggtcggtgctccccagcggtgagacgctcaacgtgtccatggacaccgccgcgctgcgcgccacgctgctgtcgcgctgcatcgaggacgtggtgcgccgctggaagttcccggtgcatcaggtgcggatgcaggagcccatccgcttccccttcatcttctga

SEQ ID NO: 5245 - DNA, 333 bp, Myxococcus xanthus
atgccagcgaccgagccgccggagcccacggagttgcacgtctgccaccgctgcctcgtgcggttggaggccagcgccggtggcgtggacctgccacgccggctgcgggaggccctggcgggacggggcctcgccgagcggacgcgggtgatggcgtcaggctgtctgggggagtgtccccggggcctcgtgagcgtgctggtggtcccggacagtggctccggggcacacgttcagctcatcgacccggcgaaggacggagcggacctggccgagcacgtcgcccggttgcctggtgtgcaagacgggcccccgcgagctgggcggccttga

SEQ ID NO: 5246 - DNA, 549 bp, Myxococcus xanthus
atgattcgccgcaagttcttcaagctgttcggcgacgcgttccacatctatgacgaggcgggcaacctcgccttctactcgaagctgaaggccttcaagttgaaggaggacatccgcatctacagcgacgaggagatgcgtgaggagctgctcaccatcaaggcgcgcggcatcctcgacttcggcatgacgtacgacgtgacggatgccaccacgggcgagcgcgtgggcgcgctgcgccgcaagggcctgcgctccatcctccgcgaccagtggctggtgctggacgcgaatgaccaggaggtggggaagattgaagaggacagcatgatgttggcgctggtgcgccgcttgctgaccgcgctgattccccagtccttcaccgggacgatgggcctcaaccaggtgctcgccttccaccagcgcttcaacccgttcatccagaagattgatttggacttctccatggacacccaccgtcagctggaccggcggttcggcatcgcggcggcggtgctcatgtgcgccatcgagggccggcagcagtag

SEQ ID NO: 5247 - DNA, 564 bp, Myxococcus xanthus
atgagcatcgcgagcgcgggcacggagcagcgccccagcctgttgctggtggatgacgattccaccctgcgcgagcggctggcccgcgccttccgcgagcgcggctgggacgtcaccaccgcgggggactacgacgaagcccttgccgccgcgcgccgcgagtcgcccgagtacgcggtggtggacctgcgcatgccgggccgcagcggcctggaggtggtgagggatttgctcacggtggatgcctccacgcgcgtcgtcgtcctcacgggttacgggagcatcgccaccacggtggatgccatccggctgggcgcggtgaactacctcccgaagcccgcggacgcggatgacctgctcgcggccttcgcgcgtgcgtccggcgagccctccgtcgcgacatcggagcgcttcgaggccccgtccctggcgcgcgccgagtgggagcacatcaaccgcgtgctggcggactgcggcggcaacatctccgaggcggcgcgcaagctgggcatccaccggcgctcgctccagcgcaagctacagaagtacccgccttcccgttga

SEQ ID NO: 5248 - DNA, 1047 bp, Myxococcus xanthus
atgctgtgggacacgctggtgctcaccggcttgctggccctcagcggcggcacgcacaaccccttcaccacgctctacctggtgaacgtggcgctgggcaccgtgctgctgccctcgcggtggatgtggggtctgctcggcttcacgctgacggccttcggctcgctgttcgtgttgcaggacgtggagctgccagcgggcctgtcgcggccggaccacgcggagctgatgcggctgcacatcaacggcatgtgggtggccttcgccgtggccgcgggcttcattgtctacttcgtccagcgcgtcacgcgggcgctcggggcgcgggagcaggagctggcgcaggcgcgcgcgctgcacgcgcggcgggagaaggtggcctcgctggcgacgctcgccgcgggcgccgcgcacgagctgtccacgccgctgtccaccatcgccgtggtgaccaaggaggtggagcgcgcgctggccaccgcgggcacctccgagtccgttcgcgaagatttgcgcctcatccgccagcaggtggaccgctgccgcgacgtcctggtgcagatgtccgcggacgccgggcagacgacgggtgagcccttccaccccgtgcccctgggccggctcgtggaggacatgctggcggagcttcccggcgcggagcgggtgacggtcgaactgcccaccgaggcccgcgactggcgcgtccacggcccaccccgggcactggcccgggtgctgcgcgggctggtgaagaacgcgctccaggcgtcccaggtgtcacgtcccgtggagctgcgcgtgcaagcgcgcggcgaaggtgccctgctggaggtgcgcgacgcgggcacggggatggcggcggacgtgttgtcccgggcgggcgagcccttcttcaccaccaagccaccgggcgaaggaatgggcctggggctcttcctggcgcgcacgctggtggagcagttgggcggctccctggagctgcgctcgacgccgggccggggcaccacggcgagcctctcgctgccggtgacggagggcgcgccatga

SEQ ID NO: 5249 - DNA, 840 bp, Myxococcus xanthus
ctgctctatttccgcttctggacgcgggtgatgaagctgttggggctgagccccgtggatgagcccgtcaagcgcctcatcacccagggcatcgtcaacgggccggatggccggaagatgtccaagcgctggggcaacgtggtggcgcctgcctccatcgtccagaagtacggcgcggacacggcgcgggcctacgtgttgttcgcgggcccgccagagcgggacttcgactggtccgatgagcaggtggagggcgtgtaccgcttcctcaagcgcgtctgggcgctggccgccacgcaccaggcggcggccgcgggtgccacccatgacgggccctacgagggcaaggcgctggagatcctccgcgccgcccacaagacgctgaagcgggtgggggaggccatcgagcgcctgtccttcaacacggccatcgccggcatcatggaaggcctcaacgcgctctacgcactggggacacctgaaacggccgcggagaaggccgccatggcggaggccgtgcggttgctggcggttgtgctcacgccgttcacgccgcacatcgcggacgaaatcgcggaggcctatggcagcaaggacttcaccgtcgcgcagtcctggccggagttcgatccggcgctggtggtggacgacgtcatcccctacgccgtgcaggtgaacggcaagctgcgcgcggagattcgcgtggcggcggacgcggcggaggcggatgttcgcgccgcggcagaagcggacgaaaaggtccaggtggccctggcggggaagacgctgcgcaagttcgtcttcgtccccaagcgcctcgtgaacttcgtcgcgacctga

SEQ ID NO: 5250 - DNA, 1251 bp, Myxococcus xanthus
atggggcgcgtggagcgcgcactgggcgcgatggccgcgcacaaccaccggcgtccggtgttggcgttgctgctggtgctggtgctggccgccctgggtggcttcctcgcgcgaggactgcacctcaacgccaacctcgtggacctgctcccgtcctccttcgagagcgtgcaggacctgcgggagttggagcgccgcttcggcgcgctcggctgggtggcggtggtgggggaaggcgcggaccccgcgtccctgaagcgcttcgcggacgacctggcgcccaagctggaagccctgcccggcatccgcttcgtcgaggcgcagcgccccggcgccttcttccgcgaccgggccctgtacttcctgtcggaagaggacctgcgggaggtgcaccgccgcttggaggcgcggctccagtgggaacagcagcaggccaacccgctctacgtgccgctggtggaggaggagccgccgtccctggacttctccgacctggaggcgaagtacacgggcggagccggacagcggctggccaccagcaacggtgactactacctggatgagggccagcgccgcatcgtgctcctggccaagccggacaccacgtccgcggacctgggtttctcgcgcaaggtcaccgatgaggtgcgcgggctgctcgccgcgcaggacctgtcgaagtacgggcccggcttcaaggtagacatcactggcaccttccagaagaagctggaccagcagaagcagattgcgcgcgacatcggcgtggcatcggcggtggccaccgcgctgatgctgctctacctcctcttccacttccgcagcgcgctggcggtggggttggtgctgacgcccgtgggcgcgggcctggcgtggacgtatggcctggtggcgctcgtcttcggcgaggtcaatctcctgacgggcttcctgggcgccatcctcggaggactcggcctggagcacggcatccacctgctggggcgctacctgcacctgcgcggcaccctgggcaccggacaggacagcgagccccagcccttcgaggtgagcttccagacgcgcgcctcggtggacgtgctactggagtgggtgacgctgtcggaagccaatcctcacacgcagctcgtctttgcgctctcgtgggatacgtggctggatggcgtcagcgccgagcagccacccgccaacgtggacctggtgggcaacgtggcccgctcggtggtgcctccctcctccgtcgcaccatga

SEQ ID NO: 5251 - DNA, 873 bp, Myxococcus xanthus
atgcgctacgccatggtgctgggagtcacgctggcctcgctcggggccgccgccgaggagcggtggaccgcgccgtatcaaattgaagcggtctccggccgcaccgcccgcgtcgtcctgggcgagcatgcgccggaggacgtggcctcacggctccaggtcatgacgctcgtcggcacgcaaggcatggcggtggcgcgcttccagcggacggagtccgtgtgcacggtcgaagaggacgtggacctgccgcccgtctgccacaccgtgggcgtctacacacaggcgaaggggacgccggacatcggtgagcacatcgtggccctggcgggcaccgtcaccggcacggtgagcatgcccgcgcccaagacggagcgggagcgtcctgtcccggggcagtggacctcggacgcgttcgagcgtcccgtggacgaaggcgccgaccccttcacgcccgcgggcatccccgcccctggctaccggtggaagacctcgcccgaagggcatgtgacgctggagtccagccgcgatggccagagcgacgacacacgcgtcccgctggactcgtgcacgcaggaacgacagggccccttcacccggctggagtgcttcccgggcgcgccgcacatcgcgccgggcgactcccctggcgcatccctgctctacgtcgaccggcggccactcgtcgtcagcttcgcggactacggcgaggccagcacggagctcgtcgcctcactgcgcgtcggcggcgacacgcagtacctggtccacgtgggactcaaggggcaggccgtcaccgggctgctcttccgcgaggggaacgcatggcgcctcctcctgcgccccgcggactatcccgtcatcgggtgctga

SEQ ID NO: 5252 - DNA, 147 bp, Myxococcus xanthus
atggtggcgcgcggctggcaggcgccgaccgcgtaccgcgagctgcggcaggcgcggtggcagtccacgctgaatgaccggcagttgaacgggctcgcggacttcgtcgccgcgtggcaggcaaggacgtccgagcgggcggcgtag

SEQ ID NO: 5253 - DNA, 999 bp, Myxococcus xanthus
atgcggcctgaagggcgcttccaggcgctgaagggcctggctgtggccaccgcgctcgtgctgccctcggtggcggcggcgggcgcggtgctggagccgaagctgtcccccagtgacaactacggggagaacttcaccttcatcggcgacctggacggcggcaccttcatcttcgtgcagctaacggtgacgaacatcggtcccggctcgcgcaccggactgtgccggaccacggtgctgacgccggggaagaaggcctggtcggcgcagacgaaggtcaaggcgcgcgactggcgctatgacgcggagagctcgacgctgaagatggggccgtgctcggcccgctccacggatggggccacgcgcgtggaagtcccgctggatggcgggcgggtgctgctggagtacgccgcgcccatgacgccccagggccaggaaggcaccgaagtggaggtgggcaaggaccgctaccaccacgaggtgacgctggccttcagcgcgttgaaggcgacggtgaagcggcccaagggcgaggacgtcgtctacacgggtggcgggtacgcggaccacacgcgctccaccattgcgccagcgaagcttgcgaagcggtgggtgcgcttccgggcgctgctcggcggcgagaagctggtgctgctggcgcgtgaggggcaggacggtgaatacggccccgtgtacgcgtgggaggaaggcgccaaggcccgctcgctggagcacttcacgctcgcgcgggaaggcgtgaaggagcggagctcgtggacggtggagctgttcacggatggctcctctgccatggtgctgcgctccacctcgctgatgcagcgcagcgcgccagtggaggatttgggcgcggtgctgggcgggctggtgcgttcggtggtgggctcgccggtgacgtacctgcaccgggcggtgctggagcgtgagggcaaggcaccggtgacggggctgatggaagtgacgctcgagggcgacctgtga

SEQ ID NO: 5254 - DNA, 1236 bp, Myxococcus xanthus
atggcgtggttgaccggaaacctgtctccgtccgcccgcatctggacggcgctggcaccggccatcgtcgcctgcacgtacttcatcggcggcttgctcctcttctgtatccgctgcgccttcaagggcattccccgcgacgaggagacgctcaagcgcggcagcaacgggctggtgggcttcttcctgcggcactacttcttctgggtcatccagccgctgtgggcggtgattctgcgctcgggtctgccggccaacgcgctgtccatgctgtcgggcctgctgggcatctcttccggcgtggcggtggcggcgggccgcttcgcgctgggcgggtggctcttcctgttcgcgggcatcctggacgtgatggacgggcgcatcgcccgcacgcgcaaggaggccaaccccgcgggcgcggcgctggactcggtgctggaccggtacgtggactcggcgatgctcatgggcctggcctggtactaccgggacacctgggtgctgctgcccgcgctgatggcgctgctcggctcctcgctggtgccctacgtgcgcgccaagggcgaaggcctgggcgtcaatgtgcgcgacggcgccatgcagcggctggagcgggtgctcttcatgggcgcgggcacggcgctgtcgcccatcctggaggccgtcttctggcccgaggagaagcaccccatgcactggctcgcggtggtggggctcgtcttcgtggccgtcatgagcaacgtcacggcgctctcccgcttccgcaatctggtgaaggcgctggcgcccaagcgtcaggaggcgcgctccggcaaggccatcatcgggctcaacgccctggcgggcgcggtggccacggcggtggacttcgcgctggtgctggcgctggtggagtgggcgggcgtgctgcccgcctgggccacggtgctgggctgcggcctgggcgcggtggtgaactactccatcaaccgggtgctcaccttcaagagcaccggcgcggtggggcggcagctggcgcgctactcggtggtgagtggaaccagcgcgctgctcaacgcgggcggcgtggcgctactgacgctgcacccgcagctggcctatgcgctggggtggtggctggtgcgcggcgtggtgtacttcgcgtggaacctgccgctgcagcgtgactacgtcttcaacaacgacgcggcggcttccgaggacgcgctcatggagcagcgcccccatgcggcctga

SEQ ID NO: 5255 - DNA, 579 bp, Myxococcus xanthus
atggacctgctgtgcggcttcgcctacgcggcgtacctgtacgaggtcttcatcctggccatcttcttcttcgtgaagaaggactcgctcttcgaaaggctgtgctggggcttcctggcggcgaacgccattggcgtcgtcatctacgtgctctaccccgccgcgccgccctggtacgtgctccagtacggcccgggaccggccgacctggccgcgccccccaaccccgcggggaccgcccgtttcgacgagttgctgggcatcagttatttcgcgagcttctactcgcgcagcaccaacgtgttcggggccatgccctcactgcacgcggcgtaccccttcctggtgacgctgttcgtgtggtcgcgcggctgggcgtggcgcatctccaccgggctgttcgcgttgctcgtcgccttctccgccgtatacctgacgcaccactacatcctggacgtgctcgcgggcctgggcgtggcggcggttgcattcctggcggtcgaaagcgtctacgcccgttggacggccaccacaccgtgggccgtgtcgttgactacaagaggagacacccgtgcttga

SEQ ID NO: 5256 - DNA, 1335 bp, Myxococcus xanthus
atggaaaacaagaggtcggtcgcgaagccggacggcaagctcgcggtcctgattccgggtctgggcgctgtgtccaccacgctgatggcgggtgtcgagctggcgcgcaagggcaagggtcaccccattgggtcgctcacgcagatgggcaccgcccgcctggggaagcggaccgacgggcgcaccgtgaagctcaacgagctggtgcctctggcggagctgaaggacgttgccttcggcgcctgggacatcatccgtgaggacgcatacgaagtggccgtgcgctcgggcgtgctcagcgacaagcacctggaggaggtgaagccgttcctccagagcatcaagccgaagcagggcgtgcacgaccctgagttcgtgcgccgcatcgaggccaaccacatcaaggccaccaagacgcaccgcgagagcatcgaagcgctgcgccaggacatccgcgacttcaagaaggagctcaacgcgacgcgcgccgtgatggtggtgtgcagcagcgtggagaccttccgtccgctgcccgagtccttcaagacgctggccgccttcgagaaggcgctggacgagaacagcccggacatcaaccccaccgcgctgtacacctacgcggccatcaaggagggcgtgcccttcgcgaacgccacgcccaacgccagcgtggacacgccggcgctccaggagatggccaagcaggagtcggtggccgtcgccggccgcgacctcaagagcggccagacgatgatgaagacggtcatcgcgcccgcgctcaaggcccgcatgctgggtctggatggctggttctccaccaacatcctgggcaaccgcgacggcgaggtgctggacgaccccgcggccttcaaggccaaggaagtcaccaagtcgagcgtgctggacaccatcctgcagcccgacctgtacccggagctgtacaagaagtacgcgcacaaggtggccatccactactacccgccccgcggcgacgcgaaggagggttgggacaacatcgacatcaccggatggctcggctatccgatgcagatcaaggtcaacttcctctgccgcgactccatcctggccgccccgctggtgctggacatcgcgctgttcctggacctggccaagcggctggagtggcgcggcatccaggagtggatgtccttctacttcaagacccccatggcgcagccgggtctgccggtggagcacgacctcttcatccagctcaccaagctgaagaacacgctgcgcgtcgtcgcgggcgaggaccccatcacccacctcgggctcgactattacggagatgacctcccgctctccaaataa

SEQ ID NO: 5257 - DNA, 408 bp, Myxococcus xanthus
atgtggacgcacgcgcgtgacttcgacggagagctctggttcttcacccgcgagcattcccccaaggtcgacgaggtgacgcacgaccaccacgtcaacctcgcgtactcggacccgacccgggaccgctacgtctccgtgagcggccgttgccggctggtgctcgacaaggagaaggcccgcgcgctgtggaaccccaccctcaaggcctggttccccgacggcctggacgaccccgagctcgccctgctctgcgtccgcgtggagaaggccgagtattgggacacgcccagcagccgcatggtccagctcaccggcatggtgaaggccgccttcaccggacagccctacgcaccgggcgaccaccagaagctcgacctggacgacagcgccccactgccccattga

SEQ ID NO: 5258 - DNA, 579 bp, Myxococcus xanthus
atgcagctcttgcacggtgagcgccggtggcgcctgccggcccagggggaagactggctcatcgtaccgtccgtcgacctggagcggctgaagcacccgcaggcaccggtccctgacgtcttcgtcagctccgccttgaagcgctggctggccacctccgccgcgcacacgttgtatgcgatgtacgaagcgctcggaggcagccgcccgctagggctgtccggactggagcgcggccggtacgagcagcgccttcagcagcggctcaccgaggccttcgtgcatggggagctggtggcgctccccatggcgcgtccggtgctgctgcccacgccctggccggaaccaccgccgctgacgtccgaggaaacccccgtcgaggaacagacgtggctggccatcgagctgaaggacgaggagggcaaccccatcccccacgcgcgctacctggtgacgctcccggatgggagtacgcgcgagggcaccctcaacaagaatggctacgcgcgcgtggacggcgtgaatcccggccagtgccaggtcaccttcccggagctggacgggcagagttggtcatga

SEQ ID NO: 5259 - DNA, 288 bp, Myxococcus xanthus
atgaaccgtgacgcgttcatcgtgggcatcgccgaaatccccggtgacatcacgtccgtcgaagccgaaaaaatgaagtctcacgtcttcggtgacacgggcgtgctggctggcgtccagcgctcgcgggtgcgcatgacggacggcagcgaggtcaccgacgccgtgtacttcaccgacgtgtggcagcgccgcgacggaacgtggctcatggtgttcgcgcacagcagcccggccgcgcccaccgaggctcagcaggcgcccgaaggcgcaccgcagcagcaataa

SEQ ID NO: 5260 - DNA, 528 bp, Myxococcus xanthus
atgtggtgcctcgggcgggatgtcctctgcccggaggggaacctcctcgttcgacgagggctcgtgcgccacgcgcgccccgaaggcgcggagggacagagcccctacacggtgggccttccggatggtgggcgcctgacgctgtggggcttcggcgcgctgtgtgagtgcggcgaagccatcttcgtccctcgggcgggcttcgcgcccgtcctgctggagggggtgccgggccatctgccgtttcgcgcggaggagctgggcccggcgcgcttgccgaccacgggacacgagcggcgggcgctgcgcgcggggctcgcctcgctggcgggctggctggccgagcacgaggactggatttcctccgagatggggccgtcctggcgccgtgagtgtttcggggcacgccgcaaagcggctcccgtcgaggcggacggactggcctcggcgtggcggcgcttcgcttcccgccttcgttccctggattctggattcaacgtctgcaccgccccggtcgccggggcctga

SEQ ID NO: 5261 - DNA, 387 bp, Myxococcus xanthus
atggtgcctcccgtggagttggactcgctgcgggaggcgcggctggagtcgcgctacttccgggaggcgctggcgttgaccgtcttcgccttgctgggcctgtgggcgcagcccgtcgcgctgaaggtgctggggttgggcatggcggcgctgggcggcctgctggcgttgacgtgccgttcacacgggctcgtcctggtgcctcggcagggggcgcaggtgcgctggcccctggggttggcgcggcggggctctccccgggacacgcggctgttggcggcgtggacgtcgttgtcggaggccctgcgggtgcgcggcgtggctgtcgacggcgagtcgtcaccgctgccgcctccaccgacacaagacggtggccctctgtcttga

SEQ ID NO: 5262 - DNA, 501 bp, Myxococcus xanthus
ctcaagctgctgtcgcgcagctgggagccggtggtgggccacaagccgcgcatcgccgtgctggggctcaacccgcacgcgggcgaaggtgggctcctgggacgcgaagaggtggaggtgattggccccgccatccgcaaggcccgcgcggcccgggtggacgcgaatgggcccatccccgcggacgggctcttcgcgaagcccgacgaggtgggcgcgcgctacgacgcggtgctggccatgtaccacgaccaggggctcatcccggccaaggcgctggacttcgagcgcacggtgaacgtgacgctgggcctgcccgtgccgcgcacgtctcccgaccacggcacggcctacgccatcgccggcaagggtgaggcgagctgcgtgcccatggtggaagcactgctcaaggccgcccagctcgcgggggcccgtcttgcacaccaggcaaccgggcgacgtgctcggccaggtccgctccgtccttcgccgggtcgatga

SEQ ID NO: 5263 - DNA, 510 bp, Myxococcus xanthus
atggccagcaagtgggacaagcagctgatggacttcctcaagcgcaccggtgacgagctcaagcgcaccaccgatgacctgcgcggcgaggctgagcgcctcctcaaggaagtgaaggaccctcagaaccaggccaaggtgaaggaaggcctggagcagctgcgcacctgggccgccagcaccagcaaggtggcggcggagaagattgaagtcgctgtgcgtcaggtcgagggcgccgtcgagcgcgccttcacgaacgaggagggcggcgagcggacccctccctcgcgccccgccaaggcgccagccgagcccgcggccgaggccaaggcccccaaggccagcgcctcccgccccgccgcgaagaaggccgggggaaagtccattggccgcaagaagcccgccgccaagggcgccgccacgaagacggcgaagaaggctgtttcgggttccaagaagacgattggccggcccaagaagcccgtcgccaagaccaccgccggagcgtga

SEQ ID NO: 5264 - DNA, 786 bp, Myxococcus xanthus
atggacgaagaggacgaggtgaccgtcatcgaggtggaggcttcaggcccgtccaccccggtggaggccgaagcgtccgcgtcccccgccgacacgacttctccgccgtctgacgccgaggcgaccccgtccgaggacgtggcggcgctccgccaggaggtggagtccctcaaggcccagctcgaattcagccaggccaaggggcgcgagacgatggagcgcctgcgcgaggcccacgagcgtgcgaaggaggcgcaggagcgcaccgtgcgtcacgccgcggacctggagaactaccgcaagcgcgcgcagaaggagaaggaggaggtccagcgcttcggctcggagaagctgctcaaggacctgctcccggtgatggacaacctggaccgcgcgattgacgccgcggccaagtcgccggacctggacagcttcgagaagggcgtggccatgacgcgcaagtccttcgaggacgcgctgggccgccacggggtgaagggcttcagcgccaaggggcaggtgttcgacccgcgcgtgcacgaggccatccagcaggtggagacggcggacgtccccgccggccacgttgcctacgaagtcgtgcgcggcttctacctcaatgaacggctggtgcgtccggccatggtcgtcgtcgcgcgtgcacccgccgagcctgtggccgccgcggagccgccggccgtcgccgagcccgccaccgccacgaccgacaccgaggcgcccgccgcgcccgcgcagtccgagaactcttccggggggagtcagtaa

SEQ ID NO: 5265 - DNA, 1824 bp, Myxococcus xanthus
atgggcaaggtgattggaatcgaccttgggacgaccaactcgtgcgtcgccgtcatggagggcggcgagccggtggtcatccccaacagcgaaggcagccggaccacgccttccatggtgggcttcactgactccggcgagcgcctggtggggcagattgccaagcggcaggccatcaccaacccggagaacaccgtcttcgcggcgaagcggctcatcggccgcaagttcgactcgcccgaaggcaagaaggccattggcgtgtcgcccttcaaggtggcctccagccccaacggcgacgcgtgggtggagattcgcggcaagggctacagcccgccggaggtctccgccatcgtcctgatgaagatgaagcagacggcggaggactatctcggtgagcaggtctccgaggcggtcatcaccgtccccgcctacttcaacgacagccagcgtcaggccaccaaggacgccggccgcatcgccgggctcagtgtcctgcgcatcatcaacgagcccaccgccgcggccctggcctacggcctggacaaggtgcaggacggtggcaccgagcgcatcgccgtctacgacctgggcggcggcaccttcgatatctccatcctggagctgaacgccggcgtgttcgaagtgaagagcaccaacggcgacacgttcctgggcggcgaggacttcgaccagcgcctcatcgactacctggccaagcgcttcgcggaatccaacaacgggctggacctgcgcaaggaccgcatggcgctgcagcgcctgaaggaagccgccgagcgcgccaagcacgagctgtccagcgcgcccgagacggaggtgaacctgccgttcatcaccgccgatgcctccggtcccaagcacctcacggagaccgtggaccgcgccaccttcgaggcgctggtgacggacctcatcgaccgcaccatcgagccgtgccggattgccctgaaggacgcgggcattcccgcgcagcagatcaaccaggtgctgctggtgggcggcatgacgcgcatgccgcgcgtgcagcagaaggtgaaggagttcttcggcagggagcctcacaagggcatcaacccggacgaggtcgtcgccgtgggcgcggccatccagggcggtgtgctcaagggcgaggtgaaggacgtcctcctgctggacgtgacgccgctgtcgctcggtgtcgagacggccggcggtgtcttcacgaaaatcatcgacaagaacaccaccatcccctgcaagaagagccaggtgttctccaccgccgtggacaaccagccgctggtgagcgtgcacgtgctccagggcgagcgtgagatggcggcggacaacaagacgctggcgcgcttcgaactggtgggcattcccccggcgccgcgcggcgtgccgcaaatcgaggtgtcgttcgacatcgacgccaacggcatcgtccacgtcagcgccaaggacctgggcaccggcaaggttcagcaggtgcgcgtggtgagcaactccggcctgtccgaggcggaaatccaggcgatgatttccgacgcccagtcgcacgcctccgacgacaagaagaagaaggagctggcggagctgcgcaacaacgccgacggcctcatctacacgacggagaagagcctggaggagtacgcgagcctcctgtcggagaaggaccgcgaggaaatcaaggcggacctggagcgcctcaaggaggtgctcaacacctccgacgcggcggtgctcaaggaatccttccagcgcctggaaggcagcgcctaccgcatcgcggacgccatctacacgggccaggcgagctga

SEQ ID NO: 5266 - DNA, 297 bp, Myxococcus xanthus
atggacgtcaccgaaggcatcgtcatctccctcatcaccgccatggtggtgggggtgcccctgttcgggctcacgcttcgcttctccctcaagcccctggtggaagccttcatccggctgaaggaaacccagcacggcggcatggaggtgcggctgctccgcgagcgcatcgcgcacctggagcgcgtgctggaggcgcacggcctcatggatgaccacctgtccctgtcccttcgccccggcgcgcccgagcgccttccggccgtggcgccgctgaaggatcgggagcgcgtgtag

SEQ ID NO: 5267 - DNA, 1434 bp, Myxococcus xanthus
atggccgacgtcatcctggaggactgcctggagcggggcctgtccctggactccgggctcgacgtgtttctcacgcagtgtgcccggctggtgcatgcgcgcgcgggcttcgtgtccctgcgagggacgcgaggcccagtgctgacgcgggtgctgggcgagcccggggtggacgtcctggaggcggcgcactggcaaggtgtccgcaagctggatgacggccggacgctcttctgcacgcggctggccctgggcagcctggagctggggggcctggggctggtggtggagggcgccttcgacggcggcggcgggctggtgatgcagctggtggaggccattggcgagcagctcgacagcgccgtgctgggcttcctcgcgctgacggacggcaagggcgcgctggagcgactggacgcgctcagcggggagccgcctgcggcctcgcggggccacattggccgctatgaggtggtgacgcccctgggcaccgggggcatggcgcaggtgctggtggcgcggacccgaggcccggagggcctggggcggctggtggccctcaagcgcatcctcccgcacctgtcctcggacccttccatcgtccagcagttcctggacgaggcccgcatcggcctgcggctctcccaccccaacctggtgcacttctacgacttcggcgaggcggagggcgcgtactacatcgccatggagttggtgcgcggcgtggacctggagcggctcctccgcgcggccaagggcccgctggagacggcgcacgcggtggccatggtgtgccagggcctggcggggctgcatgcggcgcacgtgctgcagggcgaggacggcgcgccgctcgagctggtgcaccgggatttgtccccgcacaacctcatggtggggttcgacgggcgggtgaaggtgctggacttcggggtggccaaggcccgcgcccagcgcacggtgacgctgccgggcatcgtgaagggcaagccgctgtacatgtcccccgagcaggcgcgcggcatgcggctggatgcgcgcagcgacctgttcgccatggggctcgtcctctaccagtcgctcatcggcgcgcgggccttcgagaaacccgaagaactggccaccatgcacgccatctgcgacgaggcccttccgccgcggccttcgcacatctcccgggcgctctgggacgtgctggagacggcactggccaagcgccccgaggcacgcttcggcagcgcgcgggagatggcggaccggctggcggatgcctgccgtccggcgaacgactcggagctggtgcggctcatggcgaagcacttccctgaccggcatcgcgagttcatgcagttggaccgctctgcctccgcgggagggcgggccctggacgaaacgcccatcatgcgaccgcggctccggaagtcctcaccctga

SEQ ID NO: 5268 - DNA, 225 bp, Myxococcus xanthus
atgctgggcgccctggtggcgggccggctcgcgcgccatcggctccggccgcttcctggcctggccctggtgcccgccccgccgcccgctgcccgcgagcccgcggcgctggagacggacacggacccggagcgccccagcacgcccctggagcgggtgcgccggcgcgggccgaatggccgggagcatccctggagcgagcccggattgcccacgctggcgtga

SEQ ID NO: 5269 - DNA, 696 bp, Myxococcus xanthus
atgcgggtcttcacggcggatgggacccggttgggcaccgtggtggggtgtggcggggagaccttcgccatcgaaggagggctgctgcggctgaagtccttcaccgcgcgctacggtgacgtggtggacgtgcgcggagaagacgtgcacctggggctgacgcgggacgaggtgtcaccggagcacgacagcccgacgcaggcgcggtcaggtcaccccgagtccgtgctctccgccgggttcgcgacgcccggcgaactcgtggtgcccctggcccgcgaggaggcccatcctcacctggtggtgcgcgaggcgggacaggtgcgcatccacaaggtggtgcggacggaggtgcggcacttctccgtgcccgtgcgccgcgaggagctggtggtggagcgggtgtccgaacagaccgtggacgccgagggcccgccggcgccggaggccatggcctccgcccggccggtgctggaggggctggtacccttcgaggcgggcaccttcgtcatccccctgcgcgaggagcgggtggaggtcaccaggtccgtgcatgtctggcaggaggttgcggtttcccggtacaccgacgaggtgctccggcaggttcacgccaccgttcggaaagagacggcggaggtggaggagcggggcgaggtgctccacgacggcccgttggacgggctgcactcctga

SEQ ID NO: 5270 - DNA, 1188 bp, Myxococcus xanthus
atgctcctcgccgcgctcgccgtcatggtggccgcttgcgagaagaagacgcagccagctccttcgggtgaaggaggtactcaggccgcgcaggggcagggggcggcgcccgggggcgctccggtggacgcgaacaccatcctgctgggccaggtgggttcgctcaccggtggccaggccaccttcggcatctccacgcgcaacggcatcgagctggccctcaaggaggccaacgccgccggcggggtgaagggcaagaagctgtccatccgcgtctacgacaaccagagcaagcccgaggaggccgcccaggccgccacgcggctgattacgcaggacaaggtcgcgctcatcctcggggacgtggcgtcgtccaactcgctggccatggcggagaaggcgcaggcggcgggcgtgccgatgattacgccgtcctccaccaaccccaccgtcaccgacaagggtgactacatcttccgcgtctgcttcatcgatccgttccagggcttcgtgatggcgaagttcgcgcgggagaacctgaagctgaacacggtggcggtgctccaggacaacaagagcgcgtactccattggcctggcggacgtcttcacgcgcaagttcacggagatgggcggcaaggtgacggccgtggagagctacagccagggcgacacggattaccgcgcccagctcaccgccatccgcaagtcgcagccggaaggcatctacgtgccgggctactacagcgaggtgggcatcatcgcccgccaggcgcgcgaggtgggcctcaaggttccgctgatgggcggcgacggctgggactccgagaagctcttcgagctgggcggcagcgccatcgagggcagctacttctccaaccactactcgccggacaacccggatccgcgcgtgcagaagttcatcgcggactacaaggccgcgtacggcgcggtgccggacgccctggccgcgctgggctacgattcggcccgcgtggcggtggacgccctggagcgcgccaaggacctgagcggcccgtccgtgcgtgacgccattgcccagacgaaggacttcccgggcgtggcgggcaccgtgacactggatgcccagcgcaatgccgtgaagtccgccgtcgtcctcaaggtcgaggatggcaagacgcagtacgtcacgaccatcaatccctaa

SEQ ID NO: 5271 - DNA, 921 bp, Myxococcus xanthus
atggcgcagctcctccagcacctcatcaacggcctggccgccggcaccatctacgcgctcgtcgcgcttggctacacgatggtgtacggcgtcctgaagctcatcaacttcgcccacggcgacgtcatgatggtcggcgtctacatgggctacgccaccgcgttcgcgctcgggcgcgacatgcgcagctccctgctgggcgtggccgtcgtgttcgcggtggccatgctgggctgcgcgctgctcgggttcctcatcgagcgcttcgcgtaccgccccctgcgggagaagccgcgcctcaccgcgctcatcaccgccatcggcatctccttcgcgctgtcctacggcttccaactggacctcggcttcttgccgggcgcggcgccgcgggccttcccggaggtcatcgagccggtggagtggctcgtcatcggtgaccgggacgtggtggtgtggaactggcaggtcatcagcttcggcatcgccgtggcgctgatggtgggcctgcagtacctggtgttccgcacgcgcttcggccgggccatgcgcgcggtgtcctgggaccaccgcgtggcggcgctgatgggcatccccaccgaccgcgtcatcgcgctgacgttcatgctgagcagcgcgctggcggcgggcgccggcctgctctacgccatcaaggacacgtcggtgagcccgctgatgggcctgtacgtgggcctcaaggccttcgtggcggcggtgattggtggcatcggccatgtgccgggcgccgtggtgggcggcctggtgctgggcctggtggaggagttcgtggtgggctacgcggccagcacctggcgtgacgcggtggccttcggcttcctcatcctggtgctgctggtgaagccgggcggcctcttcggccgcgtcgccgcggagaaggtctga

SEQ ID NO: 5272 - DNA, 474 bp, Myxococcus xanthus
atgtgggtagccgcgggctgtggctaccgcctggcgcctcgcggagatggtctcccggctggcgtgacgtccctctgcgcgcccgtcttcctcaacgctacgcccgagcccacgctggaaacagtcttcacgcgcttcctacggcaggagctgatccgcgtgggccggctgggcagcgcggagtcctgcgacgggcgcatggagggcacggtgctgtcggtggcgaacacgcccacgaccgttgtcggcaagagcaccagcccgggcttcttcttccgcgtctccgctcgggcgcagctccgcgtggtgaaggacggacaggtcctcaagcagacggaggttttcggctcggaggactatgtgctgggaagcggagacatcctggaggcggaggcgaaccggcaggtcgcgctcgagcgcctcgcggaggtcttgatgcgggatggctacgaccggctcgcgggtgcctggtga

SEQ ID NO: 5273 - DNA, 1065 bp, Myxococcus xanthus
atggagacgccggcgattcccgcccccgaggcccgctccgccgtccccgcgtcgctgcgcggcctgctgcccgtgctgctggcgctgccagtgctggtgctgttccagtggctgatgagcgacgcgcccttcgcctcctacctgctgtcggtggtgggggtgaacatcatcctcgcggtcagcctcaacatcgtgaacgggatgacggggcagttctccatcggccatgcgggcttcatggcggtgggggcctacatctccggcgtcctgtcgctgaacctcaaggacgtggcgctctccttcctgccggtggcggtcagcgaccaggtgttcttcgtcgtgtcgctgctggtgggcggcctggcggcggcgctgtgcggcttcctggtgggcctgccctcgctgcggctgcgcggggactacctggccatcgtcacgctgggcttcggcgaaatcatccgcgtggtggtgcagaacacggacgcgttcggccgggcgctgggcctgtccggcatcccccagacgtcgtcgccggccatggtgtacttcttcgtgttcctcacggtgctggtggcccggcgcatcaccggctccagccacggccgcagcctgtgggccatccgcgaggacgaggtggccgccgaggccatgggcgtggacaccacgggctacaaggtccgcgcctttgtcatctcgtcgttcttcgcgggcatcgccggcgcactgtttgcgcacttcgttcccatcatcaaccccggctccttcaccttcgtgaagtcgatggaaatcgtcgtcatggtggtgctgggcggcctgggctccacgacgggcgccatcgtcgcggccacgttcctcacgctgctgcccgaaggcatgcgctcgctgttcaccctgctgggggccgaaggcagcctggcgcagaaggtggaccagattcgcatgcccgtttacggcctgctgctggtggcgctgatgctggcgcggccccagggcttgttcgggacgaaggagatctgggacgtgctgccgcggtggattccgcgcaagcgcagggggctggcgtga

SEQ ID NO: 5274 - DNA, 489 bp, Myxococcus xanthus
atgaagggcgccttcatcaactaccgcgactggtggcgcgcgctgctgctgacgccgcgcttccagcaggaggagcgggagttgacgcagcaggcggagcacctgctggaggtcatgggcctgtcgcaccgccgcgacgaggaggctcgcaacctgccttatggtgagcagcgtcggctggaaatcgcgcgcgcgctgggcacgcagcccaaggtgctgctgctggacgagcccgcggcgggcatgaacacccgtgagaaggcggacctgatggtgctcatccgcaagctccgggacgacttcaagctgggggtgctcgtcatcgagcacgacatgaagctggtcatgggcatctgcgaatgcatcaccgtgctggaccacggcgagacgattgcccggggcgcgccggcgcaggtgcgcagcgaccggaaggttatcgaggcgtacctgggcgacagctatctggagagccagggaggggcggcgtga

SEQ ID NO: 5275 - DNA, 504 bp, Myxococcus xanthus
atgaaggcgcaccagttggtgccgcgcggcatggcgcacgcgccggaaggccggggcgtgttccccaacatgtccgtccaggagaacctggagctgggcgcgtacctgcgcacggacacctccggcatccagcaggacctggagaagagcttcacgctcttcccggtgctcaaggagcgtcgcaagcagatggccgggacgctgtcgggcggcgagcagcagatgctggccattgctcgcgcgctgctgagcaagccgcagttgctgctgttggatgagccttcgctggggctggctccgcaggtgacggaggccatcttccgcaccctgcgcgaggtgaatgccacgggcgtgagcgtgctgttggtggagcagaacgcccatctggcgctcaacgccgcgcactacggctatgtgttggagacgggcgaggtcgtgatggcggggccgggcaaggcgctcctggagagcgcggaggtccggcgtgcgtatctcggcgagtag

SEQ ID NO: 5276 - DNA, 747 bp, Myxococcus xanthus
atgtccccgttgtcccgtcttgtcgccagcctcgccaccctgtcgctgattgccgccgcgtgcgccggtcagcagaagcccgataaccgggaagcctcctcgaccatcgaggaggtcgccaacgagggtggagaggagacccccaccgtcgcgttcaacgtcctggatgctcccgagggcttcaccgtgaagctgccggggcccccgccgcaggcgcagcgcagcgaggccgccctgccgaagcggacggacaaggccacgctcgtcacgtacgcggccaatgagggcggtgtcagctacatcgtcaacgcggtggactacccggaggcgttcgtcgccacggtgcccgccgaggcgctcatcaacggcggcatccagggcattgccgggcaggtgggtggcgagctgaagagctccgaggacatcaccctggatggctacccgggcaaggcgtacatgctggcgtcgcccagcggcgaggtgaagggccgcagcttcctggtggggccgcgcgtctacaacctcatcaccgtctacaacgcgggcatcggcgcgccgggtgcggacgagttcctcacctcgctcacgctggtgaacccgccgccgaagattgagatcccggaggccgacgcgggcacggacgccgggacggccggtgcggccgacggcaccgcggccgccgtggagggtggcgaggacgctgggagcgcgccggacgcgggcgcccgtcgccgccgcgccaagtag

SEQ ID NO: 5277 - DNA, 774 bp, Myxococcus xanthus
gccgccatgtgggacccggcgcagtactcacgctttcgcgacgagcgaaagcgtccctttttcgatttgctgtcgcgggtggacgcggcgtcgccctcccaggtcgcggacctggggtgtggcaccggggacctcacgcgcgtgttggccgagcgctggccgtccgcccaggtgtccggtgtggatgcgtcctcggagatgattgaggcggcccgtcgcggtgcgcccgtgggctcggtgcgcttcgaggtggcggacctcgcggactgggcgccctccgcgccgctggacgtgctcgtgtccaatgcggcgctgcattggctgccggaccatgaggtgttgctcgggcggttggtggcgaagctggcgcccggcggggtgctggccttccaggtgccggccaacttcgatgcgccttcgcatcggcgtgtcgacgaggtgcgagccttgccacgcttcgcttctgtcctggcgcccgtgcggcgcaggccggtggagtccctgcctgtgtacgcgtcctggctgttcggcctggggctgacggtggaggcctgggagacgacgtacctgcacgtgctcccgggcgaggacgcggtgctggagtggctgctggggacgacgctgcggcccgtgctcgcggcgctcggggaggaggaggcgcgcgccttcgttgagacgctgcgcccgttgctgcgcgagtcctatcccgcgcagccgtacgggacgccgttcccgttcacccgccgcttcgtggtggcgcggcgggtggcgtga

SEQ ID NO: 5278 - DNA, 675 bp, Myxococcus xanthus
atgtttcgccaggtggctgacgacgtgcacgtgctcgcggtggagttccgcatcgggggaatggatttggggggccggatgacggctgtccgcctgccggatggggggctatggctccactcgcccgtccgcttcagtccggaggtacgggcggcggtggatgcgctcgggccagtgcgcttcctggtggcgcccaacttgatgcaccacctgtacgtgcaggagtgggctgcggcctatcccgacgcgaaggtggccgcgcccgctgcgctgcggcgcaagcggccggacctgcgcatcgacctggagttgggtgacacggccgaggccggctgggccggcgtcctggaccaggtgctcgtccaggggatgcccaaggtggacgagctgctcttcttccaccgccccagtcagacgctgttcgtcaccgacctggcgttcaacgtgcaccggacgggttcgtggttcacccgcatgtacttgaagctgagcggcgcgtggcagcggctcgcgccgaccatgctggttcgctccgtcatcaaggaccgggaggccgtgcgcgcgtcgctggcgcggacccaggcctgggacgtggagcgagtggtggtgtgccacggtgacgtggtggagcagggcggccgggaggcggtgcggaatgccttcgcccggttctag

SEQ ID NO: 5279 - DNA, 738 bp, Myxococcus xanthus
atgccttcgcccggttctagcggcggtggccgcaagcccgcgccgggccgccgtcgcggcgccgcgtcactggccgcgcccacccctgcgtcggctcccaccgcggagccctccgagcgcgaggcacgcaaggcgcggcgtcaggaggggcgccgtcaggccatcctcgtcgccgcacgggcggtgctggttcggggcggggtgttgggactgaccctggaggccgtagcggcggaggcggacctgagcaagccttccttgttctactacttccgctccaaggaggacctcgtgggggcgctggcggtggagggactggagcgcgaggtgaaggtgctggaggcggcggtgacggccgcggccagcggcgtggaggccctggccgcgctggttcgtgcccgggtggatttgtacgcggaggacctggacggctttcgcgtcgtctatctgtggccgcagttgaccgggcggcaatccgaggcgcaccaatcgcgggtgctggcgctgagtggacagctgaatgacgtgctggaggcgcggctccaggcggatgcgcgcgcgggccggctggccccagggctccagccgcgtcggctggccaacctggcctggaccgtggcgcacggggtgctttccctgggggctgggctggagcactctggtgtgggaacgcgcttcaccttgtctcaacttcgtgacgaggcctgtgcggtattgctgcgcagtagcggccgttag

SEQ ID NO: 5280 - DNA, 546 bp, Myxococcus xanthus
atgggcatcagtggccgaagcggcaagcagggctcgggcttcacttgtgcagagtgccactccggcggcagcacgcccacggtgaccatcgaagggcccaccacgctggcgccgggcgccaccggcaactacacgctcgtcatccggggcggtccggccgccggcgcgggctacaacgtggcggtgagcgacaacggcggcacgctcaacccgggttcggcctcgtacaagctgagcggggaagtcacccacaagaacatccaggcgttctccggcggcgcggcccgcttcgacttcaccctggtggcgccgtccactcccggcactgtcaccctgtacggcgcgggcaactcggtgaacgagaacggcaccgaccagggagacgcctccgcggccaccacgctcaacgtcaccgtggcgactggcggcggcaacggcggtgacggcgatggtgatgacggcggtggctgcgccgccgcgggcggtatcccgttgctgggcgcggccctggtgctgctcggcacccgcctgcgccgtcgtcgctag

SEQ ID NO: 5281 - DNA, 864 bp, Myxococcus xanthus
atgagccttcgccgcctcctccccatcctgttcctgatggggccgctcgcgtgtgcgaccggccctggctacctcgcctccaccgagtccgtcgccgccgtgcggcgcgccccgggagagctgcgggtgatgaccttcaacattcaatccggcgcccgcgggttggagcgcgtggcgcacgtgattcgcgccgcggtgccggacgtcgtcgccttgcaggaggtggacgcgaagtccacccgcgcgcgcggcctggaccagacggaggagttgtcccgcctcaccggcctgaagtaccgcgcccactttcgcaccacggatttgttcggcggggcctacggcatcgccgtgctgtcgcgtttcccgctggaggcactggcgcagtatccgctgccggggccgcgcggcgcggagcctcgcaccgtggcgcatgcggtggtggacgtggatgggcgcgaggtgagcgtctacctcacgcacctcgtccgccggcccttcaacagcgacacccgcgtgcggcagagcgcgtacgtggcgcggctgatggcgcaggattcgcggcccaaggtgttgatgggggacctcaacgacggaccggattcacgctccacgcggctgctgcggcgggccctgcatgacgtcgccgcggcgaccggaggcacggggggcacgtatccgctgccgctcttcctgcccacgctgcgcatcgactacgtgctggcgtgtgatgccttcacgttcgtggcgagccgggtgctgcgcgtggacgtgtccgaccactaccccgtggtggcggacctgcggctgaagccggaagccgtgaccgtggtcgccgagcgcgcggccaccggcaccgcgccttga

SEQ ID NO: 5282 - DNA, 591 bp, Myxococcus xanthus
atggtgggcgcgggcgtgctgacgtgtggcgtcttcggcctcgcctgggtggtggaccgcttcggtcagcgcgagcaggccgtgcccgcggacgtgctggttgtgctgggcgcgcgcgtgatgaccgggggcgcgccttccggggcactgcgcgcgcgcaccgagcacgcggtggcgctgtaccaccgcggcgtggctccccggctcgtcttctccggcggcgtgggcgtgaatccaccctccgaggcgcgcgccatgctggcgctggcgacgcggatgggcgtcccggcggaggcgtgtgtcctggaggagggcagtcactccaccgacgacaacgcccggctcacggccgaggtgctacgcgggctgggggctcggcgcgtggtggtggtgtcggacccgtatcacctgctgcgcgcgcgcaactacttccggctgtatggctgggaggtggccaccagtccggcgctggagaccgagcgcaacctggacacgttcgaccgcatctattggacggtgcgcgaggccgtcgcgctgctcctgcatccccgcgtgctgctggcgcgcgcacctactccttcggcaccgtga

SEQ ID NO: 5283 - DNA, 1632 bp, Myxococcus xanthus
atggccggcgcggtgcggttggcggaggtggcggtcgagctgtcgccggggctgccctacgcgcgcttcgagctcgcggagctctacgccttggagaagccgggcgacgtgtcccgcacgttggggcaggtgcggcaggcactggcgacactggcgcaggatgcccgctatcgtcggcccgcgttggcggacctgggcgccctggtgctgctggcctggggggccaccgcggtgctgctgatgggcttgttcttcctacggaagctccgttacgcgctgcatgacttccaccatctgctgccgcgagtcgtctcccggtggcagtccctggtcctggggctgctgctcttgagcctgccgtgggtgctggggctgggcgtgctgcccgcgctgctggtgatgctggccaccgtgtctctctatctctcgcgcacggagcggatcgtggcggcggtgctggtggcgggcgtggggctctttccgctggcggcggggcaactcgcgcgtgtcacggcgttcgcgggcacgccggccgaggacgtgtacctcctggagcggggcggcctgtccgccgaggaggcgcgggcgcgcgtactggcgcggatggagtcccgctcggcgacgttcgcggaggtgctgtcgctggcgtacttcgaatcccggcgcggcttgctgaaagaggcgaggactcacttcaaggccgcctcggcgctgaagagctcggatgcgcgcctgcttacgcgcttcggcaacaccctggtcgcgctgggagacgcggagggtgcggcactgctctacgtgcaggcctcgcagtcggcgccggacctggcggctccgcactacaacctggcgcaggtggtccgccgcagggcgaagacgctgccggactcggaggtcggcaaggagctggatcgcgccgccacggccatggcctcggcgcaggcgctggatggaacgctgctggtccgggacccgccgccggaggaccggctgctcctcaacctgctgctgctggccccgcaactggcggaatccgactggcttccgctcgcggatggcacgggggcggggcgccaggtggagacgcaggtgtcgcgctggctgctcccagggcttcctcccgggcccatggcctccgcgggggccgcggcgctggcggtgctgctggccctgtggggcttcttgggggaccgcttgaaggcggccaaggtgtgtgagcgctgtggccgcgcggtgtgcgtgcgctgcgacccggagctgggcatcggcagcaagcaatgtggccagtgcgtcaacgtcttctcccgccgggggctggtgccgcagcagctgagggcgcgaaagcagctccaggtggaccggcatcaggcctggacgggccgcgtggcgtacagcctgggcgcggtgctagcgggagcggggcacgtggcctcgggtgtgccggtccgcggcgcgctgtatgcgttcggtttcctcttcgcgctggccgcggtgctcctgcaccagggcctggtgcgagggccctacggtgaagcccccctctacctcaagctcgcgcccgcggcgttgctgctgctgggggtccacctgctgtcgttgcgcggtctacgccgtctgcggcggggggagtga

SEQ ID NO: 5284 - DNA, 759 bp, Myxococcus xanthus
atgcgtcatctgttcctgctttgtgccgtctccacgctgttgtcgggggtgtctgcccaggccgacacggtactggtgttcgcggccgtgagcacctcggacgcgctccaggagctggcgccggccttcacccggaccacgggccacgcggtggagttctccctgggggcctcgagcgacctcgcacgtcaggccgtggccggagcgcccgcggacgtcttcctctccgccgacacggcgcagatggacgcggtggagaaggcgggcctggtcgcgccctcgacgcgcgtggacctgctgtccaaccggctggtggtggtggtgccggtggacgcgaagtcggcgccgtcctcacccgctgggttgcgtgggttgaagcggctgtcgctggcggacccggaggcggtgcccgcgggcgtgtatgcgaaagcgtggctggtgaaggcggggctctggaaggcgctggcgccgaatctcgtgccggcgctcaatgtgcgcgccgcgctggcggcggtggagacggggcgcgtggacgcaggcgtcgtgtattccacggatgcggcacattcgaagcgcgtgcgcgtcgccttccaggtgcctgagcaggacgtgccgcgcatcgtgtatccggcggcggcgctgacgaagggcgccgcgccagaggccgggcgggcattcgtgcgcttccttcagtccgacgcggctcggaaggtcttcacacgccacggcttcggcgttcccagcgcgcgggctccctga

SEQ ID NO: 5285 - DNA, 432 bp, Myxococcus xanthus
atggaggtcgtcttcacgcccaaggccgtggtgctggcgagcgcggtgatggcgttcccgctgctggtgcgctcggcgcgctcgggcttcgaggaggtggacccgcggctggtggcggtggcgcgcacgctgggcgattcgcgcacgcgcgccttcttccgggtgacgttgccgctggcctggcgcggtgtgctggtgggcacgctgctggcgttctcccgcgcgctgggtgagttcggcgccacggtgctggtggcgggcaacattccaggccgtacacagacgctctccctggccatcttccagcgcacgcagctcgggcgggacgcggaggcgctgcggctggcgggcgtggcggcgctgctcgccttcgtggcggtgttcgcgaccgaggcggtgacgcggcggcgtgggcggagggtgcgcgcgtga

SEQ ID NO: 5286 - DNA, 840 bp, Myxococcus xanthus
atgggctacgtgccccaggatgcgctgctcttcccgcatctcacggcggagcagaacgtgcgctatggcgtgcggccggggcgggcctctcgcgtggacgaggccgtggagattctggagctggcgccgctgctgcgccgctacccggccacgctgtccgggggcgagaagcagcgcgtggcgttggcgcgcgcgctggccacggacccggcgttgttgttgctcgatgagccgctcgccgcgctggacgtggcgctgaaggaacgcgtgctgccgtacctgctgcgcgtgcgcgacgaggcccgggttccgatgctgtacgtgacgcatcagttgggcgaggcgcgcgtgctggcgcgagaggcgctgctgctggaccaggggcaggtccgcgcggccgggcctgcggccgaagtgctgggcgcggcggcgcgaggcctgctcgccggtgaaggggatggggaggagaacatcctcgaaggagtcctggagcgtccggacgacggcgggttgcggcttcggatgcagggcgggttgtcgttgtgggtgccggactcgcccgcgttggcgccgggcacgcgcgcggcctatgccgtgccggccgcggacatcctgctgtccatccaaccgctgacgggggtctccgcgcgcaacgtcatgacgggcacggtggtgaacgtggagtccgtggcgacgggcgaggacgcggccaccgtggatgtggcgggtgtgcgctgggtggtgtggctcacgtccgcgtcggtgcgtgagttgggcgtggtgcccggcgcgcgggtgtccctggcggtgaagacgtccgcgtgccggcggctgcgctga

SEQ ID NO: 5287 - DNA, 462 bp, Myxococcus xanthus
atgccgcttttccgaatggcggggatgctcgccgtcctcaccctgctgtgcgcctgctccgatggacgtggaacctccggagcgccccgtctgcccgcggtcgagctgtctccgacgacggtgggccttgcctacgaagccatgttcaccgcgtccgggggcgagccgcccctgcgctacacggtgtcaccgccgccggcgggtttctccttctatacgggagaggggcggctgctgggcccgggcagcgaggccggtgacttctccatcaccgtgacggtgcgggacgcggacggcctggagaacgtgcgcacgtacgcgctgaaaatctatccacgccctgaggtcaccagtgacgggctccccgccgccacggcgggggacaactacgagcacgtcctggtcgccaccggtgggcgccctccccttcaatgggagttggtggcgggctcagtgccaacc

SEQ ID NO: 5288 - DNA, 876 bp, Myxococcus xanthus
atggtcgtccgcagcatcgacggcgagaagctcggcaaggtcttcgccatcggcgacggcgaattccacatcgagaagggcctcttcttcccgaaggactacctggtccggtactcggaaatcagtcgcatcgacggctcggaaatcatcctcagccacggcaaggagatgctgagccggctgacgggtgaggaccgcacgggcgccgtcgccggcacgggtggcggcgcgggcgtgggtccgggcgcggtgggactgggcgccgaccaggccgcggcccgcgccagcacgggcatggacgccaccacggacacggtgggccgcaagggcacctacgacacgggctacgacacacgcctgggcgcggacgcccgccacggcaccggcgtggacacggacaccgcgggactgaaagccacggacaccacggtgggcgcgcgggacatccacggccgcgaggaggacatcaccatccccctgcacaaggaggaggtggacgtgctcaagcgggacgtccaggccggtgaggtccgcgtccacaaggacgtggtggaggaggaccgggagatggacgtgccggtgcgccgcgagcgcgtccgcgtggagcgccgggacgtgagcccgggccgcccggcgatgaatgcctcgttccaggaggagaccgtcgtcgtcccgctgcgcgccgaggaagtcgaagtccagaagcgcgccgtcgtcgacgaggaggtcgtcatccacaaggacgaggtggacgaggagcgccacatctccgagcacgtacgccgggaagaggtggacatccgcaccgagggcagcgacgagcgggcgcgtacgctgaacgcgccctccgacgacccgctcaagcgcgggtactga

SEQ ID NO: 5289 - DNA, 2064 bp, Myxococcus xanthus
atgcgacgcgttctggtgcttctccctctcctcgcgctggccagttgtaagaaggacgaaagccctggcgcggccaaagtcacggtggactactcgggctttctgcctggctgcgtgcaggtgaacgcacgcgacgagggcagcggcaaggagctctccaccaccgttgccggcaagggcgagcgcaccggaggctcgctgacggtcgcggtgattgcgcccagcggctggggctcgaccatccaggtggaggcgcgcgccttcgagcagacatgtgaggctgcgagccccgtggtgacgcggtccacgtcggtgacgctgacgccaggaacccccgtcccggtggccctgtccctccaggccacggatggggacggcgacgggtacgtctccgtgctcacgggcggcacggactgccaagacaacaacccggacatccacccgggcgcgacggagctctgcaacgacgtcgacgacaactgcaacgggcagtcggacacggtggagctgcgcctgggccagagctgcacggagggcgaaggctgcgagggcgtccgtgcgtgcggtgggaacggcgaggtcctctgcaacatgccgctggctgtgtatgcctatcctgacgtggaccaggacggacacggcgaccggaacgccgctcccgtcgccttctgcgccggtatcccgcagggctatgtcacgggtcccgcgagcgactgcaacgacaacaacgccagcatccggccaggtgcgacggagctctgcaacggcgtcgacgacaactgcaacgacgagattgacgagacgttcaccgacctcggcacggcgtgcaccgcggaggcccagtgtgccggcgtctacgtctgcgacgcctcgggcatcgccaccacctgccaggccacgacgacgcccaacgactggttcttggacggcgacggagacacctttggtgatggcacggccgtgacgtcctgcgtctcgcccggcgcgggctacgtccaggctggtggtgactgcaatgacggaaacccgttcacctaccctggcgcgacggagctgtgcgacggcctggacaacaactgcgacgggaatgtcgaaggccccgaggtctgcccgagcggcggtgccaactgggtagcgcaggacgtgggcgcaatggatcaggagtggcgctccatcttcactgaggtccccggtgatgtgactgtcgtgggcaatcagggaggcgtcgcgatactcaccgtgggctcaaccacattccagaccaacgcgaccaattgcggcgacctcagcagaggctggaacgccgtctgggcggacatggccaaccagggccgcggctatctcggctcctccggaggccacctctcgttcgtggacagatctcaggttgcgtgcaccgaaacccacggcaacctggtccgctctacacaagggctcgtcggtttccgacacgaaggaaccctggagcttcatggagtcacccagaactccggaacggtaaatcagggactgacgttcaagtggactggaggtatcggccccagcgcgttgagcttcggccccgcagcagtcgcgccgctattcgacatccacggccgttcccgtgcagtgatgttcgcggtaggcggcaccgacaatggaggcaacaggggacgcatccaccggttcaacccctcctccgggcagtggcaatcagaaagcgtggaaacctccatcccaggcatgggccgcctccgcggcgtctgggtagtgaacgacaaggtcgccttcgccgtgggcgaaagaatgggcggtgcgaacaccgtcctccagtggaacggaagcacctggagcaggatgcccttccccaacacaaacagtgagacgctgacttctgtcgtcgcctttggtgccaggtccgtctacgtcaccgcgaagagcggtcgcatttaccggtacgacggcacggggtggcagatcctcttcgacaactctgcctttgccttcaacgacatcgccggcaccagtcccgcggacctctgggtggcgggcgacaacggcaagattctccactggccccagtaa

SEQ ID NO: 5290 - DNA, 603 bp, Myxococcus xanthus
atgctgatggtgtggttcggcgcccacaacgcggtcgcggcgccgcatgaaggactggaggcccggttgcagacgggagacatcgtcctgcacacctcgcgctcctcgcagtcacaggccatccagaaggccacgcagagccccctgtcccatgtgggcatggtggaggtgaccgaacagggcgcgtgggtcgtggaggccgtgcagccggtgcagcgaatccggttctcgaagtggaaggcccgaggcgcgaagggcggcatcctcgtcctacgccctcgtgaactgagcgatgcgcagcgccagcaggcggtggcggcggccaaggcgcatctgggcaagccgtatgactggctcttcggttggggggacgacgcgatgtactgctcggagctggtgcgcaaggcctacgcccagggtgcgggcttggaatatgggaaaatggagcggctggactcgctccgcgtgaaaggcctggagcagcagctccgcgaacgttacgggaagcgggttcccctggatttggagctggtgacgcccgctagcatcgccgcggatgtacgcctggaagtggtccactccgacttcccgtccgtgaggtag

SEQ ID NO: 5291 - DNA, 558 bp, Myxococcus xanthus
atgcgcctgttcaccgccgtcaccctggggcccgccattgaagcgcgcaccaccgaggagttgcaccggctgcgccccctggcccctcaggcccgctgggtgaagctggagggcctccacctcacgctcgtgttcctgggggacgtggatgacgcacgcctgcccgccattcgcgaagccctggcgccgattggagctcggcactcccccttcgtgctgtctgtcgttggtggcggcgcttttggcgcgcccacccacccacgcgtgctctgggcggatgtgtgcggcgccacggacgcgctgaaggccttgcaggcggatgccgcccaggtgctccggccgctcggcttcgagcccgagcatcgcgagtacaccgcgcacctcacgctggcccgcgcgaaacacccgcgcggagacgccgccctcctcgcatgcgtccaggcgctgaaggacacgtcactgggcgaggggcgcgtggaccaactggtgcttttcgagagcaagggcggccattacctgccccgagtggaggtgcccctcacccgcacgctggggtag

SEQ ID NO: 5292 - DNA, 1434 bp, Myxococcus xanthus
atggccgagaagctcacgccccgcgagaagggcttttccgagtggtacgtcgacctggtccagaaggcgaagctcgccgactactcggacgtgaagggctgcatggtcatccggcccaatggctatgcgctgtgggagaacatgcagcgcgtcctggacaagatgttcaaggacctgggccacaagaacgcctacttcccgctgctcatccccgagagctacctgaagaaggaagccgagcacgtcgagggcttcaacccgcagctggccgtcgtcacccacgcgggtgggtccaagctggaggagccctacgtcatccggcccaccagtgagaccatcatcaaccgcagcttcgccaagtggatccagagctaccgggacctcccgctgctgctgaaccagtgggcgaacgtgatgcgctgggagatgcgcacgcgcctgttcctgcgcaccaccgagttcctctggcaggagggccacacctgtcacgagacggaggaggacgcggagaaggagacccggcagatgctggaggtctaccggaccttcgccgaggactacatggcgatgccggtgatgaccggccagaagtcggagtccgagcgcttcgccggcgcgctgcgcacctacagcatcgaagcgatgatgcaggacaagaaggcgctccaggcgggcaccagccacaacctgggacagaacttcgccaaggccttcgacacccagttccagggccgcgacggcaagatgcaccacgtgtggcagacgtcctggggcgtgtccacgcgcctcatcggcggcctcatcatgacccactcggatgacgccggcctcatcgtcccgccgaagctggcggccacgcacgtggtcatcatccccatcttcggcaaggcctccgacgcggagaaggcgcaggtgctggagaagacgaacgcgctggccgcggacctgcgcaaggcgggcctgggcgtggtgctggacgacgacgacaccaagagcccgggcttcaagtacaacgagcacgagctcatcggcacgtgtctgcgcatcgagctgggacccaaggacctggccaagaactcctgcgtcatggtccgccgtgacgtgcgccagaaggagttcgtgtcgctggacgaggccgtgtccaaggcgcaggccatgctggacgcgatgcagaaggacctgttcaccaaagcgaagtccttccgcgactcgcacaccttcgaggtcaactcctacgaggagctgaaggagaaggcggaccagggcttcctgctggcgcactggaacctggaccccaaggtggaggcgcgcatcaaggaagagacgggcctgacgacgcgctgccgtcccttcgacctcaagcaggagccgggcaagtgcgtcgtcaccggcgagccttcgccgggccgcatcgtgttctccaaggcgtactga

SEQ ID NO: 5293 - DNA, 222 bp, Myxococcus xanthus
atggccattcccgccgccctgctgcccgtgggactcctgcactaccgcgcccggcgccggtcacgtcgtccggcgcccctgcgcagcgccgtgggcctggggctggtgtccctggccatcctgcggctggcgggcaactcccggcggaaggttcgacgggtgccgtccttctccgccttcctgcccgacgagttcaccgcctcggtggcctccggtcactga

SEQ ID NO: 5294 - DNA, 1116 bp, Myxococcus xanthus
atgtccctgcaaggcaccctgaaggactttggtattggcgacatcctgcagctcatcgggcagcagcagaagacgggcacgctccacgtccgcgccaaggaccaggaagtgcgcatcggcttcaacgatggccacatcatcaaggcggagagcgtcacccggaagcgcaaggagctcatcggcgccatgctggtgcgctcggagctcatcaccgagacgcagctcgaggcggccctggagacgcagcgccggacgctcaagcggctgggggacgtgctcgtctccagccaggccctcaccgccgagcgcttccaggcgatgatgcagcttcaggccacggagaccctctaccgtctcttcacctggaagtcgggcacctacgaattcatccaggagccggtggagccggacgcggaagccatccatccgttgcgcgccgagacggtgctcatggagggcttccggatggtggatgagtggccggtcatccggcagaaaatccaccgcgacgacctggtcttcgagcgcatcaaggccctgcctcagccgcgcggagaagagggtggggagctgggcgccatcggtccttcggagcggcgcatctacgatgagctctcgcccgggagggatttgcgcaagctggtggatatctcctgcctgggcgagttcgagacgtgcaaggcgctctacaacctggtgaagggcgagtacgtccggccgatactcccggagggcgccccggcccccgtttctggggaccagcgcctgcttgcgcgcgtggcgggtccgttggggcgcctcgtcgccaccgtgggggtgctagcggcggtggtgctggtggttccccgggccttgcgcccggaccacgaagcgggcgttgccgcggtatttgcggactcagcggcccaacgtcatgtttcccaggcccagcgcgtccgcatcgaggccgcgctcgaggtgtttcgcctggaacgcggtgagctgcccgaacgtctggattctttggtgcaggctggactgttgaaaccgggcgaactgaaatacccgtggcgggaagagtactattaccggcggttggccgctcggcagttcattctcctgccacccttgcgctag

SEQ ID NO: 5295 - DNA, 510 bp, Myxococcus xanthus
atggtgcagactcatggggaggcggcctggaaggcgttcctcaccgacttcgcgaagaaggagcccttcttctccaagcccgtgatgccggtgtcgcgcatgccggcggatgctttcctccggctcaacgacgaactgctggcgcgcttctacaacaacaacccgagcgcctattggcagttcggcgtgaagtccgccgagtacgccctgggccagggccagctcaaggcgatgttcagccagggtgacttccggcgcttcctgctgttcacccccggcatctggaagggctacttcaccgagggcgacctcaacgtgctccccggtcaggaccacaccgacctgcacatcacccacgttccccggccgcacccctacttcgagctgtccgtcatgggcttcgcctccggcggactggcgtacctgggcgcgcagaacctcaagcaccaggtactcaagggcttcacgcgcaacgacaacgaagtgctgtaccgcttcaacgtcggctga

SEQ ID NO: 5296 - DNA, 327 bp, Myxococcus xanthus
atggcgctgatggacgcgcggcggctggtggacgcctgcctgggcgctgacgtgccggcgctcgtgcatcgcgaggcctgcagcaaaccgggatgcagcccgaagttccaggtgctggtgcgccccgaggacggccctcgcgtggccgccctgctccagcagcggtggatggacagcatcgagcgcgaaggcctggtgcccatgggacgcaccgccgctccggcagcccccctctccgaggacggcgagccgccctgcccggcctgtggcaccgccgcgccgctgctggaaggcgcctgtagcgactgcggactccagctcgattga

SEQ ID NO: 5297 - DNA, 1167 bp, Myxococcus xanthus
cgcgagggcatcggctccggcttcatcatcgacgccaggggactggtgctgaccaaccaccacctcgtggaagacgcggaggcgattcaggtacagctcgccgacgggcgcgacctggaggcgcgcgtgctgggctcggacccgctcaccgacgtggcggtgctccagctcgaacgcctggacggcggcaagcccttgccggtggtgcggctgggagactcggatgcgctgcgtgtgggggactgggtgctggccattggcaatcccttcggcctgacgtcgagcaccagcctgggcatcctcgccgcgaaggagcgcgacatcgcggcgggccccttcgacgacttcctccagacggacgccgccatcaacccgggcaactccggcggtccgctgttcaacctgaatggcgaggtggtgggcatcaataccgccatcgccggcgagggctcgggcattggcttcgcggtgcccagcaacctcgtcaaatcgctgctgccccagttggagaagaagggcgccgtcacccggggctggctggggctgatggtgcaggacatgacgcccgatttgggcgaggcgctgggcgcgcccgtgaaggagggcgcggtcgtcaccgacgtcacggcggagactgcggcggcccgagccgggctgcggccggacgacatcatcgtcgccgcggatgggcagcccatcgactctgcgggcgcgctcacgcggctggtggcgcagaagccaccgggcgcggagctcacgctcgccctctaccgggacgcgaagaagcgcgacgtgaaggcgaagctgggcacgcggcccgacctggaaggcgtcgccgagaaggagccggccgtcggcggctcgcagcgccccgccgagcatcgcgtggggctgagcctgatggacatggacccggcgctggcggagtcccaggagcttccaccctccggcgccttggtgacggaggtggcccccgcctccatggccgaacacgccggcctgctgccgggcatggtggtggtggaggccgcgaacaagcccgtgcgcggcgcgaaggatgtggtgacggcgctgcggaagacgaagcccggcgagtccgtgctgctccgcgtggccctgccgggaggcgcgctggagctgcgcgcgctcacggtgccgaaggagtag

SEQ ID NO: 5298 - DNA, 309 bp, Myxococcus xanthus
atgggtgagctggcgcgccggctgggtgtcacggagaagaccgtcacgggtgtggtggaccggctggagcgccaggggcacctgctgcgcgagcgcagcgccaccgaccgccgcgtcgtgcactgccgcctgacggaggacggccagtcgacctgggagcggctcaaccgcgtggtcgtccatggcatgcaccagttcctgggcatcctcgacgtgggagaccgcaaggccctcttccgcatcctggagaagttggtgaagcgcatgagcgccccggccacgcccacgccgcgtgagcgcgcgggctga

SEQ ID NO: 5299 - DNA, 273 bp, Myxococcus xanthus
atgcagggggcgacagagactctccaggccgccgcgacgacgaacccgaagcacgtccagtggctcttgagccgccgcttcccggagctgtacggccgacgcgacaacgtcgaggcgaagagtcccgaggaccaggctgccgacactgccgcgcttcgcgagctgctgattgaccggctcgggaagttcctcccggacgagctgcccgcgtccgtccctgccgaagctgccccgtccgagcagttcgaagacaagggggcgagcgatgcgtag

SEQ ID NO: 5300 - DNA, 1191 bp, Myxococcus xanthus
atggccgggcgcggcttcgggaagacgtggtgcggcgcgcgctgggtcatcaaaaaggcgtggcaggcgaagagcgtcggggccctcatcggcccgactgcggcggacgtgcgcgacacgatgattcgcggcgcgtccggcatcctcgccctgtcgcccccctggtttacccccaagtacgagcccagcaagcgccgggtgacgtggcccaacggcgtctatgccatctgctactcggcggataagcccgaccggctgcgcggcccgaatgccgggtggggctggggggacgaacccgcttcgtggaaacacgacatggcggccgtcgatcagctcccgctcgtgttgcgcatcggctcgcgagaggacccgccgcagcttctgctcaccgggacgccgcgcccgctgaagaagattgaagagctgctcttcgccaacgcggagacgcaggaactcaagccgggcgtggtgcttcgaacgggctcttcgctgagcaacttcgcgaacctggcgccgtcggccgtggcgaacatgcgggcgctggcgaacacccgctggggacagcaagaggttctaggccgcctgctcttcgacgtgcccggggcaatttttggctcggcgaagtggggccgcgtggaggccgacgcgcacgagtatgcccagcagttggacaggcgcatcgtcagcgtggacccgagccccacgagcgaaaccggctcggacgaaacgggcatcatcgtccaggggtgcaagtcgagcgcgctcttcggtgccgacggagtgccgctcaagcgcgtctctgtgctggcggacctgtcgcgccgagcgagcccccgtgagtgggcgacgacggccatccgggcctatctcgaatggggatgtgacgcgctcgtcgtcgaagtgaacacgggcggggagatggtggaaacgctcatcagcaccgtcgcgggcgagatgggcgtcagtgtcaacgtgaagccggtgcgggcgacgagcgcgaagagcaagcgcgctgagccggtgtccgccctggccgaagcgggccgcgtcgagttcgtcgggacgttcccgaagctcgaagcgcagctcagcaagttcaccggcatcaacgggcgtcgcgacgacagggccgacgccttctgttggggcgttcatgacttggtcttcgtcgaacagttcttcgcggtgtga

SEQ ID NO: 5301 - DNA, 963 bp, Myxococcus xanthus
atgcgcgccgcgtttcgcgggagcagcaagcgcaagggaacggggctggagctgagccgctgggcttcggccccgccgcgtcgcgaggtgcccgcgctgctcgcggcctacgccgagatgccgtggctgggaaccatcgtcgatacggtgggcgatgccttcgcggacgtgacgtggcgggccttcacccggcaggacccaacgacgcggaagtcgctggtcgacgtgtcgctgcggcgggcctgtggcgacgtgcgccgggagcggttgaagtcgctcgtcgagacgggggacgcggtggagctgcccgaccatccgctgctgcggctgctggcggacccgaacgactacatgacgggccgcgacttcgcgaagctcttctgtctgcactatgacttgacgggcgagttcttcgctgtcgtcgaagagctggcgggcgtgcccgtaggcctgtggccggtgccgcccgattgcgtcctcgcgctgccggacctgagcaagccgaagtcggagcgcacttacacggtggccgctggcgggcggacattcctcctgcctgcggcgagcgtcatctacgtgaagcgattgaatccggctgacccgcttggccgcggtatcggcatcgcctactcgctgggcgacgaagtcgacacggacgagcacgcggcgcgcttcacgaagaacgccttcttcaacaacatgcttccgggcgccgtcatcgcgattgagggcttcaacgagtcgcaggccgggcccgcgagggccttcaaagagtcgctcgcgcgtgagtccgggggccccggcaacgcaggacgggtgacgattacgagcggccggacaaccgtttgctccggctcgacacgccctttggcgacatgcatcgtcgaccacactgctccgcttcctcatggacattcgtgcggatggtgtaccgggtgccgccggagattgtgggcgacgtga

SEQ ID NO: 5302 - DNA, 411 bp, Myxococcus xanthus
atggtgtaccgggtgccgccggagattgtgggcgacgtgacgagcagcaataaggcgaccagctacgcggcgcgagagcaccttgccgaacaggcgacgaagccgcgcgccgaagtctttctcgcgtcgatgcagaagcacctggcaccccgcttcgaagacgacgtgcttctctcctacgactcccccgtgcctgccgaccgtgagcaccggctgcgggtgatggggacgctcccgagcgccttcaccttcgacgagtggcgagtcgaagcgggcttcaagcctcacccggagcggcaaggtttcgcggagctgcttccgggtcagaagcccaacgagcccggcgagacgccgacgcccgtcgaaggcagctcggcggaagcgcatgccgaggcgacgaaggacggctga

SEQ ID NO: 5303 - DNA, 501 bp, Myxococcus xanthus
atggtggacatcgaattcgacgacgaagacgagttcgcgaagaaggtcgaacgcaaagtttcaaagggcatcctgaatgccgtctccgtccgctacctcatgctccctggccagtaccggcagaacgagcggggcggctacgactgcgacgcgcaagagttgctcgaagtctccgtcgtgacgattccggggaactcgcgggccgtgcgctcgaagtccctggacgaagcgcccgaagacatcgtcgagcggattgccgcgcgcgttgtcgagttgctcgacgcgcgggccgaagtgaagtcgacggacgaggacgagcagaagagcgagcccgacgaagaagacatcgaggacgaagcgaagtcgacggacgaggaagacgtcgaggacgagcagaagagcgagcccgacgaggacgagacgaagggtttcaacgccgccgacgccgcgaagagcttcgtcgaggcattcaagggctacatccggggagtgaaggaatga

SEQ ID NO: 5304 - DNA, 1065 bp, Myxococcus xanthus
atggtgaaggcgctcggccccgaggtcgcgcgcgagctgatggacgccgccgctcgaagtgccccgggccgggctgagccgggcaacgcgccgcgcgggactggcgtctacgcgagcgcggagaacttcggcggcttcgcgaagagcgtcatcgcggccggacgccgcaccggagccggcgagttggtcgacgccgcgaagcgctttggcaacgccgatgtccagaaggccgttcagctcagcaagttcgactcggcgggtgtgctggtgcccatccagcagagcggcgaagtgattgagttcctgcggcccgacgcggcgatgctcaagctgggcgtgcgaacccagacgttcaagggggagctgcacatgggcaagcaaaccgggacgtccgtcttcaagtgggtaggggagggcgagacggtcccgaagagcgcgccgaagtacgggaagattgtcctcaaggcgcacaagggcatggtgctgaccgacatcagcaacgacttgctgcgcacgccgggcgtgggtgacgcgggcgtcggcgaggacatccgggcgacggtggccgatggcctggacgacgcgggcttcaacggggacgggacgggcgccgcgccgaaggggctcttcgctcagctcgacgccgctcacaccttcgcttccactgggacgacggcagccgcctacctgtccgacgtcgacaaggccgttgagctgccgctgacggcgcatgtccgcatgggcaacgcggcgtgggtgcttcacccgacgcgggcgacggcgctgcttcagcttcagaattccggcgtctgggtgttccggcaggaaatgctcgaccgggggacgattcgcggcttccccttcgtgatgacgacccgcgtgccggtgtcgcgcatcaccttctcggcggactggcgccagttcatctacggcatcgacgaggacttgattctgtccgagcacgacgttcgcgccgagtacgacgagacgaccgtgcgcgccatcgtgaagggcgacttcaaggttcgccagccgaaggcgttcagctccatcacctacacctga

SEQ ID NO: 5305 - DNA, 1005 bp, Myxococcus xanthus
ctggccctctgcggcaaccagaacgaaaacctcaagttgatggagcggcgcctcggagtccgggtgggacaacgcggcaccgagttccatctctccggcccgtccgacgccgtcgccttctccgtccgcctcctggagaacctggaggagatgatccgcgccggccgtcccgtctaccgggaggacgtggagcagggcatcaaggtgctcggccgcggcgcggagtccttgcaggaggtcatgctgggcccggtgctcaagagctccggcaaccggcagatctcccccaagagcatcaaccagaagcgctacgtggacgccatccgctcccacgacatcgtcttcggcatcggccccgcgggcacgggcaagacgtacctcgccatggccatggcggtcgccttcctccaggagcgcaaggtcaagcgcatcatcctggcgcgccccgcggtggaggcgggtgagaagctgggcttcctgccaggagacctgcaggagaaggtgaatccctacctgcggccgctctacgacgcgctgcacgacatgatggcggccgagcgcgccgcgcagctgctggagcagggcgtggtggaagtggccccgctggccttcatgcgtggccgcacgctcaacgacgcgttcgtcatcctggacgaagcccagaacacgacggtggaacagatgaagatgttcctcacgcgcctgggctacaacagcaaggccgtcatcaccggtgacgtgacgcaggtggacctgcccacggggaagatgtccgggttgaaccatgcgcgcgcggtgctgaagaacatcgacggcattcacttcgcggagttctcggaggtggacgtcgttcgccaccccctggtccaggaagtcatccgcgcctacgaccgggcggacgtcgcccagcgcgaagcccaggcggcccgggaagcagcaaccgctgccgcccatgcgcccgccgcgacgccggccaccgccaccgagcccgttgccgtcgagtga

SEQ ID NO: 5306 - DNA, 414 bp, Myxococcus xanthus
atgaacgccaattccaccgacgcgggcgtgctcgtcggcatccgccctgggactgtgcccgctgctgtgagcgtggggacgcggaacagcgccgccgtcgaccgcttcggcttcgactcgtgcgtgctgacggctttgacggggaccgccactggtgccccgacggcgctgtcgctggccgcgaagctccaggagagcgccgacggccagaacggatggacggacctgcctgatgccgcagtcgtccccctcactgcccccaacgcggtggcccggctcaatgtccggctgcccactgcgcagagctacctccgagtcgtggagacggtggccctcacggggggcacatctcccaccctgggcgcgtccagcctgattgtcctgtgcgggccggacgagattcccgccacctag

SEQ ID NO: 5307 - DNA, 297 bp, Myxococcus xanthus
atgcggcaggggcgccccgatgcgctggccgtgacgtacacgggcggctacgtgacgccggggcaagtggccctcgacgcgtcccaggggcccgttaccctgcccgccgaagtggaagaggccgccatcctcgaagcctgcgcgctctaccggggccggggccgggatgcggacgtgtccagcgagagtctcggcgattggtccgtgagctaccgggagcggagcgcgggccagcgccttgcgagcccccgcgccgagctgctcgtagcgcctcacgtcctgtggagggccagttga

SEQ ID NO: 5308 - DNA, 420 bp, Myxococcus xanthus
atggcccgcgacactgctgccgacctcgcgacgattctcgccggtgggggcctcaacctgagcgccggggccaacctgtttctcggcccgacgctcgaagacgacgacgccaccgtgccggacgttgcgtgcttcgtgttgcaaaccggaggggagccgccgcagagctacatcggcgggggacgcaagacgtaccggactgtcacctgtcaggtccgcgtgcgctccgcccgtgagcgcttccgggagggacaggcgctcgcgctcgcggccctcgacgtgctccacctcgcgagcgccgcgccctacgtgctgattgaggtggacgaaggcagccccaactacatcggcaccgatggaagcgaccgccactggtggaccttcaccgtggatgcctccttcatcgacctgggcgcgtga

SEQ ID NO: 5309 - DNA, 96 bp, Myxococcus xanthus
atggtcgtcaacagctacgacgagaagctgaccccgggtggcgtcgtggagttcacctgcaagcttttgggcaatggcgccccggtggccgtctga

SEQ ID NO: 5310 - DNA, 582 bp, Myxococcus xanthus
atgcccgcgcccgacttcacggggaccgagtttcgaatcgcggaccccgagcttcgccgactcaatccgggagcgcccgtgttcgtcgaggtttcccccagcggggatgccgacgcctggacacctgctgacgcctacgtcgacccgctcttcggcgacgtccacctcgccagcgctcccggcccgtcggccctcgtgcgcgtctcgggctacgcgttgcccgtccatccgctcgccctggtgcgctccatctccctcacggtgacgaacgacgtcgtcgagctgcaagtcatgggggacgcctacaagcggcgttcggtgtcgctccgggacttctcgggggagctgacggggctggccctcacggagctcgaggttgaagcgctggctgaagggattccgctgctcatcgaagttggcaaggcatccggggctcaagtcttccgcgcgtgggtcaaggtgcctgagctgtctcacaagctgacgcccggggccctgtacgagcacacgatgaagttcctcggcttcgccttccagtccgaggacggcgccgctttcgcctggggctacggctcgccctga

SEQ ID NO: 5311 - DNA, 354 bp, Myxococcus xanthus
atgtcgaacaagcacaagctgcttgcgaagaatcgtcgcgtcctgaagtcggtggaggtggacggcgtcaaggtgaacatcatcaagccgacgatgggggacaggctgcggctgattgagcaggcccgcgaggctggcgagatgacggagaagaacgagccgacgggggaccgggccggagcgcggatgctggggcgcatcgccgtctgcgtgcttcacgatgcggagacgggccgcccgatgttctccgtcaacgacatcgacgagctgctcgatgagtcgtggcttgaagacctcgcgacggacctgaccgacgccttcaacgtcagcgaagagaagatgcggggaaaatag

SEQ ID NO: 5312 - DNA, 2004 bp, Myxococcus xanthus
atgctggtatgggggactgcggcggcgctcgcgggtggcgcgctggggactgccgctggcgtcgttaagagcactgccgaaattgtgggtacggttgtcgcccctgcgctggacggcgcgggaaaggccgtcgtgcgcttctccggcttcgtccgtggggagactcccgttgttgagggcaacctgaagaaagtcgcgaagggggctgagcaggtcgacgcgagctttgctgcggccttccgcaatgccgccgcgcgaatcctcgtggtggcggcgcctctggccgctgtcgcgctcgccgttgcaggcgtcgtgcttctggcgggcacgctttacaaggcgtggaacgacgcgagcaccggcatgcgcgatgcgttcgtgtctgcttggcggggcgtcaccgaagtcgctgggcgcgcggtggccttcttccgggaactcttcacggggcttggggccattgtcgggacgtgggcacgcgggcagctcgaaacgttcgccttcgtcgtgcgcaacctggcacgcatggcggcgcctctcgcccgcgcgctcaacctcgacggcgtcgcggcctcgctcgaagggttgaaggacctgaacggcgacgcgcttctcggcgggctgaaggggttcgccgacggcgcactcggcaagttgaaggacggcttcgcttccgtttgggcggacgtctcctatggcgcgggctacgccttcgatggcgtgaagctgatcggcggtgacgctgcggcattcctccgtgagaagttcggcggcgtcttcgacgacatgctcagcgggccgaagggcaagctgcgcacgccgtccgctggaccggaaatcgaagcgggccgcgtccagattgggaacttcaacgcgaaggagttcctgacgagcgtcggcaacgtcgcggccgtcattgagcaggtggcccggaagaaggcgaaggaactcgcggacgcgctggctcgcgctgtcgacgaagcgaagcgcacccttacgagccgcttcacgcaggccctgggcgggctctacgagctgttcgagcgcttcgagcaagggatgctcgtggggggcgtgtggggcggcgtcatcgccgtggtcgccgagctgctcgcgcaaagctcgacgttcgccacgctgattcagatgacggcgggcttcatccagttcgttgccgatgccctcggacgcgtgctggcccccgtgctgccgctcctcgcgtccgccttcaacatggtggcgccgctgctcgacgccatcgtgccggtgctcgaaatgctgctcgcgccgctccaggcgattgccccggtgctggaggtgcttggcacgctcttccagggactcgccccgctcatcagcgtgttgggacagattctcgtcgcgctgactcagccgctggcgttgctcgcgggccccatcatgaaggcgttcttcgccgtcgtgcgaatcgtggcgatggggattctctacgtcgtgaagggcgtcggcacggtgtggaacggcatcatcggtttcattgccggggtcttccgtgcgctcagcaagattccggttgtcggtggcgccttcgagaagatggcgcggggactcgacagcatgaaagtcccgatggaccaagtcgacggggcgttgaacacgctgcgagatacgacttacgagtcagccgccgcgaactcagccgccgctgtcgctcagtgggagaacgccaacgccacgaagaaggcaaccgaggcgctcagcaacgttccttccggcttcaaggtggcgctcgcacggttcaacgcacaggacccgattactgggcagtcacaaactgtgcatggcgcatcgcccgttacgtcgagccctgctgtccctgtgagtggcggcaacgtcagcgttgggcagattgtgattcaggcggcgcacgaccccgctgagacagcacgtcaggtctacatcgaaatgaagcgcgaagcgggccgacgtcgcggcaacggcgagtggctgaacgggagatattga

SEQ ID NO: 5313 - DNA, 210 bp, Myxococcus xanthus
atggctccggactcgtgggttccggaggtggccgcgtggcactcggctcgtgcctggagcgcgttgccgtacctgtcggcgggcggggccttttcggtcggtgagacgaaggtgcttggcgaagtgcgggacggcgagttcgtcgaattcatccaccaaggggcgcgcgtcatcggcgagcgactcgaattcaccttgcgagaggtttag

SEQ ID NO: 5314 - DNA, 2916 bp, Myxococcus xanthus
atgtcgcccagcgagagtgagtggcagacgctgtttcatggcgacatcgacgaagtcgacttcgcaggcgaacagctcgtcttccgtgggcgtgacttgggcggccggctccaggacacgttcattgaagttgagcgcgcctatggtgacgatgcgcagggcgttgccgtggaggtggtgatgcaggccatcctgacggacaacgggacgggcgtgctgctccataccccagtgtccccaggatggaggcttcgtcagtacgcgcagaagaaggcgagtgttctcgatgccgttcgcgacctggctcaacagattggctgggaggcgcgctatcgctggcgcgagtcgagcgggacattcgctttgacgtactccgagcccactcgcacgaatccacccctggcgtgggcctttggtccggacgactaccgcgacgttgcgaagctcgtcgtcagcaggacggacgtccgcaacagggtggaggtcgtcttctcggacgcgggcgacttggacgtcgcggggcacgcgaagacgaagagtgtcgtcgtcgaggatgccgcgagtcaggccgcttacggcgtgcggtacatgcagattgccgaggatgcttcgagcaacatcgaccgcgaagttgaagcgcggaggatggcggaagcggccctgtccgacttgtgcgagccgctcgccgaccaggaaatcgacctcgacttcttcctgccggtggagctgggcgacctctttcggtttcaccccaacggcgttcactactcggacgcgcagaacctggcagtcaccgggttccgccacgtcttcacggcagagggcgacgcacgcacgacgcttacaacgcgcgggaagccctccttcggcgtctccatgtggctggagatggacacgcgtcccggcctgggcgagcccgcgcacacgtccccgccgcttgtcccactcgacatcaacgtgacggccgtggtgaacggcttctcgctgtccctcaccccggcttcgagtggcccagttgcgtcggggtacgagctgcacgtttcgacgtcgagcggctttacgccgagcagctccaccctgcgcgggactttcgacacgacggcattcggtgtggctgacctgatgccgggggcgacctactacgtgcgcgtggtgcccagggatagctacggcaaccggggggacccatcgccccaattcaccgtcacgccgaagcagctcgaaggcgcgtcgctgagcgactccgcagtcggtttccagcacctgctgtacccgcccaccgacaacctcattccgaacggctacaacgaagcgggcattcgcgccgtggggaagtctcccgacggtgacaggcttgtcgaggaccctgtgaatgcccgggttggccgctgggtgcgccgggtggagctggcgaacacgggggcatggccggggctgagctggacgggcgggtatggctcggatgtcccaggcgggcggctcaagtgctcccctggagacgagttcttcgccgaggtttacgtcaaggcgtcctcagcgactgtggggggcatgggaacccttcatttgctgtgggaggacgggagcggcgtctacgcgggccagaatacgggcgtctttctggggcaggtgggaacgacgtaccggcgtgtcaccgtgaaggggacgtgcccagccggttgcacgggggttcagctcttctgggaaacccaggtggcggcggcggacgtgggcaagcggctctacttcgatgccgtctccatgcggaagatggtcaccttcgacttgctcgcggcgaacaccctcaagacgtccaactacgccgaggacggcagcggcatccctacggccggggcgaagctcgacaacgtaggaacgacgctcaaggtggcctcgaacaacgtccaggtggggcgctactacctgagcgacggcttcttccgttccgtgcaagccctcgcggacacgggaagccgcatctactaccgaggcaacaacgagggcgtgccgaacatcgaccggctcaacatccaggtgattgagggttactccattgccggggctgctggtggagcggcgaacttcacctgggcgcactaccatgccgtcatccagccccaggcggtgagcgacaacctggatgcgctgcgcttcctggaggtgggtttctactgggcgtatagcgacagcaacgcgccccagtggctttacgggacgtcggtgccgctggccgaccgcaagtatcagaacggcgcggtcgacggcgacgccagcaacgcgacgagcgcgggcttcaccttcatgtatggcgacaggttcaaccggctgcgggactcgctttcgaacaggatgctttacctgaaggtgcggcttcacaatgcaagcggctacagcgccgagcggtggttcttccctccgagcagctacaacgtcaacatggtgaggagtgcgacagggcccgcgtcaacgcccactggcggcggtggaggtggcgggggctcgcacggaacctgtgtcgcgccgtgggagccggtgttgctcagcgatggttcggaagtgcctgccgagatgctccggcctgggatgaaggtgctcaccatgcacgagcacgagagagacggcggcatcttcgaggtgacgcacgtcagcaggcatcaggcggcgcgttgcacgctcacgatgacggatgggcgcgctgtcgtcgtgacgccggaccatcgctggcggacgttcgagcgcggatggattcgcaccgacgaactgcgccccggagagaccatcgatggtgtcgctccggggcgagtggcgcgcgttgagccttcggcggctggcgacgtgatgaagatctccgttcggttcgcgaagacctacgttgtgcagggactacttgcccataatctgaagccgagagactaa

SEQ ID NO: 5315 - DNA, 534 bp, Myxococcus xanthus
atgacccgggccaacttccatcgcgtcgaccttgaccgtgtcttcctgccattcgtcgccgtgtccctagaggtcatcacgcgctgtgcggctcggggcgtccgctacgtcgcgacccacggcttccgtgacctgccggagcaggcagagctgcgtcggctgtacgtggcgggcaagggcggcaaggcatcgcccgcaggcctgtccgcgcacaactacggcctcgccttcgacttcgtctgtgacgcgagcccgcgacctggcgtgcagccggattggcgcgagtcggcttaccgcgtgctgggtgacgaatccacgaaggcgggactcgtctggggcggcaggttcggcgactccccccatgtgcagtggccgggctacgtgagcgcgcttcagctcacgccgcttcgtaccctggtccagcagagttccctcgccgacgtgtgggctcgcctcgatgccgagcgcctgtcgccgaagtggcgtgcagcaaacccgaagctcgcggccgaactggagcggctgggcttctaa

SEQ ID NO: 5316 - DNA, 2454 bp, Myxococcus xanthus
ctcgccgaacgcctcggactggacaacggcgtctgggggcggcgcgccatccaggtccttctcctgctcgccgtctccattggcgcgggcttcgtcatctcaccaggtctctacagtcagcagattccggcgctggcggaggagaacctcggcaagccgttccgagccagctcgcccgccggcttcaaggccgcgcgggactacgagatcgtccaccgcgccatgacgcagcagcggcgccaggaagcgcgcgcggccgtcaaaccggtgtacgacctgaaccccgccgtcctggggcagctgcggtcgacggtaagttccgccttcgcgtccatgcggctgcatctggacgagctcacggaggcgcagtccgattcggaacccgaggagcgcgaaacgccccgccggcgcaagcccgcagcgtccccggagatgctggagctggagcgcagcacccgcgagaagatgcgggcggagctccaggagcgcttcttcggcaagcgcgacgccgtgctggaggccgaggacttccaggcgctctatgccacccgcttctcgcaggaggcggagacggccacgctgctggtactggagcgggcgtatcgctccgagcgcggcgcgatccatgtggcgggctctcgggaggagctggcgcgggaggcgcatcagggcctcaccgtccgcgacgtggtgaacaaggccgaggagtccctgtcggggggctccacccaggtggtggacgtccccgaggcgcaccaggagatggagcgcttcgcctcggtgcccggtaacctgatgccggacgcgccgggcgttcagcgccgcgccatcctccggctggcccagcggctggttcggccgaacctcaccatcaacatcgcggagtcggacgcgcgccggaaccaggcggcccaggcggtgaaggacgccgtcatctccatcaagaagggccagcgcgtcattggcgacggtgagctggtcaatgagtcgcacctggtcatcctgcgcggcatgcgcgcggagacggaccggctggacctggtccagctccaggtgggcggcacgggcctggtgggccttctcatcgtctcgacgtacttcttctgccgcgccgcgttccggcgcttccgtcccacgcgcaaggacggcgtactgctgggactgctgctgctgggcctattgggcctgctgcaaatctgggtgtccatcgcggacgcggtgcaggaccgctacaccgcgctgcccatcgaggccttctattacgccttcccggtggcggccggcgccatgctggtgcgcttcatcctcacgcaggagctggcgctcttcttcgcgctcgtcttcgcctgtctcaccggagtgatgctgggcaactcgctggccttcggcgtcttcacgctggtgggttcgctggtggcggccgaccgcatcgtgaaggcgaaggaccgcgtgggcatcttccgcgcgggtctggtgacgggcgcggtgaatctggtggcggtgctcttcctcttcctcgtggaaggcaagggcctgtcggccgacaccctcatcaccgcggtgagcgccttcgcgggctcttcgctggcggtgccggtgatggtgatggcgctcacgccactcatcgaggccaccttcggctacgcgtcagacatcaagctgctggagctggccaacctgaaccacccggcgctcaaggagctcatcgtccaggcgcccggcacgtaccaccactccatcatcatcggctcgctggtggagaacgcggcggagacgattggggccaacccgctgctggcgcgctcgtgtgcgtactaccacgacatcggcaagggccggaatccgctctacttcggggagaaccagaagggtgagaaccgccatgacgcgctcgcgccggcgatgagcgccggcatgatcaatccccacctgaccgacgtgctggagatggcccgtcagtaccggctgcacaacctggtggaggatgcgatttcgaactacctcggcacgcgcacgggggggtacttctaccacaaggacttgaaggagcaggaggtcaaggaaggtgctccgcccatcgacgagagcatctaccgctacccggggccgaagccgcagttccgcgaggcggcgctggtgatgatcgccgacgcggtggaggcctccacgcgctccatgacggaccccaccacgcccaagctcctcgcgcaggtgcagaagatcatcaacctcatcttctccgagggtcagctcgacgagtgtgacctgacgctgaaggacctcaacctcatctcgcagtccttcctgcacacgctcgagggtatctaccacacgcgtccggcctacccggcgggcgccgtgggtgggggcaaggcgccgccgttggtggtggcgggcgcggtgcctcggcccgcggaaggcaaggacaaggcgcggaccgcggggggcacatga

SEQ ID NO: 5317 - DNA, 186 bp, Myxococcus xanthus
atgctgaccgcgctgcaagtcgccctgacggctgctggtggcttcaccatcatcaagcggattctgttcgggagcgccgccatggcccgcgctgagctggcgggggcgcttgccgctgggcaggtcgcggagaaggccgcagcgattgccgtgctggaacagctcgactcccggggcggcaagtga

SEQ ID NO: 5318 - DNA, 81 bp, Myxococcus xanthus
atgccgatcatcgttgacgaagagatcaaggatgccctcgaagcgaacggcatcttcggcggcaagttcgaggaggtctga

SEQ ID NO: 5319 - DNA, 3050 bp, Myxococcus xanthus
tggcgtgtcatcagggagcttgggaacggtggttttgcagtcgttttcctagttgagaaacacggccgcagaagtgcgctcaaggtggcgcgccaccgagattcaagcggggacgaaaagcaaactcacgcaaggacgctccgggagctagcggcgctccttctcctggaccatccgaacatcgtcaagcatcgtgggtatgggtactccgagcatgggaacgtctatctcgcgcttgaatatattgatggttggacgctagcggagtgggcggaacgaaaacaccccacggtgcgggaggtcttgcaagtcttcgacaagctttgctccgcactgtcatacatgcacagtcgcggcgtcctgcatcgggatttgaagctgtccaacgttctgattcgaaagagcgatggagagccaatcatcatcgactttagttgtgcgaactactcattggccgaagagcttacggatgcgggcttgcccccaggcacggaccgctttcgcgcgcctgagcaattccaatggctccgagagcacaaggcggagcaccgcgcgaagtacgcctttcaagtcgcggacgagattttcgcgattggtgcgatgctctatgagttgctgaccgacccccgcccgaccgagattcaagcgcgcttttcgctcaacagtacagtcgcattgcccccgcccgcgcgtgcgttgaacgtgcgcgtgccggaagcgttgaacgacctcgtcgcgagcgtcctatcgcgggaccctgcaaagcgccccgtcgacaccgaggcactacgtcgcgaactaggcgaactcctggcctattcgagcgcggagtacctgaccccggtgcatccaccgtccgagcagcggcaggaggaaccatctgaacagcgggtgcccccagttgcggacccaagccttcctggggcgcctacgcgttctgtccggggatggcgcgggctcctagggggcctagcggccctcatcgtgctcgtcgtggcagggggcttctggctcagccagggggaacctccgcagccacgagagccgcaggttgctagtgcgccaccggctcctagttccccacattccgcgccgctcacatcggccgcccctgctatgtcaccagttagccccccgcctgtgccatcgacgggcctcgcgactgccgcaccgaaggaaggttcaaccgtgaagacgactccgtcacccgaggtcccaccccaaggccgccagccacgcggtagggcgaaggccaccgctgttgccgactgcgcgacgatgacgctcgttgcggcgctcgcggcgggctgccccggagcccagatgcgtcccgagtcgttcacctgcccggctgatgcggaagaggtaatgcgggaggatcttcgttggagggtgaaccagcgtttcgtgctcaccttaaatgcccggcatggcccggacgatgacgtgtggttcacggctggttcggaagtggtgggagtggttccgaagggcgtcccctcggaccagcgagcggttaccccaccagggacacgcttctacggcaaggcttacttcctatcggaccgaatgggccgctcggaggggcctgcattggtcatccgctatgaccgcgtgaagctgccggggcaggatgaacgtcccatctgcttcgtcgtcgagtctcactctgaggtttacgaagacggtcgggtgaagtcgtacaattcgggagggggttacgtcgttgaccgctggccctgagatcccggacaggacgtaataggtaggaggccgaaattgggccgaccaagccgttttgtcctggtgacctgtgaaggcgttccctcggctggatgcggcaggtagcttcctttgccgcgttggtcgcgagtctgcgcacgaggggaaacggcatgtcgcaagcaatcgagttcaagatcccgccaggggcgattctcttctcggcggatggcgtcggctacgagttccgcgaggacttggggccgacgcaccatgggatgtccctcttcgtggcgcggcttcgaaactcctcgggggagcctcggggaaaggtgctgctgaaggcggtccctgcgccatcggtgaaggagggggggcgggttcggcgggcacgagcaaagcttgatgagcaggttcgtcttgccacctccctcgcgcacccggcaatcctcaaggttcacgggctccacaaggtagagggctactggtacgtcagcgctgagcatccatccgggaactccctgaatgagttgctgacgctcgcggtcgagtgccgtcgatggttctcgcccctcttcgtgatgttcgtaggctcgcaggtggcggcagctcttgagcacgcgcacacggcgaaggatgccagcggacgcccattgaacatcgttcaccgagccatcgacgtcgcgcacatcttcatcgactgggacgggacggttcggctcggcgacttcggtctcgcgctgtccaacttgccggggcgcgtggcttcctctgttcgcggcccgcgaggagactacttctattcgtcgcctgagatgctgcttggcgggcccgtagacgcgcgctcggacctcttcatgttgggggtggtgctgctcgaaatggcgacgggaaagaatctgctcttccacccggacgacatcacgcaaaaggtcatgggctctttgtctgtgaagagtcgtcggcgagtcattcaggccatcaagcgggccacgctggccggggcgtcacccatggtggaggacgcgatttggcgtgccgcgacgctgacggatgcggacgtggacgcgatgacggaggggcttccccaggggcttcgcgtgacgctgaaccggcttcttcgggtctcccctcgcgagcgctaccagtccgccggagagctggccaaagacctagcgggctgggttgggggcaccttcacgaaggctgatgccgctgcggaactcagggcgcgtgcagctcaggcagaagagatgttggatgcgctggggctcacgccgcctcgcggtcgcggcaagcgccacccggatgacgtgacgacgtcctga

SEQ ID NO: 5320 - DNA, 669 bp, Myxococcus xanthus
atgacgacgtcctgcgccttcttgtccaccagcaggttgccgatgcggtgcgccagcgccttggcggccgggttctccgcggggcccaccttctggggcggggcaactgggagcttcgccttcttcttcttcgcgggggccttggcggccgccttggcgggggccttcgccgccgacttcttggctgcggggaccttcttcttcgcgggcgtcttgcccgataccgtcttcttccgggccgccggggcccgggtggtggtctttttcgcggtcgtcttcttcttcgtggccatgtgcggtgcaccctaccgcacccttggcaacacggaagcggccctctatctgttggtgtccatgagcgacgcccggctggaacagttcaagaagatggtggtggacttcccggactcccccatgagccatttctcccttgggaagctgtacctggagcggcggcagtaccccgaggccgcccaagccctggagtcggccgtccggctggaccccacctatgcggccgccatggtggccctgggggatgcctgggccggggcgggggagtccgacaaggcgcgcgaggtgctgggccgggcccgggagcacgccctggcccaggggcacccggggctcgccgaggaaatcgacgagcgcatcgccgacctgtcgtag

SEQ ID NO: 5321 - DNA, 1734 bp, Myxococcus xanthus
atgctcggactccccgccgacccggcaacgaaggacctggcgcgcatctactacctgccagatgcgcccgtgggtgcggagccctacacggccagtggagacggagcgcccctcgacgtcgacgcgctgctcgccatgtcccgggctggactccccacggtggcagccccggtgccttccccgaagcccgaggaacccgccgacctgtacgagctgcgggccctcttgcgtcgcatccgcaagcccgagcacctcgccatcgtccgccgcgcccttgccggtgagcccctggctgccgtcggcgagcaggacacgacgctgaacacgctcatgtcatgcgccgcctttgtcttgccgctgtccacgcccgaggccgtcgtcatcgagctgttccgcgcgtccttcgcggccacggactggcgcgagggcaccgaacacctgtgcgagcaggccgtcctcaagctgcggcgccaccgcgagcggaggaaggcgcgggatgcctcacggctcgcggacaacacggccatttgggaaaccctgggcagtcacgcacctgaatccgcggcgagcgacggcccgggaatcgaggaggacgctcccgaccccgacgcgtggatgaaggaactcttcctcgacatcacgaaggacacccgacggcagattcgaaattgcgaagcgaacgtcgccatcgtgctcagcaagtcgcccgagtggcgcggcgtcttccgtttcaacgaagtcacgaagaagttggaggtggagggcggccccctcggccccagcgtggacattgagacgctcgacgtcctggtagctaactggattcagctcagcaagtacgggcggcttgggctgatgccgaaggcgcacgtcgtcgcgcagcagatcctcgccgtcgcgaagcgcaacagctatgacccggtcgccgactacctgggaggactggtctgggatggaacgccacgcctcgacgggatgctcgcgacatacttcggcgcgcaaggggatgctcgatacctccaggccgtcggcgcgaagttcgccatctcagcggttgcgcgtgccctgcgtcccggatgcaaggtcgacacggtcatgattttggaggggccccagggcctgcggaagtcgacggcgttcagcatcttgggaggtcggcacttcagcgacgcgcccatcgacgtcaccagcagggacagcgccatgctggcctctcagttctggttcatcgaactggccgagctgagcaccttccggaagtcggaggaccaggcgctcaaggcgttcatcacccggacggaggacacctaccggccgccctacggacgctccaacgtgcaggccccgcgccgctgcgtcttcgtcggcacaaccaacgatgacgactacctgcgcgaccccacgggacagaggcgcttctggccggtgaagtgctcccgcatcgacaccgacgccctcaagcgcgaccgcgaccaaatctgggccgaagccgtcgtgcgcttccaccagggcgaggactggtggctgagcaacgaggaggcggcaggggccgagcagcaggccgcgctgcgcatggagaacgtgggggacagccggaaggaagtcatcctgcggtggattctggagatgccacccgaaaagcgaccctcggacgtgacacttctccatgtgggcatcgaagcctttgcgctccacccagcccaggttgaccaccggatctcacgggaaaatcgc

SEQ ID NO: 5322 - DNA, 1542 bp, Myxococcus xanthus
atgacgcccgcgcacaaggtcctgctctgcatcctggatggttggggtattcgccaggagcgtgacaacaacgccatcgtcctggccggcacgccgcacctcgacaagctggcgagcccctaccccttcaccgagctgcagacggcgggtctggccgtgggcctgcccgaggggcagatgggcaactccgaggtgggccacaccaacatcggcgccgggcgaatcgtctaccaggacctggtgcgcatcaatcgcgccgcggagtccggagagctggcgcagaaccccgtgcttcgcgcggccctcgacggagtgaaggcggacggcaaggccctgcacctgctggggctggtgtcgcccggcggcgtccattcctccatggaccacctgttcgcgctgctcaaggccgcgaaggaacgcaacgtggcccatgtctacgtgcacgccttcctggacgggcgtgacacgccgccgcagagcgcgctgggctacgtggaggagctggagcgcttcctccatgagacgcacaccggccgcatcgccaccgtgaccgggcgcttctacgccatggaccgcgacaagcgctgggaccgggtgcaccaggcctacgaggcgctggtgttcggccgcgggcccaaggcgccggacgcgctgagcgccatccgtgcgtcctacgcggagaaggtcaccgacgagttcgtgaagcccacggtgctggccgccggtgacggcacgccggtgggccgcatccaggatggcgatgcggtgatcttcttcaacttccgcgcagaccgggcgcgggagctgacgcaggccctggcgttcccggagttcaaggagttcgaccggggcgggctgcggctggggcgctacgtgtgcatgacccagtacgacgagaccttcaagctgccggcgctcttcgagccggaccagccgcaggacatcttcccggagctgctgtcacgccaggggctgcgccagttccgcacggcggagacggagaagtacgcgcacgtcacgttcttcttcaacggcggccgcgaggtcgtctacgcgggcgaggaccggcacctggtgcccagcccgcgcgacgtgaagacgtacgacttgaagccggagatgtccgcctacgaagtcacggccgagttggtgaagcggctcgactccgggaagtacgacttcgcgctggtgaacttcgccaacccggacatggtgggccacagcgggcggctggacgcggcgatgaaggcggtgaaggcggtggatgaatgcctgggcgcgctgggcaaggcgtgcgagcgcaacggctgggtgctggccatctccgccgaccacggcaactgcgagcagatggtggacctggagacgggcgagccccacaccgcgcacacgctcaacccggtgcccttccacctcatccacccggacttccgcgggcagaagctgcgcccgggcatcctcgcggacatcgcgcccaccctgtgcaaggtgatgggattgccgcagtccaaggagatgaaccgccagggcctgctgccgtga

SEQ ID NO: 5323 - DNA, 732 bp, Myxococcus xanthus
atgacctatctggcgcgaagcctccccggcgccatcgtgaaggacactcccgggctgctgctcgtcgactccgggttgccctgcaacaccttcaacgtggtgtgccgggcccggctcgagcgccacgaagcggacgcgcgcatcgccgccgccgtctcccacttccgtgacaaggcctttcccttcgcatggtgggtgggaccggacgccgcgcccgaggacctggacgcccgcctgtcggcgcacggtctggtgaacgccgagcaggagttgggcatgtccatggacctctcccgcctgccaggactcgcgctgccttcggggctgtgcatccgccgcgcagaggacgaacacaccctgacggacttcgcccgcgtcgtcgcggcgaactgggagcccgccgacccacacgtgctggacttctacgcgaggacggcgcacgtggcgctcgcacccgacagccccatccgcttcttcgtgggctacctggacggcgaggcggtcgccgccagtgagtgccaccgggcgtggggggtcgcgggcctctactcggtggccaccgtgcggcacgctcggcgacgaggcattggcgcggcgctcacgctggcacccctgctggatgcccgggaggcgggctaccggacagccaccctccaggcgtccgcgcagggccagggcgtctattcccggctgggtttcgtaccccaggggaccttccgcgagtatcaatag

SEQ ID NO: 5324 - DNA, 1110 bp, Myxococcus xanthus
gcgcccgtgcgtgtcatcgcctccgcccagtcctgggtggaaggcgaggcggtgcggcaactcgaagccatggcccgcttgccaggaatgaagctggcggtgggcctcccggacctgcatcccggcaagggtgctccggtgggcgcggccttcacctccgaaggctttctctatccctatctggtcggcagtgacatcggctgtggcatgggcctgtggaacgtggacctgctggcacgtaaagccaagcccgagcgttgggcaggcaagttggacctggaaggcccgtggacaggtgacacggaaggcttcctccaggagcacggcgtgaagtcctcgggctacgaggccgcgctgggcacggtgggcggcggcaaccacttcgcggagttgcagcgggtggacgcggtccatgacgcgaaggtcttcagcgccctgggcctggaggcggaccgcttgctgctcctggtgcactccggctcgcgcggcctgggtgaagcgattctccgggcccatgtggaccggcacgcggcgggcggcctcgcggacgactcatccgaggcgcagacctacctcacgcgccatgaccacgcggtggcctggggccgggccaatcgggccctggtggcgcggcggatgctggacggcatcggcgcgatgggccagcgagtcctcgacgtgtgccacaacagtgtcacccctcggcgtgacacgggacggacgcagtggctgcaccgcaagggcgcggcgccgtccgacgaagggccggtggtgattcccggcagccgcggcgcactgagctacctggtgattccaaccggggagagccacgccagcgcgcacagcctggcgcacggcgcgggccgcaagtggacacgcacggccgcccgggaacggatgcgcgaacgcttcacggcggaatcactcacccgcaccgccttcaagagccacgtggtgtgtgagaacaaggacctcctcttcgaggaggcgccgcccgcgtacaagcccatcgaccgcgtggtgacggacctggtggaagcggggctggtccgagtggtggccaccctggcgcccgtcctcacgtacaagacgcgcgcccggccggagtag

SEQ ID NO: 5325 - DNA, 465 bp, Myxococcus xanthus
gtgaaggtccggctcctctccatcggcaaggaccgctcgggcctgtatgagcccgcggtccaggagtacgccaagcgcctgggccactacacccgcttcgagttggtggagatggcggaggccagcggcaagcggctcaagcccggcgacgcgaaggccgccgaagccgaggcgattctctccaagcgcaagccgcaggactggctggtggccctggacgagcgcggctcactgctcgactccgtcgagctgagccgctacgtcggcaaggcgcagacgggcgccaaggacctgctgttcatcattggcggggacgaagggctcgacgcgcgcgtgcgggacgcggcgaacctcacgctgtccctgtcgaagatgacgctgcctcaccggctggcgcgcgtggtgctcatcgaacagctctaccgcgcgttcaccatcctcaagggcgagccgtaccacaagtag

SEQ ID NO: 5326 - DNA, 570 bp, Myxococcus xanthus
atggccacgaagaagaagacgaccgcgaaaaagaccaccacccgggccccggcggcccggaagaagacggtatcgggcaagacgcccgcgaagaagaaggtccccgcagccaagaagtcggcggcgaaggcccccgccaaggcggccgccaaggcccccgcgaagaagaagaaggcgaagctcccagttgccccgccccagaaggtgggccccgcggagaacccggccgccaaggcgctggcgcaccgcatcggcaacctgctggtggacaagaaggcgcaggacgtcgtcatcctcgacgtgcgcgggatgacgtcctacgcggactacttcgtcatcgcctccgcggagaccgaccgtcaggtgagcgccatggcggagaacgtccaggtgcagctcaagacgggtgacgagcccatgcgtcccatcggcaccgagggcttccagacgggccagtgggtgctgctcgactacggcgaggtggtggcgcacctgttcctcaccgacctgcgcgcgcactacgacctcgagggactctgggccgacgcgtctcgggagaagctggcctga

SEQ ID NO: 5327 - DNA, 562 bp, Myxococcus xanthus
atgctggcgccccccgggtggtcggagcccgcgcagcgccccgaattcgatgaggtcgtcatcgtcctcacgggcgagctgaccatcgtggtggaggggcggcgcgagcgcatctccgcgggcgaggtcggactggtgccgcgcggcaagcgcgtggtgtaccgcaacgacggccagggggcgtgtgactactggtcggtgtgcgcgcccgcgttccgcccggagctggcgcacatggagacgcccaagcctcgcgtgcaggagaaccacgtcaccatccaggtggcgcatggccagggccgggacttcgcgcgcctgctgaccacctgggccagggcgtacctggtgcagctcgagctatccggcgtggagctgtccctgtccctggtggacgaccgggccatccgccggctcaaccgcacctggcgcaagaaggacaaggcgacggacgtgctgagcttccccgcgggcgacctgcccaagggcacgcctggaccgcgcccgctgggggacgtggtcatctccctggacacggcgaaacgccaggccaaagaagtcggcc

SEQ ID NO: 5328 - DNA, 711 bp, Myxococcus xanthus
atgcgaaaggaccggcggggtggctcgcgctcgtactcggacctggggaccaccgcgttcctggaatacgccccggacgtgcgactggcgctgcgagtgcgggcaggcgcccggcgattcgtgtaccggccagaccccaccgccaacttcggcggccccgaggtgggtgtgctgggccgctaccgcttcgaccggcggcacagcctgtccgtcttcggtgactggaactcccggcgcttcggcaccccaccccgggcacgcccgccggagacggggggcggctcgggattcctcgccggccggcgtcaggatgcagccctgacggcgggagcgtcgtacacctaccggggcccgctggccctggggctgacgtacgccttccaggagagctcctccaacagctacggcgagacgattcgccggcaccgggtgtcggccaacgccggcgtccggctgccctggcgggtgaccctgctggcgcagggctcgctgggcatcatccagtatccggacggcatctacctctccccggaaatcatcctggtggaagaggacgaagggcagaactcgctgtcggtgaagctggcccggccgctgacggagtcgctggacctggaggtggcctggggcatctggagcacccgtttgccccgcaactcgctcacctacacgcgccaggtcttcagcaccggcttcacctggcgctactga

SEQ ID NO: 5329 - DNA, 258 bp, Myxococcus xanthus
atgacgccggacgtggtgtacgaggtgctcgtggagggcgtgacggacgcgcacgacaacccggtgctcgccccctaccaccgcgccagcttcgcgggcttccgtcctgcccggccgccctcccgcagcttccagctctgggacatgctgccccgccacaaccgccgcgacgacgtgacgggcgacctgcaccgcttcatctcctgcctccaggaggtgacggatttgctgctctccgacttggacgcttatacctga

SEQ ID NO: 5330 - DNA, 396 bp, Myxococcus xanthus
atggccctcaccgccttcaccagtcgcttgggcctcggacagggacgcattcggccccagcgggccacgcctgcctcgggcgagtacctcttcgtcctcggcgacgaggagcctggacgccgcttcgagttggccccgggcgacttcgtcgaggtgacgcagccagtggacgtcaccggcgtgcacctggtccgcaccgccttgcgcctccgtgtacctgcaggcgtcccggcgggcctggcctgggaagcgtccctcgtcgtcgacggggtgaagtacgcccgcactctggggcgccccggccgcgagcgcctcgtcggggacatggccgccaacgtctcgaagctctccggcgtccacacggtgggtgtccgcttggagctcgtctccccgtga

SEQ ID NO: 5331 - DNA, 8604 bp, Myxococcus xanthus
gcgctgctgcacgagacgaaattgatggacaaggagagcgccgcggacgcctggcgcgtcatcgcggagcgcgacccggcgagccgtgaagccgcggcgaccctggaccggctctacaccgagagtggccgtcacgccgacctggcctgggcgctggcgctgcgccgcaaccaggaagggcagagcccgcaggggcgtgaagtctccttccgtctggcggaactccagcgcacggtcctggatgacccgaacgcggcgctgggcctctaccggaagatcctggccgaggattcgggccatccaggtgcgcgcgcggcgctcgaggcctgggtgaaggcagcagtgcccgcgagcggcgcggcgctggatgtgctcgacccggtgctggtgcaggtgggcgaccacgcccgccgtgtggcgctgcgtgaagcgcggatgacttccgcgctcaccgtggagaagatcctcctctcgggagaggttcgccgcatctacgagcgcgacatgctccagccctcgctggcgttcatgtccgcggtgaagtccttcgcgcaggggctggaccgggaaggcgtgcagccggacctggagcggctggcgcgcgagacgggctctcacgaggtgctggccgaaatctacgagacggcggcgacggagctgaacgcgggggaccccgcggcgctggagctgctgcggcgctcggcggagctgcgcgagtcgttggaccagcccgaagaggctgcgcggctgtggaagagcctgctggcggacgcgcctcaggaccggcaggcgctggaggccctctcccgtctgtacgagaagggggagaacgccaagagcctgtcggaggtctacacgcgtcaggcgcagctcgccaccgacccggaggagcgcgtggggctgctcctcaaggcgggcgaggcgtacgcgaacgcgggtgaagacgcgaaggccatcgagacgtatcgctccgcgctggcgctccggaaggtgcccgagggcctgctcgcgctggaaaagctctacgcgaagtcccggcgcttcgtggagcaggcggacgtgctggaccagctcgcggatggcgccgcggatgaaggcgcacggcgcaactggctgctgaagcgcgcccagctcctggagaaggaggtggggccggcggagtcgctgccggtgtaccggcgtctgctggagctggcgcctggagacggacaggtggtggcgggcctggagcggctgatggcgcacgaggcgcctcgctccgaagcggcgcgcctgctggagcctgtctaccggggcgtcaacgacacccggaagctggtggacgtgctcgaggtgctgctgccgggcgtggcgcccgagcggcggctggagcacctccaggagatcgccaccctgcgcgaggcgctggggcagacgtcgctcgccttcgtcgcacgcctgcgcgccttcaacgaggcgccgcaggaagccgcggtgcgcgacgaactggagcggctcgcggccgactccggtgcgttcgaggaggtggcggcggcctacgaagaccagctggagctcggcgcgcaggatccgctcgccggtgacttgtggcggcgcctggcgggcatctacgacaaccgcctcaagcgttatgacctggccgtccgtgcgatggaggagatgtcgcgcagggacccgaagaacaagtcggtgttggacgccatcgcccgggtccaccgccgcacgggcgcgcaccgcgagctggcgctcgtcatgcgccgtcaggtggcggccgaggcgaacgcgtcctcgcaggtgaacctgctcttcgagctggcgcacctggccgaggagacgctggcggacaagtcgctggcggcgcagtcgtaccgggaaatcctcggactgcggccggagaacgccaacgcgctgaagctgctggggcgggtgctcgcggagatggagcgctggccggagctggcgcagcacatcgagcgggaaatccagctcgcggacgagcgtggcgcccaggaagaggcgtccgaccttcgagtgcgcttgggccggctgaaggtgtcgcgtctggacgacccgcgcggcgcactggagctgtaccaggccgtgctggagcgccgggcggggcatgccggtgcggtgggcgcgctggaggagatggcgcgctcggagagcccgctgcgtggcgccgcggccagcgcgctggagcccgtcttcgcctcggtgggcaaccacctgaagcaggtggagatgctggagtcccgtgcctcggcggaggccgtgccgcaggagcgcgcagcgctgctgcgccgcatcgcggaaatctacgccggctcgctggagaacgcggagatgggcttcctggccgccacgcgcgcgctgcgcgagctgccagatgatctgcgttcgttggagctgtgcgtcgcgctggtggacaaggccgaggcgcccgaggaactggccgccatcctgacggaggtggtgggcaaggcaggggatgcgtcacgcgccgagctgtaccgcgcgctggcccgcatccagacggacctgggcgagccctccgaggcgctggtgtcgtggaagcgcgtgctggagctgcggcccacggacaccgaagcgctggatggcacggtgcggctggtggcgtcgcagggcaagcctacggagctgctggaggtgctgcgccggcagctcgcggtggcggaggacccggcgcgtcgcgccacggtgctcttccagatgggcacgctgcaggaggagcagctcaatgatgcgctgggcgcgctggccaccttccggcgcctgctggaactcaagccggacgacctgcccacgctggagcgcatggaggcgctctgccagaagcaggagcgttggccggagctggcggacgcactggctcgccgcatcgcgctgatttccgcggaggagggactggaactgaagttccgtctggccatcgtgcgcgagtcgcggctgctggaccgcacaggcgcgctggcgctgtacggcgaggtgctgtccgtgcaggccaaccatgcgggcgcggtgggccgcatggaggcgctggtggcccgcgagccgcagaacctgctcgcggtggagacgttgctgcgtgcccttcgcatcagcggcgacatcacgcgcctggcgcaggtcatcgagacgcgcgtgggcgtgtcgggcgacgcattcgagcgcaaggcgctcctgggcgagctggccacgctgcgggagtcccaggaggagtcggagctggccttcctggccctcttccgcgccttcaaggaagacccgaacgacgccgccgtccgtgctcggttggagaacgcggcagatgcgtccgccagctatgacgagctgctggccgcgtacgaggaggctctgccgcgcgtggccgaggccgcggatgccgcgcaggtctgcctccggttgggacagatgctggagacgaagctgcgcgactcggaccgcgccatctgctactacgagcgtgcgcgcacgctgcaccccacggtgcaggagccgtcgctggtggcgttggacaggctgtacctccaactggaggcctggccggagctggcgggcatcttggaggcactggtcgctggcgtgacggagccctcggaccgggtgggctacttgttccgcctgggccagctctaccaggagcggctggacagcccggaccgcgcggcgggtgcctacgaaggcatcctggcgttggacccggagcacctcgcgtcggcgcggctgttggagggcatctacgagtcggcgggcgcgtcggagaagctctacggcatcctgaagctccaggcggagaaggtgtctggcgccgagcgcgaccgcgtgctggcgaagatggcgcaggtctccgccgaaggactggcggacctgggcgggtccatcgacctgtaccgcgagctgctggcgaagaacgcgcgcaacgagcaggctttctccgcgctggagtctctctacgagcgcgccgaccggccgcaggacctgcgtgagctgctggagggccggctggcggtgacgctggacccccgcgaggtcgtgcggctcaatgagcgcctgggccgcgtcgtgtaccgcctgctgaagcagccggaacaggccgtgccgtacttcaaggccgcgctggaccgggatgcacgtcaccgtggcgtgctcgacacgctgcgcgagctgtacgacgagacgggccagcgtgaagagttggtgggcgtgctgcgccggctgattcctcttcaggagagcagtgacggcgtgaaggcgctgcgtctgcgcctggcggaagtcctggccggcatgggccgccgcgaggagtccctggacgccgcccggcgcgcgctggaagtggagccgcaccaggttcccgagctggaccgcgtgcacgagctcttcgtctcattgcgtgcgtggaacgacgcggtgcgcgcgctggagttgaaggtgcaggtgcacctcctgacggaggagcgtgagcaggctgtcgctgcttacttcgcggtggcggacctgtgggtggggcagggcggcaagcccgagctgtcctcgggcgcgctggagaaggtgctcgagctggaccccgccaaccgcaccgcctacgagcgcgcgtgcgacctgtaccggacgcacaacgactggcgtgcgtacgcccaggtgatggaccgctacatgccccacctcgtcacggacgaggagaagctggccgcgctgcgcgagctggcccgggtgcaggaagcgcggctgggacagaaggacgtggccttcctggcgctgtgccgtgcgctccagttggacgcgtcggacgacacgctgcgcgaggaggtggagcggctggccgacgagacgggcagccacgaggagctggccgccgtctacgaggaggtcgccgacgagctgccgcgtggcgcactggccgagcggctctacgcgacgctggcgcgtgtccacgacacgcacctggatgacccgcaggcggcggaagcggcgttccggaagattctcgagttcgacccgaccaacgccaccgcgctggatgggctcgccgcggtgttccagcggcgtggccgtcagcgtgagtacgtggtggcgctggagcagaagctggaggccgccggctccatcgagcagcgcaagggcatcctccgcgagattgcccgcgtctgggacgagcagttggaggaccccgtcgagtccgccagcgcgctgctgcgtgcgttggagctcgagcccgacgcggagacgctcggcgtgctcaccgcgctgtaccgtcgtcagcggtcgtggccggacgtcgcgtccacgctgcttcgggccagggacctggcggacagcatcgaggagcgcgcgcgcatccaggtggaggtggcgggcgtctacgagcgtgacatcggcgacgacgagtcggcggtggccgcgtaccggcaggcgctggagctggaccccgtcaaccgcgaggcgctggactcgctggagcggctccacacgcggttggaccacccggcggacctgctcgccatctacgagcggatgttggagctgagcgaggactggcgcgagaagattcgcgtcctcttccgcagcgcgaccatctgggaggacaagtaccagaacccggcgaacgcggacgtctgcgtggagagcgtgctcgccatcgatccgcagaacgtccaggccatcaagacgctcatccggctgcgccgggcgcaggcgcggtgggaggacctcatcgcggcgtacgagcggcagctcgcgctggccgtcagcccgcaggagcaggccgagctctacgtggacatcggcaacgtccagtaccagcagctcaaggcgctggaccgcgcggtgaacaactaccacgcggcgctcgcggtggacgctgagtgccgtccggcgttgcacgcgctgggcacgatgtacgagcgcagcggcaactggcccttcgcgctggagatgctgtcgaaggaggcggagctcgccgggcagtcaaaggacgcggtggagctgtactaccgcctgggcaagatcaacgaggacatgctgatggacacgggcagcgcccggaccgcctatcagcaggcgctcgcggtggaccccggccacctgcccagcatccgcgccctcaagggcatccaggagcaggagaaggactggagcggctacgagcagaccctgcgtcaggaggcggagcagaccgaggacccggccgccaagggccgcgcgttgctggacgtcgcgcgctaccacgcggagacgcgcgaggaccgggacaccgccaccggctactggcaggaagcgctgaagcacatcccggacagcctggaggccgcgcgcccgctgtcggacgtgtacatcgcgcatgaggactgggcctccggcgagcggatgctggacatcgtcacgcggaagatggcggagatggcggtggcggacaaggactccgtctccgccgcggacctctgccgtcagctctaccgcctgggctacgtggcggagaagctgggcaagcgtgacaaggcgctgggctgctacgagaaggcctacgagctggacgcgacgtacctgcccgcgctggagggctacggcaacctgctggtgcagacgcgccgctacgaaggcgcgctcaaggtcttccagaccatcctcatccaccaccgcgaggagctgacggacctggaggtggtggaggtgtactggcagctcggcgacatccacgccgcgctgaaccagacggaccgcgcgcagaaccacttcgagaaggcgctggccatcgatccgggccacgagccgacgctgcgcgcgttggtggcgctcctggagaagcagggccagtacgagaagtccgccgagctgcggcagcagttggtgggtgtgctggagggcgaggcccgcgcgaaggtgtgcctggagctgggccgcatcgcgcgtgacgagctgcacgacccgtacatggccattgacgccttcaccaacgcgctcaagtcccagccggacgcgccggaggtgatggaccagctctacgtcctgctgcgcgagacgcgtcagggccagaaggcggcggacgtgctggcgcgcatgttggcgctccccgcgctgggcctggagccgcacaaggccaagcgcgtctggttcgcgctgggcgagctgcgccgcgatgacctgaaggacgtggagggcgccaccgaggccttcaacgccgccctggacctggacccgcgcttcgtggaggccttcagcgcgctggaggcgatgctcggcgcggcgcgccagtggaagcaactggaggagaactacacgaagatgctgggccggctgcccaagacgccggagacgcacgtggcgcgcatggcgctgtggcgcgcgctcggcgacctgtacctccaggtgctgaagcacccggaaggcgcggtggccgcgtacggcgtggccgccaagggcctgcccgaagacgcggcggtgcaggaggccttcgcggacctcgccggacagatgccgggccgggaggacgaggccatcgccgcgctccgccgcgcgctgccgaacacgacggacccgcgcaaggtggtgggcgcgctggtgcgtttgtccgcgctgcgcaagaactacgatggcgcctggctcgccgcgcaggcggtgtccggtctgctgggcgaggcaggggaggacgagcaggagatcctcaccaagttggggccctacgcgaagaacaaggagaaggtggagccgcgtccgctgaacgaccagctgtggcacaaccacctgttccatccgaaggcgcgcggcccgctagcggagctgctgggcctcctcttcgcgaaggtggggcacctgtacgcggtgccgtcccagcagtaccaactggtgcccaagcgccaccgcatcgacgtggccagtgcgcccgagtaccacgtccaccactatcggtacgtggcgcgcgtgctgggcatggaggcggtggagctgtattcgcccttcctcgtggcgacgcgcgagcggatggcgaagcgctccaacgagccggcgcccgagccgctcatcaacgtggagttgctccagacgcacccggcctcgctgcgcgtgggcggcaagtacttcgcggagcagggccagaaggaggtctattacctcctgggccgcaccctggcgctggcgcgctccgagctggccttcagccagcgcgtggcccccgagcggctggaggccatcctccaggcggcgctgagcctcgttgtgggcaacgtgcgcatcgcggaagcgcagcacctggtggagccggagcgtcggctgctggagcggagcctcaacgagccggaccgcgcggtgctggcgaaggcggcgcgtgcctggttgcccaccgcgacgccgcaggcagtgcggcagtacctggagggcgcggagctcaccgcggcgcgggcgggtctgctcgctgcgggagagatggagccggtgcgccgcatggtgcagggcgagacgggctccgccttccgcgtcccggtgcgtaacaagctgcgagaactgttggtgttcgccacctccgaggacctgcacgagctgcgcgtcgccgtgggtacgcacgtggaggtacaggtgcgcaggtag

SEQ ID NO: 5332 - DNA, 1989 bp, Myxococcus xanthus
atgatcagcgacgacaagattggccccaaaggggtcaaggttcgttgcaagaagtgcggccacaccatcaccgtgcgtcccgctggcgcgacggccgcgaaggactccgcgtctgagtcttcgacctccgaggcttccgcctcgactgacgtgggcaaggggagtgacgcgtccgccgccacgatgccggcgacgctgggcacgccgcccgaaggcggtctcttcaccgacgtggaagaggacgagattggcgccgtcttcgaccaggtgctgagttccggcacgcagaagattcccaccgaggccgcgaacgaagccgccgcgcgcgaagcgtccgcggagaacgtgcgcaagctggccgaagcggaggccgagccggacaaggaagaagccaaggccaacgcggcggcgcacgagtggtacgtggccatcgacgagaagcaggtcggccccttcaacgtcgagaaggtcaaggacctgtgggaccgcggcgaggtgggcccggacagcctctgctggcgctcgggcttcagtgattggattccgttgtcggagacggcggagctggcgtcggtgttggcgccgcggccctccaagcccgtcatcgtcgcgccagagcctgtgtccggctcgacgcccgcggtgtcctcgggccccgtgcagtccgccttcagcgcgggcaagggggcgcgtggtgattccgggcccgcgggcgcttccgaggaggccgtgggctggaagccgtccgcggccagcgtgctggcctcgctggtgaaggaagagaacgacgcgctgtcgaagccgcctccgacgcccgcgcccgcgctgggccgggagccagtgtcgcagtcgcgactgctggacgtgcccatgccgccgccggagccggtgtcctcgccgtctctgcggggcgcggaagtgccgatggcgcaacccatggcctcgcccatgccgtatgggcagcagcccatgcagcagtatccgcagccggcgcccatgccgtatgggcatcagccggggccgcagtatgcgcagcccatgcccgcgccgtacccgccgcagccgagctacccggctccctatccgccgcagggtgggggcaagggcaagacggggctcttcgttggcattgccgcggggctgctcctggtcggaggtggcgccgcggcgctcttcctgaagggcgggtctggcgcggacgcggcacaggcgaatcccccggtcgtcgcggcgacgcccgtggccacgccgtcgccgacacccagcagccctccgcctcctcaggcgaacacggctcccgtggcggccgctcagccacccgtgaattccgcgacggcgcctccgcccccgcccacggaggtcgctgcggcgccggtgaacacgcctccgccggagacgccgcccacggccgtcgcggcggcgcccgtggccacgccgacgccgcctccggttgaaacgccgaagcccgcggagacggcggtggcgaaggccgagcggcccaccaatcgacgcacctcgtcgtcgtcgcgccgggaggactcggagccgcgcgcgtccgcgccggcgcgtgcggagcggccctcgtcgagcgattcggatgatgacttcgacgagctcttcggcacgaagaagtcggcgccggaggcgaagccgtcgtcggcgcgtccgacggcctacgtccctcctgagcctgggggcggggttccggaccggctgcagcagtcggacatcatggcggtggtgctggccaacaagccggccatcatcaagtgcgtcaacgagcagaagaagaaggatccgtcgttgagcggcaagctggtgatgcgctggaccatccagacgagtggcaagacgagcgcggtgtcgtcccgcacggatgagttccgcaccacctacatggcgagctgcatttccgggctcatcaagagctggtccttcccgcgtcacaagcggcagggcgagcccatcgacttcccgttcaccttctga

SEQ ID NO: 5333 - DNA, 897 bp, Myxococcus xanthus
atgcagcttcgcaagatgatgttggtgctcactgcgcttggcgcgatgagcggtctcatggctggttgcggtgacgactcaacgtccccgggcgcgtgcaccagcaacgacgagtgcggcgagtcggagatctgtcacccgaccgcccaagtctgcgtgcagacctgtaactctggttcggactgcccctccacggcgaagacctgcgccccgctgggcggcacgtcgaccacgagcatctgccagtgctccacggacgtgctctgcaacggtggcacggactctgagtccacgggcctggtctgctccaacctggacaacgtctgcgtgacggcctgcacgtccgacactgagtgcaccggcgaccggacctgtaatgtcagcaccggccagtgcgaagagggtgacaccgggcccgcgagctgcaccggcgagggcctgtccacctgcgcttacggccagatctgctccagtggcacctgctccgcgccgcccgcgccgacgtgccagaactacaaggacttcccgaacaaggcggacctcggcaccacgggcccgatcatctacaaggtgggcttcgtcaatgcgacgacggacactgcgttctgtcctgctaacctgcccaagcgtctgcgcatccgcatcaacgcgtactccaacacgccgttcccggacacctccacggagctgagccgcttcttctacgtccagacggacggtggtcgtctcaacgcgtccatcagccgctcggagggcaactacattgtcactggcgccaaccgcagcaacgcggagatcatcgtcaacctctgcgtcgccgcgactagcaccaccaactcggctggcttctacttcagcgacggcaacttcgtctgccatcagtcgaactaccagtaa

SEQ ID NO: 5334 - DNA, 420 bp, Myxococcus xanthus
atggctgaaggcgcttcggagcggctgaactgcgcggagggcacggttcagctcggttccaaggaggagggcttgtcgtgtgtgaagtccggcacgaaggcaggcgcccgcacctcacacggtgcgtacgttgagtaccatccgaatggcgtgaaggcggcacaggggcagttcgagaacggtctcaaggttggcacctggaccttctacgatgcgtcaggcaacaagcgcggcactgcggagttcaaggatggcggctggcatggccagcgcgtcatgtacttccccagcggcaagccccagagaatcgaggagtacaagaacggccgtaaaaatggcgtggtcaaggatctcgctgaagacggccgggtattgagccaagtccggtacgaaaacaaccgcgaggttgctgcccagtag

SEQ ID NO: 5335 - DNA, 810 bp, Myxococcus xanthus
tgccgtgtcctggaggtgtccgagagcggctaccacgcatggcggacgcgccttccctcgaagcgcgcggtcgcggacgcgggcctcagcaagcgcattcgcgccatccacgcgatgagcgacggcacctacggcgtgccgcgcatccacgccgaactcgcggcagagggcgtgcacatcggccgcaagcgtgtcgcccgtctcatgcgggcagcgcaccttgagggcgtcagtcgccgcaggtggtgcgtcaccacgacgcgcgacgagcgcgcacgccctgcgcccgacctggtcgaccggaaattcgtagcccctggacccgaccacctctgggtggctgacatcacgtacattccgacgcacgccggtttcctctacctcgccgtcgtgcttgacgcatggagccgtaaagtcgtcggctgggccatggctggccacctcaagacggagctcgtcgtgcaggcactcgacatggctgtggggcagcgtcagccccaaagcgtcgtgcaccacagcgaccaagggacgcagtacacctcgattggcttcgggcttcggtgcaaggaagctggcgtgcgcccatccatgggcagcgtcggcgacgcgtacgacaacgcgatgtgtgaaagcttcttcgccacgctcgagtgcgaactgctcgcacgccgccgcttcacgtctcacgccgaggcgcggatggccgtcttccgcttcatcgagggctggtacaatccgctccggcgccactccgcgctcgactacgagtcacccgctggttacgagaagaagcaccgcgctgccgcttga

SEQ ID NO: 5336 - DNA, 534 bp, Myxococcus xanthus
atgacccatgcgaacttcgagcgggtcgaccttgacctcgtctatccgtcgttcgtcgtggtggccctggaggtcatcgcgcgctgtgcggcccggggcgttcgctacgtcgcgacgcatggcttccgtgacctgacggaacaggccgagctgcgtcggttgtacttggcggggaagggcggcaaggcggcgcccgctggcttgtccgcgcacaactacggcctcgccttcgactttgtctgtgacgcgagcccgcaacctggcgttcagccggattggtgcgagtcggcttacctcgtgctgggggaggaatcggcgaaggcggggctcgtctggggcggcaggttcggcgactccccccatgtgcagtggccgggctacgtgagcgcgcttcagctcacgccgcttcgcaccctggtccaacagagttccctcgccggcgtgtgggctcgcctcaatgccgagcgcctgtcgccgaagtggcgtgcagcaaacccgaagctcgcggccgaactggagcggctgggcttctaa

SEQ ID NO: 5337 - DNA, 186 bp, Myxococcus xanthus
atgctgacggcgctgcaagtcgccctgacggccgctggtggcttcaccatcatcaagcggattctattcgggagcgccgccattgcccgcgccgaactggcgggcgcgattgccgctgggcaggtcgcggagaaagccgcagcgattgctgtgctggagcagctcgactcccggggagacaagtga

SEQ ID NO: 5338 - DNA, 276 bp, Myxococcus xanthus
ttggccaacaccaagtccgcagagaagcgtcaccgtcagtccctgaagcgccgtgcgcgcaacgtcaccgtgcgcggtgaggtgaagaccgccgtcaagtccgcccgcgaggcgctcggcagcaaggatggggcgaagatgacggacgccatcaagtcggccgccaaggcgctgagcaaggccgccaccaagggcgtgctgcacaagcgcaccgcttcccgccgcatctcgcgtctcgcgaaggccgccaccaaggccgcccgcgcgcaggcctag

SEQ ID NO: 5339 - DNA, 2888 bp, Myxococcus xanthus
tggcgcgtcattaaagagattgggaatggtggttttgccgtcgttttcctcgttgagaagaacggccgcaggagcgcgctcaagctggctcgtcaccgggattcaagcggggacgacaagcaaactcatgcaaggacgctccgggagctttcggcacttttactcctgggccatccgaacatcgtcaagcatcgcgggtatgggtactccgagcatgggaatgtctatctcgcgcttgagtacattgatggttggacgctagcggagtgggcggagcggaaacacccaacggtgcgggaggtcttgcaggttttcgacaagctctgctctgcactgtcatacatgcacagtcgcggcgtcctgcatcgggatttgaagctatccaacgttctgattcgaaagagcgatggagagccaatcatcatcgactttagctgtgcgaactactcattggccgaagagcttacggatgctggcttgcccccgggcacggaccgttttcgcgcgcctgagcaattcaaatggctccgggagcacaaggcagagcaccgcgcgaagtacgcatttcgtgtcgcggacgagatcttcgcggtcggagcgatgctctatgagctgctgacagacccccgcccgaccgagattcaagcgcgcttttcgctcaacagtacggtcatattgcccccacccgcgcgtgcgttgaacggacgcgtgccggaagcgttaaatgacctcgtggcgagcatcctgtcgcgggagcctgcaaagcgccccgtcgataccgaggcgctacgtcgcgaactgggcgaactcctggcctattcgagcgcggagtacctgtccccggtgcatccaccatctgagcagaggcaggggggaacatcggaacagcagacgcccgcagttgcgaactcaagccttcctggggggcctacgcataccgtccggggatggcgcgggctcgtggggggcctcgctgccctcatcgcgcttgtcatggccgggagcttctggctcagccggggggaaccgccgcagccacgagagccgcaggttgccagtgcgccacctcctcccagttccccacattccgcgccgctcgtatcggccgcccctgctatgtcaccacctagccctccgcctgtgctgctgacgggccctgagactgccgctccgaaggaaggttcaaccgtgaagacgactccgtcacccaaggccccgacccaaggacgcccgtcgggcgggaggacgaaggccaccgctgttgccgactgcgcgacgatgacgctcgtcgcggcgctcgcggcaggctgccccggggctcagattcggcccgagtcgttcacctgcccgtctggtgcggaagagacgatgcgggaagaccttcgctgggagattaacgagccattccgcctcactctcgatagtcgccagggcccattcgaacaagtttggttcaccgcaggggctgacgtggtgggggttgttcccaagggagttgaacgacggcaacgagcagtcgcgccgcccgggacaatcttctacgggaaggcgtatttcctctctgaccgcatggggcgctcggaggggcctgcgctagtcatccgctacgaccgtgtgaagctgccgggacaggacgaacgccccgtctgcttcgtggtcgagaagcctgccgatggctacgaagacggccgagtgaaggcgttcaacaccggaggcggttacgtcgtggaccgctggccatgagagccccgaaaggacgtagcaggtaggaggccgaaattgggccgaccaagccgttttgtcctcatgacctgtgaaggcgttccctcggctggatgcggcaggtagcttctttcgccgcgttggtcgcgagtctgcgcacgaggggaaacggcatgtcgaaagcaatcgagttcaagatcccgccaggggcgattctcttctcggcggatggcgtcggctacgagttccgcgaggacttggggccgacgaaccatgggatgtccctcttcgtggctcggctgcgaaccgcgtcgggggagcctcgtggaaaggtgctgctcaaggcggttcctgcgccatcggagaaggaaggggggcgggttcggcgggcgcgagcaaagctggatgagcaggttcgtcttgccgcctctctttctcatcccgcgatcctcaaggtccatgggctccataaggttgagggctactggtacgtcagcgccgagcatccatccgggaattcgctgaacgaactgctgacgcttgttgtcgagtgccgtcgatggttctcgcccctcttcgtgatgttcgtaggctcgcaggtggcggcagctctagagcacgcgcacacggcgaaggatgccagcgggcgccccttgaacatcgttcaccgagctatcgatgtcgcgcacatctttatcgactgggacgggacggttcggctcggcgacttcggtctcgcgctgtccaacttgccggggcgcgtggcttcctcggttcgcagcccgcgaggggactacttctattcgtcgcctgagatgctgcttggcgggcccgttgacgcgcgctcggacctcttcatgttgggggtggtgctgctcgaaatggcgacggggaagaatctgctcttctgcccggatgccatcacgcccgaggtcatgggctcgttgtccgtgaagcggcgtcggcgagtcgttcaggcaatcaagcgggccacgctggccggggcgtcatccatggtagaggacgcgatttggcgtgccgcgacgctggcggatgctgacgtggacgcgatgacggaggggcttccccaggggcttcgcgtaacgctgaaccggcttcttcgggtctccccccgcgagcgctaccagtctgccggtgagctggcc

SEQ ID NO: 5340 - DNA, 846 bp, Myxococcus xanthus
cgcaacgtaatgcagacgcttgagggcatccccgcgacggacggagccggcgttcgcttgacgcgggtcatcgggcagccctcgctgcggaacctcgacccgttcctcatgctcgaccggttccactccgatgaccccggcgcctacatcaacggcttcccgaatcacccccaccggggcttcgagaccgtcacggtcatgctcgatgggcgaatgcgccaccgggacagccgtggcaacagcgggctcatcgccggaggtggctcgcagtggatgaccgcgggccgtggcctcatccactcggagatgccggagcaggtgcaggggttgatgtccggcttccagctctggctcaacctccccgcgaaggagaagatgtgcccgccggcctaccaggaccacacgccagcgcaactcgcggaggagcgcctgtctccctcggggagccgcgcgcgtgtcatcgcgggccacatgaacgggctccagggccccgtgcgtgagcgccccacgcagccgctcttgctgaccctggcgctcgaggacgaccgtcctttcgaactcgacacaccgtcggaccacactgccttcgccttcgtgtccacgggcgaggtcgacctgggtcctgaagacacgtcgaagccggtgcgcgagggctcgctggcattgctcggcccggggagtcggcttcgcgtgcgcgcgaggaatcgccggagcgagttgctcatcgccgcggcgatgcccctgcgtgagcccatcgtccagtacggcccgttcgtcatgaacacccgcgaggagatccagcaggcctttgacgactatcgcgcgggcgtgctcgaccaggggtga

SEQ ID NO: 5341 - DNA, 1221 bp, Myxococcus xanthus
taccaacgcaatcccgtgaaggcgccccgtgtgtcgggcctggcgctcaaggctttcgtgaacgcgctcgagagcggcgtcgggtcggtgatgctggacaagctgacgcgggacagcggcatcgagcgatggcgtgagctcccggcgggggacgcgccgccgctccagtttccgttggcccagggaactgccgccacggagtcgcagacacccacggagcaggccgcgcgcgccatcgccgcgtccgccagtccaccggagcgtgagagcgttgcggcctatgtccgcgcctaccgcgagggcgccacggacccggtggccgtggtgaatcgaattcatgaatccattgcccggatggacagtgggaagcagcgcctgggcttgttcatcgcccgcaagccggacgacgtgcaccgggccgcggaggcttcctccgagcggctgcgcgagggccgtccgctgagcgtgctcgacgggattcccgtcgtgctgaaggacgaggtcgacctggccgggttccccaccacgctgggcacgcggtttcgcacgcaggtggccgccgcggactcgacggtggcggcccggctcaaggccgcgggcgccatcatcctcggcaaggccaacatgaatgagattggcatcaaccccatcgggttgaatccccatcacggcgccgctcgcaacccctgggacacgggccgcatcaccggtggcagttccagtgcctccgccgccgccgtggccgccggcctgtgccccttgagcatcggtgccgacggcggcggttccatccgcatccccgcggccctttgcggcatcgtgggcctcaaggcgacgtggggccgcatcccggagacgggcgtaccgccgctgtgctggaacgtgggccacgtggggcccatgggcctcaccgtggacgatgtcgccgcggcgtatgcggtgctcgcggggccggatgggcatgacctcgtctcgcaggggcagtcaccgcatcacctgtctggctacgaggatgaaggcctgagcggcgtgcggctgggcatctgctgggactacttcgaggacgccgacgcggacgtcgtcgcccgctgcaaggaggccgtggccgcgctgtcggccgcgggcgcgcgcgtggtggagattccgcctcccgacctcaacaccgtgctgtggacgcacagttgcatcatcctgagcaaaatgtcggaggtgatgctcccc

SEQ ID NO: 5342 - DNA, 1647 bp, Myxococcus xanthus
atgctcgagaccgtaaccaagggcttccgcgccgccaagaaccgcctcgccggcaagagcgagctcaccccggagctggtcgacgagtcgctgcgcgacatccgcgtctccctgctcgaggctgacgtcgccttcgacgtcgtgaagaagtttgtcgcccgcgtccgcgagaagtccgtgggcgagttggtgcagacgaccatcaccgacacggctggccagaagcgcaaggtcagcccgatggaccacttcatcaagatctgccacgacgagctggaggccctcatggggcccgtcgacaccagcttgaagctgaagcccaagggccagctgtccggcatcatgatggtgggcctccagggctccggtaagacgaccacgaccggaaagctcgccagccggctcctccaggaagggcgcaagcccctgctcgtcgcagccgacatctaccgccccgccgccgtggatcaactcaaggtcctgggcgagcggctcaaggtccccgtctaccacgagcccggcatccagccgcccgagctcgccaagcggggctaccccgccgcgcgcgagcagaagtgcgacgtggtgctcatcgacaccgccgcccggctcgccatcggcgagtccctgatggccgaactggagtccatcaagggcaacgtccagccggacaacatcctgctggtgtgcgacgcgatgattggtcaggacgccgtgcgcacggcgggggagttcgaccggcggctgacgcgggacggattcatcctcaccaagctggacggtgacgcccgcggcggcgccgcgctgtccatcaaggaagtcacgggcaagcccatcaagttcctcggcatgggcgagtccatggacaagctggaggagttccgcccagccggcctcgcgggccgcatcctcgggttcggcgacatcgtcggcctgatgaaggacttcgagaaggtcgtcgacgagaagaaggccgaggaggatgccaagaagctcctgtccggccagttcacgatgaaggacttcgtcgagcagatccgcatggtccggaagatgggaccgctcaaggacctgctggagaagttccccctcttcggcgacctcaccgagcacctcaatccggacgagaaggaactcacgaagatcgagtcgatgtacgactcgatgacggcgaaggagcgcctgcggccagataccgtcaacaacagccgcatcaaccgcatcgccaagggcagcggccgcaaggtcgaagaggtcaaggagctgctccagaagttcggaatgatgcagcaggtaatgggcaccatcggccagaatccgggcctcttgggccgcatccccggcttcaagcagctgggtcagctgtcgcagatgaagaacatggacctctccagcatgttcggcggcgacccgaagatgatggagaagatgatgagcggcggcatgcccggcatgggcatgcccatgcagctgccgcagattgcacccggctacacgccgcccatgggccaggccgccatggccaaggcccggttgatgggctacgcgccgccctccgccgcaggcaagagcgaggaccgcgacgccatcaaggagcgccgcaagcgggagaaggagaacaagaagaagaaccggaagaagaagtag

SEQ ID NO: 5343 - DNA, 978 bp, Myxococcus xanthus
aactccacgaaaccggggcaacttcacaacaagcactcaagcgtcgacagcaaacgacagattctcagagatcatatcctcccattcttcgggaaggtggcgctcgcgaacatcggcttggccgaaatcgaagacttcaaggcgcacatgcgcaagaagaagtcggcagctcacaagcggaaggactccgcgtcaaagcgagccatccggaagcggcagcgtagcgagcccaagcccctgagcctgaagaccatcaacaacgtgctgaccgtgcttcacaagctcctgacgctcgcagaagagcatggggtcatccggcaggcgccgcgcgtaaagccctttgggaagctaccgaagcctcccttcgacttcctgagctttgaggaagcggatcagcttctcgccgtcgctgagcccgaatggcgcacgttgctgcgcgtcgccatcaagacggggcttcggcagggggagctgatcgggctccggtggcacgacctgaccctgacgcggggcctgcttcacgttcgcaggaccatttggcgcgggatagagggtttgccgaagggtgggcgtgaacggacggtcgacttgcccgcctccgtggttgatgcgctcaacgcccaccggcaccgtcgggggcggttcgtcttctgtcaggaggacgggcagccactcaccaagggcaagatggcggcaccgctgggtcgcgccctccgggcggcgggcatcacccgcgaagtggggcaaatcggctggcacgacctgcgccatacctacggcagccatctcgcgatgaggggtatcccgctgaaggtgattcaggagctgatagggcacgcgaccatcgagatgacgaatcgctacgcccacctgagccccgacactcggagagaggcagtcgccgttttggaccggcctctcgctctgccgtgcgacatacgtgcaacatggaaggaggccgctcctaaccgcacgtaa

SEQ ID NO: 5344 - DNA, 1917 bp, Myxococcus xanthus
accgttctgcgcgagcggttcggactgacggacttccgccctggccagcgtgaggtcctcgatgcgctgctcggtccgaacgccgcggcgctcgcggtgttccccacaggtggcggaaagtcgctctgctatcagcttccggcgctgctgctggagggcatcacggtagtggtctccccgctgatcgcgctgatgaaggaccagattgacgccctggcccgacagggcattcgtgccgcgcggctggacgcctcgctgtcggtggacgactcacgcgaagtcacgcaggcgctgcgcgatggttcgctcaagctcttgtacgtggcgcccgagcgcttcaacaacgagcgcttcaccgccctgctccgcgagctgcgcatttccttgttcgcggtggatgaggcgcactgtgtctcggaatggggccacaacttccgaccggactatctgaagctggcgaaggccgcgcgggatctgtcggcagagcgaatcctcgcactcaccgccacggcgacaccctccgtcgtgcgagacatctgccagggcttcggcatccccgaggagaacgcggtcgtcacgggtttctaccggcagaacctcacgctggagacgaccccggttcacgccgaggcccgcgacgccttcctcctggggcggctcggttcccgagcgcctggccccaccatcgtctacgtcacgcagcagaagaccgccgagcgagtggccgcgttcctcgccacggaaggtctccccgccagcgcctaccacgcgggcctggagcccgaggtccgtgagcgggtgcaggaatcctggatggcctccgcgaatggcatcgtcgtggcgaccatcgcgttcgggatgggcatcgacaaggcggatgtacgggccgtgtatcactacaacctgcccaagggactggagagctacagccaggaaatcggccgagccgggcgcgatggagcgccatcggtggtggagctcttcgcgtgtccggacgacgtccccagcctggagaacttcgcgctcggggacacacccacgcgggaagcaattcaaagtctggtgaccgagttgctcggcctgggtcccgaactgagcgtcgacatgttcgctctgtccacccggcatgatgtgcggccgctcgtgctgcgcacggcgctgacgtacctggagctcgaaggcgtgttgaggcaaggcacgccgtactacgcgggctacaaggtgcagccgctcatgcccattgacgcgctcgtggggcgcttccaaggagaacgggtgcagttcctgcgcgacgtgttttcccaggcgaagaagggacgcacctggtactcgctcgacccggccgaggtggcgagttcgcttcggcagccccgcgagcgcgtggtccgggccatcgaatatctcgaggagcaagggctcgtgttgctccaggtctccgagccgcgtcagcgcttcacacggctgcgcccccaggaggacgcagcagcgctcaccgcactcctccatcagcggtttcagcagcgcgaggcccaggaggtcacgcgtgtccgggacgtactgaagctcgtcacccatgcggggtgccagagcaatgcgctggtcgcccacttcggtcagcggcgggagcagccgtgtgggcactgcaccttctgccggaccggggcggcccaggtgcttcccgcggtgcgccagaggccggcactgcccgcgggcctcgacgcggcgggcttccgagccctggccgcgaaacatcccgagtcgctcgggcacccgaggcaggccgcgaggttcctctgcggattgagcagccccgccctcacgcgggcgaagctcggcggccacaagttgtttggcgcactggagggctggcccttcgaggaggtgctggacttctgtggccggtcggccgtggattga

SEQ ID NO: 5345 - DNA, 1380 bp, Myxococcus xanthus
ctctccgcatgcgcgccccccgtggacgaaacggacacggcgctgacccagcaatccttcgcgggtgacgaggacgaccccgactcccactcccaaggtacccagcttcacgcaactcccgtgcgcaccgtgatgtacgacgaagcactcgtgcagcacgacggtgcgctccgggtcgccaacctgaaactgacgcgcggggaaatcgtggccaacatgcccctctccgtggatggcaccacgccgagcctgatgttttgcggcgggggagcgcccgcgaacgagaagcgaagctgtggcttcgtcgtggacggacaaggcgtctgttcgccaggaagtctcgtcacgctcatgggtggcgacagcggctcccctcgaaaccggtgcacgggggcccccgtggtccgcgtctgcgcgggcgaagccccgtgcgagcaccaggggccgggctatctcgcctccgccaacagcagcttctccctcaacaactgccccgccgtcacgttcacctgtccctccagcggcgtgtacaccgcgctcgcgggaccgggcacgcccaacaccacctggctgatgcagctcacgagccggtcgagcacctaccccacgacacgcaagatcctccgaggcgaggagctgattggcgcgcggctccgtcagccgtccatgggccccgccctggtggtcgaggacgtcatcaacgcgaacgcgctccccaacaccgaaggctccggcatgtgggagccgagcgggcacaccttcctctaccaggtgcgctacacgacggcgtccgtgcccctgtgcccgactggggcgaactgggccgtgccagtgaagggactcttcgacctgcagggcgaccggtacgagagcccccgggccttcacgctgggctgtgacgcgggcgtcatcgccaagtgctaccgctggggctaccacccgtggctggacggcgcgacatccgggcccatcaccgaggctcactggtcctgcacccgcatggcgcgcgccgactactgcggccagggaacgtccttcaccctggacggcacccgcatccgtccctgggacgccctgacgccggccatcatctccgcgccctcgccggactccagctcgaatgacctgaccttcgaggcgggttggaacaccgcgggccccgcgtgcctcagccacctgcgctggaagcacctgaccgcgccctgcgtgccgctcaatccccccatctacgatgcgaacggcaacatcgtgaacgattgcagggacccgaacacgccctacgccccgggcaagtgcgcggagatttgcgacaacgcagaggaggccgcccagtactacggcagccgcgtcttcaatcactccgccatcaacacgccctga

SEQ ID NO: 5346 - DNA, 564 bp, Myxococcus xanthus
atgaaggcgtggatcgcaggtgcgctctccatctctctggcagcgggaagcgccctgggcgcggcgccggccccggagccggtggacgcgacgttacgcacctccgcgggaaaggaggtccggctctccaagtggcgcggaaagccggtcatcctgttctatgaggacaaggactcgaccaagctcaattcgaccctgaagaaggagctgttcgcccgggggcaggagcgcggaatcctggacgcggcctgggtgctggcggtcgcaaaccttcagaatttcgacttttttccggcccggcagattgccctctccttcgtccgggacgaggagaagaaggtgggcgtgcctatcctggtggatatggatggagcactgggaaaggcgccgtggaagctgccgctgaaaacgtccaacatcgtgctgctggacgccgaaggggccctggtctaccggcactccggccggatgaagccggatgagctgatgaccttcttcgccgtcctgagccgcctggtgggcgtggacctgaacagcccggcgccctcggagccctccccgtga

SEQ ID NO: 5347 - DNA, 602 bp, Myxococcus xanthus
atgcggggcgcgggcacggtgcggcgcttcgtatcggcgtccgccattggatactacggcggaacgcgcggcgcggatccactgacggaggagagcccttcgggtgacgacttcctggcccgcgtgtgcgtggactgggaggctgatgcgatgcaggcacacgagtccagcatccccacggccgcggtgcgcatgggcgtggtgctgcacccggaggggggcgccctccacaagatgctgccccccttccgcgtgtgcgctggcagaccggtgggcaccggcgagcaattcgaaagctgggtgcaccgcgaggactccagggatttgctccccttcctgctggcccatccccagtggagggcatggtgaacgccaccgcgcccacgccggtgacgaacgccttcttcgcgcacacgctgggccacgttctgggccggccgtccctggtgcggatgcccgcgttcatgctcaaggcggcgctgggagagatggcgaaggtggtgctggagggccagcgcgtgctgccccagcgcgcccatgaggcgggcttcgtattccggtacccggagttggagggcgcgctgcgcgacctgctggcctag

SEQ ID NO: 5348 - DNA, 1191 bp, Myxococcus xanthus
atggcggacacgacgctgacccccggggcggagctggagcgactggtcgacatcatgcggaagctgcgcgctgaaggcggctgcccgtgggatcgcgaacaagacctgcgctcgctgcggccctacctcctggaagaggccttcgaggtcttggaggagatggaccgggtcgcctacggtggctcctggcggaccttctgcgaagagctgggagacctgcttttccagattgtcttccacgcccagctcgcctcggagcttggagagttctccctggctgacgtggcgaaggccattggcgacaagctggtcagccggcatccccatgtcttcggcaacggccagcgaatggaaggcgccgagcaggtcctggacaactgggccaagctgaaggccgcggagaagaagcgcaagacgggccgggagggctcggtgctggacggcgtccccgtcgccgccccggcgctgatgcgcgccgagcggctcacggagaaggccagccgcatcggcttcgactggccggacgtcgccagcgtgcgcgccaagctgacggaggagttgggggagctggacgaggccatcgccgcgaatgatcgggatgccatcgagcacgagctgggggacgtgctgttctcgctcgccaacctcgcgcgcttcgtcggagcccccgccgaggacgcgctgcggatggccatccgccgcttcaccgcccgcttccagcacatcgagtccgccctccgcgccgagggtgtcgccctgggggacgccaccctggaacacatggagcgtcactggcaggaggccaaggcgcgcgaaaaggccctgccatctccgacgtgggttccgcgcgcgcccgtcaccacgctgaggctgggcgtggcggatcttcccgcgcagcgcgccttctgggacgtcctggctccgcggctggggtggatcacccgacgggctccggcggcggatcaggcccgctatgaggacgggggcatcctgatcgccttcgaagcggcagggacgcccacaacgggcctgcggctgagcctgacggccccctccctggcggcggtggagcgactccccggcatcctcgcggagattccggggagtcggctgatccagcaccaggccggccggctcacctttcaagatcccgcggggctggtgtgggaatatacgacttcggtagagtga

SEQ ID NO: 5349 - DNA, 1134 bp, Myxococcus xanthus
atggacgcgaagacactggaggcgcgggcccgcgccgagggaacgcccgtcatcgaatcggacaccgccaccttcgtgtggcgaggccggggccccatctgcctccaaggtgacttccaggactggcgcggcaagccgctgcccttcaagcgcgtggcgcccggactgtgggctcgcacgctgacgctgcccgcggatgcctacgtcgaatacgcgctggaggacccgcgcggccagcgcgtggaggacccgctcaaccgccacccttccgacaacggctttggcggcatcaaccactcgttccacatgccccaggcccgctcgtccctgcccgcccggcacccgcgcggcgcgcctcggggccgcgtcacccggcacgtggtggacacaggagacgtggacctgccgggccaacgccgggtgtacctgtacgcgccgcccacggacgcgtcggtgcccttggtggtggtgtacgacggcgaggactatctgcgccgcgtccgcctgccggagctggtggacaccctggtggccgaaggccgcatgcgcccggtggccctggcgctcgtgtgcaacggcggtgagacacgcagcatggagtacgcctgcagcgagtacacggtggggctgttgaagtggaaggtgctgccgctggcgcgacagaaactgtcgctagtggacgagcggcgcagccccggtgcccacgcggtgctgggggcctcgctgggcgggttgatggcgctctacaccggcctgcgcatgccggacgtcttcggccgggtgctgtcgcagtccggggccttcgcggtggagggccatgacttcgtcgtcttcgacctggcgcggcccccaccccgccgcccgctggacatctggctggactgcggccgctttgaaggcttgctggagggcaaccgccgcatcgctcccgtactctcagaagccgggcatcaggtggaacttcgggagtacagcggtgggcacaactaccctgcgtggcgtgaggacctggtacacggcctggagcgccacttccctcccccgccccgccaagcgccgggagtcattgcgtttttccgggcggtgacgcgggcgcgcccgccgtgcggggacactccggaggacgcacgttag

SEQ ID NO: 5350 - DNA, 594 bp, Myxococcus xanthus
atgtctcgcattgatggtggtaaccgcccgtcctcgcccaagggcccggcgcatgagcgcgccagcgctccggagcagcggccggcctccggcaccgccacccaggggacgaagggcgtccaggcacaccgcacggtgcagacgttccagggccgcagcgacttcgagcccgaccggcgtcccgcccagcgcgccgtgacggcgccgcctccggacgccaccgccatcgcgggtgctgacgcggagttggagctgctttccgagtttcccgaccaggcggatgcccagggcgggctcgcctccgccatgctgcacgcgcacgcgaacgagcccgcctcgcaggcccgcatcgtcgagcgcctgaagcaggacggccgcctggagtcgctcttcggcgaggtgttccgcgagggcaatccctatgtcgagcagccgcaccgcaacgccgtcgtgcgcgcgctggggaccgccatggcgcggggcacggtgacgtccgacgacctgcgcgccttcgctcgcggcgcctatgcgcaggagtggcggcagatcggctccgagctgacgacgccccgcccgctcacggagaagccatag

SEQ ID NO: 5351 - DNA, 1398 bp, Myxococcus xanthus
atggacaccgcgcgcttcatcctcttcgccctcgtcaccggcatcgccacggtcgccgtccacgtctacttgtaccggcgcctcttcacggccacgtcggagcaccgcgcatggcggcgcgtgggcatgggcgtcatgacggtgctgggcacactgctagtgctgtcatggtcggtgacgcgcttccttcccatggactccaccttcgccgtggccacggcggtgtggacgtggatgggcatggccatctacctgttgctcgcgctcggagtgttgggcgcggtgcgcaaggtggcggcgcgaatgcagcgctcaagcggcgagccggcggtggtggagctgcgcggtggcgagacagcctcggtgtcccatgcgcatgcggtggatggctcggcacaggctggcggcacgctggcggcgacgggcacggagtccgtgtcagtgactccggaagccctggcgaccagtggacatggcgcggcggcgacgcacgccgaagctgctccggtggcgatggcggaaaggcccggcggcgccacgtccgaggctccagcaccggtggatgtggaacgccgacgcttccttgctcgggcgacagccggcggagcagtgctggccgcaggtggcgtgacgggcttcgggatgtggagcgccttccatccgcccgtggtgaacgaggtggcggtgaagctgccggggctgcccaaggcgctggatggcttcagcatcgtccacttgagtgacatccacgtggggccggtcatccggcgccggttcatggacgagctggtgcgccgctgcaacgcgttgcgctccgacctggtgtgcatcactggcgacctggtggacggacacgtcgcgtcgctggccccagcggtctcggcgctgtccgagctgaagtcacgccacggcacctacttcgtcacgggaaaccacgagtactactggagcgacgctgcctgggcggaagcgctggagcgtatggatgtgcacgttctgcgcaaccgtcacgtgcgcattggcgacacggccgcgtcattcgacctggtgggtgtggacgactggtcggcgggcaagatggggttctcgcaaggctatgacctggcggcggcgacggcgggccgggattccgagcgggcctcggtgctactcgcgcatcagccgtcgaactggaaggtggcggcgcgggaaggaatgggcttgcagctctccggacacacacatgggggacagttcttccccttcacgctggcggtctccgccatctgggagcacgacgcgggcttgtttcacgaaggagaccggcacctgtatgtcagccggggaacaggtttctggggtccgccgctccgcgtcggagcgccgccggagatcgtccgggtgacactcctggcgtga

SEQ ID NO: 5352 - DNA, 312 bp, Myxococcus xanthus
atgctcgcggccgaggccgccgactccaatgaccaggtagcggaggccatccgagacaagctggccctctacgcgacgacgctggagcgcctcatccgtcacgggcagcagatgggggagttccggcaggacgtggacgcactcgccgccgcgcacagcctcctgggcgggctcctgggcatgctcgtgcaccagaacctcttccgcgcctccgtggattacgacccgctgtaccgcgccgtcatgcggatacacctggcgggactcgtgcaggccacaggcttcgactgcgtcaatgccagccagtcctga

SEQ ID NO: 5353 - DNA, 852 bp, Myxococcus xanthus
atggacgtcgccgtcctcaccttcgaaggcctgcctcaactcgatgcctttgacgcatcgctgctgcccgcgctcgcggccctgggcgtggaggcccggcccgtcgtctgggatgacccggccatggactggaagacggtgcggctggccctggtgcgcaacacgtgggacagccacctgcgccgcgacgccttcgtcgcctgggcggacaaggtgggccgcctcacgcagctccacaatcccgcgcccgtgctgcgctggaacacgcacaagcactacctgcgcgaactagaggagaagggcgtgttggtgacgcccaccacctgggtgcgcaagggcgacacgctcgatgtgggcgagctggcgctcaggcacagctgggacgcggtggtgctcaagcccgccgtgtccgcgggagcgctcaagacgcacgtcttcccacgcgcggaggcccccgccgccaccgcccggctggccgagctgacccgcgagggcgacgtcatggtgcagccctacctcaccgccttcgaaacggagggcgagcgcagctacgtcttcttcgacggcgtcctcagccacgcggtgcgccggccccccacgctgctggacgcaccgcgcggcttctccgagcccaccgccttcacgcccgaggacgcagccgagctgcggctggcggagtccgtgctggaagcagtgggacgtcccctgctctacgcccgcgtggacgtggccaccgacaacgcgggccagtcgcggctgcaagagctggaggccaccgagccgcgcctgttcctgtcgctcgacgccggggccgcggaccggctggcccgcgccatcgtcgcgaagctgtga

SEQ ID NO: 5354 - DNA, 537 bp, Myxococcus xanthus
atggctcgcgcactgctgctctcgctgctcgtgaggcagcacatggctctcaaggagaagtttcgcgccaagtacccacacccatggctggtgtgggaggcgggcgcttggaatgtccccgaagtggtggagggcaacgtggccgccacgcggctgccgctgacggacctgcgggactgcctgcccgctggagacgccctgtgcttcgaactggtgggccagacggacggcagcccgctgcggctgggccgggcctcgaacaacgcgctggtcgtcaatgacgccaccgtgtcgcgcgagcagctccacctgtcccccaccctggaaggacgctggacggtgacacgcgtggccgcttcccggacggtgacgctgggcggcacggccctggagccggagcagcccaccgtgctccagcccggcgtgcagcttcacgtgggtgatgtgcgcctcaccttccacgcggcggaggacttcgacgagcgcattggccgcatcgccgctcaggtgctcgcccagacagcggcgccccgctga

SEQ ID NO: 5355 - DNA, 441 bp, Myxococcus xanthus
atggcgaatgggacgctctggattctggtggggaacgcaagccgggcccgcctcttcgcgacggacgcgaaggcggaagaggactggcggctggtggaggagttccaccacgacgagagtcgggcccgtcaggcagagctgattgagcaggcggacaaccccaatgccggcaccctgcacggcccgccggcggagaacgagcccaatggacgaagggagctggagcacgaccgcttcgcccgcgagctgtccgtgttcctggacaaggcacatgaccggcgcgacttcgacaagctggtcatcgccgcgccgccgggattcctggggaggattcgccgcttgctgagcgcccgggtccggcagcgcgtcctcctggacgtggactcggactactccaacgtcccggcgaaggagctgcccaaccgggtgcctgtcatctga

SEQ ID NO: 5356 - DNA, 1782 bp, Myxococcus xanthus
atgacgttgcgcatccgcaccatcgcgcgcatgacgggcatccgcgaggcgacgctgcgcgcctgggagcggcgctacggtttcccgcgtccgctgcgcagcgaaggcaacaactaccgcgtctattcgcgcgaggaggtggaggccgtccgccgtgtggcccggctcatccaggaggaaggcctgtcggtgagcgaggccatcgcccaggtgaagacggagccgccgcgtgagcagcccgaagccgagcgcctgcgcgagcgcttctggtcctccgtgggggccctggaaggggacgaggtgacgcgcgtgctggatgacgcacagaccgtcatggacgtggaggcctactgtgacggcttcctgctgcccctgctgcgggagatgggcgtgcggctggacgtcgcgcgggagcacctggcctccgccctcatccgccagcgcctgcggcaggtgtatgacgcactgtcccccgcgcctgccggcccccgtgcgctgctcgcctgtccgtcaggggaccaccatgaaggcggcctgctggtgctgggcatccacctcaagcgcaaggggtggcgggtgacgatgctgggcgcggacaccccggcggcggcgctgcagggggcttgcgtgcaggttcggccggacgtggtggcgctgtccttcgtgcgcgcccgtgcgccggaggagttcgcgtccgtcctggaagacgcgctccgggcctgcgcgccctttcccgtggtcgtcggcgggctgggggctcgcgagcacctgaaggccattttctcgctcggcgcgcagtacgcggagtcatcggaagagctggtggccatctggaaccaggtgcgcaacgctcagaatcgcccgtagtcttgccgtagcgacatggctgagcgcacctatcgaatcaacatcgccgcggagttggcaggagtccgggtggagctcatccgggcctgggagcgccgctacggcgtgctcacgccgcgccgcacccccgcgggctaccgcgcctatacggaccgggacgtggcggtgctcaagcagctcaagcggttgaccgacgaaggcgtggccatcagcgaagcggcgaagctgctgcctcagttgatggaggggctggaggcggaagtcgcggggcggggtgccagccaggacgcgcggccgcatgcggagacgtggcgggagtccatgctcgccgccacccaggcgtatgaccagccgcgcgtgtcggacgtgctcgacgaggtgttggccgcgctgcccccgctcaaggccttcgatgaggtgctggcgccccttctctgcgacgtgggcgagcgctgggagtcgggcacgctgacagtggcgcaggagcacctggtgtcgcagatggtgcgggcgcggctggtgagcctgctgcacgcggcgcccctggggcggcaccggcatggtgtcctggcgtgctttccggaagaggagcacgagatgggcctgctgggagcggcgctgcggctgcggcacctgggcgtgcgggtgacgctgctggggcagcgcgttcccgcggaggacctgggccgcgcggtattggcgctgcggcccgacttcgtggggctgtccacggtggccagccggagcgcagaggacttcgaggacaccctgacgcgtttgaggcaggcgctgcccagggggctgcccgtctgggtgggcggcgccgccgcgcgctcgcaccaggccgtgtgcgagcggttggcggtgcacgtcttccagggcgaggaggactgggaccgcctcgcgggtacgtga

SEQ ID NO: 5357 - DNA, 663 bp, Myxococcus xanthus
aaaggaggcccgctgggctgggcgtgggaccggtacatcggatggaagttccgctcggcgttccggggattgtgggtgcgtggggcgcttccgccgggagggccgggccggctggtgtacctgaaccactccaactggtgggacggcttcgtgctcaaccagctctgccagacggcgggttgggacggctactgcctcatggatgaggagaacctgcgccgctaccgcttcctcacgcgcattggcgccttcagcatccggcgcaaggacgcgacgtcgccggtggcgtcgctgcgctacgcgaaggagttgctgcgaaagccccgcgcggtggtgttcgtcttcccggagggcgagcaccgccccttcggcgtgctcccactgcgactggagcggggcgtggagctactggcgcgggtgtcgaaggtggagtgcctgcccatcgcggtgcgctacggcttcttcgaacacgagcgtccagacgtgttgctggaggtgggcaccccgcatccgcccggtgacatgtccgtcttccaggagggattggagacggtggtgcggcgactggcggcggtgacgtccatggagggcttcacgcgcagggtgtccggtgcgcgaggcgtggcggagcgctgggacgcggcccgggggctggcgtcatga

SEQ ID NO: 5358 - DNA, 615 bp, Myxococcus xanthus
acggttatggccaccaaccacgccggcaccgcgcgcacgcaggccaccagctacgcgcagattccgccggtgcccttcaaggtggtgctcaccagcgacaccgacggcgtctacaccgacctgcacctgtacgagcccaccgacgccagtgccaaggacggcaccctggacgtgcggaagatggcgcacgtgtactgggccgacaccgcgagcccctccggtggcaccttcttcctcaactcgcagggcggcgacttcgaccagcccgcgtatggcccgtacctctacatccaccgctcgccgcccaagggcgtgtacctggtggccaccaactactggcccagcggtgacaaggcccacaccgtggccacgctgaacctgtcgctcttcgaaggcacgccgaacgagatccgccgcatggtgcgcatccccctggctacgccgggcaccacccgcgtgctggcctgggtgaacgtgctcggggatgggcaggccgaggtgttcgtgccttcgcaggacccgcgtccgaagcacgccgcatggccgaagaacctggatgaggccctcaaggcgctccagtccaatgaggatggcggcggcgaaggcgagtactga

SEQ ID NO: 5359 - DNA, 351 bp, Myxococcus xanthus
atgatggagacgaagtgggcatacctcatccacctgttgggctggacgctgccggtcatcgccttccagttggtggtgctggtgcgccactacaaggaacgctccggcgcggtgctcaaggcggtgctgccgccggccttcatcatggggctgtacctgtccatcgcggaccacctggccatctccaccggcatctggaactttggtgaaggcaagcacctgggcgtgtacctgggcgtggtgccgctggaagaggtggtcttcttcctgattaccagcgtgttggtgtcgctgggcctggcgctgttcaccgggttggtggcgctgctgggggaggcccgggcgtcgtga

SEQ ID NO: 5360 - DNA, 387 bp, Myxococcus xanthus
atgacgtacgcgcgattcctcgggctgttcgtggtggtgcccatactcttcctggcgtggcgctaccgccgcaccttcacgggcaggagcctggcgcccatggggctcctgctcatcgtcgtgtacgcggcgacgtcgccctgggacaacctggcggtgaagaggggcctgtggggtttcgaccccgagcgcatctggggcatcaagctggggtacctgcctctggaggagtacctcttcttcggcctgcagacgctgttggtggggctgtgggcccaggcccggctggcgcgtgcgctggcgccggatgcccaggcgtctcggcccgcggcggagacgggtgagcgccgcgaaggcgcgctgacggctcgggaggtggcgccatga

SEQ ID NO: 5361 - DNA, 642 bp, Myxococcus xanthus
atggcgggcctgctgcgttacacccaccacagcttccgggccctggatgcgatgagcgcgggcgccaaggccgtgtgtggcaaggctttgggcttgtctcccgtggccgtggagtcgctgcggcggctcgcggaccacatcggcgaggacctggagctggccaagcgtcttcacgcccagggactgggcgtggtgctgagcagcgccccggcggtggtccccctggacgccgaggtgctctgggcggcgcccctgtcgcgcttcacgcgctggatgcaggtactggccagtcaccggcccgcgctgtatcccacggtgccgctgctcttcacgccgacgctgccgctgacggtgctggccgcggcgctggggtcgcccgtgttggcgggctcggtggtgggattggttgccgtgcgaaccttgctggcgcttcgattggccgggctccacgcgccggtggcggacgcggggagggcctatgcggtgacggactggttgttgggcgaagcgctcttgcttgcggccttcctgcgctcgctgtggcggcagggaacggtgacgtggcgggggcagacctatgtgttgcgacccgggggccgaatgatacgggtggctccggagctgagtggaggacccggatga

SEQ ID NO: 5362 - DNA, 927 bp, Myxococcus xanthus
atgatgcgcctggcgaaactccccgccctgccggacgcggcgggcacctaccgctggttctatgcggacgtcaccgcgggaccctacagcgcggtgtgcatcttcatgctgggctcgctgttctcgccccggtactcggtggcggcgcggcggggcggacggccgctggagcacagcgcggtgaacttcgcgctgtaccacgcgggggtgcggcggctgtgggtcctcagcgagtacgcgcgcgcggagttggatgctccgggccggctgcgcatcggtcgctccacgctgtcgtacgagggggacggcacggtgcggatggccgtggacgacgggacggcgccgtggggccggcccgtgcgcgcgagcctgacgctggagccgatgacgcccgtgggcgaggtggtgcagctcatgccggggctgccgcactactggcaggcgctggcgcctcgttcgcaggcacggctggaggtgtcctcgctgggcatcgaggcgagcggcctgggctaccacgacaccaaccacggcggagagctgctgggcgcgcggttgtcggggtggcactgggctcgcacgcaccgcgaggacgagacggtggtggactaccacctgcctgaaggtgtcgcgccgctgcgagtggtggccggcgcgcgcggagtgcgctgcgaacggggccccacgttggtggagtcgcggcccacccacatcaccggctggggcctgcgcgtgccgtcacgcctgcacgcgggaaacgtggtggtgggacagccgaagctgctggagtcgtcgcctttctatgcacgactggaggcgcgccaggggcctctggactccctgggcgaggtggcggacttccgtcgcttccactcgcccttcatccgctggatggcgcacttccgcacgcgcatgggacgggcggcatga

SEQ ID NO: 5363 - DNA, 1458 bp, Myxococcus xanthus
atgaagcgcacccgcgtcgcggtggtaggcggcggcatcggtggactgacggccgccgggctgttggcgaaggacgggcatgaggtgacgctgttcgagcggggcgcctcgctgggcggcaaggcccaggccgtcatcgtgaatggcatcaccctggacacggggcccacgttgctgacgctgccgcacctggtgcgtggcaccttccagcaactgggcgccgaggacctgctgccgcgcttcacggagctggagccgcagtgtgcctaccgcttcgaggacgggtgtgacttcacggcctacaaggacgtggagcggatggcggagagcgcggcgggtgtccgcccgggtgagcgcgacggcatccgcggcttctacacggaggccgcggccatctggcgggccgcgggcgagccatacctggaggcccccttcgagggcatggcgggcttcatgacgcgcgtggcgaagcgtggcgtgggggccgtcatggcggggatgaagatgggcacgctgcacgagctggcggcccggcacttcaagacggaccacctgcggcagtacgtgggccgcttcgccacgtacacgggcgcgtccccctacgaggccagcgcggccttcgcgctgattccccacatcgagcatgcctatggcgtgcaccacgtccgcggcggcatcggtgcgctggtggacgcgctggggcaggccgtgcgccggctgggcatgcgcatccacctggacacgcgggttcgcttcgagcgcacgcgcgagggctaccaggtgggcccgcaggagggcacggagcgcttcgacagtgtggtggtgaacgcggacccgctggagcggctcgctcgcgcggaggagccgctggcgctgtctggcttcgtgttgctgttggaggtggagggccgcatggctctaccgcaccacacggtgctcttcggcggtgactaccggcgcgagttcgacgagctgttcggcgggcagctcgcgtccgacccgacggtgtacttctgcaacccctccgccaccgacgagagcatggtgcctccgggccgcaccgggttgttcgtcatggtgaacgcgcccgcgctgcccgtggatgcgcgcggcgcggagcaggccacccgcgactgggaagcaggcgccgagcgcgtgaaggcgcagatgctggagcgcctgtgccggcactacccggcgctcaaggggcgcgtgcgtgtcatcggccagcgctcgccggtggacctggccgcgcagggcgctccgggcggctccatctacggcttcctgccgcacgggaagttcggccccttccgccgaccgcgcatccgcggcaacacgccgggcctgttcttcgcgggcggtggcacgcatccaggcggcggcgtgccgctggtgatgttgtccggtcgcttcgccgcggagctggcttcgcagcacctccggagggatgcatga

SEQ ID NO: 5364 - DNA, 846 bp, Myxococcus xanthus
atggtggacggggacgacgcggcgagcgcggccgatgcgttgccggtgcggctggcgcgggcgcggcagcgcgtggcggagctgtacctgcccatgccggagctggcctcgcgcgagctggggccgcccgcggaccgggtgaagggcagcgaggccgcgacgccgtgggacgcgcgggagttcgctgcgctcgagcacacggtgcgccacttccggattccggagcagcccttccaggacctcatctccggcatggagatggacctgacgaagcaccgctacgccacctgggaggagctggacctctactgctaccgggtggcgggcgtggtggggctgatgctgacgccggtgctggggtgctcggacgcggcggcggtggagcccgcggccgacctgggccgggccatgcagctcaccaacatcctccgcgacgtgcgcgaggacctggagcgcggccgggtgtacctgcccgcggaggagttggccgccttcggattgtcggaggacgacttgcggcgcggacaggtgggcgcgcgctggcggtccttcatgcgcttccaggtggagcgctcgcgggcgtactacgcgcgggcggcggccggggtgcgctacctgacgggcttcggcagtcagcggatggtgcggctgatgggcgccatctacggcgacatcctgcgcgacatcgaagcgcgcgactacgacgtgttcagcgcccgggcccacgtgacgacgcgccgcaagctcgcgctggcttccgcggccatggtgcggcccgccgcggtgctgcccgccccccagggcgaggtgcgcatgccgctgcttcccaccggggcgggagggtga

SEQ ID NO: 5365 - DNA, 1035 bp, Myxococcus xanthus
atgtacgcggacgtcagccgcttcttccaggacgagcggctgcgcgcggcgatgaccttccagacgatgtacctgggcgtgtcaccctacgcgtcgcccgcggtgtacggcctgctgcccttcaccgagctgggtgtgggcatctggttcccgaagggcggcctgtatgccattccccaggccctggagcggctggcgcgcgaggagggtgtgcgcttccactacggcgcgcccgtggagcgcatcctcaccgatggcggccggactcgaggcgtgcggctggagggcggcgaggtggtggaggcggacgcggtgctgtgcaacgcggacctgccctacgcgtacgagaagctgctggacccgaaggcgacgacgctcaagcgcaaggagaagctgcgctacacgtccagcggctacatgctctatctgggcatgaagcggcgctacccggagctcttgcaccacaacgtggtgttcggccgggactacaagggctccttcgacgacatcttcgagcgcttccgcgtgccagaggaccccagcttctacgtcaacgcgcccacgcgcaccgacgcgtccctggcgcccgagggcaaggatgcgctctatgtgctggtgcccgtgccgcaccagcacccggacctggactggaaggtggaggggccgaaggtgcgcgcgaagttcttcgcgcgcatggcggagctgggcttcccgtcgctggagtcggacatcgaggtggagcgcgtcttcaccccggatgactgggccggcaccttcaacctggcgcgtggcagcgccttcggtctgtcccagaacttcacgcagattggccccttccgtccgtccaaccaggacgcgcgggtgaagaacctcttcttcgtcggtgcttccacgcagccgggaacggggctgcccacggtgctcatctccgcgcggctggtgacggagcggctgatgacgtgggcccacgcgcagggcgtttcgttgtcgcctcggacggccgccgccacgccactggaaggggtggccgcgtga

SEQ ID NO: 5366 - DNA, 1086 bp, Myxococcus xanthus
atggcactcacgcttcccgatgcgcagccgccgacgggcctgcttcctctggagcaggcctggctgcaactggtccagacggaggtggagacctcgctggcggagttgttcgagctccccgacgaggccggcctggacgttcgttggacacaggcactgacgcaggcccgggcgtataccttgcggcccgccaagcggctccgccccgcgctggtgatggccggacactgcctggcgcgtgggagcgcggtggtgccctccgggttgtggcgcttcgccgcggggctggagctgctgcacaccttcctcctcatccatgacgacgtggcggatcaggcggagctgcggcggggcgccgcgcccctccaccggatgctggcgccaggacgcgcgggcgaggacctggccgtggtggtgggggaccacctcttcgcgcgcgccctggaggtcatgctgggctcggggctgacgtgcgtcgcgggcgtggtgcagtactacctgggcgtgtgccgtcacacggcggccgggcagtacctggacctggacctgggccgcgcgccgctggcggaggtgacgctcttccagacgctgcgcgtggcgcatctcaagacggcgcgctacggcttctgcgccccgctggtgtgcggggccatgctcggcggtgccagcagcggcttggtggaggagttggagcgcgtgggccgtcacgtcggtcttgcctaccagcttcgggacgatttgctgggcctttttggtgattcgaacgtcgctggcaaggccgctgacggcgacttcctccaaggcaagcgaacctttccagtgctggccgccttcgcgcgcgccaccgaggccgagcgcacggagctggaggcgctgtgggcgctgccggtggagcagaaggacgccgccgcgctggcgcgggcccgcgcgctggtggagtcctgcggaggccgggccgcgtgtgagcgcatggtggtgcgtgcctccagggccgcccgccgctcgttgcagtcgctgcccaatcccaacggtgtgagagagctgctcgacgcgctcatcgcccggctggcccaccgcgccgcctga

SEQ ID NO: 5367 - DNA, 4236 bp, Myxococcus xanthus
gtcacggccccgccgatgcgcatcgccgcgggtacccagcactcgctgtatctgtcacccggaggcgacgtgtgggcctggggcggcaatggctccggccagcttggcggggcggagacgtccctccagggactggctccagtgcggctggcggcgctggagaacatcgtgtcggtggtgtccggagacgcccactcgctcgcactgggcgcggatggctcggtgtggacgtggggcggcaacagctccgggcagctcggtgatggcaccaccaccgatcgcgcgacgccgatgcgggtggccggcctggacagcgtggtggcggtggccgccggagacttccactcgttggcgctgcgcgaggacggcacggtgtgggcgtgggggacgaacttccacggacagctcggccggggacacacgcagccggggctcacgcccgaacaggttcccgggttgaatggcgtggtcgcgctcgccgcgggcttcgacttcaccctggccgtgctggaggacggcacggtgcgcgcgtggggctccaacggctctggccaactgggtgacggtacctccacccagcgcctgtctcccgtgaaggtctccgagctcagcggcatcaccgaggtgagggcgggcacctaccacgcgctggcgctgggcaaggacggcggcgtgtggacgtggggtagcaatgcctccggacagctcggtgatggcacttggaatgaccgcgccgtacccatgcaggtgccggggctcgagcgggtgaaggccgtggcttccatggactcggattcgctggcgctgctcgacacgggcgccgtgttcgcgtggggtgccaatggctccggccaactgggcgatggagacaccaccgaccgcgccacgccgggaccggtgccggggctgaatgcggtggcctcggtggtgggcggcgcgcagcacgcgctggtcctgcgaaaagacggcacgctctgggcctggggcggaggcctgtcgggccaactgggccacggcggctccgagcgccacgtggtgcccgctccggtgatgcgcctggcgggcgtgacgtcgatggcgacgggcagtttccactccctggccgcgctgggggatggctccgtctgggcctggggccgcaacacctatggacagttgggtgatggcagcaccgccgagcgccacgccgcggtgcgcgtggaggggctcggcggcgttcgcagcgtcgcctcggccgcccaccattcgctcgccgtgggcatggatgggacggtctgggcgtgggggcgcaacgccgccggacagttgggggatggcaccacgctcgaccgcgcccggcccgtggcggtgccgggcctgacgtcggtgacggcggtggccgcgggcggcagtcacgtcctggcgctgcgcagcgacggcagcgtgtgggcctggggctacaacgcgctgggacagttgggggacggcacgacggtggaccggttgacgccggtgcgagtgtcggggctcggtgcggtggtggcggtggcagccggttcgtacttctccatggccctgcagtccgacggcacggtgtggacgtggggcgagggcttcgagggacagttgggggacggcggtggcgtgcagcgactgagtccggtgcgtgtggagggattggcgaacatcacccgcgtggcggcgggctccgcgcatgcgctggccgtgcgcggcgacggcacggtgtgggcctggggcgacaatggggaagggcagctcggggacggctcttgggcggaccgcttccgtccggtgcaggtgccgggactgcagggcatcaccgccgtcagcggtggccgctcccactccatggcgttgcaaggtgatggcacggtgcgcgcgtggggctacaacggttacggccagctcggcgacggaacgctcacctcgcgcgtgcggcccgccctcatccccggcctgactggcatccaggcgctccaccccagccacctgcacgtgctcgcgctgcacgcggatgggacgttgcgcgggtggggctacaaccgcttcggccagttgggcctgggcgccgcgggttggagcgccgtgccagtgcaggtgcgtggcattggccgcgtggacaggttgtccgtcggccgcgcgcacacgctgatggtgcgcgccgatggcacggtgatggcctggggcgagaatggttcgggccaactgggcgacggcacctccacccaccgcacggggccggtgtccgtgcccggcgtgccctgtgtccgctctgtcgccagtggcatacagcactcgctggcgctggcgtgtgacggcaccgtctgggcttggggcgcgaacgcgcgggggcagttgggagatggcaccaccaccccgcgcgtgacgccgggactggtggaggggcttcggggcgtggtggcgctggcggcgggtggagacgcgtcggtggcgctgcgcgcggatggctccgtgtggagttggggcggcaacgccagcggccaactgggtgacggtaccctcacggaccgcgccctgccggcccacgtcgagcacctctccaacgcggtgcctgtgcctgtgggcgaaacgcatgccctggcggtgggcgaggacggcgcgctgtgggcctggggcgcgaatggctcgggccaactgggagatggtggcaccgcgccgagcctgacgccggtgcgtgtgaaggggctggagcgtgtggcgtccgtggcggccggacgtgccttctcggtggcggtgcgcgacgacggcaccgcgtgggcctggggcacgaacccgtccggccagttgggcgatggcaccaaccacgcgcggagcgtgccgaatcaggtgacctccttgaagggcatccgcgccatgtctgcgggggcccaccacgtggtggcgctgagcgccgacggcacggtgtggacgtggggcgacaacacgctggggcagttgggagatggctcgtcctcgccgacggggatgtggccccggcaggtgccggagctgcgaggcgtggaggcggtggccgcgggagagcagttcaccgtggccgtgctgctggacggtaccgcccgcgcctggggcagcaacgagtacggccagctcggtgatgggaagacgggcccgcagctgacgccgatggcggtgaaaatcgaaggaccgaaaatccgcccgcccgtgcgcaccgtgcgcgcctggggccagcacgcggtggtgcagatgtcagacggcaccgtgcagacgtggggcgacaacacgttcggccaactgggagacggcaccaccacgcgacgcgcggtgcccttgacggtgtatggattggcgagcgtggtggccgtgtcctcgggcgcctggcactcgctggcgctgctcagtgacggcaccgtctgggcgtggggcgccaatggcttcggtcagctcggggatggcacgtccactccgcgcaccaggccggtgcaggtggccgggctgggggatgtggtggccattggctcggggggctaccacgcgctggcggtgtgctcggacggctcggtgtggacgtggggctacaacgcgttcggccaactgggtgacggcaccgcggagtcgcgctccctgcccacccgggtggaggggctggagggcgtggtggccgtggcgggcggagaccactactcgctagcgctgcactcggacggcaccctgtccgcgtggggcaacaacgcgtcgggccagttgggagacggcacaggcaccacccgctattcgcgcgtggcggtgaagggcgtggacggcgtggtggacgtgcgcgcgggcgcgacgcacacggtggcgctgcggggcgacggcaccgtgtggacgtggggcgacaacgcgttcggtcagctgggggacggcgccagcggcacgcggatgcgcctggtgccccggccggtgccgaacctgtcctcggtgtccgccgtgggcgcgggggctcgccacacgttcgccgtggcgctcaagggcacggtgtggacgtggggacgcaattcgcacggccaactggggctgggggacaacacgaaccggacggagcccctgcgcgtgcgggagctgtcggacgtcaccgtggtgtcgggcggggcggatttctccctggccatgaagcgcgacggcacggtgctgagctggggctccagcctctacggctcgttgggcctgggcgccacggggcaccgctcgtcacccgggcaggtggcgctgccctga

SEQ ID NO: 5368 - DNA, 3768 bp, Myxococcus xanthus
atgatggcgggcgccacctccatggcgggcgcgggtggccaggctggcctgctgcgcaacgtggacgtgaacaacaccgcgctccaggagggcctgggcgagggtgtggtgaactcggacacgttcccgctgggcgacaccaatggcaacatggttgcctcgggctgtacctacacctcgatgccgtccacgagctcgctgccgcgctcggccgcgtacctgccgcacgtctccgagggtatctccgcggcggcgctcaacgagttcctctgcctgtccacgggcacgaacaacgtgatgcagccgcgcaccgccgtcatccacggcatcggcctgacggcgaaggagattcgcgtcatggcggagaacggcaccggccttatctggtcgccccgctcgaacatctcgctgtacggcgatacggccatggtgtcggcctacaagaaccagggtgtcaccatcgcgctgggcaccgactggctgcgctccggctccatgaacctgctgcgcgagctccagtgcgcggactacctcaacacctcgcactacgcgcggaccttcagcgacgaggacctctggcgcatggtgacgtcgaacgcgtcggacctggtggacacgttcgagaagacgggccgcatcgccgagggcaaggtggccgacctggccatcttccagctgcggaccttcacccgctcgccgcaccgcgcggtcatcacctcgaaccccgagcacgtggtgctcacgatgcggggtggcaaggcgctctacggtgaccaggcgctgatggccgggctccgcggcgcggacacctgcgacacgctggacgtgtgcggcgcctcgaaggaagtctgcctccagtccgagattggcaagaacctggaggcgctgacgtcgggcgccacggcgaagtacccgctgttcgcgtgcggtacgccggagaacgagccgacgtgctcgccccgccgtgcctcgctggactcgcgctggccggccgtcgtgaacagctccaccagctacaccggtgaggttcgcgccgcggacaaggacggggacgggctggtggactccgtcgacaactgccctgccatcttcaaccccatccgccccatggacaatggcaagcaggcggactcggatggcgacgggattggcgacgcgtgcgacccctgcccgctggaggcgggtaacgcctgcacgtcgttcaccgtgggcgacgatgaccacgacggcatcgtgacgtggctggacaactgcccgttcgttgccaacccggaccaggcggacgcggacggcgacggcaagggtgatgcgtgtgacgcgtgctccagcgttccgaatccgggcgacctgggctgccccgccaccattcacgagctgaagacgcccgtgggcggcagcctgccgctggtgggcaagccggtgtccatcctggacgtcgtcgtcaccggtgtggtgaagggcggcgcgagctcccagggctactgggtgcagacgtatccgctgccttcgggcacgagcgtggataactccggtctctatgtgtactcgcccaagggcgacctcgccgcgggtgatcgcatcgacatcaccacgggcgtgctgaccgtctacttcggcctgcccgagctgaccgaggtcaagtacgtcaagcgcagctccggcaacgaggttcccgcgccggtggtggtgacgacggccgacattcgcaccgggggcccgcgtgccgccgcgctggaaggtgtgctcgtggaggtccgcgacgtggcggtcaacacgggggtggacgagttcggccagttcctggtgaacgaggcgggtgacgccggtcagccgggtctgatgattgacgaccaggcctatgccttccaggtcccgtccattggcacgcgcttcggcgcgctgcgcggcgtgctgacgtacaacttcaatgactccaagctggtgccgcgcttccaggcggacatgccgctgccgccgccgtcgctgacgggctttggtccggacggctatgcgcgcgtgggtggcacgggcccggtgaacaccttcccgcaggcgctgacgctgtcgctgtcgtccgcctacgcggaggcgctcgacgtcgtcatcacctcctccaacgagagcgcgctgagcgtgcaggacggccgcatcaccatccccgcgggtcagacgtccgcgacggtgcaggtgaacgcggtggcgcccgcgcagagcgtgacgctgacggccacgctgggcggctccacgcagacggccaccatccgggtgctgggtgccgacgagcagcccgaggtggtaggcgtcaccccgggtgacgtgacgatggtgcccggcggcgaggtggtcttcaccgtgcaactggaccgtccggcgcccgccaacgccactgtggcgctgagcgtgaatccggcgacgggcttcggcaccttcgttccggcgaacggcacgctcaccgtgacggagaacgccacggaggccgtgttctccttcatcacggacgcggcggccacggccaccgagcccggcacggtgacggcgagcatcggtgcgaccagcgcgagcgccactgtgacgctggaccagaatgcgccgcggctgacggccctgtcgccgtcctcggcggtgacgattccggcgggcgggacgcagacgttcaccctgacggtggaccgtgcggccgcgcaggacacggttgttgagctggcggtggtgccgggggcgggcgtgcagaactacggcacggtgccggcctcggccacgattccggcgggcgccacggaggtgaccttcaccttcacggcggacgcgcagggcgagggcacgggcacggtgtacgcctcgctgtacggcatcacccagaccaccgcgctcacggtgcttccgcctccgcccgtgctcagcgcgctgtctccgtccaccgcagcggtgttgacgggccggacgttcaccttcacggtgacgctggaccgtccggcgcagacggacgagacggacgttgcgctgacgctggagccggcgacgggcgtcgggctcattccggcctcggtccgggtggctcgggatgcgacgacggcgaccttcaccttcacggcggacgaggtctcgagccccgcggaggcgctgctcacggcgagcttcggcggggtggaccggaccgctcaggtgtccgtcatcctgaccgcggaaggcggactggtcatcaacgaggtggactacgacatgcccggcgcgggtgactcgctggagttcgtggagatctacaacaactcctctacgcccgcgtcgctgagcagcgtgttcctggtgttcgtcaacggcagcaacatgtcgagctaccagaagattgccttggcggaagtcaacggcggcgtcctgggaccccgggagtatctggtcgtgggcgctgccaccgtcgtcgggccgctcgcggggcgtgccggcgtgcacacgctgcagcgggggaccaccgacttcatccagaacggtgagccggacgcggtggccctgtacgacgaggccacggatgcgttgattgactccctctcctacgaggggcacgtggtgaacgccaccatcgccgggacggacacgaagttcgacctgcgggagggtgacgcggacacgaagaccctggcggacagcaacaccgctcagggctcgctgtgccgggacgcggactcgaccgacacggacgtgaacgcggcggacttctccttcaccacgaccgtcacccctggcgcggcgaacgtcatcacgaagacgccgtag

SEQ ID NO: 5369 - DNA, 384 bp, Myxococcus xanthus
atgggttccttccagcagttcctgacggacaagaacatccccaccgagaagctcctccgcctgtcgcgccagctcgagtcctacggctccgagggtcgaaccctcttgaagaagcggagcgcccgtcgccgtgacaaggacacgcagggcaagagctacgagtcgctgtccatcggcaagccgaagagcggccggggcatcagcgcccagcagcttcaggccgcgctgggagacctgccactgacggccagcgtgcgcggaaagttggtgcgcgccgtcaacgcggtgctgggcaagcagggcggaagcccagtggacgcgcccgcgctcttcggcgccagccccgtgcgccgcggcgccacggcgaagaagtccgcgagctga

SEQ ID NO: 5370 - DNA, 669 bp, Myxococcus xanthus
atgcgccgcgttcttcccgtgctcctgctgctccatgcgcccgcgcctgtggcgaacggaacggtcggggtgcggccgctcgtgtcggcgccgtcggcatcggacgtgacgtcgcacgacgcggaggcatccacgacgcccgagacgcgcgacgtgctgctccgccggttggtggcgcgcgtggcgctggcccaggtccgcaagcaggacgccgcgtggcatccggaccagcgtgactgcgcgggcctcatccgcttcgccttccgttccgcgtacaagcaggtcgccgcggagcgcctgtccacgccgctgtggcgtgacggccggggccgcccatccgacttcgcggacgcggaggtgctgctccagcagagcttccagctcctgggccgtgacgacgccacccgcgagtcgctgcgcaccggcgacgtgctcgcctttcgccaggagcaggacgcgggccccatcttccatctgatgctggtggtgcgcccggaggaccgggcccatgcgcccgcgcgcgtcgtctaccacccgggggagaagggcgccgcagtgcgcaccggcgtcctccaccacctggtcaccgaggcgccgctggagtggcgcccggtgccgcagaacgcttccttcctcggcttcttccgtttcaaggagtggatgtcatga

SEQ ID NO: 5371 - DNA, 1575 bp, Myxococcus xanthus
atgcgtcgcctgctcgccgccgtgttctgcgccgccgtcgtgctggcggcttgtgaagacgattccccaccgcctcccacgccgccgcctccctccacggagacgtacccggacgccggcacgcgcccggacgcgggcacccaggagccctgggcctgccagcggagcacgacggtgcacaacgcgcccatgaggctgctcacccggctgcaactggagatgagccgcgccacgtcctccgcgcagcgcacggaggccatcgaccgcttcgtggcggaggtggaggagcagggcggccggcccctggtgagtgacgtcaaggcgggtcatcctcgcgtggccttcttcgtgcgaggtgaggccggccgggacaccttcgtcgccggcgacttcaacggatggtccgctacggccacgccgctggtgcaggtgagggacaccgacctgtacgtggcggaggtggaggtgccgcgcaccggcccgcagccctacaagctggtgaaggacggcgacttcatcgcggacccgggcgcgcgccacgtcgcgtgggacgacttcaaccggcacgacgtggggcggttcaactcgctcatctacccggagctccaggacgccgcgaagggccggctcaccgcgtggtacggcgtgcccgccacggtgttgggggatgcgcgcgacgtcttcgtctacacgccggcggagtatgacgggccggagtgcccgtccctgccggtgatgtacctccacgacggcaacgagagcctgacgcgcgagtccttcgcggaagcggcggactcgcactacgcggcgcggccggcggactcggcggtgctcgtcttcgtggcgctgccggaccagtccgtgcgcctggcgcagtacaccttcccgcccgcgcgcgcgccgggctggcccacgccgcgcggggatgactacctggccttcatccgcgacgacctgatgccgcgagtggaggcgtcctaccgcgtgaagacgggcccccaggagacgggcatcgcgggcgcgtcgctgggcggcctcatctccgtgtacgcgggcttccagatgccggagaagttcggcttcgtgggatcccagtccggcacgctgttctggccccatgacggcgtggtggaccgcgacgacggcaacgcgatgattgtccgcgcgagccaggagccggtggtgccggtgcgcttctacgtggaccacggctcgcccgtggcgggctgcacgcgggacggcgaggagggtggggacgactgccagtccaacctggagttcgtggaggcgctgcgcggccgtggctacggcgtggcccactggaacgagcccggcgccgagcacgactgggccttctggaagcggcgcttgccgaagctgctgtgcaacttccgcaacgcatggcccggcggtgtgcggcctgtagtccggcctcacagcttcgcgacgatggcgcgggccagccggtccgcggccccggcgtcgagcgacaggaacaggcgcggctcggtggcctccagctcttgcagccgcgactggcccgcgttgtcggtggccacgtccacgcgggcgtag

SEQ ID NO: 5372 - DNA, 1473 bp, Myxococcus xanthus
atgcagaccatgcagtccagtgccgaggcccccgtgagtgacgcggggccccgagccagtgacgaggagctccaggagggctccacgctggggaactaccagttggagcaactcctgggcgaagggtccatgggccgggtgttccaggcgcggcacacgcggctggggcgccaggtggcgctcaaggtcctgcggccggagcacgcgcgggacggcggcttcgtgcggcgcttcttccaggaggcccgcaccgtcaatcaaatcaaccacgagcacatcgtggagattttcgacttcgtcgacgagagcgcgatgggcgggcacgtctactgcgtgatggagctgctgcgcgggcagagcctgagctcgctggcgcaggcggagccgctgacgctggcgcgcatccagcgcttcgtggtgcaggtgtgcgcggcgctcggcgcggcccaccaggtgggcgtggtgcaccgggacgtgaagccggacaacctcttcgtcatccaccgcgcgggccagccggacttcgtgaaggtgttggacttcggtgtggcgaagttgctcaccgccgaggggagcaccaccgggacggtggacggcaccatcatcgggacgcccgcgtacatggcgccggagcaggccgcgggcctgccggtggatgcgcgctccgacatctacgcggtgggcaacatcctctacgagctcatctccggcaagccgcccttccaggcgccggccttcggccatctggtggtgcagatcatcacccagccgccgccgccgttgccctcgcacctgccgtccggcgagcccgttccaccgcagctggcggagctggtgatgcgctgcctgtcgaaggagcccgaggcccggccgcagagcctgacggaggtgacgacgtcgctcctcctgttgcccgcgtccgcccaggcgctgacgcccgcgcccgccgagctggcgctggaggcctccgagcggcccacgcacaaggtgcaggtggcggtgacggggcgctggcaccgccgggcggtggtgacggtggggaccgcggcgttggtggtggtggccgcggtggtcacctggtccggcatgcagccggagcccgcccccgccgaggctccagtggcccaggtggccgacgtcgtgggccggcccgcagccgcgccccaactgcttccgcccgtcacgctcacggtgcgctccttcccggagggcgcgcaggtgctgcgcctggacacgggcgagctgctgggtgtgacgccgctggtgaagcaggtgtctggtgaggccgcgccgctgcgcctgcgcgtggagctggccggctatgccccgctggagcggatggtggacctggacaagcacgccgagctggaggtgccgttggtgaaggcgctgccttcgccccggcagaagcctgcggctgggacgcagcgagacacaggcaagaagagccgcgagcgccctgtcgcgcagtag

SEQ ID NO: 5373 - DNA, 792 bp, Myxococcus xanthus
atgaagaccttcgaatcccggctgcgcgtgtggtgtggcctgttgctcgtcgcgggcgcggtgggctgtacggtgaatttcccggacgacgtgccctacacgtgcacggagaccgctgactgcggcggtgacggctacgtctgcacgtccctgccggacaacgggcctcggtactgctgcctgccggaccccacggaggtctgcaacggcctggacgacgactgcgacggcctggtcgataacctggagaccgcctgctacacggggccggaagggacgctcgacgtgggtctctgtcacgccggtgagtccatctgtacccgggatgcgagcatcgcgtgcgtggggcaggtgctgcctggcactgaaatctgcaatggcctggatgacgactgcgacgggacggcggacgaggacttcgacctgaagacggacccgggccactgcggcgcctgcaacaatgattgttccttcctccaggactgcgtgaatggcgagtgcgtgcgccgtcaggagctagactgcgccaacggccaggacgacgacggggacggcttcccggactgccaggaccgcgcggactgcgacggcaagtcgtgtggtccggagtgcgtgtgcgaggggggctcgaagacggaggtgagctgcaccaacggcgaggatgatgatggggatggcttggtggactgcgcggaccgcgcggactgccccacggaaacgcagtgcgggcccctcaggtcggatcgcgaaaacgattatccgcgctgccaggtgaacggggtctgtctgtga

SEQ ID NO: 5374 - DNA, 927 bp, Myxococcus xanthus
atggtggcgcaggcgtcggacctggtggagacgcgtgagcggctggcggagggtcacgacgcggcggtgcgatgcgcggaggccgcgtgcttcgccgagcccgcggagttgctggacgcggacctgctgaccaccgggcgtctgtctttggaggatgcgggctggacgctgcggacgtggacctacgacagggacctccgcgtggtgcacgaggacttcgtgacggggcgcaacccgcgcgacgaggacttcgcgaacgaagccgccgcgatgctgtccaagcgcctgacggcgttggcccgcccgcgcgcgatgctgacggtgaatgtcaacgtgccgcaggcggtggtgaaggtgggcgagcgcatcgtgggcgtgggcagcgtggaggtgcgccaggcacccggcgcggtggcggtagaggtgtccgcagacgagtacggcacgcagacgcgtaccctggacctcatgcccggcgcgcgcgagaccgtggacgtcatgctggagatttccggtccggcgccggatggacctcccgatgattccgtggtcggcgtggcgtcttcccggaaggcgcctcagaagtccctcttcaagcggcccgcgctctacaccgtgctggtgggactggccgcggtcggggcgggtgtggtgatgggcatggccgccaaggacgtggagaagcgcgggggcgacgcggatggggacggcatgttcgacgtcactcgcaaggagcggctggacgcgcagtcccaggccaatctggccacggttttgttggtgggcggcggcgcggtgacggcgggcagcgtggcgtggctggtgctggtgcccgcgcgcagcgcgcccgcatcgacgtccgtggcgcccggaagcggcggtggcgcctccacgtccctgcacatcatggtcggcgggagtttctag

SEQ ID NO: 5375 - DNA, 672 bp, Myxococcus xanthus
ctgggcctgtccggcttcgagtcccagattttctacgacaacctgcgggtggacacgccggaccggatgcccttcacggcggcgccgcgcgcgcccacgccgccccccgggccctacgcggacgacttcaaccgcgacacgctgggtgacgcgtggaacgccaccaacccctccgcggtgaagctggtggacggggcgctggtggtggagctgatgcacaaccggccggtgtggctgaagcagcccatccccaccaacgccaccattgaattcgacgcctggacggacaacccggagggcgacatcaaggtggaggtgtggggcgacgggcgctcgttctacgcgggcgacctgcggctgcagtacaccgccaccgggtacgtcatcatcttcggtggctggcgcaacacccagtccgccatcgcccggcagaacgagcacgcgaatgaccgggcggtgcgcgacggcgccgcggtggtgcccggcaagcgccaccacatcaagattacccgcaacggcggcaccctggcgtgggagctggatggccagccctacctgacgctcaaggaccccgtcccgctggagggcccacgcaatcagtacttcggcttctccggttggaagaaccgggttcacttcgacaacttgaagattcagccgctcggcccctag

SEQ ID NO: 5376 - DNA, 1344 bp, Myxococcus xanthus
atgggtcagccgacccagttcgccattggcgccttcatccagtccctggcgcagaacccgggcctggagcaggaactgcaggcgctggggccccgcgcgcacgtctacgtgggcaccggcctgggcgacctgcccaccatccgctccatctccctggacctgtaccgcgcgcagcgccggtgggaccgcttctggtccgcgccggagcgcaacggcgccctgcggaagtggcgtgagacgcaggagccgctgcctggccttccgccggagccgtccacggtggacgaggccacgcgcgacgaggccgaggacgcgtggtggcacttctgggcgggccgctcgccggagctgcgcgagtacctggacgagctgcgcgaaatcgaagccattggcgtgcccgaggatggcgacgtggagtccgccaagctggccgtcatcaaggagaagcgcacgcgcaacgcccggctccagaagaagtggatgtcgccggagccgccgtggaacgccgtgtcctccaacgtgctgtggaacatccacaacacgccggcctcgcagatttcgatgatgggccgcatcaccggcatgacgttcgccccggtggccgcgtgctcgtcgttcggctacggcctgcggctggccatcaacgcgattcaactgggccaggcgaaggccgtcgtcatgggtatgacggacccgccgccgatgccgctcacggtgggcggcttctacaacgcccgcgtcatctccgcggacgcctccatctccaagcccctcaccgcgctgcgcgggacgcacatcgcgggcggctcggtggtgtgggtgctgggtgacttggagcacttcacggccaagggcttcaagccgctgggcatggagcccatcgcggtgggcgtcaccgcggacgccgaccacatcatcaccccgtccaaggaaggccccacgctggccatccgcgaggccctggccgcggccggctgcgccccggaggacatgggcagctgggacttgcacgccaccgccaccccgggtgactacctggaggtccagaacctgcgcgacgtgctgcccgagcaggtgctgattacggcgcgcaagggcaccttcggccacggcatgtccgccggcggcggctgggagctgacggcgcagtacctgggctacggccagggcaaggtgttccccacgccgctgaaggaagcggagctcaacaagcagatttcccgcgtgcacggccgcttcgtcttcgacgaagccgtcgaggcgcccgcgggctgcgcgggcaagctgtccatgggcgtgggcggcatcaacgcctgcgtcatctcccgcccctggtcgaagtag

SEQ ID NO: 5377 - DNA, 2427 bp, Myxococcus xanthus
atgagcgacatccaagagccaaacgcgccggggagtccggcgcctgacgaagccctgacacgtcccggcgagtacatagcggacatcggcttcgactacatgaacctgacaaagcccatccgcctcgccctggcggagcgcggttataccaaccccacccctgtccaggcccgcgccttccggcccgccatcgagggaaaagacctcatcgttcgcagcaagacgggcaccggcaagacggccgcgttcggcctgcccctgctcgaaaagattcccgccgacgagcgccgcgtccgagcgctcatcctctgccccacccgcgagctggcccttcaggtggcggacgagctgaagatgctcgccaagcacaagggcctgaaaatcgcggccatctacggcggcgcctccatgaagcagcaggaggacgcgctggaggaaggcacccccatcatcgtcggcacgccgggacgcgtgttcgaccacatcaaccgcggcaacctgaagctcgacgcgtgtgaccacgccgtcctggatgaagcggatgagatgctgaaccagggcttctacgaggaagtcacgcgcatcctcgaccgccttcccaagacgcgccaggtgctgctcttcagcgccaccgtccccacggacatccagaacctcatcgcgcgctacacgacgaacgcggagacgctgctgctgtcgggcgacgtcttcacggtggagcacatccaccacatccgctacgacgtgtcggacgccttccccaagccgcgcaacctcatctacgtgctggagaaggaggagccgcagaacgccatcatcttctgcaacacgcgggatgacacggccctggtgacggcggtgctcaaccgcaacggcttcgacgcggagctgctcaatggcgacctgccgcagaaggagcgcgagcgggtcatgggcaaggtgaagcgcggcgaggtggccttcatggtcgccacggacatcgcggcgcgcggcatcgacatctccggcctggagtacgtcatcaactactcgctgccggaggacccggcggtgtacctgcaccgcgtgggccgcaccggccgcatcggcaacaagggcaccgccatcaacctcttctccgggcgcgagctggccacgtacacctcgctggagaagaagtacggcatcaagttcgacaagcgtgagatgccggccccggaagaggccatgcgcctgtggacggagcgccacgtgcgcgaaatccaggaggccgcgggcggctccgtcttcgagggcttcctgccgctggccgcgcagctcaagccccgcgcggacgccgacgacctcatcgccttcctgctgaagtacttcttcagccacctgcgcatggagaaggccgccgcggcgatggcggcggaagggcgtgagcctccgcaagagcgcaagttcgagagccgcgagggcggccggcgcgagcgcggcgagcggaaggagcgtggcgagcgccgagaccgtgagcgcgacgaccggcgcgagaagcgcggcgagtcctccgagcgcgagcgcgagcgccggccccgccgtgacgacgcgcggcgcgagcgcggcgctgagagtggccgcggcgcggcggcgctggaggccggtccgggcgaggcgaagctgtgggtgaacctggggaccgcggatggcctggggccgggcagcatcgccacggcgctggaagacgcgggcgccccggtgggcaaggtcgtgcgcgccgagctgcgccccaccttcgcctatgtcttcgtggcggaggaggacgccgccgccttcgagaccatcaacggcaagcagcacggcgccaagacgctgcgcgtggagaagagcaagccgcgcacggagcgtgacgccacgccccgcccgcccccgtccccggacgcgggccccggcgaggcgaagctgtggatcaacctgggcatggacgacggcatggacgaggcgaagctgcccgccgcgctggaggccgcgggcgctccggccggcaaggtgctgcgcaccctgctgcgccccacctacggctacgcctacgtggccgaggaggacgcgcccggcttcgaggccgtcaacggcaagccccacggcgagaaggcgctgaaggtggagcgtcaccgtccgcggggcgcacgcccggagcgccgtccccgcacggaggccctgccggaggttcccggccagacgcgcctgtgggtgggtctgggcaagcaggacgggctggacgaggcgggcgtcgccgccgcgctggaggccgcgggcgctccggccggcaaggtgctgcgcacggacctgcgccccacctacgcctatgtcttcgtcgccgacgaggacgtggcggccttcgaagccacgcacggcaagccccacggcgagcgcacgctcaaggtggagcaggccaagcggaagtag

SEQ ID NO: 5378 - DNA, 1230 bp, Myxococcus xanthus
atgagcgccgtcgagggtaccaactactacttccgcaaagccgcgcggatcatggacgtaggcacccccatcgaaacgctgctcgccacgccccttcgcgaggtgaaggtccaggtctccatcgagatggactccggagagattcgcaccttcctcggctaccggattcagcacgacaacagccgtggccccatgaagggcggcctgcgctaccacccgatgctggaccaggacgagtgcgcgtcgctcgcctcgctgatgacgtggaagacggccgtcgtgaatgtcccctatggcggcgccaagggcggcatcgcctgcgacccgtcccagctgagcatcaaggagctggagcgcctcacccggaagtacgtggaccaggtgcaggacgtcatcggccccacgcgcgacatcccggcccccgacgtcaacaccaacccccaggtgatggcgtggatcatggaccagtattcgcgctaccacggccactctcccgcggtggtgacgggcaagccgctggagctctacggctccaagggccgcgaggccgccaccggccgcgggctgctctacgtggcgcgtgaaatcctgcgcgacctgggcctgccggtgaagggcacgcgcttcgcgctccaaggcttcggcaacgtgggcggccacaccgcgcagctcctctgggaggacggcggcgtggtggtggccgtggcggacgcgctgggcggcgttcgcaacccgcagggcctggacatcccctccctcttcgagcacgtgaagcgcaccggcacggtgacgggcttcagcgggggcgcttcgtgcagcaacgatgacgtgctgggcgcggactgtgaggtcctcatccccgcggcgctgggccacgtgctcacccgggagaatgcccacgcggtgcgcgccaagctcatcatcgaaggcgccaacggccccacccagccggaggccgacgaaatcttcgagaagcgcggcatcttcgtggtgccagacgtgctcgccagcgcaggcggcgtgacggtgagctacttcgagtgggtgcagaacctccagcacctgtcgtgggaggaggaccgcgtcaacgcggagctggagaagtccatgaaggaggcctacgagcgcgtggcgcaggtggcgcgctcccggaaggtctccatgcggacggccgcgtacatcctggcgattggccgggtgggcaaggccaccgtgctgcgcggcatctga

SEQ ID NO: 5379 - DNA, 1218 bp, Myxococcus xanthus
atggtcaccctcgaggacatccaggccgcgcgcgagcgccttcgctcggccatccgccccacgccgtgcccgcagtcggactactacacggagcggacggagtgcgccgcggtgttcttcaagctggagaacctccagcgcaccggggccttcaaggagcgcggcgccctcaacaagctgctgacgctgaccgaggacgagcggcgccggggcgtcatcgccgcgtccgccggaaaccacgcgcagggtgtcgcgtaccacgcgcgtcggctgggcgtgagtgccaccatcgtcatgccggagcgcaccccgctcatcaaggtgtcgcgcacgcgggatgactacggcgcgcgcgtggtgctcaagggcaccaactacgacgaggcctacgcggaggcgctgcgcatccagaaggcggaggaccgcgtcttcatccaccccttcaatgacgcgcacgtcatcgccggccagggcaccatcggcctggagctgctggagcagtgccccgacctggaggtggtgctcgtccccattggcggcggcgggctcatctccggcatcgcgtgcgcgctgaaggagacgcggcccgacatccgcgtggtgggcgtgcaggcggagaccatcgccagcatgaaggcgtcggtggaggcgggcgagcgcgtgctgctggccgccgcgggcaccaccatcgcggacggcatcgccgtcaagcgcgtgggcgacctcaccttccccatggtgcagaagtacgtggacgaggtggtggccgtggacgaggaggaaatcgccgccgccatcctcaccctcctggagcaggagaagagcgtggtggagggcgccggcgcggtgggcctggcggcgctgctcagcggtgacgttcccgccgcgaggggccggcgcaccgccatcatcttgagcggtggcaacatcgacatgaacgtcatcagccgcatcatcgagcgcggtctggtgaaggctggccgcttggtgcagttggaggtccggctgccggaccggcccggaatgctggcgaagctcaccacgcaggtggccgacctgcgcgccaatgtcgtggagatccaccacgagcgcgccttctccaaggcgggcctgggcgaggccatggtggaggtgacgctggagaccaccgggcccgcgcaaatcgaggagctggagcgcgcgctccaccggctgggctggcaggtggcccgcaagtag

SEQ ID NO: 5380 - DNA, 1392 bp, Myxococcus xanthus
atgagccccgccgccctgctctccgccctgctactgaccgccgccccttcttctcccggacagaaggcgaagtcgctcgccgccagccgcgcgtgggaggagctctatctggccttctcggccggagaggcatcggacgtgcccaccccgcagcggggcaccgtcgccacggcgctccagaagggctgcgaggcgctgaaggacgaggacccggtgatggcgtactcactgggcgagcgggccaccgtgtacgaggagtccgcgggcgcgctgcggtgcctggcccgggccgcgcggaagacggaccagcgggccaccgcggaagccgccctgcgcaaggggctggcccagtaccccaaggacggcgccttcggcctggagttggggcggctgctgatggaggaacaggacgcggcgggcgccgtggcggcgctggagaaggtgccggcgaagtcgaaggaggccgcggaagcgaagcggctgctcgtgcaggcccgcgccaagacgacggaggagaccgccgcgcggcgggaggcggagcgcctggagctgcggatgaatggcgccacgagcgggcggcctaccgtcatggtcgaaacccagcccacggtggccggccagggccggggctccacgcgctcggccagcctcaactacgagtcgggcaccggcgcggacggcatgcggacgcgctccaacagccgcttcgtcatccggtacttcaacaacgatcgcgacttcggccaacgcgcggagtacgagggccgcatcgtcgccgcgctggacgaggcctacgacttcacccgcagcatgctgggcgaggtgcgccacgcgccggtggacatcatcctgtacaccctcgcggagttccagacgcacttcggcgcggcgcgggcgcgaacagtcgccgggctctactccgacaacgccatccgcatcaacgacgccgcggagctcacgccgcagaccaaggccaccctggtccacgagtacgtccacgccgcgctggatgagctctgtggcggctacgggaacaacctccccgtctggctcaacgagggcctggccgagtacgtcgagtggcgctacatgggcggcgaggaccccgagcggtcggtccggaactacatggcccgggccgccaaggcgaactccctgcccaagctggcgcagatggagggctcgtccctcatcatgcagcgcaacccgaccgtcgcctatgccacctccgccgtggcggtccgcgagttggtgaagcggggcggtacgggccggttcctcacgatggtccgtgaggtgggacagggaagacccatcgacgaggccctgacggagcactacggcaagacgcgggcgagcctcgacgaggacgtccgggccgctctccagtag

SEQ ID NO: 5381 - DNA, 1569 bp, Myxococcus xanthus
atgacgtctcccaagagtggcccgcccaaggcgctgctcatcggcgtggttaccgtcctcgtgggcggtgccgtggccggagccttcttcctgggccggcgcagcgggcagtccggcgacggcggtggcacggtcacgaacctgctcggcggcgagcgcaagggcccgcccagcgcgggcgccggcgtggaaggcatgcccgagcccgcgatgacggcgctggaggtgcccggtacggccgcgccctccgccctctgggtggacgtgcaccacccgggcaaggtgcgggacgcgctggcggccaacgtgtggctgcgcgatcagctccagaagccgctgggccagggcttcattggtgcgtgggccgccttcttcggctccaccggcgaggacctccaggcgggcttcaagggcgcggtgctggacctcttcgcggggcagttgttggacgcgcccttccgcgtgacgtggttcgccggtgacgcgcgctccagcacgccggccttcatcctccccaagccgggccgcgccgcgacgtccgcgtacgaggcgctggacggcgtggccagccgcggcggcatgacggcgccgcactgcccgggcggcggctcggaaggcaccttcgagatgaagcgctggctggtggcggaacagacgctgtgggcgggccggctcaaggacaggctggtgctcgcgcgccacccggtggcggtgctccatggcctgtgcgcggagctgccggcgctgaaggcgaaggacggcgtggacgtggagctgggttacgacgcggaggcctatggccgcgaggtgcagctcttgtcgagcgtggtggggctggccccgggcacgcggctccagttcggcgtggaggcgggacggctggtgggccggggcatcgcgggcgagctgctggacggccccgcgcgcctggacgccgcgcccctgtccgacgacctgctgaagctggtgccggaggacacgccggtgctgctggccttccagctcaagctgccggagtcgttggaccccgagacgctcaaggcgtactgggagaagggcggcggcaagggtcccacgcgcacgcgtcaggtggcgctggtgtggacgccgcgcggtgatgcgaagctgcccgtggagctggccgtgctgtggggccgcaccgacgacgcggccgcgctggagggcctgttctccggtggctacaaccggctggtgcgcggcacccactgcaaccacgtggtgctggcgtccaacgacgcggagctggagcgcctgcgcaaggcgtgcgcgggtcagcagcccaacatgctcaacgccgcgggcccggtggtggcggggctgcgcgcgcccacctcggtggctttcggggtgaacacgggccggctgctcagcgggctcaccatggatggatacctgtccgagttccgggtcagccgcaacgcgcccatgccgagcgcggcgcccccggaaatcgaagcggcgcggagcgacctggagtcgctgccgtacctgggcctgcgcggcaccgtgcagggcgattcgctggttcctggaggtttcgggtcatga

SEQ ID NO: 5382 - DNA, 855 bp, Myxococcus xanthus
atgagagaattccgctttctcgacgagaagcggaagctgggaagcctgtctccggtggaggaggctcgctggaacgagctgcgcgcacagctgggcgtggatgacgcgccagccgcggacgccgccgcctggcagcagcaggccgcgccccagggctactacgccgacgatggccagtggtacccctaccccgccggctacgagcagcaaccccagggctactacgccgacgatggccagtggtacccctaccccgccggctacgagcagcaaccccagggctactacgccgctgacggccagtggtacccctaccccgccggctacgacccgaaccaggggtacgatccgaacgcgcaggcttacgcacagcagggctacgacccgaacgctcaggcctacgcacatcaaggctacgacccgaacgctcaggcctacgcgcagcagggttacgacccgaacgctcaggcctacgcacagcaaggctacgacccgaacgcccaggcctattcgcagcatgcgtatgacccgaatgcgcaggcttacgcgcagcaggcgcatgacccgaatgcgggctacgctcagggcactgccgaagcatggcaggcggatccgcaggcctatgccgcgcagtccgcgcagcagcagtcctaccccaccgctccggcacaccagccggctgtcgagccggacaacctcagcctttcggacgacatcgacattcccgcgctgagcgagcccgtcgccgtggatcacgccaggcgccggtggacaggctcagtatgcaatgagcggggagcaataacccagcatcgagccgatgtcctcggacaagcagccgtccacggtggatga

SEQ ID NO: 5383 - DNA, 5577 bp, Myxococcus xanthus
atgtcctcggacaagcagccgtccacggtggatgaccagtctgcgtcgttcgcggacgtcaccgcggacatccagcagaatgcgcagcccgtattcgaggaggcgcagccggaagccctgagcgttgcggaggatgacttctccgaagtggggtcggacaccccagcggtggccgccagcgccgaacccgagacctcgctggaggcatcgttcgccgacctgtcgatggaggtcgagtcggcaccggatgcgccggtggcgcccacgggcgatgccctggcctcgacggaagtggaggtcccctcctccgaggtcgagttgctggacggcaccgccgacagcgaacctgtccttgcccacgagcagtctcccgccccaatcgatgatgcgtgggcctccgcgccgctcgccgtcgagacggagcacatggacgtcgccgatgcgggcgacatcatcgacgttgccgccatggcggagccggaggcggcctcgcaggctgcggattccgaaatcgcgctcgattcctccgaaatggtcgaagcgtcggctgcggactccgcggatacgacggatgcgtgggacgcgggtgcgacgaccgacgtgacggctgatgccatggcgacggccgaccacggcgcgacagatttcatcgcggccagcgcgggcgatacgtacgaggcacagcccgccgagattgcactcgacaccgcggatgaggcttcggccgaagccgagcccaccgagattgcgctcgatgcagcccacgtgagcgatgcggcggttgagcacgcctcggagatggcgttcgacgcatctgcggggtccgagccgggcgccaattactcgcccgctgaaatcgcgctcgacgcgtccgatgtcgccgtgccggaggcctatcccgagacggccctcacggcgtctgacgccagcgatgccgcgacggcggaagcctaccccgcggcagacttcgcgacggcggaggcctatcccacgacggagttcgcgacggcggaggcctaccctgaggcagacttcgcgacggccgatgtcagcgatgcctcgacggcggaggcttatcccgaggtggcgctgactgcctccgaggcaagtgatacgaccgcagccgctcccgagttggcgctctcggcttcggatgtcatcgaaacgtctgctcccgagccggagctggccgccgcggatgccagcagcgaagtcgtcgccgaggcttccccctacggcagcgcagcagcctcgttcgaagagcccttcgccgagactgccttcagcgaaggcgatgcaaccgccgctggtgaaacgtacgccgaagcggtgctcgacgccgcagaggtcagcgacacggctgtgagcgagcacgctttcgcgacgtccgaaacgagcgagtcggccactgccgaggcgtatccggaagtggcgctcgacaccgccgatgtcagtgatgcggccacgatggagttggactcggtggagaccgctgccgaagccacctccgacacggcgctcgcatccagcgcatggggcagcacggacgcggccgaggagtttgccaccacggagtatgcggcctccgacgtcagcgaattggctgccatcgagactgcgcccgagacggctcacagcacctacgaccactcgagtgaggccttcgatgggaaggaggtcgtcctcgacgcgaccgagatgagcgagcccgaaatcgctctcgatacgtccgacgtcgccgaatcgccttccgcccagtcgccctccgaaatcacgctcgacgccacagacgtcgccgagtccgccccgattgagccggccgcggagatttccctggaggcctccgacgtcgccgagccgcagtcggctgaaatcgccctcgatggctcggaggtgagcgaagagtctcccgcgcagcagggaagcgtccccacgctggagctcaacgcggccgaggtgtcgtccgacgagccctcgctcgatgtcatcgatgtcgagtccgcgcccggacacgccggggacgaggcatcgttccaggccgctgacggcgggagcgagcagcccacgctcgaggttatcgaagtcggtacggaggccaccgcttcggaagtggacttcccgccggaggctgcgcccttcgcgtcgtcggatgtcccgtcgctcgagatccggccggtccaggtgggtccggacctccacgcggaaacgatcgaggtggcgggagatccgccgcagtcgtccgcgcgcacgccttccgccgaggagatgttcgacctgagcgggaaccccgaagaggccgtgcctctcgccgcggcgaacgagttcctggcccacggacacttcgcgccgaccgatgagcgcagtgtggcgatggcggagggtgacgcgggcgccatcgagctgcagcctgaatgggcttccacttccgagcagcccgctgcggaagcggctcagacggaatgggccacttccggtgagcaggccgctgccagcgatgcgtatgcaggctgggaggatcctgtttcggaaaccgtcgaactccaggcggagtgggcggagcctgtcaccgcttccgagtggacgacctccgaacaaacggcggctgccacgggccacgcggagtgggcggcttccgatacaggcatcgcctccgaggctggccaggccgagtgggccgactccaccaccgagctccagcccgaatgggttgcggccgaaggcgcggcagcccctgaagcccaacccgagtgggccacctccgcggagcaggcgcacaccgaggcgcaggcgcagtggaccgagaccgccgcgcaagctgccctcggcagcgagcagacagaatgggctgcgaacacgcccgaggcagcccaggccgactgggcttcgtcctccaccgagaccgcgcccggcgaaatccaagcggagtgggctgagccgatcgccgaggacggccaggcccagtgggccacggctgaagcgcccccaagcgacggctggaacacggcgtcgactgaagcagcgcccgtggaagtccaggccgagtgggccgagtcttctgaggcctcgcccactgaggttcaggccgatgggtcgacccctacgctcgacgcagcgccggtggaagtgcaagccgagtgggacgaccccgcccagcaggatggagctaccctgacggctgaacctgcggcgacggaggcccaggccgaatgggctgcgccagaaatcgctgacgccactacggatgcccaggcaggttggacgacgccgggcgccgacaccgctcagtcggaatggactgcctcttctgaaaacgggtgggcgaccgccgaggaagttcagaccgaatggactgcgcctgcgaccgaaaccgccgcgcagcccgagtgggctacgacgcctgcggctgaagcagcacgaaccgactgggccgctcccggtaccgaaaacgccgggcagcccgagtgggccacgcctgcgaccgaagccgtgcccggcgaaggtgctcagcctgagtgggcttcgcctgcgaccgaggaagtccaggccgagtgggccacgcctgcggccgaagccgccgcatcgtcggagtgggcttcgcctgcggccgagggcgcccaagccgagtgggccacgcctgccaccgaaaccgccgcatcgtcggagtgggcttcgcctgcgaccgaggaagtccaggccgagtgggccacgcctgcggccgaaaccgccgcatcgtcggagtgggcttcgcctgcagttgaagaggttcagggcgagtgggccacgcctgccaccgaagccgccgcatcgtcgcagtgggcttcgcctgcggcagaaggcgcccagtccgagtgggctacgcccgcgaccgaggccgcgcaggccggctgggccgcagcgcccgtggaagccgcgcagccggagtgggcttcgcctgcggcagaagaggctcagggcgaatgggcttcgcctgcgacggaagaggcgcaaggcgagtgggcgaatcctgctgccgaggaagctcaggccgaatgggtaacgcccgcggaaggcgctgcgccagcaccggagtgggcttcgcctgcgaccgaggaagtccaggccgagtgggccacgcccgaggaaggcactgctccagcaccggagtgggcttcgcccgcgacggaggatgtccaggccgagtgggcgaccgatgccgctgcaccggcgtcggaatgggcttcgcctgcgaccgaggaagtccaggctgagtgggccacgcctgccacggaaaccgcagcccagcctgagtgggcctcgcctgcgaccgaagccgcccagcctgtctgggccgcccccacggaaggcgcgcaggcagagtgggccgcccccgaggcagaagaagtccaggaagagtgggccgccgctccggcggagggcgctcagcaggggtgggcaacgcccacggaagccccccacgcagagtggtccacgcccgccaccgaggaagtccaggccgagtgggccgaccccatcgaggaagccgctccggccgccgaatgggcctcaacgagcgcgcctgccgcctcgcagtgggacacgcccgcggacaacgcccccgcggccgcggaatggtccgcgaccagccacgacaccagcgcgacctgggacgcccccgccaccaccgagtggtcgtcggagcagacggcgaactggaacgaagcatccgctgaagaggtctccctcgcggacacggccacgcctgcctccgcggagtggaatgacgcctccgtggacgtggagcccgtcatggaggaggccgagcccatcgaagcggcgtccgcgtgggaggccgagcccatcctggacagcgcccccgtgacgtcgcagtgggccgccgccagcacggacagccccttcggcgctcaggcgcaggacttcaccgaggccatgcccatcgaggaagaagaagtctcgatggagctcgagcaggaggtggccgaaatcgacgtcgaggaagaagccgtggtgccgccgcccgcccccatggccgccatccccgtcgtcgcgtcggcgcccgtgcacttcgcccaggcggcctcactggccaccgccgcgcaggcgcagcacaccgccgtcgtcatgccggccgcgcccgccaaccacgtcgccgtggagcgtgagccgctcttcgatgacaccgccatcgtcggaggcacggccctcacctccttcgtggaaggcgagcaccgcgtcatcatccacaccgtcgaaggccaggtgaagcgcggcaccatccgcgacgcggacctgctcgatgaggtcatctccctcgagcagcagagcggcttcgccgccgagcagattccgggcaagcgcgtgaaggccatcttcttcatgctcgccgccggtgcgcgtcagccgcaggtggagggacagaagattcgggtcaccttcaacgacggacgtcaggtcgcgggcttctcccaggacttccagggcagcacgccgggcttcttcgtcatccccgccgaccagcgcaccaacaccgcgcgcatcttcatctaccgctccagcgtgcaggcggtggccgagggctga

SEQ ID NO: 5384 - DNA, 1617 bp, Myxococcus xanthus
gacttgagtgagctgctgtcgttcgacccggggggtggactcatccacttcggaggccagcgcgtgctgctgatggacccggtggcgctggggctgcttcgcaaggagctcatcaagctgatggggatgacggcggcgcgcggcaccttcacgcgcctgggctacgcgcacggctggcgtacagccgaagcgatgaagggcgcggttccctggaaggacgaatccctgtggcgccgtgccggcgggcggctgcacaccctccagggacaggtccgggtggagcccgtccagcgccgcgcggacgaaggcccggagcccttcgccgaagcgcagtggcacgactcctatgaagccgagcagcacctgctgcacctgggccagtccgaccagccggtgtgctggagcctcaccggcttcgcgtccggctacatgagctacgtcaacggcaagcccatctacggcacggagctgcgctgcgtgggcaagggagacgcggcctgccactacgtgggccgtcccgccgaggagtggagcactgagtgcacggaggtgctgcgcctctatgaaacccagtgcatggaaggcatgttggcgcaggtgacggaggcgctgcggcaggcggagcgcaagctgcgcgcgaagcggcagtcgctggcgcgcgcgggcgtgacggaggacccggcgggcatggtggcgcgctcggaggcgatgcagcggatcatcaacctggcgcgaagggtggcgaaggtggactccacggtgctcgtcacgggcgagagcggcgtgggcaaggagcgcatcgcccgcctcatccatgacgagtcaggccgcgcgcacacggccttcgtcgccgtcaactgcgccgccgtcacggagagcctgctggagagcgagctgttcggccacgcgcgcggcgccttcaccggcgccacccacgacagggccggcctcttcgaagcggcccatggcggcaccctcttcctggatgaagtgggcgaggtgccaccgtccatgcaggccaagctgctgcgcgtgctgcaggagcgcgaggtgcgccgcgtgggtgagaacaccagccgcaaggtggacgtgcggctggtggccgccaccaaccgcgacctcgcggaggaggtccgccaggggcgcttccgtcaggacctctactaccggctgcgcgtcatcgagctgaagattccgccgctgcgcgagcgccgcgacgacgtgctccccctggcgcggctgctgctcgccgaggccgcggagcgcctgggccgcagggtatccggcctgtccccggacgcggcggaccagttgctgcgctatgcgtggcccggcaacgtgcgtgagctgagcaacgccgtggagcgcgcggtggcgctgtgcgagggcactcgggtggagcgggaggacctgccggaggaggtccgcgccgcgcctcccagcctggtgcccaccggcaatccgcagcggctggaggacatggagaagcactacatcctggcggtgctggcgcagaacggcggcaaccgcgcgcgcaccgccgagcagctcgacatcggcgtggcgacgctctaccgcaagctcaagcagtacggccacccggaggcggcccactga

SEQ ID NO: 5385 - DNA, 417 bp, Myxococcus xanthus
atggacggcagcgccgtgcacgtggaccggggccgggacatcgccgtcctccgcctggacgcaccagcgccggtgcgtccactggacgtcgcccaggccctgcccgctccgggcgaacagttggtgttcgcgggccgcaatgaccgtcccgacgaacctcagcaggccgtgctggaacggctgggccgctgcccttcgcttcccgaggtgcccgccgtgctcttcaccaccatccggggccggccgggagactccggcgcgccgttggtggacgcgcgcatgcaggtggtggggctggtccacggcggggccgcctgccgcgtcgccgcgcccaccgcggggctcgcggaggtggtggcacaactgtcgcgaaggggaccggccctggcccggcaggcgccgcctccgcctcgctag

SEQ ID NO: 5386 - DNA, 336 bp, Myxococcus xanthus
atggctggcaagaaggacaagggcccccaggacgcgcggcccagggacattggcgatgaccagcaggcgggcttccacgccggagagaatttccaaccgcgcaaccgcgggcaggtggcggacgcgcaggaccgtggcgcggcggacgcctcccggcacctcgcccacgagcacggcgacgcggcgccccacgccgacacgccgtgggaggcgcgcgtggagcgcggcgaggagtggacgtcccaagatgtcccggacagggaggcccgaggcgacgaggagcccgactccgccgtctcgcgtcagggcctcgtgagcccccctcccgaggagtag

SEQ ID NO: 5387 - DNA, 402 bp, Myxococcus xanthus
gtcctcatcgtcgagaattcgtggacgatgcgggagacgctccgtctcctgctctctggcgagtttgactgcaccacggcggccgacggcgcgtcggggcttcagcaggccctggcgcacccgcccgatgtgctcatctccgatgtgaatatggacggaatggacggctacgcactctgtggccacttccgctccgagcccacgctcaagcacatccccgtcatcttcgtcagcggctatgcgcctcgcacggaagggcccgcggaccagcccgtcccggacgcctacctggtcaagccggtgaagccgcccgtgctcatcgcccaacttcacgcgctgctggctcgcgcggaggccgtcaccccggccgcgcccaccatccagcccgcgtggaagagctga

SEQ ID NO: 5388 - DNA, 1653 bp, Myxococcus xanthus
atcaacgcccatacccgcgtcccgccgccgaagaacgagcctgtcctctcctatgcgcccggcaccaccgagcgccgggaggtgcaagccgagctgaagcgcatggctggtgagcagatcgacatccccgtcatcatcggcggcaagcacatccgcaccggcaagacggacacggtgcgcatgccgcacaaccaccagcacgtgctggccacactgcacgaggcggacgccagccacgcggagcaggccatccaggccgccctggccgtcaaggacgactgggcgcgcatgcccttccagtcgcgcgccgccatcttcctgcgcgccgcggagctgctggcctcgcgctaccgccccatcctcaacgccgccaccatgctggggcagggaaagacggcccaccaggcggagattgacgccgcgtgcgaggccatcgacttcattcgcttcaacgtgcacttcgccgagcagattctcggctggcagccggaggccgcgtaccagacgtggaacatgacggactaccgcccgctggacggcttcgtcttcgcggtggcgccgttcaacttcacggccattgccctcaacctggccaccgcgccggccatcatgggcaacgtggtgctcttcaagccgtcatccaccgcggccctgagcgcctggtacatcatggagctgctgcgcgaggcgggcctgcccgacggcgtcatcaacatgctcccgggtgatggccccacggtgggcaaccccgtgctggccagcccgcacctgggcggcatccacttcaccggctccacgccgacgttcaacgccatgtggcgcacggtgggcgagaacatctcccgctacaagcagtacccccgcatcgtcggcgagacgggcggcaaggacttcatcgtcgcccacccgtccgcggcggacgacctggaggcgctcgcggtggccatcgtccgtggcggcttcgagtaccagggccagaagtgctccgccgccagccgcgtcttcatccccgaatccctgtggcccaagctgaagccgcgcctccaggcgctcatcagcgagattcgcatgggcgacgtgtcggacttccgcaacttcatgggcgccgtcatcgacgagaagtccttcaagaaggtctcctcgtacatcgacctggccaagagcgacagcggggccagcatcgtggccggcggcgacgtggaccgaaagcagggctggttcgtgaagcccacgctggtgcagctcgacagccccacccaccgcatcctccgcgaggaaatcttcgcgccgctggtgggcctgcacgtctacccggatgcgaagtacgaggagacgctgcgcgaggtcgaccaggccgcgtcctacgccctcactggcgccgtgttcgcgcgcgaccggaaggccatcgacacggcgctgcgcgagctgcgccacgcggcgggcaacttctacatcaacgacaagcccaccggcgcggtcgtgggccagcaacccttcggcggtggccgcgcgtccggcaccaacgacaaggcgggctcgggcctcaacctggtgcggtggaccagcccccgcaccatcaaggagaccttcgtcccgcccgtgaaggtgccctaccccttcatggacaacgacccgaacgaaggcgccatctga

SEQ ID NO: 5389 - DNA, 813 bp, Myxococcus xanthus
acgtacgcgctggtggacggcgggtgccgcgtggaggtccttccttcacgcggggccctcgtcagccggatgtgcgtggacggtgacgagctgctgtacctcgacgaggccaccgtcgcggacccggccaagaacgtgcgcgggggcatccccgtgctgttccccaatgccgggccgctgccgggggacacctattccgtggaccgtcagcagtacacgctgcctcagcacggcttcgcgcggaaactgccgtggaaggtgcggcaggcggacacgtcacggctggtggtggagctgtcttccaacgaggagacgctgcgccacttcccgtggcggttcgacgcacggctcaccttctcgctggctggccaacggctcacgctggagagcgcgttcgagaaccaggacacgcggcccatgccgctgcacctgggcttccatccgtacttccgcgtgccggacgcggcgaaggcccaagcaggcgtggacacggacgccacgcacgcgtgggacaactggcgcaagcaggacgtgaacgtcaccgggctgaacctcaccgaggaggaagtggaccttcacttgaaggaccactcaaagccgggaacgacgttggagcggggccctgggctcaagcccattcgcctgtcgtggagccccgagtaccgcgtcctcgtcgtgtggacgcaacgtgggaaggacttcgtctgcgtggagccgtggaccgccgccaagggtgcgctagccaccggcgaagggctgccgcacgtgcagcctggaactcggacgtcgcttcgcttcgacatccaaggctga

SEQ ID NO: 5390 - DNA, 357 bp, Myxococcus xanthus
atgccgggccgctacgtcctggagacggagtggctggactccggcggcggcagcctggggccgggcacggcgtctcgcttcctggtgcagggcatcgtgctcaccggcggcggcacggccctgcgggtgatgcgcggagaccgcatcacccagtccattggcgtcggttacgtggacaaggaaatcaagacggacgaggactacgcccaggccgtccacgacagccaggccagcggcgtcctgcccacccggcagaactacttccgggacctggaaatcgagctggagattctccgccgcagtgacccggaggcggccgcgcgcttcgacgcggacgcgctggccgcacacccctga

SEQ ID NO: 5391 - DNA, 837 bp, Myxococcus xanthus
atggccgaggtgcagcgccatccgctcctgacgcgggaggaagagctccaactggcccggcactacaaggaatccggggatgtgaacgccgcctaccggctggtggcgtccaacctgcgcctggtcgtcaagctggcccacgagtaccaccgcaacccgttgtccctgctggacctggtccaggagggcaacatcggactgatgcaggcggtgaagaagtacgaccccgagcgcggcgtgaagctgagcagctacgccgcctggtggattcgcgcgtacatcctccgctacatcatggacaactggaagatggtgaagctggggaccaccgaggcccagcggaagctcttcttcaagctgcgccaggagcaggaaaagctcatcgcccagggcttcgaggccagtcccaagctgctcgccgagcggttgaacgtcaccgagcaggacgtggtggagatggaccagcggctggggcacgacgagatgtccatcgacgcgcccctgggcaatgacgacgactcgcggaccacccgtgcggaccgctacctgccgtccaactcgatgccagcggacgagcgcctgggcgccgagcagctcaaggccctcttccgggagaagctgtccgagttcgcccggacgctggagggcaaggagcgcttcatcttcgagagccgcctcgtctccgacgagcccctgacgctccaggacatcggcgacaagtacggcgtcagccgggagcgggcccggcaaatcgaggcggccctcatcaaccggatgcgtgacttcatgcgtgaacaaatcccggacttcgacctggtggccagtcccaaggcctga

SEQ ID NO: 5392 - DNA, 4719 bp, Myxococcus xanthus
  unsure (1)..(4719): unsure at all n locations
atgaagtgcctcatccgactggcggctctgtccgcgctcatgctgtccggcgtggccctggccaagccgctctacatcaccgtcccgcgctcctatggcacccaggagccggtggcggtggacgtcgccttcgaggacaagggccccgtcgagctgcgcgtcctcaagccggagaacctggacgccttcatccgcgcccagggtgatttgcgtcgcgcgtaccagacgccgcccacgctgaagaacccgggccgcgcgctcagccgtggcttcaacgcggtccgcacgccgggcatgttcctgctcgacacgctcagcccggccttccgcgacgaggtgggagaggtgctgccccgtgcgccgcaagcgtcgggctcgggcgagccgctggcgaaggtagccgaggggccggagcgcctggtgggcgtgccgcccggcttcacggtgacgcgcagccagtggctgaacctggacctgggcggcgccgagcgggacttcaacgtccccggcttcaacgccagtggctccagcggcttccaggagcgccgcgtcacgctggcgccgctgcccgcgggcacctacgtgctccagttggtgcagggccgcgtggagggacaggtggtgctggtcgtcagtgacttgacggtgcagctcaagcagacggatggccaggtgctgctgcgcgtggcgggccgggaccagaagccgcgcgagggcgccgaggtgcaggtgtacctgcccaagggcaagggccccgccggcaagacgaacgcgaagggcgaggtgacgctggaggtgtcggagccgcgcgtcatcgccacggcgacggcaggtggggacacggccatcgtcgacacggacttctactccgcgctggcggtggcgccggacgtgttcatctacagcgaccggcccatctacaagccgggccacgaggtgaagttccgcggtgtggtgcgccagccggacaccttcctggcgcgcctcttcacgccgaagaagcgccaggtgcaggtgaagctcgtctcgcaggagggccgcgcgctcaccacgcgcgccgcggtggacgagttcggcgccttccacggcacgctgaaggtgccggacgacctgggcaccggcgtgctgcgcgtggaggcggaggtggacgggcacccacaccagggcgaggcccgcgtgcaggactacgtgaagccgacgttctacctggagatggagcccgcgtcggagacggtggtgcctggccagacgctgcgcgcgaaggtgcgcgcccgccgctatgccggtggcacgcccgacgccacgaagtacgaggtgttcctctaccgcagcctgctggacgcgcccgcctgggtggatgacgcgggcaagggcggccagggcagcgacgtgacgtacggcagcgcctccaccacggagggcaagctgagtgtgccggagcggctgtactcctccgtggaggcgcgcggcgcgtatgaggacccgtggtccagcgccagcgccttcgacgccaacggcgaggctgaaatcgaggtggccgtgccggcgctggccgcgggcgaggagcggctgccgtaccggtactcgctcaccgtgcgcgcgcgcgatgaccaggagaccttcgccaacgccacgtccgccttcttcctgtcgaaggtggaggtgctgggcctggcgcgctactccgacgcggtggtggccaagagcggcgacgcgacgctggcgattcgcgccaccacgctgtcgggcaagccctacggcgtgacgcagggcgaggtggagttcgtgctgcgcaaggcggatggctcggagaagagcctgggcaagcgctccttctccacggcggcggatggcacgcaccgcgagaaggtccccacctcggacgtgggcagcgtgctggcgcgcgtggtggtgaaggacaagaacggtgagacgtggcagggcgaggagtcgctgctcgtcatcggcggcgcggacgagccggtggcgcgcgtgcccaacctgacgctggcctcgctgtccgggacgctggcgccgggcgacaccgcgaagctggtggcgctgatgccggatagctggggttcgggtggccgtgatgcgggcccggtgtgggtgacgctgtcgggcgcgtcgctctacgacacgcaggtggtggagctgacgggccgcacgctggtgcacagcttcaacgtggagaagcgcttcggcagcgcggtgtacgcgtccgtcgcgtaccccacggccacgggccgctgggaggagcgcacggtggccttccgggtgattccgcgcgagcgcaccctcacggtggagctgcagccccgccgcgcggaggccacgccgctcaccgagcagagcatcgacgtgcgcgtggtggaccacgagggccgcggcgtggtggcgcagctctccgtgggcgtggtggacaaggccgtctacgccatccagagcgagttccggcccagggtgctggacttcttctacccgccggcgcgcaacaacgtgtccaacttcttctcgtcggagttccagggctacggctacggcgaggcgctggcgcggaagatggcggggctgccggaccacgccttcgcctccatcaagccgcccagccgccagacgaaggacctggagcgcgacaccgcgcactgggacccggcggtggtgacggaccgggatggccgcgccacggtgcgcttcacgctgccctccaaccagacgctgtgggtggtgacggcggtggcggcggacacctccggccgctttggcgagggcacctccgagttcgccacgcgcggcggcctcaacctctacgccgcgctgccgcagttcctccgtgaaggcgacgaggcggtcgcttcggtgcgcctgtcggcgggggagaagtcgccggccagccagctactggacgtgaagctggcgtcgctgggcgcgctgaaagcggaccagttcgagcacaaggtggagctggcgaaaggcggtgagcaggtggtgccgctgacgctgaaggcctcgtccacgggcgccgcgcagctcaccgtgaatgtggcgggcggcaaggactcgctgagggacctcaagcgcttcgatgtgggcccagcggcggtggaggacgtggtgaaggtgagcgcctggggcggcggcgcgctggaggtgcccgcgcctcaggaagcgacgctggcgcgcgtggagctggtgctccagccgtccatcgtcgacgcggcgctgtccaacgtgcgcgagctgctcacgtacccctacggctgcctggagcagttggtgtccaccaccgtgcccaacgtggcggtgtaccaggtgctccagaaggcgggcgcgctggcgaagctggacacggacacgcaggcgctgctggcggaggcgcgcagccgctccgtgcagggcaccgcgcgcatcctcgacatgtcggtgaagggtggcggcttcacctggttcggtggctatgagacgccgagcctgccgcagacgctcatcgcgctggatggtctggcctacgcggccgaggcggggctggtggaccgcgccgacccgcgcctggtggagagcgcccgctggctggaggcgcaggagggcctgccgcccgagtacgaggccacgcgcgcctacgtgctggcgcggctggagggctccaagcaggccgcgcgcgtgcgtgcgctggtgcagggcgcggagggcggggacttgtatccgctggccctggcggtgctggccgcggagaaggccggcgtcatcaaggagcccgcgctccagactcaaatcaacgcgctggtcgcgcgcagcgcgcagggctacgccacgctggccgcccttgggccgggccagtcgctggagcagtcggaggccttcttccgcttcccgctgcggcgcgtgggcatgacggccatcgccgcgcatgcgggctcgttcggcacattggacatcacccgcgcgcgccgncgcatnctggagctgctgtcagagccggacctgtccaccttcgaccggagcaccacgctgctgcactcgctgtggctgctggagcgcgacgcgaaagcgatgcagggcatgaaggcgcccgaggtgaagggcgtgaagacgccggtgaagttcgccccgcgcggcctgggcctggtggcggtgctggcgccgggcacgcgcaccgtggacgtgggcggcttcgacggcgtggccacgctgcgcgccaccacgcgcacgccgctgtccgccgtgcagccgaaggcggagggcatgtccatccagcgcgcctactacgtgctgcgcgagagcgggaaggtgcggctgggcgcgggcgacaccgtgtcccagggcgaggaggtctacgtggagctgacgctggacgcgcgcggcgacaaccgcgtgcgctcggcgtactacgtggtggaggacgcggtgcccgcgggcttcgtgccgctccaggaggacaaggccttccgtgggccgccgcactcgctgccgctggtgcccgaggcgctcaagcgccgcgtgctcaacccggagcgggcgacgttcttcttcgaggagccggcctggtggagcgacagcccgcgcaccgtgggctacgtgctgcgcgcgcagttcgccggcaccttctccgcgccgcccgcgcacatcgaggacatgtacgccgccagcatccacgggcggacggccgcggactcgctgaaggtggtgccctccaagaagcacctgggcgacctgtag

SEQ ID NO: 5393 - DNA, 513 bp, Myxococcus xanthus
atgccgcccgatccgccggacgcttccaccgtgagtggacacctccagggactggcccggcgcatccggacactgcgggagcggcggggactcacccaggaggacttcgccgcccgctgcggcatctccgtgtccttcgcgtccctgctggagcgaggcgagcgcagccccagctacgagacgctgctccaggtggccgccgcgctccagctcccactgtgggaactcttgcggctggaggacacgcaggacgcgggtgtccaccggctggaggccttcgtccgggggcgcggcctggctcgcgtggacgtggaccggttgctgtcggtggcggaggtgatgttcaacgagcccacgcgggcaacggaggacatccaggccgtccggccggagcctgcccgctgcggcgagcccggctgtgagaagccagtgctcgcccggggcctgtgcgccgcccattaccaccgcgagcggcgcaggaaggccgccagtccagggactggcggcacctga

SEQ ID NO: 5394 - DNA, 546 bp, Myxococcus xanthus
tggaaggtggatgactcgcactccagcgccggcttttccgtccgtcacatgatggtgtcgaacgtcaccggctcgttcaacgtgaagagcggcacgttgaacctggatgacaaggacatcaccaagtccaaggtcgaggccgtgctggacgcgtccaccgtcaacaccggcaacgccaagcgcgacgagcacctgcgggctcctgacttcttcgacacggccaagttcccggagatcaccttcaagtccaccaaggtccagaaggcgggccagggcaagctgaaggtcaccggcgacctgaccatgcatggcgtcaccaagccggtcgtcctggacgtcacgggcccgtcgaaggagtccaaggacccctggggcaacacccgcacgggcgtgacggcgaccaccaagctgaaccgcaaggacttcggcctggcctacaaccaggcgctggaggcgggcggcgtcgcggtgggtgaggaagtcaccgtgaacctggagctgtcgctggtgaagcaggccgacgccgccgcgacggacaagaagtaa

SEQ ID NO: 5395 - DNA, 762 bp, Myxococcus xanthus
ttcatctctcacggctcaccgatggtggccctggacgcggatgcctacccgcaggcactgcgtcgcttcggcggcgaggcccaggcgcgggccctggtggtggtgtccgctcattgggagacgcccggcgagattcgcgtcaccgccagcgcgcagccgtccctcatccatgacttctatggctttcccgagccgctctaccgcctgcgctacggcgcgccgggtgcgccgtccctggccgaggacgtggtcgcccggctgaaggcgggcgggttgcccaccgtggctgacgcggagcgcggctgggaccacggcgcgtgggtgccgctgctgcatgccttcccggaggcgaagctccccgtcgtccaggtctccatgccgctgggcgcgagccccgcggacatcgcgcggatgggcgaattcctccggccgctgcgcgcgcagggcgtgttgttgatgggcagcggcggcatcgtccacaacctgcgccggctgaattttcaggagaaggcggcgtccgtcgagccgtgggcagcggccttcgatgcgtggattgcgcagaagctggaggcgcgagacttcaccggccttcagtcatggttggatgcaccgaacgcgcggctcgcgcatccaagggccgaacatttgatgccgctctatttcgtcctcggagctgccctccccgaggaccgtctcacccccgtattcgagggcttccatcacggaaccttgtccatgcgcagcttcgcgctgcgcgcctga

SEQ ID NO: 5396 - DNA, 690 bp, Myxococcus xanthus
atgggactgcccggcctggagaccacggcgtccaagttggcggtggcgctggtggcgggctccgtgatgttccatctcacgaagtcgcagtcgggtggtttgctgctgctgttcccggacctggtgttcggcaagctctacctgtggcagccgctgacgtatgccttcatcgagtccagccccatcggcatcatcttcggcgccatcatcacctggtccattggcggctacctggagtccatctggggcagcaggcgcctgttgatggtggcgctgggcatcgcggtgagcgcgggcctcatcacctcgctgctggccatgctggtgcccggcgcgacggtgcaggcgtacgcgggcggcaacgtcatgacgtcggtgctctgggtgtcctacggactctccattggccggggacagacgaacttctggggtctgccgctgtcgggcaacgcgctggcgggcatcggtacgggcttcatgatgctgtcagacagcaccagtggctggctgacgcaggtgccggacctgctgggcctctgcatggcgttcgcctacgtgcgcggggccagcccgcgcaagctgtggctgcacctgcagcactggcggctgcagcgtcagttgaagggccgctccaagcacctgcaggtggtgcggcaggaccggccggaccgggaccagtacctcaactga

SEQ ID NO: 5397 - DNA, 198 bp, Myxococcus xanthus
atgggcgttatcagcttcacgggcgtcaaggtgttctccaccacgctcgcgcgtgaccgcgagaacatgggtgagaacatcaccaagtggctcaaggagaactccaacctcgaggtggtcgaccgggtggtgacgcagtcctccgacaaggagttccactgcttgaccatcacgctcttctacaagccgaaggcctga

SEQ ID NO: 5398 - DNA, 216 bp, Myxococcus xanthus
atgagcaacgaggtggacgcgaagacggcgcgtgagcgggccaaggccatcgcggagcagcgccgcgccgagcgtcgcaaccgcaagcgcaagtgcgtggtgtgcagcgtggaggagagcgacaagacgcccctgacggcacaccccgaaggcattggcccggcctgcaaggacgaggtcacctgcctgtcgcgcaaggccgccagcggccggtga

SEQ ID NO: 5399 - DNA, 1197 bp, Myxococcus xanthus
atgaagagcgtgtccaagaacgaggaaatctacttcctgtccggcaagcgcaccccgttcggtacctacgggggaagcctgaaggacctcagtgccaccgacctcgccgtggagtcggcgaaggccgcgctggcccaggcgaaggtgtctccggaagacgtccagcacgtcgtctacggcaacgtggtgcagaccagcgcggacgccatctacctgccgcgccacgtgggcctgcgcaccggcgtgcccgtccccgtgcccgcgctgggcgtcaaccggctgtgcggctccggcttccaggccttcatcacggcggcggagctgatgctcaccgagcaggccgccgtcgtgctggccggtggcaccgagtccatgagccaggccccccacgtcatccgcggcgcccgctggggcctgccactgggcaagggcagcctggaggacatgctgtggacggccctcaccgacagctacaccggccagccgatggcgctcaccgccgagcagctcgcggtggactactcgctcacgcaggaccaggtggacgagtacgccgtcctcacccagaagcgcttcgccgccgcgcaggaggcgggccgcttccaggatgaaatcgcccccgtcacgctgaagacgaagaagggggagacggtggtgtcccgggacgagcacaaccgcccggagacgtcggtggagagcctgcgcaagctgcccaaggtcttcaagaaggacggcgtggtgcacgcgggcgcggccagcggcatctgcgacggcgccggctccatggtgatggccaccggcagcttcgtgaagaagcacggcctgcagcccattggccggctcgtcaactggggcgtctccggctgcgacccgaaaatcatgggtatcggccccgcgccggccatccgccagctgctggagcgcgcccagtgtcagctgtcggacatcgacctcttcgaggtcaacgaggccttcgcgccgcagtacctggcggtggagaaggagctggggctgccccgcgagcgcaccaacgtcaacggtggcgccatcgccgtggggcacccgctgggggcttccggcgcgcgcatcaccaccacgctggtgtacgagctgaagcgtcgcggcgcccgctatggtatcgggtccgcctgcatcggtggcggccagggcatcgcggtgctcgtcgaggcgctctga

SEQ ID NO: 5400 - DNA, 648 bp, Myxococcus xanthus
atgaacgtcctcgccgagttgggcatcgccgtcgccggcctggtgctggcgctcgtgctgctgtccatgaatctgtggcgcagcatcctcttcctcttcccgtccagcgtgcgggtggagcctgaggcgcccgcggaccagatggatttgcccctggagctgtcggggcgcgccaaccagctccaggcgctggggttcgtgccgctgggcagccacgaggagaaaccgcgcctccagcgcgccacgcgctcctacgattgggcccacccgggtgagtgcgtcttcgccacgctccacgaggggcagggcggcgcgccccggctgtacctcctcacgcccctggcctccgggggcttcgtcatcaccgcggactaccggcgcccggcgctggaggtgcccggcgtctacctggcgggttcactggaggacgctccgcccgaccgcctgctgcgcgcgcacctgcgccgcctggacgggttgcagcccgccggggatttcacctgggaaggcagggtggcagccgggcgttcctggtaccaggggctcggtcgcaaggaaatccggaaacagaaccttcaaggtttgttgtggaccgtcatcgcgcttgccatcgtcgccagcgcctttttcgggccgcgcgcgccctag

SEQ ID NO: 5401 - DNA, 657 bp, Myxococcus xanthus
atggccccgaccccactgcggttcctgctggatttcatctcgccgtatgcctacctggcctggacgcgcctgccggcgctcgccgcgcgccatggccgcaccgtggagccggtgcccgtgctgctcgcgggggtgctcaacgcgacgggaaacatcggtcccgcggaggtcgtgcccaagcgggcctacatcttcaagcagaccttccgcatcgcccatgaccttggcgtgcccttcgcgccgccaccgacgcatcccttcaacccgctgctcgcgctgcgagtgacggccgccgtggatgacgtggaggcccggagccggctggtgagcgccctgtatgtctccgcctggggcggcgggaagggggcggagtcgcccgaggccgtgggcgcggcgattcaggcagcggggctggacgcccaggcgctgctcgcggcggcccagacgcaggaggtgaaggaccgggtccggcggaacaccgaggcggcggtggccgccggggcctttggcgtgcccacctatctggcggacggcgagctgttcttcggcgtggactcgctggggcacctggagcagttcctgcgcggcgaagacccgctcaccccggcggacgtcgagcgctggcgcacgctgccagccagcgcgtcccggcgctga

SEQ ID NO: 5402 - DNA, 3597 bp, Myxococcus xanthus
cgctcgttggccgtgggcatggtggtgacggggcgctaccgggtggaagggctgctgggcgaaggcggcatgggccgcatctggctggccacggacctgcacgagcaccgccgggtggcgctcaaggagatgcaggtccccgcgggcctgacggcgggcaagacggaggagctggtgctgatgttccggcacgagttcttcgccatgaagaagctccagcaccccggcaccctcaaggtcttcgactggggcatgacggaggccggcaaccgcttcatcaccatggaggtggtggacgggcaggacctgagctcgctggggcgtgagtcgccactggacacgcgcacgctgtaccgcgtgctcatccagatgtcccaggtcctggccttcctgcactcgcggctgtacgtgcactgcgacatcaaggccagcaacatccgcatcaccagcgcgggcgcggtgaagctgatggacttcggcgtcatgcaccagctgggcacccccagccccggccgtctcaagggcacgctggagtacctggcgccggagtggcagcgcggcgcgagcatcgacgggcgcgcggacctctattcgctgggcgtcatggcctactacctggtcacgcgccggctgcccttcaagcgcaacaccccggcggcgctcctggcggaccacctgacgcggccgccgccgaagccgtccacgatttgtccggtggatccgcagctggaggagatcatcctcctgctgttggcgaaggatccgcgcgagcgcttccaggacgccagcgagctgatggaggcgctctgccacgccagcggcgagccgatgccggaggagccgctgtcggcgcgcgccagctacctgcacgtgccggaagtggtgggccgcgccgcggagctggaagcgctgatgaacggcctggccgaggcggactggggccagtcccgcgcggtgctcatcggcgcgcccgcgggcgtgggcaagacgcggctgctccaggagttcgagctccaggcgaagctggcggagctgcccttcggccggggccagtgccgcgcggagggacaggcgccgctgacgcccatcgtccaggcggtgcggtgtctggtgccgctcacgccctcggagatgatggagcgcctcgggccgaagctgcggcaactgctcccgggcctgacgccggacgcgggcgaagtgcacccggtggcgggcgaggagaagctggccttcttcggcgcgctggcggagtgggtgcaggcgctgggccggcggatgacgctggtgctgtgcttcgaggacctgcagtgggccgacagcgccacgctggaggtgctcaacgtcctcatccgcgcgctgtacggcacgcgcggcatggtggtgggcacgttccggaacggcgagctgagccgcctgagcctggccttccagacggtggacgagaaaatcaccacccgcatggacctggagccgctggccgccgagcacgtgcgtacgctggtggagctggcgctgccggggctggccgtgcccgcggccttcgtcacgcggttgcatgagaccacgggcggcaatgccttcttcgccaccgagtgcctgcgcgcgctggtggaggaaggcgcgctgacgcgggtgggcggccggtggagcgccgtcgagggactggacacacggccgctgcccgcgagcatccacgacgcggtgctcgcgcgcctgggcagtgctccggcggagcaggtgtcgctgctgcgccagttggcgcccgcgggccgcagcctggagctgcccatgctccgcgcgctggcggagctgcccgagtccgagctgttcgcggtgctggacggcatcgtggagcggcagttcctccaggaggtggagggccgctacgtcttcacgcacgacaccgtgcaccaggccgtctacgacagcacgcccgaggatgcgcggcgcgtggcgcacggccgcgtggcgctggcgctccagacgctgcactcgtcgcggccggagctgtcgcgcacggtggggtggcactacctgcgctcgtcggagccggagctggccattggcccgctgctggacgcgggacgggccgccatcgaggcgcaggcgctgctggaagcgacgctgctgctgaaggaagcggcgatgctgctggaggccgcgccggacttcccgggacgtgacaggctgctcttgcgcatctgggtgacgatggtggaggtgggctattcgagcgacccgcccacctcgctcgtcttcgcgcggaagctgagcgcccattgggcctccacggtggacctggtggacgggcgaacgcaggcggtggccgcgctggaggccgcgtgcgccgcgcccgaagcggagcgtcccgcgcgcctgaaggcgttgttccgcgagcgggaggcggacacgttcgccagcaccgcggacgtcttctggaagcaggccgagctgcgcatcctccaggccatggcgctggccagcgtgggccgcacggaggagctgacggcgctgctggagcgcgtgcgggccgagcagccggaggtgtcgccctaccgcgccgcggtgcaactggcgcctgcccagttgtgtgcctacacgggccgcttctccggcgtgctggagacgcagtacgagcaactgaaccggcttcgcgggctgtgcgaggtgatgggccggctgcccaagcgcctggcgtgggcgctgggcatgggtggcttcacgatgaacatgaacctggcgctgcgcggcgagccgctggacgcgcaggcgctgcgcgacgggtacgccgtggcggaggcccatgggttcacggatgtgcgcggcttccatctgttcgcggtggtgacgcgcgcggccttcacgggcgacggcgcggcgttcgtcccggccttcacggagaagacggagctggtgcggcggctgggcaacccccggttgatggagcgcaacctggccctcttcacaccgccgtactacctggagcgcggcgagcacgagcacgtggccgcggtggtggcccgcgccgaggcgctggcgcgggtgctgccggaggaccggtggctccagtgtcacctgcgggtgtatcaggcctgccgcgacgtgctcttcgaggatgcgggcgcggcgcgccgctcacttcccgcggcccttgccgccgcgcgcgagggcggcgtgcgcatggagacgctgctgcgcgtctaccagtcccgcttcgaacgggagcagggcaacctggtggcggcgcaggacgcggcggaggcggcgctggcgcgggccacggacccggtgctggccaatccgtgggatgaaatcctctcccgccgggcgctggcggcgctgctgcccggtgaggagggcctgacgcacctgcgccgggcgctcgcgctggcggagctgacgggcaacgtgctccaggtggggctggtgcggctggcgctcgcggagcgcgcgcgggacgcggagtcctcggtggtggcgctggaggcggccgaggcggccttcatggatgcccgggcctccagcctgctggccctggccagctccctgcggggggcgctccagcgccgggccggggagctgcgtcagagcgcctga

SEQ ID NO: 5403 - DNA, 2211 bp, Myxococcus xanthus
atggggttggccgtcgcggtggccgtgctgctggcggccacccccaccttcgtcactcgcggcgacgtgacgcccgaggccgggctgcgccgcgaggccgaggccgcctggacggcgctggaggcgcgttacgtccaggaggccggaggcgcgccggcgaagcccccggcctccatcgtcctccagaagggcgcggcgctgtcgccccagcgcaacggccaggggcgcccggggctggtggagcttcggcagaacacgccgggcatgctggatgagcggctgcggctggcgcttcggcacgagctggcacaccagttcctgtggtgggcgtgtccccagtccagcgaggaccgcctcttccacgaagccttctccgtggcggtgagtggcgagctgccctcgtggaaggaggggccctatctgtcgttgtcccgcgcggcgtcggtgttggccggggcgccggaggtggacacgcccagggcccgccgcgcgctggcgcggctgctgaacgagtccccgggcttttcgccggcgctgtcgcgcaggcttcggcagtgccaggacggcgcgcggtgggcgtcgccgctgtccatcgacgagctggcgggcgtgggcgtgcgcgaggcccggcccgcgacggtggtggtgagccgccattcgggagaggtgttgctgtcggagggcgacgtgcggcgcgcgctgccgtacggctcggtgctcaagcccttcctgtacgcggcgggcgcggagcacccgacgctgccaccgcgcccgggcgtaccggagtgggtctgcggcgcgggggtgccggcgaaggtggacgcgcgcaccgcgctgctgcgttcgtgcaacggctactacctggactgggaggcgcggggttcggcgccccgggccttcggcgcgtggggaccggtgctggcctcggtgggactgacgggcctgccggaggacatggcggaggcgacggggcttcgctccacgctggccgtatcgccctggggcgtggcgcaggcgtaccggctgctggcggaggctcggccggatgtggtggcgctgctggcggacaatgccgcgcgcggcacgctggcggagctgcccgcgtcggagtcactggtgggcgtggcgacgaagacgggcaccgtgcgcgatgcggcgagccggccccagttcggttggattgccgccgtggacccggatttggtggcggtggtggtgcggcccggcgccatgccccgccagttcgcggaggaagtgcccaaggcgctggcgcgcgcgcgcaagcaggcgggcctggaggcggcgcgcgtgcaggtgctggggctgcttccaccgggggacgtcgaggcgcggtgctccggcgcgggtttcgcactggtggagggtgtgccgcgcgcgggcgaggaggcctggacacccctggcatccctcacccagcgtggcgcggccgtgtgtctgggcgcgccctggcgcgtgcgctttcccggaggcccgggcgagggccgtgactatgcgggcgtcttcatcacctccgagccgccgccgtaccggccgccgccgggcgttcccaccacccccagcgccatgaaggcgcggcgcggctccgacttcgtcttccgcaccacgcgcctgcaatacgcggcgggcgtggtgtccgccgaggacgtgacgctgacgggcgaggctcgcgtggcgctggcgcgggtggtggcccacaacgagcaacatggccacagccgtcacccggggcggcccgtctgtgacaccacgcactgtcaggccttccgcggcaccgtgcgcgtgcggtccgaggatgcgaaggccctgggactggcgccgctgaagtggcgcaagtggctgaccttctcccagggcggggaggagccctggcggcaggcgcggccccgcgcggaggtggagcgcctgttggggcgcgggctggtgtcgctgcacttcaaggcggggcgggtgcactacctgcgcgcggagacggacggtgacgcgacgttcgacaccgcgcgctcggtgccgtgtgacttgctgcgctccggtttgaagctgccgtcgtgccctcgcaccgcgtcattcaatggcgaatcactgatgttcgagggccgtggccgaggccatggcgagggcttggatgtcgaagccgccaaggccgcgggttcgggcagcgacgtgatactcgatgacgcatacggacagtga

SEQ ID NO: 5404 - DNA, 1377 bp, Myxococcus xanthus
atgaagaagacgctcacctccctcctgtgcgcggcggtttcgctcacccttctttccctggcgtgtggtgagggcaacccacctcaggtgccgcagccgctcgaggacggaggggttctctggacggagtgcagccccgagggcgccagggaagactgctcgcagggcgaatcctgcatcttcgtcgcgtcccatgaccgccacctgtgcgtccgggcctgtgattcgcagaccgcgtgcgagcacccggatgcggtctgctgcccctcgtccggagagggggccgagggcggccactgcgtgccgagcaacgcgtgcgtgccgaccgacgcgggcgtggacggcggctcgaacgaggagacggacggcggcacccaggaagaagacgcgggcgtggacccggagccggatgccggcaccgaccccgagccggacgcgggcgtggacccggagccggatgctggcaccgagcccgacgcgggcacggatgccggtacggacgcgggcacggatgccggtacggacgcgggcacggatgccggtacggacgcgggcacggatgccgggactgacggtggcacggacgcgggccacacccccatccgggtgatggcgtccaacctcagcagcggcaactaccagtcctacgacccggggcacggcatccgcctcatcaagggcgtgcacccggacatcgtgctgatgcaggagttcaactacgggagcaactcggcgtcggacatccgctcgctggtggatcagattgcgccgggcttccactactcccgtgagacgggcgcgcagattcccaatggcatcatcagccgctggcccatcatccagttcggccagtggcccgacccgcgcgtgtccaaccgggacttcgcctgggcgcgcatcgacatccccggtccccgcgacctctgggcggtgagcgtgcacctgctcacgtccagctccagcaaccgcaacgcggaggcgcagtccatcgtcaatgaggtccgctcgcagattcccgaggacgattacctcgtcatcggtggcgacctgaacacggacagcttcagcgagtcctgcttcgccaccttccggcaggtcgtgacgacggcggggccgcacccggcggaccacaacggcaacacgggcaccaacagcaaccgcaacaagccctacgaccagattctggtggaccaggacctgcgccagtaccagcaggcgaccgtcattggctccagcaccttccccaacgggctggtgctcgacagccgcacctaccggccgctgtcggagattgccccggtgcagtccggcgacagcagttcctccaacatgcagcacatgggcgtggtgaaggacttcctcgtccccaacttctga

SEQ ID NO: 5405 - DNA, 1240 bp, Myxococcus xanthus
atgaaagtctcccatcgattcgtcctcctcgtgattgtcgcggtgctcgccgcagaccaggtgaccaagtacctagctgtctctcggctgacggatgccctggatgggcgggaaggcctggcgcgggtgacgggcttcgtcaccgagcagaacctggacaaccgcccgccgcccgaggacggctcgtaccgggtgttgcggccctatcgcttcatcgaggactactggcacttccgctacgtggagaacccgggcgcggcctggggcatcttcggcgacatgcccgagggcgtgcgacgcctcttcttcctcgtggtgagtctggcggccatgggcttcatcttcgtgatgtaccggcgcacgcccatggagcagcggctggcccgggtggccctggcgctggtgacgggtggtgcgctgggcaacttcgtggaccggttgttgcgtggctacgtcatcgacttcatcgactggcactggcgcaaccagccggggatgcgctggccgaccttcaacgtggcggacgtggccatcagcgtcggggtgggtctcatgctgctggactcgctgcgggcgccgaaaagccccaatccgtgacgggcgggcggcggctggtgtaagtcccggcccgtgccgcgcaaatacatcatcctcctcgccgtcacccttggcgtcatcgtgctcgaccagtggacgaagtacctcgtcgtccgcgagctgaccacccagatggaaggcaaggagagcctgggcgagcgcctggcctcgatgtactccgagccgccccccaaggggcttcacggggatgcactatcagccccggcggcacatcgagatttcggagtcgttcttccgcatccgctacctggagaacccgggcgccgcgtggggcatgttccggagcatgccgcctgaggcgcgggtaccgctcttccacgtggccatcattggcgcgctcatcctcatcactttcagcttccgcaagctgaccggcacggacccggaagagaagtgggcgctgtgggggctgccgttggtgctgggcggcgcgctgggcaactacatcgaccgcgtcgcccgggccttcgtcatcgacttcctcgaggtccactggttcgacaaggcgaccttcccgtccttcaacgtcgccgacgcggccatctgcattggcgtgggcatgctcatcatcgactccttcgtccgcaaggagaagccggcccaggcccccacccaggcctag

SEQ ID NO: 5406 - DNA, 1305 bp, Myxococcus xanthus
atgctccccgtcctcgtccacctcaccttcacttcgctctggtcgcagctcctgctgtacgcgatggccgcgggcacggtgggctacgtcgtcttcaatggctggcgcagcgccgagggtgagttggatgcccggacgggcacgcgcgtgccagtgtccgcgcaagaccggctgctgcgggccgcggggtatggcgtcgtgggcgcggtgctggcctggttcgccctgcagtactcgctgccgcccggggcctttccgggtgccaagggcgagggcatccccgtgcacacctatggcctgctgctggccctgggcttcatcaccgcggtgacggtggcgggccggctggcgcaggacgaatggcgcacgctggagctgaaggacggggcgtgggtggacgtggaggggccgaagaagcgcgagcaaatcatggacatgacggtctggattctgctcggcggtatcggcgggagccggctgctcttcgtgctcgtgaactggcaggactacgcccgtgactggacgcaggtgttctccctgggcggagggctcgtcttctatggcggcctgattggcgcgtccgtggccgcgttcgtgttcgcgcggatgcatggtctggatttctggcgcctcgctgacgtgtgcatccccaccgtgtcgttgggccagtgcctgggccgcctgggctgcttcagcgcgggttgctgctggggggacgtggcgcccgcgcatgccgccaccgccgtgcacttccccggcagcggggtggcgcaggacctcctgggcggggtgggcaacacgtccagcctggcgtattcatcccaactccaggacacgcggtacgtcgtggaagctacgggtgaaatcttccaccacgccgcgcctggcgcggtacgcatctcggattgggtggcgcagcagggctacaccctgggggtgtaccccacccagctcttcgagtccgtcgggcaactggtgctcttcgtggggctgctgtacgcccggcgctaccgccgcttccatggccacgtcctggcgttctggctgatggcctatgcggtgctgaggagcacggtggagctgttccgtggggacgtggagcgcggcaccctgcacggcctgctccagtcgctgggggcgggggagctggcggcggcggtgccgctggaggcgtggtacaatgtctccaccagccagttcatctccctgtgcatgttcacctttggcgcggtgctgctcgcccagaagggccgccgccgggagagcgaggcggaaagcctggggcctaccccctcggctgcgtga

SEQ ID NO: 5407 - DNA, 1011 bp, Myxococcus xanthus
atgaacaagctgaagggcgcgttcatccgcagcacctccgccaagttccgcgtcgccggcctgtacaacaagttcctcacgtacgaacggttgtggatgcgcacgctccaggaaatcgaagcgggcacctatcgccgggatgtcttcaaggcgcgccgccgcgcggagacccggaaggccggcgcgacgggcacggcggggcagaagggcgtggtcgagttgccggaggacatctccgacatggacttcgaggaggtggaggagttgatccgcccccgtcccgtcaacgagccgcaggtggccgccagctttctccaagccacgggtggagcgccgtcgaagggcccgcctgcggtcgcgccgctgacgcccgccattgcgcccctcacgcccgcggtgggaagcacgccgctgcgaggcgcccccgccgttgcgccgctgacaggcattccctccgtggcgcccgtggcggggacacctccgcgcgggcagcccactgtgacgcccgcggcgggtggcacgcctgcgcacggcacgtcggtggcgccgccgggcatggcggcgaaggcaccgggcgccgtggccagcacgccgcctccgtcgaggacttctgccgtcggcgcgagcagcacgccgcctccgtcgcggcccgtggccaccggcgccgggagcatggctcccccgccgagggcgcccggcacgggcacggccggcaacatccctccgccgtcgcggcccgcttcgatgccgccttcctctgccgcatcccggcccccctcggcgagcggcggaggcgggttggcggatgacaagctgcgtgccgtctacgacgcgtacgtcaccgcgaagcgccgctgccaggaggacacgtcgaagctgtcctacgagtcggtggcggccacgttgcgcaagcaggtgccggagctgctcaagcagcacaacgcgaaggcggtggagttcaaggtcgtcatcaaggacggcaaggcatcgctcaaggccgtgccgaagtag

SEQ ID NO: 5408 - DNA, 354 bp, Myxococcus xanthus
atggtgatgggactctccctgggcacggggtgcatgtcgccctctcaggaggctcaggagcgtctcgcggcgctggaggccgaaggcgaggcgatggacgcggtgctcgactccgtcgaggagcggctcctgggcaaccaggccatgctccagacgtggcaggagcttggtcgccgccaccagcaagtgacgcagctgcactgcgagacgtccgacccacacatgatcgcgatgatgaagcactacaagaagcaggaggaccgcgcgcgtcagctcaagcggcgcggcagtggtgtcgcctcggtggacaaggcggtgctcacctccggcaaggcgccgcgcggcaacaactga

SEQ ID NO: 5409 - DNA, 906 bp, Myxococcus xanthus
atgaagtccttgcggctcgcgctcgccgtgctgtccctggccgccacggcgtgccgggacaagcccgtggaccatctccagcgggcccgtgacgccaccttcgagaagcggcccgacgaggcgctcgtcgagtaccgcaaggccttcgacgcgcttcgccacgactcctcaccggaggcgctggtgctccgcgcgcgcgccctcaagggggccgcggatgtctactggctggagcagcgcaaggtgaaggaggcggtgggcgtctaccgcgagctcatccagcagtgccccgagtcgccggaggcgctcgagtcccgcatcatcctggcggacctgctgcgcgtgcattaccgcgacctgcgcggcgccatcgaccagctcactgcggccctcaagctcaatccgccgcagggcgcggagctgcactacctggtcaccaagctctacttcgagttgggcgactatcagcagtgcgagctggagacccgccgagtcatggagcgcttccccacgagcgcctacgtggatgacgccctgtacctccaagcccaggccatcgcgatgatggagggccgccgccaggaggcctcccgcaccttcgcggacctgcgcacgcgcttcccggactccgagctggcgccgcacgccctcttcgagatgggcaagctgcgcgccgacgccggagagaacgagaaggccatcgagacgtgggtggatgcgctgaagacacaccctgaccccgcgctggtgcaggactacatcgcgagggcgcgtcggcgcatcgccaacaccacggccgcgggcgtggggcagcgcgaggtggccttcgaccgcgtccgcccggcgcgtacgtcgctggaagccgtcggtggccgccccgaggaagccgcgcacgagcacgactga

SEQ ID NO: 5410 - DNA, 120 bp, Myxococcus xanthus
atgaatcccgacaccttgaacgacactgtcatcggcatcggcgtgctcgcgcccgtcgccctgctgcccgctcccgtgctgcctggtctacccattggcggtagatggcccggactctga

SEQ ID NO: 5411 - DNA, 1413 bp, Myxococcus xanthus
atggaccccatcacgcctccgctcgccctcggccagaagcacgtcgtcgtgctgggtgcgggcttcgccggactcacggccgccaaggcgctcgcgcgccactcggcgctgtacgtgacggtcctcgaccagcgcaaccatcacctcttccagccgctgctctaccaggtggctactagcggactgagccccgcggacatcgcggtgcccatccgctcgcagttcgcacgcaagcccaatgtgtcggtgcacttgggccgcgtcacgtgggtgaacctcaaggaacgctgggtgggcggtgagggcgacgtgcggctgcgctacgactacctcgtcatcgcgtgcggcgcgcagcacagctacttcggcaagtcggagtgggaggacttcgccccgggactcaagacgctggagcaggcgacggagttgcgccgccgcatcctcagcgccttcgagcaggcggaaaacgagcgcgacgccgagcgccagcgcgcgctcctgagcttcgtcgtcgtgggcgcgggcccgacgggcgtggaactggcgggcgccatcgcggacatcagccgcacggtgctggtgcgcgatttccgtcgcatcaaaccgtcccgcgcgcgcgtcttcctcgtggaggcgggcccacgcattctgccgtccttcagcgagaagctgggagtgcgtgcgcaccgcgaccttgcggccctgggcgtggaagtgcgcacggaggcacgcgtgacggcggtggacgccgagggtgtgatgctcggctccgagcgcctggcctcgcgcacggtggtgtgggctgcaggtgtgcaggccgagtacctcacgcgcgggctcggcgtgccgctggaccgcgcggggcgcgtgcaggtggcggcggatctcacgctgcccggccacccggaggtcttcgccgcgggtgacgtggcccacgtggagctggacggtaagctcgtgcccggtgtcgcgcctgcggccatgcagatgggccgggccgtggcgcgcaacgtcctcgcggacctgcgcggccgcccccgcacgcccttccgctacaaggacaagggcgcgatggccaccatcggcaagcaccgggccatcgcggagacgggccgcgccaggctgacgggcttcgtcgcgtgggtggcgtggctcttcatccacgtctggtacctggtgggcttcaagaaccgcttcggcgtgttcgtcacgtgggtgtggagttacctgttcagcacgcgcggcgcgcggctcatcacggagcgcgagtggcggttgagtccgaaggtcgcgtctgagcgcgcgccgcacgcgggcaaggtgacggcgggcgaccccacggcgcccaccagtgatgcacggccgccggacgggacgacgactacggccgctgccgccctcgtcgcggactga

SEQ ID NO: 5412 - DNA, 783 bp, Myxococcus xanthus
atggacgcgctgctgtcggagctgtcctcggcggatccgcgcatccggctggtggaggtggactactcccccgccgtcacgaagtcactctccgagcagttcttcggaggctcccggctgcccatgaaggactcgcgcggcgggcccttccattcctacttcttcgggctcgcggcggcgaagcacccgcacgtgatgcacctggatgccgacatgctcgtcggcggagcgtcgcgcgcctggatggcggaggcggccgcgcagctcgcgtcacgcgaggagttggtgagctgcagtcccttgtcgggcccgccgcgtgcggacgggacgattgcgggagacagtcgctggtacgagcccgatgcacagggctcccacgcgttccgtttccggcgcttcagtagccgggccttcttcgtggaccgcgatgcactggtgcgccggataggcccgctgcaggcgaagctggcgccgcccattcacgtgctgcgtgccttacgcgcgggcaatccgccgtaccgcgagccggagaacctggtcacccggaggctcaagcgtcgcgggttgtggcggctggacttcctgggcgccgcgccgggcctgtggacattgcatccccagtaccgttcgcccacgttctacgagcggctgccggagctggtttcgcgagtggagtcaggggacatgcctgacgcccaacgcggccaggagaacgtgcacgactgcctggtggactggtccgatgtgagggccgcgcggcggaagtggtggcgacgcgggtag

SEQ ID NO: 5413 - DNA, 1320 bp, Myxococcus xanthus
atgcgcatcacccgtaccgcctctcgcagaaagctgttcggcgcgctgctgtgtaccctctctgtcgcggcctgcggcccggcgcccgaaggagagccctccggtgagaagtcccccgagatgggttcgcaggagaatcccgttgtctatggcacggaccaccgcacggacgtctatgcctatccggcgtccgcgctgcggacccgggccgagaagtccaccgtggcgttgatgaatccgtcggacttcaacgcctccaatcccaacaatgtcaccttcaatgccagcacgctgcagagcgcctacaacctctgctccacgcagcgcttcctgaatgacccgacgccggccttctgctcgggtacgctcatcgatgatgacctggtgctcaccgcggggcactgcatcaccagcgcgtccgcctgcgccaacacgcgcttcgtcttcaacttctaccgcacgtcggcgacgacgctgcagacggtgaccacggccgacatcttctcctgccagtccatcgtcgcgcgccagcagggcacggtgggcggccgcaacctggacttcgccgtcgtccggctggaccgtcccgccacgccgcgcttcgagccggcgcccgtccgtccgggcaacaccgccctgccgctgaacacgggcgtgtccgtgattggttccggcagcggcatcccgttcaagattgacgacggcggctgggtgcgagacgcccgcgccggcacgctggactacttcgtcgccaacaccgacaccttcggtggcaactcgggctcgggcgtgtatgagaacaacaacgtcaccgtggccggcatcctggtccggggcgtgacggactacgtcagccagggcggctgcaacgtcgtgaaccagtgcaccgacacgggctgcggtggcgagtccatcacctacgtgcgtcccgccatcgacgcgtactgcgccgtcgcgggcagcatgcgcctgtgcggcaccaccgagccgcctcctccgccgccggtcaagaccttcaccttcaacgtgaccaacaccaacagcgcgcagcagaacaccaccaacgtcagcgtgacgctggcggctggccagacgctgtccttcggcacctgctcgctgccgcaggccgcgggcacgggcgacacctacctgcgcctgttcaacacggcgacgaacacccaggtggcggccaacgacgactcctgcagcctgctgtcctacgtgtccttcaccgcgccctcggcgggcacgtaccagatgcgcgtcggctgctactccagcggcagctgcagcggcacggtggcctactccatccagtag

SEQ ID NO: 5414 - DNA, 1296 bp, Myxococcus xanthus
atgaaccacgctcacagtcaggctctcttcgctcgcgcgcaggctcgcatccccggcggagtgaattccccggtgcgcgccttccgaggcgttggcggcgaccctgtcttcttccgtgaaggcgcaggtgcctggctcacggatgtggacggcaaccgctacgttgacctcgtggggagctggggtccgcttatcctgggccacgcgtatccgcccatcttggacgccatcatcgacgccgcgcgccggggttcgtcctatggcgcgccgcatgcggatgaggtggagttcgcggagctcatctgcgccaccatgcccgcggtggagatggtgcgcctggtctccagtggcaccgaggccacggtggcggccatccgcgtcgcgcgaggcttcaccggccgcgagcacatcctcaagttcgaaggctgcttccacggcgcgggagacccgttcctggtgaaggcgggcagtggcgtggagacgctgggcctgccggactctccgggcgtgccgtcggcgctggcgaagctcacgctcaccgcgcccttcaacgacctggccgccgtggagcgcatcttcgcggagaatggccaggacatcgcttgcgccatcatcgagccggtggtgggcaacatgggcgtgctggtgccgaagccgggctatctcgaagggctgcaggcgctctgccagaagcacggcgtgctgctggtgctggacgaggtcatgacgggcttccggctgtcgcgaggcggcgcgcaggagctgtacggcctcaagccggacctcaccaccatggcgaaggtgattggcgggggcatgccgatgggcgcgtatggtggcccccgcgacatcatggagaaggtggctcccgcgggcccggtgtgccagtccggcacgctgtcggggaacccggtggcggtggcggcgggccttgcgtgcctcaaggccctggcggcccccggcacctacgcgcggctggaggaggtcagccgcatgttggaggtcggcttgctcgccgaggcgaaggccgcggacgtgcccgtcaccgtcaaccgcgtgggcagcatgctcacggtgttcttcaccggtgagcccgtctacgactacaccagcgcgaagaaggcggacacggcgcgcttcgggaagttcttccacgccatgctgaacgaaagcgtctacctgccgcccagccagttcgaggcggcgttcgtgtcgctggccattggcgagccggaagtcgcgcacgtcctcgcggcggcgagaaaggccttccgttcgcttggcaagaccggttga

SEQ ID NO: 5415 - DNA, 1953 bp, Myxococcus xanthus
gttcgcttcggtccctataccctcgtgcgccgcatcggcgccggggggatgggagaggtgttcctcgcgcgtgaggaggcgcctcgtcgtgcctgtgtggtgaagaaggtcctcccgcagctcatggcgagcccgcagttcgccggacgcttccgggatgaagcccgcgtcgtggtgcggctgcaccatccgaacatcgcgcgcgtgtacgccatgggcgaggtggaagggcagctctacctgtccatggagtacgtgcagggcaagacgctcagccggctgacgtaccggttgcggcagctcgggcggacgctgccgctgggcatcatgctccacctggggcagcggctctgtgagggcctggcctacgcgcacgacgcgacggatgagttcggcaatccgctgcacctggtccaccgggatttgtctcccgcgaacgtgtgcatcagctacgcgggcgaggtgaaaatcatcgacttcggcgcggcgcagtccacgctgaaggagcagcagacggcgccccgggtggtgattggcaacctgacgtacatggcaccggagcaggcgcgaaagcgcttcgtggaccggcgcgcggacgtgtacgcggtgggcgcgctgctgtgggagttgttcgcgtggaagcccctggcgcagcggggcgacccggtggagcggtggcggcgcgcggcctaccctcagtgggagccagcggggagtgtccggcagggcgtgcctaccagcgtggatgcgttcctgatgcgcgcgctggcctcggagcctgacaatcgcttcccggacgcggccgccatgggcgcggaactggcgcggatgaaggcgaagctggcgcccaacgtgggggatgcggatgtcgcgcgcctcatcgcggccgcgttcccccgcgagaagaaggcggaggagctcgtgctccgcgaactgctgcgggagccgcgttcccgcgcactcaccgagcccgcgttggccaccgtgctcgctccgcctaccgcgctcgcgttcgagcacgaaggcatcgacgcgcccgaggactacgtcccggccgagcgtggcgacgctgagacctcgaaggcaccgtcgtccgcccacccgcctgatgcgaatgtcccagccgcgccggatgcctccgtgcgaggcacgccagcgaaggccgcgcacgccgcggatgagcttgaagtcacggtgcgagggattcctggaagggcgccggaggtgcctcgtgctgtgaatgcacctcgcgtcaccgcgctgtacgggacggaggacgaggcgaccgtggtggagggcggggcctcgcgagcgcgccggggcctccccggcggcgaacgggcacacctcggtgtggaggaggaggccaccgtcgtccatccatcgcgaggcccggtcgcgagcgtgccactcgatgcggacgaggagaccacggtcgttcagcccgaacgtgcccggatggcggcggacgctggcgtggcgtcgaagtccgacgtgggctctggggccgcgaactccggagcgagcctgggcggagacgcggcggccacagaagccgtcgatgcggcgaagctgatggtcgcgctcgaacgggcggaggccagccgaagccagggcgcccgtgccacggcgtccgaggatgtcaccgtgacggaggtgaatcccgccagggcgctccagtccttgtcgccccaggccgcgcagttgcgccgagctacccgtgagacgcaggtgggcttcggcgtggacatctcccaagcggtggatgctgcggcggtggaggcccgtcgtctggagttggtgcgcgccatcacgggggatgaagcgctgcccgtgccagagcccgaggaggacttcggcacatggcttcgcggcggtcgtccctggctcgtcgcggggctctgcgcgggtgcgtgtgccctggggctcgcgctggcttggacgctggcctga

SEQ ID NO: 5416 - DNA, 267 bp, Myxococcus xanthus
atggaagtgaaggagccccggaaaccgggcggttcggacggcagcgagctgggggagacggcccggcagatgagggcggcgcaaccctacatcgcggcggtgtggaagctggtgggtggagcggtggtgggcgtgctgggcggctactggctggatgggtggttggggacgggcccctggttgctggtggtgctgagcctggtgggtatctgcgtgggcttctatgggttcctccatgagatggcccggctggggatgcggaagtga

SEQ ID NO: 5417 - DNA, 114 bp, Myxococcus xanthus
atggcggcggtgccgttcatcgccggcttcttcggcgtctacttcgcgctgcagtggattgaagtgagctacgtgatggccgcgtcgaaggaatcggcgggcggagacgagtga

SEQ ID NO: 5418 - DNA, 1341 bp, Myxococcus xanthus
atgcgcaccctcatccagacactggccgccgtcaccttgttgaccgcgccgttggcctccgcccagaccacgccggagtcggcaccggcccagttgtgcgaaaaccagctcgaccagaacaagcagcccgaattcagtgaagagaacctggagatcgagtcatcgaccgtcctcatcaccgaggaatcaccggcccggctccagctcaacacgaaccgcacggcactgaacgtcgagaacatctacttcccgttcgatcagaacgtcaccatcagctacgtgtacgaatcggcaggcgcctcgcatgcgctcggctacatgtacatggatgacctccgcgtcaggggctatgtcgacagcaacggcaacctcgtcgacagcaacaacaacggcatcttcgacctgcacgaggacctgttcaacctcgcgccccggagcggcgacaaggcccgcccctacattggcgagagtcggcgctgcacgcggaacttcgtctcggacggagagacgtacaaccagcccgaactggcgatgaactccgagtgccgcaacaccttcgacgagaaccaccgcgagatcgcggacgcccgcccgggttacaccttcgagtacaacatcacggacgtggtaggggctttcgccaacgaccgcgacaaccccggcggggccttttcagatagagggctctttccccatatccccaacctcctggagcctccttcggaccgcaatggaaacctgggcctggggcgaatggtcttcctgctcgccgacgatgacgacggccgctccacctacggaaacctgtcgccggtcccagacaccggcgactaccccgacggtatccctgactacgacgtctcccattacgacccgcgggggctaccacgcgccaacaacccggaccgaggaatctccccctacgaccggaccgtggacctggggatgatcgagggcgggaaggaagtcatcttcttcgtcgtcgtgttctattcaagccgcaatcacggccccaacgaaggctacgtctatccatgtgtgaagcaggacccggatggccgctgcgccctgcacctgcgcacgtccatcaacgtcttcttctccaaagcggcgtggaacatggaccagaaccccgagggcggcactatcgttgccgagcgcaacatcgggtgccaatacctggaaggctgcaaccgggacaatcccgccagcacgcctgaccaggcgtgccgggtccaaggcaccaacgaatatctctgtggctggctggacggacccatcgaggagcagaacaccacgctctatcgcctcgcgaacaaaagctctacggtcggctcgtga

SEQ ID NO: 5419 - DNA, 462 bp, Myxococcus xanthus
atgaaccgactcatcctgttgtccctcctgctcctgccgggactggccagcagcgccacggatgaaggcaagctcgccttcgagaaggcctgcgcccgctgtcacgtcgtcaccgcgcaaggacagaagaaaacaaaggccgcggccaaggccccgaactcccgcaggcgcgggccgagcgtcgacctgggccccgtggtcccgatgcgcacgcccgaccaactgcgcgcatggctggcaggccccaaccagatcaaacccaagacgggttgcgatacgcgcctgctacccgatggcgacagggagctgctcctcagctacctggcgctcagcctccaccccacacctcctacgcgcgaggagcagcttcgcctgcagctcaagcaggacctcgcagcgcgccaggcgcagaagcagcgccaggcggatgaaccgtcccgccgttcgcaggggaagaagtga

SEQ ID NO: 5420 - DNA, 660 bp, Myxococcus xanthus
atgggcgtcgtcacgatggtcaccctcgcggtgcttctcagctacggcgtggtgagccgcgaggcggaagtccagggtgatggccgccgctacaaggaggcctacttcgcggcggaggcgggactggccgaggggcgcgaggcgatgcgcatccggctgggcaatctgcagagctattcgtccgcgctcgcggcgatgccgcaagtcaacgaaccgggcctgccggcaggcggcgaccgtccctatctcgaggtccttcaagggccaggcggggtcggaggctggaactcgctggccatcgacgagtcggacttggcgcccacggagcgccagagcccctcgggcgatgcctacgccgccttcccgctccaaacgaacgtgcgctatcgcgtcttcgtccgggatgacgaggacgccaccacgtcaggtctcgacgatgacaatgggcaggtctggctcatcgccgtcggagaggtcgtgggccgcgatggaagccggcccacacgcgctgtcatccaggccctcatctccaacgagaacgcgccggccgtcaccagccctggcccgactcaggagggaggcggccccgcaggcaccttcgacggctccggcacggtgaccgacgtcggaaatgaagtggacatcacccccgccccttga

SEQ ID NO: 5421 - DNA, 759 bp, Myxococcus xanthus
atgggacagccgaaggcccaggtgacgatgcgcttccatggcgcgctgaatgacttcctgtctcccgcgcaccggcatcagacgttcagccacgcgctgagaggccgcccgtcggtgaaggacctcatcgagtccctgggtccgccccacccggaaatggacgtggtgcgcgtggatggcgaggccgtgggcttcacgcaccgggtgcagccgggcgcgtgcgtggaggtctaccccacgtccatggtcgaggagcccggcgtccgggtggggcctccgctccaggacacgccccgcttcgtgctcgacgtggggctgggacggctcgtgggcttcttgcggatgctcggcttcgacgccctgtggcgcaacgacttcgcggacgacacgctcgcgcggctctcacatgacgaggaccgcatcctcctctcgcgtgacatcggggtgctcaagcgcggcgaagtcctgcgtggctacttcccccgctcgacggacccggcggagcaactggttgaggtggtgcgccgctacgggctgacgtcccgcatgcatcccttctcgcgctgcgtcgcctgcaacgccgcgctgacctccgccgagccatccgaggtggccggccgcatccccgagcgcgtggcggaacggcactcgcgcttccaacagtgtccggactgccagcgcgtctactgggccggcacgcaccaccaacgaatgcaggccctggtggtccgactgcgcgagctcgaaggcgccccctag

SEQ ID NO: 5422 - DNA, 285 bp, Myxococcus xanthus
atggcccgcttcaagaacctgatgctcgaattcgggccgctggcgttggtggtgaactacgtcatcttcggcttggtagtcgtgggcttctacgccgccatcgagttcggcttccagcccagcagcaccggcgagaaggcgggcagttgggcggcggcctacgcggcgtcgcaggtggtgaagccgctgcgcctggccgcggtgttcgtgctcacgccgctcatcgcccggattcctcccgtggcgcgcttcattgagcggaacaagcacaagtggagcttctga

SEQ ID NO: 5423 - DNA, 807 bp, Myxococcus xanthus
agagccgtcatcacgggtgcaggcagcggcctgggccgcgcgctctgcgaggagctcgcacgcagacgggcccgcgtgctcgtcaccgacatcaacgccgcctccgccgaggagacagcgctgcgcgtcacccgcgcgggaggcgaagcgcacgtccatgtctgtgatgtcaccgagccggcccaggtcgaagccatggccgacgccgcggagcaggccctgggcggcgtggacctgctggtcaacaacgcgggcgtcgtcagcgcgggcccagtgggcgagctgtcactctccgaatggaagcgcgtgctggacatcaacctgtggggcgtcatccacggctgccatgtcttcgtcccccggatgcgcaggcaggggtccggccacatcctcaacatcgcctcggcggcgggactcgtgtacgtgcccgacctggcggcctacaacgtgtccaaggcgggcgtgatcgcgctctccgaaacactccacgccgaactgaaggccaccggcatcggcgtcaccgcggcgtgccccagcttgttgcgcacccgaatcgccagcacgggccactacaccaaggacacgcttcgaaccctcgccggcttgatgctggatgaagcccgcctgggcccggaggtcgtcgcgcgcaggctcctgaaggccgtggacgcgcgaagcctctacaccgtccccatggcggatgcgcgctggggctggcgcctgcgccgcatggcccccagcctcttcctccgcgccgtcgccgcgatgaacccctccgctcgcgcgtggcttctgcgacgacgctga

SEQ ID NO: 5424 - DNA, 943 bp, Myxococcus xanthus; identical to SEQ ID NO: 104
  unsure (1)..(943): unsure at all n locations

SEQ ID NO: 5425 - DNA, 915 bp, Myxococcus xanthus
atgcttcacctgaccccacggcgcaccctcgacctggaggcgcccgccgcgccaggacgtccgtctcacgtcaccgcctcgatcggactggtccgctcgggcgactggctctacaccgtcgcggatgagccgctgcacctggccgcgttccccctgtcgagggcaagtcccggtcatggcgtggtgctcttcgcgaaccaccagcccgaagcgcccgtctccctcaagtcgtcgcagcccgacctggaggtgccctgcctgctggcgccccagggcagctcgccccacggttcgctgctgatgctgccgtcgggcatctccgcgggcaggcagcgcggcgcgctggtcgccctgggcgcggacggcaccctggcgggagatgcccgggccgtggacgtcacggcgctgtacacccagatcagccgggagttcggaccgctccgcatcgccggggcggcgatgtcgggcggactgatgcggttgctccagcgcggcagcggcgagcccggcaccgacgccctcgtggacctggacgcggagcgggtactgcgcggactggaagccggcgcgctgggcccggacgtagtgcgcatgacgcgccgatgggagctgggacaggccggaggcatgcggctgtccttcacggcggcgtcgccgcttcctggcgggcggatggtcttcaccgcgaccgcggggagcaccggcccgacggcaaccgtgagcggctccgtcgtgggcgtgctggcgccggatggctcgccgcagttcctcgacgcgctggagggccacgtgacagtgacaggcgtggatgcccgggtggaacaggggcgcgtgcggctgctcctggcggccctctccgaagatggggcgggccccgcgaacctgctggaagcgacgctggacgtcccggcgtag

SEQ ID NO: 5426 - DNA, 1293 bp, Myxococcus xanthus
atggaggaactgcacgaggcgtggcccgtgctctccgtcgatgagcggctggagggcttccggttgcttcccgcttcggtggcggacgacttcttcctggcgttgtcggcgcgtgagcaggcggagctcatcctccaccttcagccggccgagcgacggacctgggtccggctgctgcccccggacgacctggccgacctggtacaggcggtggagcccgagcaggcggagtccatcctctcgcagctcgacgacgccagccgccgcgaagtcaacgtgctcctggcctacgcggaggacgacgccggcggtctgatgaatccgcgcttcgctcgcgtgcggccggacatgtccatcgacgaggccatcagctacctgcgcaagcaggcgcgggagcgggtggagaccgtctactacgcctatgtgctcgacgccgaacagcacctgctgggcgtgctgtccctgcgtcagctcttccagacggccagcgacaagcgcgtggcggacgtcatgcagcgcgacgtcatcaccgtgtcggaagacaccgaccaggaggccgtgagccggctgttcaccgagcacggcttcatggccctgccggtgctcgacgtccagcagcggatgaagggcatcgtcacggtggacgacatcgtcgacgtcgtccaggaagaggccaccgaggacatccagaaggccggcggtatggaggccctggaggcgccctatttcgagaccggcttcttcggcatgctgaagaagcgcatcggctggctgctggtgctcttcctagggcagatgctcaccgccaccgcgatgagcagcttcgaggacgaaatcgccaccgccgtggtgctgagcctcttcgtgccgctcatcatctcctcgggcggcaactccggcagtcaggcctccacgctcatcatccgctcgctcgcgctgggcgagatgcgactgagggactggtggcgcgtggctcgccgagagctgctctccggactggtgctgggcgtggtgctgggtgtggtgggtctggcgcgcatcctcatctggaactccatctccggcgtctacggggagcacgccttggtgctgggcatcaccgtcgccctgtccgtgctgggcgtggtgacgttcggcaccctggccggctccatgctgcccttggtgctgcgaaagttcggcttcgaccccgcgagcgcctccgctcccttcgtggccacactggtggacgttagcggcgtcctcatctacttcaccgtcgccagcctcctgctgcgcggtacgctgctctga

SEQ ID NO: 5427 - DNA, 546 bp, Myxococcus xanthus
atggtgctgggcctgctcgtgcgtctgggccccgacacggtcagcgtcatccaggtgacgcaggaacccgacagccgcgcgtgcacgttccggttgggcccgagcggggccttcgtcgcctcggaggcgccgtgtcagcgcctgccgggcgtgccagcgggcatcgaggctggcgcggtgtggacccgcgtggacaccctgctcccgccgcagccaggacagacgctgtaccggtgggccgcggtggatggcgcgctgaccgaacgaggcaccctggtcgtggacgcgccgctcgagttggtgagcgcgcccctccgccccggcttcgccatccccttcatccagtggcggcagtcacgcatcggctccgcagtgcccgtgccgcccgagtcacagggcccgctgggactggagctgctgccgggcaacgcggacctgtctcccggactgcgaaccctctctccgcgcttctactgggaggccggcggcgggcagggcctcggcggcacgcgggtgtacgaacggcgtgcgtcttcgttgaaataa

SEQ ID NO: 5428 - DNA, 390 bp, Myxococcus xanthus
atgaagctcggctacatcatcctctacgtaccggacgtgagcgccgccatcgtcttctacgagaaggccttcggactggcgcgccgcttcatccacgagagcggtggctacgcggagatggagacaggcaccaccgccctcgccttcgtcgaggaaggcgcggcgaaggagcatggcttcaccgtgcgccatctgcggccgaaggaagacgccgcggccatcgaactggcgctcgtcactcccgacgtggccaccgcgtacacacgcgccgtggaggcgggcgccgaggccacgcaacctcccaagcagaagccctggggacagacggtggcctacgtgagagacatcaacggcgtcctggtggagctctgctcgccgatggaggggtag

SEQ ID NO: 5429 - DNA, 795 bp, Myxococcus xanthus
atggcggaggacgcacagcagcagggctacacccagtgggcaccgcctatcgagatggcggatgcggtggacgcgttctggcagttctgggtgccccgaaagccccacgacgtccccctcccccggcagcaccgggtccttccggatggctgcaccgacctcatcttcggattccaacacgccccaggcccggtgtggctggccgcaccccggctggccgtcgtcggccccatgaagcgcttcatcctcgtcgacctcgagcccggcggggtgagcctgggcgtcaggctccgccctggctgggcgcaggccctgctgggtgtcagtccgcgtgaactctgcggactcaacgtctccgcccaggactgctcgcccgccctcatgcagtttcagcggcggatggaagactgcgcctcgcccgcccaggccatggccctgctccagcgcaccatcgcccgacgctgggcttcgttccggagcatggcgaagccgcgcgccgtccaggccctgggacacctccaagcctcgtcgggacaggtgcgcatggccgcgctcgctcgcgagctgggcgtgagtgagcgcaccctgcaccgggacatcctggacgaagccggcgtaccgccgaagctgctcgcgcgcgtgctgcgcctccagcgggcggtgtccctgctgcgctcccgtgagggcacggacctgtgtgacgtcgcgctcgaatgcggctacgcggaccaggcgcatttgtcacgagacgtgcgggaactggccggcgtgtcgcccaccgcactcgtgggttga

SEQ ID NO: 5430 - DNA, 498 bp, Myxococcus xanthus
atgagcacgttcaccgacttcaaaacggccgacctctgcgatgcccacgcgggcacgccgcggttccagattgccgagcccgggttccaggactacggcggcgtccggaccttcgcgggtcccatcagcacggtgcgggcacccgaggacaactccctcgtgcgcaaggccttggaggagcccggccagggccgggtgctggtagtggacggaggaggcagccgccgctgcgcgctcgtgggagaccagctcgcgttgctcgcccagcagaatggctgggcgggcgtggtggtgaatggctgcatccgagacgccgaggacgtgggccgcatgcgcatcggcgtcaaggcgctgggcacccacccgctcaagagcctcaaacgcaacgagggacaacgtgacgtggaggtccgcttcgccggagtcaccttccgccccggccactacgtctacgcggatctggacggcatcgtcacctccgagtcgcccctgggctga

SEQ ID NO: 5431 - DNA, 978 bp, Myxococcus xanthus
atgccccagacgaagctcgaagcacgcaaggcactcggaaccacgggccttcaggtatcccccctgtgcctgggagggaacgtcttcggttggacagccgacgaggcgacctcgttcgcggtgctcgatgccttcgtcgacaacggcggcaacttcatcgacacagctgacgtctattcgagctgggtccccggcaaccgcggcggcgagtcggagacgctcatcggcaagtggctgaagtcgcgcggcgctcgggagcgcgtcgtcatcgccaccaaggtgggctcgcaaacagagctggggaagggcctgggccgcgagcacatccagcgcagcgtggaggcctcgctgcgccggttgcaggtggacgtcatcgacctctactacgcgcactacgaggacctggacacgccagtggaggagacgatggcggccttcgacgcgctggtgcgcgccggcaaggtccgcgcactgggcaccagcaaccactccccgcagcggctcaccgagtcgctggaggtgtcccgccgcaacaacctcgcccggtacgcggtgctgcaaccgcactacaacctcgtcgagcgcaaggacttcgagtcatcgctccggggcatctgcgaacgggaagggctcgtggtggcgccctacttcgcgttggcctcgggcttcctgacgggcaagtaccgcaaggaccagccacctccgaagtcggcccgcgccgaaggcgtgctgaagcagtatggaaacgcgcgaggctgggcggtgattgatgccctggaggccgtaacgcgccggcatccgggagcgaacttcgcccaggtcgcgctcgcgtggctcgcggctcagcccaccatcgtggcgcccatcgcgagcgcgacgtccgccagccagacacaggaactgctgggtgcgttcacgttgcaactgacggaggaggacctccgcgccctggacgttgcgtcgtcccgcgaggcctga

SEQ ID NO: 5432 - DNA, 1086 bp, Myxococcus xanthus
atgaggaatccgcgtggaaggttcggctgggtcctcctcgccggggcgttgggcgcagccgtggtgggcacacgcctcgggcgtgctccagaaaggaacaccgcccctgtcctcgatgcctcgacgccgcaggccgctgacgccggaccttcgacgcgcccgcccctgcccgcccatgcgcagccgctgaaggaagtgccgtgtgagttcaccgcgctcctcgcggaatatcgccagggccacgcctcaccagcgtatcggcgttacgtgcgagaacagctccgcggactcgtggagtccctgtccgaggacgtgcattggcagcacctcagcgacgagcaggacgctgacgtgctggccttgctctccgacacctgggtgctgcgctacgccctggagggacaggcccgcatcctggagcggctggtggaccgcgtaagtgagacacccgacgcgcgcctgcgtgccgtgttgattcgttcactgcaacagacgggggagccctccacccaactgttgggcatccaggtcctccagggccgagacgtctaccgcgactgggtgacggacgcagcgcccgaagtccgcgcggccgcggtggagaacttccgggaggaagctgctcgcaacgccggccgctaccgcgtggtggcggagcgagcggtgtcgctggccaccgtcgcggaagacccggccacggcagcaggactcctgggcgcgtcttccatcgaagcggtgagagggccgtccgtggcgcaggtccgtacattgctccagtcaccgaagtcccccgtcgtgcgtgccgcggctgcacgggccctggcgacctcgcccgtgacagagctctccgcgagcctcgatgcactcgccgcccgctacagcgctgagcctgaggcgagcgtgcgcgcagcgctgctggaatccatctcccggctgggcctgagccgcgccgtgcccgtcctcgagcggctccgtgacacgaacgccgcggctcgagacgaagtgaatccctggattgcactgctcgcggagcatccccagcggtgggaaatgctcgataccgcacggagacactctcaccgatga

SEQ ID NO: 5433 - DNA, 507 bp, Myxococcus xanthus
atgaagaatgacttccaggcagggggctcggaggagccctacctcacgcggctcctgacactggcgcgggagtccgaggaccgtcacatccgcgccctggcggtggagctggctgcatccttgtccgtgcgactggatgcgcgggccgtggagcaattggcctgggtgctcgagaatgacgcagacgccaacgtccgggagctggcggccctggcgctgtccgatggccgcgacacgcgcgcggtgctgaatcacttcagtgccgcgtttcctggagagcagcgcctgtgcgtgcgctgggcgctcctgcgctacacgctccgggccggtggcgccgaggcccttccccaagtgcgggactactcgaagcaggaccgccgattcgctcgagacgtcgccgacttccaggcgctctacgacgcggggcacgtggacttcgaccggctgtggctgaacaagcgcgtgtatcaccgctgccctgaggacgtggaggcccgaacgccatga

SEQ ID NO: 5434 - DNA, 2379 bp, Myxococcus xanthus
atgctgcgcaccaccgaaggggagcggcgggtggagctgaccgtcatccccagcggcacggagtgggtggtgctggtgcgcgacgtgtcggcgagggcccggcgccgcagcgtgctccagcggttggccgagctgggcgcgaacctgccctccctgcgcaccgagggcgaggtgctgcgcaggatgttctccagcgtggaggagctgggacttggctgcgcgtggctttcgccagaccggctgggcgtccggctgggacagacgttcgtgccgcccggcatggtgcccacggaagccgcggcactgagtggccgctgggtacgggatgtggtgggccagtggcctcccctgctgaagcgcgcctggcgcgacggcgcggcctatacagacgagttgccccaggaggccgagcgcttcctccgaggcgcccggggcgtgctggttcgccagggcatccagcgcgccggacagacgcgtgccatcgcggtgcgcatcgacgtggaggcacagccccgggccatgctcgcgctggtggcggactggctgcgcgaggaggagcttccacccgtgcggctcttcggcgcgcaggtgtccgcggcgctggacgcggcgctcaccatctcccgcctgtccgcgcaaaacacggcgctggcggcgctcaaccgcctggcctcggtgacagcctccgcgccgcacccacaggcgctgttcgctccggggaccgacgaaatcgccgggctcctgggttgcgacgcggtggcggtgctcctgccagcggacgacggcgaagtggagctcgcgtactcgagcggcctggacaccgaaggctcggaggacttcacgcggcgctggcgagccggaaacctgtgcctccaggcgcaacgagaaggcatcccgctggagcgcgaggtggagtcctgtccggacgaactaagcgaggaactgcgccggcagggcttccgcaccgtggtggtcgtccccctgcgggtgcgctcgcggggcgtgggcaccctgtccgccctcttccgggaacggaggcccctgacgccgctcgaacgggagacgttgcaggccatgggcagccacttcgcggcggccatcgaatcccaccggctgctgcatgagcttcgtggccgcgccgaggacctggcgttgctgcacgaggtggccaaggcgctggcggccaccctggaactggacaagctcctgcacattggcgccaccagcctggcgcgcatcgtggacacgtcggatgcatacgtgttcctgccggatgtctcgggggaacggctccagcttcgcgcgatgacgggaggctcaccggagcttcaagggcccgccctgccactcctcccggccgatgcgtcactcgcgtcggtggcgttccacacgcgcgaggtggtgatggtagaggacgcccgctccgacctgcgcgtcaacgaggaggtgcggcgcctgcccggtgctcgagcattcctggtgctccccctggtggtccacgagcgccccatgggcgtgatgatggcggtggagacgcggcggccacggcgcttcacggtcgcggaggtggagcgagccagtgccatcgccaaccaactggcgctggcccgcgagggcgcgcggctggtggaggaccttcaagccagctacgtggagctggcccggacccaggcccagttggtgcgccgcgaacggctggccgcgctgggcgagctgtccgccgtggtcgcccatgaagtgcgcaatccactgggtgccatcttcaactcagtcgcgtccatccgccgcatcgtcgggccggacagcgcggcggtgccgctgctggacatcgtcggggaggagtcggaccggctcaaccgcatcgtcgcggacctgctcaccttcgcgcggccgcccgcgccgcatccctatgccgtgccgctgtcgcccctggtggaggacgcggtgcgaggcgcgctggcggaggccccgggccaggtgcgcgtggaactggacctggcggacgatgtcccctcggtgaccgtggacgagcggatgatgcgccaggccttcctcaacctcgccatcaacgccgtgcaggccatgcctcagggcggcatgctgcgcgcgagtgtccggcgcgcgacggggactcccgaggtcgaagtgcagttcgtggacagcgggccgggcatctcccctgacgtacgggcgcgcatcttcgagcccttcttcaccaccaaggccaagggcaccggactggggctggcggtggtgaagcgcatcatcgagtcgcaccagggccgggtcgcgctggaatcccagccgggccagggcaccaccttccggctctatctcccgctggacacctccgccgcggcggtaagcgaaggctggtaa

SEQ ID NO: 5435 - DNA, 519 bp, Myxococcus xanthus
atgccgaagccgctcgtgctcacgtccccccgcttcaaggacggcgacctcattcccattgcctacaccggcgagggcgaggacatctcaccgccgcttcaatggacggacatgcctgccgggacgaagagcctggccctcatcgtggaggatccggacgcgccagacccgcgcaatccccagatgaccttctcccactgggttgtctacaacatcccaccttcggcgcagggcctaccggaaggcgccacgccggacgtcctcccggagggcgcccgccaaggccagaacgacttccaccgccagaactacgggggccccatgccgcccgtgggcatgcaccggtactacttccgcctgttcgccctggacacggtgctgccggacctgggccgcgtctcgcgcacacagctccggaaggccatggaaggccacatcgtgggacaggcggagctcatcggcctgtacaccaaggtccaccaccgcggcgcggagtcccccggggccactcccgcctga

SEQ ID NO: 5436 - DNA, 678 bp, Myxococcus xanthus
cacaccacgaccgcgggcacgacgcgcgaccacgagttgaaggtgtggtccgacgcttcgggtgcgagctacagcttcgtcttcaaccacgcgggcaaggtgcagtgcgccaccccgggcttccgggcggagtcgcgcctgcgggtccgcgccaccggctttgccgcccacaagagctgccgcttctgcgacccgctggcggccgagctggtggactccgacggccacgtcctctacccattcgccacgcagctcgatgacctcgtgctggtgcgcgagtgcattcagaccgacatcgtgctggagctggcgccgtgcgccttcgccgagtcgctgcaggcctggccggacaaggcggcctacgaggcctcgcgcaagccggggaaggcgctgctgggctcgcagttcttcatccccaaccctgcctcgctcatgtcgaagggcagccctcctcggcccgtcgagccccgagcccacttcaccgggcacgtcgaggccgcggacgtgcgcaccaacggcgtcaccggccacccgttccagcacgccctcgtgcggacctatggaggcacttatgacgtcctcgcggcggccgacgaggcgacgccccggctgcggcccggcaacatcgtgagggggaccttctggctggtggcgcgcgtgacggcggggctgggctga

SEQ ID NO: 5437 - DNA, 180 bp, Myxococcus xanthus
atgttggcggcgctcgacaggctcgagagccaccctcgcttctaccggcgcacgcccattaccctcgacgacgtcggccgcgtcgaggcatacctgtttcccaaggagcggttggctggccgccccatcatcgagtccggttgctggcgtcgatacctgaaggagaggaagcaatcgtaa

SEQ ID NO: 5438 - DNA, 180 bp, Myxococcus xanthus
atgcaggatatcgccttccgcgtggagcgcctctcgctgcccgagtacatcgactgggtggtgggcaacgcgcgcaggttcgacggagtggagctccaggcgcagggcaacatcggggaggagaaggcggcctcgctggtggacgaaatgctgcgtaccgggttggcgtcgaaggggtga

SEQ ID NO: 5439 - DNA, 204 bp, Myxococcus xanthus
atggagcttccgctggggtggtgggcggagcaacacggcaacgacaacctcgtgtacgcactcatcgaccacgtggaagaggccctggaactgattggtgccagcctgttcctcgcggcgctggcagaggaactgggcgagcgggtggtgctcacggtacgaaaggaggagccccatgggcctggcccagccgctccccgctga

SEQ ID NO: 5440 - DNA, 1083 bp, Myxococcus xanthus
atgggcctggcccagccgctccccgctgagacacagcgcccggcggagtcggtgcgtgtgtcgcccccctcttcctcgcgcgcgccctacatcgccgggcccctcttcgactgggccttcttcctgcttcctccactactggcgctcgggctgggcatcgtcatctcgggcacgcccttcagtgacacccccgtccagcgcctcggtcaggagaagacgtgggccgggttgatggtgggcagcctcatccatgcccacctggtggcggtgttcttccgtagccacggcaaccccgccatcttccggctctacccgcttcgcttcatcctggtgcccgtgctcgcgtgggccgctattcgtggctcggcagtggtggccgccggcgccacggtgctcgcgacgttctgggacgtgtggcactcgggactgcagacgttcggcctggcccgcatctacgaccgcaaccaaggcaacccacccgaggtggggcgccaactcgacttctggctgaaccacctgctgtacgcgggccccatcctcgcgggcgccaccatgctggaccacttcaacagtttcgagtccttcgacggggtgggaatgccgtggctcgcctccgtgcccgcgcgcatgacggccacccaccgcgcctggacacttggcgtcgtggcggtgggcggcatgttcctcctcttctacataggggccacggtgcgcctgttgcgccaaggccaccgcccctccttccacaaggcgttcctgctggtcaccacgggggcctgctccatctacacctggggcttcaactcgtggggtgaagccttcttcatcatgaacctgctccatgccatccagtacctggcactggtatgggccatggagggcgagcgcctccgtgagcggctgcggctgaagtggcgctggctcgcgctcgcgctgttcctcggcaccgtgctcacctatggcgtgtgggccgaacttctcgacgccagcgcggagagtctctgggctctcaccctcgtcgtctccctgatgcacttctggtacgacggcttcatctggtccgtggcgcgcaggcaggtgtga

SEQ ID NO: 5441 - DNA, 891 bp, Myxococcus xanthus
atgccgcccgacaaggcggagggctccggcaaggcggtgctcatcgtggagcgacagggcggggggacctcctcgcgggtgaagcttcgcttcgaccggaagggccccctcctcgtgggcagcgtggtgaatacccggttcagctcgaacagcatggacctgttgacccagcgtacccattcgtccaactacacagcgccgatgtcggacgacgagaatgatgagggagatgagtccgagtcggacggcatggcgcatggcgtctctgatttagaagccacggttcttccttctcctggacaggtctcctggggccagaagcactggaaggggcccgaggacgcggacctgaaagtgagcctgcgccgacgcggtgacctgctggtggtgagcgtccggttgcgagatgacaagatggtgaccgcgacggatggcagccccaaggccattctcgccgcggaccacctcgagctgtcgtggacggagtgggccgccaccaagtccgggacgaaccagtatgtgcagctgggggtcgcgcgcaatgcgcgagggactcccgtggccacctggttccgtcctccgtggaagaaggacacgccgctgcccaccatccggtggacctcccccgatgccgtggaggtggaccttcgcctgcgctggctcatgccgacgcccgcgaagctcggctactacgacccgacaagcgtcactccccagctcaaggtttccttctccgatggagacgggaaggggcaggagacactggtggacgtcaacgcgggcatgctcttcttcgccgagccggggcggccgtttcccaccgtggagcaatacgttcagccgtggatgcgcgtggcggacgacgccaccctgcgcagcctcacgctctaa

SEQ ID NO: 5442 - DNA, 1281 bp, Myxococcus xanthus
atgctgtcgcccgagttctggattcgccgcgcgccgtctcccgacgaggtgctgctcgatgccgaccaggtggcggcgaagcgcatgcgcgccttcggtccggatggcggcctggtcgacttgaagcgcatcccagccacgctgacgcgggcggaagtcgccagctgggtcaaggatgcgcagcagacgcccatccaggcagccatcgacgaacagggccggctggtgacggaggcgatgctcgaagagctgcgccagaacaccgcggccgagcacatccccgaagcatccaccgcgcgctacggcctcagcgtgcggcgcacgcccctgcggtccctcccgtccgagcggcgattcttcgcggcggagaacctgcgcgactacgagagccttcaggccggcatcctgttcccgggcgagccggtcgtcatcgcgcaccacagcgcggaccagcaatggctgttcgtcctgacgacccaggggcccgcatgggtccggcgcggagatgtcgcggaaggcacggcggacacggtgttctcctacgtggcgaaggcgcccgggcgtgtcgtcacgggcgaccaggtgcgcacggtcttcacgccggaagcacccggggtgtccgagctcgagctcgacatgggggtcgcgctgccgcgggccgacgtggcgcccggcgagcccgtcaatggcgccagcagctatgcgtcgtggccggtgctgctgccggtgcgtgagcaggacggcacgctggccttccagagcgcgctgctgcgccgtaccgccgacaccgcgccgggctatctgccgctgacacgtgccaacatcctccgccaggcgttcaagttcctcggcgagcgctacggctgggggcaccagttcaatgcgcgcgactgcagcggcctgaccagcgaggtgtaccgcagcctggggctgttcctgccgcccaactccgggatgcaagggaagagcgcggcgctgaaccaccgcctcttcacggcccaggactcacacaccgagcggctgcgcgcgctggcccgggcgcaggtgggcgacctcatcgtcgttcccggtcatgtgttgatgctcattggccacgtgaatggcgagccctacgtcatccaggatgtgccgtatgccgtattcaaggatccggccacgcagcagctccggaagacgaagctgaaccaggtgtcggtcaccccgctgctgccgctgtacgccgacgacacgaccctatacgtggacgcgatgacgagcctcgtgcacgtcacgcagccatag

SEQ ID NO: 5443 - DNA, 306 bp, Myxococcus xanthus
atgcgaagccggctcttcgtcgccaaagccgagcggctcgatacgacccagctcggcctcgagtttgcctacaagctcgcggcactcgacgcgctcaaccaccagctcggacagcccgctgcgtccgcgccggcggatccaaccgagacgggcggggcgcgcccgcctggcggcaagcgcaagccgactgggcgtcgcgacctacgcgaggccgacctcccggaggaacgcatcgaactgaacgccccgctgctcgagggctccgccccgaggagcggctgggaggagagctgtcagctcgcctga

SEQ ID NO: 5444 - DNA, 189 bp, Myxococcus xanthus
atggtcatcgcccgcgccaagtaccgcgacgccgacgcggcggacactgccgagccgacgagcgtgaccgcaccgctgccgccgcagctcctgccgcgcgcgctcgcgacaccttcgctcctggcgcacatcctcagcgacaagttctgcgacggcctgccgttccatcgccaggagtgtatggcttag

SEQ ID NO: 5445 - DNA, 792 bp, Myxococcus xanthus
atgctcatcctcatcctggccaccttcggatcgctctacctcgtgttgtgtgtggtggtgttcgcgctgcaacgctccttgctctacccggctcccaagggcacgccgccgctggcggaaagtgacggcttcagccgcctcccgttggagggcggcctgtacgtggatctgttccacctgccggcgcctccgggcgcgcccacggtggtgcacttccacggcaacggggaggaggtgctgacgcagatgggcctgggcagcttgatgcaagcgcgggggttgggcttcctcaccgtcgagtacccgggctatggcgcgtcaccggggcatcccacggaggaaggcatctacgccgcggcggaagcggcgctcgcctggctgcgcgcgaagggtgtgagcgccgagcagacggtgctcagtggccgcagcctggggacgggcgtcgcggtggagatggcgcggcgcgggcacggttcgcgggtcatgctcgtgagtccgtacacgtccatcccggacatcggggccacggcctttccctttctgcccgtccgcctgttggcccgggaccggtatgacaccgcgtccaaggccgccgccgtgaagctgcccgtgctcatcatccacagcgaggaggacacgctcatccccgtggacatggggcgccggctggacacgctcttcccccaggccgtcgtggagacagtggctgtagcggggcacaacgatgtcctcgaagaccccggaaaggtctacagacatcggatggcgtcattcgcactgggagaaccctga

SEQ ID NO: 5446 - DNA, 504 bp, Myxococcus xanthus
caggagggaatcgccgacaacgagacacacgccttcttcacccgcctcatggacgagggcggggcgatgctgtggggccgcgtcacctacgagatgatggagagctactggccagcggtcgcccgcggcgacgaggaggcgccgccggcgatgcgcgagtgggcggtcaatctggaggccaagccgaagtacgtggtgtcgtcgacgcgaaaggacttcccgtggaccaatagccaccacatcgccggcgacctgcgcacgggcgtgcagaagctcaaggacgcgaccccggccggcgtgctcctcggtagcggcaagctcgcgaccgagctggaccggctggatctgatcgacgagtacaagttcctcgtccaccccaggatcgccggccacggcccgaccctgtaccagagcgggctgcccagcacgcgacggctcgagctgctctcggcgaagccgctccgcagcggcgcggtcgccatgcactaccggcgcgcgcgctga

SEQ ID NO: 5447 - DNA, 321 bp, Myxococcus xanthus
atggaagggtgttcgatgtcggagcgcgagaaaaagaggcggcaacgacgtagcttcctccctgagttcaagtccggggcggtgaagttggtgctggaggagggcaagtccatcgcggaggtggcgagggacttggacctgacggagacggccttccgccggtgggtggagcaggcccggacggaccgggggcaaggcaagccgggcgccctcaccagcgaggagcgggcggaactctcccagttgcgcaaacgcctgcggcagctggaaatggagaaagagctactaaaaacgcggcggccttcttcgcgaaggagatga

SEQ ID NO: 5448 - DNA, 501 bp, Myxococcus xanthus
atgaacctcgagcagaaatacgaagccctcctacacgaagcgaagcggcggcagctcccagacgtggccggcatccggctggtcttccagacgctctcgctagcctcggcgatcgaccgggattgcgcggcgttgctcgcgccccacggcctctcggagggccgcttcgtgctgctgttcctgctcgacgccgcccacgatgccctcgcacccaataagctcgccgagcgggcgggcgtgacccgcgccaccgtcacggggctgctcgatgggctggagcgagaagcactgatcgagcggcattacgacgcccaggatcgccgcgcgctgcgcattcgtctgacccgcaagggcaagcagacggcgaagcaagtcttcgaccagcacagccgttggatcgcgagcctgtacggcaacctgtcggcggcagaacgcgggcagctcacggccctgctcgacaagctcgctggcaacttgaccgcgaggaaggccgagccatga

SEQ ID NO: 5449 - DNA, 777 bp, Myxococcus xanthus
atgagtccgtcccttccccgcaagggcgcgacccgcgccaccgacattccgcctgacgtgctggacgccttgtcgcacggcgagatgcagaccgccacgctcgccgagtgcatggcgctcgaccaggcccgtctgctgcgggcggtctttcccgagctctcccccgatgcattggcggccgccgatgcagcctgcaagctcggcatcctcaagcgcatgagcgcgatcggtgcgctgctgctggaggagctcggcaccgccggcatcgagcgctctcggacgcacgccgcggacatggtgcgcggctgggcctgcttcatggtcggcgcgcggcccgagctggatctgcaggcccgactggccaccatccgcccgctcgccgatgactcgcatttcggtgtgcgtgaatgggcatggatgtcggtgcggcgccatctggcgcgagagctggacatcgccatcgccgagctctcggcctggacgtcttcgcgctccgaatacgtgcgccgcttcgcaaccgaggccctgcgcccgcgcggcgtttggtccgctcacatcgcagaacttcagcgagaaccagggcgggcgctcccgatcctctcgccgctgcgtgccgatccgtccgtctacgtgcaggactcggtagccaattggctgaatgacgccgccaagacccagcccggctgggtgcgcgatctctgcgaccaatggctgcgcggcgaccccgccgacgctacccgccgtatctgcaaacgcgcttcacgcaacttgaaatga

SEQ ID NO: 5450 - DNA, 984 bp, Myxococcus xanthus
cgcaagctgggccacctggtggtgtcggagcttggcttcggatgcatgagcaacagccctggccactacggtccgggcgtggaccgtccccagagcatccgtgtgattcgcgacgcctatgaccgcggcattcgcttcttcgataccgccgaggtttacggcccctacgtgaacgaggaactcgtcgccgaagcactggggccagtgcgcaaccacgtggtcatcgccaccaagttcggcttcaaaatcgacggcacgaacgggttggacagccgccccgaacgcatccgccgcgtggtcgaggaatcgctcaagcgcctgaagacggaccgcatcgacctctactaccagcaccgcgtcgatctgaccgtccccatcgaggatgtggctggcaccgtcaaggacctgatccagcagggcaaggtgctgcacttcggcctgtccgagccgagcgcacgcaccatccgccgtgctcacgccgtgcagcccttggctgcgatccagaccgagtactcgctcatggaacgcagcgtggaggacaacggcgttctgcaagcgtgcgaggagctgggcatcggcttcgtgccgtggggaccgctcggtcaaggcttccttcccggcaagctgcccctggatgcacaggccaggttcgatgcgaagacggacctgcgcaagaccttcccccgcttcagtcgggaggtcatgcaggccaaccagtccatcctcgacttcctgaaggccttcggcgagaagaagggcgccacgcgcgcgcagattgccctggcctggctggcagcacagaagccttggatcgtccccatccccgggacaacaaatctcgatcactcgcgcgagaacctgagctcgctcaacgtcaacctcacgccggaagacctgcgagaaatcgaagcggccttcgccaatatcaccgtgcatggcggccgtatggacgcgaagcagatggaccagatcggcaaggactga

SEQ ID NO: 5451 - DNA, 147 bp, Myxococcus xanthus
atgttgtacgggtccaacaccttggtgctcttctacaagacgttctccacgtcctacacctacacgcgaatcggcaaggtggagaacgcctcagaactggccgcgacactgggctcgggcaacgtaacggtcatgttcgaattatga

SEQ ID NO: 5452 - DNA, 2067 bp, Myxococcus xanthus
atgattgccgcccggctggggcccgacgtgcccgaggccgaggcggcggagcgcccggaaggagcgacaacggcgatgagcctctatctcgccgtccagaccgatgggcgcgtcgtcaccaccctgcctcgcacggagatgggccagggcatcaccacggccgtggccatgctcgtcgccgaggaactcgacatggcgctcgaccaggtcgacgtgcgcagcgccgacgcggacccccgctgggccatccagctcaccggcctgtcgtcgacgatgcgcttcctcacgggccccctgcgcgccgcagcggcggaggcccgggcacggctggtcactgccgcggcgctgcgctggcgcgtcctggcccacaccctcgccacctcgcacggcgtggtgagcgcccccgacgggcggcgggccggctatggtgagctggcggaggacgccgctcgcgtgctgctccccgcggtctccagccagcccaggcccgtgagccggttcaagctggtgggccagcccaccggacgcatcgacgcgagggacatcgtcacgggcgccacgcgctatgccctggacctggacatccccgaggcgctaccgacggtggtggcccggcccccaacgctgcgcggcaccgtccagtcggtcgacgatgcctcggcgcgggcgatgcccggcgtggtggcggtggtgcccctgggcaccggcgtggcggtggtggcccgtaccttcggacaggcgcttgcggcgcgcgcggcgctgcgcatcacctggacgcccggacccgccagcgcactgtcggacgcggacatccggacccgcctgcgcgacggcatcggcccaaggcccctgccgccgctgttcaccacacggacgcttgagggacgcttcgacttcccctacctggcgcacgcgaccatggagacgcagagctgcctggcccgcgtgcaaggtggacaggcggaggtctggctgggggcgcaggaccccaaatacgcgcagcgcgaggtggcccgggcgctcggctgggagctcacgccgtggcgagtgacggtgcacatcgcccgggccggtggcggcttcggccgcaggttcttcaccgaggccgcggtggaggccgcgctcgtctcacgggccatcggcagaccggtgaagttgatgtggagccgcgacgatgacatgcgccacggccactttcgccccgccagccaccaccgcatcctcgcctacctgggcccgggcgggcgtgtcctgggctggcatcaccgcgccgccattcccaccgtggagttcccccacggcttcggtgacgccctcaccgcgctggccggcgaggtcctgcccgaggtgaccagtgcggtcttcttcgcgctctcccagaagctcccatacggattcggatgggtgagccaggagctgcgcgacgtggcgattccgattcccaccgcgtcgttccgctcggtgttcaccagccaggtgggcgtgtccaacgaggtcttcgtcgacgaactggcccgcgagctccaggtggaccccgtcgcgctgcgacgcgagcggctcacttcgaatcgcctcaaggcggtgctggacaaggtcgccacggagggacagtggggcagaagcctgccacccggtgtcgcccagggtgtcgccgtcctcgaggaatgggacagcgccatcgcccacctcatcgaagtggacgtcaccggagggacgcctcgggtactgcgcatcgtcatcgccgcggatgtcggcctgcccatcaaccccaagggcatcgaggcccaactccagggcgcggcggtggacgcgatgtccaccacgctgagcgcgggaatccacatcgacgcgggcaccgtgcgcgagggcagcttcgcggactatcgctggatgcgcatgaagcacgtcccgtccgacatccaggtgcacctggtccgctcggatgaccgggtggtcggcgtgggcgagctcggctatcccagcgcagcggcggccctgaccaacgccatcgcccgggcgcgaggctcgatgcccacccgttttcccatcctcgacgagggagtctga

SEQ ID NO: 5453 - DNA, 480 bp, Myxococcus xanthus
atggcggcacatcagttcatcctcaatggccagacggtgttggtggaggcgcccgaggacctgtcgctgctgtgggtgatgctccacgtgctgggcgtgacgggcccgaagtacggctgcggcgtgggcgtgtgcggcgcgtgcaccagccacctggacggcgaggccttccgcccctgcatccacccggtgggtgggctgtctggccgcgaggtggtcaccatcgaggggctgggcgcccagggactgcatcccgtgcaacaggcgtggatggaggaagatgtggcccagtgcggcttctgccagccggggcagatcatggccgccgtggcgctgctcaagaagaacgcccagccctctgacgcggacatcgacgcggcgatgagcgacaacgtctgccgctgtggaacctatgtccgcatccgcgccgccatcaagcgcgccgccctgctgctgcgaagcggcgcgggcggcgggtga

SEQ ID NO: 5454 - DNA, 1256 bp, Myxococcus xanthus
caggggtggcttgagacgcgccccgcctctggaacgcgcgtggcggcctccctaccgcgctcggcgttcgctgacgtcgaattgcccacgcagcgcaagtcggccttgctccgtcgggatacctccctcgtgtcgatcaccgatgggttgccggaccctcggctcgcgccgcaggcggagttggcgcgcgcatacgcgcgggcgcttcgctctctcagccgaacagcgggggctacggcgacgcagcaggagctccgagcctccgcgaagtgatttcgagcttcgtcaatcaggctcgcgggctctccacaaccatcgatgagatcttcctcgcacgtggatcgcagggcgcgctcagcctctacgcactggcgatgctcgaacgtggcgacgtggtcgctgtggaggtgccaggttacgcacctgcgtggcgcgcgttcgagttcgcgggggccaagatctcgcacatccccatcgatggcgagggattgaggaccgacgtcctcgagaagacggcgcggaggttgtcgggcaagctgaaggccgtctacgtgacgccgcatcatcagtacccgacgtcggtctccatgacgccggaacgacggataaagctgctacagctcgccgagcacttcgacttcaccatcgtcgaggacgactacgactacgagtaccacttcgaaggtgagccgctgctaccgctccacgcgaccggaggatcgcggcgcgtcgtctacatcgcgtcgctgtccaagctgctcgcgccgaccgtgcggctcggctacctcgtcgcgtcggaggggtgcattcgcaagctgaaggaaacgcgtgagctgctcgaacgacaaggtgacgtcgtcctagagcacgccatcgcggagctcttcgaagacgggacgctccagcgtcacgcgaggcgagcccgtcgagaatacaaagcacgccgagatcacctcctctcgcggctccgcgcgacgcctgcgctcgacgagtgcttcgactactccgtgccggcgggtgggttggcgctgtggctgaccctgcgcaagggaagcatcgactcgttggtggcaagggcgcgtgaggagcacctgctgatggctccaggctccacctatcttcccaaggggcgcttggacgccgttcggctcgggttcgccgcgcacacgccggacgagctttcgcgaatctgcgacacgctcgcccgttgcattccaagccgacctggtctgcgccccaatcttcggaccagttga

SEQ ID NO: 5455 - DNA, 2028 bp, Myxococcus xanthus
atgactgtcgagtacaaactcacgattcggacgggcacgaagctcggcgcggggacggatgccgacatttccatcgtcctcgtgggcacgcgaggagagagcgccccccgcgtgctggacaagcacttccacaacgacttcgaggcgggcgcggaggacgtctacgccctctcctccgaggacctcggtgacctggtcctgttgcgcttcagcaacgcgggcggcgtggcggccgactggctgctcgactgggcaatcgtcacggccggagagaagcagtggcacttccctttctaccggtgggtgctgagtggcgccacggtcgacgtgctcgaggggaccgcgaagctcgctcgccaggcaagcagcgagcgcgagtccacggcgcggcgcgagctgctcgaggcccgccagcggatgtacccgtggcgcgcgcctgagatgaccgaggggcttcccggcgcgctcgacctccgtgaggggaggccgctgccgaaggacgagctctaccggggcctgacggagggcagctacgaagtggtcatcgcgaagacgctggcggccatcaagctgaacctgcccatgctgacccgcgcctggaacgggctggtggacatcttcgacttcttcaaacacctggaggtgccccagctcgcccagcgctggaaggacgacctcgagttcgcgcggcaggccgtccagggcatcgcccccctccacatcacgctcgtccccagtctgccgcagggcatgccgctcaccgacgacgacgtccggggcctcttgtcgcccggcaccacgctggccagggcgctcgacgccaagcgcatcttcctgatcgacttcgaaatcctcgacgacatcaggatgtaccggaaggtcggcgaggacggagtcgaggagcggcgctgggctcccgcggcgcgctgcctgctgtacctggatgaccagcgtcaactgcgacccctggccatccagctcgggcgggacgcccagaaggaccctgtcttcacgccgaacgacgacgcgtacgactggctcgccgcgaaaatctacctccggtgcagcgagggcaactcgcaccagatggtgtcgcacgcgctgcgcacacacttcgtggcggagccgttcgtcatggcgacgatgcgcaacctgccggacccgcaccccgtctacaaactgctgcggcggcacttccgctacacgctcgccatcaacgagggcgcacgcaagggcctgctcgacgcaggcggggtgttcgacgacttcatcgcgacaggcggccccgacaagggccacctccagttgggcaagaagggcttccagcgctggacgctggcggacaacaagccccgtgctgacctggagcggcggggcgtgctggaccctgccgtgctccccaactacccgtaccgggacgacgccctgcccttgtgggacgcgttcgaggagtacgtcggcggcgtcctcaggcacttctaccggaccgatgccgacctcgaggccgacaccgagatgcagcaatggtggaaggacctcaccgagcacgggctgcccgtggacaagctgccctgccgggagctgcgccgcgtcgacgacctggtcgacatcctcaccaccgtcctcttcacggtcagcgtgcagcacgcggcggtgaactacctgcaatacgagcactacgccttcgtaccgaatgcgcccctgagcatgcgccgggagccaccccgccagaaggggacgctgcgtgcagaggacatccccgagatgattcccaccaagtcccagatgctctggcaggtcgccatcggccgggcgctctccagcttcggagacgacgaggagtacctgctgcacgagggcggctggcgcgaggagtacttccacgaaccggagctggtggccatccgccagcggttccaggagcgcctgcgcgcccagcgcgaggcggtggaggcgcgcaacgcgggcgccgaggtgccctacaccatcctgcgtcccgaccggattccctgcggcatcaccgtctga

SEQ ID NO: 5456 - DNA, 891 bp, Myxococcus xanthus
cgccgcatgtccaaccctacctcgcccgtcatcggcatcattggtggcagtggcctgtaccagatggatggcctgacggacgtcgaatggaagaaggtgacgtcccccttcggtgagccttcggacgagctgtgcttcggcacgctcggagggcaccgcgtcgtcttcctgccgcgtcacgggcgaggccaccggctggcgccgacggacatcaacttccgcgcgaacatcgacgcgctcaagcgcagcggggtgacggacctgctgtcgttgtccgccgtgggtggcctgcgcgaggaatacccaccgggcaccttcgtcgtcgtggaccagttcatcgaccggaccttcgcccgggacaagagcttcttcggcacggggctggtggcgcacgtctccatggcgaagccggtgtgctcgcggctggggaacgcggtgatttccgcgtgcgagggcctgggcgtcgtcgcgcgccggggcggcacgtacctggccatggaggggccgcaattctcctccagcgcggagagccacatgtaccggagctggggctgtgacgtcatcggcatgacgaacatgccggaggccaagctcgcgagggaggcggagctctgttacgcgacggtggccatggtcaccgacttcgactgctggcatccggaccatgacgccgtcacggtggaccaggttgtctccgtgctgctgggcaacgcgggcaaggcgaagggactggtgaagaacgtggtgccgctgctcgggtcgcatactggcccctgtgcacagggctgccacagggcgctggaccacgccatcatcaccgcgcccccggcctgggacgccgccatggtggagaagctgtccgcggtcgcgggccgggtgctgcgccgatga

SEQ ID NO: 5457 - DNA, 1069 bp, Myxococcus xanthus
atgcccaacctgctctctcgaggtctcttcagtctgttcttcggtggccggcgcaagcccctggccagccttcctggccccgcgccggggattctgggtaacatcggcgacttcctcggcgcccagccgtgggacgtctgcgcccgctacgcgcgcacctacggccccgtcgccgtcgcctggctgggacccagcccggcgctggtgctcaatgaccccaccctcatccacgaggtgctggagacacgccggctggagttcgagaagggcaacatcggcgaccagattcgccactccgtgacggacgacacgcccttcatcgcacagcagggcgaggactgggctcgcaagcacgccatggatccgctcgcccagccgtggactcccgcctggcaggcggcccaggtggagcccctgcgcgcggccatcctcgagtcggtggaggcgctgctccagcaaccctccatcgacctgacgcccacgctgcgcaagctgacgttcgacgcgttctgcgtggccacggtgggcgagaagctgcccacgtccgtgtacgacgacttcatgctcctggcggcggcggccgacgcgcgcatccaggccaagctgccgttgaagttcgtctcaccgcccaagggtttcgcggatgcgaaggagcgcttctacggcctgttcctggacaaggttcgcgcggccaggaaggccccggcgccgcaccgcgtggacctgatgtcgtggacgctgcgcgagatgccccagctcgacgatgtggtgcacgcgaacctgctcggcgggttcttcttcggaggcgtgttctcctcgagcaccaccctggtgggcgccttccatcagctgaacaagtaccccgccaccgaggagcggctggcgctggagtcccccgcgctggggcaggggccgctcaccctgcagcgcctaaaggacgcgccctggggcgaggccgtggcctatgaggccctgagaatcctgcccgcggtgcgcatcttcctgcgccgcacgccgcccacaccgacgcggttggcggaagtcacgctgccgccgggcacgacgctca

SEQ ID NO: 5458 - DNA, 675 bp, Myxococcus xanthus
  unsure (1)..(675): unsure at all n locations
atgcacccgcgcaccgggctgccggcggatgggctgtgtcacatcgagatgatgcatgtgcacaccgccgcgccgatgcacgccgacacgctctaccgcacgcgcgacaacgtctatgtcttcattggagacccgacgccctttggctacgaggggccgcagcatgcgtactacgggcaccaccccgtcgtgctcaacgtgctcgtgcgcatcgatgtcgacgtggacgtggtggagtactgctaccacgacgggccgcactaccacgcctatccgcctccgccgcgccaggagttcgtggacaaggaggacgtccactactacgcgggcgagtacccccaggagtaccggcgggaaagtccgaagttggtgcgagtcaatacggtgtaccgctcctggagtgccccacgcccggtggtgacgttggccccgccgccggagtaccacggccctgtcatccaggtgggcctgaacatcccattgccctctgtcgaggtgcgggtcgggacaccacggncgccgcctcctcccccacccgagtgggagcgagacgtcatccggcatgagcatgtgcacgtgcaccatgaccactgcgagcaccacgtccacaagaagcacaagcacaagcacaagcacaagaagcacaagcacaagaagttcaagggacgggactga

SEQ ID NO: 5459 - DNA, 1227 bp, Myxococcus xanthus
atgtgcacgtacttcggcctgaatgactcgaagtttggtcgcatcaagactgccggcttcgagcgcctgttggctggcatcactctcaatccccgcgccgacaagaagagactggcacgcgcctcgacctgtacgccgtcttcaccaagaggctcgttcgctgacatgtgggattgggtagcactgcccgaagttggaggactcgtgatgatgctgagaagcgaatgctggaagtgcctggcgctcgtcgtggccctgctattcaccggcgcggctcatgcccagcagcgcaagggcgaccaacccaaagacgtggggattgacactgcggatatcgagcggagaaccggcgccaagggcgagctgagcgccgacgagggggtgttcaaggtgaatctgccccgtactgacctcaaggtgggcgcggccggcgtgaagctcatcccgcccctcggcctgaccgcctgggccgccttcaagcgcgtgggggacgccaccatggtgatgggcgacatcgtcctgctcgaggaccaggtgaacccggtgatggacgtggcgctccagaacgggctggaggtcacggccctgcacaaccacttcttctgggaacagccgaaggtgatgttcatgcacatcagcggcatgggggagacggccaggctcgccgacgcggtgggcaaggtgttcacccgcctgcgtgagacggcgggagggaagggccgtgtgcctcgcgcctcggtggacccggcccgctcgaaactggatgtcacgaagctcgacgcgttgctaggccagaagggcacgtccaaggacggcgtctacaaggtcaccgtggggcgcaccgtgcgcatatatgggcatgaaatgggcaaggcgatgggcgtcaacacctgggcggcattcgctggtacgccgcagcaggccgttgtagacggggacttcgccatactggagagcgagctgcagcccgtgctcaaggccctgcgggcggcgaacatcgacatcgttgccattcataaccacatgacgggcgaagagccacggatgctgttcctccactattggggagtggggccggcagacgcactcgcacgcggagttcgctcggcaatggagctcaccctggcgcctactgggccgtgagcccgccgtggtatacgcgactctgtccctatctccacggccgactgccctcgcgtcctgtaaatggaaggccagactcctggc

SEQ ID NO: 5460 - DNA, 159 bp, Myxococcus xanthus
atgcccacggtgggcgggaagaacgctggctgcaaggtgggcaacctgcccgagtactccttcggctgtggcgcaactggcttcctccgcggactcgtggtggatagcgcgaacacctccctgtacgttggatacgtgctcgacgagagttgcctttag

SEQ ID NO: 5461 - DNA, 1017 bp, Myxococcus xanthus
atgcgtgccaccgttctccacaagcccggcgacgtccgcttcgaggagcgcgccgagccgaagattctcgcgccgacggatgccatcatccgtctctcggctacatgtgtctgcggctcggacctatggccctaccgaggcgtgcaggcggtgactgagccgacgccgatggggcacgagtactgcggcatcgtcgaagaggtcggaagcgctgtcgcttcggtcaagccagggcagttcgtcatcggttcgttcttcgcctccgacaacacgtgccctcactgcaaggcgggttaccaaacgtcgtgccagcaccgagagccggtgagtggggctcaggcgccaaggatgcgagtgccgctcgccgacggcacgctggtcgtgacggccgaggtgccgcccgatgcgcttgtgcccagcctgctggccgtgtcggacgtgtttggtaccggttggttcgcagccgacgccgccaacgtgaatcccggctcgacagtcgtggtcgtcggcgacggtgccgtcgggctcctggcggtactctccgcgaagcagatgggagccgagcgcatcatcgcgatgagccgccatgagacgcgccaggcgctcgctcgtgagtttggtgccacggacattgtgtccgtgcgaggcgacgagggcgttgctcgcatcaaagaactgacccgggggattggtgccgattcggtgctggagtgcgtgggcacacaggagtccatgctccaggctatcggcgccgcgaggcccggaggcttcgtcagctacgtgggcgtgcctcatggcgtgagcctggacggcgagaagctctttttctcgcacgttcatctccacggtggccctgcgccggtacgtcggttcatgcctcaactgattgacctggtctggagcaggaaggtcaatcccgggaaagtcttcgacctcaccctgccgctcgagaaggtcgccgagggctatcgcgcgatggacgaaaggcgcgcaatcaaggcgctgcttcgcccgtga

SEQ ID NO: 5462 - DNA, 753 bp, Myxococcus xanthus
agcgtcgaggactttcggcgcaacctggcgactgttcgcggacgcatcgccgctgcgtgcgcgcgagtcggtcgcgatccagtagaggtccgcctcctgccggtcagcaagaccatgcccgaggcccgcatccgcatggcctacgcggctggctgccgcgaactcggagagaacaaggtccaggaggcgttgggtaaggccgaggcgatggcagatctcaccgacctgcggtggtcggtgatcgggcacctccagacgaacaaagcgaaggtcgtcgcgcgcttcgccagcgagtttcaggcgctggacagccttcgtgtcgcggaggcgctcgatcgacgcttgcaggtggaggggcgcgcgctcgacgtgttggtgcaggtcaacacgtccggtgaagccagcaagttcggcctgccgccggatgaggtcgcccgtttcttccgcgacttgcccgccttctcctcgctgcgcgtccgtgggctgatgactctcgcgctgctgtcggccgatccggcgcgtgtgcgtccgtgcttcacgctgcttcgggaactgcgcgcgcggctgcgtgaggaggcgccggctggcgtcacgatgaacgagctctcgatggggatgtccggcgacttcgagtgggctgtcgaggagggagctaccatcgtgcgcgtgggacaggcgatcttcggcccgcgcgcgctgcccgacagtcactattggcctgagccgaacgcgacctcagaccccacgtcgtaa

SEQ ID NO: 5463 - DNA, 1434 bp, Myxococcus xanthus
atgctgaaggcggtggcgcccatcgagctcgtcaagcgccgccacctgctccagggacggctgggacaggcgccgagcctggacaggattcaggcggactatccggaggcgatgacggtgcggatggagcgcgagtcgccgggctccacgcgcaccgacgccttcttcggagagcggctgctcaacggcatgttctccaccctcatggatggcgacccggaggctcccggggacccggaggcgttccggctctacttcccgtggaacgcttacgagcaggacggcgtccactgcctgccggacgtggacgtgcggctgcggctggtggaggggcggctgttgccggtgcgcatcatcctgggcatgcgcgagccgggcgcgacggcgccgggctctcccgtgacgcggcggagctacacgcccgcggacggcgaggcctgggaggccgccaagcggatggcgcgggtgagcgcgacgctggagacggagctgggcaaccacctggggcagtgccacttcaacgtggagcagtacgccatcgccgcgcaccgcaatctgcgccgcagtccgctgcgctggctgctcatgccgcacctgcgggaggtggtcctcatcaaccactccgccaacggcttcctcgtgggacccaccggctacatcacccgcgccagcgcgctcaccgagcgcagcgtggagacgcggctgttgcacctgatgggcagctacgactggaagggcttcgcgcccgcgccgcccatctgcgagtcgcaccgctacgcacgcgcggcgggcctgttctggcggctggtaggggagcacgtggatgccttcttcgccgagcacggcgcggcgttggaggcgcagtggagcgaggtgcggcgcttctcggacgacctggtggggcactcggcgcccgccttcgtgtgccgctacctgcgcgcgacggtgccgggaagggcggcgccgtggttcgtgcgctccgagcgcatggacctggacgcgaaggtcgccgcgacccacgccaaggccgtcagcgcggtgacccggacggacgcgccccagcccggagagatggaggcgctcaagcagttgtgccggtacgtcatctacttcgcgacgttccgccatgcctgggccaacaacctccaatgggacgacgcgggcgaggtgctctatgcgtgcctgggcctgcgctggggcaaggcgggcgcgctgtcgacggaggcggaccatgacgtcgcgccgcctccggaggaggccacggagatgctgtggatttcgtggatgctctcgaagacgagctacggcttcctgctggccaacgaggaggcggacgtgcatccccgcttcgtggagtgcctgcgcgcccacgccgccgagttctccgcgctggggatggacatccgcaccgtcagttcccgcatcaatatctaa

SEQ ID NO: 5464 - DNA, 795 bp, Myxococcus xanthus
atgtccattgcgaatgctcttggcgaagtcttccggcgcgaactcgatgcgcagttggtcccgttgcagcaggcggtccggcgcatggaggaaggcctggaggccctggagttgctgcgtgaggtgacgcaccggttggcgccgctgaccagccgtctcggcgccatggcgggagtgcggacgcccacggagttgcccgcgtccacgcgcggaggccgcaagcaggtggtcgcggcgccaaagggccgcgcagccgtgggccggcccgtggccgcgaagccggtcgtcagtcaggcgcgcacggaggagggcacccgggcgtgcgccgtcatcggttgcgagcgccccagccgttccaagggatactgctcggcgcactaccagaagctgcggttgctgatgcggaccaaccgccggccgtcggcgtggaaggacgacgcgcttccgcaatcggtgggggacgtgacgctgccgcgtggccgcgccgccagcaaggcgctgcgcgagggtggcgccaggaagaaggccccggcccccgtggtggcgccgccgcccgccgaggagaaggcgccggccgccgcgaagaagtcagcgggacggaaggccgcgggcgcgaagaaggccgcacgggcgaagaaggccccggccgccgcgaagaagtcggtggccaagaaggcgccggccgcgaagaaggccgcggccaagggtgggcgccaggtcaagaccaccaaggcgaaggtcggagccggcaagcgcaagaagggccggtcctcctcccagggctcgttgttctga

SEQ ID NO: 5465 - DNA, 345 bp, Myxococcus xanthus
atggtcttccccaactacggccgcagcaagggcggacccattgtcggcgccagcatgggcgacctggagttctacgccaacggcgcgcgccgcacgctgaatgacgcgagcaagtcgcgctggcacgacaaggagcgccaactgctcgccgccatcgaggcggaaatcgcgcggcagcggggcggcgacgagggtggtggcagcgacggcggctatggcagccagggcggctacggcaaccagggaggctacggtggtagccggggtggtggcggcttcggaggcggcagctacggcggcgacgacatccctcctccgaacgacgacgacaacatcccgttctga

SEQ ID NO: 5466 - DNA, 1114 bp, Myxococcus xanthus
atgacacccaatgtctgtgtcgtcggagccggtgccttcgttccttcacgcgtggtgagcaacgagcggatcgccagggccatcccggggtggccggcggagcgcatcgaggagaaggtcggcatccgcgagcgccgcttcctctgggacatcgacgaggccacgggccgggcgattccgccgcccgagaatgacgggcacatctacccggccagcaacacgaacatgtgcgaggtggcgctccagaaggcgctcgcccaggtgggtgtggatgccaaggagttggacgcgctcttcgtggtgacgtgtacgccgaacgcgccgcacttcaaccacagacgccatggagctgcaccggcggctggagctgcgcgaggacgcgttcgggctcgtggtggacgacggctgcggtggcacgccgtacgtgttggacatggtgaagaagatgatggaaggagggcgcttccgcacggtggcggtggtggcctctgccttcacgtctccgctggtgaaccgtgaggtctacacggacgagctgccgcccgggccgggccgctcgaagacgctgcagggctacctctccatgtatgtcttcggcgacggcgcgggcgcggtggtgctccagtcgaagccaggagagtcgggggcggagggtatcctggcgtccttctccggcaacgcgtacggagacctggtcatccgcaagggtggcggcctgttgaagctgccgtatcagccggggcggatgcgcccggcggacatggccttcgtggtggatggcttccgcgtggcgcgcagctatccggagtacatgcagaagtgcctcgacgccgtcctcgggccgcgtccggagctgcgttcgaaggtggagcggtactacttccaccagccgaacaagcgggtgatggacgccttcgtggagcgggcgggactgccgcgtgaggcggtggcgtgcaacgtggaccgctacggcaacacgtcggcggcggggatgctcatccttctggccgaggacttggaagcaggacgcgtgcgtctgggaagtggtgacctggtggtggtggcagcggtaggcgcgaacgtccattacggcgcgcaactcgtgaggttgtaa

SEQ ID NO: 5467 - DNA, 1107 bp, Myxococcus xanthus
atgaaggtccatggcaagccgatgcgctccatctggctggcgccggacgcgcaggccgcggaggccattgaccagacgcggctgccgcatgcgctcgtcagcgtgcggctgacgacgctggatgaagccgctcatgccatccggagcatgctggtgcgcggcgcgcccctcatcggtgccaccgcggcctatggcgtctggctggctttgcgcgcggatgcctcggacggcgcgttggagcacgcgctcgcggtgctgcggggcacgcgccccaccgccgtgaatctgcactgggccctggatgacatgcgtcagctcctggcgccgctgcctcccgctgaacgggtggctgccgcgcttcgccgcgcggaggccatcagcgacgaagacgtggccatcaaccgcgccatcggtgcgcacggcctgaagctcctggaggacgcctggatgcgcaaggggcgccagggccgtctggaggtgctcacgcactgcaacgccggctggttggccacggtggacttcggcaccgcgctctcgcccatctaccaggcgcacgacgcgggcatccccgtgcacgtctgggtggacgagacgcgccctcgcaaccagggcgcgcagctcacggcctgggagctggggcagcacggcgtcccgcacaccgtcatcgcggacaacgtggggggccacctgatgcagcacgggcaggtggacctgtgcatcgtcggcacggaccgcaccacggcccagggcgacgtggcgaacaagattggcacctacctcaaggcactggcggcgaaggacaacggcgtgcccttctacgtggcgctgccctcgcccaccatcgactggacgctgcgggatggggtgcgtgagattccgattgaacaacgcgacggcacggagctgagcgacgtcaccggacggttggcgtcgggcgaggtggccacggtgcggattacgccggaggggagccccgcggcgaactacgctttcgacgtgacgcccgcgaggctggtgacggcgctcatcaccgagcgcggcgtgtgcccggcttcgcacgacgggctgctgtcgctcttcccggagcggcgcgggagggcggaatga

SEQ ID NO: 5468 - DNA, 588 bp, Myxococcus xanthus
atggatccgaatatcgccaaggagttggacgcgcgattggcgctggcgacgaaagacgacacggcccgcgggctcttcttcaacggcgtggtgtccgccgttcgcacgatgggaggggacgcggcggtggagcgctgtctggcggccagtggcgagacgcgcttcatcgacttcttcaactacccggtggccgccttcctgcggatgtccttcacggcggcgcaggtgatgggcccggagcacggcggcttcgacggagcgctgcggcgcatgggcgtggtggccacgacggacttcctgtcttcggcggcgggcaagacgctgttgttgttggcgtcggacagtccgaagcggctcgtaggcaacctgcactcgggttaccgcgcggcggtcagctacggcgagcgcgcggtgaagtggacgggcgacaccagcggcatcttcacgatgaagcgggacttcatgccgcccgcctaccacgagggcacgctccaggccgtcatcgaggcggtgggtggcaagcaggtccaggtgcacggccggcagacggggccgctcgacaccgaatacacgctgtcgtggcagtag

SEQ ID NO: 5469 - DNA, 579 bp, Myxococcus xanthus
atgttgggtgtcctgttgctgtcggcgcaggcgggggccaatgaggtggtgatgcagttccgcacgcaggaggacccggcgagccctgcggacccggcggtgtgcgcggcggcacccttcgaggtgaacgtgaagctgggcgggagtgtgtatgtgccagagcacaatcccaaggacggcaaggtggtggatgggggcggccgacgcgtgggctcggcgacggcatgcgtccaggtgacggacagcgcctttcccgccgggcagcagctgaatgtctacatgcgctacaacctgccggaggggcgcttcacggcgcggggcacgtgcacgctggtgagcaacgacgtgccagcggcggggctggtcctggctggctgcgcgatgcgactggtggacgtgcccaagggcttcgtgggtggctcggtgtcgagcaccagcgtcttcaatccccgcaagctgccgggctacgccacaggttcgtattacacgctgtacgcctaccgtgatggccaccagcgtgacgcgagcaaggtgacggaagcgcatgcggccgaggccgcggcgagagcgcgggagtag

SEQ ID NO: 5470 - DNA, 1452 bp, Myxococcus xanthus
atggaccgcaagcggatggagttctacacggcactcgggtaccgggctccttcagccgcggcaacggctcagacgacgtccggagtcgctagcgccgacgtatcggagttgccgccgctcggtccagacgacctgggcgcgctgcgcgagcgcttcctgcgcgagccggaagaggtcctgagcctcatccgccaggacttgggcgcgcccgtttcagagggagccctggtgcacgtgctccaggagctggagcagtccttacgcgagcccgaagccgcgctccaagccctgcggcaaccggcattccaggcacgggcctcggtgtcactgccgccggacttcaccttcccgttgatgacgactgaaattcccatcgacgcctcgcgaacccgctttgagcccgtggcggacctgcgcggatggctcctgttcagcggtcgcgcctggcttcacggcggctggcatcgggcggagttccgtcggcacgacgatgcgcatcacgccacgcgtttccgctacgagctccgcgagcccgcgccgggacggccggtggaggtcgcgttgttcggaggcttcggcacgggtgagtaccccgcgcgctatgtggcccgtcagctcatcatgcgaggcgagcggctggagtacgcggtgcacctcgggggcgtgtactacgcgggccgtcggggcgaattcgacgcgcatgtggccgagccgctcgaaccgttgctgcccgtcacaacgctgatgacgctgaacgcgggcccggagatgcgttccggaggcacccccttctaccgctacctggacgagcggcgaggtgcttcacgagcgaagcaagtccaggagggaagctacttctgcctggcctcggagcgcttccaactcatcggtctggacaccgcgtacttcgagccaggacggcaccaggagcccgcgctcctgagttggctggagtcagtgctgaaggagggccgccagcgaggagcaacgaacatcctcctgagccacgatgcgccctaccgatacggagaagcaaggcacgccggtttgctggaagacctccgggaactggcggtcgagcgcgcacaggtcgacgtgtggttctggggcgccacgccctacggagcactgttcgaccggagcgccgcgctcccgttcctgggaggaagcctggggcacgcgggtctcccggtgcgagcggtgacgccgggcctgaagtctccagcacccgtgcgcttcctggagtcgcacgcacgcttccccgagtggacagacctgaggcccgaactgggcaacaacggctatggctcgctgctgctgcacgaggacggaacgttgggcctccaactcctggactggcggggcaacgttcgctgcacggccaagctggcccgcgagggggacggcccgctgacgtaccagcacctcgagacgtccgaatcggcgctgtga

SEQ ID NO: 5471 - DNA, 507 bp, Myxococcus xanthus
atggctcgcgacatcgtcatctggccccataaggtcctcacctcgtccaccaagcccgtgactgacttcggccctccgctcgagacgcttttggagcagatggccgagtccatgaaggaagccgaaggcatcggcatcgccgccaaccaggtcggcgaatccctgcgcgtggcgctggtgggacgggaggacggcaccttcttcgaaatcgtcaatccgcagattctggagaagaaggagccggtgacgatggaagagggctgcctgtccgtcccgcgcgagtgggagaagtgcccgcgcttccacaaggtgaaggtgcgttaccaggacaagtccgccgaatggcatgaactcgaggcggaaggtcggcttgcgcacgtgctgcagcatgaaatcgaccatctcgacgggcacgtcttcgtggaccacctgtccagcctcaagcgcacgctcatcctggaccggatgaagaagctccagaaagtgaaggcccgccagaagggctag

SEQ ID NO: 5472 - DNA, 699 bp, Myxococcus xanthus
atggccgaagccgccagggccacgcgctccatccccgagcgcgtggcgcgattccgcgaggactaccggcgcaagcacgtgagccctcgctactctgggcgcgcacacttcgtcttcacgagcctgggctcgctggcggtcatcggcttcgccgtgtcccacctggagggaaggcggcccctggaatggctgacgctgcccgcggtcttcctgctgggcaacgtggtggagttcctggggcaccgagggcccatgcaccaccgccggtgggggctgggccttcttttccagcggcacaccgagcagcaccaccgcttcttcacgcacgaggccctggcctacgagtccgctcgggacgtgaagatggtgctctttcccccggtattgctgctgttcttcctgggcgccgtcgccgcgccactgggggcgctgtgcttcgtcctcatctcgccgaacgtggggtggctcttcgtcgcatcggcggtcgggtactacctgacgtacgagtggctgcacttctgccaccacctgccgcccgagcacccggtggcccggctcgcgctgatgcggcagctgcgccgccaccacgaagcccatcacgacccttcgaagatgcagcgctacaacttcaacatctcgttcccgttcgcggactggctcttcgggacgtcatggcggcccgacaatgaccgtcgctag

SEQ ID NO: 5473 - DNA, 1422 bp, Myxococcus xanthus
aacggtgcacaggggctcatggggcccgaggggccgcagggcgccatgggaccgcagggcctccgtggtgagcagggcgtgcaggggccaaccggtcttcagggtgagacgggcatgcagggggaccggggaccggagggtcccgctggcgcggtgggacctgccgggccggcgggaccgcagggctccgtaggacctgagggcccggtgggcccattgggtgccacgggcccccagggtgatgtcggtctgggcacggtgacgcgtaccacagtggagccggcggccggcaactgcgccaccggtggcgtgcggctggagatgggcgtcgacgtcaaccgcaatggtacgctggatgcgggcgaggagaatgtcgcgctcacccgcttcgtgtgcaacgggccggtgggaccgcagggcgggcaaggtcccgcgggcgcgacgggacctgcaggggctcagggcccttcgggatcggttggtccgcagggccctcaaggtccgcaggggcccatgggctcgttgggcgcctacggtgacgggtcgactggggcgtacaacgtccccagcggcaacaccgtggatctgaccacggccactggctacggcacgttggccggccggcagcacctccagttcaccaacgtcaccatctccggcacgcttattgtcccgagtggaacggtcatccgggccaccggcgacgtcaccgtcaacggtacgatcatcgtggaccccagtgccgaggacaacggaaccgggcctgcggaggcaggcgtggcgcgtgcggccgcaggcgagccccagggcgggcgtgggctgttgccgctccaggccgcgcaactcctgcgacccggcggcctgggcggcggcgcgggtgccaagcaggtcggtgtggccggtggcaggggtggcggctccctggtcatgctcgcgcagggagcggtccgcattcccccggggggcgccatcaatgccaatggtgaggctggtggaaccgcctccaacctgcccggctctggcggtggcgcggggggcgccatcgtcctcgtgggcaagggctccatcaccgtggggggattcgtccgagcggtgggggccaatggtggcgctggcaacaacgcggggggcgcgggcaagggcggcggcggcggtggcggcggtggcatcgtccagctcctctccaccacgacgcccagcgtgacaggcggcattctcgtgagtgcgggtgccgcgggcgccaccgcgaatcccacgggcgcaagccaggccatctccgcgggcggtgggggcggcgcgtgcggtggaaatggtggttcgggtggtggcgggacgctggccgcgcctcagccgtccgaggccggggccgccggctatgacctccggactgtcacgcccacgccggagaacgtgttcctgtag

SEQ ID NO: 5474 - DNA, 519 bp, Myxococcus xanthus
atgaagaagacgcgagacgaggcactgaacctccaggaagtgggggacatggaggcgcggtggcggggcctcgccacccagttgctggaattgggggacgacgcgatggatgcgcagctgctggtggccttccgcgccgcgcgtgaagaaggggtggtgcctcccgatgcgggcttcttcctggtggcccacatcctcaccgccatggcggacgaggcgattggtgacgaaccccgcgtgtgccgcctggcgctggagctggagttgatggagcgtgagtacggcgtggagcagggcgtctggctcagcggcgaggagactccacccgaggactgggaggccctgcgcgcggcgtatgaggccgcttgcgacgaggcccgcgccaccttcttcactgcctatggcgaggaggagatggcccgcctctacctggatgaccgcatctgcttccaccgccgcttcgagagcgggcgccgcttcttccacgggctgcccatgcttcccgagcatctgcactga

SEQ ID NO: 5475 - DNA, 756 bp, Myxococcus xanthus
atgaccaccgactccgcccaccgtctcctggacctgctgtgggagcgctacgccgcggaggtgccctatgcgcgcaccttcgtgcagctctcagggggccgcttccgcaatgaccatgtcgcgcttcgctcgctggcccggcccggtggtggcatcgcgctcttctcgcagtccttcatccggctcggctggaaggccgcgggcgcgtacacctttccggatgcgcacctgtccgccatctatttgtcacatccggcagggctgccccgcatcttcatctccgagctgaagcaggaggagctgtccccgcgcgctcgcgagctgctcgcccggctgcccgaggaccccgcgcctcccgaggacgtggacgcactggccgcgtggttcggctcgccgccccctccagacgaggccgcgctgctggagctggagaaggagtcccagtatggcgcctggctgctcgccttcggccgcaaggtgaaccacttcaccggctcggtggacgacgtggaggcgtggcagaagcgcatgcgcgaggccggggtgccgatgaaggccgacatcgagggcgcgcccgggacgtcgctgcggcagacggccacgcaggccgcgccgctgcccgtgttgctcgagggcggtggctcgcgctcctggccctacgcctacttcgagattgcccagcgcacgccggacttcgacggcttcctgggcccccaggcccgggcgctcttcgacatgacgaagcgcggcgggtag

SEQ ID NO: 5476 - DNA, 885 bp, Myxococcus xanthus
atgcgcctgcacctggtcgacggcacctacgagctctaccgcgcccatttctcgccccgtccgggccatgccgcgccggatggacaggacgtgaaggccacggtggggctgatgtcctcgctgctcgcgctgctgcacgacgcggacgaggcggtgacgcacgtggcggtggcgttcgacaaccccatccgctcgttccgcaacgcgctgttcgacggctacaagagcgacgagggcgtgcccccggagctgcacgcgcagttcgacctggcggaggaggccgtgcgcgcgctgggcgtcaccgcgtggtccatgaaggagcaggaggcggatgacgcgctggccaccgccgcggcgcgctgggcggacacggtggagcaggtgcggctgctcacgcccgacaaggacttgggccagtgcgtgcgtggcagccgtgtggtgcaggtggaccggcggcaggaaaaggtgctcgacgaggacgcagtgcgcgcgaagctgggcgtgccccccgcgagcgtgccggacctgctggcgctgatgggcgacgcggcggatggcatccccggactgccgggcttcggggagaagggcgcgtcggcattgctgagcgcgcatggccacctggaggacattcccgcggaggcgtccgagtggaaggtgcgtccccggggcgcggagaagctggcagcgacgctgcgcgagcaccgtgacgccgcgctgctctaccgccggctggccacgctggtgacggacgcgccgctgccgggcacgtcgtcactggaggacctggcgtggaagggcgtgccgcccgccgtgtacgaagcgttctgtgaccggctgggcctgacgacgctcaagcgccgtcccaagcgctgggcgccgtga

SEQ ID NO: 5477 - DNA, 1704 bp, Myxococcus xanthus
ctggccatcaacaccatccgcaccctcgccatggatgcggtacagcaggcccactcgggccacccgggggctcccatgtccctggcccccgtggcgtaccagctctggcagcaggagctccggtatgacccgtcccaccccatctggccggaccgggacaggttcatcctgtccaacggccacgcctccatgttgctgtacgcgctgctccacctggccggggtgaagcgcgtcacgcgggagtacaccgtcgaggacgcgcccaccgtgtcgctcgaggacatcaagaagttccggcagctcgactcgtccaccccgggccaccccgagtaccggtggaccagcggcgtggagacgaccaccggccccctgggccagggcgtgtccaacagcgtgggcatggccatggccagccgctggctcgcgagctactacaaccgccccggcttcgagatgttcgggtacgacgtctacgccatctgcggcgacggcgacctgatggagggcgtggcgtccgaggcggcgtccatcgccggccacctccagctacccaacctgtgctggatctacgacagcaaccacatctccatcgacggcagcaccgacctggccttcaccgaggacgtgggccggcgcttcgaggcctacggctggcgcgtgctgcgcgtgccggacgccaacgatttgaacgccatgggtgaggcgctgcgcaccttcaagacggcgcgcggcaagcccacgctcatcatcgtcaccacccagattgcctacggcgcgcccaagctccagggctcctccaaggcccacggcgagccgctgggcgacgaggaaatcaagggcaccaagcgcttctacggctggcccgaggacgagaagttcctggtccccgacggcgtgcgcgagcgcttccaggagcgcatgggcgctcggggcaagcagctgcgcacggagtgggagcagaagttcgccgagtaccgcaagcagttccccgagctggccgaccagttggagcgcatgcagcgccgcgacgcaccccagggctgggacgcggagctgccgacgttccccgccgatgccaagggactggccacgcgcgactccagcggcaaggtgctcaacgccatcgccaagcactacccgtggctggtgggcggctcggcggacctcaacccgtccacgaagacgtacatcaccggcggggaggcgatgaagccgggcgagtacgcggggcgcaacatccacttcggcgtgcgcgagcacgcgatgggctccatcgtcaacggcctgtgcctgagcaagctgcgcggctacggcgccacgttcctcatcttcagtgactacgagcgccccgccatccgcctctccgcgctgatggagctgcccgccatccacatcttcacccacgactccattggcgtgggcgaggacggccccacgcaccagccggtggagcagttggcgtcgctgcgcgcgattcccggcatcatcgtgctgcgccccggtgacgccaacgaggtggtcgagtcgtggcgggtgattgcccagcagcgcaagcaccccgtggtgctggtgctcacgcgccagcccgtgcccacgctggaccgcagcaagttcggcgcggcgtccggcgtggctcgcggcggctacgtgctgtccgatgcggagggcggcaagccggaggtcatcctcatcggcaccggcagc

SEQ ID NO: 5478 - DNA, 501 bp, Myxococcus xanthus
atgacgaagaagctccttgccgcgttcctgctgtccaccgcgctcgtctccgccggctgcggcgacgaccatcccgaagaagagggcgtcgacgccgaggcgtgcgagcacctccaggaggggcccgccaccgccgtcatctccaacatggggaccaacaacccgccccccgagattcgcgcggaccaccgccgctacgacatcaccctgatgagcggctcggaagggaatcagggcatggtggccttcgccgcgagcgaggccgccgactacgtcatctacaccaacgcggacgtgcccctttccgtcaccacctccagcggtgaggcggtggaaatcgaggagagcaccagcagctccaagggctgcaccgacatcaagggccgccacgtcgtgcctctcacggtgggcacgcactacctgaccttcggccccacgtccgtggcgactttcggcgtgctcatcgaggagtcgcacggcgaccacggccacgagcactga

SEQ ID NO: 5479 - DNA, 672 bp, Myxococcus xanthus
atgagcggtgcgtgcgagcacctcgccctgcgcgagtcgatgattgccaccgcccggcggatgaatgcgtccgcgctcaaccagggcacttccggcaacctgagcgtccgggtgaaggccggcttcctgctgacgcccaccggcatggactacgactcgctggtgccggaggacctggtcctcatgcgcttcgacggcagccacgaggggcgccggagtccgtcctcggagtggcagctccaccgggacatcctggccgccaggctggaggtgggcgcggtgctgcatgcgcactccatgttctgcaccacgctggcgtgcctgcaccgggacattcccgccttccactacatggtgtccgcagcgggtggcacggacgtgcgctgcgcgccctatgccacgttcggcacggcggagctcgcggcccacgtgctggccgcgctggaggggcgcaaggcctgcctgatggcgaaccacggcatggtggcggtgggcagggacttggcggcggccttcaagctggccgtcgaagtggagacgctggccgccatgtactggcgggcgctccaggtgggtgaaccggtgctcctggacggcgcggagatggcgcgcgtcctggagaagttcaagacgtacggccagcagccgacgcccccgtcgcgcgaagcgtga

SEQ ID NO: 5480 - DNA, 1209 bp, Myxococcus xanthus
atgttcctgcccttcttctacgagctgcgccggcgcggactgaaggtcggcgcccaggaggcgctggcgctggctggcgcgctgcgagcgggcctgcacgacagccacctggacggcttctaccatgtggcccgggcgctgctcgtgcactcggagacgcagttggatgcgttcgaccaggccttcctcgcccacttccagggcgtggagacggcgagcctggagctgacgcaggagctgctcaactggctggaggaggcgcgcgagcggcccgacctgagccccgaggaggtcgcgctgctcgagcagctagacccggaggagattcgccggctcttcgaggagcgcctgaaggagcagaaggagcgccacgacggtggcaaccgctgggtgggcactggcggtacgtctcccttcggcaacaacggctttggccgcgagggcatccgcgtgggcggcggcgcgggcaaccgccagggccgcgcgctgatgcaggccggcgcccggaagtacgccggctaccgcgacgacgtggtgctggacacccggcagatggcggtggcgctgcgcaagctgcgcgccttcgcccgggacggcgcaccagacgagctggacgtggacgagtccatcgccgcgaccgcgcgcaacgctggcgagctggaagtggtgacacggccgccgcgacgccccaacacgcgcgtggtgctggccatggacgtgggcggctccatggacccgtacgcggcgctggtgagccggctgttcagcgtggccagccaggcgacgcacttcaaggaactgcgcacctactacttccacaactgcgtctacggaaagctctacgccacgccgcagctcacgggcggaatcacggtgccggagctggtggcccaggtgggacggcaccacaagctggtgatggtgggggatgcctccatggcgccctacgagctgtccatccgcaccgacgcgcaggggcactacaagacggacgggctggaagggctgacgtggctgatgcagctggcgcagcacttcgagcgcaacgtgtggctcaacccggagcccatgggcacgtggcgctcggggaccatctccgtgattgcccgcatcttccccatgttcgccctgacggtggagggcctgggtgaagccgtcacccacctgacgcggggccgcaccgtgaggggcgcggcggcgcggcgctga

SEQ ID NO: 5481 - DNA, 849 bp, Myxococcus xanthus
atgagccaggcgcccactcccgtccgcttcaaaggcaccgacacctacctgacccacgagagcctccaggccgcggtcaactgcgcgctcaccctccagcgccccctgctggtgaagggcgagcccggcaccggcaagacgctgctggcggaggccatcgccgaggccctggggcaccggctcatcacctggcacgtgaagagcaccacccgcgcgcaggacggcctctacgtctacgacaccgtgcaacgcctgtatgactcgcgcttcaacgacggggacgtgcgagacatccgcaagtacatccgccaggggccgctgggagaggccttctcctcccccgagcgcgtggtgctgctcatcgacgaggtggacaaggcggacctggagttccccaacgacctgctccacgagctggaccggatgcgcttccgcgtcaccgagacgggtgacgaggtggtggcgaaacaccgccccgtggtggtgattacatccaacaacgagaaggagctgcccgacgccttcctgcgccggtgcgtgttccacttcatcgacttcccggacgcggagctgatgcgccgtatcgtcggcgtgcaccacccgggcctggacagcgcgctgtccgagcaggcgctgaaggtcttctacgagctgcgcagcttcacccgcctgcgcaagaagccctccaccagcgagctcatcgactggattgccgtgctcaaggcccagggcgtcaacgacctcaagctggacgaacagctccccttcctgggcgcgctgctgaagaaggagcaggacctggtctccgtggcggaggccttcgggcgcgggcgccgtccccgggcctag

SEQ ID NO: 5482 - DNA, 570 bp, Myxococcus xanthus
atgctcgtggagccgaacccgcacatcgcgctcaacatggcggacgatccgcggctgtcccgggaggaactgtgtgagcggctgtcgctgctcgccgagcgcggactcattcgcgtccacgcgcttccggacgggctgcaggagctgttctctcccgaggagatttcaagcgccattgatgcccggcagtcccgcactccctttggctattcgctcacggatgccggcggcgccatctgggagcaccacgccaggcccgattggagccggttcgtcaacgcggggcaggagccctccgccgacgaggcccaggacgcctgggtcatcgaggccgcgagccttgaagccgcggacgcagagttccacttccatgagtcactcggcgatgtgcatcagccggtgggcgagtccaagcacggcgaggtgctgacgccgtggcaggtgacgtactggaagacgctgcctcacggataccggctccggtacgtcaccgtgccgcgtcctgccgacccggctcggagcaggagcgtgccttcccgaccgccttggtacacgcgcgtctggctgtga

SEQ ID NO: 5483 - DNA, 480 bp, Myxococcus xanthus
cacccgcacgcccaactcatcactgacttctactcagcgttccaacgccgggacgcccaagccatggccgcctgctaccaccctgaggtggagttctccgacgccgccttcgtcggactccgtcgccgggagcccggtgccatgtggctcatgctctgcgagcgcggcaaggacctggaggtcaccttccgcgacgtgcaggccgatgaccaccggggccgcgcccactgggatgcgaactacacgttcagcggcaccggcaggaaggtgctcaaccgcatcgatgccgagttcgagttccgcgacgggaagattgtccggcaccgcgaccacttcgacttctggacctggtcccgtcaggcgctgggccccaccgggctggtgctcgggtggacgcccctgttgaagaagaaggtccagtcgaaggcccggaagtccctggacatcttcatgcgcgagcgtggcattccccaggagtga

SEQ ID NO: 5484 - DNA, 531 bp, Myxococcus xanthus
gtacccattccagaggacctggtgctgttgtcgctgggcatcctcgcgcaccaggacgtcctccccatcgccctggcggtcgcggtcgcaatcaccggagtgctctgcggcgacacggccctcttcatcaccgcccaaaggctggggcccgcgctgtacgcgcatccacggatgaagaagctcctgccgccggaacgccgcgagcgactggcccagctctacgcgcgccacggcgggcgctgcatcttcgtgggacgctttctctcggtcctgcgcggggcagtgttcatcatggccgcggtgcaagggatgcggctgcgcgacttcctgctgtgggacgcgttggcgctatgcctcagcgctccggtggtggtggcgctggggtacgccttctcgcacagcgtggacgcggtggcgaaaggggcggcgcgagccgagcacctgctggtgctggccacgacggcggccctgctggcggtggggggcctgcgccgactgcgcacgcggcgcctggcccaacgcccgcggtga

SEQ ID NO: 5485 - DNA, 249 bp, Myxococcus xanthus
atgccggcgcacactcacaccctgaatgtgagcagtcagcacggcgatacggaaacgcccattggcaccgtgctcgcggcggactccacggcgaccgtgctcaactaccgggctgcccccatcgacgggaccatgaaccccgcggccatcggcgtctcgggtggaagccagccgcacaacaacatgtcgcccttcttgtgcatcaacttcatcatcgcgctggaaggcatctacccgtcgcgcaactga

SEQ ID NO: 5486 - DNA, 606 bp, Myxococcus xanthus
ggacgccggagttgaatgcccgccatgggcccagacgcagttttcaacctgctgagcaccgaacgcctgcatctggtgcagctcccaccggatgcggcgtggcgggtgctcgcgtaccacgaggcgaaccgggagcacgtctccaccgtgtcaccggcacggccggccaacttcttctcggtgacgtactggcgcacgcggctggcgcaggaccgcgaggacttccggctcgacctgtcgctgcgcgtgttcctgctgccgcgaaaacagtccatccagttgtcgcccatcatcggcaacatctcactcacgaacatccgccgcggtccgttgcagtccgcggacctgggctacggcttggaccaccgctacgaaggccagggcctgatgacggaggccctgcgcgcgctgtgtgactacgccttcaacgtcatgggcctgcaccggctccaggccaaccacctgccggagaacctgcgcagcgccgcggtgctgaagcgcctgggcttccaggtggagggcatcgcgcgggagctcctgctcatcgacggccagtggcgcgaccacgtcctcaacgcgctgattgcccctggccggcgaggatga

SEQ ID NO: 5487 - DNA, 1230 bp, Myxococcus xanthus
atgctgaagcgtggatggaaggccctcgctggcgtcacggcgctggccgccgtggggtgtgcacacgcaccaccgccccaggagctcctcaacgcgcgcgcggcctaccaggaggtctccaccagcccccagggccgagagcgtcctcgagacgtcgcggcggcgcgagatgcgctgctggaagccgagcgggagtacgaccgcagccaggactctcctcgcacccgctcgctgtcctacgtggcgttgcgcaagtccgagacggcgggggcacgcggcaccgcggacctggcggcgcggcgtcaggcggaggcccaggccacgctccagcaagcgcaggcgcggcagtggcagcgctcgcaggcggagctggatgcggcccggcagcagctcgcccaggccgagcgtgagcggctgcaagccctccagcaacagcaacagtcccggcagcacgccgtgacgcagcaacaggaagccgagcgcatgcggatggatgcccagcggcgccagcacgaggcggaacagctgcggcggctggcccagcagcaggaagcggagtcgcggcggctggcggagaagaccacgcggcttcaggaagaagcgcaacgccgggcgcgggccgagtccgaatcccggcgactggcccaggagaaccacgaactgctccagcgctcggcggagctggaagcggagcaggaggcacggcgccaggtggagcgggagctggaacgcgagcgacaggcgcggctcgacgcggaacagcgcgccacggaggcgctgacacagttggagtcgacggcgcgcgacgtgaaggtccgcgaggaggaacgaggcctggtgctgacgatgtcagggcaggtgctgttcgcgtcgaacgcggtggacctgctccctacggcgcgtgagcaactgacggaggtggcccacgcgctcaaggtgtccgacagtcccatggtcatcgaaggccacacggattcgatgggctcggacgcgatgaacgaagccctgtcctaccggcgggcggagcacgtgcgggagttcctcatcagccagggcgtgagtcgcgaccgcatccaggtgcgcggcctgggcgagtaccgccccgtcgccaacaactccaccccagagggccgcgccaacaaccggcgcgttgaaatcatcctcccgcgtggaggggaggaggccactggcggcagcggcgctgagcccccgacgacgcctcggcgctga

SEQ ID NO: 5488 - DNA, 360 bp, Myxococcus xanthus
atgcgcctgaagctggcggcgatgctgctgggcctgacgatggtgggatgcgccgggcggcaggtgcttcccgcgccgaacgagcaccgtgtgcaggcggaagcctcgctgcgctcggcggaaggcgctggcgccgcccgagtccccgaagcagccctacacctggagttcgcccggcagcagattgccgacgcggagcggctgtgggtggaaggcgaacaggaagccgcggagctgcgcttcatgcaggccgaggcggacgctgagctggcacaggcgctggcccgggccgtcccgctggagcgcgagtcgcgacgcttggccgcccaggcggagtccctgcgccgcggccagccgtga

SEQ ID NO: 5489 - DNA, 1365 bp, Myxococcus xanthus
atgcggagcgacacgtccgcgcccttcgacatcccggacctgtccctgccccagcagctgccggggcgcctggcgctgcccatcgacaacgcggacctgttccgcaaggcgcgcccgccggaggagcacacccggcccggggcggccaggctccacgtcctggtgcaggtcagccacctcatcgcggaggcggggttggacctgtccatggtgctgcaggtgctggtgcgcaaggtgtcgcaggcgctcggagacgcgtgcgtgctccaactgctctccgaggacacgacgcgcttggagctggtgacggtgcaccatcccaacgcggaggcccgcgcggtgctggacgcatccatgcggcgctgtccggggcgggtgggagaagggctgtcgggccgggtggcggcgacggggcagccgctcttcgtcccgcgccttcaggccgaggacctgcgcgatgagcgcgtgccggagggcatgcccttcctccggcactatgggccccacagcgtcatcgtcgtcccgctgggcgtgcgcggccgggtgctgggcaccctgggggtgatgcgcgaggcgcagggccgcgagtattcggtggaggagcgcgcgctactggagagcctggcggcgcgcgcggcgctggccattgaagacgcgcggcgatacggcgcggccacgcaggcggtgaaggcgcgggacgagctgctgtcggtggcggggcacgagctgaagtcgccgctgaacgcgctccaactccagattcacctgctggcgcgcatggcccgcgaggcgatggccgtggacgggctggcggagcgcgcggagcgggcggcgaaggcgggccagcggctggggctgctcatcgatgacctgctggatgtctcgcgcctcagctcggggcggctggggctgaagcgtgaagaggtggacctggcggcgctgacgcgcgagctggtgggccgcatgtccgaggagctggcgctggcgggcaacgaggtgcggctgctgctggacaggccggtgtcggggcactgggaccggctgcggctggagcaggtgctggtgaacctgctcaccaacgcggcgaagtacggcgcgggccggccggtgacggtggaggtggaggcggtgggcccggtggcgcggctgtccgtgcgcgacgagggcatcggcgtgtcgccggaggagcaggagcgcatcttcgagcagttcgagcgctccgcgtcggtgcagcacttcaagggcctgggcctgggcttgtggattaccaagcgcatcgtcgaggcccacggcggcagcatccgcctgacgagcgagccgggcaagggctccaccttcaccgtggagctgcccttgccggcttga

SEQ ID NO: 5490 - DNA, 2034 bp, Myxococcus xanthus
atgaagcggtatggcgctggactgttgacggcgtggttgctggcggtggctcccgcctgcggcgactcggatgaaggcgcgccaccggacgcgggattgcccgacgcgggcgacagtgggattccggatgcgggtgacagcggcacacccgatgcgggtgaggagctgcctccgctgctggtgcccgcgggctgcaacccgctggcctccgagcatgactgcctcctgccatacccctccgactacttcctcgaggaggatgcggcgctgccgtccggccaccgggttcggctctccgaggcggcgaagctgaaggcacccgacggcgccgcgttcgacttcacggacctccacccggcggacggttactctcatggcacgcaggtgctcgcgctctttccggacggtgtggatgacgcgcgcctgccgtcggtgacgagccccaccgccgcgacgaacgggaacacggtgttcctcgacgcggagcgcggtgagggcgtgctccacttcgcggagctggaccccagggctccggacgacgcgcgccgcgccttgctgctgcggcccgtggtgcggctgcgcaacacggcccgctacatcatcgccctgcgcgggctgacggcgaaggacggcacgcccgtgccggtgcccgagggcttccggcgcatccgggatggccagacggcgggagacccgctgctggcacccctggccgccaggtacgaagcggacatcttcccggcgctggaggccgcgggtgtgccgcgcgcggagctccagctcgcgtgggacttcaccaccgagtcgcaagagggcgtcacgcaggacatgctccaggtgcgccgcctggcgatggaggcgctggaggccacgccccccgccgtcacggtggcagacgtgcgggatgacgtggacgccaacgtcgcccggcgcatcaccggcaccttgcgggtcccgctcttcctggagagcgaccagcccggtgcgctgctggcccgtgacgaggaaggccgtgtgcggcgcaatggcgacgcggaggtgcctttcacgctccagattcctcgcagcgtctgggggcagtccgtggcgccggtgcgcttgctccagtacggccacggcttcttcggccggcaggcggaggcggatggttccttcgtccggcccttcatccaggccacgcggatggtggtgctgacggtggactggtggggcatgtcgcagacggacgcgccgggcgtgctccaggcgatggcgggcaaccctggccagacgatgcgcttcaccgaccgcgtccaccagggcatggtgaatcagctcgccgtgacgtacgcggctcggacgaccttgggggcgttgaccgagctgcaggacgacggcgtgcgcgtctttgacccggagcagacgtacttctacggcatcagccagggccacatcctgggcggcacgtacgtcgcgctgtcgccgcacgtctcacgggccgtgttcagcgtgggcggggcggacttctcgctgatgatgttccgcgcccggcccttcggcatgttcctggatgcgattgcccagacggtgccggacgcgctcgaccagcagaagttcgcggcgctgacgcagacgtccttcgaccgcatcgacccgctcacctatgcgccgcacgtgctcggcgacctgtatcccggagcgcccgcgtcgcgccgggtgctggtgcagtacggcctgggggatgcgcaggtgcccaacgtggccaccgagctgcatgcccgcgccatgggattgacgcagcaactgcccgccacctggcgcgtgccgatgctgcccgcggaggaggggacggtggagggctcggcgctggtgcagttcgacttcgggctgccgtcgccgctgcccggcacagtggcggacctgccggccgccgacaatgccgttcacgaaggcgtgcgccgggacgacgacggacgggagcaggtggaccggttccttcggccaaacggacaggtggaggtcacctgcgacggcatctgcttgggtggcaactaa

SEQ ID NO: 5491 - DNA, 1011 bp, Myxococcus xanthus
atgaagacgcgcgcactccaccgactggccttgctcgccgccgccgtgctggccgtggccgccccgggctgccggcacgcgcccccgctcgacccgggcctggacgcggatggcgacggcgtcctcaatggggaggatgcctgccccaccgtgcgcgggctcgcgcggctccagggctgccccgcgaaggacacggacggcgacggcgtggaggacgcgttggacaagtgtccgcgtcacgccgggcccgcgtcgcgggagggctgccccatccgcgactcggacgaggacggcgtggaggacgcgaaggacgcctgcccgcgggtgttcggcctgctggagcggcagggctgtcccgtcgacgacccggaccgcgacggggtggagggcgcggcggacaagtgcccggacgagcccggacccgcctcgcgcgaggggtgccccatccgtgacgcggacggggatggcgtaccggatgaagaggacgcctgccccgacgaggagggactgccctcgctgcgcggctgcccggagcgggacgtggacggcgacggcgtggcggaccaccgggacaattgcccgcgagagcggggcgcggtggacaaccagggttgcccggcggcgcgcaagcagcgcgtcgtcatccgcccggaccggctggagctgttggagcgcatcaccttcgcgcccggcaccgccgctctccagccgcgggtccagccggcgctcgacaacgtggcagacgtcctgctggtgcacccgcggctgggtgtcatcgccatcgagggccacacggacaaccgcggggacccggacgtgcagcgggaggtgacgctggcgcgcgcggaggcggtgcgggactacctggtggagcggggtgtcccgccagaccggctggaggcgtggggattcggcccggacaagcccgtcgagtcgaatgagactgcccagggacgcgaggccaaccgccgtctggacctccgggtggtggcgccgcgcggacggccgtaa

SEQ ID NO: 5492 - DNA, 1461 bp, Myxococcus xanthus
atgagtgcttccagccccctgttcggtgatttgctgctcaagctggggattgtctcgcccggtcaggtgcaggaggcgctcgccctccaggccctcaccgggcagcgcgtgggggaagccctcatctccctgggctacgtcacgcgagagcagattcaggacgcgctgggagaggcgctcgggctgcaccaggacaagagcccccttcagcccgcgctgggcgagctgctggtggggctcaagtacgtgacgctggcgcagctcgacgaggcgctcgcgcgccagcgccgcgacggccgcaagctgggcgaaatcctggtggagctgggccactgcacctacaagcaaatctacgaggcgctggggctgcagaaccgcatcgccgggcggcaggacctgccgcgcccctcctctgacggccgtcgccgcgtggtggtggtggacgacagcccgctggcctgcgccttcgtgcaggagggcctggtggcgctgggctacgaagtcctctgcttccaggacccgttcgaggccctggagagcatgggccgtctccagcccgtcatcgtcctcagcgatttggagatgcccggcctggacggcgtggagctgtgtcgccgcctgaaggaaggccccagccacgcggtgcccgccatcatcctcaccgccaacgacgtggaggccgagcgcgtgcgcggcctgcgcgctggcgcggatgactacgtcaacaagtccgcgtccatggacgaactggccgcgcgcatcgaaagcgtggtgcgccgcaccggcgaaacggagcgcatgcgcaagctgttcgcgcgttacacgtccgacgcggtggtggaggaaatcctcaagagcgcggacgcggtggtgctcaccggcgagaagcgcgaggtgacgttgctgttcgcggacatccgcaacttcaccggcctggcggagagcctgcctccagagcaggtggtgggggtgctcaaccaggtgctcgggcggatgtcggacgcggtgctcacctgcggcggcacgctggacaagttcctgggcgacgggctgatggccgtcttcggcgcgccggtggcccgtccggatgacgcgctgcgtgcgctccagtccgcgaagatgatgatggatgcgctgacggacctgcgcatcgaggcggaggcggagtgggcggcgggcgggcgtgagggccagccgctggtgctggagctgggcatcggcatcaactcgggtgtggtggtggcgggcaacattggcagcacggtgcgcgccgagtacacctgcatcggggacgcggtgaacgtggccgcgcggctgtgcgcgctggcgggcccgggggaaatcctggtgggggagcgcacccgcgagctggtggacgccaacgagacggccttcgaggacttgcctcccgtgcggctgaagggcaagcagcagcccgttccactgttccgcgccttgtaa

SEQ ID NO: 5493 - DNA, 423 bp, Myxococcus xanthus
atgaacgcctcgtctgacgagccccctccgtcccgccgctcccccgtgttgttcgtggggctcgtcttcggactcgggttggtggtcgccgtcctggtgggcgcgctgagcggctccaaggccgtgcacgccgaccgcatccaccaggacctcgccctgctggaggaggccctgggccgctaccgcgcggacaagggcaccctgccggaagacgcggacgtggaggagctgctggtgcccgcgtacctgccctccgtgccgttggacccgtggggccggccgtaccgctacacgagcaacggcgaggaagtgttcctgtccaccttcggcaagagcggagaccggggtggctcgggcgaggagcaggaccacaccaaccacgacgggcacgccgtgcccaaggttgagcccgagcggacgtga

SEQ ID NO: 5494 - DNA, 1362 bp, Myxococcus xanthus
atggccatcgtgtgcgtcaccaacctgtcccctgagtccctcgcggctgcccacgtggcggcggccgtggcggggcggctgcaagagtcgctgctgctcctgggcgtcgcggagggcgacgcattcctcgacgacggcaccggcgcgctggtcctcacccagcagcggttggaggcggaggccgcgcggctcgaaacgctcgcgagggtggtgcactaccggctgcaggcgggcacctccgcggacgaagtgctcagtgacgaggagtgccggcacgcgcgctggattgtggtggccgcgtccggctggcgcaccccggcgtggcggcgggccacggtgcccgaacgcctgtcccgttacggctgcgcgccggtgctggccgtgcgcagcgacaccgcgctgaccgactgggcgcggggccgcaggcggctgttggtgctggtgggcgtggaccccggctcctccaccacgggcgccgcagtgtccttcttgcgcgagctgcgccgggtggggccgtgtgacgtgctggccacctacgtgtgctcgcccatggacgaacgggaacggctgggcatccacagccccgtgcacgtggagctgctggagccggcgctgcagggcatggaggcgctggaccccatcgtggagcgcgtgctgcaacgcgaggtgcgcgagcaggtgggggacctggtgggcgagggccgcgtggaggtggtgctggagcccggcttcggccgtccggcggaccacctgatgcacgtggcgcacacgcgcggcgcggacctgatggtggtgggcacgcaccagcgcagcggggtgaagcggctgtggcatggctcggtgtccgcgggggtgctgcggcacgcggcgcagtccgtggtgtgtgtgccccccatggtgcaggcccggcgcgcggaccgcccgccgcgaagcgtgctggtgcccgtggacttctccgaggcctgcaccaaggccatctcccatgcgcgcacgctggtggggcccgggggccgggtacacctgctgcacgtccaccgccgcaagctggaggaccgcggcttcgcggaccactacggcgtgctgcccgagcccgccagggacagggaccaggtgctccagcggctgtgggagttggtgccgcgcgacgaaaccgcccagacggtgcgctggagcgtggagggtgtgacgggcgaggacgtgacgctggccatctgccaggccacggagcgcgaaggggtggacctggtgtgcgtggggacgtccctggagccctcgcgcctgcgggacgccctggagggcgaggtggcccatgagctggtgacgcgttgccgccggcccgtcatggtggtgccctccgcctga

SEQ ID NO: 5495 - DNA, 468 bp, Myxococcus xanthus
atgtcccaggaaaacaccggaaagccgaagcgcggcctgaagcgacccatcgaggtcgttcgcgcggagctgctcaaggatccggagacgaagaagatcgccgaggccgtgagcatgaagctcgaggactacgtggagctggtcctcaagtacgcccaggacaaggacaaggaggccgaggtcgccgtcatctccgacgaggagctgcgccgcaacggcttcaaccccctctcctccgaggaggccgccaacatcctcatcaagggcatgaagggcgagctgcccggctcccccccggacttcgaggcctccaagttcacccaggacaaggcctccaccgccggcaagccgtccctcacctcgcctcccgtgggcggcgccgcccccaccggtccgcaagatccagccgcccgccaggaactgatggatcagctcaagaagggcagcagcggcggtaaccgtccgtaa

SEQ ID NO: 5496 - DNA, 429 bp, Myxococcus xanthus
atgggcgcactcaagtccgttacgaacgtcatcagcaaggtcgccagcacggtcagcaagattgccggtggcattgcgaacatcggcggcaaggccatggagttcctccagaagcccctgagctcgctggtggaccccatcgccaagttcatcggtgacaaggtcggcaagctgcccctggtcggcaagttcctgggccccacggcggagaacctggtgaagcagggcgccgcgtccttcctgggtgagggcacgctgggcagcctgggcttcctgtccaagatcgcccccaaggtgcaggacatcaccaacatcgcgcaggcggtcaagggcgcggcggacaaggtcggcgccttcgcggagaacccgctgggtctgcagaacttccagaacatcatcgcgcagaaccacgcccgcttcgtggagtga

SEQ ID NO: 5497 - DNA, 489 bp, Myxococcus xanthus
atgcccaacctgtcccaggcgaaggcggagcagtacctgccccacctgaaccgggccatggcggaggcgaacatcaccacgcccatgcgcaaggcggccttcctggcgcagctcgcgcacgagagcggccagctccgctacatggaggagattgcctccggcgccgcctacgagggccgcagggatctgggcaacacccagccgggcgacggcgtccgctacaagggccgtggccccatccagttgacgggccgcgccaactaccgcgccgcgggccaggcgctgggcatcgacctggagggcaacccccagcgcgccaaggacccggacgtcgcgttccgcatcgccggctggtactggtcgtcgcgcaacctcaacacctacgcggacgcgggcaacttccgcgaggtcacccgccgcatcaacggtggctacaacggcatggcggaccgcgagatgtactaccgccgcgcgcagaacgtcttctga

SEQ ID NO: 5498 - DNA, 1236 bp, Myxococcus xanthus
atggtcgtgctgggaggctggtcgcgcccggagggctcgaaggaggcgcccacggacgtgctcgaaggcatccgcgcgcgcctgacgcggagcctggagaactggaccgtcggtgccgacgacgtgcgggcggtgcacaccgcgctgggaagtctcccggcgggcacgtaccgggccgcgctggagcgcttgcagcaagacggcctgctgggcgcatacgtgaaggcgcaggacgcgggctcgcggctcgcgttcctggagcaggcggagtcgaagggcgcgctccatcggcgcagcggggagtcgggcccggtgggccccctgggctacccggcggtgccggacgtcttcgtcaatgaccggcggctgccgggggcgatgcgtgacgcggtgaatgcacacgccatcgacgtgggcgcgggcttctaccgggcgcacaccgaatacctcggccggtatgcccgcgcggtggatggggcccagagcctccaggaactgggtgcgctgggaccgccacgcgccgcgcacctgtccgaatccctcctgggcctcgagtggaaggacccgtcgcggcgggactacgaggcggcctggaaggcgggcatcggccagccgaagacgctcaacctgacggtgcaacacgtcagcgcccggcagcgggagctctctggggagcgcgccgggggcacggtgcagcttcacggcaaggtgggtgtcagcagcgagagcgcccagtggagcgcgaaggcggcgctcgacacccggggacacggggaactgaagggagacgtgggcgtctccgcgcgcgcgggccccgtgggcgtcgagctgtcacacgacagctccggcgagacggagaggaaggtcaaggtgaacctgggactcgtggagctcagtctggcatcggacggcgagcagcgggtcgcggtgggtgtcggctcgctgttccaggtgcacgcgacactcaacgcgaagaaagcggagctcgggggcggcgtgtcagcgaagctcaaggcggatgggagccaggccagcgcggaggcgggcttctccatgaagggcctgacggcggagcgggcccagcaatccttcggcccagggcatcggaacgtcttccagccgcccgccgagctggcatcccgcacggcctgggatgcgctgccggagtccacacgagcggcctatgcgaaggaggggtggaatcgggatgcgtggacccgggccttgccgcgctga

SEQ ID NO: 5499 - DNA, 426 bp, Myxococcus xanthus
atggcgacggagcgagcgcagcggttcgtggatgcactggcgaagctggagaaggagggggacctggaggccctcgtctccctcttcagtgacgacgcacaggtgagcaacgtggcctcgccgcaggtcttctccggccaggagggcgcccggcggttctggcgtgaatacaagggcaccctccaacgcgtggagtccaccttccgcaacatgattgaggcgggctcccgcgtcgcgctcgaatgggagacgcagggcaccgcccacaacggcgcggcggtggcctatgaaggcgtgtccatcatcgagtgggatggcgaccggatccgccgcttctacgcgtactttgatccgcacgcgctcggcctggagctgacctccggcaacgcgccgcgctcggaagtccccgccaccacccccgcgtga

SEQ ID NO: 5500 - DNA, 864 bp, Myxococcus xanthus
atgacccgctttgctgccttcttcgtcgtcctgtcgttgattgccgccccccacaccgcctgggcccagcagcgccagaccgagtccgcgaaaaagacccgggcggtgaagtcctcctcgaagacgaaggccacgaagacgaaggccgcgaagccggtcaaggccacgtcgaagcgcaagcccgcgaagaagggcaagaaggccacgccggccgtggattcgaggggcgtgaacgccccggagcttcaggcccagcccatgatgcaggtggagcccgccaagcccctgtctgcgacggacgacgcgcccaccgtccagaagaagtccggggaggccccggcggaagggggcgactcgctggacttcgacctgctggagcccgccgaagccgcggccgccgcgcaggtggacccggacctggagaggcgcattggccggcgccgcacgatgctcaagctgcaccagggcctgggcttcgcgatggccgccggtctggtcggcaccacggtggtgggccagctccagttcaacgactcgttccgcggcggcggtgatgaccgcaacctgctgggcctgcaccgggggctcgccatcggcacgtcggcgctgttcgccaccgtggggctgctgggggtgctggcgccggaacccttcgagaaggagttccagtgggacaccatcaccgtccacaagatgttcatggcgctcgccaccgtcggcatggtggcgcagatcgtcctcggcatcatggccacggaccgttttggccggctgtccgagacggacatggccaccgcgcaccagatctccggctacgtgacgttgggcgcggtgtcggccggcgtcttcacactgttcttctga

SEQ ID NO: 5501 - DNA, 345 bp, Myxococcus xanthus
atggtggagcacctgcggacccacttcccggagcggaccaccgggctggaagcacgcgagctggatgcgcacgtcgagcgcgcactccaggccgcccgcgactatgggctcgcgagccggcgggagctgtgccgcttcctcaacctgtgtggcctccatggctgggacttcgaccggcggccgcgcaacgcctggatgaaggccatgctcacggccccggacgtgacggcccccggcgcccggctggaccggctggtggagcactccctccaccggctggagttggagtcccaccgcacccggctcgagggcgagttcggccttcaccgtagagaacgaaggagc

SEQ ID NO: 5502 - DNA, 162 bp, Myxococcus xanthus
atgacggtgctgttcaagtcggagaagcaggcggtggccgagggtagcttcgacatcagcctggatgcctacaacgtcaaccgcccgtcgctgttgatggtgaaggtggacgacgtcctggtgctggagcccaagctggtattcgaggtggagggtacgtga

SEQ ID NO: 5503 - DNA, 951 bp, Myxococcus xanthus
atggccgagcaatcccaacagacaccgtccgccgtggccgggccgttgctccatctggggtgtcagtcctgcggcgcgcgtctggtgctggagcccgcgctgcggaccacgcgctgtccctactgcgccgcgcccgccgtggtggagcgtcctccggtgcccggtgtgcccgagcctgtcttcgcgctgggcttcgcgctcacgcacatggcggcgaaggcgcatgtggcgcggtggttgcgttcgcgcagccgcttcacgcgctccggcatccgctccgccgcgccgggcgaggtgcgaggcgtgtacgtgcccgcgtacctctacagcgtgctggcgcaggcgcgctaccgcgcatccattggggagaactaccaggagacggagacgtacacgacgacggagaacgggaagcaggtgacgcgcacgcgcaccgtgacgcgcacggagtggcgttcgctggaaggcgagctgaccagctacgtggcggacgtgctcgtcaccgcgtccaaggggctggacaacgcggagctggaggcgctggagcccttcgacctgcgcggcctggctcgctacaccccggcgctcatctccggctgggtggcggaggagccctcgctcacgctggcgcagtgtcaggagctggcccggaaggaagcggtggagcgcgtgggcgggctgttgtcgcgcttcatgccgggggactcgcaccggggcctggagcatcagtcccggctggactgggaggcgctcgatgtgtgcctgttgcccgtctgggtgctggcggtgaagtacgcggaggatgcgccgccgctgcgggtgctcgtcaacgggcagacgggggccgtccatggcgaggcgcccatctcttcgtggaaggtgctgtccgccgtggtggcgctgctggcggtgctggccttgggctggctgctcacgggaggtgggcgatga

SEQ ID NO: 5504 - DNA, 564 bp, Myxococcus xanthus
atgttcgacgcgggcgtggacgtgagctggacggcggactcgaacgcgggctcgcggcggtcggactgggcgccgcacgcgggccggacgcgcttcgatttcgagggcatcccggtgccggcctcgcgcgggttgaaggtgcgggagtgcgaggcgttggcgccccactaccagcgaggctccaggctggacacaccccatggaccggagggcgcgcacgtcgagcgcttcgaggccacgcgctcgggcgcccggcggagcgtgctggaagcggtggagcgcctggccatcgagcgcctccagcagggcgtcattccgggcagccgcttccggaacatccacgtcgccgtggcgctgttcagcctgcgcacccagcggctggccctgcccgtgtacgtgctggcttaccgataccgcgacaagccgtaccgggtgctggtgcacgggcaggatgtgcaggtggtgttgggcgaggcgcccatctccccgttgcgcgtggcggcggtcatcctggcgacgctgctggtgctggtggccgtgttgtacggcgtgggcgtgttgtga

SEQ ID NO: 5505 - DNA, 351 bp, Myxococcus xanthus
atgggcatggccatggaggtctacagtcgcctggagcgcgggaagatgctgccccggacccagacgctgcgccgtctgtgcgacgtgctccaggtctccgcggacacgctgctgggcgtgggccgtcccgacggcgcgcccgtcatgccccgcaagacggtgaaggaagacccggtggagctgcgccgcatgacgcgcaagctgcgggagctcgaacccggtcagctccgcgcggtgtcccgggtggtgaacgccgtcgtcaccgtgctgcctcagccggcggctccggcgcccgccgccccggcgaagcccgccgcgcgtgcggcgcgcaagcgccgggcgacgggctag

SEQ ID NO: 5506 - DNA, 471 bp, Myxococcus xanthus
atgacacagatggagatgcggatgcgcaagctggcgttgctgttgttcgtggggttgtggctgggctgccgtgcggatgggactgactccacggaaggcacactgcccctgcatccccaggagacgtacacgtatcccgggtgcgccaacgaggactacaactgcccgcgcttgaagacggtgcactgcgcgctggagagcctgcgcacggagcgcgatagctgccagcaggacagtgactgcgtggccgtctccgtcaacggccggtgcacgggctatggggagtgccccccggcgatggtgaacaccgccagccgcgcggagttcgcgacgcgggccgccgaggaggtgctgcgctactgcaccgagtctcccatctgcgccagcaccggccagtgtgcctacccatccttcgtgccccgctgcaagcaggggcattgcgtggcggagccaggcgacgccggttcctag

SEQ ID NO: 5507 - DNA, 867 bp, Myxococcus xanthus
atggccctggatggcgcgagcaatgcctacgtggtggactcctccgggcgggtgacccggtacgacccgagcgggcaggtgctgtggaccgcgttggtggctgtcgagaatcccagctggcccgagctcgcggtgagcgccagcgggcacgtctacgtgctgttgagcctgggcaaccatgaaattgcgcgtcaactcaagctcatcgccgtctcgccgcaggctgccgagcgctggagcctgctcttcaatgagggccagttcaactacacctggggcttggcggtgaatgcccagggtgaggtctatctggccggcagtgtgcacaaccgggacgcgacgtccgggcagtcggtgttcgtgaagtcctacttgcggaagtacagcgccgagggcgccatccggtgggagactcaggacatcgggagcctcttcgccgtcaaccccgagggcgcgacgagcaccctctcccccggggacggaaccaccgagggcttcacccagcggtggattggtgcgaacgggatgacgcagtggaacgcggcggtctcgaacgtgccgggcgtggtcaccctgcagaccttctcgccctccggcacgctgctcatcggcgggcacgaactcctcgcaggcggaacggagattggtcgaggctggttcgcggcgatgaacctcacgacccgcgcgctcggcccggtgacctatgtcgaggggagcacagggggcggaggcccggtccgtatcagcggcctcgcgctcaccccgggaggtcatgtcgtggtgaccggtggcttcagcgccacttgggaccaggacgggggcttcatccgggtgtacgacgggcgcgtgctcacgggcgtgccgtag

SEQ ID NO: 5508 - DNA, 378 bp, Myxococcus xanthus
atgacgacccttcgcaaggtgatgctcgttgacgatgaagatgacatccgcaccatcggcaatctcagcctcagccgtgtggggggatggcagacggtgctcgccgcgtctggcgcggaggccctggagaaggcccgcacggagaagcccgacctcatcttgctggacgtgatgatgccgggcatggacgggcccaccaccttcggccggctgcgcgccgaggagtccacggcgcacacgcccatcatcttcatgacggcgaaaatccagaaacaggaggtcgcccgctatctggagctgggcgcgctgggcgtcatcgggaagcccttcgacccgatgacgttgccccaggagattcgcgagttggtgccagggtga

SEQ ID NO: 5509 - DNA, 2448 bp, Myxococcus xanthus
atgggccgtccatgggccacctccgacaatgaccgctaccgcagtgcgctgcggcacctgcgcgtggccagcggcgacctggagatggacgtgctgcgcgaacgcatgggcctgcgcacgcttcacggctcggacccggaggacttcgccgcgctgagggcccgcgcggacgcgctgcgacagttcccctccttcctgtccgccatggaccggcgcacgatgaacgcggcgctggacctgttcgtcagcgcgctggaggagagcgccgcgctgctggagcgagcccgcgccgcggacgcgcggggtgagaaggaagcggcggacgcggccgtccaggccctgttggagggcaccgtcagcacgcgggcggagcgcctcatcaacacctacctggagctctacgagcgcacgcaggcgcgcaacgagcgctcgcgcatcatcttcttcatcgtctccctggcgctggtggcctacgtgctggtggtgatggtgcggctgtctagggccaccgccgacctggccacgctcaacacggatttggagcggcgggtggaggagcgcaccaaggccttgtccgccgccaacgacgggctgcgcgccagcgaggcacgcaaggccgcgattctggaggcctctccggacggcatcctgctgctggacggcggcggggacttgctggagctgaacccctcggcgcagaagaccttccaggtggtcgccgcggacgtggtgggccgcgacttcctctccgtggcgctcccggcggagctgccggacggtgcccgtcagaaggtgctggccgcggggcggaacaccgcgtcggggcaggccacgcggttggagtcgccgtgtctgcgcagggatggcagcaccttccccgcggagctgaccatcgtccgcgtgccgggagaaggtccgcctcgctacaccgtcttcgtgcgcgacatcaccgagcgcaaggcggtggagcggatgaagaacgagttcatctccaccgtcagccatgagctgcgcacgccgctcacctccattcgcggctccctgggcctgctggagggtggcatcgtgggcgatattccgccccaggcgctggacatggtgcgcatcgcccgcaccaacaccgaacgcctcatccgcctcatcaacgacatcctcgacctggagaagatggaggcgggcaagctggagctgaaggtctccacgccggaatgcgcggacctggtggagtccgccttcgcgagcgtccggggcatggcggacggcgcgggtgtctcgctccacgccgaggtgacgggcacgccgcaggtgaaggcggaccgggaccggctggtgcaggtactcaccaacctggtgtccaacgcggtgaagttctccccgcagggcgcgggagtgacggtgcgcgtgggggaagaggaggacgggcgggtgcgtttcagtgtggtggaccagggccccggcatctcccaggagcagcgtgcgcgcctcttcggccgcttccagcaactggacagctcggacacgcgctccaagggaggcacggggctggggctggccatctcgcaggccatcgtggagcagcacggcagccgtatcaccgtggaaagcgaggagggccggggctccaccttcaccttcacgctggagtcggcccggcccgcgtccgtcacgccgccgcccgtcatccccgaggacgtgtcccgccatgaggtgctggtgaccaccgcggacgcggagctggcgtcgctgctgggcgggctcctcgcgcacgaaggctaccgcgtggtgcgcgccaccagcctcatcgaggcggcgaagcatctggacacggccctgccggacgcgctggtggtggacatgcggcttccggaagggcacgcgctggactgggtgcggcgcctgcgcgaacagccgcgcacgcacgagttgcccgtgctggcgctgtccggccgctcggaggacgcggagggcgttccgcactgggtggattggatgcctcggccattggaagagtcacggctgctcaagtcgctgcgctacgccacacggcagccgggccaggcgcgcgtgctggtggtggatgacgacgccagcacccggcgcacgctgtgcgcgcagatggagcggctgggcgtgcaagtcttcgaggcggcggacggcgagagcgcggtggaactcgcgcgcgagacgacgccggacctcatcgtcctggacgtcggcctgccgcgcctggacggcttcgaggtcgtcgacatcctccgtcaaggcaagggccgcgccacgccgctcatcgtcttcacgggccgggatttgacgcgcatggatgagcggcagctcaccctgggcatcacccggcacttcaccaagtcgcgcgcgtcggaagaggagctggtctcctccgtgcgtgacctcctcaacggcctgctggcgagaaaggcacacccctcatga

SEQ ID NO: 5510 - DNA, 2022 bp, Myxococcus xanthus
atgagcagcaggacactcctgttcctggaggacgacaaggatttgcagtccctggtgggcaccttcctgcgtgagaagggctaccgcgtggagcccgcgcgcagcgcggcggaggcgcaggccgtgctcgcgcgcgtgccggtggacgccgccatcgtggacggcctgctaccggggatgacgggcgcggacttcattcgcgagctgcgcaagacacagcccaagctgcccatcctcttcgcctcggccttctggaaggacttgaagagccatgagttgctcacgcggcaactgggcgtggtgcgcatcatccacaagccctacaagccggaggagctgctcgtctgggtgaaccagctcttccccgcgcccgccctgccgccaccgccaccgcccgaggcgttggaggaggcggaggaagtgaacgtggaagtggacgacctggccgccagcctcgcggcgctcaacgcggagtacggcgcccggctgaaggagaaggtggcggcgctggaggcgctgctcgttcgcgggcgcgggggtgacgcggcggcgctggaggaggcctacacggttgtccacaagttgcacggaaccgcgggcagctacggctttgcggaggtgagcatccgggcgggccaactggaggcggtgctcttgccggcccgggctggggcgcccgtggatgtggcggcgctggacgcgtccttccgcacgctggccgccgcggcctccgttccggtgaagcccgccgccgcgccgccgcagtcctccgagggcgtgctgctggtggtggacgaggacgcgaagctgctggccgaagcggagcgcatggggcgccaggtgggcgtgggcgtggtgacggcgcgcacggcggacgcggcgtgtgaggtggcgcggcggcagtgggtggatggcgtgctggtccacctggacctgggcgggccactgggcggcctggccgtggcgcatgcgctgcgcgcggaggagagcctgcccgtgctgccgctggccgtcacgggtgcccgggacgtgctggaggaacgggtggcggcggcgcacgcgggggcgtccctcttcctgccacggcccttcaccgcgcgggacttctccgccgcggccgagcgcatggtggcggcgcgccgcccggagcgcgcgcgggtgatggtggtggatgacgacccggatgccatcgccgcgctgacgcaggccctcgccagcgaccagattgaggtggtggggctgagcgacgcgcacgggctgatggaggcgctggcgcagcaccggccggacctgttgctgctggacgtgcagatgccggggcccagtggcttcgacctgtgccggatcctgcgctccacgccggagtggcaggagctgccggtgctgctgattaccgcgcacctggggctggagttccggctggcggccttccaggcgggggcggatgactacctctccaagccggtgctgcgcgaggagttgcgagcgcgcgtgcaggcccggttggagcgcacgcgtctgtctcgcgagcgggcggagcgggatgggctgacgggcctgctgctgcgccggcccttcctggacgggctccgcgcccggctggccgagtcgcggcgccagggaaagccgctggccttgtgcttcctggacgtggaccacttcaagcaggtgaatgaccgctacggtcacctggccggagaccgcgtgttgatgtggttgggccggctgttgggcgcgcgcttccgccgcgaggacgtgcgtggccgctggggtggcgaggagttcgtggtggggctcttgggagagagcgcgggcagcgcctcggaaatcctcgctcgcaccgcggcggagctgtcggacatgaccttcgacggcgacaccggcgagcccttccacgtcaccttcagcgcgggcatcgcggtgtcgccgggggacggcgacacggtggagtcgctgctgcggaccgcggacgcgcggctgctgcgcgcgaaggagaacggccgcaaccgcatcgaggcgtga

SEQ ID NO: 5511 - DNA, 888 bp, Myxococcus xanthus
ggcatctaccgggtccacaagccggtgggcgccacgagcttctcggtggtgcagcggttcatggaggaggcgaaggccgtgcagccgggcaagcggataccggtgtgccacggcgggacgttggaccccttcgcggaagggctgctgctggtgttggtggggcaggcgccgcgcctgttcgagctgctgcacgccgtgcccaaggtctacgaggccgaggtcgtctggggtacggagacggacacgggggacctgcacggccggcccgtcctccagggagacacggcggcgctgacgcccggggccctggacgcggcgctggcgtccttcgtgggctggcgggagcaggtgcctccggccaccagcgcgaagaaggtggggggcgagcctgcctaccggaaggcgcatcggggagaagccgtggagctaccgccctcgcgcgtgtacctgcacgccgcgcgctggctgtcccatgacctgccgcgcgccagccgcctgtggctgagctgccgtgggggctactacgtgcgctcgctggcccgcgacgtggggcgcgcgctgggctgcggggcgcacctgtccaccctgcggcgcacggcgattgggccgtgggaggacccggggctggggcagcgggtgtggctgcacggacgcgacctgttgccctgggcccgcgtgcggacgctcacggacgcggaggtgggcgagctgcgccgcgagcgccccgtcccagcgagcggcctccagccggcggattggacactgccccccggcttcccggacccggaggcccccattcggggcttccaccaggggtgcctcgccttcctgctacgggagcgcgacggcgcgctgtggagcgagctggagctgcgcggagggctgtag

SEQ ID NO: 5512 - DNA, 1854 bp, Myxococcus xanthus
atgggcgcgcctccgccgtggcaacgcgtcatcgagcaggcttacgcgtcggagatatcgccgcccttctcctggccggagcccacgccaccgggcgcggccctgctcggcctggtcgagccactcgtccacgcggcacacgcgcggctcgtctccgccctggacacctgcctgcgtgacacgcccgaagcgccgttcgagccagagcacacggcccgcatgttgctcgcgccgctccctcggatgttgatgcccttgctgggacggacgctcgcggtggagctgcgcatcgctcagctcgaaggacgactccagggagacacgcccgaagcgcgcttcctggacttcgcccagcacctccggcgacgcgacgtggcgctcgacatcctcgccccgctacccggtgctcgcgcgggcaagcccgtggagtacgtcaccgcgtgggaagccacgggcgtggagctgatgcagcgactggcccgggacgccgcggcgctgtggcaccgcttccacggcggcgttcctcccggcctgctggtggaggcccaaggcggtctgtcagacccgcaccgaggtgtacgcaccgtcttcctgctccgcttcgcctcgggactgcggctcgtgtacaagccgcgcccgctcacggcggaggccgtcttccagcaactcctctcctggctgaacgcacgcggcctcacgcctccgttgcgcacggtggaggtcctctcctcggacggctacgggtggatggagtacgtggaggccgcgccctgccagtcggccgaggaagtgcggcgcttccatctgcggcaaggcgccctcgtcgcactgctctacgcgctggacgtcaccgacatccattacgagaacctcatcgcggtgggcgagcaccccgtcctggtggacctggagacgctcttccatccccacacgctcgccgcctccatccgggacgtggagaagcaacccggtgcggtgctgaacggtacggtgctcaagagcgggctgttgccgcaacccgcctggcgcgcgaaagacggaacggaggtggacttcagcgccctgggcgccggcgagggccagctcacaccactgggctacctggtcgcgacggcgcatggcacggaccagctccgcttcgagcggcggcggatggagattcctggcgcggcgaaccgtcctcgcatggaaggacaggacgtctccgtgacggcgcaagcggacgcgctcgcgcaggggttctcagccctgtaccggctgctcgccgagcaccgggatgcgctgctcgcccctggagggccgctcgcggcttttgagcacgcgcccgtgcgtgtgctctttcgcggcacagccagctacgacgccctgctgcacgagagcatgcatccccatgcaatgggggacgcgctggaccggcagcgcttcttcgaccacctctggctggccgtgaaggagcgcccatacctggcggccctcatccctttcgagcatgaggaattgcagcgcggcgacatcccccgtttcaccgccctgcccggctcgaaggacctgtggtcaggcgcgggccgccacctgcccgacttcttcgacgactccggcctggagcgggcgcggcggcgcttgacggggctgtcgccggatgaccacgagcggcagctcggcttgctgcgaagcgcgctcggccgggtccggttggcggcaagccctggcgaccgccctcgctatccgttccgcgagccgcccgcacccgcgcacccagacgctctgctggcggctgcacgacgcgtgggagagcgattggttgccctgtcgttcaccggcgcgggccattcccactggctgtcgctcgagatg

SEQ ID NO: 5513 - DNA, 411 bp, Myxococcus xanthus
atggcgatttccaagcgggggctggtggacagggtgaaggaggtgcccgtccaggcaggcacgcgcggcgcgcgggtcctcctgggcaccgcggtggtgactgcgcggggagtggccaacctccagtccaagattcggggcaccccggcccgcggccgcgtgaagacgtcggcggcaacggggacgcggcgcacggccaaggcggcccgcggcgtcatcgagagtggcaagcccacgaaggcccccgcgcgccgcaaatcaccgtccaccaagacggcctccgcggcaggagcgaacaatcaggtgggccgcaagtccgtgcccggacaggccgccgccgccaggcgcggcaccgcgaagacgccgcgccccgccaccagggcgaagcgcgggcagaagcaccggcactga

SEQ ID NO: 5514 - DNA, 375 bp, Myxococcus xanthus
atggtgggcgtgcaggacgccaccgcgtcccatggcgccgggctccagttggtgtcgttctccgtggatccgaagtacgacaccccggagcggctcaccgagtatggcgagcgccacggcgcggacttctcccgctggagcttcctcaccggcgactacgagcagttgaaggagaccatcgtccagggcttcaaggtcagcatgggccgagagcccggcgcgcccgaggacgacctgctctccatcttccacgggacgcacttcgtgctcgtggacgacgccgggcagattcgcggctactacgacagcgcggacagcgactccaccgagcgcctcatccgcgacacccggcgcctggcccagacagggcactga

SEQ ID NO: 5515 - DNA, 552 bp, Myxococcus xanthus
atgacgctgccgggggatgccagtgtcctgacggggagcgccggcatcacggtgcgcaccgcggcggtggaggccctgctggagttgggctacccgtatgcgctggaggtccccccggacgccctggagcgggcccggagtgagcagaggctgccgacgacggcggcccccacgtcccgcctcctccgctcgcccatcctggcgacaaccgccacgctcctctgcctggcgttgcagctcatcctgatggccctcccggatgtccgcacgctcgacgatgtgggtgcgttgctgacgccctacctactgcccgtcatcgcgcccgcgctactggccatcctcggaacctggacgaagacgcgcccgctccagtacctcggaagcctgggcctggggatccagggcctgttctggttcggcggcgtcttcatgctgacgcggatggcgtcgaaagtgccgtggctgtgggtggccgcgccctggtacctccccttcatcgcctgctacctggtgtggcctcgccccctgccgccccccgaggcggattcctga

SEQ ID NO: 5516 - DNA, 228 bp, Myxococcus xanthus
atgacggatgacgtggaggccgtcacgccggacgacacgctccatgacgtcatcgggctgatgggacgccgtcaactgcgccgcatccccgtggtggagcgtgacgacggcatcgtgggcatcatctccctgggcgacatcgccttgcgcgccgaccacgacgaggagctgcaacaagccctggagcgcatctcctccaagcgctccttctggagccggctcggctga

SEQ ID NO: 5517 - DNA, 855 bp, Myxococcus xanthus
atgctggacccacgcgccatcttcgagcgcatggtgcaccagttggcgcccacacccgaggcggcgcgagcgattgtcgaccaccgcctctaccgcttcctgtcggagctggtggcgggcgtacaggagtacgccgccgccgaggccctggacgccttcctcacggacggccgttacgagctcatcctgctggacacgccccccagccggcacgcgctggacttcctggacgcgcctggccggctggcgcgcttcctggacgaacgcatcgtgtcgctgttcggcccggagaagcgggcgcgcggcgggcggctgtggcacggcgcgcaggcggtggtggaccgcgtcctggcgggcatcttcggcgcgggcttcacccaggagatgcgcggcttcatcggtgccttcggcggcctcttctccggcatgcggctgcacacggagcggctgcaccagcggttggcgtcgccggacgcggccttcctgctggtgacgtcccccgaacccgcctccctgcgcgaggccacctggttccgcgagacgctggccgcgcggggcctgcccttcgcgggctacgtgctgaaccggagctgggcccatgacgacgtgctcgcggcgccggaggcactgctggagcacacgggaggcgaccgtcacgcggagcaggcggtggcggcgctgtcccgcctggcctcggtggagcaggcgcgggcccaggcccaccgcgacgtgctcgaccgcctcacccggcaccttccctcggggacgctcgcggtggccgcgccggacgcgggcgcggagctggaggaattcagcggcctggtgcgcctgggtgacgcgctggccgcggggtga

SEQ ID NO: 5518 - DNA, 585 bp, Myxococcus xanthus
atggggctgatgtaccagttgctggccctgctccggcgcacgcggccggatggacgcttcgtccatccgctgaccgtcgtcgacctgcccgccacgggacacgcgctggcgctggccgccttgccccagcgcgtgctgtccctgatgcccggagggcccatcggacgcgacgtgcgggaggggctcgacttcctccaggatgcggcgcgcaccgcgatggtcctcgccagcctgccggagccgctgcccgtcagcgaggcgctcaccgtggccgccgagctgcgccggctggagctgccgctgtccgcggccgtcctcaaccggatgccggaggaccccttcacgcccgagtcccgcgccgccctgcaccggatgctcgccgcgcacggaccgcaccaggggtggcgtgagctggagcggctggagcgggcccgggccgcctccgtccggctgtcacgcgcgctgcgcgcgccgctgctcaccctgccggagctccacgccacgggccccgcgctggtcgaggcgctggcggagggcttcgcacctcatccggagcacgcgccctggcaggaggccctgccgtga

SEQ ID NO: 5519 - DNA, 1221 bp, Myxococcus xanthus
atgagcaccgagcacgccgcccccgccctctccacgcgcgacttcatcgacctggaggagcggtatggagcgcacaactaccatccgctggacctcgtcatcgaacggggcgagggctgctgggttcatgacgtggagggccgcaagtacctggactgcctgagcgcgtactcggcggtgaaccaggggcactgtcacccgcgcatcctggagacgctgcgcgagcaggccgcgaaggtgacgctgacgtcacgggccttccgcaatgaccagcttccccacctctacaaggcgctgcgcgagctgtctggattgagccgcgcgctgccgatgaactccggcgcggaggcgtgcgagacggccatcaagctggcgcgcaagtggggctacaccgtcaagggcatccccgaggacaaggcggaggtcatcgtcttcgcgaacaacttccacgggcgcaccatcagcctcatcagcttctccaccgtgcggagctaccggcagggcttcggccccttcacccccggcttcaccgtggtgccctacgacgacgtggaggcggtgcggcgcgccatcacccccaacacctgcgccatcctgatggagcccatccaggcggaggccggcgtgctgattccgcgcgacggctacctgaagcaggtggccgagctctgcaagcagcaccgcgtgctgttcatggtggatgaaatccagacgggcctggggcgcaccgggaagacgtttgccttccagcacgaggacgtgcggccggacgtcatcgtggtgggcaaggcgctgtcgggcggcttctacccggtgtccgccgtcatggcggatgacgaggtcatgggcgtgctccgtcccggcgagcacggcagcacctacggcggcaatccactgggctgcgccgtggcgcgcaccgccctggacgtgctgcgcgacgagcgcctggtggagcgctccgccgagatgggcacgtcgttcctggccatgctgaagacgctgaagaaccgccacatcgtggaggtgcgcggacgggggctgatgattggcgtggcgctggacatctccgcgcggcccgcctgcgaggcgttgatgaaggaaggcgtgctctgcaaggagacgcacgactccgtcatccgcctcacgccgccgctcatcgtcacccaggccgagctggactgggccttcgagcgaatcaagaaggtcatcgaggcgctgtag

SEQ ID NO: 5520 - DNA, 684 bp, Myxococcus xanthus
atggcggaaatccgtgaactgtcgcgtgtgtccgtgaacaagttgggcgagtacctcgtcgccacgcccgcgcgtcgcaagcgcatcatccacgaccagaagcacccgccggagcagcagtatctgcgctacccggaggcgtcgcatgctattacggacttcctctgccggggcatggacctgtccatcctccgtgagcaccagcgccgcttcgcgtgcagcgtgccccagtcggagttcgaggcgcagcggctgcaactgtgctcggaggcgctcgagcgcttcgcggacctggtgccctggctggatttggaggagacgctcatcagcgcggtgggcgcggagcctcccgtgctggaggtggcgggcgtcaccatcagcgtgcggccggaggtcgtgctccagcgcatggacagacatggcaacgcgcgcgtgggcctgatgaagctgtacttctccaagcaccagccgctggatgagcgctcagggcagtacatcggcacgctgctccagcgcttcaccgagcagcacctgtgcccgctgggcccgtgtgaccaccgcctcatccaggtggtggacgtcttcgcggggacggtcttcaccgcgccgcgggcgcacatccggcggctgagcgacgtggtgctcgcctgcgaggaaatcgcggagcgctggtccgtccactga

SEQ ID NO: 5521 - DNA, 309 bp, Myxococcus xanthus
atggctcagcgcgacaagcagcaacagccgggcatccagccacccgaggattactacggccgtacggaggaaccgcggcaacacgctccggagacagaagagagcgaagagaagcgcgacctggcggacgccgccgagtcgccggaagtcacgcatcgcatgcgcaccatcgacccgacggagcgcacgcccggcgccatcctggatgagattggggacggggatggtccgcgcagcgacgccggcaccaacccattgcccgacacctactggagcgcctacccctacggcgaaccccagagagagtga

SEQ ID NO: 5522 - DNA, 1095 bp, Myxococcus xanthus
atgctgctgaagctctaccgcggcgcgcctcacgtggtgatggagtacgtggaagggcgttcgctggacacggtgctgaacctggcggccatgcggcggcgacccctgtccgcggagttcgcggcgcacgtgacggcggaggtggcggatgcactgagccacgcgcacggcctcacggatgagtggagccggccgctgaacatcgtccaccgggacgtgagccctcggaacatccgcgtgggcgtccatggcgaggtgaagctgacccacttcacggtggcggcctcgtcgctctccgggcgcgaggtgacgagccaggagctggtgaaaggtgacatcgcctacgcctcgcccgaggcactgcggcgacggaaggtggatgcccggtcggacctgttctcgctggggctggtgctgctggagctgctgacgggccggcacccgttgatggtggatgacctggcgcccgtgctggagtcggagccgctggagcttcacgcgcaagggccgacgtggatgcccgtgaaggaggtggcggcgcggatggcccaggtgggcccggagcaggtggagcggttggcggcgggtgtcgccgagcccctgcggtgcatcctgctgcgggcgctgcggcagaacccctcggagcggttccagacgggcgcggagatggcggaggcgctgcgcgcgtggctggattcgcagggaggccaccggggccgtcaggccatcgcgcaggaggtggagcaggccgccgtggaggcgacggtccggcgcaaccaggcggagctgctcgagggcgggctgcatccggaagggctgaccgtggaggaagcggccctggccggagagccctcgtccgagacgcccctgggcgaagccgcggggtccgcagtccgattgtcacaggtggccgagctgacgctggaggcgcgcatcacccagacggtggaacccgcagcggacgtgcagcacgccgccacggaggcaccggacgaggcacgccccgaggcctcctcatcccagccgccttccccaccggagccctctgacacggcccctgagtccacgacgcccgaggagcccgacacaccgtga

SEQ ID NO: 5523 - DNA, 1227 bp, Myxococcus xanthus
atgggcaggctgctgttcctcctcgtcttcaacgtcagcgcctgggccgtgctccggtcgctgtggcccggcctgctccgaaagtggcgcctgggtgccttcgcgctggggaccttcctgtccctggtggcgtggctctactccgcggtggccggacggcacgcgcagcttcccgtgggggatgcggccctgcgcgtcttctccgtgggctggtccgtcgccatcatcatgattgtcctcgccggcgcgcccttcctcctgctgcgcaggtggctggaccggcccgcccgccaggagccgcccctcaccgcgcccgaggccaaccccgccccgccggtgaacatggcgcgccgcaacctgctgacgaacgccggccgcgcggtgccgctgctggcggccgggacgagctcggtggggctcgccaacggctacacgcagttctccgtccgcgaggtcgacatccacctccccggcctgtctccggcgatggacgggttccgcatcggccagattacggacgtccacgtcggcacgttcatcgacacccagtacctgcaagacgccgtgcgggcgatgaacgacgccaaggtggacctccaggtgatgacgggggaccttatcgacgacctggaccagctcgacggcaccatggcggcgctgtcggagtgcaaggcccgtcacggaatgctcgccatcctgggcaaccacgagcactggcgcggcctggaggccatccgccaggcctacgccgacgtggaggcgcgaggcggccccgttcgcctgctggtggacacgtcccatgccttcgagcacgccggccagcgcgtgcgtgtggtgggcgtggactaccccatgtccggccgcagtcaccgcgtgaaggcggagcgcatgcagcagtccgcggaggccggcttccgcgacgtggcgcccgaagaggtggtgctctgcctgacgcaccatccggacttcttcccgctcgcggccgagcgcggcgcccggctgacgctggccggccacacccacggcggacaggtggccttcctgggcgtcccggccttgtggttcgtcttcaagtacatgctgggccgctaccgccagggcgaccaccagctctacgtgtccggcggaacggggcactggctgcccttccgcatcggcgttccgacagaggtgacggtcctcacgcttcgcgcgacgggggcgtcggctgctggccgtacgtcttga

SEQ ID NO: 5524 - DNA, 951 bp, Myxococcus xanthus
atgcgcctggagcaccccaacgtcgtggagctgctgggctaccggcggtggccggatgcgcgcgatggctacctggtcctcatcatgggttacgtggagggccccaccctgtccgagtgggccctggccgcgcagcccacgccccggcgcgcggtgcaggtgttccagcagttggcgctcacgctggatgccatccaccgcgcgggcgtgctccaccgcgacatcaagggcaacaacatcatcattcgcgcgtcggacgggcagccggtgctggtggacttcggctcgggggaccatgcgtgctcgcccgtgctgaccgaggacaccctgccgccgggcacccccagctatcgcagcccggaggccctgcgcttctgggcgcagcctcggcccgcgggctcgcgttacgcgttcgcgcccacggatgatctctactcgctggggctggtgctctacgaggtgctcaccgggagctttccctatccgacgcagctgccgcccgccgggctgctggccagcatcgagtccggtggctttcccctgccctctgtccgcaacccgcgcgtcccgaaggcgttggacgccatcgtggcgcgcttgctgtcgccctccgcggcggggcggcctccttcgggagcggccctgttcgacgcgctggacgcggcgctggcgggcgcggactcggcctgggatgagcacctgtttcctcctctcgctcccgaggaggccgtcaccgaggaggcgctggagttcttcgacggggacgaggaagcgcgcgagctgcgccactggatgcgtgtcccggagcgagcgcgcccgccagcgtccttcgcgccgcccacagagcccgcctcaccctgggctttgacagaggtccgcgcgagcaccgggtggcggcggtggcgggacgcgctgaaacggctctgggccacgctgcgctcgtggcgctga

SEQ ID NO: 5525 - DNA, 1461 bp, Myxococcus xanthus
atggaggccgcggagcgggtgaaggtcgtggatgtgaacgaggccacggtacgcctgctcgaagcgcgcacccgggatgaggtgcttcgcaccttgtccctgtcccggtcccgcgtcttcgtcccggagccgttgaaggccttcaccgccgagctcctcctgctctgggaaggcggcacacggttggagctggagaccgagctccagaccctggggggccgccacatcgaggtgatgctcaccctgacccggccgtcgagggagcggagcgaccgggtcttcgtcaccctgcgggaggtcaccgcgcagaaggcgtcccaactggcacgccaggagagtgaggcccgcttccggaacatggcggaccacgcgccggtgatgctgtgggtgacggacgtcaccggccgctgcatctatctcagccggacctggtacgagttcacgggacagacggaggcagaaggcctgggcttcggctggctcaaggccgtgcatcccgacgactccgagcattcaggggcggtgttcctcggcgccaacgcgcggcgcagccccttccggctcgattaccggctgcggcgcaaggatggtgagtaccggtgggccatcgactcggccagcccccgcttcgggctgaacggcgagttcctgggctacatcggctccgtcatcgacatctccgagcggaagcaggccgaacaggagcgcgagcggctgctggccgccatggatgaggccatccggctgcgcgacgagttcctcaccgtggccagccacgagctcaagacgccgctgacgccgctcagcttgaagctgcagacgctggcgcgggccacccaggagcggcgcggaccggagctgctggagcggctgcccgcggacctggaggtcatgcagcggcaggtgaagcggctgtcgacgctggtgggcgagctgctggacgtgacgctcatcagcagcggtcatctgcacctggagctggagccggtggacctgggagcgctggtccaagaggtggccgcgcgcttcgagggtgagtcccagcgcaccgggacgcccatccaggcgaagctggacgaggtggtggtgggccagtgggaccgggggcggctggagcaggcggtatcgaacctcctctccaatgccctcaagtacggcgtgggtcaccccgtccacctacaggtcggcaggacggcggagcacgcctggttcagcgtccgtgacgaaggcattggtattccccccgaggcggtgggccgcatcttcgagaagttcgagcgcgccgtctccgagcggcactacggcggactgggcttggggttgtacgtcacgcggcagaacgtccaggccatgggtggaaccatcgacgtgcgaagcacgctgggccagggcgccaccttcacggcgcgcctgccctgccagatgtccaacgtgaacgcggcgcgggaaaaggcgtcatga

SEQ ID NO: 5526 - DNA, 1377 bp, Myxococcus xanthus
atgccagactgtgacttcggctcgctcgcgggcctggagcggcagggcgccatctaccgcgcggaaatccggtacgagacccaggtgcagcccggcaccgtacgagtcctcccggagaacggtggtttccagttcgatgcatcgggccagcccatgtccgtcatgggacgcaagccccatgcagccaccatgaatggcgagcggttcttcatttcctccgagcccacgagccaaaccgggctccaagaccgctacacgttcatcggctgtcacgcccaggggccacggagcctcaccggctgcgttctctggtgccgaggcagcacactgcgccagagcggtagcttccgcgccgagcgcatgacgtggcgagagggcgagcccgagtccgccaaccttcagctcctgtccgaaatgcccgtgggcctggacacgcctgtggacgtgtatgtcacccatggccacgcctatgtcgtggccatcgaccggcgcggcgtcggcggcggcctcgccgtcttcaacgtgagcaatccctacatccccgtccagcagacggtcatccgcttcggccatagcgactactggaatgccgtgtgggctcgagacaatgcgctctacgtaggcagcgcgcgctccggcctgctcgtgttcgacctggccgacccgcggttgcccgccttcgtgcgcaaccaccccagcggtggcagcccagtcgacgtgcacaccctcttcgtggatggaaaccggctctatgccatgtcgccatcccacaagcagacgctcatcttcgacatcacccaaccgctggagcctcagctcctcacccgcttcacgtatcccagaagtgtgggctatccgcatgacgccttcgcgtatgaggggcgcctctacatcaaccacctcgacgatggcttcctcatcgcagggctgggcggcgagacaccggagttgctcggccgctacacctatccccatgccttcagccacgccaacgcggtgggtaccttcaatggccgcaccgtggccttcgagggcggcgagacgatgggctcccatatccgcgtgctggacgtcaccgacccggcgaacatcgtgaagattggtgaataccgcctgcggggcctcacctccgtccacaacatgctgctggtgggcacgcggctctacgtcgcgtactaccatgagggcgtgcgcgtcctggacgtgtccaatccctcgcagcctcgcgaaatcgcgcactacaacaccttccgggagtcagaccggaaccggacagacaagctgaccgacggcgccatcggcatccgcgtgccgggagacggccgcatctatgtggtggacacgtcgcgcgggctgctcatcttcaacgagccgtga

SEQ ID NO: 5527 - DNA, 237 bp, Myxococcus xanthus
atgattctcaagggcgagcggctgtacgtcgcctggtaccacgagggcgtgcgcgtgctggacgtggccaaccccacccagccccggcaggtggcgcacttcaacaccttcagggagacggacccgcaccgggcggacggcgccttcgagggcgccattggcatccgcgtgcccggggatgggtacgtctacgtcgtcgatacgtcgcgcgggctgctcatcttcaacgagccgtga

SEQ ID NO: 5528 - DNA, 222 bp, Myxococcus xanthus
atgacgtccccgcttcgcccgggatgggtcctgctgtccgtcctgatcctgctgctgtccgccaccactggctgtgatgacgacccgcctccgcccattcccgacgcggggcagcagcccacggactccggcacggacgcgggttccgaggacgccggaacggacgcggggcccgaggcgccctgggatgggggctacaccgtgctgggacgacccgggtga

SEQ ID NO: 5529 - DNA, 1848 bp, Myxococcus xanthus
acgctggcggagacgcgtggcgaactggaggccacctcccagacgctccagcagacgcatgcggcgctggaggacacgcgcggcgcgctccaggaaaccagcgacacgctggcgcacaccacccgcgagcgcgaccagcgcatcgcggagctggcggacctgggcgccgcgaaggacgcgctggagcaggagctcaccgggcagattggtcatctccgcagcgagctgtccgagacgcagggcaactacgaggccgagcgggccgcgcacgagaagctggccgcggagtcgagcgcgcacatcggagacctcaccagtgagcgcgacggactccgctccgagctggaggccaccagtcagacgctggagcagacccacggccagctcgccgccacccgcgacgcgctggcgcgcgagcagcacgcgcaccaggagagccggaaggccgccgcgagcacccagaccacgctggaaggccagttggccgaggcgcgtgcccatggcgaggacctgggcgagcacctcaccctcaccaagcacgagctgggcacacgcgtcgccgagctgacgcagctcaccgccacgctggcgcagacggagaacacccgggcccacctcgaggagcggctgcacacgctcaccgaggagtcgcagcgccgcgaggagctcctccagaacgacctgacgcagaagggcaccgagctgtcggacacgctccgcaagctcacccacgtgacgcaggagaagatgcgtcaggcggaggtgctcaaccgcgaggtcgccacccgcaccgagcagctcaaggccatggaggccaagctccagacgcaggccaccgaggcccgccgtcaggccgagggcctggggcagcagattaccggtctcaacgagcagctcgaacagggccgcaaggcgctggcgggccgcgaggaccagctgcgcgccgcgggcgccgcccagcagaaactcaccgccgagcgggacggcctcgcgggccagctccagcaggccgaggcccggctccagcagcaggcccagcaggcgaaccaggaacgtgccgacgccaagcgcgcggcggacgaactggccgcgaagctggccaagaccgagcagcgcatcacccagttcgcgcaggacgcccagacgcaggccaccgaggccgacgccagggccaaggacctgcagggccagctgagcgcgcgggcgaagaagatccaggacctggaactggcggtggagaacgcgcagggcgccaagtcccgcgcggagaaggagctcaacgccaaggtggccgccgccgagagcaaggcccacgaggcctccacccgcctggccgccgcacagaaggagcgcaaggacctggaggcgcggcacgccaaggagcaggaagacctcgccgccaagcagaaggcggagctggagcgtcgcgacgccatcaaggcgcaggaggtcgcccgcctgcagcagtccgtgcaggagaagagcaaggccctcaaggtcgccgagctggagctggcccgctacaagagcaagtccgccaccacggccaccccggccaaggccgccgccaagcccgcggcggccgaggacgacgagctggccgtgaggacgcagctcaaccaggtcatcgcgcccgccgccgcggcccaggccccggccccggcgaagaagccggccgcaaagcctgcggcccaggccccagcgaagaaggcccctgccccggctcccgccccgccggcggcgctgagtgatgagtccgagcccaccgaccggaccctggtcatccagttgcccacggccaaggaagacgacgactggacggccctggtggacgagttggacaagtaa

SEQ ID NO: 5530 - DNA, 906 bp, Myxococcus xanthus
ttcaccagcgtggaggacgcggaaaagcgcctggagcaggtgggctatctatcctcgccggagatcgccacggcggccttcctggcggaccggatggacaagcccatcctggtggaaggcccggccggcgtcggcaagacggagctggccaaggccctggcccaggcgctgggccgcgagttcatccggctccagtgctacgagggcctggacgaggcgaaggccctctacgagtgggagtacgccaagcaactgctctacacccagctcctcaaggacaagattggggacatggtgcagggcaccaccacgctggcgcaggcggcggaccgactggcctccagcgacgcggtgttcttctccgaacgcttcctgctgccccgcccggtgctgaaggcccagctctccgagcgccctgccctgctgctggtggacgaaatcgacaaggcggacccggagttcgaggccttcctgctggaggtgctctccgacaacgccgtcaccatccccgagctgggcaccttccgggcgaagcacatcccccgcgtgctgctcacctccaacgccgcgcgcgagctgtccgacgcgctcaagcgccgctgcctccacctgcacatcgacttcccggaccgcgagcgcgagctgcgcatcgtccgctcgcgactgccccaggtgccccaggtgctggcggagcaggtggtggaagcggtggccgccatccgctcgctcgacctgaagaaggcgccctccatcagcgagacgctcgactgggcccagagcctggcgctgctgaacgcggagcagctcaccgccgacgtggtggcctccacgctgaacctcgtcctcaagtacgaaggcgacatcgagaaggcgaaggccaacctctcgcagattgcccaggcctga

SEQ ID NO: 5531 - DNA, 1380 bp, Myxococcus xanthus
ctcgaggagatggagctccgcctcgtgcgcgcctcgctggccaacgcggccctggtcgacctgcgcgaggaagccatcctccgcaccgtcctgtcgctggcgcgcctctacaaggtgcggcacggcgaacgcgacgtgggcgtgggcgcgctgctcaccccgtttcgcgaggaggtggagcgccgcctgggccccgtcctccaagcccccttcccgcccacgcgggaccggctgatgccgcacgtgaaggatttgcgccagcacgccgccaaggcgcgcgacatggtggcgcagcggctgcgcgggcgcgttccccccgaggcattggaccgggaaatccggcacaaggaactggtgctggtcaccggtggcggcggcggaacggcctacgtctacctgggggtgatgagcctcctgggcgaatacggcctggagccgcgcctgctcgccgggacgtccatgggcgccatcctggccatcatgcgctcgcgcctgacgcgcttcgacgccacggacatgatcaacatcgtccgcgggctgtccttccggaagctcttccgcttcatctccacggagagccgctatggcctgcccgccgcgctgcggctgtttctgcgcgcggggctgggccgcttcttcagcgcgggaccggagaacagtggcatgcggctcaaggacttgccggtgccgacgctcatcgccgtgggcggcatccgccgcggcatgcttccccggccgctggagtattacgagcgcctgctaggcaccagtccgctgggcctgctcaaccccgtgggcgtggcacgccgcatccaggccgccatgggcgccatggccgagctcttcacccgccccgaaatcaccgcccgcctctacctgggtgcggacgacaccaccggcgacttcgacgcgctcgacgccgcgggcttctcctccgcgctgcccggcgtcatccactacgacgtgctgcgcgaggaccccggcatgcacacgttggtggaaggactcatgggccagcacggcgtcgcgaggctcatcgacggaggactggtggacaacctgccagcgaaggcggcgtggaaggcagtggcccgaggccgcatcggcacgcgcaacgcgttcatcctcgcgctcgacggcttcgccccgaagctgaccacgcccttctggctgcccctccagcggctcgccgcgatgacggtggcgccgaaccttccttatacgcaccacgtcaaacgctttccgcgaacactgtcaccgctagacgtcgtaccgtcggtggaactggcctcgaaggcattacaattcggcaggacggcactcgcggaggacctcccgttcctccgtcggatgctcgcccccctgccaccggtgctgtga

SEQ ID NO: 5532 - DNA, 912 bp, Myxococcus xanthus
caaatctggctcgacggccgactgatgaaatgggacgagggccacgtgcatctgatgacgcacgcgcttcactacggcctgggtgtcttcgagggcatccgcgcatacaaaacgcatgacggacggctggccgtcttccggctgcgtgagcacgtccgccggctgctcgactcggcccacatcatcatgctgaagattccgtacaccgaggacgagctcttcgacgcgtgcgtgaatctgctccgcgcgcagaaggacctgttcgccaacggcgcgtacctgcggccggtggccttcatgggcgacggcgccatgggcctgggcgcggtgaaccccacccgcacggccgtgacggcctgggactggggcgcgtacctgggcgacaagggcatcaaggaaggtatccgcgccaaggtcagctcgtacacgcgcatgcacgtcaacgtgaacatggtgcgcgggaagattaccggccagtacgtcaactccatcctcgccaagcgcgaggcggtgctggcgggctacgacgaggccatcctcctggacatcagcggcttcgtggccgaggcctccggcgagaacatcttccaggtgaacaagaagggcatcatcaagacgcccccgctgtccggccccatcctggacggcatcacccgcgacacggtgctgcacatcctgcgcgacagcggccgcacggtggaggaggtcaccttcacccgcgacgcgctctacatcaccaacgagatcttcctctgcggcacggcggcggagatcacccccgtgcgcgaggtggacaaccgccaggtggctgacggcaagcccggccccatcacccggtacgtgcaggacatgtacttccgcatcgtgcgcggccaggagccgcgctacgcggattggctcacgtacatctga

SEQ ID NO: 5533 - DNA, 1341 bp, Myxococcus xanthus
atggctcctcccgctggctacgactacgacgacaatccgttcaagctcgagaacccatccatcctcgacatcgctccaccggagccgaagtcggtggaggacacggggctcaagatgggcatcctgtccgacatcgccctgaagtacctctattacgcgggcacgggcacgggcatgggcatcgcggacgagatgcgactgccgtggccaggtgtcatcgagcacgtggtggacttcctcgccacggagaagctggtggacctgcgcggcggcaagggctttggccgcgcgtccgtggagttcatcctgtcggagaagggccgcgagtacgcgcgcgacgccctcacccgcaccacctacgtgggccccgcgccggtaccgattgagcagtacaacgcgctcatcaccagccagacggaggagacgcccgtcgtcagccaggaggagttggtgatggcgctcagccacctcaccgtccccgcggagctgatggacaagctggggccggcggtgaactccggccgctcgctgttcctctacggctcccccggcaacggcaagacgagcctggccgaggccgtctcccacatgtttggcggcgaggtgttcgtcccccactgcctggagattgggaatcagatcatccaggtccacgaccggctcatccacacgccggtgtcgctggaggtcggccgggatgcctccggccgccggcagaccttcgaaatggacaaccggtggctcgtgtgccgtcggccctccgtcgtcgtgggcggcgagctgacgctggcgatgctggacctcatctattcggagagcacccgcttctacgaggccccgttccaggtgaaggccaacggcggcatgctcctcatcgacgacttcggccgccagaaggtccaccccacggacctgctcaaccggtggattgtccccctggagaaacgggtggacttcctcacccttcacaccggcaagaagttcgaaatccccttcgaccagctcctcgtcttctccaccaacctggaccccaaggaactggtggacgaggccttcctgcgccgcatcaagtacaagattgaggtcgggaaccccgacgaagaggcttaccgggaaatcttcagtcgcgtctgcgaggcagcgggaatcccgtacgtggaccaggccgtcacgtacctcatcgagcactactacaagccgcggagcatggagcttcgctcgtgccaccctcgggacctggtgagcctcatccgggacgcggcgcgctaccggcagatacctccagcgctctccaaggacctgctcgaccaggcgtgcgaggtgttcctcgtcaatctgtga

SEQ ID NO: 5534 - DNA, 534 bp, Myxococcus xanthus
atgccgtccgtcaagcaactgcgcccgttcgccctggcaaccctggaggctttcctcgaagcatccggccgcgtcgtgctggtccaacaacctcccgagcccgtcttccaacaggtggccatgcggctcggcgaggcacgcaccgtgggcatggcccaccggacacggctcgtggaccggctgttcgtgatgctgcgcgggttcgatgccctggaggtccacttcctcaggccggagacggagggagaggagttctccgtgggacgcatcgaaggctgctccctggtggtacccgacccgtccgtgtccaagctccacgcgatcctgcggtggcacgcccaggccggtgactgctcggtgcgcgaccagggttccatgaatggcacctgggtcaacgcctcctcgctggggccggaccaggaccggatgctcaacgacggcgacgccctggcctttggcgatgcccagttcctctacctgcgcacggagacgctccacgctcacctgaggatggccagtcccagccggggctga

SEQ ID NO: 5535 - DNA, 675 bp, Myxococcus xanthus
atggccgcgctgttccctcatcgaaccagcgcggaagcctccatgattccggtggtcctcgaaatccggaaccacaaggccgtctgtgacttcatccgtgaggaggcagcgggcgccaagaagcaggcgcaaatcacgctgaccaccatcaagcggatgcacgacctcttcctgggcaacacgccggaggcccagacggagcgcgcgcgcatggagcgccgcgagcgcacggagaaggagctggccaaggaacgcgacaggtccgggctgcgcaaggacatgccgctgcaccgcacgtacttccacgacatctcccagccggcgaagatccagccggagttggagaagctcgtggactacacggccagcgccgagttccgcgagttccaccccatcaagcaggcggccacggtccagcacaagttcgtgcagattttccccttcaccgagcacagcgggaaggtggggcgcatgtgcagcaacctcatcctgctgcgcaacggctacatgcccgccgtcatccattccatcgaccggcagcgctactacgagtccttccgaggacccgcggcgggcttccggacggtgctgatggacgcgatggagaactcgctcgacaacggcatgaagtacttccgggacctggggcgcaagttcaaggccctgaacagctag

SEQ ID NO: 5536 - DNA, 1020 bp, Myxococcus xanthus
gacaagttggagcggctcctgcgagtagcccagggccaccacaaggcgctcatcctcacccacgacaatccggacccggactcgctggcggcggcggtggccctggcgcacctgctcgagcgcaaggcgggcctgaaggcccacatcggctacggcggcatcatcggccgggcggagaacatcgccttcgtgaaggtgctgcgcctgcccgtctcacacgtgtcgaccatcgacttcgacgagtacgacctcttcgggctggtggacacgcagcccaaggtaggcaaccactccctgcccgcgcggctgcaagcgcacctggtggtggaccaccatccgctgcgccaggagagcctggaggcccctttcgcggacgtgggcggcgacttcggagccacgtccaccatgctggtggagtacctgcgcgcggcccggttggagccctccgcggaggtggccaccggcctgttctacggcatcaaggcggacacgcgcgacctgggccgggagacgacgcccacggacgtggacagctacctgtggctgttcccgcgcatggacaagatgctgctggcgcagattgagcaccccgagctgcccgcgcgctacttccagctgtaccacacggcctacgagcgggcgaaggtgtacgggacggccattgtcaccgacctggaggaggtctactccccggacatggtggcggaggtggccgagcggctgatgttcctcgaaggcatgaagtggtcgctggccttcgggacgtaccgcaaccagctcttcctcagcttgcgcgtgaaggaccggcggatgaacgcggggcgcctcatccgcgaaatctgcgaggactacggcggctcgtccggcggccacggcagcatggccggagcgcggctgccgctgtccgggaagctggcgcagcgcaaggcgctcaagcgcgagctggtggccaagttcctggaggcattcggcgtcgccaacgagcggccggtgtcgctgctgtacgcgcaggactcgtga

SEQ ID NO: 5537 - DNA, 708 bp, Myxococcus xanthus
atgtgggccaacaacgagacgggcgtgctccagcccgcgcgggaggtggcgctcgcgtgccggcagcgcggcgtgctgttccacacggacgcggtgcaggccgcgggcaaggtgcccctgtccctgcgcgaggtggacgcggacctgttgtccctgtccgcgcacaagttcggcggccctccgggcgtgggcgtgctgatggtccgcaagagcgtggacgtccgcgcgctcacgccgggtcatcaagaaggcggccgtcgcggagggacgcagaacgtgccctacgcggaggcgctggcgctcgcgctcgcgttggccgatgcggagctgactgagacaacggcgcggctgaccacgctccgcgatgcgttcgagcgggaggtgacggcgcgactgcccggcgtgcacatcaacggcggcgcggccccgcgcgtgcccaacaccagcaacctgcgcttcgacggcgtggagggtgaggcgctgctcatcgccctggatctggagggcatctgcgtgtcctccggcgccgcctgcgcgtccggcacgctgacgccgtcgcatgtcctgcgggccatgggcctgtcgcccgcgcaggcccgaggcagccttcgcttcagcatgggccccggcacgacggaagcggacgtggcgcgcgtggtggacgcgctcgtccgacacgtgccgcatgtccgcgcgctggccggctag

SEQ ID NO: 5538 - DNA, 588 bp, Myxococcus xanthus
aagcagaccctgcgagaggagctcacggcgcgccggaaggcgatgacgccggacctcatcgatacgcggggtctcaaggttcagtctcggtttctggcggcgccctactatcagaaggcgcgcacggtggcgttgtacgcccccattcggggggaagtgccaacccgggatatcctgattgcggcgttgcaagacggcaagattgtctgctacccgctctcacatgttcacgggcggattctttcgttccgtgccatcaagtcggaaagcgagctggaaccgggacgtttgggggtgcgtgagcccaccaactccgcggacctcatcgcggtggaccagattgacctcttcgtggtgccgggcctgggcttcacccgggaaggcaagcggctggggcgcgggggcggttactacgacgccaccctccgcgcggccagtcagcgcagtcgtcgggtgggcctggccttcaatgaccaggtcgtccccgtgctgcccacgaccggggatgacgtcgacatggacctggtcgtaacggagtctgagtccctgcgcggcctgtaccgcgactgggacttcctcgatacgtga

SEQ ID NO: 5539 - DNA, 774 bp, Myxococcus xanthus
atgggggacgtggtgggccgcccgggtcttcaggcggtccgcacgctccttccgagggtccgcgcgcagcacggcgtggacgtggtggtcgccaacgcggagaacagcgaccaaggctcgggcatcacttcagagacggcccactacctgctcgacagcggcgtccagctgctgacgagcggtaatcatttctactccaagaaggccatcctcccctgggtgaaggagcatccggacctgctcttgcgtccggccaactaccccaagggcacgccgggcaagggccacagcgtggtgaagctgccggatgggcgcgcgctgggcgtcatcaacctggaggggcgcgtcttcatgcgcaccgaggccagccccttcgaggtggtggaagggctggtggaggagctgcgccagcagacgccctgcatcctggtggacatgcactgcgaggcgtccagtgagaagaacgccatgggcgtccacctggatgggcgggtgtccgtggtggtggggacgcacacacacgtgcagacggcggatgagcgcatcctccccggtggcacggccttcatcaccgatgtcggcatgtgcgggccgctggactccgtcatcggcatgaagaaggagtcctcgctgacgcgcttcctgggcaagccggcgccgtatgaggtggcggagcggctcgtctacctgcaaggcgtggtggtggacatcgacgacgccaccggacagggccggagcatccaccgcgtgcgtgagcacctgccaggcacctga

SEQ ID NO: 5540 - DNA, 1263 bp, Myxococcus xanthus
atgaatccggacgcgctgcgcaaggcgacccccgaggagcagttcgaagaagtgacccgtggcacggtggacctccacgtgcccgaggacctgaagaagaagcttcagtactcgtatgacacgggcaagccgctggtcatcaaggcgggcttcgacccgagccggccggacctgcacctgggccactcgctgctgctcacgcgcatgcggcgcttccaggagttcggccacacggtggtgttcctcatcggtgacttcacggggttgattggcgacccgacgggccgcaacgccacgcgcccggcgctcacgcgcgacgaggtgaaggccaacgcggagacctacaagaagcaggtcttcaaggtgttggacgagtccaagacgcaggtgcgcttcaactccagctggctggactcactggggacggaagggatgatccgcctggcctcgcgctactccgtgcagcgcatgctggagcgcgacgacttcaagaagcgcttccgcggcgaagtctccatctccatccacgagttcctctacccgctcctgcagggctacgactcggtggtgctcaaggcggacgtggagctgggcgcgacggaccagctcttcaacctgctggtgggccgccagttgatgaaggaagagggcatggcgccccaggtcatcatgacgggccccatcctggagggcctcaacgcgaaggcggttgacggaaagattgtcggcgacaagatgtccaagagcctggacaactacgtgggcatcgacgagccggcggacaccatcttcggcaagttgatgagcatcaccgacgacctgatgtggcggtactacgagctgctctccgcgaagacgcgggcggagctggcggaaatgcgcgcccaggtggagtccggcgcgctgcaccccaaggcggtgaaggtcggcttcgcgcaggagatgacggcgcgcttccagggcgaggaggccgggaagaaggccgccgaggacttcgagaagcgcttcgcgaagaaggagctgtccacggacgagctgcccctggtggaggtgtccctgggcggcgcggagaagctgccggtgacgaagctgctgccggagtcgaagctggtcgcgtccgccaccgaggcgcgcaagctgatggcgcagggcggcgtgcgcgtcaacggcgagaaggtgcaggacgtcaaggcggagctgggcgccggcgagtacacagtgcaggtgggcaagctgaaggcagcccgcgtgaagctcggttga

SEQ ID NO: 5541 - DNA, 624 bp, Myxococcus xanthus
atggaccgcgaggtgttggacttgtgccccgcgcgccccgacgtcagcgtgagtgaaggcgacgtgcggcgcttcctctcgcgccactacgacgacccgcgcctccagcgggccctgtccgtggcgggccggcccggcgcgcggcaggccaacatcgactggctcaccggcctctgggtcagcaccgggcctcgcaacgccttcacgcacgtcttctgcggcgacgactggcagcgaggccccattggcggcctgcacttcctgccgcgttatgcccagctcgaggcggagggccgcctctgctaccagggcccggtgcgcggtgccgcggccttgaagggtgacgcctacctcatccgcttcaagggcgtggcgccctggtcctgcggtgagaagcgcgtcggcggcttctcacgtgggccggacgcggtgggcctgatgtccattggcacgcgcgccttcgcccggtgctgcgcgcgcggcggggccaagaaggaaggcggcgtgtactcggcgccggacctgggcgggacgaactggcgcatctggtgcggcacgcgcaatggcacctacggcatcgccaccctgcatcccacggacgacaaggccacctgcggggaatga

SEQ ID NO: 5542 - DNA, 402 bp, Myxococcus xanthus
atgacggcgctgtgcatctccctgctgtcggctgggggcgccgcctactgctacacccgcgcggacgccctccaggtgcagggccagtggctgatggagcgcggcaccgcccaggcggaggactacgcggcccggttcgacggcgccgcggcggatgcccaactgaagacgttcgcggagcgccgggccatcctggagaaggcacacggatggcagcgcgggatgctgctgggcgtgctgatcgccgcgttggccaccgtctccgcgtacctcctgttcctcctcaagcggctgaacgaccagttgctcgatgccaccggcagcggggcacacgaaggcaccgaccgggagtccgcctccccggagcccgtccaggcgttgatgcccagtccgcagcgctga

SEQ ID NO: 5543 - DNA, 300 bp, Myxococcus xanthus
atggaggaggccatgcccggctgcgcgcactgtggacaccgactggacatcatcgcgaaccaggtgggccggcgtgacgagtgcccccactgcggcgaggacatccgttcgtgccgcaactgccgtcacttcgacctgggcgtggcgaaggagtgcaaggagcccttcgccgaggtgcccaaggacaaggacggcgccaacttctgtgagctgttccagattggcgaaggcggcatccatgagaaggagagccgggacgccctgctgaacgccgcggagtcgctgttccgcaagaagtga

SEQ ID NO: 5544 - DNA, 1290 bp, Myxococcus xanthus
atgcggtggttgaagaatctgtacgtccaggtgctgctggccatcgcggtgggcgtcatcctcggatggctgcggccggacctgggggagtccatgaagccgctgggcgacggcttcatcaaactggtgaagatgatcatcgcaccggtcatcttcctcaccatcgtcgcgggcatcgcgaagatgggcgacctcaagcacgtgggccgcatcggcctcaaggcgctcatctacttcgaagtcctgacgacgctggcgctcgtcgtgggcatggtggtggtgaacaccctgaagcccggcgcggggatgaacatcgacccggcgcagatcgacacctccggcatcacccagtaccgcgcgtccgcgtcgcagcagggcaccatccccttcctcctggacatcatcccgcatgacttcctgtcggccttcaccgaggggaagttgctccaggtgctgctcgtcgccgtgctgacgggcgtggcgctcacccgcctggggcccatgggacagcgcgtgctcgacttgtcggatgacctggcgcaggtcttcttcggcatcgtcgggatgatcatgaagctggcgccgctgggcgccttcggcgccatggccttcaccgtgggtaagttcggtgtcgaatcgctcagctccctgggccggctgctcatcgccgtctacgtcacctgcgccctcttcgtgttcctggtgctggggctggtggcgcggctgtccggcttctcgctgtggaagctgctgcgctatatgcgcagcgagctgttgctcgtgctggggacgtcgtcatcggagtccgcgctgccccggctgctcaagcggctggagacgctgggctgcgaccggggcgccgtcgggctggtgctgcccaccgggtactccttcaacctggacgggacgtgcatctacctgacgatggcggccatcttcatcgcccaggcggtgaacgtggacctttcgctgggcgaggagctcaccttgctgggcgtgctgctgctgacgtcgaagggcgcggcgggcgtgacgggttcgggcttcatcacgctgatggccacgctggcggcgctcaacggcaaggtgcccgtggaaggcgtggccctgctgctgggcgtggaccgcttcatgtccgaggcccgggccatcaccaacgtcatcggcaacacggtggcgacgctggtggtgtccaagtgggagggcgtgcgtgacgacaccgtcatgcacgccgagctcgacagcgggcccaagcccctggaagggatgagcctgggccacggcgcctga

SEQ ID NO: 5545 - DNA, 2406 bp, Myxococcus xanthus
  unsure (1)..(2406): unsure at all n locations
atgaccgtgcagatatcgcaaagaacgctggaagacctgngcttcgcggatgtgctccgcgcgttggcgcaacgctgccggacggagcccggcagggagcgggtgctcgcccggccgttcctggccacccccgaggccgtggcggaggccctcgcgctcgtcgccgagacccgctcgttgtcccaggagcagttctccctccccttgggtggcgtgacggacctgcgtacgcccatcggccatgcggccaagggcggcatgctggagccccgccagctcatcgactcggcgcagctcctgttcgccttcgtccgcacccgcgaggcactggacgaacgccgggcccgcgtcccccggctggtggagattgcccgccggatgccatcgctggagccgctggctcgccgcatcgaccagtgtttcgaaccggacggtgagatctccgaccgtgccagcccggagctgcgcgaagcccgggaccgcgcacgtgggctccatcgccgcatcaagtcgcggctcgaggagatgctccacgatgagaccttcctccccaagctgcgggagaactactacacgatccgcaacgggcgttacgtggtgccggtggtggccaactaccgctcggaagtggacggcatcgtccacaacgccagccagacgggccagacgctcttcatggagcctcaggccatggtgggcctgggcaacgacctcgccatcgcccagtcggaggtgaccgaggaggagcgcaaggtgctccaggccctgagcgaccagctcggccgggagtcggagcgcatcctggagggcctggacgccgtggcggagctggacgaggccgaatccgtggccatcctctccgcggacctgggcgccagcatgccggccttcgagaacgtcacggaaatgcagctgcggcagctgcgccacccgcgcctggtgctcaagggcgccgaggtggtggccaacgacgtgacgctcacgggcgatgcgaaggccctggtcgtctcaggccccaacgcgggcggcaagacggtgacgctgacgggcgtgggcctctgcgcgctgatgctccgcgccggcctgccgattccggtggccgaaggctctcggatgccgctgtaccgctccgtccactccaccgtgggtgacgcgcaggacctggagcagggcctgtccacgttcagcgcgcacgtggtgatgctgcgagacatcatcggcgccgtgggcgagggctcattggtcctcatcgacgaaatcgccgcggacaccgacccgcgcgagggcgcggcaatcgccatcgccgtgctggaggagctgatgtccaagggcgtggtggtactcgtcaccacgcacctggaggagctgaaggcgctggcgcacatggacccgcgcttcctcaacgcgcgcgtgggcttcgactcgaagcgcatggcccccacctaccggctccagattggcgccgcgggccagtcgtcggccatcgagatggcggcgcgcgtgggcctgccccagaacgtgtgcgagcgcgcccgggagctgtccgtcagtgccggcggtccgctcaccaaggcgctggcggcggccgaggaggaacggcgcaagctctacgaggagctggaacgcgcccgcgtggcggcccaggaggccgaggcgctccgggccgacctggagaagcagaagcagtccttcgagcgcgagcgccgcgcccggatgatgcagttcaacgacgacgtacacgcggcgagcgagcacgcggcggcggaagttcagaagctgctgacgaagcttcgagccgagcagaacgagaaggccctcgccgaggcccggcagcaactccagcagcgcgcggatgaggcgctgaagcgcgcccaggccgccaaggcggagctgttccaggtggaagcacctggcccggccaacctgaaggtgggcgcctgggtgcaccactcggggctgaaccgcgatgtggaaatcctggagctggcggacaaccacgcggtggtgtccgcgggtggcgcgctgaagatgcgcgtgcccatcacggagctgtcgggcgcgcgcacgcgcaagccgcagcaggcgaagttcccagagcggcagaagcaggatgcggcgctcaagcgcgcggcctccgcggccccctccgaggtggaggccacccatttccgctgcgacgtgcgcggcatgcgcgcggacgacgcgctggcggagctggagtcgttcctggaccgcggcatgcgcagcggagaagacgccgcgctcgtcatccatggccatggcacgggggcgctcaagcaggccatccgtgactacctggccgcgtctccgtacatccgcatgtaccggccgggtgaaggccacgaaggcggcgacggggtgaccgtggtcgccctgcgcgcctga

SEQ ID NO: 5546 - DNA, 1086 bp, Myxococcus xanthus
atgtggatggccgcggcagtggcagcggtggtgacgacgggctgtggcaaggccagcaacaagccggccctccccgagcagacgggtcccgcggcattgggcgtgcgcgccatcactccagccacggagttgagcgccgacgtcacccgcgtgacggggcagatccgctcgaagaacgaggcggtcctggggccccaggcgaccggcaccatctcgaggatgaacgtgcgggtgggcgacaaggtgaagaagggccaggtgctggcggcgctggacgcctccaacgtcgccatcagcgtggagcaggcgcgcgcggtgaagcaggccgcggacgcggcgctggagctggccacgtcctccctggagcgcacccggaaggtggcggagtccggtggcgtggccgccgcggggctggatcaggccgtgattggccagaagcaggccgccgcccaggccgcccaggccgccgccgggctgcggctggcggaggagatgctgcgtgaccactccatcatcgcccccttcgacggcgtcatcacggcccgcacgaagaacgtcggtgactcggtggcgatgacgccctccacgcccgtgttcagcatcgtcgacacgacggggctggaagttcgcgcgcaggtccccgagtccgtggtggacaaggtccgcgtgggcagcaagacgcagggcacggtgagccccagcggcgcgcgcttcgacgtgcaggtggccgtcgtgggcgcggtggtggacgcctccaaccgcacggtggaggtgctggcggacgtggtcggtgagccgtccccggcgctgcgtcccggcgccctggtggagctggacttctcgaccgtgaatcaggccgacgacgacaagggcctcttcctccccacccaggccgtcagcgcccggggccaggagggcttcgtgtgggtggtgcaggacggcacggtgcgcaagcgggatgtgcgcgtcgagcgagtgctgcctggttacgtccgcatcctccagggactgggcgccgacgagcgcgtgctcgccgactcctccctggacgtgaaggagggcacggccgtccgcgtagtgcagtga

SEQ ID NO: 5547 - DNA, 3135 bp, Myxococcus xanthus
aagacattcatcacccgccctgtgttcaccgcgatgctgatgctcgcggtggtcgtttttggcatcaatgcctacccacgcatcggcgtggaccagttccccgacgtcgagttccccgtcgtcaccgtcaccacggtgctgcccggcgcggacccggagtcgatggagaagaacgtcagtgacccgctggaggaggcgctcaacaccctcaacggcgtggagcagctgcgctccatcaacctggagagcgtgtcccagatcgtcgtccgcttcaccctggacaccaaggtggacgtggcgtcgcaggacgtgcgggaccgcgtccaggccacgctgagcaagctgccgacggaaatcgagacgccggtggtggagaagttcgacatcggcgcggcgcccatcatgacgctgtcgctgtccggcgcgctccctattgaagagatgacgcgcgtcgccgaggacgtcgtgaagcccgccctccagcgtcagccgggcgtgggcagcatcgacgtggtcggtggccgtgagcgcgaaatccagatcgtcgtggatccggagcggctgcgtggcttcgggctggccgtcagcgacgtgagccaggccgtgcaggcgcagaacctggacgtcccgggtggccgcaccatggacagcggccgtgagcgcgtggtgcgcctgacgtccgaggccaagagcgtggacgagctgcgcaacatcatcatcgccagccccaacggcgcgccggtgcgcgtgcgtgacgtggccgacgtggtggacggtccggaagaggcgcgctccagcgccaagagcggtgaccgcagcgccgtggcgctggtggtgcgcaagcagtccggctccaacacggtgcaggtggccgagtccatcaaggagtccctgggagaggtcaacagcctgctgcccgaaggcgtgcgcacggagatggtgacggacaactcgcggttcatccgctcgtccatcgccgcggtgcagttcgacctggtgctcggtggcttcctcgcggtgctcatcgtgctggtgttcctgcgcaacctgaactccacgctggtggccgccgtcgcgctgccggtgtccgtcgtcgggaccttcgccgtcatggcggccctgggcttcacgttcaacgtcgtcacgatgctggcgctgacgctgtccatcggtctgctcatcgacgacgccatcgtggtcatcgagaacatcgtccgtcacctggaagagggaaagacgcccatgcaggcggcgctcgagggcgccagccagattgcgctcgcggtgttcgccgtgacgctcgccatcgtcgccgtgttcatccccgtggccttcatggacggaacgatgggcatgttcttctaccagttcggcgtcacggtggccgtggcggtgctcatctcctacgccgtgtccatgacgctcacgcccatgctgtcggcgcgcatgctgagccaccatggcaaccccacgggcatctccgcggcggtggagaaggtgctggtcgccactgagacgggctaccgaaacatcctggccagcatcctgcggcaccgggccatcaccctggtgatcgccgtggtggtgctcttcctcaccctcttcatggccagcttcctgaagttcacgttcatcccggagcaggacaacggcaacatcaagctggcggtggagctccccatcggctccacgctgcaggagacgcaggcggagctggacgcgctggacgcgcaggtccgcgccctgcccggcatcgactccaccttcgccaccgccggtggcggcgtgcaggaggaagtgcacaagggagagctgctcatcaacctggtgccgctgaaggaccgcgccttcaaccagggcgagctgaagacgtacctgcgcggcgccatcacccctcgcagcggcgtcaccgtcacggtgcaggacatcgcggccgtgggcggcggcggtgcccgcacgcagcagattcagttcaacctccgcggtgacaactgggacgaggtcatcaaggccgccgaaaaggtgcaggccaccatgcgccagaatccgggcttggtggacgtggacatgacgttccgctccggcaagccgcagtacgacgtcaaggtggaccgcgagcgcgcggccagcctgggcgtcccggcggcctcgctgggtgccacgctgcgtgccttcctgggccgcgacaagttcggcgactaccgcgagggtggcgagacgtacgaaatcaaggtggccctgccgccgcagacgctggcctccgccgacgcgctgggcaagctgaccgtgcgcagcatgacgggccagttggtggagctgcgcaacttcgcgaccatcaccccggccgacggcccagtgcagatcgaccgcgagtcgcagaagcggcagatcaccctgctggcgaacctggcctcgggctacgcgctgagcgacggcatcaacttcctcaacgcgtacgcggagaaggagctgcccaagacggtcatctacgacttcgagggtaacgcgaaggagatgggcaaggccgtggcggccttcggctccgccctgctgctgggcatcatcctcatctacatgattctcgcggcgcagttcgagagcttcgtccaccccttcaccatcatgatgtcgctgcccttcgccctcatcggcgccattggcggtctgctcgtcaccggtcaggccatgtcgatgttcgccctcatcggcgtcatcatgctcatggggctggtggtgaagaacggcatcctcctggtggacttcacgctgcagttgcgtgaggaaggcaagacggcgacggaagccctgctccaggccgctcccgtgcgtctgcgtcccatcctgatgacgaccatcgcgatgatcgccggcatgattccggtggcggtcgccaagggtgacggcgcggagacgcgcgcgcccatggccatcaccatcatcggcggtctggtgacgtccacgttcctcaccctgggcgtggtgccggtggtgtactcgctgatggatcagctcaccgagaagttcaagcggcgcaagggtccggacgcgacctccggtacgccgcacgcggtgggtccgaagcacggcgctgaatcgccttccgtggccgctgcggcccgggtggagaccgcctga

SEQ ID NO: 5548 - DNA, 600 bp, Myxococcus xanthus
atgcggcggccggatgacaaaccggccgcgctcgcgaatcggcgcggcgacccgggtgcggagggccaggaccctcccgaggacggtggctccgaggagagccacggtctgatggaggaagacgtcgagacctccacgcccgagtcgcggcgcctccacgagttgctgattgagttcagccgctaccgctccctgaagaacccgctggcgggcatctgcgaggacctccagctcacgcccacgcagatgcatgcgctgtcgtggctgggcaacgacggtccggtgcaggtgggcgtcctggccctgcgggtgggcatcacccggaagaccatcaccggtgtggtggaccgcctggagagcatgggtctggtggagcggacccgggacgtggaggaccggcgcgccgtcgtcgtgcgcctcaccgagcagggcagcagcgtcttcgcccgcatcgaccggggcatggacgccagcctgcggcgcgtgctgagcctgatgagccccgaggaccgcgacgccgtgttcggcatcctggagcggatgctggcgcgcctgacggccgaggcggaatcggccagcggcgactcccaggcgagctga

SEQ ID NO: 5549 - DNA, 1224 bp, Myxococcus xanthus
atgacgatgaccgccatcctcctcgtgagcctcaccatgggactgggcgccgccgccccggctggcgcgcgtgcggaggtgacgtggcccgcggtggcgccgtccactgtccaactgcgggccccggggagtgcggcgcctccgtccgacgtgtcctcgctgctggcctcccggtgcaggcagtgggccgccacgcccgacaacgcctgggcgctggcccatggcctggcgctggacggccgggacttccgcacccgcgacggtcagcccgcggcggacgccatcatcgcgcgctacctgcgccggacaccgccgccgtcccactcgcccgccgccgcccagcggctcttcttcgacagccgaaccgccaacggcacgccggtggagccccaccccgcccttcagctcaagagcctgctgcacgcgggctacccggcgcgccaccgcttcaatgcgtcctggggccccgtcatggtgcaggcgctggtggagcagttgcagctcgatttccgcccctcgctcgtggcccatcccgagggtgcctgggcgctggacgcactgtccctggcgatggagcccggcaccacgttccgcaccagcgagggcacgacggtccacatcgacacggtgatgcgggacgcgctcgccacgctcgaagccgcccaggccgagctgtccgcggcgatgcgcgcggggcggacgcaggtccccaagcgaaagcaaggcatctacgcccacccgtgcggcgggcttcactacttccaggccgtggcgggctgggcccggcatgcctccgtgcgcaaggtgtggcgcaagcggctggacgcgcaggtggacgtgctgctgtaccggctggactcggaaggccggcagtacgaggcggcgctggccgacgcgccgttcgcgcaccggctgcccctgctggtgcagatgctgaagttccagggccacctgctggagacgctcggccgctaccgcgacgacacccggtggcggcccacgaaggcccagcagcagacggtagagcgggcgcgcacggccctggagcacaccgtgcgccggctggaagccggtggcgccttcgacgggtggccagcgctggccgaacggcagccgcagctcgcgttggacttgttgggcgacacctgccacgccgcgcgcggcgaggccctgtggcggacgcccgccgtcagtgccccagccgcgcaagctcctgcgcggtaa

SEQ ID NO: 5550 - DNA, 792 bp, Myxococcus xanthus
atggcgggcgaggaggcgctggaggacggcgcgctgctgctgtggacgtcgcccctggcgtgggacgaggccggtgtgcgccggcgcgtgcgctacctgtccatggcgtcgcatgacctgcgcggctcactggccaacgtgcgctcatacgcggccctgctgctcaacggccgcgtgcccctggagcccaaggtgcagcgtggcctggagaccatcctccgcaacgcggaccgctcgctggccttctcccaggatttcttcgacgccagccgggcggacctgggctccctgccctgcgagcaggagcgccaatccctgctgcccctgctggacgcggcggtggagcggcagcgcgccgcggcgtcggcggcccaggtggcgctcgtgttgggcctgaacccggagcaggcggtgcccgaggtcatcgtggacggggcccgcatccaacacgccgtggagtcattcatccagtaccagttggcccgcgcccaaccgggcgaggtcatccgattgggcatccgcgacttcgcaccccgggtgcgcgtggaggtccgccgggacggggcgcccctgacggatgaggacgccgccgccgtcttccagcgcgaggagcgcgccttccgggagaagcggctggaggaccccttgcgcgtctacctggcccggcaggaggtggaggcccacgggggcagcgtgggcgtcgagtcggaccgaggtggcagcaccctcttcctcaccctggcccaggcccccgtcgcggcgctcggttctccagcaaccatgcaggcttga

SEQ ID NO: 5551 - DNA, 231 bp, Myxococcus xanthus
atggaaatcctgctgatcatgggggtgctgctgctcctgttcggagcgtcgcgcctgccacagctgggctcttcgctgggaagtgcgatccgcaacttcaagcgcggctttggcggtgagggcgaggacgcggcggcccctggggacaagaagggctccgggacgctctccagcagcaccggcgtgcagaacgacgtcaccaagagccagacgcccagcggccacgtctga

SEQ ID NO: 5552 - DNA, 171 bp, Myxococcus xanthus
atggccaacgagcccaagcagccgaagccggagcagtccgcacccaagcccgaggagcgcgcgcgtccgcggacctccaaggcggacgaagcccgggaagatgggatgcccggctatgggcagcccgatgcggacgttcgtgagcagtcgcttccggagcagtcctggtag

SEQ ID NO: 5553 - DNA, 957 bp, Myxococcus xanthus
ggcaactacgaagtcctctccgtgctgggcaagggcgggatggcggaggtgtaccgggcccgggtgttgtccggaccgcgtgagggctggacggtggcgctcaagcgcctgttgcccgcgctgacgcgggatccggagtccgtgtcgctgttcgcccgcgaggcgcagctgtccaagcagctccaccaccccaacatcgtcacggtgctggatgccggcgcgctggagggcatctacttcatcgtgatggagctggtggacggccgcgacctggggcagatcctccggcgctgcaaggtgcgcgggattccactgccgctcgacttcgcggtgtacctgggcaaggtgctgttggaggcgctcgcgtacgcgcactccgccacggggccccagggcgagcggctgggcatcgtccactgcgacgtgtcgccgtccaacctcttcatctcccgcgtgggcgaaatcaagctgggcgacttcggcgtgtcgcgcgtgctggtggacggcaagctccagggcggcgaagtgctgggcaagccctactacctgtcccccgaatcgctgctcggtgaggtgaacccggaggcagacctgtgggccgccacggtggtgctctacgagctgctgacgctggagcgccccttcaccggcacgacgccggatgccgtgttcaacgccatccgcgcccggcagtaccggcccctgcgggaactgcggcccgacatcccggaggcgctggaggccgtggtggcccgggccttcgcggagcgtcccgaggaccgcttcccgacagcggaggagttcgcccaggcgctgacgccccactacgacgaacgcgtgggcacgccgctggccattgccgccgtggtgcgcggtctcttcggtgccagtgacgaggtgcccgccgcgccgtcgcccagcgggacgccgccgacgccgggcacgcgcgcggagtag

SEQ ID NO: 5554 - DNA, 1257 bp, Myxococcus xanthus
atgcctccgcaggcttccctcatcccccgtgaggagggagggcttgcacatggagaccgaaacggaccccggaatggacgtatcggttcgaatttctgccgagcatcacgcgccccgcaggggacagcccttgaacaaagctacagtgcttccaaatcctcgaatctattgggaattcccgccagagtctttggaaatgataaggacggggggcggcggggtcaaggcatcctcgcgcgtttacaaggcaggcgcgggacctctatgatggaaagagcccgaatccacccacatatgccgccctcgctattgaacaagggtcttgcgacggttctttccgttgcctccggcctcgcgtgggcgggaccgcccacggtgtcgagctcctatcaaggggactcctatggcgtggtgtccctgcgcatgcagggagaccagctggtgggggtcgcgactggcggaccctgcggattcgaacccgatacggaggtgctctctggcgagttccaggacaacgtcctggtgggccaggtgttgctctgtcaattggggccccactgtgagccgcgggtgaatcagcccgcgctggtcgtgttcaacccggacgatggggtgatgacggccctgttccggctgaaggacggttgccgctcgccggtgttgaagaacgactccctcctgctcctgcggccgttgtcccgggacgcggaagcggtggcgccggggcgcgcggcttcagcgaccgcggcggtggccgcctcggccacggcggacggcgcgaactcgtccgcggcgcaggtggccgcgggactgggccggcagggcgaggtgtcacccttggaggaggggcagcgccagttggccgcgggcaacgcgggcgtggcgcagcgccacttcgagctggccctgtcgaaggacccccgcagcgccgccgcggtggtgggcctgggggccagccagctgatgctcaatgacgtgagccgcgcggtgaagacgctggaggcgggcagggggttggggcgtgcggacgtccacctgtggctggcctacgcgtatcagcgcgaaggcaaccgcaaccgctcgcgcgagtcgctgcgcaaggccttcgagcagggctggatgcccgcgggccgcgcggcggaagcggtggcggagcaggcgctgcgcgaggacatcgaaacactcatgcaacagcagcggacccggaagcggggtcccgtccgcccgtcggcgggggctggaaacaccacgccgtga

SEQ ID NO: 5555 - DNA, 5097 bp, Myxococcus xanthus
  unsure (1)..(5097): unsure at all n locations
atggggcaggcccagctcgtggagatggagcgagtggcggaccacgccgtgcgtgcccactcgctggcgaaggcgtgcgcggccacctacccccagtccacgggggcgcagcgctgccgcgtgctcatggccgccatcgaggcgcccgagttcagcatgggctcgctggcgtcggacgggccgggccgccgctccgtcgaggtcacccaccgcaacgtgtccatgctgcacttccgtgcgtactccgtggacctggagaagcggctggcccaggtggatgactacaacctcatgccggacagtgcgccgttgaaggccctggtgaagggccagcgtccggtggccacctggagcgtgccgctgccgaagacggaggacttccgggagcaccgcaccttcgtcacgccgccgctcacggcccgggggacgtacgtcatcatggcctccgcccacgaggacttccgcgcgacgaacaaccgcatcgtcgcggtgtacctgacggtgacgccctgggtcatcgtcgcgcggccctcgaacggggacctgctggaggtgcggttggtggacggcgacaccggcgagcccgtgtcgaaggtgcccctgcgcctcatccgcgtcgactacaggcagggcttcaaggaggtggcgcgcatcctctcggacgcggacggcgcggccaccttcgactcggtcccgggcgatggctaccgcagctacgtcctggtggcagaagtcggacggaacgcgataatgcacccgggccaggtgccgttctacaagcgccatcagcccggggacgtccaatcggcgctcgtcttcaccgatcgcgcggtgtaccgcccccagcagaaggtgctgtggaaggcggtggccttcagcggccggggcgagcaggcgcgctatcagacgctggcggaccgcccgctccaggtgacgctgttcgacccgaaccaccaggtggtggagtcccgggaggtccgcaccaacgacttcggctccgccgcgggcgagttcacgattcccaccggccggatgctgggggcgtggtccgtaatcgtgagcgcggggggccgcgcggcgattcgcgtggaggagtacaagcggcccaccttcgaggtgacgctgaaggacgcgaaggcgcagctgcgcctcaaccggcccgcgacattccagggcgaggcccgctactacttcggcatgccggtgacgtccggctccgtgcggtggcgtgcgttccgcgagccggtgctgccctggtggtggtggggcccgccgtccgggtcctcgcagcgggaggtggtggcgacgggcacgtcgccgctgggcgcggacggaggcttcaccatcggtttcacccccgaggcggatgagcggtccgcggccactccggggctgacgtggaactaccgcatcgaggcggacgcgacggacgaaggcggtgagacgcgctcggccagcagggccttccggctgggcttcgtcgccgtggaggcgcgcgtggacctggacacggggttcctccgcgagggcgccgtggccgaggtccggctgacgcgctccacgctggatggcgcgccgcagccggggccgggcaagtggcggctggtggcgctgaatcagcccgcgcagcccttgctgcccgcggacgagccccagggcctgccggagtacaaggaccccgaggcggtgttcacgcccacgcctggagacaacctgcgtcctcggtggttcggcgcgtattcgccggagtccaccattcgcggctggacggatggggcccagcaggcgaccggctcggtgcagcacgacgccgagggcctggccgtgctgaagctgccgtcgctcaaggcgggcgcgtaccggctccactacgagacgacggacgccttcggtcagacgtacaccgtggggcgcgagctggtggtggccgggaagacgacgcccctcgcggtgcccgcgatgctggtggccgagcgggagacggcgcgggtgggggaggtggcgcggttgatggccgtctcggggttcaagggccagccgctgctgctcgacatctatcagggcgagcggctcatctcccggcgcaagctcaccgcgggccagtcttccggagtcgtggaggtgccggtgacggcggagctgcgcggcggcttcaccgtggcgctgtccacggtgcgtgactaccagttcctgttcttctcgaagtccatcttcgttccctgggacgacaaggagctgcagctggagttcgccaccttccgcgacacgctgcgaccgggcgcgaaggagacctggcgcgtgacggtgaaggggccgaagggcgcgaaggtggaggcgggcacggccgagctgctctcgtacatgtatgaccagtcactggacctgttcgcgaagcagacgccgcccagcgtggcgtcgctgtatccccagcggcacgcctccgtggacatgcagtcgtcggcgagcatgggtgacacccggtgggtggtgaacgcgcgatatgacgaggtgccgggctggtcaccgcctgcgcctgacgccttgctcttcggggagggcttcgaggtgggcggcccaggccggcggcggatgcgacacatggttcgtggtgggatgggcggcatgcgggagggcnccgtgccaagggccaccatggcaccggcgccgggcgccccgccgcccccgccgctcgccgaggcgcctgcccgggctgaggcgaagatgcaggcggacaaggaagagcgctttggcagcgggggagcgactccggatgcgccgcagccgctgcgctccaacttcgcggagaccgcgttctgggcgccccaggtgctcaccggggcggatggctcggcgacgctggagttcaccgtgccggactcggtgacggcgtggagcgtctgggtgcacgccatcacgcgtgacttgaagggcggctcgctgcagcgcacctcccggagcgtgaaggagctgatggtgcgcccctacgtgccgcgcttcctacgcgagggcgaccgcgcggtgttggaggtgatggtgaacaacgcggcgtcgcgcccgatgcagggcacgctcacgttggacatccaggacctggagctgcagaagagcgtgctgtcggacttcggcgtccagaaggcgtcgcagtccttccgcgtggaagcagggaaggggacgcgcctgcgcttcccgctcaccacgcccacgcgggtggggcccgttgccttccgggtggtggcgcgctcggagaaccacagtgatggtgagctgcgcccgctgccggtgttgccgggccggatgcacctggcgcagtcgcgcttcgtgacgctgaagggcaaggactccaagacgatgcagttcgaggacctgcgcgcgggcggggacccgacgcgggtgaacgagcaactggtcgtcacggtggacacgcagttgttctattcggcgctccaggcgctgccgtacctggtggactacccctacgagtgcacggagcagacgctcaaccgcttcgtgtcgacgggcatcctgtccagcctgtacgggcagtacccgtcggtggcgcggatggccaaacaactgagcgagcgccccacccagttggagacgtgggacgcggtggaccccaaccggaagatggcgctggaggagacgccctggctggagatggcgaagggcggcgccgggccggaggccggtctggtgaaggtgttggacccgaaggtcgccgccgccgagcgcacgtccgcgctggcgaagctccgcaaggcgcagacgtccagcggcggcttcccctggtgggcgggggggcctccgtcgccgtacatgacgctctacatcgtgcatggcctctcccgcgcgatggagttcggcgtggaagtcccgccggaaatcacccggggcgcctggggctacctggcgcggcacttccgcgaggagtacgcgacgaagctgatgaaggaggagcgaggctgggagttcctcacgttcctcaactacacggcctccgcgtatccgaacgcgagctacaccggtgatgccctcaccgaggcggagcgggcgtggatgctcgcgttcagctacaagcactggaagaagcactcgccctacctcaagggctacctggcgctgacgctgaagcgcgcggggcgcggcgcggacgccaaccgcgtctgggagagcgtcatggactcggcgaagacgagtcccgagctgggcacctactgggcgcaggaggaccgcagctggctctggtacaacgacaccacggagacgcacgccttcgcgctgcgcacgctgacggagctcaatccgaaggacgcgcgccgcgagggcctggtccagtggctgctgctgaacaagaagctcaaccactggaagtccactcgcgccacggcggagtcggtgtacgcgctggtgaagtacctccaggcggaaggcgcgctgggcgtgcgcgaggacgcccaggtgacggtgggcccgcgcgtggtgcgcatgtccttcgccccggacgagtacacgggcaagaagaaccaggtcgtcgtgcccgggccggagttgaacccggcgacgatgagctcggtggtggtggagaagacgacgccgggcttcgccttcgcatccgcgacgtggcacttctccacggagaagctgccggacagcgaccgtggggacttcttccaggtgtcgcggcgctacttcctgcgtgagcgacaggggaaggacgccaggctcgtgccgctggccgagggcgccgtggtgctccccggagacgaagtggaggtgcagctctccctgcgtgcgaagcacgcggcggagtacgtgcacctgagagatccgcgcgccgcgggcttggagccggagaacgtgcagtcccgccaccgctgggacttgggcatcgtctggtacgaggagacgcgggactccggcaccaacttcttcttcgagcagctgcccgcgggtgagtacaccttcaagtaccggctgcgcgccaacatggccggccagttcaaggtgggccccgccacggtgcagtccatgtacgcgccggagttcaccgcgtactcggccggggcggtgctcacggtgggcgcggcgaagtag

SEQ ID NO: 5556 - DNA, 768 bp, Myxococcus xanthus
atgcattgggtcgtccagcacaacctgttcaacgagccgggcttccacacgctgatgggcgtgctgcggcgcggcgagattccgcacaccgtcgtgaaggtcatcccgttcgatggcggtgtcgagccgactgtcgacgtcgacgggcccgtcatcgtgatgggctccctcagcctgacacgttacgcgaagcggagaggctggacgccgggcgcgttcctcaacgacaacttcgacttccggatctggcgcgagaaactgggccaccacctgctcaacgccgatgcccaggtccaccgcttcggggacgttccaccgagggagggccccttcttcatccgcccctgcctggacgacaagtccttctccggcatggtgaccacgtgggacgacttcaacgcgtggcgggcgagcgccctcgcattgggcgaaggcgccacggtcgatgccgacacctgggtggccgtcagcccgctgaaacacatccagcgtgagtaccgcatggtcgtcgtcgacggacgtgtcgtcactggcagccggtacaagctcggggaccgcgttgcgtcgtctcccgaggtcgagcccgacgtgcgcgacttcgcccaggccatggccgacacctggacgccagaccgggcctacgtcctggacgtcttcatgcacgacggcggcctgtacgtcggggagctcaacaatctcaacgcggcgggattctacgcctacgacgtcgcgaagatggtggacgccatcgaagcaatgccctggtag

SEQ ID NO: 5557 - DNA, 621 bp, Myxococcus xanthus
atgggcaagccctaccgtcctaaagaccactatttccagaaggccaagcaagagggcctgcgggcacgttcggccttcaaggttgatgaactcatcaagcgcttccccatggtgaagaaggggcacgtcgtgctcgacctgggggcggcgccaggaggtttcctccagatattggcggacgccgtggggccgaagggccgcgtcatcggcgtggacatcgtcgccatccgtcccttcagccagcccttcgtgcagacggcggtgctggacgtgctcgcggatgacttcgacgcgaagctgaccgagctccatgccggccccttcgacgccgtcatctccgacatggcccccaagacgagcggcatcaaggccaccgacgaggcgcgcagcctgcggctggcgggcaaggcgctggagttggccgcggcgcgggggcggcccgggtcgtccttcgtggccaaggtcttcatgggccgggacttcgaggacttccgcaaccagatccgcgccctcttcgaagaggtgaaggtggtccggccggaagccacccgcggcgccagcatggaggtctacctggtgggtcttcgccgccgtgcgccagaggccccggaggcgaactga

SEQ ID NO: 5558 - DNA, 1140 bp, Myxococcus xanthus
atgccccacccattcaccgaggaacacgaggccttccgcaacacggtgcgcagcttcgtggagaaggagatgaccccacacggcctcgagtgggaccgggcgggcatcttccccaaggagctgttccgcaaggcgggggacctgggcttcctgggcatcaaccacgacccgaagtacggcggtagcgggttggactactggtacgtgacggtgttcgcggaggagctgagccgcagcctcaacgcgggcgtgaacatggcgctgctggtgcagagccagatggccacgcccatcatcaacgagattggaacggacgagcagaagcgcgagttcctggagccggcgctcaagggcgagaagatcgccgcgctgggcgtgagcgagccggggtgcggctcggacgtggccagcatcaagacgacggcgcgccgggacggggatgactacgtcatcaacggctcgaagatgtggatcaccaacggcacgcgggcggacttcatcaccctggcggtgcgcacgggcgaggccggctacggcggcatctccctggtgacgttccccacggacgtgaagggcttcggcgtctccaagaagctggacaaggtgggcaacctgtcctcggacaccgccgtcctctacttcgaggactgccggattccggcccgctacgtcctgggcgaggagaacgaaggcttctaccacatcatgaccaacttccagggtgagcgcctggtgggcgccatcaccacggtcgcgggcatggagcggatggtggaggactccatccgctacggcaacgagcgcgaggccttcggccggccgctgatgaagttccaggtgtggcgccacaagttcgtggagcacctgacggccatcgaagcggccaagcgcctgacgtaccacgcggtggacctcttcgaccggaaggagaacccggtgaaggaggtctccatggcgaagctgttcgcgggggacctggcccagcgcgtggcctacgactgccagcagttctacggcggcatgggctacgtggaggagacctccatcgcccgcatgtggcgcgacgtgcgcctcatcaccatcggcggcggcacctccgaggtgatgaaggagatcatctcgaagatctacggcttctag

SEQ ID NO: 5559 - DNA, 1173 bp, Myxococcus xanthus
atgtcgtcgctcccgctcacaggcctgcgcgtgctggacttgtcgcgcctgctgcccggcccctacgccaccctggtgctggcagacctgggcgccaccgtggacaaggtggaggagccggagggcggggactacatccgccagatgccgcccctgcgggatgacgtcagcggcctgttctacggcctcaatcggaacaagcgctccctgacgctgaacctgaagcagcccgaaggccgcgaggcgctgaagcggctggtgcgccactacgacgtgctggtggagagcttccggcccggcgtcatggacaagctgggcgtgggcgagtccgcgctgcgcgcggagaacccccggctcatctactgcgccatctccggctacgggcagacggggccggatcggctgaaggcggggcatgacttgaactacgcggcccgagccggcctgctgggctacggcggagaggccggcggcgcgcccgcgtttcccggcgtgcagatgggggacattggcggcggcagcctcttcgcgctggtgggcatcctggcggcgctgcacgagcgtgagcgcacggggcaggggcgcttcgtggacgtgtccatgacggacggcgcgctggccttcctgcacatgcacctggcgtcgcgcctctacatggggacggaaggcgtcgcccttcagcggggcaaggaggcgctcaacggtggctacgcgtgctacggcctgtatcgcacggcggatgaccggtggctcgcggtgggcgcgctggagcccaagttcttcgcgggcgtgtgtgagcggctggggcgtccggagctgctggaggacgcctacgccccgggtgagtccggcgcgcgcgtgaaggcggagctgacgcgcctgttcgccgagcaccctctggcgtactggcaggagcgcttcgcgggctccgacctctgcatcgagcccgtggcggaaggggacgacgtgctgaaggacccgcagctccaggcccggggcctcttcgtggaggcggaggacgcggtgctgggccgcaaggtgacgcacctgctgacgccactgcgcatgggcgagacgccgctgcgcgcgccgcccacgctggggcagcactcgcgggagattctggaagcggcgggctttaccgcgcaggagcttgcgcggctggggcactga

SEQ ID NO: 5560 - DNA, 141 bp, Myxococcus xanthus
atgaccatctccgtgagcaacgacgacttcgtgaagattcgcgagaagaagctcaacgcgcagatggcggccatgcagggcaagctgaagttcaagcccatggacatgggcctcgcgatgaagctcgcgaagctgctctaa

SEQ ID NO: 5561 - DNA, 312 bp, Myxococcus xanthus
ggcttcgaaatccgccgggcgcggaacgggaaggaggcgttggaccggctggagcccgaaccgcccaacctcatcctgttggacctgatgatgccggtgatggacggttgggagttcgcccagcggatgcggcagaagccgcccgaggtggcgcgcatccccctcatcgtcctgagcgcggaccgcaatgtgggcagcaaggccgcagacattggcgcggtggggcatctggccaagccgttcgaactcaacgatttgttggacatggttcgccgctcgctgaaccccgccgccgcgtccaccatcgcgtga

SEQ ID NO: 5562 - DNA, 1737 bp, Myxococcus xanthus
tggcaggacgtcaccttcgcccagttcctggacgaggtgaaagcgctctccgcgggcctggttgcccagggggtgaagcccggggaccgggtggcgattttcgcgaacaccagtctgcagtggctcatctgcgatgtggccatcagcgccgcgcaggccatcaccgtccccatctatgcgtccaacacgccggatgagtgccggtacatcctcaaccactccgagacgacgctcgtcttcgtggacaacgacgagaaggacgcccggcaggcgggccggctcacgcgcctgcgccagaagctggcggagtgtccggcgctccgccgcatcgtcgccttcgagggccccgttgccggtggcaccgagctgtcactcgccgacgtcatcgcccagggccgcaccgagcatgccgcccgtccggacgacttcgaggcgcgggtggcgggcgtgtccatggaggacaccgcctccatcatctacacgtccggcacgacgggggaccccaagggcgtcatcctcacgcaccgcaactgggccttcgaggcgaaggccgcccagtcggtggggatgatggtgccctctgactcggtgatgctgttccttccgctggcgcacgtcttcgcgcaggtggtgaaggccgcctggctgagcatgggttaccggctcgtcgtcgcggagtcggtggacaagctgctcgccaacctggtggagacgcgtccctcggtgctgccgtcggtgccgcgcgtcttcgagaaggtctacaacaacgtggtggccaacggctcggcggccccggggctcaagggccggctcttccgctgggccttcaagctgttcgacgagtacgtcgaggcacgcagccaggggcgcgagtacgccaccctgggcttcgcgttggcgaagaagctggtgttctccaaggtgcacgcggccatcagcgagaagctgggcggcaacatgcgcgtgttcatctccggcggcgcgcccctgtctccgaagatcggctacttcttcgacctgctgggcctcaaggtgctggagggctacggcctgacggagacgtgcgccggcaccaccgtcaatcgcgagcacaagatcaagattggcagcgtgggcgcgcccgtgccgggcatggaggtgatgattgcctccgacggcgaaatcctcatccgcggcccggccgtcatgaaggggtactacaagaaccccgaggccacggcggaggccatcgacgcggagaactggttccacaccggtgacatcggcgagctggacgcggacaactacctgcgcatcaccgaccgcaagaaggacctcatcgtcaccgcgggcgggaagaacgtggcgccgcagaatctcgagaacgccctcaagacgcacgccatcatcagtcaggccatggtgtacggcgacaagcggccgtacctggtggtgctcatcaccgtgtcggaggagggcgcgcgcagactcctcctggaccagggcgcccctgtgggcacctacgcggacaatgcccgtcgtccggaggtccaggcggcggtgaaggccgcggtggatcaggtcaacacgcagcagccgccctacgccacgctcaagcgcttcaccgtgctggagaacgacttcagccaggagacggaggagctgacgcccaagctcagtgtgaagcggaaggtctgcacccagaagtacagggcgcagctcgaccggatgtacgaaggcaccaccgtcgtcgactga

SEQ ID NO: 5563 - DNA, 597 bp, Myxococcus xanthus
atggcgctggacgccgcgccggaggattacgagctggtctggcgcaaggcgcgcatcctccagtggcaggcggacggggcggccaacgagaagctcaagaaggtgctgggccgccagacgtgggactggggtgagaaggcggtgaagctcaaccccgcccgggtggagggccactactacgcggccaccggcatcggcgcctactcccaggccgtgggcatcatgaaggcgctgggcgaggggctcgagggcaagttcaacgagcggctcgacaaggccatccagattgacgcgggctacgaccggggcgcgccgctgctggccaagggccgctactactacgagctgccctggcccaagcgcgacctggcgaagtccgccagcctctacgaaaagtccatcgcgaagcacccgcagatgctgcgcgcctactacttcctggcggagacactcctcaaggacggcaaggccgcgaaggcgcgcgaggccattcaaaaggtgaagcaaggcagcatcgcgtacgaccccgcggaagggcggcgcgtgcaggagtggtccaagaaagtcgaagccgatatcgagaaggagctcagatga

SEQ ID NO: 5564 - DNA, 90 bp, Myxococcus xanthus
atgggcaaggtcctgttgaaggtctacccgcagtggttcacggagaacgaggagcacctggtgtcgcagcggacctccgactcggcgtaa

SEQ ID NO: 5565 - DNA, 360 bp, Myxococcus xanthus
gctctacagtaccgggggcccgcgggcgtcgccggcgcggccaccacgcccgagtggggcttcggcttcaaggccttccccttcgcgcaggcggtgccccaccggctgtccgtgcgcgtctatggcgccggtgtgatcgaggccacccggaacatgttccgcctctggcgcggcgagcacccgatgccccacatgcatgactggttcgtccagcgcctgcgcatggacttcgaccgggaagtgcccttccagatgggcggcgacgtcatcggcatgcggcgctcgctggagttcgacctggccgaggagagcgttcagctcgtcgactggcgccagctgtcgcgcatggtccggacctag

SEQ ID NO: 5566 - DNA, 702 bp, Myxococcus xanthus
atgccgggacccgtgagctacacctatgagtacccgaggccggcgctgacggtggactgtgtcgtcttcggtctggatgacgaggacctgaaggtgctgctcatccgccgcggggtggagcccttcgccgggcggtgggcactgccggggggcttcgtgcggatggaggagtcgctcgacgacgccgcgcgccgggagttggatgaggaggcgggcatccggccgaaccacctggagcagctctacacgttcggcgccccggggagagatccacgcgggcgcgtcgtcacggtggcgtacttcgcgctggtgaagctcagtgaccatgtgccgcatgcggcgacggacgcgcgggacgcggcgtggttctccgtctgggatacgccgaagctggccttcgaccacgtggacgtgctcggcacggcgctgcagcggctcaagggcaaggtccgctatcaacccatcggcttcgagctgctgcctcccaagttcacgctgacgcagctccagcggttgtacgaggtcatcctggagcgggagctcgacaagcggaacttccgcaagaagatcctcgccatggacctgctcgaggagctggacgaggtggagcaggacgtctcccatcgggcagcgcgcctctaccggttcgaccacaagaagtacaagcagctggagaaggcgggcttcaacttcgagctctga

SEQ ID NO: 5567 - DNA, 594 bp, Myxococcus xanthus
atgctcgttcgcaacgcccccgtctcggcccgccgcccggcgaactccccctcggagtcgcccgccgcggagaagcccaacgccgccgcggctcccgcggccatccaccagaaggactcgttcagcaacacgacgacggcgctccagcgcacggcgaaggtgggtgcggcgcccgcgggcgaccacggcaagctgatgatggagtacctgaccggcgcccgccctcctccggcggacttcgagaaggtcatcggctacaagccctacgccatccagacgccgcacggtcagcggatgcaggacccgctgggctacgcctccgtcccgctgaagatcggcccggacaaggagttcgaccccgcggccaagacgcacgactacggctacgacctgctgcgctacttcgacaagaagggcacgccgctcggcccggatgcacgcaaggccgccgacgccctcttccgcaaggacatgttcgactacgcgaacgaccagaagggcgcgctgaaccgcttcaagtaccgctcctgggcgcagatctacgccaccgcggtggagctgaactcgaagcggcagggcaacggccctccgtga

SEQ ID NO: 5568 - DNA, 804 bp, Myxococcus xanthus
atgtccgcgctgcccttcgacgtcgccgctgcctcggtgctgggccgggagcacgcccgagcgggtcgcaacaaccaggatgcgctgtgcatccgcgccagtgagcatggcctggtggccgtggtgacggatggctgtggcagccagccctgcagtgagctgggcgcacaactgggcgcgcgcaggttggcgcgggccgcgctggtgcggctcgcggacggtgagcgcgtggatgagcccaccttccttccaggccttcgtgaggatgtgttgtgcctgctcagtgagctccgggcggacctggggcgggaggtgatgggggacttcctcttcaccgtggtgggcgcggtggtgacgccctcgctgacgctcgtcttctccgcgggagacggcgtgtgggcactcaatggcgaggtgcatccgctcgggccatttccggggaacgcgccgccgtatctcgcctatgcgttgatgcacggagaggacgtcgcgctgaccacgcgggccctggtgcccacggaggacgtccacgcgctgctgctgggcaccgacggtgtggtggacctggagcggctggccaccacgcgcatgccggcggggaacgaactcgtcgggccgctgtcgcggctctggacggaggaccggtacttcgccaacccggatgccctgcgccgccggttggccttgctcaaccgagaagccgtgcgcgcggacttcgcgtcccagcaactggcgcgaactccgggcctgctgccggatgacaccacgctggtggtgctgcgccgccgcatggggagggcgtga

SEQ ID NO: 5569 - DNA, 1878 bp, Myxococcus xanthus
atggacgtctggctcgaaggcaagaaggtgcggttgaaccccgcgcgagcgctgggcaagggcggcgaggcggacgtgttcgacatgggggatggccgcgccctcaaggtgttcaagccacccgagcaccccgactacacgggcctgcccgcggagcaggccgcggcgcgtgtccggttggacgagcaccaacgcaagctgcgcgtcttcccggcaggactgcccggccgggtggtggcgccccaggccttggcgacggacaagaaggcgcacgaggtcctgggatacgccatgcgcaagctggacggcgtggagcccttgcggcgcttcggagagccgtcgttccgcagggcaggcgcggcgtccgggcgggtggtggacctgctgcgcgacctgcatcggacgctcgacgcggtgcatgcgtcgggcgtggtggtgggggacttcaacgacctcaacgtgctcgtggcggggacgtcggaggcgtacctcatcgacgcggacagcttccagttcggcgggttcctctgtccggtgttcacggagcgcttcctcgacccgctgcggctcgggagcacgggcacgcaagggttggtacccagccgccccgcttccatcgagagtgattggtatgcctatgccgtcgcggtgatgcagtcgctgctgtgcgtggggccgcacggaggcgtctacaagcccaggagcgcggctgctcggacgacgtccgcgggccgggtgctccaacgcatcaccgtgttccatccggaagtgcagtatccaaagcccgcgttgccgctggcgaccttgccggacgacgtgctgcaccacctgcaccgcgtcttcgtggaggaccttcgcggcgtctttccgtatccgctgctggaggggctgcgcttcaccccctgcgcatcgtgcggcgtggagcatgcgcgagcggcctgcccgacgtgtcagccccacgccaccgcgactgccacgccggtgacgtcggtccgaggccaggtgacggcgacgcggttgttctccacgcgaggcgtgctggtgcacgcgagcaacgaggcgggcatccttcgctggctctaccacgcggaaggcgcgtaccggcgcgaggacggacgcgtggtgctgcgcggggcgctggacccgtcgctgcgctgggccttgcaaggggacgtgacgctggtgggccggggcggtgaggtggcggtgctggcgcccggccggcccccggaccggatgggcgtggatgcgccggagggccagtccgctttcgccaccaacgcgcggcaccggtactgggccgtgggcggcgggctgtggcgggacggcgcatatgggccggagcgcgtgggcgcggtgctcgaaggacagacgcggctcttcgtggggccacgcttcgggttgggcttccatcgcgcgggcggtctgcgcggcgccttcgtcttcgatgcggagcgcctgggcttgaaggatggactgtcgctcccctggcccacgggaaagctcgtggacgtggactgtgtcttcgatgggccctccgcctggctgttcctggtggaggaagccggtgggcgcacgctgcatcactgcgtggtggtgggccacgacggggccgtgcgcgcgagcgcggtggcggaggccggtgacggctcgtggctgggcagcgcgccacgtggacggtgcgcggcgggcgacgcgctgttctgcgccaccgatacggggctcacccgtgtggagcttcggcagggccgcctggaggcggtgcgcgagttcccggatgccgagcccttcgtggacgcgggctgctcgctcttcctcgtgcggcaggggctggcggtggtggggcggcaggacatcaccgtgctgcgaatgaactga

SEQ ID NO: 5570 - DNA, 930 bp, Myxococcus xanthus
atgtcggcgacggacgcgttcaacctgcacctgttgctcatcgacgtgcagaaggacttctgcttcccagagggctcgctctacgtggcgggacgcagcgggcgcggcgccgtggatgacagccgtcgcatcgcggagttcatctacagcaacctcggcgcgctgacgaacgtgacggcgacgctcgacacccacttcgcgtaccagattttcttcccgtctttctgggtggaccaggacgaccagccgctgacgccgtaccgcgaggtgacgcgcgagcagattgagcgtgggcaggcgcggcccaaccccgccatggcgaagtggctgtgcggtggcaactacccctggctgctcaagcaggtgaagtactactgcgaggaattggagcgggcgggcaagtacacgctgtacctgtggccgccgcactgcctgctgggcagcgacgggcacgcgctggcgggggtggtgcaggaggcgcggctgttccactccttcgcgcgtggcatgcagtcgtgggcggaggtgaaggggggcaatccgctgacggagaactactcggtgctgcgcccggaggtgttggggcggcatgacggccagccgctggcgcagcgcaatacccagttcctcaagacgctgctgaccgcggacgcggtggtgattgcagggcaggcggcgagccactgcgtgaagagctccatcgacgacctgctcggcgagattgtcgcgcaggacgcggcgctggctcgcaaggtgtacctgctgacggactgcatgtcgtcggtgacggtgccggacggcaaggggggcttcgcggcggacttcaccccgcaggcggaggcatcgctgaagcgcttcgcggacgcggggatgcacctggtgaagtccacggacccgctggcgagctggccggacctgcgcatcgcctga

SEQ ID NO: 5571 - DNA, 798 bp, Myxococcus xanthus
atgagcagcaaggcgaatggcagtggcatccggaagctcttcgaggacgcccacgcggagggcgtgctgagcccggcgggattgcaggcgctgacggtggtggacctgggcgcgcagattcaggcggggctcggcgtctgcgtggaggacgtgcagtccagcgaggtggtgctggtgaccgtgatgccggatgactcggggagcatcgactactccgggcattcgaagacggtgtgtgacgggcacaacctggtgctggacgcgctgctggcgagcaaacagaaggacggcgtcctcttccacacgcgctacctcaacgggttcgtgctgaacccgtaccggccggtggaggacgtggtgcggatgcatggcaagaactaccgggcggaccatggcacgccgctgtacgaccagtcggtggtgctgctgggtacggtgctggcgaaggcgcaggagttcagcgccaacggcgtgccggtgcggacagtgacactgttgattacggatggctcggaccagcactcgacgtcggcgaaggcaaaggacgtggcggcgctggtgaatgacctgaagcgcgcggagaatcacatcgtcgcggcgatgggcatcaacgacgggagcacggacttccggcgcgtgttccgcgagatgggcatcgacgacaagtggattctcacgccagggcagagcgcacaggagattcgcgcggcgttccaggtgttcagccagtccgctgcgcgggtgagtcagggggccgcgagcttcagccgtacggcgctggggggcttcgggcagtga

SEQ ID NO: 5572 - DNA, 1194 bp, Myxococcus xanthus
atgtccgacagcccgcgcgtcctcctcatcgctgaacgctttcctcccgacatcggcggcctggcccgcagtggcgcgcgcaccgcgggctcgctggtgaagctgggcgcccgggtggacgtgctggcctggacgcgcacggcggcgccaggcgcgctccagacggtggaggacgccggggacgtctcacccttcgcgcggggtgtgacgctccaccggctggggttgttcggcagcacggacctgtccatgcagcacacgctcgacgtgctcggctacctgcacgcgaagcaacgctatgacctggtgtgggggcactacctgtctccgcccgggttcctcgccgtcgccttcgccgagtccgtgggcattgcctccaccgtcagcgcccggggcaacgacgtggaccagctcatgttccccccgggcgacttcgcgcgcctgctgtggacgctgcaacgtgcccgcgtcctcaccgctgcctccgcggacctgggccggaagatgtgcatgctcctgggacgggacgaaaccgtggaggtcatcccaaacgccgtcgacaccggcatcttctcccccggtcccgcggacccggcgctccgggagcggttgggcatcgcgccagacgaagccgtgctcggcttctccggtgaacttcggcacaagaaggggctgccgttcctgctctccgccctcaccgaggtgcgccgcgtccggcccgcgtgcctgctcgtcatcggcgaggtgcggccgcgcgacgccgagcacctggtcgccttccgcgccgagcatcccgaggacgccgcgcgcatcctcatctccgggccgctggacacaccggaggccatcgccgcgcacctgcgcctgtgtgacgtctacctccagccgtcgctgtgggagggcatgcccaacgccttgctggaggccatggcctgtgcccggcccgtcatcgccagcgacgctggcggcatccccgaggcggtggacgccggacgcaacggcttcatcgtctccaaggccctgctcaatcacctggggcaggcgtgcctggatgtcctctccctgccgctcgaacagcgcgccgcgatgggcgccgccgcccgtcagcgcatcgaggagcgctttcaggcgcacgcggaggcagaggtgctccgtcgcgtgctggctcgcgccatcccgagccgctcttcgtag

SEQ ID NO: 5573 - DNA, 729 bp, Myxococcus xanthus
atgacgctggatgaggggctcgaggacgcgctcgcgtggcggctcaccctgtggccgggcctcgtgctgctcgcggggaccgtggggtgcttcgtcgtgtaccttcgcttccggcgcctggacctggagaaccggcggtacacgctggcctctcaggtcatccatcggctgcgccgtgacatcggccctgatgcgtcggtgaggctggagctcgacttcacgcccgtggacagcccggagaagctgctcggcaagcacaccacgcccagcggctgggaagcggagaacttcagcgacccgtggttctccctccagacgcggctgctggacggcacgcacctgcgcatcgccatggtgcagcggctcatgaagcggtcgcgcacccggcgcagcgccagcggcaagtacaagacgaagcaccggcaggacagctgggcgttgctccaggtccaattgcgagtgaaggcggcgcgtcatcaggacctggcactgctcgagccggaggcccgtcaggcgatgcgcctgccgggggacgtcgccgtggacaagctccagttgggcgaggaccggatgttcctgcgcaccctcgtggagaaggactgggatgccgggcccaatgtgcagggggacgcggtggatgcgccgaagacggtggtgatgatgctgctgagcctctaccaggtcctcaattactccagacaactgcgtcagcaggcgaaggcttcgtga

SEQ ID NO: 5574 - DNA, 696 bp, Myxococcus xanthus
atgatgggcatgggccggttccttctctgttgttccctggtcgcgctcacgggcgccgccgggtgctccaagcccggtgacgccgaggtgccgcgagccgttcgcgcgcaggaggccgccggcgcccccgtcgccgccgcggacgtaaagggcctcgagggcaagctcaagttcaaggacgacgccgaccgcgagcgcttctccctcaagccgaaggacgacggcgccaagctggtggatggcgaggagcgcgagctggcgcgttacaagtggaagggcgcgtcgctgaaggtctcgggcccggatgacgtggcgctgggatatgtcgtcggctccgcgggcggggcgctcaccgtgcgggacggtgagcagcggcaggtgctgttcacgctcgcgcggcaggggccgggctggcgcctcaacgacatgaagggcacgctcctgtactccgtgtggccggaggatgacggtgctcgcatccaggacggcgctggcgcggacgtggcccgcgtgaaggtgcgcgagggcaaggtctccctgcgtgatgcgcaggggcgcacgttgctcgccaccaagtcgctgttggcggcggaggccgccgcgtgtctcgctttcgaggcgctggagctgccgctgcgcatggcgctgctcttccacctccaggcgccgccgtcccaggagctggcccagccatga

SEQ ID NO: 5575 - DNA, 270 bp, Myxococcus xanthus
atgccgctgtgtgagcagcacgtgacgtccgtgggcgcggagatgctctgcgcgacgtgcgcgcggcaccatgaggactccacgggggaccggaacggcgaggacgaggaccacccgagctactactacgacaactacgggtactacggcgcctccgcctcgtcggggagcggcagggcccatgacgccaacgatttcaccgaggctgacggcgcgagcctccgccacgaggacgacgcctccttcgaggaggacatgggcggtagctga

SEQ ID NO: 5576 - DNA, 1059 bp, Myxococcus xanthus
atggctggccgctggctcgtctatgcgttgggaggcggcatggggcacctgacccgtgcctccgcgttggctcgtgcggcctcgcgccgagggcacgccgtcgtcctgctcaccaacagcccgttcgcgagcgggctcccactggaggacgtgctgggcactggtgtcgaggtgttccggctcaaccccgcgctgggacgcgaggccgtgggcgaagtggtggagcagtgcctggcggacgtgcgcccggacctgttcgtcgtggacacctttccccgggggctcggaggcgagctggcgccgatgctgccttccgtgcgcgcgcgcaaggtgctgattcaccgcgacgtgaatcccacgtacgtgaagcagtacggcctggcgcgggcggtggacgcgttcgacctgctgctcgtcccaggtgaggccgcgcccttcgcgaaccatcctcgcgccgtgaggaccgcgccctggctgctcctgcgggccagcgagctgctgccccgtgacaaggcccgcgcgcggctgggcgtgcccgcggaggacccgcgcgccctggtggcggtgatgggctgtggcacccccgaggaagtgggggaggcggggcacatcgccgcccggctggacgcgatgctggggccagaggccgtggtccggtggctggtgccgcccggagcggcgatggatgtgcccgcgccgcgcgcgaagcagggcagccgggctggggcttccctggaggagggcctggccctgcgcatggccacgtggcccgcgctggcggtgctccccggcgtgcacgtgctcgtcggcgcgggagggtacaacaccgtgcaggaggcccgcgtcaccggaacgcccttcgtggcgctcgcgcggccccggctctacgacaggcaggccctgcggctgcgccccgaggagcgggcgggctctgtggaggcgctggtgacgcgtgccgccgggctcgctcgtgcccgaccggctcggagcctgaggccctacgtcaacgggacggacgacgcggtgacgctcatcgagcgcaccgtcctcagtgcttga

SEQ ID NO: 5577 - DNA, 276 bp, Myxococcus xanthus
atgagcctgcgctcctggctcgccgccaccatgggggtgctgacgttggtgacgttggcggccgccaccctgctcatcgtcctgacgagcgtgctcgaccgttcggccgcgaccctgggggtcgccttcgggggcatccgggtgtccgaggagctggaggtgggtctgctggcgcacgaccggatggtccgggaaggccccgtcaaggtgccccgtggcccgggcgggctgtcgcggatcgagctggaggccctcgctgtaccggcagatgggtga

SEQ ID NO: 5578 - DNA, 414 bp, Myxococcus xanthus
atgaattcgaagctcgtgttcgctaccgtggccctgctgtcgacgtctgccttcgccgaggaggatctcaagcccgcgcaggaggaggcgaaggcgtcgttcgaggagaagatctccgaggctttggctgccgcgaacgagaagtgtggcaccaagctcaccgtcaagaccgacttccagaacttcaagccggaggcctgggcgaactcgagctatggctcctactgtgaggcggccatcaatgggatcaccagcatgtgcgagcgcccggcctacaagaaggcgatcgcgaagaaggtgaccggcgtgtcgtgcctgttcggtggcgtcaagccgcccgagaagaaggacggcaccaacgacgcgacgctgcggaatctctcgctcgacaagggcacgctggcgtaccgcatg

SEQ ID NO: 5579 - DNA, 1194 bp, Myxococcus xanthus
atgggtgagctgcggcgcatcgcctcgacggcggcggagcgtcagcggctcgacgctgtccgcgaggacgtggacgtctacttctccgcccagtgggacccggtgcgtgcggagcaggaggcgggcccggcgctggacgccgcgttgagtggcttggaacaggtcagctccatcaacgtggagcgcgcgcgcgtggcccgctcggaagcggagcggtggaacgacatggcggactccgtgggcgtggtgctctgcggcttgctgctcttgggcgtgctcgtcgtgagcgtgctgctgcggcgcgtggcgctccagccgctgcgggacatcagccagtccatgcgccgcttcggcgcgggctgcaggcgcgcccgggccccggaggccgggcccaccgagctgcgggacatggctcgcacgttcaacgagatggccaacagcctggcccaccagcaggagcagcagctcgcgttcctcgcgggcgtggcgcacgagctgcgcaatccgctgtccgccctcaagttgtccacagccctgtcggaccgcagccgcgcccagctcacgcccgagcgcatggaccgcaccctgtccctggtagggcggcaggtggagcggctggaccgcatggtgggcgacctgctcgatgccacccgcatcgaagctggcaggttggagttgcgcccggaggtgcgggacgcgcgtgagctggcccgcgaggtggtggagctctaccgctccggcgacaccggccatggcctccgtctcagcctgccggacgtgtccgtgccggttcgcgcggacccggcccggctggagcaggtgctccacaacctcatcagcaacgcgctgaagtactcgccggcgggcagcaccgtggaggtgtccgtgcgccgcgaaaaggacacggctgtcctttgcgtgacggaccagggcatcggcatttccgaggaggagatgcgcctgctcttcgcgcccttccagcgcgccggcaacgcccgtcagcgcgccccgggcgtgggcctgggcctgtcggtggcccggcgcatcgtcgaggggcatgggggcagcatcgacgtgacgagccagcccggccacggctccgtcttctgcgtgcggctggccgtggccaccgaggccgttcggcatgccgaagaagacgcggggctgacgtccctcgaggacaccctgcactga

SEQ ID NO: 5580 - DNA, 606 bp, Myxococcus xanthus
atgaagaccccgcgccgcgccgcgccgctcgccgccctcctggccctgggagggctgggggcgtgtgcctcccgccagcaggcaccgaccgccgccgcgaagcccgaagccccgcgggccgccgagcctgtcgtccggtccacggaagggggcttctccgtcgcgattcccgggccggtgagcgaggagcgccgttcgcaggagacggatgtcggcgcggtgacactccacaccttcatcgccgtgcggccggaggtggataccgcctactacgtctcctacacggacttccccgcggccgcggtgtcccaggcggatccgcgtgacgtggtggcccgggccagccacggggcgctggaggcgctgggcgccaccgggctgtccgcgcggccgctggtgctgagtggcttcccgggctgggaggtggagggcgtgtccggcccgcgccacctgcgaggacgcttcttcctggtggggccccggctctaccagcagttgctgctacacccggagggcaagccgccccaggacgcggaccgcttcttcgagtccttccagttggacccccaggtggccgcgatgttgacgggagagcggcgctcctga

SEQ ID NO: 5581 - DNA, 1302 bp, Myxococcus xanthus
atgcctgttcgtcccgaacggaccgccgaggtccaggccctggccgagaagctgggcgcgcccggtgcgaaggtggaagacccctgcgtggcacccctggggaacggctgcgcgcgcacggcgctggcgcccttcttcgcgtcgctggatgcgttggccacgggcaccgccacccgccccgtcgtcatcgaggccttcggcaactcgctgattgccggggaccgcatcgtggacgtcctgcgcgacgacctggccacggcgttcggaagcgcgggccggggcgtgttgctcgtggaccgcatggcgccctacggcgggcgaggccgcaccagcgccagcagcagtgggtggcagccgcgcaccctgggcgagctgcgcgcgcctccgcacgccttcggtgtcaccggcgtgtatcacgtggccacgaacgccaaggcgcgcagccgtttcaagctggatggtgagccgcgcggaacgctgtggtggctggatgtgccaggcgctggcgcggtcagcctctccagtggcggcaaggtgctggcgcggaccgagcccacgggaagtggcttgtcgcgcgccacccacttcgagctgcccgaggacgcacagacgctggacgtggtggccgagggacagggcgcggtggtgcagggcgtggtgttgcagcatgcgcggcccggcatcgtcctggacacgctgggcgtgccttcgtcggacgcgagcctctatgcacgcatcgacggcgccacgctcacgtcccaactcgcggagcgttcgccccagttgctcgtcttcttcctggggggcaacgagtccaagcgcatcgaatggaagcgcctggacatggagaagctgcgcacggacctgcgggcgctgctccgccgcgcgcgggaggcggcgcccgggagcgcgtgcctgctggtggggcccatggacgcggtgaaggggcccggcgcgaaggctcaggcgctgacgcagcgttcctcgctggaggcggtcaacgccgccgagcgggaggtcgcgctcgccgaagggtgtgcattcttcgacttctacgccgccatgggcggaaagggggcgctcgcgcgcttccatgcgtccggctacatgcatgacgacctggtgcatccgcgcggcgcggggctggacgtgctggggcacctggtcaccgacgcgctgctgcgcgcctatgtggagacgccgccgtccgcgcggggtgtcgcggcggtgatgcccacgccctcgggggcgggagccgcgcccaccggggtgtccgagcccagcgcggaggccacgccatga

SEQ ID NO: 5582 - DNA, 2136 bp, Myxococcus xanthus
atggtgtgtgagcccgccagcctcgacgccgagcagtcccctcgggccttctccgaggaagtgcgcggcgccctggacgcggtcgtccgcgccgagctgtcacaggggcccgtcgcggggctgtccgtgggcgtgacacgcggcgcggagcgctgggtgtgtgcctatggccttcgcgacgtgggccgcaagctgcccgcgacgccgcgcaccacgtaccgcatggcgtccgtcaccaagtccttcacggcggtggcggtgctgcagttggtggagcaggggaagctgaacctgtacgcggacatctccaccctggtgccgacctatccggccaagcagtggcccgtcacggtgagggacttgctgggccacgtgagcggcgtccccacctatgacggggtggcatccacccgcaacgtgaaggcggtgagcacggaggcggccatcgccgccttcgcgggcaagccgctcgccttcgagccgcgcacccgctacctgtacacgacgtggggctacaacctgctgggcgcggcggtggagacggcctccggccagtcctaccgcgactacctgcgcgagcacatcttcaagcccgcgggcatgccgaacgcggacctggacatcaccgccacgcgcgatgagcaccaggccaagggctaccgcatccagggggcggcgctgaagccgtcgcgcttcctcgacgtgtccagccgcttcgccggtggtggcacccgcgccacggtgggggacatgctgggcttcggccgcgccgtgctgtcgcacaccctggtgtcgcgcgagacgatgggccgcatgcagacgtccatgtccaccctcgacgggcgcctcaccgactacggcatgggcttcgcgacgtatccgctgcgcggccactacgtggtggcccacgcgggcggccagccggagacgaccacgctgctgatgatgctccccgccgaggacacggtgattgccctggcctccaacgtggagggcgaggcgcggcgcatgcgccggctgtccatccgtttgctggagcaggtgctggaagagggcaacacccgccgcgatgtctacgtggcggacccggtggatgcggtggtgcacgaagggctcagccgcgtcgccagctatgggctgtcttatcaccagtgggccacgcgaggcccgggcgtgctgccggaggagacggacctgcccggcgccttcgcccaggtgtccgcgatgctgaaccggaaggagattggccgggacacccgggcggcgctggagcgtgtccgaagcgggcatgacccgcgtctgcgcgccctcttcatccgcgtgggcgcgcacatggcccgcacgttggagaaggtccacggcggggctcggctgaaggactacaccgtcgaaggaccgctggcgttcttcgaggattacctggccgcttgtgacgcgaagcaggttccagaggcggagcgcatcagcgagtcgctgcgcgcggacgtgctccgtctggccgcgagctggaagcgcgcgcagttgcccgagctccagcgcctgcgcctggacgaggagaagaacccggaggcgcgctgggccgcgctgcgcaagtccgtcaccgcgtcgccggggttccatccggattactcagacgagttgctgcgcatcgcggagggcttcgcctggcgcaagcagcccgctgcgcggcggcgctggttggagcgggcggtggagctgcagccccggggcctggatgcgcgctgggccctggccgaggcgttgctcgcggcgaacccggaggaggccgtgctgccgcatctgcgcgaggccgtggccacgccgcagggcacattggcgctcgcgcctcggaacttcctgaagcgcctcatcaacgcggagtccaccgcggtggcggcgggcctgctgcgcgcgggcgtggcgttgcatccggatgcgcccgaattgtgggatgcgttggcgaagcgggagcagtccctgggccggaaggcggcggccaccgcggccctgcgtgaggcgaagcgggcgcgtgaggcgcccaggccggaagccgcgccggtgccctccgtccccgaggtgccgggcgccagcggccccgttccggatgaccacgggctggtgcccgcggggaagtga

SEQ ID NO: 5583 - DNA, 558 bp, Myxococcus xanthus
atgctgcgtccctcggccaccttcgagcgcgcgcggccggagggttcggtgggcagctccctgggcttcgtggcgctgtccaacctggccgcctccttcaccacggcgctcttctacctggccctcctcttcgccatcccgcgtgagatgatggatggcgacaacgtctcccagagctggttccggctggccggagtcggggtgttcggggtgatgatggtgctggcgcctgtcatcggcatgctcgtcgcgctcatcaactccgcgctggaccacgtcgtgttccggatggatggcaccggtcagcccttcgtagtcaccctgcgcgccaatgccctgtcgttgtcgccctacatgatggggctgattcccttctgtggcatgtatggcgcgcccttctgggccctggggctgcgcatctacgcgtaccggagcctgcaccgcacgggctggagcaccgcggcggtggctgccctggcggtgccgctgctctcctgtggtctgttcttcgctgcctacgcggtgattgcggtcgtgggcgccagcatcggcgggtag

SEQ ID NO: 5584 - DNA, 1017 bp, Myxococcus xanthus
atgcgggtggctgtcttcgacacacaccgatacgaccgggacgcgctggaggccgccaacgcacgtttcggacatgcgctcacctacttcgagccgcgcctgacgctccagacggcgccactggcggagggcttccccgccgtgtgttccttcgtcaacgacaaggtggacgcggccacgctggaggtgctgcacgcgggtggggtgcggctcgtggcggcgcgctccgcgggctacaaccacgtggacctcgaagcggcgcggcggctggacatgcgtgtcacgcgcgtgccggagtactcaccccatgcggtggccgagcacgcggtggcgttggtgctgtccctcaaccgtcacatcccgcgtgccttctctcgcgtgcgtgattggaacttctcgctcgacgggctggtggggttcgacctcgccggcaagacggtgggcgtggtgggcacgggccgcatcggccgcgtggcggcgcgcatcttcaagggcttcggttgcaatgtgctctgctgcgacgtggcgccggacgcggccttcgagcgcgagctgggcgtgcgctatgccccgctcgacacgctcttcgccgagtcggacatcctctcgctgcatgtcccgctgacgccgggaacgcggcacctggtggacgcggcggcgctggcgcggatgaagcggggcgtggtgctcgtcaacaccggccgaggcgcgctcatcgacagcaaggcgctggtcgccgcgctcaagtccggccacatcggcggcgccggactggatgtgtatgaagaagaggagggcgtcttcttccaggacctctccgggcaggtgctccaggatgacgtgctggcgcggctgctcacctttccgaacgtgctcgtcacgtcgcatcaggccttcctcacccatgaggcgctcgccaacatcgccgagacgactctggcgagccttcaggcctttgagcgtggcgagcccctggtgaacgaggtgcgcgccgagcaggtgctccgcgcgcgttga

SEQ ID NO: 5585 - DNA, 1293 bp, Myxococcus xanthus
atgtccattgtctgtgccaccaacttctccgacgccgcgcggcgggcctccacgctggccgcggagctggctcgcaaggccggtacgtccttgtggctggttcatgtcctcaaccccgactccgtgcgcgccttcggcaaagccctgttggggtccgccgaggcggtgctgagcgacgagacgaagcgcctggaacagctgggggtgaaggtggagcccgtgctcctcaccggcgagccggcggtgatgctggaggggttctgccgggagcagggggcctcgctggtggtggcctcgcgagccgcggacgaatcgcccttcgggggcgaaggtggcacggtggaccggatggcgcagtcgctgacggtgcccctgctcgtcatgcgtgaccccgcaccgctggaggcgtgggtccggggcgagcggtccctgaaggtgttcctcggcgtggaccgctccctgcccttcgaggcggcgcgcgactgggtgctgacgttgagcaagggtggccgggtggacgtggtgggcggacgtgtctactggcccgaggaggaagcccgccgcctggggctgcggcaggccttggccttcggtgatgccctgcccgagctgcagcacgtgctggagcgggagtgcgcggagttgctggccccgctggcccagggcggaacgcccgtgcgcgctcgcgtggagatgggcgtggggcgcatcgccgaccacctggtggacctggccgagcaggagcacgcggacctgctggtggtgggcacgcaccaccgccgcgcgctggggcggctgtggagcgtgtcgcgtcatgcgctgcggctggcgcggatgtccgtggtgtgcgtgcccgcgcaggcgatggcggtgggcacggacacgccgttgccggagtaccgcgaggtgatggtggccacggacttctcggagacgggcaaccgcgcggtggcacatgccttcgcgttgacggctccgggcggcacggtgcacctggtgcacgccacggaatcgaagccgtcactcgaggaggaggcccagatgcgcgagcaactctcggcgctcgtccccaagagcgcgaacgaccggagcgtgcggctgaacatcatccccggcagcaaggacgtggtggccacgctggcgcagacggccgagcggctcggtgtgagcgccatcgtcatgggcacacatgggcggtcgggctggaagcgcgccgtgttgggctcggtgacgcagtccctgctgctgcgcacggaccggcccgtgctggtggtgcggcccccggcgacgtga

SEQ ID NO: 5586 - DNA, 1161 bp, Myxococcus xanthus
tcgtggctggagttgagtgcgtccgccctgcggcacaacgtcgcggtgttccgggccctggaggggcagggggcgccgcgagcactgggggtggtgctcaagggcaacgcgtatgggcacgggctcgcgcaggtgttgcccgtggtccacggcgaggtggacctcctctatgtcattgccccgcaggacgcgctgaaggtgcgggagtacgagcgggcacagggactggggccaaggcaggtgctcgtcctgggcgcggtggcgccggatgaggcggtggtgttggcgcgcgagggcgtggacgcggtggtggcggaccgtggctgggcggacgcggcggcggtgttgcgcgcggcgaagctggagcgtcccctgcgggtccacgtccacctcgacaccggtctggggcgcgagggcttcacgctggaggggctgcccacggagtctcgtttcctctcggagtcccgcgacgtgctggaggtggtgggcgtgctcagccacttcgccaacacggaggatgtgacggagcagggctacgcgttggcgcaggtggacgccttcgagaaggggctggcgttcctctccgagcaactggcgccggcccggccgctgcaaaggcacatcgccgcgagcgccgcgacgctggtgttgccccgcgcccgctatgaggcgctgcgcgtggggatttcgctctatgggctgtggccgtcgccggagacgcggctgtcggcgcggctggtgctgggtgaggttccggtgctcaagccggtgctgtcgtggcggtgccgcagccaggtggtgaagtggctgtccgcgggcagctacgtgggctacggctgcacgtaccggtgtccggagcccacgcgtatcgcggtgctgccggtggggtactacgacggctacccgcgcctcgtgtcgggcaaggcgcacgtgttggtgaatggccgccggtgtccggtgctggggcgggtgatgatgaatcacctcatcgtggacgtgacacgcgccacatccgacgagcgtcccgtgacggccaccctgatgggccgcgatggcgaggagtccgtgcccgccgagtcactggccggctgggcccagacgattcactacgaactcgtcacccggctgggggcgcacctgaagcggacggtggtggcgtag

SEQ ID NO: 5587 - DNA, 2754 bp, Myxococcus xanthus
atgcccaacctgctccgtccagcggcactggccgctgtcgccctcctcagtgcgtgcggtgcccggcagaaccctcccgccaccgctgaaccccctttggcccaggcgtcacgacaggccgtctccgccacgccgccgtcaccgaagctgcgcctgcccacggaggtgcgccccaccggctacaaggtggcgctcacgctggacccgaaggtgtcctcgttcaagggcgcgatggacatcacgctcgacgtgacgaagcccacgtccgtggtgtggctgcacgccaagagcctcaacgtgacgggggccgtgttcatccagaacggttcggccttcatcgggacgcccgtgaagggcgaggaggacttcctcggcttctctgtggcgaagccgctggccgccggccgggcgaggctggtcatcaactatgaaggcgtcgcgtcggagaaggagacggacggcgccttccgcgtcaatgaaggcggggactggtacatctacacccagttcgagccggtggacgcgcgccgtgtgttcccctccttcgatgaacccggcttcaaggtgccgtggcagctcaccttccacgtgcccgcgggcgtcgtggccgtcaccaacacgccgcaggagtcggaggaggtgcgcccggacggtggccgcacctaccgcttcgcgcgcacgcagccgctgcccagctatctcatcgccttcggcgtggggcccttcgacttcctccccgccgcggacgcgggccagaagaaggtgaagacgcgcatcatcaccccgcgcggccgcacggcggagggcgcctacgccgcgcaggtgacgccggaaatcctcgccgcgctggaggactacttcggcatcccgtacccgtacgagaagctggacgtgctggcggtgccgctgctgcgcggcgccatggagcacccgggcctggtgacgttcaactcgcgcctcatcctcgcgaagccggaggaagactcgctgggccgccagcgtgccttctccgacacgcaggtgcacgagctggcgcaccagtggttcggcaacctggtcaccatgcagtggtgggatgacctgtggctcaacgaggccttcgcctcgtggatgaccccgcgcatcgtcgaatcgtggcgtcccgcctgggacgcgcccgtcgagcgcgtgcacgaccgcgcccgggccctggacgcggacagtctcctgtcggcgcgccgcatccgccagcccatcgagagcgccaacgacatccacaacgcctttgacggcatcacctatggcaagggctccgcggtgctcagcatgacggaggagtggctgggccgggatgtcttccagcgcggcatccagcgctacttccgcaagcacgcgggcggcaacgccaccgcgaacgacttcctggacgccgtgtccgctgagtccggcaaggacgtgacgggcatgttggggagcttcctggaccagagcggggcgccgctcgtcaccgcgtcgctggcatgcggcgcggacggcgcgaaggtggtgctcacgcagcagcgttacctgcggctgggggccgcgtcgccgggtccgcagacgtggaaggtgccggtgtgcgtggagtacgcggcgggcggcaaggaggcccggacctgcacgctgctggagggcgagcgcgccgaggtggccctgagcgaggcgaagacgtgcccggactgggtgttccccaacgcggagggcgcgggctacttccgggtccagctcgatggggacgcagcggcgaagctggcgaagtccgggatgaagcggctgtcgcgcaccgagcgggtgacgttcctgacggacgtgcgcgcgctggccctggctgggacgattcccgccgccgaggccctggccctgacgagccgcctggcgaatgagccggaccgcgtcgtcaccctggcctcgctggacctgctggagctggtcagctcgcggctgcttccggacgagaagctgaaggaccgggctcgcttcctgcgtgagacctatggcccccgggcgcggcagctcggcttcgccccgcgcaagggcgagagcgaggacacgcgcctgctccggccccggctggtgcggctggcgggacgggacggcagggatccgaagctgctcgcggaagcgcgtgccctcgcgaacaagtggctgaaggacaatcgcgcggtggcgccggagatggtggacgtggtgctcgccctcgccgccaccgagaacgacgcggccttccgggagcagctcgtcgtggcggtgcgctcggagaaggagcggcgcacgcgccagcacctcatcggcgcgctgagcagcttcacggacccggtgctggtgaagcagaacctggccctggtgttcgagaagggcttggacccgcgtgagacgatgtggatggcgttcgcggcctcgcagggactgcgcacccaggacgtggccttcgacttcgtgaaggagaactacgaccgcctggtgggggactcgcccgaggcgctgctgtcactcgatgccgcggggcgcatggcctacatcggcagcaacttctgcgatgcgggcaagcgtcagcaggtggaggagttcttctccgagcgcaccgcgaaggcgccgggggggccccgggtactggcgcaggtgctggagatcgtggaccagtgcatcgcgctgaagaagacgcaggcggccagcgtcgagtccttccttgcgaagggcaccccgtcgcgtccgccgcaggcacccgcgtcgcggtag

SEQ ID NO: 5588 - DNA, 684 bp, Myxococcus xanthus
atgcgctttcgggaccgagcagatgcgggccgccggctggcggcgcggctgttgccctaccggggtggcgaggtgcgtgtgctgggcctggcgcgaggcgggctccgggtggcgtacgaggtggcccacgcattggaggcgccactggacgtctgggtctcccgccgcattgacgtgccgggccggatgacggtgctgggcgcggtgtcggaagggggcggcatctacctggaccaggacgcgctgcggggcctgggcctgccggaggtggaggcccggagcctggcgcgggcggaggcttcggaagtggacaatcaggtccagcggctgcggggcacctcggagcccgcgatggggggcttcacggtgctgctggtggatgacgggctggtgtcgggcgccacggccatggccgcgctccaggtgctgcggcggcaacacccggctcggctggtgctgggcgtccccgtggggaccccgcatgggctggcccgggtgcggccggaagcggacgcggtgcattgcgtggaggtgctgcccgcgatgcgtgacgtgtcggaggcctacgacgactaccggccgttgccggacgtggagctgcggcagttgctcgtgcgcgcccgggagcccgtgcagccgcgcgaggtcctcgagtccacggacctgggcggcttctttagagcg

SEQ ID NO: 5589 - DNA, 345 bp, Myxococcus xanthus
atggggagcgtgatgcacttcgccctggtccagcacgccacgtgcctggagcatggtgaggtgatgcacgtggaggccggtgactcccatggcgccggtcacgctgaggcgtccttcgacgatgtgcggctcgcctccaagagtacggaggcggactcccacggctctgatgcccactgtgtccacgccttcttccggcgggaggctccgcctccgcagcaggacactccgttcctcctggtcgcgcccgctcgctccgagcccgcgctggcggtgttccgcttccatgcggagcccgtcgcccgtcttcacctggctcccaaggcctctccgccgcgcgcgtga

SEQ ID NO: 5590 - DNA, 558 bp, Myxococcus xanthus
caggtcgcgctcctcggaggctcgttcaacccgccccatgtggggcacctcatggccgccacgtacgtccatgctacccaggacgtggacgaggtgtggctgatgccgtcctggcagcacccgttcggcaagcagatggagcccttcgagcatcgcgtcgccatgtgtgatgcgctgtgcgcggagacatcgggctggctgaagacaagccggatcgagcaggagccgggactctccggccgcacggtggacacgctgaccctgctggtggcgcggcatccggacatccgctggtcgatcatcatcggcagcgacatcctgcgcgaccttccgcattggaaggacttccaccgcatcgaggagctgtcgcgggtgatggtgctcaaccgcgcggggtacccggcgccgaacacattggggccgccgctggcggaggtgtcgtcgacgctgattcgcgacctgctcgcgcgcggcgaggctccgtcggacctggtgcccgcgcgcgccattgcctatgcgcgcgagcacggtctctatggcctgaagcggacgccgtag

SEQ ID NO: 5591 - DNA, 1230 bp, Myxococcus xanthus
cccggcaccggaatcgtctacgcctcgttcgaccgcttcccttcgcccaagggcgcagcggtgcacatccgggccttcgtggagtcactgggcgcagcctttggccgagtcgacctggtcgcgctccgggacagccccactgcgcccaccgggccgctcgcgctggtggagggcgtgacgtaccacccgctggaatcacgcgggaaggacctgatggcccaggccctgtcgttccgctcgcacctggcggcatggtggcgcgaaaggccgcgagcctccgtcgtgcacgtgcgctccatcttcgagggctaccccgtcgcctgccggaaggaagcgctgacggacgcgctcgtcttcgaggtgaacggcctgccctccatcgagctgaagtatcactacccggacgtggcggatgacgcggaactcttgcgcaagctggtggcgcaagaggacgtctgtctctcgcgcgcggacctggtggtgaccccgagcacggtgacggcggagtacctcgtgacgacacggggcgtggacgcctcgcgggtgcgggtgattccgaacggcgccgacctggaggtgttccggtacgcgccgccgcgccctctggagctcgggcgtcccgtgcgactgctgtacagcgggacgatgacgtcctggcagggcgtgcaccatgccatcgaggcctgccggttgctgcggcgggacatgcccacggtgctgacgctggtgggcccgctgcgccggcacacacgacgggcgctgatggaccggtgcggtgacctgctgctggagggcacagtggagttgctggagcccctgccccaggcggagctggcggcgctgcaccatgcctgcgacgtggtgctggtgcccctgcccttcaacgaccgcaactgcgtgcagggctgctgtccgctgaagctgctggaggccatggccaccgggacgcccgtggtggccagcaacctccccgtggtgagcaccctggccgcgccggacgaggtgatgctgatacggccgggctcggcgaaggcgattgctgaagcagtgaaggccctgcgggcggaccccaccctgggccccgcgatgagcgcgaaggcacgggcgcgagtggagcgcgacttcccatggagccgcgcgggcgaagccctggtgagcgcctacgaagagcggctcgggatggcgcgagccagcacgcgacggagcacctctgcctccgcgtgcgcctga

SEQ ID NO: 5592 - DNA, 279 bp, Myxococcus xanthus
atgctgtatgaccacgacgacttccactgggccctcctggaagaggagcgccagcacatcgtgcaggtcctcaagggaaaggtgctggtgggcgagctggtcatccccggccgcgaggtgacggaggtgaacatcgcccccgacccggacacgggcgcccagggccacttcctggtggagctcatgggcgggcccaaggaagacccgcaggcgctctaccacttcatcatggcgcacggcatcgacccggcgccggggcacaaggacctcaagcactga

SEQ ID NO: 5593 - DNA, 186 bp, Myxococcus xanthus
atgatgcccgtcatggacggcgaggagttcgtcggccggattcagcaggagcagcgcctggcggagctgcccatcatcctcgtcacggcgagcggccgcgcccacctgcccggtgtccgcgccatcctcaagaagcccttcgacatggacgtgctgctgagcacggtgggcgaacaccgccactga

SEQ ID NO: 5594 - DNA, 1526 bp, Myxococcus xanthus
atgaatcgagtcgcgagcctgctgtggaccctcgccgtcatcgcggtgctcggcggtgcgggcgtgtgggcctaccggcactcctcactggaggccgccacgctgctccaggaaggcgggcgctaccttcaagccgcgatgtcgccgctgctcgccgggagcgtggccctggccttcgggctgagctacgcctccggcgtggtcgcccgccgcgcgcggcaccgcccggcgccgtcgaagccaccgccggcgggccccagcctctccccgctggaggtcctcacccccgacacggccaccgccgtcaggacgctgctcgtggacctggggcagcggctgcgccgcatcgccgcgaagccagacccggacatcatcggcttcaagaacctgttgatggatggcgccatccgcctgggcgccagcgacatccacatccaccctctggaggcggggacgcgcatcgccttccgcatgcacggcgtgctggaggaggtcctctccttcccacgcgagcaccactcgcgcctcatcaaccgcgtgaaggtgctcgcgaagctgccgctgtacgacctggacaagccccaggacgggcacttcccctggaccacgcaggacgggcccgcggacatccgcgtctccatcctgcccaccaaccacggccccgcggtggcgctgcgcatcgcccgcaccggcgtgcggctgccccagcttccggcgctcggcttccccgaagcgctgctcacgaagtaccaggaactgctcgcgctgccgcagggcctcatcctggtggcgggcgccactggcagcggcaagacgacgtcgctgtatgcctcgctgggccacatccagcagtcgcgcggcgagctcacgcgcatcgccaccatcgaggaccccatcgagttcgacgtcccgctcttcgcgcagacgcaggtcaacgccgcgcaggggcttcaacttcgcgcacggccctgcgcgcggtgctgcggcaggaccccaacgtcatcatggtgggcgagattcgcgactcggagacggcgcgcaccgccatccaggcggggctcagcggccacctgctgctcagcaccatccacgccaactccgccgcgggcgcgttcaaccgcctcatcgacatgggcgtggagcccttcctcctcgcctccgcgacggccgccaccctctcccagcgcctggtgcgcggcctctgtccgcactgccgcgcgccgcagccgctgacgcccgaggaggcggtgcggctggatgcggccgggattgcgcgcgggaacttcttcggccccgtggggtgcgagcactgcgagggcagcggctacctggggcgcaccgcgctctacgagatgctcgtcatctcccaggccatccgcgacgccgtcaacgccaaggtgcccagcacccgcatccaggagattgccgtccaggagggcatggtgcccctgctggccgcgggcgtcgaacgcgcgcgggcgggcgacacgtccctgcgtgaagtgttccgcgtcgttggcggctga

SEQ ID NO: 5595 - DNA, 354 bp, Myxococcus xanthus
atggagaaacggaacaacagggtcgcgaactggacgcggttgcaccgccggtttggcgaccacgtgcgcaagcttcggacggcccgggagctcacgcaggaagcgctcgcggaacgcagcgacctgtccgtggacgccatccgccggattgagcgcggttcgttttctccgtccctggacaccctgggcaagctctccaaggggctcgacgtctccttgaagacgctcttccagggcttcgagcgcgagcgctccaacgccgtggcggagatctgcgacttcctgtcccttcgctcgggccgcgaggtcgagctcgcctggcgcgtcatccaggccatgttcgaggaccgctga

SEQ ID NO: 5596 - DNA, 432 bp, Myxococcus xanthus
atgcccgggcttgtctccctcctcctgctgtccgcgcccgtcctggccgccgagcccgcgacgcaggacaaggcggtattcgaagccgaactccagcgcaacctggaggccttcgagaagaacatggaccgcagcatgcccatcccctgcggccacccgccgatgcgccccgagcgaatcaagggagaggacctccagttcgccccctcgcagctcacccgcatcaaggagaccacctatcagctcagatgcaccttccatctcgacgggacggccaccgactgccagatgctcaagcccggagtggacctggacgcgaagagccgcgaaaccatcaagcagtggcgcttcaagccggccatctacaaggacaagcccatcgcgacgacctgcaccgtgtccggcaagctgaagcgacggccggagaactga

SEQ ID NO: 5597 - DNA, 1131 bp, Myxococcus xanthus
atggtggagggccgctttccgctggagcgcaacatgagtcgccatctcggccccgccgtcatccttggctcgacgctgcttctgggcagcgcctgcaagaagtccgaggaccccgcccccgagccctccgccactccgcctccggcacccaccgagcccgcgcctggctacaccctgtccttcctcgaagcggcgtcgccctcgggatgtacctggattcgccatgagtcgtcgggcacacgcaagccgctcgccaccgtggacgcggtgtgcgagcggctcaagctggcctgggggccgcgtggccggcagggcctggtgatggaccggggcaacggcgagctgcctccgcgcgcctggcaggtggacttcgagtccggccagagcacccggctgctgctgcccgagctcggccacaccgacacgctgggtttcgacgaagcgggccacgtcgtcgcgctggtgtcgcagttggaggacctgccacggaagatggagagcggcagtgagtacttcctcttcgacggcaagcgcttcctcctcccggaggcggaaggcagcccgggcctggcacacgcgtaccgccacgaggccggccagtggaagcacctggagacggtggccacgctgtatgagatggacggtgccctgggcacggaagccctggccacggccagccggctgacgtcctccaccttcagccaggatgcggaccggctctccgagtcggagttggaggaaggcaacgaagacgcggcccggctggacgcggtggtgaaggaccggggccacacggcctacggcatgtgggtctccatggagacgcaccagggcccgctctactcctgggaagccacgggcgagctgcccacgctcatgctcccgctgcgctgggaggtgaacgaccgactggtggagcctgagcaactggcgctcgcgcccacgtcgaccgtggcgctgcggatgcgcggacgcctgctgctggtctccgccgagcaggccgcccgcgtctacgacgcgaagacgaagaagcgcatcgccgcgttggagaacgtccacggcacgcgcttctggccccagcagcggaccgtcaccgcggcggcgcccgccagcacggtgacggagccgtag

SEQ ID NO: 5598 - DNA, 138 bp, Myxococcus xanthus
atgacgaccctgccgccatggctgtcccggatgagcagcctcaagagcctggacctctaccagacctcacttccacccgaagaagtcgaagccctgcgcaaggcgctccccgaatgcaacgtgggcttccggacgtga

SEQ ID NO: 5599 - DNA, 1326 bp, Myxococcus xanthus
gcgctgctgacagacctctaccaactgacgatgacggaggcctatctcgaggagggaatgtgggacgaggccgtgttcagcctcttcgcgcgcaagctcccgccccggcggaactacctgctggcggcggggctcgacgatgcgctgaggtacctggagaagctgcgcttcggcacggaggcgctggactggctggcatctcgaggccgcttctcggaccggctgctcgggtggctcgaacgcttccgattcagcggtgacgtggacgccgtcgcggagggaacgccggtgttcgccgaggagccgctgctggaggtccgcgcgcccctgccagaggcgcaactggtggagacgtacctcctcaaccaggtgcacttccagacgaccgtggcctcgaaggccgcgcgcgtggtgacggccgccgccggacgccacgtcatggacttcggcttgcggcgctaccacggcacggacgccgggctgaaggtggcgcgcgcggcgtacgtagcgggcgtggactccacctccaacgtgctggcggggaagacgtatgggattccgctcgccggaaccatggcgcacagctacgtgcagtcacacgacgacgaactggaggcgttccgcgccttcgtgcgcgtccatccaaacgccacgctgctggtggacacctacgacacgctgcgcggcgtgcagcacgtcatccgactggcgcgggagctgggcgaggacttccaggtgcgctccatccgcctggactcgggcgatttgctcgcgttgtcaaaggccgcgcgggagatgctcgatgaagccggcctggagcaggtgcgcgtgtacgcgagcggcggactggacgaagacgcagtggcgaaactggtggcgcgcggggcgcccatcgacagcttcggcgtgggcacggccatgggagtttcgtcggacgcacccgcggtggacatggcctacaagctggtggcgtacgcagggcgaccccgagtgaagctgtcatcggggaagctgctgctcccgggcgcgaagcaaatctaccggcgggaggtggacggcgtggcgcgcggcgacgtgctcacgtgcaggcaggacaccgcgcccggaaggcccttgctccaaccggtgatgcgtgggggacagcggttgcccgaggcatcaccgacactagaggccatccgcgaattcgcgcgaagcgaactctcaaggcttccgcccgagattcgcgccttgtcccccgccaagccgccctatcccgtggcgctgggacaggcgctgctgcgggctcgcgagcacgaagtggagctgtggtccgcggcgacgtga

SEQ ID NO: 5600 - DNA, 306 bp, Myxococcus xanthus
atggacctgatgggggacacgctgtgctgcgtggtgcacgacaagaacgatttgacgcgggatgacctgctcaacgcgctgctcttcgtccacggcaaggagccggagcccaaggtggttcagattggcccgcgctacttcctgacgccggggcgactggtgggcgccgccgaacagacgtgcgcgctcctggacaaggtggaccggaacctgcgcttctccgcgttccgcctggatgggcactcgatagtggagccccaggtcatcgtcctggagaagaagtccccgaagttgtccctcaagtga

SEQ ID NO: 5601 - DNA, 666 bp, Myxococcus xanthus
atgcgaacgctcttcattggagacgtgcacgggtgcgcggaggaactggacgcgcttctgacgcagtgcgcctggcagccggacgaccgcgtggtgctggtgggggacctggtggcgaagggcccggactccgccggtgtggtgcgccgtgcgcgtgagcagggcttcctggcggtgcgaggcaaccatgacgcccacgtgctgcgctggcacgccggccgggggccgcgcggcaagaagctgaagcctgagcaccagcaggtgctggataccctgacgcccgaggactgggcgtggctggagtcccagccgctgtaccgcttcttccccgagctgaacgtggtcgccgtgcacggcgggctggtgccaggcgtgccgctggaggcgcagaaggaagacgagctgctcaacctgcgcagcatcctgccggatgggacgccgtcgaagcgcgtggacgcgggcgcgccctgggccagcctgtggcaggggccggagctggtcatcttcggccatgacgccatgcggggcatccagcggcacccgcatgcggtggggctcgactccggctgcgtgtacggcggcaagctctccgcctacgtgatgccggagggccgcatcgtgtccgtcctggcgaagcgcgcctacgtggatgtggacgcttcctga

SEQ ID NO: 5602 - DNA, 1629 bp, Myxococcus xanthus
atgcactgcctggatgggcggctggcggaagtggccgccctcacgcagctcttcacccgggcggacgcgggcaccgtggagctggccgcgcgcgccgcggaggccctgccgccgctgggcaagtgctcggacctggcggcactggcggcgcgtgagccccaacccacggacggcgcctctcttgaacgggcacggacgctggtgcgggtgcgagccctgaaggccgcgggcaagtacacggaggcggtggcgctgctggagcccgtggtgaaggcggcgaaggacgcggatgaccgccacggcggcgcggacgccctgctgctgatgggacaactgcgggaggagacaggccagccgcgcgacgcggagaccacctacttcgacgccgtgtggaacgcggaggccgggcgcaacgacgtggcggccgcgcgcgcctggacgcggctggtgcatgcctccggctatgtgctggaccagcacgccctgggacaccggtggcgtgagcgcgcggaggccgccattgaacgactgggcggtgacggcgtgctgcgcgcgcagctccaggcccgggtcggcgcgctcctcttcgcgcaggggcgctacacggaggctgccgagcagcaggagtccgccctctcgcgcttggaagccacctatgggcccgacagcctggaggtcaccgacgtccggctcgagctgggcgccacgcgcatggcgcagctgcgcgccgacgaggcgatgcggctcttcgaacaggcgctgagcacgcgccgcgcggccctggggcccagccatccggacgtggcacgtgcccagttggagctggcctatgcgcactggcgcaggtctgacgtcgaacaggtggaagccctggcccgcggcgcgctggaggtcttcgagcgcgcgctcggccccgagcacccggacgtcgcctccgccatcaatcccctggccgcggccctccagcggatgaaccgctccgatgaggcgctgcggctccaggagcgcgcgctggacatcgcgctcaaggtcgaaggcgcggacggcgcgggagcgctcatcaccctgggcaacctggccacgctgatggcgcgcgtcggccgctccgaagaggccctgacccgcttccacaccatgctcgcgccgttggagcagcggctgggcgcccaacatccctacgtggcccagacgctgagggccacgggaaaactcttgatgatggaccagcgctacaccgaagccctgccctacctcgagcgcgcccgcgccatcctcgatgcgcgcgaggatgatgcctacggctaccggacggggacgctgatggacctgggccgcgcactgctcgcgctggaccggcctcttcaggccgccgaactcctggagcgggtggtggccagcggagcccggtcgccgcaggcacccagcgagcaggcacgcgcgcgattcttcctggcgcaagcgctctggaacgcgaagcgcgaccggcctcgcgcgcttcagttggcggaggaagcccgtgagtcattggtgacgctggggacgtcaggacaggaggcgctggaggaagtggatgcctggcgggcacgcctgcccaggcccacacacattcccgccgcgcgagccccctga

SEQ ID NO: 5603 - DNA, 363 bp, Myxococcus xanthus
atgctggtgtctcccgaggacgaccccgagctggcctacctcaaacgcacgtaccgcgccgagttcagcgactgcttctccaccgcgctcctcgcgctggagccgcgccagcgcaacgtgctgcgcctcaagtacctggacggcctgagcatcgaccagctcgcagcgctgtacggcgtgcaccgctccaccacggcgcgctgggtgctgggggcgcaggagaccctgctccagcagacgcggcaacggctcaccgagcgcctgcgcctcacgtcctcccagctcgacagcgtactgcgcctcatctccagtcagctcgacgtgagcctcagccgcctgctgcgctcgcggatgaacgactga

SEQ ID NO: 5604 - DNA, 849 bp, Myxococcus xanthus
ctcgcatacaggctgggtatccgtcgtcgcgtggcgttggaaaacctggccatggcgatgccggagaaaagtgacgcggagcgccgggagattgcgcgcggcgcctacatcaacatgtcgcgcgtggtgctggagtcgctgccctccggcgaccggctgccgctggactgggccgagcagggcgtggaaggcgatgcggcctggcaggcgctgaaggcgcgcgtggccacgggcaagggcgcgctgctggtgacggcgcacttcggcaactgggagttgctgggggagatgctcatccgccatggcgtcccgctcgatgcactggtgcgtccgctgaagggcgcgctcaacacgcgcatcgcggagaaccgcgtgagaatcggcgccggcctcatctatccgcgaggcgccatccaggaaatcatcgacgcggtgaatcgcggcgagtcccccttcatgctgctggaccaggcgctgccggcgaagggggcggccttcgtgcccttcttcggcaagctggcctccaccacgccggccatggcggtggcggcggcgcgcacggacgccccggtgttcgtggtgatgggcgtacgcaacggccgaggcggtgcccgcttccgcatggaagtggaaggccccatcctcccgcccgcgccgggtgagtgcgccgacccgattacggagcacaccgcgcgcgtgacggccgcgctggagcgctgcatccgcaagtacccggaccagtggatgtggctgcaccgccgctggaaggtgcagccgccaccggaggccgccctgcccgccgggactacgccaccaccgtccgcttcaggtgcgcccccagccgggtga

SEQ ID NO: 5605 - DNA, 753 bp, Myxococcus xanthus
atgtccgacacgctgctgacgaagctcgactcgggggtcctcaccctcaccttcaaccggcccgagaagaagaacgccttcacgcatgccatgtacgaggcggccacccgcgcgctgaaggacgcggagggcaacgtcgacgtgcgcgcggtgctgctcaccggcgcgggcaacgtcttcaccgccggcaacgacattggcgacttcatggagcacccgcccgcgggcgaggacagcgccgtgttccgcttcctgcgagcgctggtggacgcggacaagccgattctggcggcggtggacggcccggcggtgggcatcggcacgacgatgctgctgcactgtgactacgtggtggccagcgagcgcgcgcgcttccacatgcccttcgtccagttggggctgtgcgcggagggcgccagcagcctgctcatccccaggacggcgggcttcgcgctggccagcgagctgctgctcttcggcgagcccttcgacgcggccacggcgctgcgcgcgggcctcatcaacaaggtggtgccggacgccagcctccagcaggtggccaccgagcgcgccgccacactggcctcccgcccggcggaggcggtgcgcgtgacgaagcggctgattcgcgagcccctgcgcgcccagattcgcgagacgctggcccgcgagggcggtgagttcatccagcgcctccagtccaccgaggcgcaggaagccttcatgtccttcatgtcccgcggccggaagtag

SEQ ID NO: 5606 - DNA, 858 bp, Myxococcus xanthus
ctgggacgcgcgctcgggcaagccctgggcgtagcgcccgctgactgccacttcgagcgtttccccgatggggaaatgcacgtcgaggtgcccgagcaggtgcgaggccgcaccgtcatcctggtgcagtccacgacgccccccgcgggtgagcacctgctggagttgctgctgatggcggacgcgtgctggcgcatgggggccgcccgcctggaagccgtggtgccctacctgggctacgcgcggcaggaccggcgcgccaggccaggggagcccctgggcggccggctggtggcagacctgctgtcacagggccgcttcgcgcgcgtgctggtggtggacctgcacagccccgcgctggaaggctgcttcggcgcgccgctggagcacctcacctcgctgccgttgctggcggaagcgctccgcgagcacgtcaccgacacctccgtggtggtggcgccggacctgggcgcggtgaagcgcgcggaggccctggcgcggctgctgaaccggccgtgggcggtgattcacaaggtgcggctgagcggagacgaggtccacgccagcgggctgatgggcgaggtgcggggacgccgcccgattctggtggatgacatggtgtccaccggtggcaccctggccgccgccgcgggcaccctgcgcgacgcgggctgcacggaggacttcacggtggcgacgacccacgccctgctggtgggccccgccgtggagcgcctgcgcaccttgccgctcacccggctggtgagcaccgacagcgtggagcctgtcctggggctgccgttccagcaccaggtggtgacgctcgcgcccctggtggcccgggccctgcggccctga

SEQ ID NO: 5607 - DNA, 2535 bp, Myxococcus xanthus
ctcctcctcccggtgtggttcgccatcggctcgaagtacgtgctcaccttccaggggcgccacgtcttcaatccgtccatgttcggcgtggccatgtcgctgctcttcacgcgcgagctcatcaccgccgcgcccgcctaccagtgggccaacggagaggtggccctctccgccttcatcctcatggcggcgctggtgctcttcttcttccgggtggggcgcgggtggctggtggtcagcttcctcttcttctacgcgctccagacggcgctgcgcgcctatgtgctccggcaccacctgcctccggaggtcctcttcctcggtacgctgggtgcaccgtcgttcttcatcttcgtcttctacatgctcaccgacccgaccacgtctccgggcacgcggcgcgggcagatactgctggcgctggcggtgacgctggtggacctggtgctgcacttcaaggagagcgtctacacgttcttctatgcggccctcacgtgcgccacggtccgcttcctcttcgtccacgcgcgagccgcctggcagcgcgggttgcgcgagtcgctgagcacactggtgtcctccggctggctgaagcgcgcggtggtggtgggcgggctgggaggtctcatggtgggtggctacaccctggccgccacgcccggagtccggacctcgccgctggacttccgcatggagcgcgtggaggcgcgggccgcggggctcgactccaccatgggcaacacgctcgaggagttggacccacggctggggcatgtcgcgaagtggctggtggcggtgggggattccgtcgccgtgggggactacgacggggatggccggccggacctgttcctcacgcacccgctggcgcggcccgaggaccacgcgatcctctatcgcaacctcggcgacctccgcttcgaacgggtgcctgttcccgcgctggagcgcttcgccacccgctacaaggaagagggcctgccgggcggcggcaccttcgtggactgggatggtgacggcgacctggacctcgcggtggcggtggccttcgggcccgtccggctgctgcgcaacacgttgcgagagacgggcaccgcgggcttcgaggacgtgacggaggccgcgggcgtgacggaccacgcggtgagcctgggcctgaccttcctggactatgaccgggatgggcacctggacctcttcgtgctcaacgtgatgaccacgcacctgccgggctacgagccgccggtgccgctcaacctcttccggctgcccgagcccgagcacgcagaggaccgccgcatgttccgcttcatgcacgacggctggcacaacgcggccaacggtgggctcaacgcgctctaccggggccggggagacggcaccttcgagaaggtggacatcgccgcgatgggcatgccggagacgcactggtcgctggcggtgagcacggtggacttcaaccgcgacgggtggacggacctgtacgtggccaacgacttcgggccggacgacgtctatctcaacgagggcggcaagcacttccgccgcgtggcgggtcggctcttcggcgagattggaaaggacacgtacaagggcatgaatgcctccgtggcggacttcgaccgcaacggctggttggacctgtacgtctccaacgttcaccactcgctccaggcggagggcagcctgctgtggatggtgggccccgggaaggacgccttcacgccggagttccgggacgaggccaccttccgcggcgcgctcaacgagcggcgcttcggttggggcgcggcggcgggagacctggacaacgacggttggccggacctggtgcaggccaatggcatggtggatgaccgcctggacgcggcgcggtggcgcatccccgacggccagcgcaaggactactggtacgtgaatcacaagctgatgcagtccggcccggaggtccacacgtacgcggacaagtggggcgacatccggggccgcaccatctacccgaacgaggcgcgtcgcgcgtacctcaacctgggcgacgcgaagcccggacacttcgtggacctggcgcgcgagctcgggttggacgacccggacaactcgcgaggcgtgctgctctcggacatggatggggatggcgacctggacgcgctcatcaccaatcagcacgggcccgtgtcgctgtatcgcaacacgctgcgctcagaggggcgccaggatgcgcacttcgtgggcctcacgttggtgggccacggtgggcgcacgcaccggagcgcggtgggcacccgggttgttgtctcctacgaggaggcggggaagcgcgtggagcaggtgcaggaagtcgggttgatgggcggcttctccgcggcggcggacgcgcggctgcatttcgggctgggccggtacacggggctcgtgacggcgcgggtgcactggtacgggggcgacgtgcaggaggtgtcgctgtcgtcggaccgcacgcatgagcttcggcagcctcctgacgcggaggtgttgcaggggcgtgccgggccatga

SEQ ID NO: 5608 - DNA, 774 bp, Myxococcus xanthus
atgatgtcgccgctcaagggttcgacggtgcggcgtgatgcgctcacggaggcgcagcgtggacagatgctggcgctaatgcagctctgctacacgggcgtgtcgccggagcgcttcgccgaggacttggaggccaagcaatacgtcatcctcctccacacgcggcgaggcggggagttggtgggcttcagcacgctgcgcgtcgccgaggaactcgcgggcgggcagcgggtggaggtggtgtattcgggcgacacggtcatccaccccgactggtggggccacaaggtgttgcaggtgtgcttcgggcgcttcgtgttgtcgcgcaagctccgccatcccctgcgtccagtgcactggctgctgttgagcgccggcttcaagacgtacctgctcgcggtgaactacttccccaggacgatgccccggcgggactggacgccgcctcccggacgcgccgacttccttcacgcgctggccgcccgctggttcggcgcgcagtacgacgcgtcgcggggcacgctccgtttccagggcgcgcactatcgtgtgcgggacggcgtcgcgcccatcgaccgcgcggcggcgttgcaccccgacatcgccttcttcgccgagcgcaatccgcgccatggcgagggcgaggagctggtgtgcctggtggagattcgctggtgggacctcttcctggcgctggggcggagcgtgtccggacagcttcgcggctgggcccggcgagggctgcggaacgccggtgtccgcgtggggacatga

SEQ ID NO: 5609 - DNA, 1647 bp, Myxococcus xanthus
ctgagcggcctgcgggccgtgctcgctccctccgcgctgcgcttctaccgggccttgcgccatccggaggccgcgcaggcggtgtgtctgcagcgggtgcttcgttcggccgtgggcagcgtgcaggcggagcgcattcctggcttccaccgcatcagcgacgcccgtgacttccaggccgccgtgccgtgggtgaccccggacgcgctgactccggacgtggagcgcatcgccgcgggcgaggcccgggtgctcacgcgtgagccggtgctgcgcttcgaactctctggaggctcctcgggcgccagcaagcgggtgcccatgacacgcggcctcctggccgagttccagcgcgccctggcccccatgctcttcgagttgctccaccgccggcccgcgttgcgcgagggcgccagctactggtccatctccccactggcgcgaaagcaggtccgcacggcgggcggcattcccgtgggcagcgcggaggacagcgcctacttctcgcgcgtgctgcgccccttgctgtcccgcatcttcgcggtgcccggtgaggtgggggcattgccggatgtggagtcctgccgctacgtgacgctctggcatctcgtcgcccgcgaggacctgtctctcatcagcgtgtggaaccccagctttctcacgctcctcatggacgcgctggagcggcacggggagcgactggccgatgacctgatgcgagggcactgccggccacctgcgtccggcgcagcgtacgatgaagccgcgacgcaagcggtgctggaccggatgcgcttctccccgcgcccggagcgggcttcgctgctgcgtgaggtgctgcgaggtggctggagcgcccgcgcgctgtggcctcgattgtcgcttctcagcatgtggacggacgcacaggccgcccacgcgcttcccgccgcatgccgccgctttccgggcgtggaggtgcagggcaaggggctgctggccacggagggcgtcgtcaccgtgcccctcttcgatgcgcccgcccccgtgctcgcggtgcgcagccacttcttcgagttcatcgacagcgagcagcccacctcgcgacctcgcctcgcacacgagctggagcagggccgcacgtacacggtgctgttgtccacctcgggtggcctgctgcgctaccgcctgggcgacctggtccgcgtggagggcttccaacacgcgacgccctgtcttcgcttcgtcggccgagcggacgccatttgtgacctggtgggcgagaagctcgccggcacgcgcgtgggggccgtgctggatgccgtgcttccagacttctttggcggcgcgcgccccggcttctccatgctggcgcccgagtggactcccgcgccgtcctacgtcttgttcctggagacggacgcccccgcttcacggctcgcagccgccgcggaggccgtggagcacgccctctgcgagggacaccactaccgctacgcgcgagccctgggacaactcggtccggtgcgtgccgtgcgcgtggcggacggggctcgccgctacgaggcccgctgcgtcgcgctgggccagcgcgcgggcgacatcaagcccgtggacctgcaccgcctgacgggctggtcggaccatttctccggagccgccacatga

SEQ ID NO: 5610 - DNA, 1164 bp, Myxococcus xanthus
ggactggacgtgtgggtggagcagggcttctccgcgttgaagggcaagcgcgtgggcgccatcgtgaatcccaccagcgtggatgctcgcttccgccacctggcggacctgctgtcgggcgcggacggcgtcacgctggctgcgctcttcggtccggagcacggcatccggggtgaggcgcagtacatggtcgccgtggacgaggcgaaggaccgccgcaccggcgtgccggtgtacagcctctacggctccaccttcgaatcgctgtcgccccggcaggagtcactccaggggctggacgcgctcgtcttcgacatccaggacgtgggcagccgctactacacctacgtctacaccatggcgctggccatgaaggccgcggcgaaggcccgtgtgcccttctacgtgctggaccggccgaacccgctcaacggcgtggcgatggaaggcaacctggtgggggagggcttccgctccttcgtgggcctgtacgcgctgcccaaccgccacggcatgacggcgggggaattggccagcctcttcaacgtccaggagggcttcggctgcgagctgacggtggtgccgtgcgaaggctggcgccgcggccagttctggtcggagacggggctgcccttcatctcgccgtcgcccaacatgcccaccgccgacaccgcgctggtgtacccgggcatgtgtctgggcgagggcaccaacgtctcggagggccgtggcacctgccgccccttcgagcagttcggggcgccgtgggtggacacggaccagttgctggcgcggctggcgaaggaggagctgcccggggtcgccttccgggccgtgggcttcacgccgacgttcgacaagtacacggggcagtcctgcaacggcgccttcatccacgtgacggaccgggaggccttccagcccctgcgcaccggcgtcgccatcttccagacgctgcatgacattggcccgggctcgttcgattggcgcgcggatgcctacgagttcgtcgaggacgtgccggccttcgacctgctctgcgggacggaccaggtgcgccgaggcatcgaagcggggtggccgctggagcggttgctggaggggttctccgctcagacggaaacgttcgcacgtcacaggacgtcctacctgctatacgcttga

SEQ ID NO: 5611 - DNA, 1086 bp, Myxococcus xanthus
aaggacttctggtacgtcgcgtgtctctccaccgagctgaagccaggcgagcccctggcgcggaccctcttcggcacgggggtggtcctcttccgtgacgtacagggacagcccaccgctctccgggaccggtgtctgcaccgcaacgcgcggctgtcccggggcgcggtcttcaatggccgcatcggctgcccgtatcacggctgggtctacgacgcgtcgggcgccgtggtggaggtgccctcgttggggccttcgcagcgaagcgagttgctcgacgccgacgcctgcgcgcgggagggactggcgaccgcgccctgcgcgctgggacgcctgacgcgctttcccaccctggagcaggacggccttgtcttcgtctacatgggcggtgccgagcccgcgcggtccgcgccgttccgcgtgccgtactgggaccaggaggggtggaccgtctacttcatggtgacgcgcttcccgaacggggtgacgaacctcgtcgagaacttcatggacgtcccgcacacgctcttcgtgcatccgggctggttccgcaggcccgccagcaagcgagtgccggccacggtgcggcgcacggcgggcagcgtgttggtgacgtacaagcaggcacaggacaccgtcacgggcctgggccggctcttcaatccgcgcggactgccgctgctccacacggacaagttctacgtccccaatgtcacgcgcgttgactacctctggggcgagcacggcttcgtcatcaactcgcagtgcacgcccatcgggcccacggacagcctcgtctacacggccatcagctatcggttaccggtggatgtccccggtgcgctggtgggacgcgccatgatgccgctggtgcggtggtacacgcggcaggtcatccagcaggacgtggtcatcatggacatccagcgcgaggccctgctggacggcccgggtggaggcgtctactccggcacggaggcggacctgcaccacgccgacatcgaggcgtatcgccgctggctgcgggagggcggccagggctcggggcccgaggacgccgagcgcgacatggccttctggatttga

SEQ ID NO: 5612 - DNA, 333 bp, Myxococcus xanthus
atggcgggcaaggacgaggagcgcgcgctcacccgggaggacctgctcgccatggcccgggagatgggcgtgagcgaagccgccgtggagagcgtcatctccgcgcgcacgggacgcgacaaggcgcagcgccgcatgcgcagggcctacatgggccttgcgtcacacgcgacgagctacaccatcgtcatgggagggctcaccctcatcgacctgttttcggggccgggctggtgggtgcagtaccccgccatcggctggggcatgggactggcgttccatgccatgggcacgctgctcgcggctttcaatcacgcggacaggcagcggtga

SEQ ID NO: 5613 - DNA, 1380 bp, Myxococcus xanthus
gggttctgggcttcggtgaaggaagccattcacggaaccgagagggacctcacccggcttccggttcgcagcgccatcttcctgctcgccgtgccgatggtgctggagatgatgatggagtccgtcttcgccgtcgtcgacgtcttcttcgtcggccggttgggggcggacgcggtggcggcggtgggactgacggagtcgctgctcaccatcatctatgcggcgtccgcggggctgagcatcggcgccacggcgctggtgtcccgccgcatcggtgaaggcgacccggagcgggccgcgcgcacggcggtgcaggcggtggggctgggcgtcgtgttgtccattccggtgtcggtggcgggcgtctacttcgcgcggccgttgatgacgctgatgggcggctcgccgtgggtactggagcacggcatccgctacacgcaggtgatgctgggcggcatgggcagcgtcctgctgctgttcctcatcaacgccatcttccgcggcgcgggggacgcggccatcgccatgcgcgtgctgtggctggccaacgccatcaacatcgtgctggcgccgctcctcatcttcggcgtggggcccttcccggagctgggcgtcatgggcgccgcggtggccaccaccttcgggcgctcctgcggcgtggcgtaccagctctaccggttggcgcgtggctccggccggctgcggctgcggcgcgagcacctgcgcctggagccggggacgatgctggccatgctgcggatgtcaggcgcgggcacggcccaggcgttggtgggcacgacgagctgggtggtgctggcccgcatcgtggccacgttcggcagcgcggcggtggcgggctacaccatcgcgttgcgaatcgtgctgttcgcgctgctgccctcgtgggggctgagcaacgcggcggccaccatggtgggacagagcctgggcgcgggaaagccggagcggggcgagcacgcggtgtggacggcggggcgcatcaacgccgtcttcctgggctcgctggggctgctgttcgtcctcgcggccaatcccgtggtgggcatcttcacgaacgacgccgcggtcatgaaggaagcggtgctcgccctgcgcatcctgagcgccagcttcctgttctatgctttcggcatggtgttgacgcaggccttcaacggagcaggggacaccaccacgcccaccgtgctcaacatctgttgcttctggctgttggagctgcccctggcgtgggtgctctccggccccctgggcttggggccgccgggggcattcctgtccatctcggtggccttctcggtgatggcgctggtggccgtcgtcctgttccggcgtgggacctggaagcaccgggtggtctga

SEQ ID NO: 5614 - DNA, 1569 bp, Myxococcus xanthus
atgtcgcccctggagggccgtatcgacgagggccggcgggaggagatgctggacagggacttgttctccgtcaccgtgcaggcgagcggcctgtatcgcttctcgtgcacgcggctgctgctggtggagtgccgggttcggttgctggatgtggctgggaacgcccacgacatgccctccgctgtcgagggggcgagggtgtcgtggttccccacgctctccgagggcacctggtacttcgaggtctccagcagggactcgtacgggcgctacacgtacgagctggcgtcgctgggcgtggacgaccatggcgatacgttggaggatgccaccgtcctggaggccggctctggcacgtcgttccccgtgcggctctcctcgccctttgacgcggatgtgttcaccttccgctcgcgggtggggcatggctaccgcttcatctgtgagcaggctcccaacccgttccttcaattgacgctgcagtccgcgaccggcttgctgatggatgcggtgcagggcacgtcaggggagccgctcacggtgagcctgcaggcgacgtccgagcgagactggctcctgatgctggctgccgaccatggcaccttcccggtggatgccgcctgccgcttcgaggacctggggcccgatgagcatggcgacacactggagaccgcaacgcccgtgacgccgggtgtcccggtggcggtcacccttcagtcgcgtgatgacgtggatgtcttctccttcacgggggagcccgggcatgtctacacggtgcggacggaaggggccgggcggtggtccgcccaggtggtggacgaagatggcgcgaacgtggcgctcacgacgaccgaccagttgcgggtccgtctgaaccgctggggcacctactcccttcgcctccagggaggggctccctgggagcactccttcgtgctgacgctggtggacgcgggaacggatgaccacggtgactctccagagacggcgacattcatctccccgggaatcaccatcacgggccgcttcgactcacctcaggacacggatgccatcgccttccacacccaggcacgtgccatctaccttgcgtcctatgcgccgttcgccgacctgtccctgaacccgcgaggcgccgtgggaatcctggggttggggagcggccgccatctcttcagcgcgagggacgcccggcaggtcaccttgatgttccagcccctgaatggcgtggagggtttctccctgacgctggaggaggtggccttcgatgaccatccggactccagcgaggatgcgcaggtcctggcgctgccggcttcgatgtccggcgtggtccagtcggccgtcgacacggacgtgttctccgtctggctggaggaggggcgcgcataccggctgggcctggacgccggcacgcttcgcgcgacgctcatcgcgcctggcggtctcctggcgaatctgcgggacggacggttcgtggcgagccggagcggtctccatacgctgtttctcgccggtgcttccggcctggagcaggtcccctggcgcttcacgctccaagcggagtga

SEQ ID NO: 5615 - DNA, 183 bp, Myxococcus xanthus
atgctgatggcgctgggtgtgggactggcggcgggtttcggaatggcgttcatgccgtccacggccgaggccaacgctcctgagttcacgcagtccgtctgtgagcgcaactcggactgtgaccacttctgtggcgagggattcgggcactgcatccggggcatgtactgcgcgtgcatgtaa

SEQ ID NO: 5616 - DNA, 720 bp, Myxococcus xanthus
atggcgcgtcaatcgccggagcacttctcgctggaggtggatggcacgcgctggtgctggcacaaccgcctgctgggaacgcggacggacttcacgccgggggacgcggcgagcctgccgctggcgccgctggactggtttggccggcaggttcaggaggacctgctgctgctggccggcacgcatgagggtttcccgctagtggcgggccagttgtgtttcccttccgggtggtgcttgggggacaagctgggccggtcgctgctggccgtccacgagccggtgccccagttcaacgcgaagctggggccctccacgctgaagttgatggagggcctgaagcccgggcgccccgtcacgcgctgcaactgggccatcagcgtcacggagcggctggacctggagccgcgcacgctgccggagtggcggcacttgttcgacggcatcaccccggacaatgcgggcgagcgctgcttcctccgcctggagcgtcagacgctcacccggctgccccgcacgcgcgccatcctcttcaccatccacacctacgtggccccggtggcctcggaagtggaagcgcccggtcggcggcagcggctggcccgcgtgctgcgcaccgtgcccgccgacaccgcggcctacaagcgcatcacgcccgtgctggcgccgctgctgggctacctggaggcgggcgaggctgacgccgggtggaacgggtaa

SEQ ID NO: 5617 - DNA, 786 bp, Myxococcus xanthus
aacgacatgcagaagacgtggctggtcgcgggaatgctggtgctggcgggctgccagcagcagggcaagacggattcgacgccggcggcgacggcgacggcgcccggcgcgagcgcgaatccgcagacggaggaccagaagacgctgtacgcgctcggcctgtccattggccgcagcgtgagcgtgttcgacatgactcccgaggagctggagtacgtcaaggcgggcatcaccgcgcaggtgaagggcgacaagcccgcggtggagctggagacgtacggcccgaagctgcaggagctggcgcgcgcgcgcagcacccgcaaggcggaggctgagaaggagaaggcgaaggcgttcctggagacggcctcgaaggaagagggcgcccagaagacggagtccggcctcatctacaaggagctgaccgccggtacgggcgcgtcgccccaggcgtcggacatcgtgaaggtgcactaccgtggcacgctgccggacggcaccgagttcgacagctcgcacaagcgtggcgagcccacgcagttcccgctccagggcgtcatcaagtgctggaccgagggcgtgcagaagatgaaagtgggcggcaaggccaagctcgtgtgcccgtccgacatcgcctacggtgaccgcggcgcgccgccgaacatcccgggtggcgccgccctggtgttcgaggtggagctgctggagatcgtcaagccgccggagatgccggccatgggcggcacgccgccggcgggcaagccctccgcggccgagaagaagtag

SEQ ID NO: 5618 - DNA, 831 bp, Myxococcus xanthus
atgcgccagggcctgctgttgatgatgggagcgctgctgctgagcgcctgcgtccagggccgttcccgggaagtgctccgcgagccgtccgccacgggcgctgtctccgaatcggagttcaaggcgctgcacacgctgcgcgaggacgcgccgccagcgcccaagggccaggaggtggaggtggccggcacgaaggcctacctgagcctgccccagggcgcccaggggccgctgcccgccgtcatcgtcatccatgagtggtgggggctcaatgaccacatccgccactggacggaccggctggccgcggagggctacgccgcgctggcggtggacctgtatggcggcaaggtggccacctcgcgggatgaggcgctggcgctgctgaaggccgtggacccggcgcgcgcgcaggagacgctgacggccgcgcacaccttccttcagcaggacgcgcgggtgcaggcgccgcgcacgggcaccatcggctggtgcttcgggggcggctggtcactgcacgcggccatggccatgccggagctggacgctgcggtcctctactacggcaacccggtgacggaggcgcgggagctcgccgccatccgcgcgccggtgctgggcatcttcggcacgaaggacccgtccatccccctggagacggtgcaggccttccggcaggccttggatgatgcgggtgtgcggcactacatcctggagttcgaagcggagcacgccttcgccaacccgtcgagtgagcgctacgacgcgcaggccgccgcgggtgcctggcagcaggtggcggccttcctggaccagcacctgcgtcagtag

SEQ ID NO: 5619 - DNA, 2586 bp, Myxococcus xanthus
atgaaggccgcgctcgccagtggcgcggacgccatctatttcggattggacgaagggttcaacgcacgcgcacgcgcggagaacttctcgctcgccaccctgccggagacgctggcgctcgtgcaccgcgccggcgcccgcgcctatctgacgctgaacaccctggtcttcgagcccgagctcccggtggtggagaacatccttcgccgcatcgccgaagccggcgtggacgcgctcatcgtccaggaccccgcgattgcgctggtggcccgcgcggtgtgtccgcagatggaggtccatgcctccacgcagatgaccatttcgagcgcggaaggcgcgcgcttcgcgaagggcctgggcgccacgcgcgtggtggtgccgcgcgagctgtccgtggcggagattcgccggctggcgtcggagacggacgtggagctggaggtcttcatccacggcgcgctctgcatgtcgtggagcggtcagtgcctcaccagtgaggcgtggggtggacgctccgccaaccggggacagtgcgcgcagtcgtgccggcttccgtacgacctggtggtggatggccagacgcgggagctgggcgacgtgcagtacctgctcagccccaaggacctcgcgggcgtcatggcagtgccgcagctcgtggagattggcgtccactcgctgaagattgaaggccggcagaaggggccgcagtacgtcgccacggcggtgcagggctatcggcgctgggtggacggtgtgtccgcggggacgccggacacgggggcgctgcgcaaggacctggcggacatgacgctgtcgtacagccggggcttctcgcacggcttttttcggggctcggaccaccaaacgttggtggaggggcctttcccgaagcaccggggcgcgtacctgggccgcgtggagtccgtgcacggtcgtgacgtgcgcgtggtggacgacacggagggccgtccctggacgggagggctgggccaggacgacgagaaggcgcgcccggatgcgcccgtgggcaaggtgtcctctccgctggagacggcgacaccggtgccggccgaggtatcgccccgccccggcatgggcgtggtgttcgacgacgggcatcccgaggacaagcacgagcccggcggtccgctgttccgagtagagcgcaagggccgtggctgggtgctgggcttcggcaatcccggtccggacatgggccgggtgaagccgggccagcgcgtctggatgacgagcgacccggccctggcgaagcgcacggaggagctgctggggcgcggcgagcccgaaggccgcgtgcctctggagttgaccgtgacaggcgccgccggttcgccgctgacggtgctgggccgggcgcgcggtggacacgtctattcggtgtccagcgaggtggcgctggccgaggcgcgcggtggtggcatcgacgaagcgctgctgcgggacaagctggcggcgctgggcggaacgcctttcacgctgacggggctggatacgtccgggctcgcggcggggctccatttgccggtgtcggagatgaaggcgctgcggcgccggctggtggcggagctgtcggaagccgtggcgcgcggtccggtgcggaccgtgaacgaaggctccacgctggagtccctgcgcgcgtcgctgcgtgagcgtgtgcagccgacgccccgcgccgtggaggacgtgcgcttgctgccgctgtgccgcacggacgagcagctcgaagcggtgattgccgcggggctgcccgaggtcgagctggactggatggagctggtgggcctgcagcgcgcggtggagcgtgcgcgcgcggcggggctgcgcgtgacgattgccacggtgcgcgtgcagaagccgggcgaggaaggctacgacgcgcgcatcgcgaagctgaagccggacgcggtgctggtgcggcactggggcgcgatgatgcacttcctggagcgcccgcccgcgcatggggagacgcgccctgccctgcacgcggacttctcgctcaacgtcaccaactccgtgacagcactgcacttgctggggctcgggctggacacgctgacgttcgcgcatgacctggacgcggtgcagttgggggccatgctggagcacctgccggcggagcgcttcacggtgacggtgcatcaccacatctccacgttccacaccgagcactgtgtgtattcccacacgctgtcccacgggcgtgactaccggagctgtggtcgtccgtgtgagaagcaccgcgtgtccctgagggaccacaagggtctggagcacccggtggtggtggacgtggggtgccggaacacggtgttcaacgcgcaggcgcagagcgcggcgtcgctcgtgccgtcgctgctcgcgaggggcgtgcggcgcttccgggtggagttcgtgcgcgagtcccgcgaggaggcttcgcgcgtgctctccgcgtaccaggagctgctggccggtcgcatctcccctgcggaggccgtgcgccgcgcggcggtgcatgaacaattcggcgtgacgaagggcacgatgaaggtgctcaaccccaccttcaccgtgcagcgctga

SEQ ID NO: 5620 - DNA, 411 bp, Myxococcus xanthus
atgctcgccgtcgcgctgctcagcggcttcgcgctgcggggaggcccccgctggggcaaggacccagaacgcgtgaagcaactggtgacgtggaagctcgacgacaagctggacacgctggacgccacggagtcccagcgccagtccatccacgccgtgaaggaccgactgttctccgacggggtgcagctcatgcaggagcaccgcgcggtgcgcgaggaggccttccaacagctcgcgtcggacacgccagaccggcagaagctccacgccctggtggacgcgcgcatcgaggccatgcgcgccttcgctcaccaggcgacagacgccgccctggaggtccacggcacgctgacgccgcagcagcgcaaggcgctggccgaacagttccgcgagcacgtaggcccgtag

SEQ ID NO: 5621 - DNA, 1347 bp, Myxococcus xanthus
atcgacggtggcgcatacactgcgcgggctttgaagaccgccaacctcgccatcgtcttcaccgacatcaagggcttcaccgagcggaccagccggcagacgctggaggagaaccagcgcctgctccaggtccacgaggccctgctggcgccgctgttcaaggcgtttggcgggcgcatcgtcaagtccatcggtgacgcgtacctcgtcaccttcgaatcgcccacccaggcggtgctcagcggcatcgccatccaggatcggctgtggcaccacaaccggacggtggaggtgtcggagcagattcacgtccgcgtggccatcaacgtaggcgaggtgcggctggacgggaacgacatcttcggcgagcccgtcaacatcgccgcccgggtggagggcatcgccgaggcgggcgaggtgtacttcaccgaggccgtctacctggcgatgaacaaggccgaggtgccttccaaggaagtgggcgcctacgagctgaagggcatcccggggaagattcgcgtcttccacgtgccccgggcgccgtaccgcgtggaggctcccgcgcccagcgccatcgccgagacgccgggctccgaatcgatgccgcccttcgggaacctggccctgtcccgcgtgtcggaggcttcgtcaccgggggcgcaggtggacctgtccgtgctggggcagcgggccgctgcgggcgccgcggtcatcagccaacgcgcggccgcgggtgccacggtgctgggccagcaggccgcggagctcgggcggcaggcgcgcacggtgggcggttcgctcttttcgcgcggcatggcgacgcttccgccgcaggtccagaagcaccgcgcgctggtgggcgtgggcgcggccgtcgtgctcgcgggcgtcgcgatgctggcgttcagtggcgacgagacggtgcgcgccatcaaggcggtggagcgggcgccggaggaggagcggaccgcgctggccaaggacgtccggaccctcatcatgaaggaggaggactccgggcggcgcaacttcctgctgggccgtctgacggaagcgacgggcaagcccgatgacgcgctgaaggtctacgccacggccgtgaaggccggcagccgcgccgcggaggaccgcctcatcgagatgctgtcgcatgcgcgatgcgacgtgcgctcggatgccgcgtccacggtaggccggctccagttgaagcgggcggtgagcgccctggaggacctgaagtccgacggtgggcccgatgacggggtgcggacgggcctgttcggcatttccaagtgcgactcgaaggtggccgcggaaagcgcgctcaagggcttcaaggagcgttga

SEQ ID NO: 5622 - DNA, 1113 bp, Myxococcus xanthus
atggtggggggacgcccggactgggagcgcttccgcgaagtcatcggcaccgtgattgagcacagcctcgcggcctcgcgccccggcgccaaggtacgcgcctacggcgagatggtggatgtcctctgcctggatgggatgccggacgtggcggtggagctggaggcactgtggaatgacctcagcgtgctgtaccccctgtccctcctgtgcacctacgccatcggccacttcggccaggcggcgcacgcgcggcccttcctcgatgtctgcaaggcgcacgcacacgtcattcccaccgagcgctacacacggctcgcggatacggaaggacggctgcgagaggtcagtctcctccagcagcgcgcccaggcactggaggtggaagtcaagcagcggcagcaggcggagcaggccctccgcgaggccctccatcgccgggatgaattcctggccctggccggtcacgagctgaagacgcccctgaccgcgctccagctccaactccaatcactcccctccgcggcggcgcggaaggatggtggcggacgcctgctggagcggctggacaaggccatccgccataccgagcggctcgccacgcacatcgacgggttgctcgacgtctcccgcattggcgagggccaggtgcccttgatgatggagccgctcgacctgtcgcggctcgtccgggacacggttacccgcgccatgactccggcggccgaggcggactgtcccctccagttgatggcggaggtccctatcgaaggcgtatgggacccgctgcggattcagcaggtggtgggcaacctcctggtcaatgccttcaagtacggcaggggccgtcccatcgaggtgcgggtggacggcgcaccggaccacgcgcgcatcatcgtgagagaccacggcatcggcattgcccccgagcaccaggagcgcatcttccaccgcttcgaacgcgccgttccctcgagcgcctttggaggactgggcctggggctctacgcggcccgccaggtcgtggtggcgcacggcggcaccctccgcgtggagagcgagttgggccagggcgccaccttcatcgtggagttgccctaccgtccgcagtag

SEQ ID NO: 5623 - DNA, 1071 bp, Myxococcus xanthus
atgctgaaggacgtgaacgcggaggcgttgttccgcgaagcctcggcgcgccagcccgcgggaagcacgcgcgccgcggcggaggcaccggtccggccgacaacggagcgcgccttcattggcatcgacgtgaagaacaacaaggcctaccgcctgcgcacggacacggccaacctggagcgcgtggcggaggagctggcgcggcgcggactcaacggcgcctcacgcggcacgctggacgacgccgcgcggttggagcccgtgaacggcgatgaggcgctgacctccggcacggtctcaggccagacgtggagcaacggggtggacacgcgcatccgcatgggcctcacggatggctatgccacgaactcgtggccctatcggaccatcggccacctgagcgctggctgttcgggtgcgctcgtgggccgccgcgtcgtcgtcaccgccgcgcactgcgtcgtcagcgcgtacagcgggtggaaccccatcttcaacaccttcaccgcccgccgcgacggcgccaccgcgccgtggggtgtccaggacgccatctggtactgggtgccggagggctacatcaacggctcgtgcaacagcgtcgccagttgcaaccgctacgacgtcgccatcatggtgctcgaggacgacttcccgaacggccacccgggctggatggggcactggaacgcgtccacggacacgctcaagacgtggtccagtttcatgcgcggctaccccggctgcggccacgtggcggcccccgcgagctgcacggcccgcacgctgtacggcgacacccagcagtgcaagacgagcaacgcctacagcccggacgcggacggctggcaccaggaaatcgaaatcggctgcgacggcagcccgggccagagcggctcgcccatctactcgtatgacgcgcccgtctcggggccggtcgtggtgggccagtacaaccagtactactgcgacgccacgggctgcgcgggcaacgcctttccaaacaggatggggcacctgacgccctcgtggaacaactccatcagctacttcaagtcgctctatccgtaa

SEQ ID NO: 5624 - DNA, 510 bp, Myxococcus xanthus
atgggacagctctatacgtttcgcgacaagcacccactggtgcaccccaccgccaccctcttctcctcagcagaggtaacaggggacgtcatcatcggcccgggctgcatcattggccccggggtcaaaatcctcggggatggcaatggcccagtccgcatcggcgcgggcgtacaggtgctggccaacaccgtgctgcaccggctgtcggaccacacgctgacgctggaggacggcgccatcatcggtccgggctgcacggtgcatggcagccacgtgggcgcgaacaccgtggtggagccgggcgccatcctctgtgacggaacgcggctgggacgcggcagcttcgtgggcgcgggcagcctggtgaagcagggcagcgccttcgcggatggtgcgcacatcgagggcttcccggcgacgcagacgggtacgttggcgtccctgccgccggtgccccgctgggcgctgcggccggaagacctgccggggctgcggcgcatcggctag

SEQ ID NO: 5625 - DNA, 1107 bp, Myxococcus xanthus
atgagcaactttcgacgcgccacccgtgacgacaacaccgcgctgctcgacctgttcggcacggtgcccatgcagggagacctggtcctctccgcacagcgagcgcccgactacttcggcctctacaccatgcagcgtggagagacggaggtctgggtccacggcgagcacggccggctggacggcatgggcgccgtgcacgtgcgcgatggctggctggagggccgtccgtgccgggtgggctacctgggagacctgcgcacccgtttctccgcgcgccggaaccgcggcctcgcgcgcttctacgggcccatgatcgaggagagcgcccagcgcctgggcgtggacaccttcctcacggccgtcatggcctccaatgcccccgcgctccacgcgctcgtgcggcggcggcccgggcgcgtgagccagccgcactacaccctgctccgtcgcttctccgccgtgtccatccagttcctgctccgccgccgtccccggcgaagcgctgtgaccgtgcggcgcgccacacccgcggacgtccccgctgtctcggcgttgctggatgccgaccaccgtgcgcgtcctttcggctaccgcttcgacacgggcgagttggagcaccgcctcgcccactggcccgggctgcgaatcgaagacacctatctggccttcgacgcgaccggcgcgctggtgggctgcaccaccgcctggaacccggaagccgtgaagcgctaccgcgtccatgcctaccgtggaggcatgcgctgggtgcggtggggctgggacacgctggccaccgcgctccgcgcgccgcgcctgcccgcgccgggcagcgacttccgctacttctatctctgcaacaccagcgtgcgcggagaagacccggccgtcctccgcgcgctcgtggagcgggtgtacgcggactttcacggccagggcttccacttcttcacgctgtaccaggacgaactggacccgctggcgcccgcgctgaagggcttcctccagcggcgcctcgacttccacctctacgccgtgacgcccgcctcacgtccccgggagaccttccccgccgggcggaccggcttcgaaatctgcctgccctga

SEQ ID NO: 5626 - DNA, 1674 bp, Myxococcus xanthus
atgagcgcggcggcgcccaaatcccagtggctggggctcggcctgtggttggtgccggtgctctgcttctccgtgctcccggtggccgcgctgctctggcgaggcctgggccactccgggacgggcggcttggactggctgctcgccgaaggtggagcgctggggaacacgctgctcatcgccacgggcgcggcggtgctggccttcgtcctgggagcgccgctggcgctggtgctgcaacgcaccgacctgcccctgcgcggggccttcacggtgctgttcaccctgccctccgccgtgcccgcgttcatctggggcatgggctggctgtcgctcgcgagcccccgcgcggggtacctcaaccggctgctcggcgatgacaccttcgacatctacggccccgcgggcatcgccttcgtggagggcgtgtcgggcctcccgctggtgctgctggcgggtgcggcggccctgcggcgcgtggacccggcggtggaggaagccgcgcgcgtctgcggagcttcgacgcttcgggcgctgctgacgacgacgctgccgctggcgctgccctccctgctgtcgggcgcggtgatggtgttcctcatggcggcctcgtccttcggcgtgccgtacctgctgggcgtgtcggcctcaccgcccacgcgggtgctcaccacgcgcatctatgaactggtgctgatgggcggtgacgagggcctggcgcgcgccgcgcaactggcgacgtcgctgctgctgctcgcccccatggcgatgctggtgacctgggcgctgggccgtgccggccgcgtccgcctcagcgcgggcaagggcctgtcgtcccgtcccttcccgctggggcgcgcacgcgggctcgtcctgggcgcggtgagcatgacggccgcggtgctggtgctcctcccgctgggggccatcctcctcacgtcgctccagcgcagcttcggcgcggcgctgacctgggagacgttgacgctgacgcactgggcgggtgtgctgctggagccgcgcacgttgcacgccacggggcgcagtgtcctgctggcggcgggcgcgggtgtcctggtgtgtgggctgggactcgcggcggcggtgcttcgacgcgggctgcgccgcctgggcacgggcgtggaggcgctggcggtatggccctacgcggtgccggggacggtgctggccctggcgctgctgctcgcgttctcccgggacttgcgcttcatcctgctggaccgcgtcgccttcgtgctcgcgctggcacacacgccgtggctgctgctcatcgcctacgtggcgaagtacctcgcgctgggcgcgcgcaacagcgacgaggcgctcgcgcaattggacgcctcgctcaccgaggccgcgcgggtcagtggtgccggcccctggcgcgcgttcgtggatgcgcccctgcccttgctgcggccggcgctcaccgcagccttcgtcctggcgttcctcgcatgcgcgacggaaatcacgatgtccgtcctgctcgtacccgcgggaaccgaggtgctcgggacgctgctgttcgaactccagagctacgcggaccccgccgccgccgcggtgctggcatgtgccttcatcgcgctggtggtggtggggcaggccctgctcgcgctgctgacccggcggcccttggacacgcggtga

SEQ ID NO: 5627 - DNA, 1047 bp, Myxococcus xanthus
atgtccctgcccatgctgctccgggccgcgggggtcgccaccgcgctcgtcctgctcgccgcctgccgcatcgagtccgccgcgccctcggccgggcccacgctggcgcgcgagggcacgccctccggagacgtctgggtctacacgtccatgtaccggcacgtcctggacgcgctggagccgctgctgaaggcgcggctcccggacgtccgggtgcattggtatcaggcgggcagtgagaaggtggccagccggctggaggcggagcgcgccgccggggccatccgcgcggacctgctggccacgtcggacccgttcctctacgagcggctggcccgtgaaggcgccctgctccgctacgcctcgcccaacgtgctccgggtgccccgcgccctggtggacctggacgcgcgctacgcggccctgcgcctgtccaccatggtcctggtgcaccggcagggcgggccaccgccgcccacctccttcgcggcgctcgcggaaggtccgtggacgggacgcgtggcgattggagatccactgacgtcgggcaccgccttcacctgggccgtgttctgcgacgcgaagtacggcgcgtccttcttccccgggctgcgccagcgaggcgccatcgtcgcgggaggcaacgcggcggtgctccagaaggtggagagcggcgaggcggatgcgggcgtgttgctcctggagaacgcgctcgcggcccaggcccgcggcagtcccatccaggtggtgtggcccaccgatggcgccgtcgtcatccccggccccgcggccctcttcgcgacgacgcccaaccccgtcgcggcgaaggcggtggtggacgtgctgctgtcgcccgaaggccagcgcatcatcgtggagaagggagacatgcacgcggtggaccccaggctcgcgggccctcggggagaggccggtgtctcggagttgctggagcgcgcgcgcccatggacgcccgagttgctcgaacgcgggctcacacagggcggcgccgtgaaggagcgcttccgccaggccttctcccaatga

SEQ ID NO: 5628 - DNA, 1218 bp, Myxococcus xanthus
atgctggtgaccgcggcgctggcctcgtgctcgggtgacgagggcggcgtggagccgaccccggacggcggaggcggctccacggtcgactccgggctcccgcccgaggacagcggcaccccggacgcgggcacgggtgacgcgggcgaggacgccggcaccccagaggacgcggggacgaacgaggacgcggggacgccagacgccgggcctgcgtttccgcccaacaccctgtcgggcttcggcctcttcaccgggacacccgcgacgggtgggctccagccggtggaggggaacatcccctatgagctgaccacgccgctcttctccgactactcggtgaagtcgcgcacgctgtacatcccgccggacgcgcaggccgggtactcggccaacgacgtgctggacctgccggtgggcaccatcatcaccaagacgttctccttccccgcggacctccgcgtcccggaagagaacgtgcgcgccatcgaaacgcgcgtgctggtgcacaggcccgggggctgggaggcctttccctacttctggaacgaagcccagacggaggccacgctggccaacggcggccgcgtcgtccgcggcgtgcgcttcattggcgaggacggcgtggagcggacgctggactacctggtgcccagcaagaaccagtgcctgaagtgccaccatctccaggacgcacaggagaaccaggtgctgctgcccattggcgtgaaggcccgctacctcaaccaggaccatgactatggcgacgggcccatcaaccagcttcagcacctggccaacctgggccggctgacggggctgcctccggtcaaccaggttccccgcgcgccgaacgcgttcaacgcggaggacggcacgctggagcagcgcgcgcgcacctacctggacatcaactgcgcgcattgccacaaccccaaggggacggcgggcaccaccagccggctgttcctcaacgtggacaacacggaggagttcacgttgggcgtgtgcaagcggccgggctccgcgggcggtggcgtgggcggtgagttcgacatcgtccccggcagccattcggtgtccatcctctggtaccgcatgcacaccgaggagtcggggaagatgatgccggagctgggccgcgtgcttcgccacgaccagggctcacgactcatctccgactggattgacgccatggacccacgctcctgcaagtag

SEQ ID NO: 5629 - DNA, 531 bp, Myxococcus xanthus
atggagcgcaacacgtggggcaacaacaacacggtggacatcgccatcctcagcggtctggccatcgagcccgaccccgtccagtgggcggccggcttcttcaactaccccagccaggacatctccatccacgacaacaccttcaccggtggcagcggccgaatggtggacaacggcacgccggacccggagcgccgtccgctgggcgcgctggtgggcgccgtctaccagtacggcgccgcggcccacggcgtgacgggcgtggagcacgtgctgtgggacggcgtcgacccggcgcctcgcgatgagagcctggccaaccccatcaacatctgcttcacccgcaacacgctgccagagggagcgcaggcctcggtggtggacttcgacctgcaggccgtcggtggccacctctcggcgggccccacccccgaaaacgcggccgccgcctggggagagacgcgccgctatgcccagggcgccgagccctacaactgctcgggcttcaccccggccctgaccatccgctga

SEQ ID NO: 5630 - DNA, 1125 bp, Myxococcus xanthus
gcgaatgacttctcccgggacatggtggccgcgcacaacctggcgcgctcccgggcccagcccgcacccaagcccgcgctgccgccgctggcctggtccacccaggccgagcgcaaggccgcgtcctgggcgaaggcctgcaagttcgagcacaacccggaccggggcgacttcggagagaacctcgccgccgccacgcccggcgcgtggacgacgtcccaggtggtgaagagctgggcggacgaagccgcggactacgactaccggcgcaacacctgccagaagggcaaggtgtgcgggcactacacgcaggtggtgtggcgcaagacggcggccgtggggtgcgccacggtgatgtgcaacaagaactcaccgttcggcgcgaagtttcctacctggcagctctgggtgtgcaactacgcgccgccgggcaactgggtgggtcaacggccctactgagcgcgccccacggggccggtgtgtcccgggtgacggacactcacgcggcgggaggtgacggccctccgcctggcggcggataatccccccatgctccgccccacgccccgccatcttcgaccgcttggcctgctcatccccctgctcctcaccggctgtggctccgacacacctggagaggaagacagcgacaccgagccgctggtcatgacgcagttcgaccgcgacatgctggccgcgcacaacgccgcgcggaggaacgtgtcgcccgcggcctcccccgcgttggaggacctgacgtgggacgagcaggcgacgcgcacggcgaaggcctacgccgcgaagtgccagttctcgcacaacccgaatcgcggcaacctgggggagaacctcaccgcggcatcgtccagcgccatgggcgcccagggcgtggtgcagggctgggtggacgaggccgcccactacgaccacgccgccaacacctgcgcgagcggcaaggtctgcggccactacacccaggtggtgtggcgcaacacgcgggccctgggctgcgccgtccaggagtgcacgaaggactcgcccttcggttcccagttccccaagtggacgctctgggtgtgcaactacgcgccgccgggcaactacgtgggccagcgcccctactga

SEQ ID NO: 5631 - DNA, 525 bp, Myxococcus xanthus
atggcccggctgctgctgaagacgggaggcgcgctggagcaggcggagtcccacctgaacgccgcgctccagcaggctcccaataatccccgcgcctggtacctgcggggtttgttgtgggaggagcgggatgaccgccggcaggccgtccaggcgtacgagcaggccgtgcaactgcgcgcctcctacgaggaggcccgcttccggctcgggacgctctggctggacatgggggacctgctcaagtcggagttgcacctgcgttacctggcgcggctgaagccggagtgggtgcaggtgcgcctccagctggcggaggtgctggagaagcaggagcgcctgctggacgcggagaaggagctgctggcggcgcgaggcttccagccggccagtccgctggtcctccggcggctcgccgacttctacacgcgcacggggcggccccagctcgcggagcgggtccgcgcggcgctggaagcccctccgaagcggcgaatgcgtgacctcaaaccatcacgtcgctga

SEQ ID NO: 5632 - DNA, 1284 bp, Myxococcus xanthus
atggcgctgcccctgttggagcagatgattccccgcaacgcgcatggcgcgccgggcaccgtgccccgcagactggccgtcttctacacgcccaacggcatccacatgcagaagtggacacccaagatagagggccccgcgtgggagctgacgcccacgctggaacccctggcggcggtgaagaacgacctgctggtcgtcaccggcctggcgaaccagcccgccttcccggatggtgacgggcaccatgccgccgccaccggcgcgttcctgtcctgcgccaaggtgtacaagacggagggcaccaacctccgcgtgggcatctccatggaccaggtcatcgccaaccacatgacggcgacgcgggccacccgctatggctccatggagctgggcatcgacgcgggccgcggcatcggcaactgcgactccggctacgcgtgcccgtatgccaacaacatcgcgtggtcggggcctcgaacaccggtggccaaggagaccaacgcgcaggccgcgttcaaccggctcttcgcgggcggcatccccggagagacgcaggcacaaatcgagaagcggcgcgcgtacggcaagagcatcatcgacgtcgtgcgcgatgacgccaccgcgctgaagggccagttgggcacctcggacctgcagaagctggatgagtacttcaccagcgtgcgggagttggagaagcaggtggaggacgtgtccgtcccatccatggcctgcgcttcgggagccgcgcccatcgtgtccgaggacccgacggcgaagaccaaggcgatgatggacctcatcatcctcgccttccagtgtgacctcacccgggtggccaccttcatgctggccaacgcgcgtgccaacaaggtctaccccttcctggggctcagcggcgcacaccacacgtactcacaccaccagaagtcgcagtccaactacaacgcgctcgccaccatcgacaagtgggaggtgacgctcctccagtacctgctggagcgcatgaagtcggtcatcgaggccaacggcctgtcgatgctcgacaactcgatggtctacttctccagcgaaatcggcgacggggactctcacaaccacgtcaacctgcccatcatcctggcgggcaagggcggcggcgcgctcacgccgggccggcacatcgtctaccagcaggacccgctggccaacctgtacatctacctgatgcaggccatgggcgtgcccaacgtcaccaccttcggtgacgacgggacgggcccgctgccgggccttgtgtag

SEQ ID NO: 5633 - DNA, 1170 bp, Myxococcus xanthus
atgacctttgtcaacctgtcgagccagcacgcggacccgcccgtggtgggcgtgaagctggccctgcgctcggtgctcgtctcaccgcatttcctcttccgggtggagaagaacgcgccgccaggaagcaccgaaccgtacacgctcgacaacttcgagctggccagcaggctctcctacttcctgtggagcagcatgccggacgacgcgctgttcgccgccgccgaagcggggaagctgagcgaccccgcggagatggaggcccaggtgcggcgcatgctcgcggacccgaaggcacgcgcgctggtggagaacttcgccggccagtggctcttcacccgcgcgctgggtaccgccgtgccggacggcacgctctatggcgcgttcaacgaggagctgcgcgccgccatgcgcacggagacggagctcttcttcgcggagttcatctccggcgaccacaagctgaaggacctcatcgacgcgccgttcacctatgtgaacgaccaactggccgcccactacggcctgccattgcccggcagccccacgcacaaacgcgtggagctcacgggccacccggagcgcagcggcatcttcggcaagggctcgctgctcatcgtcacgtccaacccggaccgcacctcaccggtgcagcgcggcgtctgggtgttggagcagttgctgtgctcggcgccgccgccaccgccaccggacgtggagaacctgccgccgcccatcacgccggacatgacgatgaaggagcgcatggcgctccatcgcagcgcgccggcgtgccagggctgccaccggctgatggacccgctggggctggcgatggagaacttcgaccccattggccgctggcgcctccaggaggtgagcggcgcgcccgtggacgccacgggtgacctgcccgacggcgccatcctcaacggggtgcgcgacatgcagacctacctgaaggaggacccgaagctgaccaactgcatcaccgagcacatgctcacctatgccacgggccgtggcctggacgaggccgaccactgcgcggtgaaggatgtcgccgacaaggccgaggcccgcggtgggcgactcgtcgactacatcctcagcatcgtctcgagcagccacttcacgcagcgtggcgcggaggaggagcagacgccatga

SEQ ID NO: 5634 - DNA, 1707 bp, Myxococcus xanthus
atgcgcgaggccgccgaggccgccgagcaggccctggagacgctcagcaacgacatccgcatggaccggggcgtctatgacgtgctggccgcgctggacttgtccggcgaggacgccgccacgaggaagtggatggagaaggtgcggcgggagttccgccgcgcgggcgtggaccgggatgacgccacccgcgctcgggtgaaggcgctccaggaggagctggtccgcatcggtcaggagttcagtcgcaacatccgccaggacacgcgcacggaggcgctgtctccgtccgcgctggagggcctgcccgacgactacgtgcgcgcccatccgcccgggccggacggcaaggtgcgcatcaccacggactacccggacatcgtccccttcatgacgtactcgcgggatgcccaggcccgcgagcagatgtggcgcgtgttccgccagcgcggccaccccgccaacgcggacgtcctgcagcgcatggtgtcccgccggaacgagctggccacgctgctgggctaccggaactgggcggcctacgcgaccgaggacaagatgacgcgcacgcagcaggtggccgcggacttcatcgaccggctgggcatggccaccgaggcccgcgcgaagcaggagtacgcgcagctcctggcccgcaagcagaaggacgtcaagggagccaaggtgctggagccctgggaccaggacttctacgaggaccggctgcgcgcggagcgcttcagcttcgactcgcaggcggtccggccctacttcgagtacggccgggtgaaggcgggggtgatggacatcacctcgcgcatctggggcatcacctacaagccggtgaaggacgcccgggtgtggcagcaggaggtggagacctacgacgtgttcgacggcgacacgctgctgggccgcatctacctggacatgcatccacgtgacgacaagtacaagcacgcggcgcagttcgatctcgtcgcgggccaggccggcaagcgctacccggaggcctcgctggtgtgcaacttcgcgcgccccggcgagctgatgacgcacgacgaggtggagaccttcttccacgagttcggccacctgctgcacgccatcttcggcgggcacctgaagtgggcgggcatcgcgggcacccgcgtggagtgggacttcgtggagacgccgtccatgctgctccagcagtgggcgggcaacccggaggtgctgaaggagttcgcgaagcaccacgagacgaaccagcccatccccgcggagatggtggagaagctccgcgcgtcgaaggagttcggccagggcctgtgggcgcggcggcagttgttcctgtccgcggtgagcctggactactactcgcgagcgccgggcttcgacacgaccgaggccctggttgccctgcagacccggctcagccccttcaagcatgagcaccgcgacggcacgcacttcgaggtggccttcgggcacctggatggctactcggcggcgtactacacgtatctctggtcctccgtcatcgcgaaggacctggagaccgagttccagaagaagggcttcctcgaccgggagacggcgatgaagtaccgccgcaccgtgctggagcccggcggctccaagcccgccgcggagctggtgaaggacttcctcgggcgcgagtacggcttcgacgcgtaccgcgcgtacctcgacgcaaagtaa

SEQ ID NO: 5635 - DNA, 4902 bp, Myxococcus xanthus
atgcgcgcgggcctgggctatcaactcaaggccgaggccaccggcgtcgagggcgcggtcagcccttcgttcgacgtgacgccggccgccgccgccactgtcgaggtgacggggctgccgcagaccgccatcgcgggctccacgcatgatgcggaggtgacggtgcgtgacgcgttcggcaacgtcgccagtggctatcgcggcacgctgagcgtgcagtcctcggacgccacggccacgctgccgggcgggcacaccttcacggaggtgaacgcgggccgcttccgtttcacgggcatcaccctgcggcgggcgggcacccagcgtgtcgacgtgcaggacgccgcgcaagcgggcctggcggggcgccaggacgtgcgcgtctcggcggaccggacctcggcattggctttcgcgcgcgtgccctcgcatgcgtccgttcgcgccgcgctgaccgccgtggaggtggtgctccaggatgcgcatggcaaccggacgcccgtgggtgcaccttcggtgacgctgtccctcgtgccggcgggtggcgcgccactgcgtggtgtcaccgaggtggcgcccatggaggggctggcgtcgttctccagcgtgcacgtggacacggagggccgcttccagcttcaggccactgcggatggactgacgcccgccacgagcacggacatcgacatcatcgataacgtgttccccgccatccctgtcctcgccgcgaccgcggccacgcacgacagcgttacggtgtcctggacggcggtgggtgatgacggcgaccaggggcgggccgcgtcgcatgccctgcgttactcgctgaacccgattgagacggatgcggacttcaaccaggcgacgccggtgggcggcctgggcgagcccgcggaggctggcacgcaggagtccgccgttctcacgggccttcagcccggcacgaactactacgtggcgctgcgcgtggcggacaaccaggacaacgcggtccgctcctccagcttgatggtgcagacgcaggtgcagggcgtcacgcggctcgtcttctcccagcagcccgtggatggggacgcgggcgatacgcaaccggagctccgcgtctcgctgttggatgaggatggagaggtcgtcacgacggccacgtcgccggtgacgctcacgctggaggacgagcccgacttcacacccttgcaggtggcggcggtcgcgggcgtggcgactttctcgggcgtggtggtggagcaggcgggaacgcaccgcttcgtcgcgtcggccacggggttggatccggtgcccagcgacgcgttcaccatcgcgccgggcgacgccgtccggttgtcgctcgcgggcctggtctcgccggtggccgcgggcgccgggggcagcgtcgtggtgacggcccatgacgccttcgacaacgtggccacgggctacaccggcgcggtgcgtttctcgtccactgacgccgaggcggagctgccgggcgactacacgttcaccgtggcggatgcgggccagcggaccttcagcggcgtgaggctgctgacctctgggcctcagagcgtcgccgtggtggacacggcacggccggagctgaccgacacgctcgatgtggaggtgagcaccggtgcggccgctgagttggtgctgagcgcgcttcccgccgaagtggaggccggcgaggcgcagagcctcaccgtcatcgcgcgcgacggtttcggcaacatcgtcacgggctacacgggcacggtgcagttcgaatcgagtgaccctgaggcgacgctgcccgcgaactacaccttcgttcccgggcaggacgcggggcagcgcacgttctcggtgacgctggtgacctccggcgcgcgctcggtgacggtgcgggaggagggcaacacggggctggaggcggcgctgaacacccaggtcctgtctggtcccgctgtgcagttgacggtgcagttggactcatcgacgacccgcgcgggcgagcccgtgggggccaccgtgtcggtgcgggatgtccacggcaacctcgcctcgggctaccggggcaccgtccacttcgagattccaggggacgcccaggccaccgtgccttcggactacaccttcaccgagttggacgccggtcagcgcctcttcaatgtggagttcgccacagtgggcacggggcagctcgtcgtcacggacaccacgacggcgacgttgactgggaatgcctctgtgacggtgcagcccgggctcctcgcggcgttgtcggtagcggggccgacgaagtccatcgtcgcgggcgagcctcaatccttcaccgtctccgcgcgtgaccgcttcggcaacgtgctgacggcgtaccagggaacggtggcgcccgcgtccacggacccggaggctgcgcccctgtcggcgcacgtgtacactgcggcggaccagggagcgcacaccttcaccatcaccttcgagacggcgggagcgcagtcggtgacgttcacggacggcgatgccccggtgtccggtacgtctgacttcaccgtggaggcgggcgcgcccgtgcagctcgcgttcgtcgcgcctccggagccgggcaccgtcctggagccgctgtccgagacgcgggtggccttgcaggatgcgttcggcaacgtctcgaacgtcacggcgccgtccgtgacgctccagttggtgggggcggtcggggtgacgctgggcggcaccttgacggtggcgccggaggcgggcgtggccgtcttcagcgacctcacggtggaccaggcgggcagcttcgtcctctccgcgaccacggagaacccgtcgctgccgtccgtcgacacgatggtcaccatcaccgacgacgtcgcgcccgccgagcccgttctgaacgccagcctggtggacaacacgacggttcgcctgacgtggctggccacgggagacaacggcgtcgtgggcaacgccgcgcgctacgagctgcgctacagcgcggggcccatggacccgcagagcttcgcgctcgccagcgaggtgcccacggcggcgccacgggcgccgggacaggcggaggaagtgattcacgcgctgccgccgtcccaggcggccacctggtacttcgcgctccgcgtcttcgacggctcgaacaacggcagcaccgtggcgttcgtctccatctcggtgccgggcccctgcggcgatatcgtctgcgcgccgcgcgcgccggagtgtgacgaggacggtgtgcagcgtgtggcgtacgcggaagcgtgcgtggtgacggcgggcctggcggagtgccagtacacggccaccccggaggtctgcccggggcaggacggcgtctgtgtcgcgggggcgtgtgacacggcgcctgcgcccgtggcgggtgagttggtcatcagcgaggtgatgcaccgcccggacgcgaacaccaccgagtacatcgagctgaccagcaccgtcgacggaccgcgggacatcgcgaacctgcgcatccgcttcgacaatggcgcgggcggtgagacggacttcagcgtgctgacgaccggggaccggccgctcgtcgtcccgggccggggcaccttcgtcctcgcgagcaacacggatgaggccaccaacggcggcgtggtggcgcagtacggctacgggagcacgctcttcgagcttggccactcggggcacctcttcgtcgagatgggcgccaccgtggtggatgacgtggcgtactcggcctccttcccgcagacgacggggcgctcgatgaacctgtcgtccgtggtggtgggcacgcgggccagccagcacgcctggtactggtgtgactcggaggaagtgcttcctggcggtggacggggcacgccgggcggcgccaacgcgtcctgcggtgtggagatcaccggcccggtggaccactgcgccattcagtatccgaagtccttcgctacccccatccgggcgggccgcgcggagtctgtctacagccagttctatgagccccaggtgagcactcggaaccagaacggcaacgacggcttcccgcacctcgtggcggagctgggctacggaaccgatgcctcgtcacctgcctcgtggacgtgggtgacggcggagccgaacgcgggcttcgccacgccgggcaacgacgatgagcgggtggctccgctgaacatcgcggcgccgggcaactacatctacggcttccgctaccgtttcacccaggggcccgcggcggcccaggcgtgggtgtactgcgaccaggacggcgtcgtcgcggagggaagcacgggcaattacggcacggtgacggtggttccgccgccagccgtggccaatcacgtcgtcatcagcgaggtgagtggcggcaacggaggcggtgccgcggcgaccgatgagttcatcgaactctacaacccgacgaacgccgacgtgaacatcggcggctggctggtgcagtacaggtctgcgacagggccttcgtactccggcaccgtcaccatcccctccgggactgtcatccgcgcccacgggtacttcctgctggggggcggcaactacagcggccccgtggcgcgggatctgggctattcgttcgacgtctcgtcgtccacgacggctggtggccatgttcgtatcggtcctgggctgacgaccgccgtcaatgacgtggcggtagacaaggttgcgtggggcaccgggaactcgcccgaaggcaccgccgcgccctctcaccccgcggtgggcggaagcctggagcggaaggccctgagcacctcgacccctgccaccatggcggatggcagtgctgatgcgtccttcggcaacggctgggactcgaacaacaacagcgcggacttcgtcacccgggccatccgtcagccacagaactcccagagcccggtagagcagccgtag

SEQ ID NO: 5636 - DNA, 804 bp, Myxococcus xanthus
atggctgatggcgtgttccgggacgggctgctcgcgggcaaggtggcgttcatttctggcggcagcagtggcatcaacctaggcatcgccgagtccttcgtgaaggcgggcgccaaggtggccatcaacggccgcaacgtggagaagctcgaggccgcggtgaaggggcttcaggcgcacggcaccgccatgggcgtggccgccgacgtccgggactatgccgcggtggagaaggccctccagacggtgcgcgaggcctacggtgagctggacgtcgtcgtgtgtggcgccgccggcaacttccccgcgcccgcgctgggcatgtcctccaacggcttcaagaccgtcatggacatcgacgtgctgggcaccttcaacatcagccgcgccgccttcgagcacctgcgcaagccgggcgcgtccctcatcaacatctccgcgccccaggcgtatctccccatggccatgcaggcccacgtctgtgccgccaaggccggcgtggacatgctcacccgcgtgctggccattgaatggggtggctccggtgtgcgcgtcaacgcgattacccccggccccatcgacgacacggaaggcatgcgccggctcgcccccagcgacgagggccgcgacaagctcgcccaggccctgccgctccagcgtttcgggaagaagcaggacatcgcccagctcgcgctcttcctggcgtcggaaggctcgtcctacatcaccggctccatcatggtctgcgacggtggccagtccctgctgggcggcggcgcgctcatggccgcgctcggcatgtaa

SEQ ID NO: 5637 - DNA, 1038 bp, Myxococcus xanthus
atgacggaaagcatcgcgctgctggggtacggccgctttggccgtgccctgtctggcctcctgctggtggcgggcatcccgcatcgggtgttcgagccgcgccaggatgacgtgcccgacgcactgagggcaccgacgctcgcggagagtgtcgagggcgcggggctggtggtgctctccatgcccgtgtctggaatgcgctcggtcctggaggagcttcgcccgcgcctgtcgcccgcgcagacggtgctcgacgtcggaagcgtcaaggtgcgccctgtgcaggtgctggcctccgtgttggggcgggacattccctgggtgggcacgcatccgctgttcggcccggccagtctggcgaggggcgacctgcctcgccgcacggtggtgtgcccgaacgaactgcacccagaggccgtgcgcaaggcccgggtcctgttcgaacgcatcggctgtgaagtgacggagctgtcgccggatgcgcacgacgcgctgatggtgcgcacgcatgtgctcaccttcttcctggcccacgggttgctcaaggcggaggccggaaaggacctgcccttcgcgccgcccagcttccagcccgtggctcgcctggaggagtacgcacggctggaggtgccccatctcttcggcgtcgtgcagtcggagaatccctacgcgcgggacgcacgcgtgcggctgctggaggccctcacgcagctccacctgggctgtgattcggggcgctcgggcgcgccggagcctgtcgccgcgccgcccgggctgacggaagttcgggagtgcgtggatgcgttggaccgtgagctggttcaactcctgaatcgtcgcgcccagctcatccagcaggccgcacacctgaaggccgagcacggacttccgctgccagacgcggagcgcgaggcgagcctgctggagacccggcgtcagtgggccgcggagcagggcatggacgcggacgacacggaagacgtgttccgcgccgtcctgcgcttttcacgtcgcgccgtgcccacgggctcccgctga

SEQ ID NO: 5638 - DNA, 828 bp, Myxococcus xanthus
atggacgggacctacaagtcgctgcgcatcgagaagaatgaaggcgtcgccgagctggtgctcaccggccctggcaagggcaacgccatggggcccgacttctggcgggagatgcccgaggccatccgcgcgctggatgcggatgactccgtccgcgtcgtgctggttcgcggcgaaggcaagcacttcaccttcggcctggacctcatggggatgatggagtccctggggccgctgctcaccggcgaaagcaacctggccctggagcgcttgaagctgctgtcgctgattggcgacatgcagcaggccaccgagggcatggcccgctgccgcaagcccgtcatcgccgccgtgcacggctggtgcatcggtggcggtatggatctcatcgccgcgtgtgacttccggtactgctcccaggacgcgaagttctccctgcgcgaggtgaaggtgggcatcgtcgccgacctgggcgcgctccagcgcctgcctcgcatcatcggcgagggccacacgcgcgagctggcctataccggtggtgacgtggacgcggcgcgcgccctgcgcatggggctggtgaacgaggtgttccccacgccggaggccctgctggaggaggcccgagcgaccgcgaagcgcatcgccgagaatgccccgctcgtcgtccagggcgccaagcaggtcatggagtactgcgcggacaaatccatcgcggatggcctgcgttatgtggcggtatggaactccgcgttccttcagtcccatgacctggccgaagccttttccgcattcgtggaacgccgcccccctcactttcaggggcgctga

SEQ ID NO: 5639 - DNA, 129 bp, Myxococcus xanthus
atgacgtcagaggaactgcaccgcaaggcggtggagttgatcttccgcttcgagctgacggggcccgtcgtgccatacaatgcgccggtcgcgccctatcaagcagcgccgtccatccgtgctccgtga

SEQ ID NO: 5640 - DNA, 3555 bp, Myxococcus xanthus
tcctttacccacctccacctgcacaccctctactcgctcctcgatggggcgatccggatgaaggacctcatcaagacggtgaaggagaaggggatgagcagcgttgccgtgacggaccacggcaacatgttcggcgccatcgacttctacaagaaggcgaaggacgccggcatcaagccgattctgggcatggaggcgtacgtcgccggacccaaggggcgtgaggaccgctccgagaaggtctcccaccacctcatcctggtggcgaagaacgaggagggttacgccaacctgcgctacctctcctccaccgcgtacatgcacgggttctactaccacccgcgcatcgacaagaaggtgctcgccgagcacagcaagggcctgttcgcgctcaccgcgtgcctgggtggtgaagtcaccagcgcgtgtttccgcggcgacatggaccacgcccgccgcgccgcgcaggagtacaaggacatcttcgacccggggcacttcttcctggaggtgcagtccaacgggatgccggagcaggacaaggcgaacgagaacctcaagcagctctcgcgcgacctggacatcccgctgtgtgccaccgcggacgcgcactacatcaagcgcgaggacgcgcgcgcccacgaactgctcatgtgcatcgccagtggcaagacgctggcggacggcaagcgcatgaagcactccacggacaagctctacgtcaccagccccacggagatgctggagttcttcaaggacatccccgaggcggtccacaacacccagcgcatcgccgagcagtgcaacctggagctcaagctgggcaagccgatgctgcccaccttcaaggtgcccgacagccacacgccggacagctacatggcggagctggcgtatgagggtctgcgcgagcgcttcaccgaactggcggccaccgtcacgtatcccatcgaccgcgagcagtaccaggcgcggctggcgctggagattggcgtcatccagaagatggggttctgcggctacttcctcatcgtccaggacttcatcaactgggcgaagaagatgaacatcccggtgggcccgggccgtggctccggcgccggcagcctggtggcctacgcgctgcgcatcaccgacgtggaccccatcccgtacaacctcctgttcgagcgcttcctgaacccggaacgcgtgtcgatgcccgacttcgatatcgacttctgccaggaccgccgggacgaggtcatccagtacgtcggccggaagtacggcgagatgaacgtggggcagatcatcaccttcggctcgctcaaggcgaagagcgtgctgcgcgacgtgtgccgcgtgttcgcgctgccgttcagcgaaggtgaccgcatcgcgaagctggttcccgaggtgctcaacatcaccttgagggaggccatcgagatggagcctcgcctcaaggagatgatggagacgccctccaacatcggcgaggtagagggcaagcccgtcaccaccagggacgtgctcgaaatcgcgctcgcgctggagggcctgcatcgccagcccggcatgcacgccgcaggcgtggtgatcgccgacaagccgctgtgggagttcgtgcccgtctaccagccgccgggtgaaaagacgctgatcacccagttcgccaaggacgaggtggaagcggccggcctggtgaagttcgacttcctcggtctgaagacgctcaccgtgattcagcacgcgctggacctggtgaagcgcaaccacggcaaggacatcccgcggcacgagattccgctcaacgacgagaagacctgggagttgatggccaagggcgacacggccggcatcttccagatggagtccagcggcttcacggaaatggtcgtgaagctcaagccgaactgcttcgaagacgtcatcgccgccggcgcgctctaccgcccgggtccgctggactccggcatggtggacgtcttcatcaaccgcaagcacggccgggagaaggtgtcgtacccgcaccccgcgctggagccggtgctcaaggacacctacggcgtcatcgtgtaccaggagcaggtgatgcagatttcgcaggtcctgggtggctacaccctgggccgcgcggacctgcttcgccgcgccatgggcaagaagaaggccgaggtcatgcaggccgaacgggccggcttcctcgagggctgcgcgaagaacaacgtcgacctcaaggtcgccggtgaaatcttcgacctgatggagaagttcgccgagtacggcttcaacaagagccactcggcggcctacggcctggtcaccatccacacggcctggctgaaggcacactacccctgcgagttcatggcggcccttctctccagcgagaaggacaacacggacaaggtggtgaagcacatcggcgaggcgcgcgagtcgggcctcgaggtgctgccgccggatgtgaatcagtccgacatggaattcggcgcggtgagcgggaagattcgcttcggcctgggcgccatcaagggcgtgggcgagggcgccatcgagtccatcctggaggcgcgcaaggatggctccttcaagagcctgttcgacttctgcgagcgcgtggacagccgcaaggtgaaccggaaggtgatggaagcgctggtgaaggcggggtccttcgacttcgagaagcgctcgcgccggcagattttcgacaccatcgagaaggcgatgaaccgcggctcggccagccagaaggacaaggcggctggccagagctcgctgttcggcatgctggcgggtccgtcctcggatggggggggcggcggactgaaggacgactacgtcgaggtggaggactggtcggagaaggagcggctgtcgctggagaaggaggccattggcttctacgtgtccggccatccgctgcatcagtacgacaaggagctgaagcgctacgcgcggccgattacggcggtgcagcgcgcgcgcaaggacgacaagctcacggtggcgggcatcgtcaccgtgctgcgcgagcggcccacgaagacgggcaagcgcatggcgtgggtgacgattgaggacttgtccggctccatcgagttggtgtgcttcccgggcaaggacggcacgcgcaacgtgatgggccgggacggcaagtgggcgaagcagggccccaagccgggcttcgagaactgggagcacctgctcaagtcggacgaccccatcctggtgtcgggcacggtgcagatcagccagcgtgacgaggacacgccgacgccggagctcatcgtcgacgacatccagagcctcaaggcggtgcgtgagaagcgcaccaagcggctggagctgcgcgtgccggcggacctgctcacggaagagcgggtggcgaagctgcatgagttggcgaagaagtacgccggcgcaacgcccgtggcggtgagcgtgctcttcaagggcgagggcgaggcgctcatcggcaacacgtccatcaaggtgcaggtgaatgacgacctgctgctcgcggtggaccgcctgttcggcatgcgggtggtggagttcggctga

SEQ ID NO: 5641 - DNA, 1290 bp, Myxococcus xanthus
gagtactgcgtgggcgtgcgcggcaaggtcgtgtcgcgcgggaagaacgtgaacccgaagatgaagacgggtgaaatcgaggtccgggccagcgacctcaccatgttcaaccgttcggagccgacgccgttccccgtcgaggacagcatcgacacgtccgaggagaagcgcctggcccaccgcttcctggacctgcgccgcgcgccgctccagcactcgctgatgacgcgctcgaagatgaacgcgctgacgcgctcgtacatggtgggcaacgggttcctggagctggagacgcccttcatgggcaagtacacgccgggcggcgcgcgcaacttcctggtccccagccgtctcaacgcgggcaagttctacgcgctggcggagagcccgcagctctacaagcagttgttcatggtggcgggcttcgaccggtacttccagatcgtcaagtgcttccgcgacgaggacctgcgcgtggaccggcagccggagttcacgcagatcgacgtggagatgagcttcgtcacccaggacgacatcttcacgatgattgagggcctgctgaagaagctgtggggcgaggtgctgggcatcgacatccccacgcccttcatgcggatggacttctacgagtccatggcgaagtacggcaacgacaagccggacctgcgcttcgggctggagcacgtggtgctcaccgacctcattcgtgagcacggcgagggcggcggcgtcccgatgatttgggaggcggtgcagaacaagggcatcgtcaaggccatggtcgtccccgcggagaaggcgatgagccgcgcggagagcgacaagctggaggagttcgccaagcaggcgggcgccaagggcctggcccgcgcgaaggtggcggacgggggtgagtggacgcagtccccgctgtccaagacgatcagccccgcgctgcggcaggccatcaaccaggccgtgggcgcgaagacgggcgacctcctcctgttccagttcggcaaggaggcgctggtccacacggtgatggccaacctgcgcgtgcacgtggccaagaagctgggcctgattccggagtacggcagcggcggccagtggaagttcctgtgggtcgtgaacccgccgctgttcgagtacgacgacgagacgaacacctgggcggcggcgcaccacgccttcacgcgtccgcacgacgaggacgtggcctacctgctcacggacccgggccgggtgaagtgccaccgctacgacgtggtgctcaacggcttcgagattggcggcggctgccat

SEQ ID NO: 5642 - DNA, 528 bp, Myxococcus xanthus
atgcacgcggtcgaaatcgcgcccggcgtcttcgaacatccggtggtcaagggcgcgggaggggattcgcccgtggtctctctcagccacgcgcgctcggtggcggcagcggttgcgtgtgggccggagcacatcgttggcgtcgacgtcgagcagctctctcctgaacggacggacgtcttcgaatccgtgatgccgcagcgcgaactggccatggtccgtcacgcgcccggcggcggcgagctggcggcgaacgtcatctggaccatgaaggaagcgctctccaaggccctgcgctgcgggctcaccgctccgttcgaggtcttggaggtcgacgccttcgaggggcatgtcgcgggaggctacggctgcctcttccgcaacttcgcccagtatcgcgcccgtgcctgggtgctcggcggatacgtgctcgcggtggtgtcgcccaagcactcgctgctccatgtcacaccggcggatctggagcgcatccgccaggtgtttggtcgcgacgtgtctcgaagctag

SEQ ID NO: 5643 - DNA, 894 bp, Myxococcus xanthus
tctgaggctccgggcatgagggcgtcccaggcggaggccccccattcaaggagacttacgatggaagtccggtttcatggcgttcgggggagcatcgcggtgtcgggctcgcgcattggtggcaacacggcctgcgtggaggtgaccagccagggccaccgcctcatcctggatgcggggacgggcatccgcgcactgggcgaaatcatgatgcgcgagggcgcgccccaggaggccacgctcttcttctcgcatctgcattgggaccacgtgcagggcttccccttcttcacgccggcctggctgcccacgtccgagctgacgctctacggtccgggcgcgaatggggcccaggcgctccagtccgagttggccgcgcagatgcagccgcctcattttccggtgccgctgagcaccatgcgctcgcggatggacttccgctcggcgttgcatgcccgacccgtggaggtgggccccttccgcgtcacgcccatcgacgtgccgcacccgcaggggtgcctggcgtaccgcctggaggcggatggccactcgttcgtctacgccacggacgtggaggtgcgggtgcaggagctcgcgccggaggtgggccgcctcttcgagggcgcggacgtcctgtgcctggatgcgcagtacacgccggacgaatacgagggccgcaagggcgtggcgaagaagggctggggccactccaccatgatggatgccgcgggcgtggccgggctggtgggggcgcgccggctgtgcctgttccaccatgacccggcgcacggatacgacatgctcgaggacatggcggagcaggcccgcgccctcttccccgtgtgcgagcccgcacgcgaaggccagcggctggtgctgggccgcgctgcctga

SEQ ID NO: 5644 - DNA, 339 bp, Myxococcus xanthus
atgagcgtgggccccgagctcagggatctggcggagcagcgctccgggctggcatcactgcgcgccaaggagggactgcaggcgttctatcgcgcctgggagacggggcagccacaggtgctggtgctggtgggagagccggcacgcttgcgcgagcatgtcgggcaggagcgcggcgtgagcgacgcggtgcccgccgcgcgtacgccggcgatgacgggccgcgcgggtcaggacgccgtgagcgaccacttgaagacggtgttcggccgggtcctgaaggttccccggcagcgcctgcacgacgacgtgtcgctgggcaactacggccttaggagc

SEQ ID NO: 5645 - DNA, 23496 bp, Myxococcus xanthus
atgacaacgcgtgaggttctggccgccttcgcggaaggcaggctgtccaaggtcgaggcacggcggcggcttgccgcgctgcgggcggcgagcatccggttgccgctcagcgaaggccagaaaggcctctgggcgatgcagcgggcccgtcccgaatcgccggcctacaacgtgccgctcgcctaccgcctgcgcggcaaggtcgacccggcgaggctgacccgggcctgggaaggactgctcgaacggtatccgctgctcgctggcgcgattcgcgtcgaaggcacggagccggtcatcgtccccagtgggcaggtctccgccgaggtccacgaggttccatcggtctccgattcagcactggtggcgaccctgcgcgcctccgcgaaggtgccattcgatctcgcctgtggaccgctcgctcggctgcacctgtactcgcggtcggagcacgagcatgtcctgctgctgtgcttccaccacctggtgctcgatggggcatccgtggcgcccttgctcgacgccctccgggagcgttacgccgggaccgaggcgaaggcggggctgctcgaggttccgatcgtcgctccttaccgcgccgccgtggagtgggagcagctcgccattggaggcgatgagggacggcgccacctcgactactggcggcacgtgttggccacgcccgttcctccgccgttgaatcttccaacggaccggcctcgctccgccacggggctggacgcggagggagcaacgcactcgcagagggtgcccaccgagcaagcattgcgactgcgcgagttcgctcgggcacagcaagtgagcctgccgaccgtcctgctcgggctctactacgccttgcttcatcggcacacgcgccaggacgacgtggtggtcggcatccccaccatggggcggccccgggcggaactggcgacggcgattgggtacttcgtcaacgtgatggccgtgcgcgcgcggggcctggggcagcactcgttcggctcgctgctgcgccacctccacgactcggtcatcgatggcctggagcatgcccactatcccttcccgcgagtggtgaaggacctccggctgtcgaatgggcccgaggaggcgcctggcttccagacgatgttcaccttccagagcctgcaactgacgagcgctccgccaaggccggagcccaggtcgggcgggttgccggagcttgagccgctcgactgcgtccatcaggaaggcgcctacccgctggagcttgaagtggtggagggcgccaagggcctcacgctgcatttcaagtacgacgcgcggctgtacgaggcggacacggtcgaacggatggcgcgtcagttgttgcgcgccgcggaccaggtcgcggatggggtggagtctccgctgagcgcactgtcgtggctcgacgacgaagagcgccgcacgcttctccgcgactggaatgccacggccacgccgttcctcgaggacctgggcgttcacgagctcttccagcggcaggcccgggagaccccagacgccatggctgtgagctacgaggggcactcgctcagctatcaggcgctggatacgcggagccgcgagattgcggcgcacctgaagagcctcggcgtcaagcctggggcgctcgtgggcatctacctggaccggtccgcggagctggtggcggcgatgctgggtgtgctgtccgctggcgcggcctacgtacccctggacccggtgcaccccgaggaccggctgcggtacatgctggaggacagtggcgtggtggtcgtgctggcccgtcaggcctcgcgggacaaggtcgccgccattgccggagcctcctgcaaggtgtgcgtgctggaggacgtcaaggctggagccacgtccgcgccggcgggaacctcaccgaacggacttgcctacgtcatctacacgtccgggagcacgggccggcccaagggcgtgatgattccccatcgcggggtggtcaacttcctcctgtgcatgcgcaggacgctgggcctgaagcgcacggattcgctgttggcggtcacgacgtactgcttcgacatcgcggcgctcgagctcctgcttccgctgtgtgcgggggcgcaggtcatcatcgcgtcggcggagacggttcgggatgcgcaggcgttgaagcgggcgctgcgcacccatcggcccacgttgatgcaggcgacgcccgcgacctggacactgttgttccagtctggctgggagaacgccgagcgggttcgaatcctctgcggtggagaagcgctgccggagtcgctcaaggcccacttcgttcgcaccgcgagcgacgtgtggaacatgttcgggcccaccgagacgaccatctggtcgacgatggcgaaggtctcggcctcgcgtccggtcaccattggaaagccgatcgacaacacgcaggtctacgtgctggacgaccggatgcagccggtgcccatcggtgtgccgggcgagctgtggattgcgggcgcgggcgtggcctgcggttacctcaaccggccggcgctgaccgccgagcgcttcgtttccaatccgttcacgccgggcacgacgctctaccggacgggggacctggcgcgctggcgcgctgacggtgaggttgagtacctggggcggctcgaccaccaggtgaaggtgcgcggcttccgcatcgagatgggggagattgaagcgcagttggccgggcatcccagcgtgaagaactgtgccgtggtggccaaggagctgaacggcacctcgcagctcgtcgcctactgtcagcccgcgggaacgagcttcgatgaggaagccatccgtgcacacctgcggaagttcctccccgactacatggtccccgcgcacgtcttcgcggtggatgcgattccgctgtcgggcaatggcaaggtggaccggggccagctgatggccaggccggtggtcacccggcggaagacatccgcggtccatgcccgttcgcctgttgaggccaccctcgtcgagctgtggaagaacgtgctccaggtcaacgaggtgggtgtcgaggatcgcttcttcgaagtggggggggactccgtgctggccgccgtgctggtggaggagatgaaccggcgcttcgacacgcggctcgccgtcaccgacctgttcaagtacgtcaatattcgcgacatggcgcgccacatggagggcgcgacggcgcaagcccgtactggggccaccgagccggctcgcgaggacaccgcgtcggagcgtgactacgagggcagcctggccgtcatcggcatctcctgtcagttgcccggagccgcggacccctggcgcttctggaagaacctgcgagagggcagggacagcgtggtggcgtaccgccatgaggaactgcgcgagctgggcgtgcccgaggaggtcctccgcgattcccgttacgtcgcggtccggtcgtccatcgaagacaaggagtgcttcgacccgcagttcttcggtctgacggcgcgggacgcgtccttcatggacccgcagttccgactgttgctgatgcacgcctggaaggcagtggaagacgcggcgacgacgcctgagcgcctgggaccgtgcggcgtcttcatgacggccagcaacagcttctatcaccagggctcgccgcaatttcctgcggacgggcagccggtcctccgcaccgccgacgaatacgtgctgtgggtgctggcccaggcaggctccatcccgacgatggtttcctacaagctcggcttgaaggggccgagcctgttcgtccacaccaactgctcgtcatccctgtccgcgctgtacgtggctcagcaggccatcgcagcgggagactgccagacggcgctggtgggggccgccacggtcttcccttcggcgaacctgggttatctgcaccagcgggggctcaacttctccagcgcggggcgggtcaaggccttcgacgccgcggcggacggcatgattgccggtgaaggtgtcgccgtgctggtggtgaaggacgccgcagcggcggtgcgcgatggcgacccaatctactgcctcgtgcggaaggtggggatcaacaacgacggccaggacaaggtgggcttctacgccccgagcgccaccgggcaggcggaggtcatccggcgtctgttcgaccggaccggcatcgaccctgcatcgattggctacgtcgaggcccatggcaccggaaccttgctgggtgaccctgtcgaggtctccgcgctgagcgaagccttccggaccttcaccgaccggcgcgggtactgccggctgggctcggtgaagtcgaacctgggccatctggacacagtggctggactggctgggctcatcaagacggcgctgagcctgcggcagggcgaagttcctccgacgctccatgtgacccaggtgaatccgaagctcgagctgacggattcgccgttcgtcatcgccgaccgtttggcgccgtggccgtccctgccgggaccgaggcgggcggccgtgagtgcgttcggccttggcgggacgaatacccacgccattctcgaacactacccgcgcgactcccgcccacgggagaggagccagcggtcgaacgcagtccgtgcggtggctccattctcggcgcgcaccctggaggcgttgaaggacaacctccgcgcgctgctcgacttcctggaggacccggcgtccgcggaggtggcgctcgcggacatcacctacacgttgcaggtcggccgggtcgcgatgcctgagcggatggtggtgactgcgtcgacgcgcgacgaattggtggagggactgcggcgaggcatcgcgacggtgggcggtgcccacgtgggaacggtggtcgatacgtcacccagcgtggatgccgatgctcgggcagttgcggaggcgtgggcgacgggcgactcgattgactgggattcgctgcacggtgacgtgaagcccgcccgtgtcagcctgcccacgtatcagttcgcgaaggagcgctacgggttgtcgcccgcgcactccgtggcgaattcctccaagacgcatcctgacgcgggtgtcccgctcttcgttccgacctggcagccgtggtctgagggcgcgtcaaatgcctcgttggcgctccggcacctggtggtgttgtgcgagcctcttgatgcgctgggggctgaaggtgcctccgcgctggcgagcacgctcgcggacaggcgcatcgaagtggtcaggacgtccagcccaagtgcgcggctggacgcgcggttcatggcgcatgcctcggcggtcttcgaacgcgtcaaggcgctgctgtcggagcgtctgaccgctcctgtgacattgcaggtgctggtgccagaggagcgggatgcgctggcactgagtggcctggggagcctgctgcgttcggtgtcgcaggagaatccgttggtccgggggcagctcatccgcgtccagggaagcgtctccgcatcggcgctggtggacgttctggtgaagtccgcgcgcgccggtgacgtcaccgattcgcggtaccacgcgggccagctttctcgctgtgagtggcgcgaggcacgtgtcgccaagggggacgcatcccgcttctggcgcgaagacggcgtctatgtgatttcaggaggaaccggcgccctggcccggctgttcgtcgccgaaatcgggaagcgcgcgacgcgggccaccgtcattctggttgcccgcgcatcctcggcggaggcggtggacggtgggaacgggctgcgcgtgcggcaccttcccgtggatgtcacccaaccgaacgacgtgaacgcctttgtcgctacggtgctgcgcgaacacgggcgcatcgacggtgtcatccatgcggcgggcatccgccgtgacaactacctgctcaacaagccggtggcggaaatgcaggcggtgctcgcgcccaaggtggtggggctcgtcaacctggaccacgccacccgcgagctgcccctggatttcttcgtcacgttctcgtccctggccgcgtttggaaacgccggtcagtcggactacgcggcggccaatggcttcatggacggattcgcggagtcccgagcggcgctcgtgaacgccggacagcggcagggccggacggtgtccatccgttggccgctctgggagaacggcgggatgcagctcgactcacggagccgtgaggtcttgatgcagcggaccgggatggccgcgctgggagacgaagcgggactgggggcgttctaccgggcgctggaactgggctcccctggtgtcgcggtgtggacgggggaggcccagaggtttcgtgaactctccgtgagtgtttcgcccgcaccgcctccgcatcaggtggcgttggacgccgtggtgtccatcaccgagaaggtcgagacgaagctgaaggcgctcttcagcgaggtcacgcgatacgaagagcgccgcatcgatgcccgccagccgatggagcgctatggcatcgactccatcatcatcacgcagatgaaccaagccctcgaagggccgtacaacgccctctcgaagacgctgttcttcgaataccggacgctcgcggaagtcagcgggtatctggccgagcaccgcgcggaagagagcgcgaagtgggtggcggcacctggagagaattcgtcttccgtcatccaggaggccaggccgccacgtgcggatgcgacgcaccgggcgcctcgcgccgacgagcccatcgccgtcattggcatgagcggccgttatcccggggcggagaacctgacggagttctgggagcgcctgagccgcggtgacgactgcatcaccgagattccgccagagcgctggtcgttggacgggttcttctacccggacaagaagcacgccgccgcgcgggggatgagctacagcaagtggggcggcttcctcggcggcttcgctgacttcgacccgctgttcttcaacatctcgccgcgtgaggcgacgagcatggacccgcaggagcgcttgttcctgcagagctgctgggaggtcctggaggacgcggggtacacccgggacagcctggcccagcgctttggcagcgcggtgggcgttttcgcgggaatcacgaagacgggctacgaactctacggcgcggagctggaaggacgagatgcctcggtccggccctatacgtcgtttgcgtctgttgccaaccgcgtctcgtatctgctcgacctgaaggggccgagcatgcccgtggacaccatgtgctcggcctcgctgacagccgtccacatggcttgcgaggcgctgcaacgaggcgcctgcgtcatggccatcgcgggtggagtgaatctctacgtccacccgtcgagctacgtcagcctgtccgggcagcagatgctgtcgacggacggccggtgccgcagcttcggggcaggggggaacggcttcgttcccggcgagggtgttggagcggtgcttctcaagccgctgtcgaaggccatcgccgacggcgactccatctacgccgtcatccggtcaaccagtgtgaaccacggtgggaagacgaacggctacaccgttcccgacccgcaggcgcaggcggcgctgattcgcagtgcactggataaggcgggcctctccgcgcgcgatgtgagctacctggaagcgcacgggacggggaccgagcttggggacccgattgaagtcgcgggactcacgcaggcgtttcgccgcgacacggatgcccgcgcgtactgccgcatcggctcactcaagtcgaacatcggccacctggaggccgccgcgggcatcgcgggtctgaccaaggtcatcctccagctccgccacaagcgactggtgcccagcctccatgcggagtcgctcaacgcgaacatcgcctttggtgagacgcccttcgtggtgcagcgcggcttcgaggactgggcacggcctcgagtcgaggttgacggcgtgctctcggagcggccgcgccttgccggggtgtcgtcgtttggcgccggtggggcgaatgcacacgtcctggtggaggagttcgagatgggcccggagaagactcccatgcgtccgggcacgccggtcctgttcccgctctcggcgaagaatcccgaccggctgcgcgaggtgggccgccgtttgtgcggctacctgttccaggcgcggcacgtcgatgccgagcacctgcgcgctctggggtacacgcttcaggtcgggcgcgaagcgatgaacgcgcgcctggctttcacggctcggtcggccgacgaagcacgagagaagctggaggccttcctccgcggggatgcgggcgcagatgtcctgctgggcgaggtggacgacgacgcctgtgccttcggccgtgcccggagcgcggcctcgcaaacgctcgcgcagccgttggacgaaagcaggggccgtgagctgctggcggcgtgggtccagggccgggaaatcgactggggcgggctctacggtggcgaggcaccggcgccgcgccgggtgagccttccgacgtacccgttcgagcggaggacttactggctggcactcaaggggcagggcgtgcgaaccgtgtcgccgtccgtgctggagacgaaggtggagtggatcgacgcgccagtgcccgagacgctgccctggcgggagcggctgctctccaagctcggcggcactgtctgggtcgtctacgacgaagagtccgatgcccggcgattcgtggcgctgctggagcaggtgagcgcgtccggcggggtgtcatcagcgcttcagatccacatgcaccgcttcgttcgtggtgcagcggttgagggaccgcgcatcgacgtgggccacgaagctcgggcgaccgtgttctggttgctcccgggagcggtgggggacacggcagggtggctgcgcgccgcgctgcctgaattcgagcgatgggtatcgcggggcgcgggtgtcaccgtgtactgcctgggcggtggcacggctgcgacgctggagggcgacgttggtggcctcgatgccgcgctgtcgaccatggcgcggccccaggactcgtggcgctgcgtgttcatggaggatgacgctcattcactccccagcttgcagcgcttcctgcgtgagtggattgtcgacgaaggccggccagcgcggagcctggtgcgttacacgggtgagcggaggcggttgctccagtggggcgcgatgagcacccagtcggtggggcaggttcccgtggttcaagccatggaacccgtctacctgctggagaaggtatggcggcgccagcctgtctccgtgtcgacggctgagggttcgaccggttcgcgctggcaagccgggagccgggtggtcgtcctggtcaaccccgagacggcgcagttcgtcagtgaattgcggcaggctctggcacccgcggaggtgcgcgtcgtcattgccggagcgctcttctctccagaagcggggcaggcactggcgtccgagcttctgcgcgaagtgggacacgtcgatgtggtgatcgatgtgtctgacctctacgcgcagcccaggagcgtggatgacgacaagctgggcagggtcaccttcctccagcgactgattcgcgagttctccgcgctgtccatcctgcatgtcacgcggggcctgcagccattcgagtgcgcccagccgagtctggcgggggccaagctcgtgggcctcatgaagatgctcagcgcggagtacccccacgtggtcgcgaagagcatcgacctcgacgtcggtgctgaggcgctcgtggaactgctgggcagggagttggcggctccaagagaacagtccgaggtgtgctaccggcgcggccttcgcttcgcaccgctgctcgaaaaaaggcgggtggaacgcactgacgcggatggcctggagcgccagccgttcgacctgcacgaaacaggcgtctatgtggtgacgggaggcactcgcggcatcgggctggagatcgcggagcatctggtctcccgaggtgcgcgtcggctggtattgatgggtgcgacgccgttgccgtcgaggcgcgggccagatgcgggaggtcgttccccgcaggacacgctcaggctggagaagctcgcggcgcttgaacgccgagtggactcactggacatccacattggcccgctggacgaccggaccgcgctcgctgcgctgttcaccagaatccagcgcgagcgaggccccatccgaggcgtgattcacagcgcgggggcttactccgacatcaagacgccagccttcgtcgacaaaaaggccgtggacatcgaacgggtgctcgctcccaaggttcggggcatcgagtgcctgagcgacgtcctcgaaggcgcggacctcgacttcttcgtctcgttctcgtcgctgacgggcgtgataccgaggctcgcgcggggcctgagcgactacgcgatggccaacgcgttcctggaccacttcacggcctatcaacaccaaggccggaagcggacgtgctaccggaccatcacctgggtggattggaacgagaccggcgcgggcgcccgcctttcacccgaggacaaggcacggctcgaccaggccctgggctcgctcgggatgcggagcttcaccaacgatgagggccgtgccctgttcgagaagtcgatgcgcctgggggcgaggagctgggtgttgctggcctacctccatccggagacgtcctgggccgagggcaacccgatgctcgcggagtcgcccgtgacgacccaacggcgcacggtggagacgccagaagcggcgccagcagtggacagctccggggtgaaggcagcgattcgtgacgcggtctgcgaggtcctccagttgccagtcgacacactggacgacgaccgggccttccagcgctatggcctcgactccatctcggcggtccagctctcggtctgcttgaagcggcggctcgggagcgatgtctccccccgcgagttcatcgagcatccctcggtccgtagcctctccgagtacctgggaacgcagttggatgtggcaccgccgctgccctccgtggttcccgtgcctgagcatgacgcgcccgcgcctcgttcgcagacacgcgggggtaaggacgctcaggccgtggccatcgtgggcgcggcgggtttctttccgggctgccagtcgctccaggccttctgggatgcgctcgacgccgagcagacgctcctggaggaaatccctcccaaccggttcgactaccggcctctcttcccggacaagagccggagcaagtggggcggcttcattcccgacgtcgcgtcgttcgacccggggtttttcaacatcctcccggccgaagcggagaccctggacccccggcagcgcctgctgctcatggcggtctaccactgcctcgaagacgcggggcaggccccggagaagctcaagggcagccgcacgggcgtcttcgtaggcgcggaggagaatgagtacctgctgcacctgcgcgagcaaggcgtcgataccgcgtctggcttcgaccaggcggccagcatggtggccaaccggctgtcgtacttcttcgacctgagcgggccgagcgagctggtgaacacgatgtgctcgagcgctgctgtggccatccaccgcgcggtgctggcgatccggtcgggggagattgaccgtgccatcgtcgccgccgcgaacgtcatcctgcggcccgatgggttcatcaagctctcccaattgcagcagttgagcccgagcgtccgcgtgcagtcgtttggcaaggacgccagcgggcaccaacgcgcggagggcgtggcctccgtgctgctcatgcccttggagcaggccgagcgtgaggggcaccccatccacgcggtgctgaggggcagcgcggtcaactacaacggtcgctcgggcgtatcgattgccgcgccgagccgtcagagccacagcgagctgattcagtcttgttatcgctcggcgggcatcgacgtgcgggacgtcgagtacatcgaggcgcagggcatggccaaccccgtcgccgacatcgcggagtgggaggccatcaatgacgcgctgaagcggcttgccacggcgcagggcgtcgacgtggtgccgggccactgccgggtgagcagcctcaagccgctgaccggccacatggagtcggcgtcggcgctcggcgcgctgttcaaggtcatccacagcttccgccgcgacaaggtctacggcatcgccggcttcgaatccgccaactcgtatctggagcttgaccgtcagcccgcgcggctcgcgacccggacggagccctggcggcgcaatggaaagccgcggctggcgggcctgcattcgttcggcgccggcgggaacaacgcgcacctcctcgtggaggaatacgtgccccagctggaatcgcggccgtccgcgggcgggccgccctcgcgtcagtggcatgtcgttccggtgtcggcgagcagcgtggagcagcgggtcgacagggtcgcgcggctggcggccacgctcagggcggagccggagttggacctggacgccgtggcgttgacgctgcaactcggacgggacgcgatgaagcaccgcgtggccttcctggccgaggaccggacgcggttgcagcatcagctcgatcggtacgtcgcgggcgagcgctcggaaggcgtcttcgaagggagcgctgagaagagcaaggggcagcgggacgcagctgcgcaccccagtctccaggcaagtcagcgggaggctcaggagactgcggtcgcgtggtgccggggcgccgtggtcgattggcaatggccactggaggcgaagccccagcgcgtgcgcctgcccgtctatgcattcaagatgcaacggctctgggtggatgcggcgccgcggcagccccgggagggcacgatgcccatcgcggaacaccctgcatccaggccgggggatgacacccggttccgagcgcgggccgagtcgatgattcgcacgacgctcagtcccttcttgcgcgtgcccccggagcagctcgacctggaggcggagttcagcgagctgggcttcgactccatcctggtcatcaagctggccgccgcgcttcgccaggggcatggcttggtggtcgagcctgcggccttcttcgagtactcgacgcccgcgcagctcatccagcacgtgagtgaccagctggcgcgggatgcggcaccaccgtcaccggcttcggacctcctgcctcacgcgggggccaccgctccgcggaacaccgacgagccgattgccatcatcggcctgagcgggcgctatcccgaggcacacgacctgacggcattctggtcaaacctggcgcgcggggcggactgcgtcagcgagctgccatccgaccgctggccgctggatgtcttcttcgacgccgacaaggacgcagccatcgcgagtggcaagagctacggcaagtggggcgggttccttggaggcctctacgacttcgatccgctgttcttccgaatctctccgcgcgaagtggagatcattcacccggagtcccggctgtttctccagtgtgcctggcacgtcgtggaggacgcgggctatacgccgacggcgctggcatcggagcgggtgggcgtgttcgtcggcgcgtcgaaggtgggcgtggccgagcagcaccacaccttcttcaccatccccaaccgcgtctcctacgccctgaacttgaaggggcccagcctcgccatcgacacggcctgttcgtcgtcgctggtggccatccacctggcgtgccagcagctccaatcaggtgactgcacgctggccatcgcgggcggggtcaatacctatacccacccctaccacttcgcggacctctccaagctgcagatgctgtcgacggaagggaggtcgaaggcgttcggcgcgggggccaatggattcgtgcccggggagggcgtgggcgccgtgctgctcaagcctctgggacgcgcgctgcgggatggcgaccacatctacggcgtcatccggggctcggaaatcaaccacggtgggaagaccaacgggttcacggtgccgaacccacgggcccaggcggaggtcatcactcgggccctggcgcgagcgaaggtgcctgcccggcatatcacctacgtcgaggcgcacggcacaggcacggacctgggagaccccatcgagattcgggggctgacggaggccttcgccgcgcagacgccagacctcgcgtactgccgcatcggctcggtgaagacgaacatcgggcacctggaggccgccgctggcatcgcggggctgtccaagatcctgctccagggacagcaccgcaagtacgtgccgtccctgcactcgagcacgctgaatccccatatcgacttcggcaagacgccgttcgtcgttcagcaaacctgcgaggactggctgccctgcgacgcgcagggacagtccatcccccgcattgcctgcatctcctcctttggcgcggggggcagcaacgcccacctcatcatcgaggaagccccggcggaagccatgacgcaagaccctcaggcgctcgtagacggggccgcgctctttgtcctgtccgcccggacggaggagcagctgcgcacgtatgccgcgtcgttcgacgccttcctggcgcaggcgcccgcgctgtcactgcaggatctctgctacacgctccaggtgggacgcgaggcgatggactgccggctggcctgccaggttggttccatccgcgaactgagggagcggctgagcgacttcgcgcaggggcggtccacgcccgagttgctcacggcgaacatccggaagaaccccgagggtctggcctcgcaggatggcggcgaagccatgaggacaggcgcgctctctgagctgggcgcgcggtgggtgaagggcggccacgtcgactggcggagtctgcacgaggggaagcgcaggcgacgtctcagcttgcccctgtatccgttcgcgaagcagcgctacgcgctaccggccacgccaaccgccgtatcggccgtggctccggcgcgcctgcacccgctgttgcacgagaaccagtcgacgctggccggtccgtgcttcgtcacgcacttcagcggggacgagcccttcctcgcggaccacgtggtccggggccagaaggtgctgcctggggtcggctacctcgaactggcgcacgaggcggtgctgcgctcattggaaccggcggaacgcggctcgacggccatccgtctggagcaggtcgtgtggctgcgtcccttcgtctactcggcggagaatgcgtcgctgaccgtccgactgtcgcttgtggccgacgagagcctgtccttccggatcaccagcaccggcaggtccggagagacgatgctgcacgcccaggggcgcgcgcgccgtggcccgggtggcgtgattgcggagcgcgtggacattccaggcgcgctggcgggctgcacccggaaggtggtgaacggcgaggcgctgtacgacgtcttccagtccattggcatcgattacgggcccgcgcaccgggtgattgatgaactggcggtgggagagaaccgggtggtcgcgaaggtgtcgctgcgcgggacgagcctcgcagaccgcgctgcctacacgctgccgcccagcctgctcgatggggccctccaggccacgctgggcctggcgatgggacagggcgcgctgagaacggcgcttccgttctccctggacaccctgcggattctccgtccctgcccggaccaggcctgggtggtggtcgagcgtgaaccgcgaggcggagcgaatggccccatcgtgtgtgcgatacgcatcaccagcgaggcaggcgagccgtgtgtggtgctcgaaggcttcaacgcgcggcccatcgatagcgcaacggcgcagccgcccgcggacgagcaggcgacgctgctttggtccccggagcgtgtgcgcgagccagcaccggaaagcccagcgccgtccttcgaccatcacctggtgctcacctgcggcatgtcggggctgacggcttcggacgtcgagcgcgcggttcgggacggccgtggctccacgtcggtctcttgccgcgagctgcaatcccgtcaggagcggctggacctgcgttacctcgacttcgcccgccagacgcttgaacgcctgcgcgagacgttggccgggacgaagggcaagctgctggtccagctggcctacgcgggagcggacaaggtcgtcgcgggcctcggcggcatgctgaagtcggcggcgctcgagaatacgcggctgagctgccagagcattggtttcgacggtccggtgtcggcggagcagctggcgaaggctttgctggagaacgcccggacgcccggggagcgtgaggtcgactatgaaggcgcctcgcggttcgtcacgcgttggcatgagcgcgcccgtctcccggtggcgtgcgaggcggacacggtcggagcggtaccctggcgggccgggggcgtctacgtcatcacgggtggtggtggcggtgtggctcggctgatggcccaggagattgtccggcggtgtgagcggccgacgctggtcctggtggggcgctcggacgcgaaggaaccgctgctcgccgcgtttcgtgagtgggaggcgtccggtgcgcgggtgcggtacttcgtcgtggacgttgccgacatggctcggatggcggaggtggtcgcggaagtccgccgggagttcggaacggtccacggcgtcatccacacggccggcgtcatcgaggacaacctgctcgcccggaagtccgaggcggagttggtccgggtgttcgcgcccaaggtcagcggattggtggtgctcgacgaggcaacgcgaggcctgtccctcgatttcttcgtggcgttctcttcaattgcaggcgccctggggaacgctgggcaggcggactacgcggcggccaacgcgttcatggacgcgtacatggcgcaccgccagacgcaggtggccgctggcgaccggagcggcgtgagccgggccctcaactggccgttctggcgcgacggcggcatgcgcatggacgcggcgacggaagaggccatgacgctgggcacggggatggtgcccatgccgacggggaccgccatgacggcgctctaccgggtgctgaccgggagcgcgtcgcgggtcctggtcacggtggggcgggtcgagtcgattcggaagttggtgggccaggagcccgtgtcgcgtcgcgagcgagcccctgagaccccgaacgcaggagacctgcaagcgcgcgtcgaggcggtgttgctggagggcgtgtcagagctgctcaaggtgccgcgcgaggagctggacgccgacaccaagctcagtgactacggcttcgactccatcaccttcacggagtttgccaacctcctcaatcgacagctttcgctgggcttgtcgccggtcatcttcttcgagttcaccaccgcgaatgcgcttgcggggtacctgtgtgagagccacggcccacgattgctggaccaactgggcgcggaggccgctgcgttcgagcctgcttcgccgccgtcggcccccatgccggtcgagcctgcaaggagcgaggaacgggtcgcgcccgcgcagccgcgcgcgagagagcccatcgccgtgattggcatggcggggcgcttccccagtgcggatgacctcgatgcgttctgggggaacctcgtcgccgggaaggactgcatccgggaggtgccgaactcgcgatgggattggcgggcctatgacggtgaccccatccgcgaaccgaacaagacggacgtgaagtggggcggcttcatcgacggcatcgacgagttcgacccggcgttcttcggcatctctcctcgcgaggcccggctcatcgacccgcagcagcggctgctgatgatgtacgcgtggaaggccattgaggacgcgggttatgcgccgtcaagcctcgcgggttcgaacacggccatctacgtcgggacgggccatttcggctacggcgacctcatcaaggaagccggcatccccatcgagggctacacgtccgcgggcctggtgccgtcgatggggcccaaccggctcagctatctgctcgaccttcacgggccgagcgagccggtggagacggcctgctccagctcgttggtggccctgcaccgcgcgatgacgtcactggcggacggcacgtgtgacctggccatcgtgggtggcgtcaacacgatcgtcacgccggacgggcacatctgcttcagcaaggccggcatgttgagccgggatggccgctgcaagaccttctccgaccgggcggacggctacggccggggcgaaggggccggcttcgtggtcctcaagacgctcagccgagcggaggcggacggggacgcgattcatggcctcatcctggggagcgccgagaatcacggcggccatgcgaactcgctgacgtctcccaatcccgcgtcgcaggcggacgtcctcatggcggcctaccggaaggccggagtccccatgagcacggtgggcttcatcgaggctcacggcacgggcaccgcgctgggagaccccgtggaggtcacggcgttgacgagcgcgtaccagacgctcgtgaaggccgacggggacgccgccagtgcgcagcctcgctgtggcatcgggtcggtgaagaccaacatcggccacctcgagctggcggccggcatcgccggcgtcatcaaggtgctgcttcagatgaagcacgccacgctggtgaagagcctgggctgcgagaccttgaacccgcacatccggctggacgacacgccgttctacgtcgttcgggagacggcgccctggccgcgcctcacggaccggcgaggagtggaactgcctcggcgcgcaggcgtgagctcgttcggcttcggtggcgtcaatgcgcacgtggtgctcgaagagtacgtggcgcggcgacaggagaccgcgagcacgcaggtgatgcccggtacgccggccatcatcgtgctctcggcgaagacggccgagcgcctgaaggtccaggcccagcagttgcgcgacgccctccggcatggccggtatcaggacggggaactggcgcgcatcgcctacacgttgcaggtgggccgggacgagatgaaggagcggctggcgttcaccgtcgactccctggccacgctcgaacgccagttgacggcgttcgtcgagggaaccgagctcgagtcgggcctctaccgtggcactgccggaagccgtggcggcactgccgttgttgaggagccggcgagtgggctcaccgagcggatctcacggggagagattgcgcccgtgttggagtcgtgggttcgcggcgggaaggttcgctggcacgaactccatgcgggtggccgcgcccagcgcatccgcctgcctacgtatccgttcagcagagaaagacattgggtcttggacacgcagacacccgcgcaacccctccgtgccggtcgcgtggtgacacgcgccaccgcgaacaggagggcacccatcgtgctgcgagaccctagcgacctggaggccgagttgatggacgctgcaactccgaagcgcaataccgtggtcgaggcacccgagccggagcgtccgacgcccaccgctcctcctgctgcacccccgccaccgagcgcagctgcgtcgagcaaactgcgcgaggaactggcgacgagcctcgcccaggcgctctacatcgaccgcgcgcaggtcaacgcggagtccaccttcgtcgaactcgggctggattcgattgtcggggtggagtggatccacgccatcaacaagcaatacggcctgtcactcccggtgaccaaggtctacgaccacccgaacctctcactgttcgcggactacctcgcccggcagctggggccgaccgcaccgcctcccgcgccgccgccacaggtggaggcgaagacggtacgcgtcgcgcccgtcgtttcgagcccgcctcccagcgtgcaagcggtgcaggcgccagcgatcgtgaagaaggaggtcgcaccggcgggcaccgtgcgaatcgccgtcatcggcatgtcggggcgctaccctggagcggagaaccttcggcagtactgggacaacctccgggacggggtcagcggaatctccgagctgccgtacacccgatgggacgaggccaccgcgaagcagttccggcaggaccggaactattgccaccggatgggcgcgctctcggacatcgagtcttttgacccgctcttcttccgcatgtcgccggccgaagccgaagtgacggacccacagcaccggctgttctggcaggaaggctaccgggcgttcgaggacgcggggtacgccggtgaggccctggatggccgccggtgtggcgtctacctgggcatcatgggcagtgagtacgccacgctgttgcagcggagtggggcccaggccatcaacaccacgggcaacagctacgccatcgcggcggcacggctggcgtaccacctcaacctgaagggcccggccatcgccatcgacacggcgtgttcgtcgtcgctggtggccacgcacctggcctgtcaggcgctgaccagccatgaaatcgacatggccctggtgggcggcgtcacgctgtacctggcgcccgagtcatatctggccatgtgcgacgcgggcatgctgtcgacggggggcgcatgccggcccttcgacaatggcgcggacggcttcatccccggcgagggcgtgggcgccatcgtcctcaagaggcttgaggatgccgagcgtgaccgggacgccatcctgggcgtcatcatcggttcgggcacgaaccaggacggcaagacgaacggcatcaccgcgcccagcgcggccagtcagatggagttggagcgcgaggtctaccggcggttcgaggtcgacccggccacgattggctacgtggagatgcacggcaccggtacccggctcggcgacccgattgagctggaggccttgtcgtccgtcttcaaggagcgcacggaccggactcagttctgcgccatcggctcggtcaagagcagcatcgggcatacctccgcggcggcgggggtggcgagcatccacaaggtgctcctcgcgatgcagcatggctcgctcgttccgtccctgaactactccgagccgaaccagcacttcgacttccagcggtcaccgttctacgtcaacaccgagcacaagccctggaaaccgaacggccatgcgctccggcgggccgccatcagctcgtttggcttcagtggaacgaacgcgcacctggtgctcgaagagtatcccgcggcgtccaggccgccgaccgtgagcgcggtggggccggcgtcggtgttcgtgctctcggcgaagacggcggagcaactggccagctccgcggccgagcttcgccgattcgtgcaaacgctggatgcaggcgcgctggcccacctggcgttcacactgcaagtcgggcgcgcggcaatggagcatcggctggccgtggtggccggtagcgcttcggagctgagtcgctcgctggagggtttcctccacggttcgccggggaaggacgttttcgtgggcaccgcgctcggggctggtccggccagcggtcaggctccgtccaccgacgacctcaacgtcctcgtgggtgtctggagacagagtcacagctacgcgaagatcgcggccgcctgggtccggggcgcacgcgtggactgggccgcgctccacggcggacagggccctcgcagaatcagcgcgccgacctatccgttcgccaaggagcggtgctggctgcctgagcatgcatccgaggccgcggcgcccatggcgcatgccatcacggacgctggtcatccgctcgtccagcggaatacatcgacactgtccgagctgcggttcacgtccacgttcaccggagatgagccgttcctggccgagcatcgtgtcgctggccgcagggtgatgccggctgccgcccagttggagatggcgcgggcggcggtggtggcgttgctcggtgcgggtgagcggacgaagcgcgtgcagttggcgaacgtcgtctggccgagagccctggtggtcgagacgggtgccaccgacatccacatcgggctcaagccgcagcccgacggtgacctggcgttccggatctacagttcgcctgagtacgacagcgggatggccgtgctgttctgccagggaacggcgcgactgaagaccgccgacatgcccggtgcggcggagcggtcgcgtgtcgaacggaacacgctgctgcgtgagtgtggcgtcgacagcctggatggcgaggcgtgctaccgccgtttccgcgccgcgggcctggagcatggtccttcgttccaagcactgcggcggattcacgtaggccgggagcaggtggtggcggacctgtccctgccggcatccaacgcccgtgcggcggcgtcctacgcactgcctccgggcatcctggattcggcgttgcaagccgtggtcggtctggcgcgcggcaaggacgacgcgccagcggccctgccgttcggtctggagcgcctggacgtgtatcggccgtgtccctcggaggcctgggcgcacatcacgcggccagccgcgaatggaccggactcggccatgccttgcgtcgacatcgccatctacgatgcgcagggcacgctgtgtgtcgagctcaagggctttgtcacgcgggcaccggaggcgtcccgtgagtcggctgagcacggccgggaagtcctgctcatgacgcccgcgtggaccgtgtcttctccgcgagtggatggcacgagtcccgcgaagcccggccgccacatcgtgttcctgtgcgagacgggcagggcactggaggcggcgctgcggcctcacgctggggatgccgaactcatccggttggagtcctctcatgaccggatgggagaccgcgtccaggagtacgcgggccggctgctctccacgttcaagcgcgtcttgaagtccgggccgcagggggacgtcctctgccatctggtcatcccagccaagggggagcagcagttgctcaccgcgctcgacggcctgttgaagaccgcgcacgccgaggagccccggttgaagactcggctcatcgaggtgcatgagccggagggcgcttcgctggcgtcgttgctgttcgcccgcgacgccgggtggacaggctccgctccggtacacacgcggaggctggcgagagccgcggtggcaggaagtggcacagcgagcgtcgagcactccgcacagcgagtccgtctggcgccggggcggcgtgtatctcgtgacgggcggactgggggggctggggatgattttcgcccaggagattgcagcccgtgcgccaggtgcgacgctgattctctgtggccgttcgtctcctcgtcagatggagccccggttggcgacgctccgtcgttccggcgtcacggtcgaatacctgcgcgccgacgtcagccagttggacgaagtccggcggttgattgctggcatccgtga

SEQ ID NO: 5646 - DNA, 3639 bp, Myxococcus xanthus
atgctgagtgccatggacgccgtccttcagcggctgcgtgcgctggagcactcgggaccccgggcgccttgccgggtcgaaatctggtgtgaccgcgggagtcctgccgcggtctgtgaaggcctctggagctttctccagtcgctgcagttggagcaccgcaacgttgaggggcaggtggtgcggctcgacgatgtcggtgggcggcactgggtcgaggaagtcgttgagcgggagcggcggcagggccggggcgattccgccgtgacctatcgtggtcggaagcggttcgtccgtgccgcggttcgcgttccctggcccgtgcctgcttcccggcaggagctactggcccagggccggaagacctacggtgtcgtgggtggtggcgcgctgggactcgcgctggcgcactggttggtcgagcagtgtgatgccgacgtcatcatcgccagccgctctggacggccgctcagtgcaggcccgcaggcatcgtcccggctgcgctggtgcaagctcgatgtgacggaccctcgcgacgtcgagcaggcggtgggggagtgggcgcgggaagcacggctggaaggactcttcttcacagtggggcatgtcgagccagggcccgcgctggcgaagacggaccgcgagcttcgccgcacgctggcacccaagtgcctgggcgcgctcaacctgctcgaacagtgtcaccgtctcccgtgccggttcgtcgcgctgttctcgtcccaggcgagcaggggggagtaccagcacagtgactacgccgccgcgaatggcttcctgaacgggctggcggacggcttcggggcggaaggggcgccgcggttcacgaatcgcctgggcgagcccctgtccgtgatctcgctgagctggcctcagtggcgcgatggcggcatgcgtctctcccgcgaactctcggagttgctcgcctcttcgcaaggcctcatccccatgcccaaccaggtggggttcacggcactgcgcgaggtcgtccgcggtggcatgcgccatgtcgccatccagtatcgcctgtcggagcagcctcggaaggaggcggttgttccggcccaggcggtcgatgctgacgctcgggcgaaggcggagcagacggtcagggacgtcgtgggaagctacctgggccagcccgcgcatgcgctggacatggaggcggagctgtcggccctgggcgtgacctccctggccatcgtggagttgggtctggccctccatcggcggcacggcatccgggtgcagcccgcgcgcttcttccagtacacgacgccatcgcaactccgggacttcgtcgcccaggaattgtcgaagcgtgcgtcgcctgctcacgctcaagtcgctgcgccggagtcacgcacccgtgcggcccctcacgagcgcaccgagcccatcgcggtcgtgggcatccatgcgcgcttcccaggcgccgaggatgtcgatgcgttctggcgcaacatcgtcgagggcaagcgctgcctctccgaggtacccgcgtcgcggcaggaggcgctcctggcactggcaggagacggctcggatgtgacgcggcctcggtggggaggcttcatcgagggggtcgacgagttcgacccacgattcttctccatctcgccgcaagaggccgagctgatggacccccagcagcgcctgctgctggcctctgtctggtcggccttggagaacgggggcctcatcccggagcagttcgcccggacctccacgggtgtcttcgtggccgccgcgccaggggagtacccgcgcgtcgtctccattcccgtgagccatccgttgggcacgaccgccgtcacggcgtccattgctcccaaccgcatctcccacgtcttcaacttcaaggggcccagcgagtactgcgacaccgcctgttcgtcggcgctgacggcggtccaccgggcatgccaggcgattcgttccggtgagtgcgagcaggccgtggtgagcgccatcaacctgctcctgtcgccgacgaccttcaccggcttcgaggccatggagtacctgagcgtcgacggttcatgccgccccttccagcccgaggctcgcggcttcgttcgcagtgaaggggtagggacgctcgtcctcaagcctctgtcgcgggcggtggctgacggagacatcatctacggcctggtgcgtggcagtggcgttgcgcatggcggccggggactttcgctgacggcggtcaaccctctgggcatgaaggacgcgattgtctccgcgtaccgcgccgcgggcgtgagcgcgcggactgtctcctacgtggaggcgcacggcgtcggatcgcctctagcggatggcgcggaagtggaagccatcaaggctgcgtttcgcgaggtggatgagcgtgcgcgcgacggcgagcctcacgtctgccatttgagcagcctgaagccctgcatcggtcatggagagctggtctcgggcatggcggcgttgatcaaagcgctcatggcactccgccatgcagtgctcccgggcctgccgggtttcacgcagtggcacgaggacatctcagtggcggactcgcccttgaaggtgtcgtcggacagccagccgtggcggacgccggcaggcgctgagccgtccccgcgtcgcgccggcgtcaacagcttcgggttcggcggggtgaatgcgcacgtcctcttggagtcgttcgctgcggacacgcggctggcggggggccgcgaggggccgcggttgttcgtgttctcggcccggacagcggaccgattgcaggaggtggcgcggcggctctcgtccttcctggcgtccaacagcgacatcgtcatggcagacctcgcctacaccctgcagaccggacgtcacgccttcaactgccggttggccgtggtcgctcgcgaccggaacgagttggccgccgcactgagcacgtacctggcctcgccggagcggacgtcgtgggccggtacccccatccatgtgggcgaggtggatggctcgactcgactggggaagttcctgtcggaggccgcgggagcgtcactggtggagtcactgctcgctgagcaggggctggagcggctcgctgagtactgggtgctggggggccacgtcccgtgggcgcggctgcatgagggagcggacgtcaaacgcatcccgctgccgacgtatccctttgccagggagcggtattggctcgcgtctggctgcgccgattcgcaggcgagtgcccatgaggtcccgctgtcgccgaagggccgcggcgtggaggccatctcggaggcgattcgcgagcagctctccttggcgctgagcgtgcctcgggcgcagctgggcgaccacgtcaacgcgagagacctgggggcggactccatcacgatgatgcggctggcgcaggtgctggcacgaaccctgggcgtcgacgtgcggctccgtgacctggttgaccggtcgaccatcgcggcgattgcatcccatgtcgcgacgttggtgcgcgggcgcgagccgagagtggaagacacggtgcccgtggcggtgcctgagcaggacgccctggacatgctcaaggaagggcttctgtccatcgaggacgtcgcggcccggctggagaacgacgctcatgacaacgcgtga

SEQ ID NO: 5647 - DNA, 2205 bp, Myxococcus xanthus
  unsure (1)..(2205): unsure at all n locations
atgtccgtcgaggcgttctggcgggccttggaccgcgaccagccgctgcttcaagagattcctcgcgcgcggttcgacatcgacgcccactttgacccggatggcagcgacccgagcaagagccacagccgatggggtggcttgatcccgcgcatcgaggacttcgacccggagttcttcggcgtctcgcacggcgaggccgctcgcatggacccccggcagcgcctgctgctgatgtcggcgtacaacaccttcgagaacgcggggtacgccccggagacgctgcgggagagccgcaccggcgtcttcgtcgccgtcgaggacaacgagtacctggcgcatctccagtcggctggagtggagatggcggaccccttcggccattccccgagcatggtcgccagccgcctgtcgtacttcttcgatctccgaggcccgagcgaggtcatcaacacgatgtgctccggcgcggcggtggctctccaccgcgccgtggtggcgctgcgcaacggcgaggtcgagcaggcgttggtcggtgcggcgaacctgcttttgcgtccggagctcttcgtgtcgctgtcccggctgggacagttgagtcgaggcaaggaggtctggtcctttggtgagcgtgcctccggctatctgcgcgcggaaggcgtggccagcgtcctgctcaagccgcttgaccgcgccgaacgggatggcgacgccatctacgccgtcatccggaacagcgcggtcgctttcaacgggcggggcggcacgtccatcgcgtctcccagcgcggccagccatgcggcgctgatccaggagtgctaccagacggcgggcgttgacgcgcgcgccgtggagtacatcgaggcgcaggggatgggcacccccgtggcggacatcgccgagtgggatgcctgcaacagggcgctgcgggaactcgcgcagcggcagggtgtctcgttggaggcggggcaatgtcgcatcagcacgctcaagccgatgatggggcacatgcactcggcatctgcgctgggggcgttgttcaaggtcatccgcagcctggagaccgacacggttcacggaatcatcgggttcgatcagccgaatcggttccttgaccaggatgtgcagccctgccgcctggcgcgtgagagttccgcgtggcgacggaagggtcagcctcgattggctggtgtgcattcgtacgggtccggaggcgtcaacgcccacctgctcatcgaggagtatctgcctcggcgtgacgcgcgaccaccagatggccatggaccgcaggtggtgccgctgtcggcgggagcgccggacctgctccccgggatggcccggagcctgcgacaggcgctggatgcgcagccttcgggctcggtgcacgccgtggctcggactctccagcagggacgcgatgccctccgattccgagtggccttcgtggctgagtcggtcgcggacctccaggctcaactccaggcatatgaagaaggccgacgctcctccacggccttggaaggtgtcgcggagcccggggtagaggaccgtccgaatggggaaggcgacaccgaaccgcgcagcgcggcgcaacgatgggtgcagggcggggcggtgcggtggagccgttcgggcggagcagacgcgttcgagcggatgcgtctccccggctatcccttcgcgctccggcgctgctgggttgaaggccgcgataccgcggcaccggtccatgcgtccacgggcgtcctgttccagctgaagcgcgtgaacggcgatcggcaccaggtgcgtgtgtcgttcgacggtggcgagttcttgttccgggaccaccaggtcgcgacgacaccgatacttccaggtgctgcatacctggagctggctcgcgcggcggcggtggcgtgcgacttcacccatccttctgaactcacggacgtcgtctggcagcatccgctccgcgaagacgcgcgcggggacgtgcgcgtcgtgttctccgaagcnnggacggggcaggttancttccaggtcgtgtccccaaaccacggaaccgtcggcagtgagacaggccatgttcgtggtcagctggcgtcctcatcccatcctgaggaggagccccgacagttgccccaactggaggggagatgccctgagcgcctggacggggatgtcgcgtaccagtggctgatacaggcatggctggagtactga

SEQ ID NO: 5648 - DNA, 1101 bp, Myxococcus xanthus
atgtcgctcgaagagctcctgggcgttcggcctcccagccagcggcgctcgcaggtgagcttcagcttcttgttcttctcggacgtgcgcaaggacatctccagcgcggagaagtaccgcttcatgcgcgacgtcaccttgttcggggacgcgaagggcttcaccgccgtctacatccccgagcggcatttcagtgagttcggctccatctacgcgaactcggcggtgatggcctcgtacctgattgcccagacgaagcgcatccggttccggacggcgggcatcagcctgccgctgcaccatccggccgaggtcgtcgagtggtgggccatgaacgacaacctgtccggtggacgcgtggacctgggcttcggctccggttgggccaagccggacttcatctatgcccccgacgcctacgagaaacggcgggccatctgcgcggagcgcatcgacatcgtgcggcggctctggcgcggggagacggtgccctttccagggccgggcggtgtggacatccccatcaccgtctatccccggccggtgcagaaggaactgaatgtctggttgctcatcacccagaacgcggatgccttcgcgcaagcggggcggctcggcttcaacgtcttcaccatgctgtatggctgtgacctggacgtccttcgtgaccggatcgccctctaccgccaggctcggaaggaagcgggccatgacccggagaccggcatcgtctccttgatgctccacacgctggtccatcgcgacatggcgttggtccgccgggcggtggaggcgccattcaaggagtacatccgaagctccttggatgcccatctcgccgcggggctgggctcggcggggaaggtgagcctgaaggagattggcgaagcggagaagaacaaaatcctggagtacgcctatgagcgctacttctccaccggggccttgttcggtgacgtcggcgacgcgcggcggatggtggagaagaccatcgccgcgggcgtgaacgacatcgcgtgcctcgtggacttcggcgtcgactacccgctggtcatggagtcgctgccgtacctggaaaaactcgtggcggattactgctga

SEQ ID NO: 5649 - DNA, 6267 bp, Myxococcus xanthus
atgttgaacctgatcaacaaccacgcacacggttatgtggtcacgcccgtggtcctggcctgcaacgacgctggcctgttcgaactcctgcggcagggaccgaaggacttcgaccggttggcggaggcattgcgtgccaaccggggacatctgcgcgtcgcgatgaggatgttcgaatcgctcggctgggttcgccgcgacgcggatgacgtgtacgcggtgacggcggcggcggccgcgcatcggtccttcccccgcgaggcgcagtcgctcttcgcgctgcccatggaccggtacctgcgcggggaggacggcctgtccctggcgccgtggttcgagcgctctcgggcgtcgtgggataccgatgacacgctggtgcgcgagctgctcgacggcgccatcatcacgccgctgatgctcgcgctggagcagcgtgggggcctcaaggaggcgaggcgtctgtccgacctgtggtccgggggggatggaagggacacgtgcgtccccgaggccgtccaacacgagctggccgggttcttctccgcgcagaagtggacgcgtgaggacgccgtcgacgcggagctcacgcccaagggcgccttcatcttcgagcgggcattgctcttcgccatcgtcggctcgtaccggccgatgctggccagcatgccgcagctgctcttcggtgactgcgaccaggtcttcgggcgggacgaagcgggccacgaactgcacctggaccgaaccctcaacgtgattgggagcggccaccagcaccggaagtacttcgcggagctggagaagctcatcatcaccgtcttcgatgccgagaacctgtcggcacagccgcgctacatcgcggacatggggtgcggtgacggcacgctcctgaagcgggtgtatgaaacggtgcttcggcacacgcggcggggaagggcgctcgaccggtttccgctcacgctcatcgccgcggacttcaacgagaaggcgctcgaagccgctgggcggacgctggccgggttggagcacgttgccttgcgcgcggacgtggcgcggccggaccgtctcatcgaggacctgcgggcgcgcgggctagccgagcctgagaatacgctgcacatccgctcgtttctcgaccacgaccgtccctaccagcctcccgcggacagggcggggctccacgcccggattccgttcgattcggtgttcgtgggcaaggcgggccaggaggtggttccggcggaggtgttccacagcctggtggagcacctcgagcgctgggccgccatcctgcaccggcatcccctggtcatcctggaggttcactgcctgccggcgccggtggttcgcggcaacctcagtcagagcgagagcctccacttcgacgcctaccaccgcttctcgcatcagatgctggtggaggcgaaccacttcctgctcgcggccgcgcaggcggggctgttcgccagggatgacgtcatccgccgtttcccgcggacgctgtcgttcacccggatgacgctcacgcagttcgagaagcgatcctatcgcatccggtgggcgcgactcggagacctgccggcactggagcggctggagcgcgagtgctgggacgcggagctgcgcgcgccggacgccgtgctgaaagcccgcgtcgagaagtaccctcagggccaactggtgctggagctggagggacaggtcgtcggggccatctactcccagcgcatccgtgatgacggcgtgctccagggctccacggctgagacggtcgacacgctccacacggacacggggccagtggtccagctcctgggcgtcaacgtctcgccgagcgcgcagcattcgcggctgggagaccggctgctcgagttcatgctgcagtactgcgcactgtcgaatgacgtggcatcggtggtgggggtgactcgctgcaaggcgtatggccgccacgcgcacctgtccctcgaacagtacgtcgccgtgcgcgatgagcacggcttgtccgtggaccccgtgctccgcttccaccagattcacggcgcagagctgggcgaattggtcgtgggctaccgggttcgcgatgcggacaaccacggccatggcgtgatggtgcgctatgacgtgcacaaccgtgttcgccgggatgccccggtcgaagacgccgagagcgcgagtcctgctccagcggtgacggcccgtggcgtggcgtccacggagaccgagtactacctgcgtcaggtggtcgcacggattgtcgagtgcgacgcggcggcggtccggctggaccttccgctgatggaactgggcgtcgactcggtggggctgatggagctcgccgagcacatcggccggcgcttcgagctgaagctggaggagaccttcttcttcgagcacaacaccctggaccggattggcgcgttcctcgccggccggaatcagccggtggtggcgcagcccgtgtccgcgcccttgcgtcccgcgcccgtgccggctccctcgggcgaggtgagtgaccaggagattgccatcgtgggcgtggcctgccgcctgcccggcggtgtccagacgccgcagcaactgtgggacacgctgattgctcgtcagtccctcgtcgggacgctcgaggacatccgctggcgctggtccggcctgggacatgcggccgcctcgggccatgtcgcgcatgccagtgacgtggaccggttcgacgcggccttcttcaacatctccccggcggaagccgagttgatggacccgcagcagcggctgctgctcgaactcagctggcagtgcatcgaggacgcggggcacgatcccttgcgtctggcgggaagcgacaccggcgtcttcgtcggcgcgagtggctccgactataagacgctccaggacaagtacgggcgggacatcgctccgcaatacgcggtggccacgtccacgtccgtcatccccaaccgcatctcctacttcttcgacttcagcggtcccagcgtgcaggtggacactgcgtgctccagctcgctggtggcactcgaccaggcgctgcgagcactgcggagcggtgagtgcggtcaggccctggtcggcgccgtcagcctcatctgcgagccgagcaacacggtctgctaccagcgcgcaggcatgctgtccgaggacgggcggtgcaagacgttcgatgcgagcgccaacggttacgtccgtggggaaggggcggtggtcttccttctcaagccgctgaagaaggccctggcggacaaggatccggtctacggcgtcgtgatgggctcggccgtcaaccatggtggacggaccgcggggctcacggcgcccaacccgcagaagcaggcggagttggtgtgcaaggcgctccaggctgcgaacgtggcgcccgaggaagtcggctacatcgaagcgcacggcacgggcacttcgctcggcgacccggtggagaccaaggggctggtcaccgctttcgaccgcatgtctcgggcgaaggggacgcgttccaccgggcggtgtgcggtgggctcggtgaagacgaacatcgggcacctcgaagcggcagcgggcgcggcgggcctgctcaaggcgctgctgtgcctgggccacaagcggattcccgcgaacctccacttcgaacagatgaacccgcggattggcttcacgggcaccccgttctacgtgagccacgaggagcatccctgggagctgtcggagggacaggcccgtcgcgtggcgggcgtgagcagcttcgggtcgggtggcacgaacgcgcacgtcctggtgcgggagcacgtggcgacaaggcccgtcagcaatggcgtgggggctggggggcggtatctcgtcctgttgtcggctcggaccgaacgggcgctggagcggcgtgaggcggacctgctcacctggctccaggcgaatcccctggaagacctgggcgacgtcagcgccagtctggccatggggcgcgcgcactggggacatcgctccgcctacgtggtgtcgagccatggggacctgtgtgagcaactgtccttggccgagcggcgccgggcctccaccgtgggagcgaccaagttcgacagtctgcgcaagcagcgcttcctccagcgcttgcagcaggtcttcccacacgacgtgttgctgagagccgcgcgcgagggggctgggttccatgacgacctctgcgcgctcgcagacctctacctgctgggctccgagttcgactggcagccgatgttcagtgcgctcctgacgcgtcggctgcggctgccggcgtaccccttcgagcgtgactcgtactggttgcacccgaaggaggctgctgacggaattcccgccgtggtgaaggcgcctgtccgcgaaccgcaggcgggtgccggttcctggctgtgcgtggcccagaagtgggtgcccacggcgctggaggatggcatcgactggcgcgtccgtctggcgcgctacgcgggcaaggaaatcgccatcgtctaccaggaggcggacgacctggcgtccttcaaggtcctgctgtcagcggcgtgtgcggggctgggagaccgtgctccaagagtccattccgtggacgcccgcgacttcggtgatgcgctcgacggcaatccgttcccggtgcttcccgacgtggtgttctcgctgggggcctcgaagccggagggacagggcgccctgcgcgcggcgcagaccgtgtttcgaatcagccagacgctgatgcgcgcggcgggggagcgtgctgtccgcctctatcacctccatgaagtgagcccgtcgcagtcggccatcgacgccgaggcgcttggagggttcatccggtccgccatgctggagaacgcggcccatgtctggaaggtggtgggcttcagcgcggacggagcggcactgtctcctcgtcaggcgctgttgcaggaatggctctccgacccggaagcgtcgccagaaatcgttggcagccacgtctgcgccacgccgtgcgaggtccgctatgcacaggcgcagcgggccctggcgacgttcgtggaggtgccacccgagcaggcacggacggacttcccgaagctgcggcagggaggcacgtacctggtgacgggaggcctggggccggtgggcgagcaggtctgcagacagatggcccgccggtaccagcccacgctggtgttcttctcccgaagctccctggacccggtccgggaggcgcagctggagacgcttcgctcccttggggcgaaggtcgagtacctcccggtcgacatcaccgacccggccgccttgcgaggcgcgtgggcggaggccaaggcgcgggtgggcgtcttccacggcatcctccacctggctcggctggtcgaggacagccccatctactccaagcgctgggcgtccttcgaacgggtggtcgcagccaaggcccggggaacggtgctgctcgacgaagtctccgcgaacgaaccgctggaactcttcctgctgttctcgtccgtggccgccttcggcatccgaggctcgtccgactatggctacgcgacggcctatcagaacgccttcgcgcgccatcggaacgagcaggtgaagcgtggggagcgctctggccggacggtctcccagtgttgggggccttggacggtggacagctacatgccggagcggcgcgatgaacggttcgcggccatgggctggggcctgattgagccgtcgcaggcgctggaggccattgaccagagccttcagctctccgagccggtggtggcgctggtcaggactccctcgttggagctggctcgacgtgtcttcggcctggcgcgaagcaacgacacacaaccgagcgcctcatccccgtgggccgggctggaagaggggctgcggcgtttcgaagcgggtggcgctcccgcgcctgcggccgtggcggcgttcctggcggactacgacctggagcaggtgccgacagcgttggttgagcgagcgcacgggctgatgttctccgcgcccgtggagcgggctcctcgtcgcctggcgaccggtggcgaagcgctcgaacgcgcggtccgggatgcgctcacggaagtgctgaagctgcgcggtgactactcggacgaccagacgttccagagcttcgggatggactccatctccgcgacccagttggccacgcggctggagaagaagctggcgatgcccatcctgcctcggtggttcctggagttctccacggcccgggcgctgattcgccacctggccgctcaatctccccagaggcaatcatga

SEQ ID NO: 5650 - DNA, 414 bp, Myxococcus xanthus
atggggctgttcgcggacttcgtggtcctgagccgggagagcgtctacacgacgaacttcatgcgctacggcttcacgccggggatgggcgccacgtacatcgtgccgaagcggctggggtactcgctcgggcatgagctcctgctcaacgccaggaactaccgcggcgccgacctggagaagcggggcgtgccttttccggtgttgccgcgcaaggaagtcttgccccacgcctacgagattgcgagggacctggccgcgaaacctcggctgtcgctcgtgacgctcaagcggcacctggttcgcgacatccgccgagagcttccggacgtcatcgagcgtgagctggagatgcacggcatcaccttccatcacgacgacgtgaggaggcgcatcgagcagctgttcctctga

SEQ ID NO: 5651 - DNA, 789 bp, Myxococcus xanthus
atgcaagccgcttcccctccgcaccgcgactaccagacgctccgggtccgcttcgaggcgcagacctgttttctccagctccaccggccggatgcggacaacaccatcagccgcacgctgattgacgagtgccagcaggtgctcacgttatgtgaggagcacgccaccacggtggtgctcgaaggcctgccacacgtgttctgcatgggcgcggattttcgagccatccacgaccgggtcgacgacggccgccgggagcaaggcaacgcggagcagctgtaccggctgtggctgcaactggcgacaggcccctacgtgacggtcgcccatgtgcagggcaaggccaacgcgggcggcctgggcttcgtcgccgcgtgcgacatcgtgctggcaaaggcggaggtccagttcagtctctccgagctgctgttcgggctgttccccgcctgcgtgatgccgttcctcgcccggcgaatcggcatccagcgggcgcactacctgacgctgatgacgcggcccatcgacgcggcccaggcgctgagctgggggttggcggacgcggtggacgccgatagcgagaagctgttgcggctccacttgcgcaggctgcggtgcctgtcgaagccagcggtgacccagtacaagaagtacgcctccgagctgggcggccagctgctcgcggccatgccccgggccatctccgccaatgaggcgatgttctccgaccgcgccacgctggaagccatccatcgctacgtggagacaggccgactcccatgggaatcatga

SEQ ID NO: 5652 - DNA, 663 bp, Myxococcus xanthus
atggacgtctcctactgggaatgccagggcctgcgggccatgggcgcgatgggcaccgaccggttcgcgcgggagccggagcgtgcctgccggcccttcgaccgggagagtgatggcttcatctttggagaggcgtgcggcgccgtggtggttgagtctgcggagcacgctcggcgacgcggggtgactcctcgcggcatcctgtcgggctgggccatgcagttggacgcgagccgcggcccgttgtcgtccatcgaaggggagtcgcaggtgattggggctgcgctgcggcacgcggacctcgcgccggagcgggtggactacgtgaatcctcacggcagcggttcgcgtcagggggatgccatcgagctgggggccttgaaggcgtgcggcctgacgcacgcccgggtcaacaccacgaagtccatcaccgggcatggcctgtcctcggcgggtgccgtggggctcatcgccacgctggtccagttggagcagggccggctgcacccgtccttgaacctggtggacccgattgattcatcgttccgctgggtgggggccaccgcggaggcccagtccctccagaacgcgctggtgctcgcctacggcttcggcggcatcaacaccgctgtcgccgtgcgccggagcgccacggagagctga

SEQ ID NO: 5653 - DNA, 141 bp, Myxococcus xanthus
atggccatggccctggcgaagtcggacgccgcgcgtgctcgcgttcacaccgcgaaggccctgtcggactcggatcccgacgtgaagctgcaggcccaggctctggacgacgtgctcgcggagcaccagcgcgtgtcctga

SEQ ID NO: 5654 - DNA, 351 bp, Myxococcus xanthus
atggagcggccgggccgtcagcatcaggccaacgggcagacgacggcccacctgggggcggaaatcgcctcgctggccgtgcccgaaggcgtcaccccacaactgtggcgctcggccacgttttcggggcaggccgcactggtgaccgtccacgaggcctggaacgcggtgcgcctccaggccgtccccggacaccggattggattggtggtggggggcaccaacgtgcagcagcgcgacctggtgctgatgcaagacgcctatcgcgagcgggtgccctttctgcgggcggcctacgggtcgaccttcatggacaccgacctcgtgggcctctggcacgcagcactttga

SEQ ID NO: 5655 - DNA, 1890 bp, Myxococcus xanthus
atggccaaggagctgtttgacacccagacggggttcaagcggcagctgctggagctggacgagcaattcaagcagcggctggggcactcgattctcgagcgaatctatgacgcgcgcgccgcgcggttggatccgctcgacgatgtcctggtgtcctttcccgccatcttcatgattgagcatgcgctggcgcggctgctcatcgaccggggtatccagccggacgctgtcgtgggcgccagcatgggcgaggtggcggcggcggcgattgcgggcgcaatctcagtggacgcggccgtggccctggtggcggcgcaggcccagctctttgcccgtacggcgccgcggggcggcatgctcgcggtgcttcacgaactggaagcctgccggggcttcacgtccgtcgcgcgggatggcgaggttgcagccatcaactacccgtcgaacttcgtccttgcggcggatgaggcgggcctgggacggattcagcaggaactctcccaacgctcggtggcgttccaccggttgccggtgcgctacccctttcattcctcgcacctggacccgctgagggaggagtaccgaagccgcgtccgcgcggattcgctgacgtggccgcgaatccccatgtactcgtgcaccaccgcgaaccgggtgcacgacctgcgcagcgaccacttctggaacgtggtccgcgcgcccatccagctgtacgacaccgtcctgcaactggaggggcagggcggctgcgacttcatcgacgtcggccccgccgcgtccttcgcgaccatcatcaagcgcatcctcgcgcgggactccacgtcacggctcttcccgttgctcagccccttctcccgcatcgaccgggagctcgatggggtgacgcggagctgcgcgatgacggaggcgcccgcacccagggcgcctgcgcaggtgccgccgccgccgagctcgccctgggcgctgcacacccgaggagcggcgagcgcgccggtgaatgcccgcaaggccgcgctcttcccggggcagggctcgcaggagcgcggcatgggggccgcgctcttcgacgagttcccggacctgacggacatcgccgacgccatcctggggtattccatcaagcgtctctgtttggaggacccaggcaaggagctggcgcagacgcagttcacccagccggcgttgtacgtggtgaacgcgctcagctacctgaagcggctgcgtgaaggagcggagcagccggccttcgtcgcgggccacagcctgggcgagtacaacgcgctgctggtcgcgggggccttcgacttcgagacgggactgcggctggtgaagcggcggggcgaactcatgagcggcgcgtccggagggaccatggccgcggtggtgggctgtgatgccgtggccgtggaacaggtccttcgagaccgtcagctgaccagtctggatatcgccaacatcaactcgcccgaccagattgtggtctccggaccggcgcaggacatcgagcgggcacggcagtgtttcgtggaccgtggcgcgcggtacgttccgctcaacgtgcgagcgccgtttcactcgcgctacatgcagccggccgccagcgagttcgagcgcttcctgtctcagttccagtacgcgccgctccggtgcgtggtcatctccaacgtcacgggccgaccttacgctcatgacaacgtggtgcaggggctggctctgcaactgcgcagcccggtgcagtggacggccaccgtccgctacctcctggaacagggcgtggaggacttcgaggagctgggccccggccgcgtgctgacccgcctcatcaccgcgaacaagcggggcgcccccgcaccggccaccgccgcgcccgcgaagtgggcgaatgcctga

SEQ ID NO: 5656 - DNA, 1428 bp, Myxococcus xanthus
atggggacctcagagccagttgagccggaccacgccttgtcaaaaccaccgcctgtcgcgcccgtcggcgcccaggcactgcctcgcggtccggcaatgcccggcatcgcgcagttgatgatgttgttcctgcggcccacggagttcctggaccgctgcgccgcccggtacggtgacaccttcaccctcaagattccggggacgccgccgttcatccagaccagcgatcccgccttgatcgaggtcatcttcaagggtgacccggacctcttcctcggagggaaggcgaacaacgggttgaagccggtggtgggtgagaactcgctgctggtgttggacgggaagcggcaccggcgtgatcgcaagctcatcatgcccaccttcgtgggtgaacggatgcatgcgtatggctcggtcatccgggacatcgtcaatgcggcgcttgaccggtggcccgtcgggaagccgttcgcggtccatgaagagacgcagcagatcatgctggaggtgattctccgggtgattttcggcctggaggacgcccggaccattgcccagttccggcaccacgtgcaccaggtgctcaagctggccctgttcctgttcccgaacggggagggcaagcccgccgccgagggcttcgcgcgggccgtgggcaaggcgtttccctccctggacgtgttcgcgtcgctgaaggcgattgacgacatcatctaccaggagattcaggaccgccggagccaggacatcagcgggcggcaggacgtgctctcgctgatgatgcagtcgcactacgacgacggctccgtgatgacgccccaggagctgcgcgacgagctgatgacgctgctgatggcgggccacgagacgagcgcgaccatcgccgcgtggtgcgtctaccacctctgccgtcacccggatgcgatgggcaagctgcgtgaggagatcgcggcccacacggtggacggcgtgctgccgctggcgaagatcaacgagctgaagttcctggatgccgtggtcaaggagacgatgcgcatcacgcccgtcttcagcctggtggctcgcgtgctcaaggagccacagaccattggcggaacgacgtacccggcgaacgtggtgctgtcgcccaacatctacggcacgcaccatcgcgcggacctgtggggagacccgaaggtctttcggccagagcgtttcctggaggagcgggtgaatccgttccactacttccccttcggagggggcatccggaagtgcatcgggacgagcttcgcctactacgagatgaagatcttcgtctcggagacggtgcgccgcatgcgcttcgataccaggcccggctaccacgcgaaggtggtgcgccggagcaacacgctggcgccgtctcagggcgtgcccatcatcgtcgagtcgcggctgccgagctga

SEQ ID NO: 5657 - DNA, 516 bp, Myxococcus xanthus
atgaacactccttccttgacgaactggcctgcccgcctgggctatctccttgccgttggcggcgcatggttcgcggccgatcaagtcaccaaacagatggcgcgcgacggggcgaaaaggcccgtcgcggtcttcgatagctggtggcacttccactacgtggagaaccgagcgggtgcgttcggtctgttctccagcttcggcgaagagtggcgcatgcctttcttctacgtcgtgggcgccatctgcatcgtgttgctgattggctactacttctacacgccgccgacgatgaagctccagcgctggtcgctggcgacgatgattggcggcgcgttgggcaactacgtggaccgggtgcgcctgcgctacgtggtggatttcgtgtcatggcacgtgggggaccgcttctattggccctccttcaacatcgcggacacagcggtagtcgtaggggccgccctgatgatcctggagtcgttccgcgagccgcgtcagcagttgtctcccggatag

SEQ ID NO: 5658 - DNA, 1125 bp, Myxococcus xanthus
atgatgcaggagcgcggcgtcgcgctgccgttcgaggaccccgtcaccaacgcggtcaatgcggcgcggcccatcctggacgcgatgtcgcccgaggcccgggagcgcatcgagctcctggtcacctcgagcgagtccggcgtggacttcagcaagtccatctcctcgtatgcgcacgagcacctggggctgagccgccactgccggttcctggaggtgaagcaggcgtgttacgccgccaccggagcgctccagctagcgctgggctacatcgcgtcgggcgtgtcaccgggggccaaggccctggtgattgccacggacgtgacgctggtggacgagagcggtctgtactccgagccggcgatgggcaccggcggcgtcgccgtgctgctgggcgacgagccgcgcgtgatgaagatggacctgggagcgttcggcaactacagctacgacgtcttcgacaccgcgcggccctcgccggagattgatatcggcgacgtggaccggtcgctcttcacgtacctggactgcctcaagcacagcttcgccgcgtatggccgccgggtggacggtgtcgacttcgtgtcgacgttcgactacctggcgatgcacacgccgttcgccggactggtgaaggccgggcaccgcaagatgatgcgcgagctcaccccgtgcgacgtggacgaaatcgaagcggacttcggccggcgcgtgaagccgtcactgcagtacccgagtctggtcgggaacctgtgctccggctccgtgtacctgagcctgtgcagcatcatcgacaccatcaagcccgagcggtccgctcgggtgggaatgttctcctatgggtcgggttgctcgtcggagttcttcagcggcgtcatcggcccggagtccgtgtccgcgctagctgggttggacatcggtggccacctccgggggcgccgccagctcacgttcgaccaatatgtcgaattgctgaaagagaaccttcgctgtctggttccaacgaagaaccgggacgtggacgtggagcgctacctcccgctggtgacgcggacggcgagccgcccgcgcatgctcgccttgcgaagggtcgtggactatcatcgtcagtacgagtgggtgtag

SEQ ID NO: 5659 - DNA, 252 bp, Myxococcus xanthus
atgacagacgaacaaatccgcggagtcgtgcaccagtccatcgtgcgcgtcctgccccgcgtgcgctccaacgagattgcgggccacttgaacctccgcgagctgggcgcggactccgtggaccgggtcgagattctcacgtccatcctggacagcctgcggctgcagaagacgccactggcgaagttcgccgacatccgcaacatcgacgcgctggtggcgttcctggccggtgaggtcgcgggtggctga

SEQ ID NO: 5660 - DNA, 900 bp, Myxococcus xanthus
atgtgcggccagacgtccttgttcgccgggcagattggcgactgggcatgggacaccgtcagccgcctgtgtggcacggacgtgctgaccgcgaccaacgcctcaggcgcgcccacctacctggccttctattacttccgcatccggggcacgcccgcgctgcatcccggcgcgctgcgcttcggcgacacgctggacgtcacgtcgaaggcgtacaacttcggcagcgaatccgtcctgacggtgcaccgcatctgcaagacggcggagggcggcgctccggaggcggatgccttcggccatgaagagctgtacgagcagccccagccaggccgcatctacgcggagaccttcaaccggtggatcacgcgctcggacggcaagtcgaacgagagcctgatcaagtcctcgcccgtggggttccagtacgcacacctgccgctcttgccggacgaatactcgccgcggcgggcctatggggacgcgcgggcgcggggcacctttcacgatgtggactccgcggagtaccggctgaccgtggaccgcttcccgctgcgctacgcggtggacgtcatccgggacgtcaatggggtggggctcatctacttcgcgtcgtatttctcgatggtggactgggccatctggcagctggcgaggcaccagggacgcagcgagcaggccttcctgtcgcgcgtggtgctggaccagcaactgtgcttcctcggcaacgcggcgctggacaccaccttcgacatcgacgtgcagcactgggagcgggtgggcggcggggaagagctgttcaacgtgaagatgcgcgagggcgcgcagggccgggacatcgccgtggcgacggtcaaggtgcgcttcgacgccgcttcggaaggaggccgccgtgggtga

SEQ ID NO: 5661 - DNA, 1239 bp, Myxococcus xanthus
atgaatgcctactgtggcatcgccaggttggatgtgttgcagctggcgacccaccgtggcctggacacctcccgcttcgcgaacctgctcatggaggagaagaccgtcccgctcccctatgaggaccctgtcacctacggcgtgaatgccgcccggcccatcctggaccagttgaccgcggcggaacgggacagcatcgagctgctggtggcttgcacggagtcctcgttcgacttcggcaaggccatgagcacctacctgcaccagcacctggggctgagccgcaactgccggctcatcgagctcaagagcgcctgctactccggggtcgccgggctgcagatggccgtcaacttcatcctgtccggcgtgtcgccgggggccaaggccctggtggtggcctccgacctgtcgcgcttctccatcgccgaagggggagatgcctccacggaggactggtccttcgcggagccgagctcgggtgcgggcgcggtggccatgctggtgagcgacacgccccgggtgttccgcgtcgacgtgggggcgaacggctactacggctacgaggtgatggatacctgccgcccggtggcggacagcgaagcgggagacgcggacctgtcgctcctctcgtacctggactgctgtgagaacgccttccgggagtacacccgccgcgtccccgcggcgaactacgcggagagcttcggctacctcgccttccacacgccgtttggcggcatggtgaagggcgcccaccgcacgatgatgcgcaagttctccggcaagaaccgcggggacatcgaagcggacttccagcggcgagtggcccccgggctgacctactgccagcgcgtggggaacatcatgggcgcgacgatggcgctctcgctcctcgggaccatcgaccacggcgacttcgccaccgcgaagcggattggctgcttctcgtatggctcggggtgcagctcggagttcttcagcggcgtggtgacggaggaagggcagcagcggcagcgcgccctggggctgggagaagcgctggggcgccggcagcagctctccatgccggattacgacgcgctgctgaaggggaacggcctggtgcgcttcgggacccggaacgccgagctggatttcggtgtcgtcggcagcatccggccgggcgggtggggcaggcccttgctcttcttgtcggcgattcgtgacttccatcgcgactaccaatggatttcctag

SEQ ID NO: 5662 - DNA, 240 bp, Myxococcus xanthus
atggacaagagaattattttcgacatcgtcaccagcagtgttcgggaggtggtacccgaactcgaatcacatccgttcgagccggaggatgacctggtcggactgggcgcgaactcgctcgaccgcgccgaaatcgtcaacctcacgctggagaagctggcgctcaacatcccccgggtcgagctgattgacgcgaagaccattggcgggctggtggacgtccttcacgcgaggctgtga

SEQ ID NO: 5663 - DNA, 507 bp, Myxococcus xanthus
atgcctgggccgcggtgtgctgagaacgattgggttgcattgctcgtccgcgtcaatcacgagaaagtggctgccgctcagttggggaaacacggctacgagttcttcctgccgacgtacacgcctcccaagtcctcgggtgtgaaggcgaagcttccgctcttccccgggtaccttttctgtcgttaccagccgctcaatccgtaccgcatcgtccgggcgcccggggtcatccggctgctcggaggtgacgcggggccggaagccgtgcccgcacaggaattggaggccatccgccgggtcgcggattcgggtgtctcttccaatccctgtgactatctgcgggtggggcagcgcgtgcgcatcatcgaagggcccctgacaggtctggaaggaagtctggtgacgagcaagagccaactccggttcattgtctccgtggggctgctacagcgctcggtgtccgtggaggtgagcgccgagcaactggaaccgatcaccgactga

SEQ ID NO: 5664 - DNA, 1053 bp, Myxococcus xanthus
ctcaaacgggtgggcagccccgccgaactgcgcctgacggtggcgcgggccctggagcggcgcgcgctgctcaactggaagaccgaggcgcggcagtcggcgggcgaggtggagctgagctggggtgctcccgccatgcacccggtggtggaagcgctgcggaaggtgtcgcccacgcaggccacggtgctgctggtgggggagagcgggaccggcaaggaggtgaccgcgcgggccctgcaccagtggagtgagcgcgcggacgggcctttcgtggccgttaactgcgcggcgctgacggagacgctcctggagagcgagctcttcggacacgagaagggcgcgttcaccggcgcggtggcccagcggcgcggccgcatcgagctggcgcagggaggcaccttcttcttggacgaggtcggcgagctgaaggccgagctccaggccaagctgctgcgcgtcctccaagaacgccgcttcgaacgcgtgggcggtacgcggaccctggaagccgacgtgcgctgggtggcggccaccaaccgcgatctcaaggcgatgatggcgcgcggtgagttccgcgaggacctctaccaccggctggccgtgttccccatccggctgccgtccctgcgcgagcggcgcgaggacctgcggccgttgtcggagctgctgctgcgccgcatcggagacgagctgggtcgtccaggcttgcgcgtgtcaccggaggccgtggcgcggctggaggcgttcacctggccgggcaacgtccgcgagctgcgcaatgcgctcgagcgggccgccatcctcgcggatgggccggtggtggagcctcggcacctgtggctggatccaacgggcgcggcggggcccgtggtggatgcgcccgtctcggaggggggccggcttcccagcctgacgctggaggagctggagcgacgggccattgagcaggccatcgcggacgaggcggggaaccgcaagcgtgccgcgcagcggctggggattggtttgcggacgctgtacgacaagctgcggcgctacgagtcgccctga

SEQ ID NO: 5665 - DNA, 387 bp, Myxococcus xanthus
atgcacgacgtgttcgtgcagttgcttcgttaccagggcgcgctgaaggacgcggcgccgtcgagcctgttgcaccggattgccaccacggtgtgcctcaacaggctgcgcggcgcgaagcggcgtccggaggaccgggaggacgaactggtgctgcagattgcctccgccgacgacaccgagtcccgcaccgccgcgcgcggcctgttggaccgcctcttcggccgggtgcccgcgtccagtcaggacatcgcggtgctgcacctggtggatgggatgacgctggaggagacggcccgcgaagtggggctgtccgtgtccggcgtgcgcaagcgcctgcgggcgctgacggcagtgctgcaagagctggagctggaggccgcatga

SEQ ID NO: 5666 - DNA, 228 bp, Myxococcus xanthus
atggccctggtgccgtcgggaacgcaggtgttgccgcgcgcctacgaactggacgatgccccggggttcgagcgcttcgtcttcgtttcgtccgatgcgcccttcgacgtggcggtggtgctggccgccgcggaggcactggctggaaatcccgacgcctcctcggcacctctgtcattgcccgggaacttgacgcaggcctccctcacgctggaaaagcatgagtga

SEQ ID NO: 5667 - DNA, 525 bp, Myxococcus xanthus
atgagcgagcagggggccttcgcccagcagtcgggggacgatgtctcggagtcctcctcgcgagggctgcgccggggctccacccacatggagttctggttgagcgacatccaggtcgccaacatgggggtgaagctgggcggcggaggcgtctacttcacgctgatggcgggcctggagccgggccgcgacgcgcgcttcagcttcgcggcgggcgtgggcgggcacatgacgctgtcccagcggctctgggtggacctggacgtgacgggcggcgccgtccagccggtgcgcaacccgctggagggtgatggtggcaatgtgctggggcaggcccgcttgatgctgggcttccagctcatgccccgcctggccgtgttcgccgggcccacctacaacgcgtggttctcctggggcgagtcggacttcgactccatcacccggctgtccttccgggagacccatccggagccggatcaacgcctccagcactggcccggcatccaggtgggcctccacatctga

SEQ ID NO: 5668 - DNA, 1107 bp, Myxococcus xanthus
atggaattccgcatcgccgccgacgagctgaagaaggccctctaccgcgcccagggcatcgtggagcgcaagacgacgatgcccatcctggcgaacgtgctcgtcaccgcgaacaagggcggcatcaccgtcaccgccttcgacctggacatcggcgtcgtgtccgagcacccggccgaggtcatcaagacgggcgccgtcacgctgagcgccaagtacgtcttcgacatcgtccagaacctcccggacgcgcaggtcacgctgaagaagctggccaacaactacgtggacatctccagcggctcggcccacttcaaaatcgtgggcatggcggccgaggagtaccccaagctgccgaaggaagagaacgcgcccctggtgcaggtggggggcaacacgctgctggagatgatcaagaagacgcagttcgccatctccagcgacgagacgcgctacatcctcaacggcgtcttcttcgagccccagtccaccggcaaggtccgcatggtggcgaccgacggccaccggctggcgctggtggagcgtgagctgccgggcgacttcaagctcaagagcggcgtcatcatcccccgcaagggcctgatggagctcaagcgcctgctggacgaggcgccggacgcggagtgccacctgggcttcgcggagaactcggcgctgttcaagaagccgggcctcaccatggtgatgcgcctcatcgacggccagttcccggagtaccagcgcgtcatccccaaggaaggggagaagatcgtcctggtgcccaaggtgcgcctgctggagagcctcaagcgcatcgccctgctgtcggcggacaagagcaacgcggtccgcatcggcctggaggagaaccagctcatcatcaccgcgagcaacccggacctgggcgaggccaaggacgtgctggagctggcctaccgcggcaacggcatcaccatcggcttcaacgcgcgctacctgatggatgtgctcgccgtgacggagacggacgaggtctccttcgagctgggtgacgagcacagcccgggcgtgctccacgcccccggcgaccggagcttcaccgccgtcgtcatgcccatgcgcgtgtga

SEQ ID NO: 5669 - DNA, 1323 bp, Myxococcus xanthus
atggccacgcacccggacaacctgcgcgcccggctggaggaccgcgcggacctcctggaggccacgcgtcttcgctatcgcgccctgcgcggcatgctggcgtccttcttctggaagcagcgggtgcgctcgcagttcgagctgctgctggaggtggcgcgcacgcagccagaggtggacgccaccctggccgcgctgaagcgccgcgccgccgcggaagggtggcctgcgaacgccgcgcccatgaagctgatgcgggaggtggagcgcctgcgggaggacgtgcggcgcgtggccttcaagcggctgcccgcggagggccggcccgcgacgctgggcgaggcgctgctgaagttggaagagacggtgctggaggcggggccgctcctggggcggcacatctgggcacgggcggtggagctgttgccgcgcaacctgccggagctgcgcgccgcgtgcgccgccgcggaggtgttcgagcacgtcttcaagcggcccgcgccggaaggggtgctgcccttcacggtggaggaggcggaggcgcttcagcgggccttgccgctggcggagacggcgctggcggcgctgtggcagcggctggagcacttcgatacgcgggggcaggtgaagggcttcctgcaggcccgcgtctctcgcgcgccgcagcgggtgcctcgcagcgggccggagctgctgctgcacgtggccttctggcgaggcgtggcttgggcgcggctgcgcgcttcgttgggggagcggctggccccggtggtgcccgcggatgccgaggtgccggcgctgttggtgtggctggcggcgcgcgaggggcgtttcgagcggggcgcggagcctcggatgggcgggccggggctgttcgcgcccgaggcgcctggcccgcagccgcggacggacggggctgtagggctgcgcggtgtgggcgtggaggtggccggggaggtgcggcttccggcctgcgaggcttttggcgaagggcgcgccgggctctttgaactggccgcgcagttggcggcgctgtctcgagagcgtcccgtgggcacgtgggatgaggagaccgcgtgggctcggctgtggaacgcggcgcagcgggctcgaggcgagcagggcgaggacgtggagcggctgcgggacgcgctgcggctgttcatcctccttcgcggccagggacagacacccgcgcgcctgttctctcccgagcgggcgcgggttcccacggtggaaatcggggccgacgcgggggcggccgtgaaggaccttcccgcgctggtgcatgcggcccgcgcggcggcgtggcgcgggcgctag

SEQ ID NO: 5670 - DNA, 294 bp, Myxococcus xanthus
atggagacggacgtcaacccggcgagccgggcgtcggagcatgagtacctggacgtgcccccggtggtgcgggcggagcacgccgaggcgtcactgacgcgcttgattgaacagcagacggcgaaggtgccctcgcacgtgttcctggtggcgagcctcgcctcgatgggcgcttccttcgtcttggaggtgacgggccgctcgcacctcagccgcttcattggtcagtgggtgtcgcccctgctggtgatgggcgtctacaacaagctggtgaagattttcggaccgcggtga

SEQ ID NO: 5671 - DNA, 1524 bp, Myxococcus xanthus
atgacggcggagctggcggcccgtgaggcggcgcaggtggagcggcgcaacctgctccaggtcttcacgcaggcgccggtggccctcagcgtgctgcgcggctacgagctgcgctacgagttcgccaacccgctgctccagaagctcatgggcggacgcgagctgaacgggcgcacccaggaggaggccattccggatttgtcgccggagctgctgagcctccaccggggcgtgctggagacgggcgagcgcgccatcgcgcgggagtaccccatcaccatcgactacgagggcgccggccgcgtcgagacccggttctggaacatcatcttcgagcccctgcgcgacgagcgcggcctcgtggacggcctggtgacgttggccttcgacgtcaccgagcaggtgttcgcgcgccaggccgtggagagccagcagaagtggctggaggccgtgctcgacctgatgcccatgccggtggtgatggcggacccggccagtggcgacctcaacttctccaacgccgcggcggaccggctctacggcctgcacatccccaaggacgtgcccaccaccgcgtatggcgagcacttccacgtcacggacctggagggccgccggctgagcgtggatgacctcccctccaaccgcgcggcccggggcgagcggctggacgggctggaggtccactggcacacgcccgcgggccggtacgccctcagcatctcgtcggagacgctgcccgccatgcatggccatccgtccgtggtggtgattcccttcctggacatcacccgcctgaagacggtggagcagcacctccaggaggccgtgcgtgcccgtgacgagttcctgtccgtggccagccacgagctgaagacgccgctgacgtcactggggctgcggctccagtccttcgtgcgcgccatccacgcggacccggagtccgcgttggcccagcgtcacgggcgcgaggtggaggccatgcgccggcaggtgacgcgtctggccgagctcgtggacgggctgctcgacgtgtcgcgcatcagcaccggccggttgaagctccagttcgagccggtggacctgccctcgctcgtgagcgaggtggccgcgcgtttcgagctggaggccgcgcgcgccggctgcgagctgcacgtcacgcaggcggaagggttcgaaggggtgtgggaccggctgcggctggagcaggtggtctccaacctgctgtccaacgcgctcaagtacggcgcgggcgcacccgtgcacatcgacgtggcgccggggggcatgggcgcccggctgcgggtgaaggaccggggcattggcatcgacccggaagcccacgcgcgcatcttccagaagttcgagcgcgccgtgtccgagcggaactacggcggcatgggcctggggctctacgtgacgcgcacgctggtggaggccctgggcggcaccatccaggtggacagccagcccggcgagggcgccaccttcgtggtggagctgccgctccagcccgcgagatag

SEQ ID NO: 5672 - DNA, 1143 bp, Myxococcus xanthus
gtgcgcctcctcgcgcttcacgtccacgacttccggaacctcccccaggtccagctcacgcccagcgcccacgccaccatcgcggtggggcagaacgggcagggcaagacgaacctgctggaggccctctacttcctggccacgctcaagccgctgcgcgcggggcgtctgtcggagctggtgcgctggggttcgcagggcgcgcgggtgacggggcgcttcctgctcaagggcgccgagcgtgaaatcgccgtggaggtgggcggcggcacgcggcaggccttcgtggatgggaagaaggcctccagcctggaggactacttcggcggcgtgtccgtggtggccttcacgccggatgacctggaggtggtgaagggcggtccggactcacgacgcggcttcctggaccgggcggtgttcaaccgcttccccgccttcctgcgcgagagccgcgagtacgcgcgggccttgaagaaccgcaaccgcctgctgcgcgaagggcacaccgtggacgcggtgtatctggaggcctacgacgagacgctggcgaaagctggcgcgcgcatctattcgcggcggcgcgcgttgatggcggagctggcgcccagggcgcaggcgaccttcgcctccattggccgcacggtggacccagccgtgtacaactaccgccccgcgcatctggagggcgacttcgccgccgcggacgaaacggcgctggcggccatgctgcgggagagcctctccgcgcgcctgcggcgggacatggagcggggcttcacctcggtggggccgcactcggacgacgtctcggtgacgctggggggccgcagcgcgcgggcctacgcgagccagggacagcagcgggcgctggtgctcggctggaagatcgccgaaatcgaaaacctggaggccgcgatgggcttcctgccgctgctgctgctggacgacgtgtcgagcgagctggacccagagcgcaacgcctacctcatgggctacctggcccagagcggcgcgcaggtggtgctcaccaccacggacggctcgctggtgcggggcgcggcggcggacgacacgctctggctcgacgtgcacggcgggcaggtggcggtgcgcgcggacgccgagccgcctcccgccaactga

SEQ ID NO: 5673 - DNA, 504 bp, Myxococcus xanthus
atgccgcggatgacgttgctgtgcctgctggtggtcatgcccctggcgggctgtcacaggacgacgttcgaggattccgtcctcaccaagcccgccgtgcgctaccgcattggcaagctccccgcgtattgggagcaggtgcggctggaggacaacgacctcgccttcgccgaggagggcaccggtcgcgcgctctccgtcaacgccacgtgccagggacatgatgacccgtcgctccaggtgctcacccggcacctgttggcgggcttcacggaccggcaggaaatcgctgaacagcgcatccccatggatgggcgcgaggccctgcgcagccgccacctggcgaagatggacggcgtgcccgtgcaactggagctggtggtgctgaagaaggacaactgcgtgttcgacttcacctacgtgtcgccgccggggctcgcggacgggcgcatggcggacttcgacgcgctgctggccggcttcgaatcggagcgcaagggatga

SEQ ID NO: 5674 - DNA, 753 bp, Myxococcus xanthus
atggaccgcgcgaaggagcgcctggagtcactgggcgccctgtcgcggatgacggggcaggtgttcagtcgcgcggtgcgtccgccctttgactggcgcgggctcgtgtaccacacggagtcgctgggcgtgcgctcgctgcccatcgccctgctcaccgcgatgttcgcggggctcgtcatctcgttgcagttcggctacttcctgtcgcgcttcggcgtgcagtacaccgtgggccgcgtggtcatcctcacgctgttccgcgagctggcgccggtgctcaccgcgctcaccgtgggcgcgcgcatcggcagtggcatcgccgcggagctgggcgcgatgacggtgacggagcaggtggacgccatccgcgcgctgggcgccgacccgctgcgcaagttggtggtgccccgcgtgctggcgtgcctgattgtgttgccggtgctcaccgtgttcgcggacgtcgtgggcctggtggcgggcgcgctggtggtgaacatccagtacgcgattacgctcaacctcttcttccagggcgcgctggacgcggtgctgatgccggacttcgcctcgggtgtgttcaagggcgcggtgttcggactcatcatcggcctggtgggctgcttccgcggcctcaccgtggagggcggcacggagggcgtgggccgcgccaccacccagacggtggcgaccacgtccgtctccgtgtgcctggcggacttcttcatcacccagctcacgctgagcctgtga

SEQ ID NO: 5675 - DNA, 1362 bp, Myxococcus xanthus
tccgtcctgtctcatgggcctggcgggaggtggcccagacacacgcacgcgctgcggccggagggatggttgggcacagtcctcaagggtggttacgtcgtcgaactggagccagcgctggtcgagcgcgtggacttgcgcatcgaaggagagcgaatcgtcgcccgtgggccggacctgacgccgggcccggatgacgaagtcgtggcgctgtcgggcaagctcgtcttcccggggctggtgagcgcgcaccaccgcctgtacgcggtgctgggccgtggcatgccgcgcccgccgctggagacctaccaggaaatcctcgagcaggtggcctggccgtacgagaacgcgctcgacctggacgccgtgcaggtggcgggctgtgccggagggctggaggcacttcagtgcggcaccaccaccgtgtgcgatttgcactcctcgcccaaggcgatttcgggctcgctggtgcggctggcgcgcgggctccatgaggtgggcgtgcgcggcgtgctcgcctacgcggtgtcggatcgccagggggcgctcgggcgcgaggaggggctggaggagacggtcagcttcgcgaagaaggcgaaggggcgcttccggggacaggtgggcgcggcgccgtgcttcacgatcgggccggatgcgctgtcaggcctggcggaggcgctgaaggcgctgggtgatggcggcctgcacctgccgctggcggaggacccgctcgatgagcgcctgtccaacgagaactacggtgcctcgccggtttcgcggttgctggaggcgggcctgctgtcgcccaagagccaactggcgcacgtgggccacctggactgggcggacctggcgcaggtgattgccaccggtgcgtggctggtgcacacgccgcgcgccaaccaggggctggaggtggggtacgcgccggcactgaagttcggggcccgggccacgctgggcgcggatggcgtgtcggcggacctgttcgcggaggcgcaggcggcgtacctgcgctcacgtgaggcggggcagcccatcgatgtgctgcgctacctggccaacgggcaccgcatggcgtcgcagattttcgacgcatcggtggggcccatgcgcgagggctcgctcgccgacctgctcatcctggactacctgccggccacgccgctgacggcggagaacctggcctggcacgtggtgttcggcctgggcagccggcacgtggaggcggtgatggtggatggcgtgtggcgcatgtgggcgcgccggccgctgtcggtgagcccctccgtggtggcggagcaggcgcgcgaggccgcgtcggcggtgtgggcgcggatggcggaggcggcgaagaagtag

SEQ ID NO: 5676 - DNA, 819 bp, Myxococcus xanthus
atgcgctcctcgtcccagacgacttccgagttcgcgttccagccgccccggccgggtgagcagctcatctatttcgagcacctgacgaaggcgttcggcgccaagcgcgtctatgacgacatggacctggacgtgcgcgccggtgagacgctggtggtgatgggcggctcgggcacgggcaagagcgtgctgctcaagtgcctcatcggattgctgtcgccagacaccggacgcatcctcttccaggggcacgacctggcgcgcttcacggaggagcagttcatgccggtgcgccggcacgtggccatggtgttccagggcgcggcgctcttcgactcgctgaacgtcggggagaacgtggcgtacccgttgcgcgagcacttcccggatatgccggcggacgaggtccgtgcccgcgtggcggagaagctggcgctggtggacctgcccaacacggagcggctgatgccctccggcttgtcgggcggcatgcgcaagcgcgtggggttggcgcgggccatcgccacggagccggaggtcatcctctgggatgagcccaccacgggcctggaccccgtcaccacgcagtccatcaacgtgttgatcaactcgatgaagacccggctcggttgcacttccatcgtcgtgacccacgacatggtgagcgcgttcaccgtgggagaccgcatcgccatgctggccaatcggagaatcgtgcaggtgggcactccgcgggagatgctccactccaccgtcccggaggtgcgtgccttcctcgacgcgcgccgcgtggaactgttccccggaggcgcgccatga

SEQ ID NO: 5677 - DNA, 1209 bp, Myxococcus xanthus
atgagcctgttctctcccgctggaaccgagcgccgcctggcgctgcgcacgggtctgttcgtcgccgtcggactggcggtcgccagcgtggtggtgatggtcatcggccagcagtcgcgcctgttcgagcgcaagacgatgtatcgcgcctacttcgccaacgtgcagggcctcaatgatgagtcgcccgtctggctcggcggtctcaacgtggggcgggtgacgggcatcgtcttctcgcccgacccgaatgacccgcggctggaggtccagttccaggtgtcgtcgcgctacacggaccgcgtgcgtcaggactcggtggcgcagttgtccagcatgggcgtgctgggcgacaaggcggtggacatctccctgggcagccccacgtcaccgccagtggaggcgggtggggtgctcaagtcgtccacgggcggtgacttgtcctcgctgctgagcggggcgtcgcaggtgatggagaactcggtggccatcagcaagtcgctgcgggcggcggtggagacgtacgccaacccggagatggccaacgacgtgacgcgcggcgtggcggcgctgcgggcgctgctggaagaggtggcgaagggcgagggcgtgctgcacgcgctcatctacgacaagcaggccgggcgcgaggtgcgggggctgctggccaacgcgtccagcgcggcggcgcgggtggatggcgcggtgggcgagctggaagggattctgcgcgaggtgcgcacgggagacggcacggcccacgcgctcgtctacggccaggacggcgccaaggcgctgacggagctgggggcggcggccgggcagctggcggggctcatcgaggatgcgaagaagagtcccaacggggcggtgcaccagctggtgtacggcgacgcgagcggcatgttcgcggacctgggcagcgcggcggcggacctgaagaagattacggcgaccgtggcgaagggagacggcaccgtgggcgggctcatcagcgacccgacggtgtacgaggacctgcgtgaggtgattggcaacgtgaagcgcaaccgcatcctccgcgcgctggtgcgcttctccctgagcaaccggcaggatttggagcaggtgggcaaggtgaagggcgtggagccacgctccgaagcgcccgacgcggctccggcggagacggcgccctcggcgcctggggagtctgcggcccaaccctag

SEQ ID NO: 5678 - DNA, 891 bp, Myxococcus xanthus
atgttcatgctgggcaccgcgctgcacctgtcccgccagcgcgcgctgctgctcgccgccgtcttcgtcttctgcacgccgctgctctccaccgccagccgcgccctgtggcagcacggcccttcgctgctgttcctgaccctggtgctcctctgcctcgtccgcgcgcgcgaggctccgcgtcacgtggcctgggcgggcattcccctggcgctcgcctacgtcatgcggcccaccaacagcctctccgtgctggtgctgtcgctctacgtgctgtggacctggccgcgtcaggcctggaagttcttcgcgggcgcgctcgcagtggccatcccgtgggtggcggtgaacctcatccactacggctccgtgctggcgccttattacgaaccgcagcgcctggagctgtccgcctctcgcgtggccgaggcccttgccggaaacctcgtgtcccccgcgcgggggctgctcgtgttcacccccgtgctcctgatgagtgcctggggcctgtggatggacctgcgcgcccggaccttcacccggctgcatgcggtgctggtcgcggtggtcgcgctgcactgggccgccatctccaccttcccgcactggtgggcggggcactcgtatggcccgcgcttcttctcggacatggtgccctacctcgtcttcttcctcgtccccgtggtgcgcgcgctccaatggaaaggccccgaggcccggcgcggcttgacggccaccttcgcggtgctggccgtgctgagcctggtcctccatgtccacggcgccagctcgcgcgcggtgtaccggtggaacagcttgccgctcgacgtggatgaacacccggagcggctctgggattggtccgacccgcagttcctcggacggcgctga

SEQ ID NO: 5679 - DNA, 1281 bp, Myxococcus xanthus
ctgcgtgaggaccgcttcctcgacgtactccggcggctcatcgccctgactccgaagctgcagaacaaccctggcgcggggctggtgcccgaggaacggctggccgcgcaggtagtgctggacaccctggcgccgcacatcgagagcggcttcatccaggcggagtccgtggcggggccgggccaggcgtcgcgcccctgtctggtgctgaccgtgccgggggagggagaaggcgccatcggcttcgtcggcgcgcacttcgacgtggtccccgcggaccagaagacggagggctgggagcgcagccccttcgagctgtgggagggccccggcggcgtgctctacgggcgcggcgtcaccgactgtctggggcacgtcgccgtgctcaccgacctgctggcccagctggccgagcgcaaggtgcgccccagccgcacgctgaaggtggtgctcatctccaacgaggagtcctcggagctgccgggcctgggcctcaactacgtggccgagcagggcatgctcaagccgctcgatggccagccggtgtactggctggacagtgccaacttcggccccacgctgggcacggcgggcgtgtcgctgtgggagctgaaggtgacgggcgtggggggccactccggcatgccgcagaactgcgtcaacgcgctggagttgggcatggccgcgtcgttggagctggcgcgcttcttccacgagcgcttcccgcccacggaggacgagaagcgctggggcttcctctcgtcctccagtctcaaggccaccgtggtggaggcgcccaacaccaaggagacgaaggtgcccgccgacgtcgtcctgcgcggcgacatccgcctcacgcccttctacgacctggcggaggtgcagaagactgtgacggacttcatggcggagctcgacgcccgactggagcgcgacgatgcccccgcgcacttcccgcgcacgcgcacggcgggcggcaagcgcggtgagctggcgttccgcttccagggggaggggaccgagggcatcgcctgccggctggactcggagggcctgcgcgcactgaaggaggccatgcaggtggtgcgcggtgtgtcggccacgcccttctcgctcaccggctcgctgccgctcgtgagggacctgcaacgacagggctgcgacgtgcagattacgggcttcggggacatgcagtactaccacgcccccaatgagcaggcccggctggaggacttccggcagggcttcgcgattctccgcgaactgctcgtccgcctctga

SEQ ID NO: 5680 - DNA, 1152 bp, Myxococcus xanthus
ttgctgatgattccagggccggtggagttcgagcccgaggtgctccaggcgctgggcgctcccaccctcggccacaccgaccccgctttcattgccgtcttcggccgggccctgaagcggcttcgggaggtgtgcctggcgccctccgcgcagcccttcgtggtgtccggctccggcacgctggccatggagttggcggtggccaacctggtggagcccggggacgcggccctggtggtgaacaccggctatttcagcgaccggatggcgaagattctcgagcgccacggcgcccgggtgacgcacgtgcgcgctccgccgggggacgtgccctccctggacgaggtggagacgcacctgtcgaagggtggcttcaaggtgctgtccgtcacccatgtggacacgtccacgggggtgctcgcacccgcggaggcgctggtgcgggccgcgcgcaagcacggcgtgctgtcggtggtggatggtgtgtgcgccaccgcggcggagaccttccgccaggatgcgtgggaggcggacgtgtacctcacggccagccagaaggcggtgggggttcctcccggtctggcgctgctcaccgtgggcccgcgggccatggaggcctggcgcaagcgcaagacgccggtggccagcgtctacgcggacttcgcggagtggctgcccatcatggaggcgtacgaagcgggcaagccggcctacttcgccaccccgcccgtgaacctggtggccgcgctggacgtgagcctgggtcagattctggccgagggcatggacgcccgcttcgcccggcaccagcggatggcgcgggccttccgcgcggcgtggaaggccatggggctgcgcctgttgcccacctccgacgccgtggccgccaacgcgctgagcgccgtgtactacccggacggcgtggacgcggcgctggtgggcggggtgaaggggcagggcgtcgtcgtcgccggcggcctccacccggacctcaagacgcgctacttccgcgtgggccacatgaaccgcgtggggcccgcggacgtcctggccacggtgggagccctggagcgcgcgctcatcgccgccggtcaccgctcggagcccggcgccgccgtggccgccgcccaggcgtcactcatcgtgggctga

SEQ ID NO: 5681 - DNA, 612 bp, Myxococcus xanthus
atgtacgcgggttacgaatcgagcgcgggtggtggcgcggcctgggagctggagttgcggcgtctggcggccaccgacgacgacatggcgcgtgggatgttcttccagggcacgctggacgtcgtgggtttcctgggaggcgaaggcgcggtggcccgctgcaagggggtggccggcatctgggaaatcaacctcctccacatgtaccccatcacccggttcctccggatgtcatccacggcggcgcggctgttggccccgcagttggacggcttcgagggcgtgctgcggcgcatgggaacgcaggccacggtggacttcgtggcgtccgtcttcggacgggagttgatgcaagcggccagcggcaagccgcggctgctattgcagtcgctgggagaggcctacctcgccgcggtgacctacggcgagcgctacccgctgtggacgggggagacgagcgcccgctttatcatgcggcgtgacttcatgcccgccgcctaccacgagggcgtgctgcacggcgtgctggaggcggtgggcgcgcgtgaggtccgggtccacggtcgccaggtggggctgctcgacagcgagtacgagctgtcctggaagtag

SEQ ID NO: 5682 - DNA, 2148 bp, Myxococcus xanthus
atgcacaccaacgcactcgcgctgctgatcttgcagctcatcgtcatcatcggcttgtcgcggctcatcggccgcggcgcgcggtggttgggacagccgttggtcatcgcggaggtggtggccggaatcgtcctggggccctcgctgctgggctggctggcgccggacatcatgaacgggctgttcccggcctcgtcgatgccggtgctgacgatgctcagccaggtgggcctggtgctgttcatgttcctcattggcctggagctggacccccagctactcaagggccgggggcatgcgtcggtggccatcagccactccagcatcgtcgtccccttcgcgctgggcgcgggcgcgggcgcgctgtggctctacaggagcctgtcgtcgccagaggtgccgttctcctcgttcgtgctcttcatgggcgtggcgatgagcatcaccgccttcccggtgctggcgcgcatcctcaccgagcggggcctgctccagtcgaaggtgggcacggtggccattgcctgcgcggcggtggatgacgtcaccgcgtggtgcctgctggccttcgtcgtctccatcgtccgtgcgtccagcctggctcaggcggcgctcaccacggtgatggcgctgggctacatcgccttcatgctgatggtggtgcggcccttcctcgcgcgcctgggcgcgcgggtggccagccgtgagggtctcacccagaacgtggtggcgggcacactggtgctgctgctggcgtccgcgggcgtgacggagctcatcggcatccacgcgctcttcggtgccttcctcttcggcgcggtgattccaaaggaaggccgtctggcggagacgctggcggagcggctggaggacgtggcggtggtgttgctgctgcccgtcttcttcgccttcagcggcctgcgcacgcagattggcctgctaaacaccgcggaggactggctgacgtgcggcgtcatcatcgtgctggcctgcctgggcaagttcggcggcagcgcggtggcggcgaggatgacgggcctgcggtggcgcgaggcgagcgccatcggcatcctgatgaacacgcgtgggttgatggagctcatcgtcctcaacatcggcctggacctgggcgtcatctcaccccagctgttcacgatgatggtgctgatggcgctggtgacgacgttcatcaccacgccgctgctgaagtggatctacccgctggaggagattgcccgcgagcgcgtggtggtgccgctgccggtggagccgggccctccgccctacagcgtgctgatgtgcgtgtcgcacgggcaggcggggccgggcatggccaccctggcgcgctcgttgtcggggcgtgaagagggcgcgcagcttcacgcgctgcatctggtgtccccggagcgcgcgtccctgcgcccggcgcagcagcgggcccccgaggaggacagcgcgctgatgccgctcttgtggcgggccgtaagcctggggctctccgtgcggccgttgtcgttcgtctccgccgagccggcccaggacatctgccgcacggcgaaggcccggcgcgcggacctggtcctgctggggtggcacaagccgctcttcagccagacgatgctgggcggcacggtgcgtgaggtgatgcaggaggccagtggcccggtggcggtgctggtggaccggggcctgtcggacatcaagcgcgtgctggtgcccttcgccggcagccggcatgaccgcgcggccctggccctggcccggcggctgaggcagcaggcggacgccgaggtgacggtgctgcacgtgacgtcggacctcggcggcaacggcggagcccgggcgcaggtggaggcgctgttcccggcgaacgagggcggcgtgacgttgaaggaggtgcgcagcgacgcgccggacgaggccgccctgggtgaggcgcgccacggctatgacctggtgattgtcggcatcggcgcgcagtgggggctggaggacaaggtcttcggcctgcagcgcgagcgcatcatccgggacgcgccgggctcgctgctggtggtgtccgacgcgtctcccgccacggcggcggagtccacctccgaagccgccaacgacggggccactgcagtccgggtgttgcccgcgaggagctga

SEQ ID NO: 5683 - DNA, 819 bp, Myxococcus xanthus
atgcatctgggagccaccctccggctgttgcgcacggatgcgggcctgtcgctgcgggacctggcgcgccgtatcggcgtgtccagcgcgtacctcagccgggtggagaacggcgtggacgcgccccctacgcccgagcgcctgtcggccattgcccgcgagctgcgagtcccgtcctcgctgctgatggacgtggccaaccggatgagcccgtccgtggccgcctacctggaagaggtgccgggcgcgggggccctcttcctggacatcgcccagcggcgcctgtccggattgcaattggcgcgcgtgcgcgacttcctggaggcggagttccctgtggcccaaggacggcgcgacgcgcccgtgccaccgctggcgccgttgctggcgccggagcgggtggtggtgcagttgtcctgcgcgggctgggacgacgtgctggacgtggtggcggagcggctggcctcctcgcagcccggtgcggacgtcgcgcgggtggtgggcggcctgaagcggcaccgggaggagtcctcgtgcgcggtgggcggcggggtggcggtgccacattccttcctgccgggcgcggtgcccaccgcggccctggtgacgttggccacgccgctcgcgggcgacacccccgacggcaagccgcttcgcgtcgtggtggccatcctggacgccgagcggggcaacccccagttggtgcggctggcgcatctggcgcggctggcggcccatgggctggcggaccggttgttggggctcagccagccggcccaggtgctctccagtctggaggagctggaggcactgcgctga

SEQ ID NO: 5684 - DNA, 459 bp, Myxococcus xanthus
atgagcagcccgcgcttctacgccttcgaccctcgcgccacccgcatcgccctcttcgtgggggcctgcgtgctggccgtcctcaccgcctgggccctggcggatgcccgcgccgaaggtggcgtccaggccatggcccgcgccggcgtctccgcggggctgatgttgaccttcctggtgtccttccaccgcctgcggccccgcacgggctggggcgtcacggtggacgcgcggggcgtgcgcgtggcccggcccttcagccagaaggagctggacctgcactgggggcagattgaccacgtgcgccggattggccggaaggggagcgtgctcgccctgttcctcaaggaggaaggccgggtgctcgtcacccggcatctcttcgcccgcaaggctgttttcgacgagttgatttcggcgctggaggaccgcctcccgccgccccgtttcgacgcctga

SEQ ID NO: 5685 - DNA, 2447 bp, Myxococcus xanthus
atggaaaagacccccgctaccggctcggcggttgctccgccgcccgtggagtatgggacggacagcattaccaagctcgagggccgcgaggcggtccggaagcgccccggcatgtacatcggcgacacgatggcctacgggctccacaagctcgtgtacgaggtcgtcgacaacgcggtggacgagtcgctggccgggcactgcaccgacatcgaggtcgtcatccacgtggatggctccctgagcgtgcaggacaacgggcgcggcatccccgtgggcccgcaccccaagttccccggcaaggacaccctggaggtcgtcctcacggagctgcacgccggcagcaagttcggcaacggcgcgtacaaggtctccggcggcctccacggcgtgggcgtcacctgcgtcaacttcctctcggagtggttcaaggtccgcgtccatcgcaacggcattgtctacgagcaggcctacgcgcagggcgtcccggacaccccgccgcgcgaggtgggcaccaccgacaagcgcggcacgcacatcgccttcaaaccagacgccacggtgatggagttggtggagttcaacttcgagacgctcagccagcgtctgcgtgagctggccttcctcaacgcgggcctgcatatcgtcgtccgcgacgagcgcacgaacaaggagcacgacttcaagttcgacggcggcatctcctcgttcgtggagtacctcaacaagtcgaagcagacgctccacgacaagcccatctccttcagcacggagcgcgagggcgtcatgctcgacatcgcgatgcagtggaatgacggctacgacgagcgcatctacaccttcgcgaacaacatcaacacccacgagggtggcagccacctgtccggcttcaaggcggcgctgacgcgcacgctcaacagctacgcggagaagggcagcctctggaaggacctcaaggagacgcccaccggcgaggacgcgcgtgaaggcctgtccgccgtcatctccgtcaagctgaccaacccccagttcgaggggcagacgaagacgaagctgggcaacagcgaggtgaagggcctggtcgagcagatggtgaacgaccagctcggctccttcctggaagagacgcccatggtcgccaagaaggtcgtggcgaagattggcgacgcctgccgggcgcgtctggccgcgcgcaaggcgcgtgagacggtgcgccgcaagggcgtgctggacggcggcgggctccccggaaagctggcggactgtcagagccgcgacccgaacgagagcgagctctacatcgtggagggcgactccgcaggtggctccgcgaagcagggcagagacaggcgcaaccaggccatccttccgctgcgcggcaagattctcaacgtggagaaggcccgcttcgagaagatgctcaccagcgccgaaatcgtgacgctgattacggcattgggcacgggcatcggcgcggaggactacgacccggagaaggcgcgctaccaccgcatcatcctgatgacggacgccgacgtggacggcagccacatccgtacgctgctgctcaccttcttcttccggcagatgccggagctcttgcagaagggctatctctacatcgcgcagccgccgctctacaaagtcacgcgcaacaagaaggaccagtacgtcaaggacgagcacgcgctgaacgagtacctgctcaagattgcctccgagcacgcgcgggtgctgacgcccgggggcgagctgggcggcgcggagctgaaggcgctgctggagaaggtgattacgtacgaggagcgcctggagaagcaggccaagcgccgggacgcgcgcgtggtggacgcgctggtgcagggcgcgcgcctgtccgcggagacgctgacggacgaggctgccctggaggcggcggtgaaggccgcctatgacaccttcgagcgccgcatgccggacgtgctgggccgcgtgcgccacgagctggtgcaggaccccgagcaccacaccaagaagctggtgttccacaccgacgtgaatggcgccatgcgggagacggtgctcgaccactccttcctgtcgtcgccggagtacctggagctgtcgtcgctgcgcgacgcctttgtggcgctgggcaaagcgccgtacaccgtgcgcgtggacgcgggggaaatcaccgtcttctccgtgcaagaggtgctcgccgccgtccgcaagacgcgcagcgtggcctgggcctgcagcgctacaagggtctgggtgagatgaacccggagcagctctgggacacgacgatgaacccggccacgcgcacgctgctccaggtgcgggtggaggacgcggtggagagcgacgaaatcttctcgctgctgatgggcgaggcggtggagccgcggcgcgagttcatcgagcgcaacgctctggacgtgcagaacctggacatctga

SEQ ID NO: 5686 - DNA, 531 bp, Myxococcus xanthus
atgctcgtgccattgctcgttgcgggattcttcagcggtgccattccccaggccggagagacggcgccggacttcacggcgaaggactccgcggggaacgtctacacgttgtcggagatggtgaagaggggccccgtcatcctggccttcttccccaaggccttcacgggcggctgcacccgcgagctcaaggcgtaccgggaccgttacgcggacgtggagaaggcgcaggggcaggtgttggccatcagcatggatgacgcggagtcgctcacgcgcttcaaggccgaactgaaggcgccgttcccgttcatccccgaccctgaagggaaggtcgtctccgcctatgacgtgaagatgccgctgctgtcggtgccgaagcggtacacgttcgtcgtgggggagggcctgaagattctcaaggtcgagtccggcaacgacgccatcaacccgcacggagcgattgtcgcgtgcccgctgcgcaagccggccggcgcggacgcgaagacgccggattcgggcacgaagtag

SEQ ID NO: 5687 - DNA, 351 bp, Myxococcus xanthus
atggcgggctccttcgcggaggtcagcgtgggcacgtcggcggaggcctatacgtacccgggcgcggtgagcgacgggaacctgcacgagcaactgctcttcaccttcggctacggcgtgtggctgggccggggtgggccgttccggggcgaggcgatgctctattacgaccaccgcaaggactcgttcgcggggggcatccgctcgcgcggcggcggaatcgtgggcgcctttggcctgaggggccgggcgctgctgacggatgactggggtgtcgccgccgaggtgcagggaggcggcgcgctcgtgggccggctgtcgttgattcgtgccctgggaggtgagcggtga

SEQ ID NO: 5688 - DNA, 1056 bp, Myxococcus xanthus
atgcggcccgcggagaaccgcgcgattgcggattccaaggtgggccaggcgcagcagggcggggtgacgctgtcggtggcggatgggctggcgacggtgcgcgaattggcgccgggcacgctggtgctgtggggcaacgcgccggccttcaccgcccgcatcgacgtgggcgcccaggcgccgtccgactggctggtgacggtgcgcaacgcgatgccggacgcggtgctggtggccgaggaggaagggggcgcgccgctggcgcaggaggcgcttccgcaggcgctgcccaccgtgaaggtgtggcgcgtggcgctgcgcgcggggacgacagcgcggctgtccgtggcgccgccggattccgaatcgcgcgagcccttccgcttcctcgcgctggcggacgtgcaggaggccctgccgcgcgtcggcgatatctacgcgcgcatgcggcgggacgacacggcgcgcttcatcctcttcgcgggcgacctcacggagtcaggcacgcgcgatgagctgacggagttccaggagcggctggaggcgggctcgcgcattccgctgtacgccaccctgggcaaccacgagacgttcacccgcgacgccgccgagtaccacgcgctggtggggcgcggcagccagagcttcgtcttcaagggcgtgcgcttctcggtggtggactccagcaacggcacgttggaccccggcgtggaggagcaattggaggggtggctggcggcttcgcgggacggcacgcacgtggtggccatgcacgtgccgccgcaggacccggtggggctgcgcggcggcggcttcgccaaccggggtgaggccgcgggcctggtggggaagatggcgcgcgcgggcgtggacctcacgctctacgggcacatccactcctactattcgttcgccaacgcgggcatccccgccttcatctccggcggcggcggcgccattccggagacattcgacggggtgggccggcactacctgtccgtggatgtgagcgcggacgacggcttgcagcaggcggcgctggtgcgtgtggattga

SEQ ID NO: 5689 - DNA, 525 bp, Myxococcus xanthus
atgttcgactcgaacgagaacgaccccattcccccggcgctgcgtgcgctgcttgagctgttcaccacggagctggcggaggtccgcttcccggacatgaacggcgaggtgctggacgccgcggccgaacaggtgcgggcgcaggcggaggccgtggcgcgggcgcaggcggcgctggagtccgcgcggcaggcgctgcacgaaagccaggaggcgttgctccagaagggccagcgggcgctggcgtacgcgcgtgtcttctccgaggagaacgtggagctgagcgcgcggctggacggcatccacctgccgcgtgcggcgcgcaagggcgcccgggctgacggcggagcgttggaccccgcgagcgcggcgcagggcaacgatgagaacgcgccccgccgccggggccgtcctcccaaggctcgcgccgtcgcgggtgcatccctgttcgcggatgggtcctcgccggaggcgctcgccgccgcggcgcaccacaccggcaacggcatgttgtccgaggcctga

SEQ ID NO: 5690 - DNA, 1542 bp, Myxococcus xanthus
atgaggcttcccgcctccgccgagcctcagttcttcgacgacctcagccgcgaggtcgccctggcctgcgacgcgggcgacaccctcacctgggtggacgcccgtgcccggaacgtcctcgccgccaatcccggacagacgctgcgcggactggcggcccagggcaccgaggagaaggtggaccggctgctggtccaggcgcacgacgagaaggtggaaggctgggagctcatcctctgccgggaccaggtgcccacgacgttcgccttccgcgcccggccccatgacggaggcgtgctgctggtgggcagcctggtgccggaggactacggcggcgcgctcgagcgggtgagcaccaccctgagcgagatgtccgcgctccaccgcgagacggagcgccagcagcgcgagctcaagcgccgcgcggacgaactggcccgcctcaacaacgagctggaggaatccaaccgcggcgtgcgcagcctccacgccgcgctggacacgggcattggcatcgcgccggagcaccacgagcgcatcttcgaggagttctcgcaggtggagagccacctgcaacgcaaggcgaagggcaccggcctgggcctgccgctggcgcgccggctgacggagctcctgggcggcacgctcaccgtgaagagcgcgctgggacagggcgccacgttcaccgtcaccctcccgcgcgtccacatggaggtcacggagatgaccggcctgacggagcgcagcgagcacctggaccccagccgggccccggtgctggtgctggaggacgaccggcagacgctcttcctctacgagaagtacctggcgcgctccggcttccaggtgctgccggtgcgcagcacggatgaggcccggcgcgtgctggagcgcgtgcgccccgccgccatggtgctggacgtcatgctggagggcgagacgagctggggcttcctggcggacatgaagaacaacgaggccacccgcgacatccccatcctggtggtgacggtgacggaccgcgagcagaaggcccgcgcgctgggcgccgacgagttctggctcaagccggtggacgaggtgcggctgcaacgcaagctgcaggccatggcccgcaccggtccggtggagcgcatcctcatcatcgacgacgatgatgtgcaccgctacctgctcacgcagctcctcaaggacatgccctacgtcctgctggaggcggctggcggcaaggaaggcgtccagttggcgcgggagaagtccccgcacctcatcttcctggacttcgtgctgccggacatcaccgccttcgacgtgctggacgagctgaaggcggacccgcgcacgcgtgacgtccccgtcatcctccacacctcgcacgagctgaaggaggccgagcgctcgcggctggcgaaggagacggccgccatcctcgccaagcacacgctgagccgcgaggtggccatcacccgcatccgggacgcactgtccaaggccggcctgggctcccaagcgttgccgcaggaggcaagccgccgtgggtga

SEQ ID NO: 5691 - DNA, 705 bp, Myxococcus xanthus
atggagagcgtgagcaagagcgtggaagcgcgggcggaccggctggccaccgcctctcaggaggcgctctatcaggaccccttctgggccgcccgttacgggctggagcgcgcgcagcgcttcggtgacgaggacgcgcgcttccacgtccgctacctggtgcagtccctggacgagcacctcccctctgtcctggaaggctacgcccgctggctgcgcaccctgctggtgtcgcgcggcatgtgctcgcgccatctggaccggcacttcgccgcgctggccgccgcgctggaagcggaaggctggggccccggcagcgaaccccacgactacgtgggcgccgcgcgacaggcccttcgctaccaggagggtccagcccgcctgctggaagaggaggcgcccgagctcgcgcgcgccgccacggcgcgcctcacgctctacatcatccccgaggaccagccccgcctggaggaagagctccagttgcaactgtcctacgtggccgacgcgctcgccgccgggaagcccgacctgctcggcgaccatgtgcgctggtacgccggcttctggccgaggcgcggatttggcctcctggcatttcccagtgtgctgggcatgttgaagtccgtgctgggctcacgtcaccccgaagcacggacgctcctctccgaagcgggggtgtcctgggaggagactcgttcatga

SEQ ID NO: 5692 - DNA, 648 bp, Myxococcus xanthus
gactccgccctgacgggcctgctgaacgcgtatctcgcagcgcagctcgccgggaaccggcgtgaggcgttgcggctgctcgtggacgagggactgctccgggacatccccctccagacgctgcacctggaggtcatccagcccgcccagtatgaaatcggccggctgtggcaggagaacgtcatctccgtggcgcaggagcacctggcgaccgccgtctcccagctcgcgctcgcgcacctgtaccggcacctgcccagggatccgttcaacggcaaggtcgtcctcgtctcctgcgtccagggcgagctgcatgaagtgggcgcgcgcatgtccagcgacttcctggagatggccggcttcgacgtgcgcttcctgggcgccaacgttccaccggagcacctggcccgcatgacgaacgagcttcgtccggacctggtcgccctttccgtgacgatgacgtaccacctgcccgcgctccgtgaagccgtggcgcacgtgcgcaagacactcccggatgtccccatcgccgtgggcggcctggccttcaactgggcacccggactggaggaggagctgggcgtgaacttcttcggcaaggacgcgcggcagttcgtcgcgtccgcctgccgggccctgggagtctga

SEQ ID NO: 5693 - DNA, 327 bp, Myxococcus xanthus
atgacctcaccgcccagccatgactcccagcccaagccgggtgagagcgccgtctacatcgtcaaggacagcggcgtgcgctgcttcgccccgccttgccccacctacaacgccttcccggtggacaagccggacgcggagcccatccccgtgcacgagctggagctgtcggcggtgacgaagggctcggacgagcagacggatgcgttgatccgaaagacgctggacggcaccgggctcaagattcagggcaccttggagacgcggcccaacgcgggccccgcgggcgcggccaccgtcctgcgcgccagcaaggtcgaaaactga

SEQ ID NO: 5694 - DNA, 1233 bp, Myxococcus xanthus
atggttccccggctggcgcgggctcgcacgctggcgcgcaacttcccggaggtctccggggagatgacgctgcagggcgggtggagccaggtccgctcggagagcgtgctcggccgcgagtcgccagggcgccctgtcccgggcggactcttcgagcgcgcccagcaggtgctggagaccttcgacttctccgacccgcgcatcgtcgcctggcacttctccgccgaggagccgatgcagggtcgcacggtgctgctggagctgcgcgcgctggggcagcaactgcgctacctgtgcggcgtgcgagtgggagacacgcgcgaggagcacgatgaggtgtacagcgtcttcggcttcagcttcgagacgctccatggacacatcgaggccgggcgcgagtggttcctgctcaagaaggagcacgagagcggtgaggtgcgcttccacatcgaggcggcctggcgtcccggccagttccctaatgggtggagccggctgggcttcgcgatggtggctccgcgctatcagcgcgcgtggcaccggctgacgcacgtgcgggtgcgcgagctggcgttgaagcacccggagttcgtcggccagctcacgagccacggccggctggcgcactccggccatgcgctgggaacggccccggtgcagttcttcgcgcagcgggcgccagggcgacgagaaacgcagttggaggaggagatagaagccatgaatcgaggacacgggttgagggccctgggactgggcgtgctggcgggaatgcggagcatgagcgcgccggcgctggcgagccgctggctgacgaagacacagcccgacagcgaggaccggctcgccagaaccctggcgcatccgtggacaccgcgcgtgctgggcctgctcgccgtgggtgagcttgtcgcggacaagctgccgatggcgcccccgcgtgtcgccgccgtgccgttgacgggccggatgttgtcgggtgccctggccgcggcctcggtgacgaccgagcgccaacgcggcgggcggctcgcggcggcggccctgggcgccctggcggcgctggcatcgagctgggccttctattcgctgcggcgcaccgccacgaagaagctgggcgttccggacgtggccgtggccctgacagaggacgcgctcctcgcgggcctggcctcgcggctgctgcccgtcagcgagcatcaggccgggcaggccacgctgtcgcccgtgtga

SEQ ID NO: 5695 - DNA, 498 bp, Myxococcus xanthus
atgcgctgggtggccgtgcgcttcgccgagttcgccccgtccgaactctgcgtcttcgagcgcagtcacccggaacgcgggggccaaccgctggcactggacgacgagctgacggtgaagattcagggcgcgggcaccttcgccgtgcgcgtcatccaccaggacgcccagagcttcacgctcggcacgctccacgggcacccggaggcgggccgcatcaccttcggcgcttaccggaacgcgcgcggcgatgtcatcttccacatccgcagccgggcgcgctccggctcgacgttccactacctcggcttcgtcaccgccggagacgccatgcagaccaacacctggaccgagttcgtcctgcgcgccgcgctgacggccggtgacggggtgcatggcgtcatccacgcggacaccaccgagttggaggacgaaccgcccggcggcgacaccgtccacgggcccaccttcctggcgcggggagacggaagacaatga

SEQ ID NO: 5696 - DNA, 555 bp, Myxococcus xanthus
atgcgaaagctcgtctggagtggggtgatgctgtgcggactgctcgcgggctgtgcgagccggcaggagacaggcgctgctccggcggagccgccacccgccgaggccgaagccagcgcagaagcgacggcgccggtccctgaagacacgcaggccaccgagacttcgcccgccgaggaaggtgaggcgaaaacggtcgtccagcccctggtggtgacgcccaatcccgagccgaaggaccccatcaatgtccgaagcgccaaggtggacggtggcatcctgacgctggccgtgatgcatggcggaggttgcgccgagcacacgtactcgctggcctgggatgggaacctccagcagggcgcggatggcacgcccgtggcgaacctggtgctggtgcacaatgggaacaacgaccggtgcaaggcgctcctgcgggccactcctcgcttcgacgtgtcctcggtttcgcagctcttcggggcgcagttcgggaagacctcgggcacggtgaacctggtcctgtcggaccaggctcacgtgcgctacgacttctga

SEQ ID NO: 5697 - DNA, 1281 bp, Myxococcus xanthus
atgaagcgggaagtgaaggccggcattgccgggctggtgttcgggtccatgctggtcggctgcggggtggcgccggaacaggaagcgcagaacgaagtggaggagatgacggcggaggcgacatcgagcgccgaggccgggctcgatgaacaccgtggctcctcgatgcccgccgcggtggcgcgtttcggccccgcggtcgcgtacggtgacggcaagttcttcgccgtctggaccgatgtgcggaccggcggcatctacggcacccgggtgaagccggacggcaccgtgctcgacccggggggcatccgcatcaacatcagtgacgagaatggggagcggcccgccatcgccttcaacgggaagtacttcttcgtcgtctgggagagccgcgatggtgtcgacggggtgcgggtgaagccggacggcaccgtggtggggccggtgttccgcgccatccagacgggtgaaaccgtcggcccggtgcgtgtggcctgctccccgaagatctgcctggtgacgtacaccgtctccggtgacgaagagacggtcatcttcttcacgcgggtgacgaaggatggcgtcgtccttgatacggacgacgagtccctcagcgccgtccccaacttcgcgaatgacgcgtcatcgacctggaacaacaaaacgaaggagttcctggtcgtctggtccgacgagcacggccaaggcccggagaatgcggacatctacggcaacagggtgaaggaggacggcaccatcctcgacggcgacggcttccccatctcccaggccgagggcgcccagacgacgcctgacgtggagtggacgcacaagaattaccaggtggtctggaccgatgaccggaatgggaacgcggacatcttcggcgcgcgcgtgagcaagacaggcatggtgaaggaccccgaaggcatccccatctccaccgcagagggcgcgcaggccgagccgcgcatcgcccaccacaacgacaagtccctggtcgtctgggacgacaggcgtgacggtccgcatgccgtgtggggtgcgcggtggggcgagaacggggacgtgtgggacccctcgggtttccctatctccaccggggaccaaccacaggagtacctgccggatgtcgcctacgggggcggcaagttcttcgttgtctactcgggccaggagacgttcgatcccctcgaaccgcacttcatcctgggcacgcgggtgacgcaccaggcgcacgtgaaggacgtgcccgccctgccgctcacgcgccagcactga

SEQ ID NO: 5698 - DNA, 1098 bp, Myxococcus xanthus
atgacagccgacgccgtgggcgacgtctggacgtacgcgctggagctgacccgggcgctcgcgccgcacggggtggaggtgacgctggcgaccatgggggcgccgctcaccagcgcgcagtgggcggaggcgcggggcattcccaatctcaccgtggaggaagggcgcttccggttggagtggatggaagacccgtgggacgacgtgcgctcggcgggcgactggctgctcgcgctggagcgccgcgtgcgtccggacgtggtgcacctcaatggctacgtgcacggggcgctgccgtggctgcaccggcccctggtggtggggcacgcatgccgcctgtcgtggtggcgggcggtgaagggcgaggacgcgcccgcatgccatgcgcgctatcgcgaggccgtcaccgcgggcctcggctccgcgggccgggtggtgacgccgagccgggacctgctcgactccctccagatgcactatggcccgctgaccgccgcggaggtcatcccccatgggcggcgcgcggaccgggtgccacctcgctcggagcgggagcccttcatcctcggcgtgggcagtccgtgggacgccgcgaagaatctcaccgtgctggacgccgccgcgccccgcctgggttggccggtgcggctcgcgggagacgcgcgccatccctccgagcggaaggcggagccgcgccacctccagtggatggggcacctggagccgcatgtcctggcggcgtggatgtcgcgcgcatccatcttcgtgctgccggcccgatacgcgccctttggcctcaccgcgctggaggcggccctgtccggctgcgcgctggtgctgggcgacattccggcgctgcgcgaggtgtggggagatggggccgcgtgcttcgtgcccccggacgacgtggatgccctggtggagacgctggagcggctgcgcgaggacaccgggctgcgcacccggctggccttgcgcgcgcgggcgtgggcgctgacgtacacgccccggcggatggccagccgctacctctccgcctacgccagcctcgtgggcacgcagggggtgctgtctccagcgggcacccccacgcactga

SEQ ID NO: 5699 - DNA, 1110 bp, Myxococcus xanthus
atggcggaccacctcaagaccttcttcgacgcgcggcttgtcgaacgcctcggcgcgtcactccacgccgcggcgccgaccttccctcgcgccgcgttcatccgagaggccgagaagggcctggatggccatgagttgatggaccgggcgcgtcatatcgctggtgcgctgcaccgtgcgctgccccaagactacccagaggcggtggaggtgctgctgcgctcgctcggcccccggacggaggccacggagggaggggccatggcttccttcttctatctgccgcacacgattttcgtggcggagcatggcctggagcacttcgagccgtccatgcgcgcccagcacgtgctcacccagcgattcaccgcggagttctccatccggccctacctggagcggcacaccgcgaagacgctggcccgcctgcgcgagtggacagaggacccgagcgagcatgtccggcggctcgtgtcagagggcacgcgcacgcgcctgccgtgggcctcacggctgcgcgagttccagaaggaccccacaccggtgctcgcgctgctggagcggctgaaggacgacccggcgctttatgtgcgccgctcggtggccaacaacctgaatgacatcggcaaggaccaccctgccctgctggtgcaggttgcgacggcgtggatgaagaacgccacgccggagcgggagtggctggtgcgccatgcgctgcgctcgtccatcaagcgcggagagcccgcggcgctggcggtggtgggcgcgcggccgccgtcaggcatcgaggcccgcgtgacgcagttgccccgccgcgcggcactgggcagcacggtggaggtccacttcgaggtgaccaaccgctcgaagcagcagcagacgctggtggtggacctcgcggtgcatttccagaaggcgaacggcgaggcgcggcccaaggtgttcaaggtgcgcgagctgctgcttggcccgggacaagcggagacggtgagcaagcgcgtctccttcgcgcagctctccacacgcaagcactacgccgggccgcaccgcttcgaggccctggtgaacggacaggggttgccgctgggtgtcgtcgaggtcagcgggtag

SEQ ID NO: 5700 - DNA, 390 bp, Myxococcus xanthus
atggacggcggactcgcgatattcggcctcggcctcttcctgctgggaatcgccaacctgtacacacgacacagctactggctggctgtctccgtgctgctcctgtcggtggtgtccatggggttggccttcagcgagtccaagcggctgcgcgatgtgtcgctgggcgtgggcgtcgtgctgctgctgctcaccgtcatcgcgctcgccgtgggcacgtcgtggtggctgccactggccaccttcctcttcgccgtggcgtatggcgtgctctgggcggagtaccgtttccccttcttcaagaacgtggcgccgggcgacgtgccgcaccacgcggagcggcgcttccacgtccactggccctggcaccgtcggcgcgtgacgccgtga

SEQ ID NO: 5701 - DNA, 2757 bp, Myxococcus xanthus
caattcggtaaatacgtcctcctctcgaagatcgccgcgggggggatggccgtcacctaccgcgcgcggatgacgggggcagcgggcgtcaccaagccctgcgtcatcaagcagatcctcccgcacttcgtcgacgatgcggacttcgtcgagatgttcatcggcgaggcgcgcgtggtggccagcatgagccacagcaacatcgcgcagattttcgacttcggtgaggtggacgggcagtacttcatcgcgatggagctggtgcagggccagcccttgtccaaggtgctgcgccgcgcccagcggatgggcatggcgtccttcccggagccgctggcgctccacgtggccagcaagctgtgtgacggcctggactacgcacaccgacacgtgggcgaggacgggctggcgctgggcctggtgcaccgcgacgtgtccccggacaacgtcctcatctcctatgagggcgaggtcaaggtcatcgacttcggcatcgccaaggtgacgagcgcggtggaggcgaagacgtctcccggcaccctcaagggcaagtacccatacttctccccggagcaggcacagggccggcaggacctggacgcgcgcaccgacgtgtacgccgcgggtgtcgtcctctacgagatggtgtgcggcaagcgcccctatgaaggggagttcgtcaccgtcctgccccgcatcctcgtggccgaccgcctgccgccgtccgcgctcaaccccaccgtcagcgaggacatggagacggtcatctcccacgccatggcgctggaccgtgaggcgcgctaccagacggcgaaggacttgagcgagtcgctggtggagctgctctaccgcgacaacccgcgcttcacccccaccctgctgtcgcagctcatggcgcacctcttcccggaggagctggccgccgagggccgccgggtggaggtgtcccccgccttccaggagcagctcaccgcctggcagacgggcgtcaccgaagcgtcgccccagggacgcgcgcggcccccatccagcaacgccccgcggggctccagccccggcgtgcgcagccgcccgggcagtgacggaggccgccctggcagcgacagcggacggcccggcagcgaaggaggccgtcgcccctctgcgagcaccccaggagcgcgccgtcccacgagcagcggcgtgcggcgggtgacccagtcccagctcccccgctccgagggtggcgtccgcaggacatacacctccgagcgccccgggccccccgtgccggcgctggacgaagagcccagcaccgacgcgggtgatgcgcctgcccccacccaggccgcgccacgcgacacgcccatcgaagtgcccgccgccaagagcaaggagcccaccaccgaggcgcatccggtgggcacctggactggcaagggctaccgcacctccgtggacgacgctcgggacacgctggcgcgcgaagaagccgcgcgcgtggcgaaggggaaggagaaggcgcgcgtcgtgacgatgtccgtcgtctacgccaccgccgcgctgttcctcgtcggtgtgttctacaagctcgtcatcgcgcgcgagtccacgttcgacgacatgtacgcatccaccaccacgctgtggctcgcctccaagcccgcgggcgccaccgtgcggctcaacgaccaagtgctcaagggcgtcacgccgctgatggtggaggtcaagattggcgaggccaacacgctggccctctcgctgcccggccacctgccctggacgaagcgcttcacgcccacgtcgaacctggtggagccgctgacggcggagctgaagcccatcgcagcgcccccgccgccagtcgaagtggccgtggcggcgccagaggacgcgggcgccgcggtggtggcggaaggcgccgccacgccggaggacgcgggccccagcgcgccggaggacgcgggcgccagcacggaggtggcggtcgcacaggacgggcccgaggaggaggacacgccgcagcggacaatgcacgaggtggactaccccacccgcgtgctggtgctgcgcccccagtacaacgccgtccccctgcccgagtacaacaccgccagcatcgagctgaaccccggcacgacgtactccgtgtggacgcagggcagcgcgtcgctggccgagggccggggcaccgcctccggcacgctggcctacctcatcgagggcgacgggccggtggacagcagcttcggcctgctcggcacgtcaacgcgcaccatcaagggcgctcggaagctccacgtcttcgcgctggatgacggcggactggacgacaacagcggcgccatccgcatcaacgtccgccagtccgcctacgtgccgccgcgctcgttcaccttcgatgcgaaggaaaacgcggtgccgctgaagcccgagcaccagatggtgctgcgcggcctcaacccggactccacctacctgctcaccgtgcgagacgacgtcgcggagctgcgctccggccccaacggccgcgtccgccaggtgctgtgcatggagcgcggcccggcgcccgaatccgtgcgcgccacccaccgcatcctccagaccggcaagcgctaccagatgacgggcacggagaacctgcactgcaccttccccgacatgcaggtgggcgacaaccggggcgccttcgaggtggacatcgtcgacgtgacggccatgtccggcaaggagcgcgcggaggccctgaagggctcacgccgctcggagcggtag

SEQ ID NO: 5702 - DNA, 1173 bp, Myxococcus xanthus
atgcgcgcactctgctggaacggcatcaacgacctgggcgtggagacggtgggggaccctcgcatcgtcaaccctcacgacgtcatcctccaggtgaggatgtccaccacctgcggctccgacctccacttcatcgacggctacatcccgacgatgcgcaagggagacgtcatcggccacgagttcatgggcaccgtcgtggagaagggccccgcggtgaagaaggtccaggtgggtgaccgcgtcgtcgtcccgtccttcatcggctgtggcagttgctggtactgccagcacgacctctggtccctctgcgacaacaccaatcccaagggtgaattgcaggagcccctgttcggctaccagaccgcgggcatctacggatacacccacaccttcggcggctacgcgggcgcgcatgcgcagttcgtccgcgtcccccacgcggacaacgactgcttccgggtgcccgaaggcgtgacggatgaacaggcgctgttcctctccgacgccgtgcccaccggctacatgggcgcggacttctgcgacatccaacccggccagacggtggccgtgtggggctgcggcggcgtggggctgatggcgcagaaggccgcgttcctcctcggcgccgagcgggtgattggcatcgaccgcttccccgaaagactgaagctggcgcgggagaaggtgggcgcggagaccatcagctacgaagaggtggacagtgtcctcgacgtgctgaaggaactcaccggcggccgaggccccgacgcctgcatcgacgcggtgggcatggaggcccacggcacgggcgtgggcgccgcgtatgaccgcgcgaaacaggcgatgcggctccaaacggaccgggggcaggcgctgcggcaggccatcctcgcgtgccgcaagggcggcatcctgtccgtggtgggcgtctacggattcatggacgcgttccccctgggcgccatcatgaacaagggcctcacggtccgctccgcccagcagcacggacagaagtacctgccgcgcctgctggagcacgtggtgaagggcgagctggacccgtccttcctcgccacccaccggttctccctggaggacgcgccgaaggggtacgagctcttcaagaagaagcaggacggctgcgtccgggcggtgttcctgcccaactga

SEQ ID NO: 5703 - DNA, 486 bp, Myxococcus xanthus
acggtgctccagcgctccatcaccatccaaggcgcgccggaggcgctgtatcgccgctggtgcgacgcggagacgctcaaccaggtgatgggacacttcgccgacgtcacctcctctggcgagagcctgcagcactggaaggtgccgggcgtgctcggcaaggagctcgaatgggacgcggaggtggtggaggagcaccccggtgagctgctgagctggcgctccgtgggggacacggccctgcccaacgaaggctgggtgcgcttccgacccgcgccgcgggactggggcacggcggtgacgctccgcttcgtcttcgacccgccgggcggcgtcgtgggcgagaaggccgtgcagttgctcggcgccgtgcccgccgcgctcgcgctcaaggccctcaagcgattcaagagcctcgtcgagacgggcgagattcccaccacccggcccaaccccgccgctcgcgagggcggctactcctcctga

SEQ ID NO: 5704 - DNA, 1380 bp, Myxococcus xanthus
atgaagcgcctctttgcctccctcctgacgctctccgccctctccctgacgtctgcctgcggcgacgacgacaacacgcccaacaaccccaacccgccgccgacggacaccaccgagaacgtgtccgccaacatcacccaggacaccacctggaaggcgggcgtcacgtacacgctgaagaactacatcttcgtggagagcggcacgctcaccatcgagccggggacccgcatcctgggcgaccagggcagcgcgctcatcatcacccgcaacgcgaagattcacgcggtgggcacggcgcaggcccccatcgtcttcaccagctcgcggcccgtgggcagccgcgagcccggtaactggggcggcgtggtgctgctcggcaagggccgcatcaacgtggcgggcggcgagaacacggtggagggcttcttcgcctccggcaacaatccgctgacccagtacggtggcggcgccaacccgaacgacgcgcacgactgcggcaagctgaactacgcgcgcatcgagttcgccggcttcgagctgtccgaggacaacgagctcaacggcctcaccgtggccggctgcggctcggacaccgacctggactacatccaggtccacatgggcgcggatgatggcgtggagttcttcggcggctcggccaacctgaagcacgccgtcgtcacccaggcggacgatgactcgctggactacgacctgggctacaacgggaagattcagttcttcatcgcgcagcagaacgcggtggtgggcaacttcggcatcgaggcctccggcaacaagaacgacaacgcggccacgccgcggtccgcgccggaaatctggaacgcgaccttcatcggctccggccgtccgtcgggcaccagccccgcgcagtcgggcatggtgttcaacaccggcgcgggcgggaagttgaacaacgtcatcgtggcccacttcgccgacctggcggtagacgtgagcggcacggcctccgcggccctgtggaacgcggccacgccggagctgtacctgcgcaacacgttcttctggaacaaccgcggcgacaaggtctccatccccgcggcgccgaacccgaccgtggacgctggcggcaacatcaccaacccggacgtgtccaacttcaacgagcccgagcgcgtgctcgcctccgcgctgaacaaccgcgtggtggatccacagctcaccgacgcgacccacctgacggcgccgaacttcatgccggtggccggctcgcccgcgctcaacccggactccgccgccacgccgccggcgggcttcgacacctccgcgcgcttcgtcggcgcggtgggcaccaccaactggctggccggctggacggccttcccgcaggactga

SEQ ID NO: 5705 - DNA, 2730 bp, Myxococcus xanthus
atggagggcataagcgacgaggcgatgctggccgagtccgccgtgccgcccccgggcttcaccggcatctacggccgcgtgacggacgaagccaacggagagggcctcatcgaggccaccgtgaaggtcgtggcgggcgcccagaagcaggtgctcaccgacctggatggcttctaccgggtcgcgctgccgcccgggaagtacgacctgcgcgtcttctatgacgtctaccagggccgccgcatcaccggcgtcgtggtgacgaagggcaaggcgacgaagctggacgtcgcgctcggcgcggacgaaggcgcggtgcaggaagtcgtcgtcgaggcccgcgcggaccgccgggccgagggcgcgctgctccaggagcgcaagaaggccgccgccgtttcggacgccatcagcgcgcaggaaatcgcgcgcacgccggactccagcgcctccgacgcggtgaagcgcgtggtgagcgccacggtggtggacggccgctacgtgctgctgcgcggcctgggtggccgctacagcaccacgctgctcaacggcgcgctgctgcccagcaccgagccggacgagcccagcgtcccgctggacatcttccccaccagcctcctcgccaacctcaacgtagtgaagagctacacaccggacctccccggcaccttcgccggcggcacgctgctcatcgaaaccaactcctacccgagcgagttcgagctcaagccgcgcatcagcctggccggcgactccgagacgacgttccgcgagcgcaacagccaggcccagggcggcttcggtgagaacctgggcttccccagcgggagccgccagctccccaacgcgattccgcgcgacagcggcctggggatgtcgggtgagtccagcgacgtgctggagcagcagtaccgcagcttccccaacatctggcaggcgcgccgcaccaccgcgctgcccaacatgggcctgggcgtgtccatgggcgacaccctgcgcttcggcaacagccggctgggctacctggccagcgccaactacggtcaccgcgacggcgtgcaggagggcaccttcgcccgtgtcgaccgcgacgagacgggcgcgctcaacgcccgcgacgcggcccgcagcacgcagggcttcgagacggccagcctcagcggcctgggcagcgtcggcttccagttggaccgcgacaacgagctgacctggttcggcctctacacccgcggcaccgacacccgcacgttcaccgcgcgcggcagcaacatcgtccgcggtgagagctacgagagcacgcgcctgcagttcgtcagccggcagctcttcttcaaccagctccgaggcttccaccgcctgggtctgctgggggacgcggagctggattggcaggccaacctgtcccgcgtggaccgcgacgagcccgacacccgcgacaccctctacagcgacaacctctccgcgccgtcgggcacgcccaccttccccaaccagcccaacagcggcgagcgcttcttcgccgaactgggcgagacgtccacgggcggcagcgtcaacgtcaccgttcccctctccgccgtccggctgaaggtgggcgggctcacccaggtgtccttccgtgacttcggtgcccgccgcttccgctacctgctgggcaccacgccggtggaccgcacgctcccccccgagcagctcttcgccccggagaacctgggcaccggcatccgcgtgcgcgagaacacccggccggacgatgcctatgacgcgtacctgggcatcttcgccggctatgcgtccgcggacgtccagccgacggacgccctccgcctggtgggcggcctgcgcgtggagtcctccacccagcagctcacgctgaaggacccgttcaccggcgcctccggcacggagaaccgctccgagtacatgaacctgctgccggccttcaacgccatctacgcgctgacgcccaccgtgaatgtgcgcgccggctacagctacacgctggcgcggcccaccttccgcgagctggcgccgttcatctacttcgacttcgtgcgccgccggaacgtgtccggcaacccggacctgctccagacgcgcatccacaacatcgacgcgcgcgtcgagtggttcgcgggtgagaacgaagtcctggccgccagcgccttctacaagcgcttccaggaccccatcgagcgcgtcatccgcaaccccgagtcgggggacctcagcttcgagaacgccgcgggtgccaacacctacggactggagctggaggcgcgcgcgtcgctcgcccgcctcacggagacgctgaaggccgtgcgcgtgggcgccaacctcacgctcatccagtccgacgtggacctgggtgaccccaacgtggggggcgcgcagacgaaccggaaccgtcccctccagggccaagtcccgtacgtcatcaacctcaacgtcggctactcgcgccccgaaagcggcaccgagctgaccgtcctctacaacgtgtatggccgccgcatcagcgaagtgggcgtccagggcctgccggacatctacgaagtgcccttccaccgcgtggacatctcgctgacccagcagctcggctcggcgcagctcaagctcaccgcggccaacctcctcaactcgagcgtcaccctccgccaggagtcggtggacgtgcagacgtacaaacccggcgtcgccttcagcgcgtcgctgggctggtccctctaa

SEQ ID NO: 5706 - DNA, 381 bp, Myxococcus xanthus
atgaacgtgacgcccctggtggacgtcgtgctcgtcctcctcatcatcttcatggtcgtcaccccgctgatgacgaagcagatgtggatgacggtgcccgccaagggcgatgaccaggaggcccctccgcctcctcccgatgcaaagccaccggtggtcctcacggtggacaagtccggcgtgctgcgaatcaaccgggaagaagtgccccgcgaccaagtcgtggcccggctccagcgcatgctcaacgcgcgcccggacaagattgtgttcttcgacgccagtgatgatgtgccgtacggcgccgccatggacgtgctggacctcgcgcgaggcggggacatcacggtcggcgtgctgccggacaagctcgcggattga

SEQ ID NO: 5707 - DNA, 375 bp, Myxococcus xanthus
atgaacgtgacgcccctggtggacgtcgtgctcgtcctcctcatcatcttcatggtcgtcacgccccagattgagtccggcgccgcggtggagctgcccacggcgacgaacccggacaaggagaacaaggagctgacccccaccacggtgagcctgtccgcgaccggggccttcttcctggaccgcaaggagctcaagcgcgacgcgctcatggccgagctgaaggccgtgcgcgcgaaggacccggactcgcccgtggtgctcaaggccgaccggggcgtgcgctactccgaggtgcgcggcctcttcaaggcgatgcaggagctgggcttccccggcatcaacctgcaggtcgtcgacaagcagaagaactag

SEQ ID NO: 5708 - DNA, 765 bp, Myxococcus xanthus
gagcaaccggtcatgaatttcaatctcagggacatctacaaccacatgggtgtgttcgcgctgggcatcgcgtggaccctcatcctcttcgccgtcgcgtccctcgcggtgttcttcgaacgcctcttcgtcttcttccgctcgcgctccatctccaagcaattcgcgtcccgcgccggtccgctcctcacccagcaccagcacgaggcgctggtgaaggaggcggaggccaccaagggcagccacctggccatgctgctgggcggtggcatgaagcacttcctcgcgaagtcccgcgtgccggccggcaagctgggcccggtggagctcacgcgccgtgagctggtccgcatcaacgagcgcgtcagcgccgacgtgcgccgcggcatgtccgtgctcgccaccgtcggctcggtggcgcccttcgtcggtctgctcggcacggtggtgggcatcatcgaggccttctccggcatcgccaaggagggctccggcggcctgggcgcggtgtccgccggtatcgccgaggcgctcgtcgtcacggcgctgggtctgctcgtcgccatccccgcggtgctgatgttcaacttcctctccacccgcgcggattcgctccagctctccctggacgccgcgcggagcgagttcatggactacctggaggacctggggccgcaaaagcccgtggccaccaacggcgccgcggtggccacgggcccggagctggctgctcgcaaggagtcccgcgatgtccaccccgcgtag

SEQ ID NO: 5709 - DNA, 420 bp, Myxococcus xanthus
atgccgtcacgcgccctcatcatcaacgccgacgacctgggctacgacccggccgtcacgcgcggcatcctccgctccatgcgcgagggcgtcgtctcgtcggccaccttcatggtgaacacgcccttctccgaggccgccgcgcgcgaagcccggggcctctccatcggcctgcacctcaacctcgcccggggcgcgcccgtgtggagcggcttcccgcgcgagttgctcggcgaggacggcggcttcgtggaggcgcgcgcgggcagcctgccggcggacgcggtggaggcggagtccttcgcccagctcgcacggctcgcgggcctgctgggcctgccggccacgcatgtggacgtgcacaagcacctgcacctgcacgcgggggtcctggagggcctgggcccgggcggcgcgaag

SEQ ID NO: 5710 - DNA, 519 bp, Myxococcus xanthus
gatttggtgcaggtgtcgctgcggggcacgggcatccggctggcggatggcgccaccaatgtcatgccggtgccacagcaccgggtgaagcaggacgagccgctgctgcccaccgagcgccgggagaacatggaggcggttcaccgggtctggcaggtgtcgtaccggcacatccggcactcgttggagcggggctggtaccaaggatgggacttgcacccgggccagctccccgtgcgctacgcggcggtgtatgcgttctttctggagggcctggacgcggcctcgcgcaggctcaatgccttcatggagaaggccgcgcaggccacgctggtgggagacgtcttcgacgacgcggccaccgggcagggcctgctcaacttcttcctgcggggcctgagctgcggcgcgctcacccaggacgaggtgctggccgcgggcctcacgctggaggagctgcgcagccgctccttccgcgacatcgtcgcgtcacgccgcgcccgggccacttccggctag

SEQ ID NO: 5711 - DNA, 894 bp, Myxococcus xanthus
atggctcccacggaggtcaccgtcgtcgcggacgcaccggtgatgttcgtggacgtggactacgaggtggtcgcctccggggacagcgtgagcgcgggacggctcaagctgatggtgagcgcgagcccggagctccccctgctgtgcgcccatgacgagcccggctacgcgcgcaccttccaccgcgtcaccaccggactggccgccacactcaaggttcccggccccgcccggacgcccgcgcgaacgaaggcgcttcgcgtgttgaaactggatggacggctcgcgggattcgactggcgcaccgagcaaaggctggagggaggctcgcggcgcacggaagtctccaccagcctgctgctgccaggggccacgaatggcccgcacgcggaggaccgcaccatcaccacggtcacggatgaggagggccggctgaaggagcagcgccatgcgcatgcggaagacgggcggctcacgctccaggtgacgctccgccgcgaacgggagccccaaccgcccacgcgcgccgctcccgagacggcgtaccgctacgaggggagacagggctcgcgcgcactcaagggcaccttcacgtcgaaacgagggctggccacggaagacacggtccatgacaccgtgcgcgacgtgctgcgcccgggtggcccggcggaagccgtgctcgacgtctaccggcccgccgacgtgccctccgcgcccacggaactggtgctgcgccgggtgccctcggctgggccacgagccctgacgctcaccacgggcgacgccaccgaggaggcgcgggccgccgaaagcggcacactggagtggacgaagcgcgcccttcccgagggacagctcacgtccgagctcatccacggcagcccgccgccctga

SEQ ID NO: 5712 - DNA, 762 bp, Myxococcus xanthus
atgctgaagggggctttcaagaagcccaccctctccttcaagacggcccggctcgcggatgcgtccttgtccgacgccaccatcaacctcgtctacgagctgaacaaccccaacggcttcgggttgaacctggccgaggtggactacgccttcttcgtggagggcaagcaggtggtggccggcaagccacgctcggggctggcgctcaaggccaacggcaagagcgaactcgtcttcccggccaacgtgaagttcgcggacatcgtccccgtgctggagaccttcctcaagcaggacaaggccgccttcaaggcacagggcacgctaggcgtgaagacgcccctgggcgtgctgagcttcccgctggcgaaggagggcaccttcgaggtccccaaggttccgcaggtgtccttccaggcgccgcgcatcaaggacatcaccctgaccggcgccaccgtggaattcccgttgtcgattaccaaccgcaacagcttcccgttgccggtggccggcatcactggcgcgctgaaggtggcgggcgcggatgtgggcacgctgtccaccggcaacctgggcaagctggacggcagcgggacgaagcaggtcaccctgcccctcaccatcagcttcgctcgcgcggcgaacgcggccctggccctgcgctcgggcggaaatgcgcaggtccgcctggacggcaagctcacctcggaatcccagagcgttcccctgagtctcaatcagctcgtcaatttcgttaagtga

SEQ ID NO: 5713 - DNA, 393 bp, Myxococcus xanthus
atgcgccgcatcctcttcaagtcgaaaatccaccgcgcgaccgtgacccaggctgacctggattacgaagggtccgtcaccatcgaccgcgacctgcttcgcgccgccgacatcgtggagaacgaaaaggtcgcggtctggaacatcacccagggcacgcgcctggagacctacgcgctggaaggtgaggccggcagcggcgtcatctgcatcaacggcgcggcggcgcacctgaacaagccgggcgacctggtcatcctggccaccttcgcggaagtggaggaagccgaggtggcgaactggaagcccaccgtggtgttcgtggacaaggacaaccgcgtggtgcccgggcagacgaaggagattccgggcccgcagcgccgctcggcctga

SEQ ID NO: 5714 - DNA, 444 bp, Myxococcus xanthus
atgaggcggtcgtgggtgagcgctggcgcgctctcgctggtgctgacaggttgtacgggcacgggggccttccgtccggatccgaacaacgacgacccgctctacggggtcatccctgtcgtgaaagcgccaccgcagaaccggtgcgctgcgctcggcacgtcctccgcgcggggctcgtgtgacgacgccctctatctggccaccgagtacacccgccggctttcggtgggtgatgagatctgcctcgagggtggctacggcgaagacccgggctcggcgtgcaaggcgcgtgcggccatcatcgacacctctcccaatcaggtgaagctggaggtgcgcggtccgaagccggactcgcgctggttcaacgtggagatgcggcacgcctggtacgaagaaggcgcgctggtggacctctacctgtccgagcggggttattga

SEQ ID NO: 5715 - DNA, 633 bp, Myxococcus xanthus
atgggtctctacgacagcgtggccgagcggctggccttcatgaagaagatgactccggcggagctgaagaagctcggctcggcgcggctgtcggacatcgtcctccaggaggtggcgcgctcgcgtgtgcgcatcacgaccctggagaagcgctacccgcaggcggcgccgcgggagctggcccagcgcatcgtggacgaaaagaagaacctcgccagcatggtgggcggagtgagcggggtgttcgggctggtggcgttgccggcggacctgctcttcatggcgtacctgcaaatcatcctgctcacggacgtggccaccctctacaaggtgaacctcaagacggagcgggcgcgcggggagatgctggacttgttcggctacgccaacggcctgggcccgctgcctcgcgcgggtcccaaggtgttgggaaagctggccgccatgctgttggagaagggcggcatgcagacgctggggcgcgccatgccgctggtggccgcgcccgtcaccgcctacttcaacaaccagcacatccagatggtgggcgagcaggccgtgcgcttctacgagggcttcgacaaggcccacgccaaggcgaaggcccagcgcaagaaggccagcggcgcctga

SEQ ID NO: 5716 - DNA, 459 bp, Myxococcus xanthus
atggaggtccaggccgtctggtggctgaaggcggagagcctccttcccgtcaacgtcctcgcggagcggctgggcggcatcgccccgccccggctgagccggctgctggaccggctggaggccgcgcagctcgtccagcgcgagcgctccgtgcggcatgaccggcggcgcgttcgggtgaggctcacggagcagggccgcgccctcgcggagcaggcggacgcagtggtccaggagcgcatggcccggctgctgttgcccttggaaggcgagcagcgcagcgcgctgatggatctgctggaggggtgggtggaggccctgggcggaaagaaccgcgcgccggagctgaccaccgaagggggcgagacggacgccccggtggccgatgagctggagcccgccgcggcgcccaggcgtactcacacggagctgatggccatcaccgccaacgcggcctga

SEQ ID NO: 5717 - DNA, 636 bp, Myxococcus xanthus
atgggattcgcgggactggcgctggcctgcgccgtcgcgaactggcttcaccggccggtggagcttccgtaccaggccgcggagcccgaggcttccaccccgctcgcccaggcccccacaccgcggccgcgctccgtcgcgcccgggccttccacgcctgtcgccccggcgcagccggacgctcgccccatcaccaggcccacctcggcgtccgaagcagagcgctccgcacgctcccggcgcacgccccctgcccagcgcctgcggctggtgacggccctgcgcggcacgcacccctcgcctgaagcccgccgcgacgcggtgctggcggagctgacggcctccggcgaaagccacgagccctggacggcgcaggcccgggcggcgctggcgaagtggcatgcccaggtggaggccgacgtgctgcccgtccaggccgagccgcctcgatgcttcgcggccggctgcgtcgcgcgcgtcaccttcccggacagcgactcattccaggagtccttccgccgcaccgcagacctgcggctcggcgagggcaccacgcacatgcaactgccccctgagcgccgggcgtcgggcgaggtcgtggccgcgtggctcgtcctgcgtcccgccacgccctga

SEQ ID NO: 5718 - DNA, 606 bp, Myxococcus xanthus
atgaagctggagttccccttcaagcagtccctgctcgccaccagcgtggccgtcctgctcgtcggctgcggcaccgccgtcgaggaggagtcccccgtggctcccgaagccgccgagctggagagcagcgaggatgccctgttcagcatgctccccgcctgcgaggagcccgaggagctggagcacgtcgtggagcacgcgtgctaccacgccgaatacggccccttcgagcccgtcaccgccgccgccctgggcgcgcccgtcctggtggatgtcagccaggcccacaccgcctaccaggtcaccctgccgcagcgctcgccgttcaactacgccggccgcgtctcgttcctcccggacgagtcgggtgagttcgccttcatcctgtcgcgtcagcgtggcctgcgcatcttcgaggccgccaccggcaccgaggtggcgcgcgagtgccgctacaccgtccccaccgaggtctgctccagcctgaagacggcctacatcgcggacctcgaggccgacaccgagtaccacctggagttccgctccatcctcccctccaacgccgccttcaccctcatcgtcgaggaggcgggtcaccaccactga

SEQ ID NO: 5719 - DNA, 648 bp, Myxococcus xanthus
atgaagcacctcatgcgcccgaccctccgagtcctcttcctgaccgcgtgtgccgcggcggccgtcgcctgtggtggtgacgacgaccccgcccccatcgagcccggcgactcctgcgagcccaacggccacatccaccgggagccctcgggcgactggtgccactgcaacaagggttatgtggccgccgatgatggcctggcctgcgtgccggacccgaaccacgtccctggcgacggcttcgacttcggtgacgacggcgagcacgcatgctggcacgtgacgaacggtcccttcgtcaccgtcaacgccaccaccgcccgtcatccccgcgtggacgacttccacacctactacacggtgaagctcctcccggagaacagccagtacgtggggacgttcagctacaaggccttcgccaccggcaacttcgtcgtctacctgagcagcccggacgtgcccgtcaccctcaccgagacggccatcagcaccaccgtgccccaggccggcgcccaggccaccggcggcttctgtgacggtctgaagcacatggtcggctacgaactgacggaccgcgtccagtacacgctccagctcggccccacgtcactgcccgaactcaacatggtcatcgagcacgtgcagtaa

SEQ ID NO: 5720 - DNA, 855 bp, Myxococcus xanthus
gggcccggcacctacgactggacggtggagcacgacgggcgcacccgcaactaccgcgtccacgtccccccgggctacgacgccacccggcccaccgctgccgtggtggccttccatggactcggctccaacgaggtggagatggaggggctgacgcgcctgtccacgctggccgacacagagggcttcctcgccgtgtatccccggggcctcagcacctccgaaatcaatcaccaggggactgacggcccctaccgggggtggaacgcgggcgcgtgctgcggccccgcctggacggccaaggtcgatgacgtgggcttcgtggacacgttgctggcggacctggacacgcgcgtgtgcgtggacacgcgccggaccttcgccacgggcttgtccaacggtggcttcttctcgtaccaactggcctgccggcgcgcgagccgcttcgccgccatcgcccccgtggcgggcatggagggcgccacgccctgcaacccgtcgcgccccgtgccggtgctgcacatgcacggcaccgccgacccggtcatccgctaccagggtggcaacaacctgggcatcttcggcggcgcctacccgtccgccgaggagtccgtgcgccgctgggccgagcgcaacggctgtacgggtcccaccgtggagacgtaccagcagggcgacagcacctgcaccgccgccaccgggtgcagcccggagtccgccaccgcgtccctgtgcacggtgcagggcggccagcacacctggcccggcttcacggacttcaatcacggcggcacaccccacctggacgccacgcgggaagcgtggaagttcttccaggcacgcccccggccctga

SEQ ID NO: 5721 - DNA, 435 bp, Myxococcus xanthus
atggacgacacagggcaggacttcacgtcggagcaggagcagcccctggaggccacctgcgccagcgtggacaacacggccatgacgacgcacgcgtgcgcccatgcgtccaaccctggcgacaacgtgaacgtgaatggcgtcacgggggcgcccgacatcagcactcagcacaagcactacaccgtgacgctgtccggcagcggcacgggcaaggtgacgtacatccccgtggccagggcctcggcgggctccaccgtggagtccgtcgcgttctacgccacgcagaacgtcaccatcaccgccgtggacaagagcgtcacgcccaacgtcacgctgaccgcgctggtcagcaccaacggcatcaccgaggacacctgcacgctgcaccacgcacgggtgttcgactcacggtcggccacacctacgagctga

SEQ ID NO: 5722 - DNA, 171 bp, Myxococcus xanthus
atggtgcccgagtacctgtatgacaaccgcggccgctactaccgggacgcggacggagatggctacggcgccaacagcccgctctaccgcttcgcgtgtgaggcgcccgcgggctacgtcacccaacgcttcgactgcgacgacaccaaccccgccatcttcaactgctag

SEQ ID NO: 5723 - DNA, 966 bp, Myxococcus xanthus
atgcgaaccgtcgccaccaccactttgctcgccacgtgcgccctgctggctctggccggctgtgacaacgacgaccccgtccctccgacgccggacgcgggcacccgtccggatgcagggaccgaacctgatgccggaacacagcccgacgcgggttcggtccagggccccacggtcatcggctccacgccctcggagggagagacgaacgtcctgcccgtggagctgttcaaggcggatgcgacgaccaccggggtgcgcaagctcgtcacgctcaccttcgacacgcccatggacaccacggcggcggatgtcacgctcgttgaccggacgacgccggccaatgcccctcgcacgctgacgggcacctggaccgaggatggcctgacgctctcggtcgccatcccccggcccgaatccgacctgccgccgctggaggaggagacggcgtacaccctggagctcggcgcgctgcgcggcgcggagggccacgcggtggacacgtcgcatgcgggactcggtgatgggcggctggacttcaccaccggccggcgcgacggcaccaccgaacacgcctgcgcccacgcactgctggagagcccggtgcccgtcaccgcgagcgcctcccccaccatctaccccgcgacggatacctcccacgagttctacggcctgacgctccccgccagcggcacgtccttcctgggctacacggaagtcgtgtcgggagagagccgggacgagcccgtcatcctgtacctcaaccaccccatcccggtggcggtgcacgacacgacggaaggcgaggacgctatcgccaccgcgctggagcccgcccggcccgtctgcctgcccgccatcacccacacgctgaagttcaccgcgcccggcggcgaccgcttcctccggctcaccttcggcccgacggagcgggagacgttcaccttcgtcttcgaacgctactga

SEQ ID NO: 5724 - DNA, 1247 bp, Myxococcus xanthus
atgagcatcaacgtctacgccgtggccacgcccttcgtcatcgtcctggcgctgggggaattcgcttactgcgtcatccggcgcaacgggtactacgccttccaggactccatcgcgagcatgggcaccgcggtgctcaaccagtgcgtcaacgtggcggtggcgctgctggtgctcccgctcttcatccaactggggcagttcgcgccctggcagttgggtgcgtcctcgccgctggagctggtggcgctcttcctgggcgtgaacttctcttctactggttccatcgcttcgggcaccgcaccaacatcggctgggccgcccattccccgcaccactccaccgaggaactcaactacgcggtggccctgcgcgcgagcgtgacgcagcgcctcttctcgttccttttctactggccgctggtgctggtgggcttcccgcccgaggccgtgctggccatggtggccttccacctggtgctccagttcatcccccacacgcgcgtcatcccgaagatgccccggtggattgagtcctggctcaacacgccgtcgcaccaccgcgtccaccacgcgcgcaatgacgtctacatcgacaagaactacgcgggcttcctcatcatctgggacaagctgttcggcaccttcgaggaggagaaggaggcgtgctcctacggcctcacctccccgcccaacacctgggaccccaccgtcatcaacttccaggcatgggggaagctggtcagcgacgcggtggccaccaagagccactgggaccggctgcgcatctgggtgatgcccaccggctggcggcccgcggacctgccgccgcgcgcctccgtgggctggcaaaaggacggcgtggagctgaagttccagtccaccgagctacccggcgcccggggctacctcgtgttccagttgctggcggcgatgcccttcatgctgctggtgagccaccacgcctcgccgctgtccggctggcagaagctggtgctcagcctgctcttctgggccatggccaccgcgtggagcgggatgctggagtcacggcgctggagccttccgctggagctggggcgggtgctcgccatgggggcagcggtgacatggtggctgatacacgcctccgcgccgcagagctggaccgcgttgtgcgcggcgtggatgggcgtgtcgctcgtctggctggtggtggtgcgcggcgccagccagggcgccacgcccgtgccgcagggttcgcgctga

SEQ ID NO: 5725 - DNA, 2316 bp, Myxococcus xanthus
atgacgccgggcgccagcaacatcaggtccgacgcggagcgacgcggcacgtccgcgagctgtcccaccggaatgtggaagtcgcccacggcgaccggcggcggtgcctgggaggcgccacgaaccgtggtggagaagaatggtggctgctgcgccaccctcccaggggtcctcacatctgaaaacccaacgtcccacatttccccctcattcgcgcgcacccggaatggaccaccagcacacccgcccttgagcgggcgggcggacagtccggactcgacaagcggttttccatggttaagggaaagcgacgctggcgccccaccgggcgccccggaggcccctgtcaccatgaccgtcgaaaacgccccccagcgggagacccacgcattccaggcggaaatcaatcagctcctcagcctggtcatcaattcgctctacagccacaaggagatttttctccgcgagctggtgtccaacgcgtccgacgcgctcgacaagctccggttccgcgcgattacggagccggagttgctggcggacgagccggccctggagctgcgcctcatcccggacgaggcgaagggcaccctcaccatcgaggacaccggcatcggcatgtcgcatgacgagctggtgaagaacctgggcaccatcgcccactccggctcgcgcgagttcatcgaggcgctggcgcagaagggccagcagaaggacatgcagctcatcggccagttcggcgtgggcttctacagcgcctatctggtcgcggaccgcgtggaggtggtcagccgcgccgccggccagggccagtccgcctggcggtggacgtcggaagccaagggctccttcacggtggagcccgccgagcgcgccgcgcgcggcacctccatcaccctgcacctgaaggaggaccagaaggagttcctgggcgagtggcggctgcggtcgctcatcacgcagtactccgactacgtgggccaccccatcaagctccaggtgagcaagacgacggggaccggcgacgaggcgaagacggagacgtcgttggaggtcgtcaacaaggccagcgccctgtggcagcgctccaagtccgaaatcacggacgagcagtaccaggagttctacaagcacctgacgcacgactgggaagcgccgctggcgtggacgcacttcaaggcggacggcaacacccagttcaccggcctgctcttcgtgcccaagcagcctccgttcgatttggacgcgcagcagcagcgcggggtgcggctgttcgtcaagcgcgtgttcatcatggaccgctgcgaggagctggtgccgcagtggctgcgcttcgtgcgcggcgtcatcgattcggatgacctgccgctgaacgtgtcgcgcgagctgctccaggactcgcaggtggtgcgcgccatccgcaagcacgtggtgaagaagtccgtggacctgctggagaagctggccaaggacaagccggacgactacctcaccttctggaaggccttcggcacggtgctgaaggaaggcctggccacggaggccgagcagaaggacaagctgggcggtctgctgcgctacgagagctcgcgcgaggagggcctgacgtccctggcggactacgtgggccgcatgaaggaaggccaggaggccatctattacgtctacggcgagtcccggaaggcggtggcggacagcccccacctggaggcgctgaagcagcgcggcttcgaggtcctctacatgacggacccggtggacgagtgggccgcgcagggcctgcgcgagttccagggcaagccgctggtgtccgcgctccaggcggacctgaagctccagtccacggacgagcagaagaaggagcaggagcagcacgccgaaggcctgaagacgctcacctcgaagatgaaggacgtgctccaggagtcggtgcgcgaggtgcgcgtgtcggaccgcctgacggactcgcccgtgtgcctcgtcgtgccagagggcggctcgccggcctacctggagcgcctgctccagcagcgcggccggggcgcgggcatgccgcgcgtgaagcgcatcctggaagtgaatccgaagcaccccgtcatcgagcacctgaaggccgtgcatgaccgcgacccggccgcggcccaggtggcggagtggattgagctgctccacgaccaggcgctgctcaccgagggcagcaccatcgccgaccccaaccgcttcgcccgccgcatgacggggctgttgacgcaggtggcggccctggcggcggcgcccgcgccagcgcagacccccgcctcggcgacggcgagctga

SEQ ID NO: 5726 - DNA, 1119 bp, Myxococcus xanthus
atgggccagttggacacggccgtccagcaggcgcagcaggggcagtacgcggaggccgcctcgctgatggaccgggcgctgcagttgtccccggcgcccgaggtcaggacgcacgcggaggacgtgcggcgcatcatcaccacccaggggcgtgcccaggcagaccggtacctgcacgagggcaacttcatcgcggcccacgagctggcgcagttggtgctgagtctggacgcctccgcatcggcgtgggcgcagaacatcgccgcggagtacgagcacttcatcaccgaggaggtcgagcggctgtcgcgcgagggtgacgccgcgcgggcgcagcgtgactgggggcgcgcgcagcagagctacggcgccgcgctgagcctgcggcagggtggccgggccgcgccgctggaggcgtacgtgcgccacatggccctcgccgaccagcgcatcgcgggccgcgactggaacggggcggcggatgcctaccatgtcgcgctgcgcacgggtcaggacgacggatatgccaaccaccagttggagcgggtgcaactgcggccctaccgcgtcgtgctgcgctcggtgctggtgacgccgggccggccggatggccgggcctgggtgggcgcgtcgaacgacatcttcacgcggctggccaaccggctgacccagacggcccggcagcgtggaatgacggacctggtgaaggacctggccatgagcattccgcatgagaatcgcccgaggctgcgcatcgaggtccaccatccggatggcatgcacctgacgacgcaggggcgtgacggcatctacacggcgtatgacgcggagttcgtcgctgtcgccaatgccttcgacgaccggcgggtcggcttccaggtgtacatggacgggccgaacgggagcgagctgctcggctcggtagacgtgcccatgcgcgagctggtggagcaccgcgaggtgtcgctggagggccgctcggtcatcgcgctgatgctgagcaccggcggtgacggccgtcagccgggcccttacgccggcatggcgcacgtgctgccgccgcctccgcccggtacgccgccgccgggccgcggccacgccgccacgccgattccctga

SEQ ID NO: 5727 - DNA, 1224 bp, Myxococcus xanthus
tacgcgcacttctggcacacgccactcggcatccgcgtcggtgacttcaccttcgagcgcagcctcgaatgggtcgtcaacgacggcttgatggccatcttcttcttcgtcgtgggcatggaaattcgccgcgaggtccatcagggcgagctgtcagagttgcggcgcgccgcgctccccgccgcggcggcgctggggggcatgctcgttccggcgggcctgtacctcctcctggcggataccccggacacccgctcggggtggggcgtgcccatggccacggacatcgcgttcgcggtgggcatcctcacgctcctcggaagccgggtgccccccgccctgcgcgtgctcctgctcgcgctcgcggtcatcgacgacctgggcgccatcatcgtcatcgcggtgttctactcatcgggcgtggccatcaccgggctgctcgtcgcggcgctgggaatcgtgggtgtcttcgcgatgcagcggtttggcgtgcgctcgaagtgggcctacatcgttccagcgttcgtcgcctgggcgggcgtctactccgcggggattcatccgacgatcgcgggcgtcatcatcgggctcatcacgccggtgcgcacctggctcggtccggaaggattcgtcaccggcgctcggaccgaactcgaacacatcgcccaggcgcagccaggcgagctgtcctcccatcacctgtcggagaccttgcgccgggtcgatgccgcgcgccgtgaggccatgtcgccttcggagagcctgattgccacgctgcatccgtgggtggcgttcggcatcatgccggtgttcgcgctcgcgaacgcgggggtgccgatttccagtgaaccgctcgatgcggcgtcgtggaccgtggccctcgcgacggccaccgggctcctggtgggcaagcccctgggcgtgattggcgcctgctggctcgcactgcgcctgcggctcgcgacgttgccgaagggcctgggcatgcgggagctgctggtgctgggaagcaccgcgggcatcggcttcaccatggccctgttcatcgcgcagttggccttcacggagacgaagctgctcgccgcagggaagctgggggtactggccgcgagcggggccgccgccgtcgtcgcactcgtcctgggacggtggttgctcaccacttcggcccggcccggcgccgcgaggtccgtggacgaggcggagcgttcgacggcgctatga

SEQ ID NO: 5728 - DNA, 744 bp, Myxococcus xanthus
ttcaccatcgagtccgcgaagctgaaggagccccgccacatcaccgtctacctgccgccgggctacacgacggcggcggagagccgcttcccggtgctctacatgcccgatggcggcctgaaggaagacttcccgcacctggccaccaccgtcgacacggccatccgcgcgggcgagctgcggcccctcatcatcgtgggaatcgaaaacaccgtgcggcggcgggacatgacgggcccgaccacggtggcatcggacctggaggtcgcccccgtcacgggaggctcggcgacgttccgagccttcatccacgaagagttgatgccggaggtggagcgccgctaccgggtgacgcaagagcgggccatcatcggcgagtcgctcgcgggctacttcatcgtggagacgttcttcctccagccggaactgttcggcacctacctcgcgctgagccccagcctgtggtggaacgcggagtcgttggtgaagggggcgggtgaatggttcgcggcccggccggacctgcgcgcgggactttacgtgtcctccgccaatgaaacgggcgacatcgtccccgccgtggcgaggctccaggacgtcctccgaaccagcgcacccgcgggcctgaagtgggaagtcgaaccccggcccgacttgcgccacgacaacatctaccgggagagctcgcccagcgtgctgcgcaagtggctgcctcccgtggtggccgctgaacgcgcgccctga

SEQ ID NO: 5729 - DNA, 1026 bp, Myxococcus xanthus
atgttgatcgtgatgcgacccgacgcgacggcccaggacatcgagcgtgtgaacgacgagatccgccgccgtggttggcaaccgcacgcgattccagggggcactcgcacggccgttggcatcaccggaaacccgggcgcggtggaaccggagcccttccgcgtgctccctggcgtcgctgacgccgtggccatctcccagccgttcaagctcgtcagccgcgaggtgaagccggacgacacgcagctgcgcatcggcgacctgacgattggcggctccgccttccacgtcatcgccggcccgtgctcggtggagtcgcgcgagcagattctctccaccgcccacgcggtgaagaaggcgggtgccaccatgctgcgtggcggtgcgttcaagccgcgcaccagcccctatgagttccagggcctcaagggtgacggcctggcgctgctggccgaggcgcgccaggagacgggcctgctcgtcaccaccgaggtgaaggacaccgcgacgctccaggccgtcgccgacaccacggacatccttcagattggcgcgcgcaacatgcagaacttcagcctgctggaggccgtgggggacctgcgcaagccggtgatgctcaagcgcggcatgagcgccaccatcaaggaactgctgatggcggccgagtacatcgtcgcccgcggcaacacgcaggtcatcctctgcgagcgcggcatccgcaccttcgaaacgatgacgcgcaacacgctggacctcaacgcggtgcccatgctgaaggcgctctcgcacctgcccgtcttcgtggacccgtcgcacggcatcggcgtgcgcaaggcggtgccggcgatgatgcgcgcggcgacggcggtgggggcggacggcatcatcgtcgaggtgcaccccgacccgccgcgcgcgaagtcggacggcgcccagtcgctggacttctccgagttcgagaagtccatgaacgaggtccgcgccatcgcccaggcgatgggccgcgaagtggtcaggctgggatag

SEQ ID NO: 5730 - DNA, 2073 bp, Myxococcus xanthus
ggtcgctaccgactgtccgcgcgaatcgcgacaggcggcatggcggaggtgtacctgggccgccgcatcgaggacgacggcagccgtgggccctcggtcgcggtgaagcggttgatgccgcacctcgcctcggaccggcgcgtggtgcagatgttcctcaacgaggcccgcatcaccgcgcaggtgcgacaccccaacgtcgtcaccatcatcgagctgggcatggagggcaccgagcccttcatcgccatggagttgctggagggacgttcgttcgccgagctgcgtcaggaggccgccgagcacggacaccgcgtgccgctgggcatcaccctgcgcgtgctggtggaggcctgccggggcctggacgcggcgcaccgcgccgtggatgaagcgggccggccgctgcgcatcgtccaccgcgacttcacgcccgacaacatccacgtgggtgtgaatggcgcggtgaaggtcatcgacttcggcatcgccaaggcggacgcgctgggctcgggcacggagcccggcatcctcaagggcaagttcttctacatgtcgccggagatgattgccggcaagccggtggaccaccgcgccgacctgttcgccgcgggcgtcatgctctacgagcagctctgtggccgccggcccttcaccggactgtccgccgacgaggtgctgggccgcatcgcggagggacgccccaagccgcccactgccttcgacccgtccgtacccaccgcgctggagctggtgtgcctcaccgcgctggcccgagagccggccgcgcgcttcgacagcctggaagacttcatcgccgccatcgagtcgattggtggcgcagcggagatggccacgcctgagcagttggccgcctacgtggattcgctcttccctccggaccgcgaccccaagcgactggccctgcggcgcgcgcggctcgcggacccgtcccatggaagtacgccggcgccccacacccggcccatcctgggcgtggtcgacgcgcccaccgcgtggccccaggtctcccggaccacgaaccccgacgcggcgacggtggcgggcgccacgcggaaggcacccacgggcacggccgcctccaccgcccaggatgagcacgccccgagcaggcgacgctcgcgcatggtcccgctcatcgcgggcgtgctcgcgctgggtgcagtgggcgcgggcgcgacgtggttcctcacgcgtcccgcagcgccccccgccgaacgcctggcccgggcggagtccgcctccacggcggatgcgaaggcggctgccctggagggactggcgtcggatgaccgagcaagcgcggaggagctgagccgggcgggcgcgctgctgctggaagccggcgcgcacgcgcaggccctggccctggcggatggcttcgtcgcgcgctttcccaaggacatcgaagcgcacctcatcgccgcgcgcgccgccacggagttgcgactgggcaagcgagccgagcgcgccctcgaggaggccaccgcgctggcccccaaggacctccgcccaccgctggcgctggccgagctgcgcgagcgtcagggggacatcccgggcgcgctggccgcgctggccacggtccacgcccggaagcccggctcctcggaggtgacgccccgctacggcctgctgctctcgcagagtggccggctggatgaggccgccagcgtgctctccgcgtggacacgctcccacgatgacgccgcgagcctcgccgagctgggcttcgtgcgcttccgacagcagcgcgtggacgaggccgccaccctgctcaagcgcgcgattcggaaggcgcccaagctcgccgtggcgcactactacctgggggccgtgctcttccggcaaggcgacaccgcgggcgccgagcgtgcctacgtcgaagcggaccggctctctcccgaggacccacgagcgctggcctcccgttgccagctccacgcccacaccggcaacacggcgggggtcaccgaggtgaagcgcgccttgtccgagcgcttcccgacgcgcgcggaggccctggccgcggagtgcgtcgcggtgaaatga

SEQ ID NO: 5731 - DNA, 1017 bp, Myxococcus xanthus
atgacactcaaggaagcgctgggcaaggtggtgggccggcgcgacctcacccgcgaggagatgacccgcatcatgggtctgatgctcgccggggaggcttcgcctgcccaggttggcgcgctggcgacagcgctgaagatgaagggtgagacggaggatgaaatcctcggcgcggcggaggccatgcgggcctgcgcggcgaagctgtccccgcgtgccgacgtggtgctcgacacctgcggcaccggtggcgacggcgcgcacaccttcaacatctccaccgcggtggccttcgtggccgccggggccggagtgacggtggccaagcatggcaaccgcgcggtctccagccgctgtggcagcgcggacgtgctggcggcgctgggcgtctccatggagcgtccgcacgagcgcgtggccagggacatcgacgagcacggcgtgggcttcctcttcgcgccctcgcaccacggggccctgcggcacgtggcgcaggcgcggcgggacatggggttccacagcgtgttcaacctgctggggccgctgacgaacccggcgggcgcgcgctaccagctcctgggaacgttcgacggcaagcgcgtggagcagacggcgcgcgtgctgggccggctcggcagccgccgcgcgtgggtggtgcacggccatgacgggctggatgaaatctccccgtgcagcgccacgcaggtcgcggagctgcgcgaggacggcacggtccacaccttcacggtgtcgccccaggacgcggggctggacgtagtgcctcgtgaggccatcgcgggtggcgacgcggaggagaacgcccagcggctgcgcgcgctgctggacggcgagcgctcggggctgcgcacggcggtgctgctcaacgcggcggcggcgctcgtcgtcgtgggactggcggcggacctgcgtgacggcgtgcggaaggcggagcaggccatcgactcgggcgcggcccgcaacaagctctccgccctcatcgaagggggcttgtcatga

SEQ ID NO: 5732 - DNA, 789 bp, Myxococcus xanthus
atgagcacgacgggaacgttggaccgcatcatggcgcgcaaacgccaggaacttgaagcgcgtccgcccatggcacctcgcccccggcccacgccccgcgacttcgcccaggggctggtgacccaccgctccgggcggcgagtgagcgtcatcgcggaggtgaagcgcaagagcccttcgggcggggacttcccccacgcggacgtggtggcggtggcccgagcctatgaagccgcgggcgccagtgccatcagcgtgctgacggatgggccggacttcggcggcagcctggaggacctcgtggccgtgcgggcggcggtgtcgctgcccgtgctgcgcaaggacttcctcgtggcggcgcgcgaggtggaggagagcgcgcagtggggcgcggacgcggtgctgctcatcgccgacgcgctggaggatggcgagctgcgggagatggtcgccaccgcgaaagcggtgggcgtggccgcgctggtggaagcccacacggaggcgcacgccgagcgcgcgctggccgcgggcgcgaagctggtgggcatcaacaaccgcaacctcgccacgctgaagacggacacgggcacggccctgcgggtgatgccgaacctgcgctcccgggcccgggtgctggtggcggagagcggcctcaagtccctggcggacctggtggcggcgcaggaagcgggagcggacgccgtcctggtgggtgagtccctgcttcgagagcccgaccccggacacgcgctgcggaggctgctcggggtgaaggacgcggcgccatga

SEQ ID NO: 5733 - DNA, 639 bp, Myxococcus xanthus
atgagtgtccgcgtgaaggtgtgcggcgtcacgcgcctgtccgacgcggtggccgcgtgggaggcaggcgtggacgcgctgggcctcaacttctacccgaagtccccccgctacctggacctccccacggcggcggccctggcccgtacgcggcctcccctgggcacggtgctgggcgtgttcgtcaacgcggcgccggacaccatccgggagacggtgcgcgcctgtggcctcacggccgtgcagctccatggggacgagcccccggaggcctgttcggggtacggggtgcctgtcatcaaggcgctgcgagtcacggggccggaagacgtggtccgggctcggacgtatgtgggcgtaggagacgtcgcggggctgctgctcgacggcgcggcgccggggtatggcggcggcggcgtgggcttcgactggtcgctcgtcgcggggctggcgggaagcggcgtgcccgtgctggtggcgggaggcctgcggccctccaacgtggccgaggcggtgcgcgcgacgcggccgtacggcgtggatgtggccagtggcgtggaatccgcccctggcatcaaggacgtggaagcggtgcgcgccttcgtgcgcgccgcgaagtccatcaacctctgggagtga

SEQ ID NO: 5734 - DNA, 1206 bp, Myxococcus xanthus
atgaccacggagactgccgccggccgcttcgggcgctacggcggacgctacgttccggagacactggttcccgcgctgcaggagctggaagaggcctacgccacggcgagcgcggacccggccttcggcgaggaggtcgcccgcgtgctgcgcgagtacgtgggccgccccaccacgctgacgcccgcccggcgcctcacggaggcctggggcggcgcgaatgtgtggctcaagcgcgaggacctggcgcacaccggtgcgcacaaaatcaacaacaccgtgggtcaggtgctgctcgccaagcggatgggcaagaagcgcatcatcgcggagacgggcgcgggccagcacggcgtcgccaccgccaccgcgtgcgcgctcttcggcctgccctgcgaggtgtacatgggcgcgctggacgtggagcggcaggcgctcaacgtcttccgcatgcgcgcgctgggcgcggtggtacggccggtggagtccggctcgcgcacgctgaaggacgcgatgaacgaggccatgcgcacctgggtgtcgcaggtgtcggacacgcactacgtcatcggcagcgcggcggggccgcatccgtatccgacggtggtgcgtgacttccagaccgtcatcggccgcgagctgcggacgcaagcccaggcggcctttggcggcctgccggatgccatcatcgcgtgcgtcgggggcggctcgaatgccattggcgtgctgcacccgttcattggcgacgccagcgtgcggctggtgggcgtggaggcgggaggccacggcctggatacgaagcagcacggcgcttcgctgacgctggggacagagggcgtgctgcacggctcgcgctcgctggtgctccaggacgaggacggccagattcaggaggcgcacagcatctccgcgggcctggactatcccggcgtgggcccggagctggcgcacctggcgaagacgggccgcatggaggtccgcatcgccacggacgacgaggcgctggcggccttctacgaggtggcgcgcctggaaggcatcctccccgcgctggagacgtcccacgccttcgcgcgcggccgggagctggcgcgtgagctgggggcgggcaagcacctggtcatcaattgctcgggccgcggagacaaggacgtggccacgatttccgcgcggggcgtgcctccgccggtgggggtgaaggcatga

SEQ ID NO: 5735 - DNA, 489 bp, Myxococcus xanthus
atgacgtacgtcaacctcatcatggccatgggcgaggcgcgttacgcgaagctcgcacgcgagcgcggcgtgtctggaaccatcctccccgacctgccgcccgaggagagcgcgagcctgcgcgccacgttcgacgcggagggcatggacctgattcccctgtgcgcccccacgacgcccccggcgcgggcgcaggccatcgcgaaggatggccgtggctttgtctattgcgtgtccgtgtcgggcgtgacgggcatgcgcgcggagctgccgccggacctttcacagcgattggatttggtgcgcaaggccgcgaccgtgcccgtggtggcaggctttggcatctccacggcggaacaggcacgcatgctgtctgcccatgcggacggcgtcgtggtgggcagcgcgctggtgcgtgccgcgcacaccgagggcctcgaggcggcgaaggcgctctgcgccgacatcaagcgcgggctgcgacgctga

SEQ ID NO: 5736 - DNA, 4251 bp, Myxococcus xanthus
atggatggcacgctctcctggcccgacccgagcttgccacccccgacggaccaggtgctcctcgccacgctggaggtcagcgcgctggcggccggccactgcgagacgcgagccttcaccggctccgctacgctgccggggccccaaacggacggaatctactacctcggagccatcaccgacgtgcaccagaccctcgtcgaactggacgaggccaacaacaccgcggtgaccgcgctgggcatcggaaaccggccggacctcgtcgtcacggagcttcgtggccccacgagcgtcacggacagcgggacggtcgcatcgacgctcaaggtgtgcaaccaaggcaccaacgtgtcggacgacaccatcgtggagctttacctctccacgaacggcacgctgtcacttccaacgacgggcggacctccccccacgaatcaggcctcacagggaacggtggaagtgcccgaactgctcccggcccactgtgccatccgccacgcctctttcccggtgatattgccgcccggcgcgacacctggtcagccgctctacctgggcgccatcgccgatacgcccgagttctccacggaactcaacgaggacaacaacgtcttcgtgggggacctcgtcgccatgggagcgggaccggacctcgtcgtcacctcggtgcacgcccccaccagcatccaaagcggagacctgctgggcgcctccgtgagggtttgcaaccacggcacgctgcccgcgaatcccagctcgctcgagctgtacctctccgtggatggcaacgtcaccgtgccaggcagcggcagcccaccgccgccgggacaggaacgggtgggccagacggatgtgcccctcctgaaccctggcatttgcatcactcgcaacgtccagggcgccgcgacgttcccagccggcgcacccgtggatggcgccctcttcctggccgccatcatcgattccacgcaagacatccctgaactgcgtgaggacaataacgccttcacccagggactcatcggcgcaggtgcgcgcccggacctcgtcgtgaccgcggttcgtgctccggccagcgtggccccttcggcatcttgggcccctgtcagcgtcacggtatgcaacgaggggaccgtcgctgcctcggcggtcccggtggatatctacctgtccatggtgccgacgctggactcgcctgccatggggggactgctacacgggacccagttcaaggtcggcggattcggcctctccagcgtcgaagcagggcgttgcgtcacacgcgaggagcccatcaccctggaccggcccctgggtgcgccaccccaactccaagcattctacgtgggcgccattgtcgaccccaggtcgaacatcgtggagcttcgcgaggacaacaatgcctttgtcggtgagcaaatgggtctcggcaacgggccggacctggccatcacctccgtgaagggccccgccagcagcatgcctggcgacgtgcctgtcaccgcccgcatctgcaatcagggcaccgtggcctcacagaacacccaggtggagttctacctggccgcgcatgccttcctgaatgctccgattcaggggggctcgccttacaacgccgacccgcatacggcgttctccattgggatgcaccaggtgccatcgttggatgcgggcgagtgcaggacgatctccacccttgctaccgcgatgagcttccccgcggagtacatcgacaaggcgttcaatcttggagccatcatcgacccatacgcgcaggacaatgaactccgcgaagacaacaacaccttcgtcggagacttcatgggcctgggccaccgtcctgacctggtggtcactgccatcgatgctcccgccagcgtgcgcgacagcatcctcttcgcgaccaccctgaccgtctgcaaccagggcacctattcctccgagcccacgatggcgcaggtgtatctgtccaccgaaccccacctggtgctgccagattggagcgggcatggaactccgctcccgtggagtcaaacgcccgtgggcgacgtgagcatccccaccctgcacgtcgggcactgcttcacagggcaagtgactggcgcggcctacatcccgcccggctcgcacggcgaggccatctatctgggcgccatcatcgatgcgaacgactccatcgaggagctccgcgaggagaacaacgccttcgtgcgcggccgcatcggcgtagggagcaaggcggacctcgtcgtcaccgccatcaacgctccgacaagcgcgcgaatccacagtgccttcaccgccaccgtgacggtttgcaaccagggcaccgactacgcgagttcctcggacctggaactccacttctcgaccctgcccacgttggaaatgccacggtggttcggttcgggctcccccctgcccgtcacccaggcccccatcggcaacatctcagtgccacacctggacgcgggccactgcatttcccaatccatccaggcctctacagagttgccacccgacgcactgtttgcccaacccctgtacctgggcgccatcatcaacggatggggcaacgtcgacgaactgcgcgaggacaacaacaccttcgtgagcggaatcatcggcgtcggtgatggccctgaccttgtcatcacggcggtgcaggcgcctccgaatgtcgggccgttcgcgacgtttcacccgaccgtcacggtttgcaatcaggggacggagccctcgaacagcaccctcgtggagttccacctctccacggaagaggcgctcgtcatgccgcgctggagtggacccggcaatccactgccaccgacgcagcagcccattggcgagctgagtgtccccctcctgaatccagggaggtgcttcacgggaagcgctgtcgcaacactgacgctgccgcccgcgacatcccctgaccagaaactctacctgggtgccctggtcgatgggatgcaatcccaggaggagctgcgtgaagacaacaacatcttcatgagcggacgcatgggcgtgggccatgcgtccgacctggtcatcacgtcactcacgggccccgcgagcgtcgaagccaacaccgcgttcaccgccacggtcaccgtctgcaatcaaggcacgtccgaatcctatcccacggaactggaggtccacctctccaccgacgcaagcatggccatgcccgaatggtacggcccgggaatcccgatacccgccagccaggtgtacgccggcgagttcggagtccccgccttgggtatcgacgattgcatcacgctgcaggtgccctcctggtcgaaccttcctgtcctggcccagcccgaacagcccttgtatctcggcgcggccatcaatccggacctgctcgcgggtgagctgcgcgaggacaacaacaccttcgtcggtgacatcatgggtgttggcgccggtcccgacctgattgtcaccgcggtgcaagcgcccgtcagcgtggaacgcaacggcaacttcactgcctcggtgacagtctgcaatcagggcacccaggcatcgggcagcgtgcagttggacctgtacttctccacccgggcccaggtcgtgatgcctcagtggaatgcaccaggtttcccctacccgcgcacgcaagcactcatcggcgcctggaacgtgcagcccctgaatccgggacaatgcaccacagagcccgtcctcgcgtgggtggaactgcccgaggaggccgagccccatcacccgctgtatctgggcgcgatcattgactcgaaccaggcgcaggccgagctgcgcgaagacaacaacatcttcgtcagcggactcatgggtgtgggcaaccagccagacctggtcgtcacctccgtctccggccccaactccgtgagaacgggaacaaccttcaccgccaccgtgcaggtctgcaaccatggcaccgcgcccaccaacggctccatggatgtggcgctgtacctgtcgagcaacaacacgctcgaattcccctatcaaagctggccgggcgtcccccccgacagtcagagccagattggagtgatgaccgtgcaatctctgcacgccgggcagtgcgtcacgcgcaacacgcaggtgacggtcaacacgcctccggattctggccccactgggttcttctacctgggcgccctcgtcgacccatggcagaacctcgaggaactgcgcgaggacaacaacgtcctcgcggaccggttcatcgcggtgatgccgtag

SEQ ID NO: 5737 - DNA, 630 bp, Myxococcus xanthus
atgagcgccgccgtcttcacacgcgacggcgagctcttcctctacggaaccagcggccccgacacccacagggtcagcggcttccatgccgtggacgtgacgacgggaaacctgacccgcctcctcacgcggccggtgccccagctcgcgaacggcgcgatgtgtggcgtctactcctggggctcgcctcgtccgcagccgacgacccgggaccgcggattcttcggcgccagcgagagcgccctcttggagtgcctggcatacggccccatctccctcggcgcgctcggcgaagtctccaccctcccaggtgccctgggcatcctctgggccaaccccgccatcgccgcgaacaacacgcgccgcacggccctggagtccttgaaggtccggacggcgcgcgaagcgctgacggcggtctgcaacgagcgcgtcttcaacacgcgcgcgcctgccctgtccgcgctggagaatcccgcgtcgctcgaacccggccgggtggaagagctgcgtcaacggctggagcggcacaatcactctggcaagcggaccgccatcccgctgcgaaaacgaatcttcgcggtggacccgctgcgagccatggagcgcgccgaggaacctcggttctga

SEQ ID NO: 5738 - DNA, 444 bp, Myxococcus xanthus
atgcgggcgctgggagaccccgtgctggacgccttcgaaatccgcctgcaaggccaggacgcggctcagtacgagaaggtcctgctgggcatgggacaggtcgaggtcacgtccttcggcgagcccgtccgcttcgagccctcgcccaacgcacgcgccatggatttgtcggacgcggaccacgcccacctcctggggcgcttcttcctgcccaggaacgtgaagcaggtggacatcaccgtgcgcttggacgacgtgggagcgttcaaggaagacagcctggcaggcctcatcaacgcccaagccggaaccatccagttctcgacgacgcgcagcgccctggagcaacgctcacgcgtcgtcatccacctgcacctgaaggacagcctcttcgacggcaggggtggaaagacgctcctgccggcgacttacatcgcccactga

SEQ ID NO: 5739 - DNA, 483 bp, Myxococcus xanthus
atgggccgccttctcggcgcgccgctgaaggcctggcgcttcgacaccgtctacaccagcccgctgagccgcgcggcggacacctgcgccctggccggctacggggactacgcccaactgcgtgaggacctcatggagtgggactacggcgactacgaggggcgcaccggcgcggagattcgcgccgagcggcccgactggaccatctggaagaacggcgtccccaacggagagaccgcggcgcaggtcgccactcgcgtggacagcgtcatctccgacgcgctccggacggacggggacgtgctcatcttcgcccacgggcacctgcttcgcgtgctcgcggcgcggtggctgggcctgcccccgtgggaaggccgcctcttcctgctgagcaccgcgtccatcagcgtgctcggccatgacggcgacaggcgccgcccggccatcgtgtcgtggaacgacaccacgcacctgcgcgcgtag

SEQ ID NO: 5740 - DNA, 987 bp, Myxococcus xanthus
atgacggtgacgcctcaggggctctactgcgttcccggcggcttccacgtcgacccctggcgtccggtggaccgggcgctcatcacccacgcgcatggagaccacgcgcgcagtggcagccaccgctatctgggcgcccgggcgggcaagggactgctccatcggagattgggcgcggacgcaaccatcgacacgctcgactacggcgaacggctgcgcatcaacggagtcaccgtcagcttccatcccgcgggccacgtgctgggcagcgcgcagctgcgtgtggagcacggcggcgagacctgggtcgtgtccggcgactacaagcgcgcgccggaccccacgtgcacgcccttcgaggtcgtcccctgccacaccttcatcaccgaggcgacgttcggcttgcccatcttccgctgggacgcgacggagcaggtggccgaggacatcctgcgttggtgggacaccaaccgcgcgctgggccgcgcggcggtgctgttctgctacgcgctgggcaaggcgcagcggctgctcgcggagttggcgaagctgaccgaccgcaccgtgttcgtccacggcgccttgcactccctggtggacgtataccggaacgcgggcgtccgcatgctgcccacgcaccgggtgtcggaggtggagaagggcacctcgttcgcgggagcgctggtgctggcgccgccgagcgcgagcggcaccacgtggatgcgccgcttcggtgagcacgaaaccggcttcgcgtccggctggatgcgcgttcgaggcaaccgccgccgccggggcttcgaccgcggcttcgtgctgtcggaccacgcggactggcccgacctgctgcgcacggtgaaggacacccgggcggagcgcgtgctggtgacgcacggctacgccgagccgctggcccactacctgcgcgagcagggcgtggacgccgcgcccctggccacgcccttcgaaggcgaagcggaggactga

SEQ ID NO: 5741 - DNA, 828 bp, Myxococcus xanthus
atggccgtgcgcatgcctgccctcgtggggtggggcatgggtctcctggccgtccattccactcgccatgcgcatccgctgactgttcatggttcccccgcagagccccggactcgtggagggcaacgtaggccgagcgcctccatgggaggattgccccaccgcgccccttccctgcatgacacccgatggatggagagacgaggacccatccaggcccctcctcatccgtccgcaaggctcagcagataccctccgagcccccctggccgacggacgcccgaagggtcatgctgggaacacgagaggccctccatggagattctccgagcgactccgtccgagcacacactgcttcgaaacctctacccgctctacctccacgacctgagcgagttcggcgtcgactacgccatggacgaacaggggcgctggcggccggacttcctgcccacgtggctgattcccgcccccgaggtccaccccctgctgctgcgctgggagggccgcgtcgtgggcttcgccttcgtgggacagtcccccttctcctacatgacgcctggacgcgacttccggatgagcgagttcttcatcctgcgaaacgagcggcgcatcggcctgggccggctcgcggccagggccgtgttcgacctcttccccggcatctgggagctgtcccaactgccgcgcaaccgcccggccatcgccttctggcgcagggtcatcgacgagtacacggggggcgccttcgaggacaccttcatcgatggttgccccgcgcaggtcttcgacagccggcagcgcgtggcgcccgctcagagacggtag

SEQ ID NO: 5742 - DNA, 1197 bp, Myxococcus xanthus
atgccccggcgtgaattgttcctgctcaacaagatgctcaccggcgaactgcgggtgggcgtgtcctccacgctggtggtccgcgcggtggcgcaggtggcgggcctgcccgcgcccagcgtggcgcaccggctgatggggacgtggacgccctcgcccaccttcttccggcagctcgtgtcccaggacgtgtcggatagcgacagctcccggccctaccccttctatctcgcgtcgccgctggagcagccaccaggggacctgggcgaccgggcggaatggcaggtggagtggaagtgggatggcatccggggccagctcatccaccgcaagggcagcgtgcacctgtggagccgcggcgaggagctcatcaccgagcgcttccccgaaatcgcggacgccgccgccgcgctacccgagggcacggtgctggacggcgaggtgttggcctacgcggacggaaggcccctgcccttcgcccagctccagcggcgcatcggccggcagaaactgacgcccaaggtgctggccgaagcgcccgcggcctacctcgcctacgacatgctggagctgggaggcgaggacctccggagccagccgctgcgcgtgcggcgcgcgaagctggaggcgctgttggaagacgtgcctcggctccccgtctcccccgtcgtgcaagcggcgacctgggaggacctggccaccgcgcggggcgaagcgcgagagcgcaacgtcgagggcttcatgctcaagcgcctggagtcgccgtacctcacagggcgcaagcggggcgactggtggaagtggaagattgacccgttcacggtggacgcggtgttgctgtacgcgcatccgggccacggtcggcgctcgtcgctgtacaccgactacaccttcgcggtgtggaacggcacggagctccagcccgtgacgaaggcgtactccggcctgacggacgcggagattggccggctggaccggtggattcgcgcgcacacgcgggagaagtacggccccgtgcgctcggtggaacctgaacaggtgttcgaactgcacttcgagggcatccagtcctcgccgcgtcacaagtcgggcgtcgcgctgcgcttccctcgaatcgcccgctggcggacggacaagaagccgcaggacgcggacacgctggactcactcaaggagctgctccatgccagcgggtag

SEQ ID NO: 5743 - DNA, 1388 bp, Myxococcus xanthus
ctgcgcggctggttccgcgcgaaggggtggacgccctatccatttcaagaagaagcctgggccgcccatgcgcgcggcgaaagcgggctcatccacgtccccaccggcgcgggcaagacgtacgcggcctacctgggtccgctcgcggacgtcgcggcgaatggacagccagggcttcaactcctctacgtgacgccgctgcgcgcggtgtcccgggacgtggagaaggcgttgagggagcccctcaccgtgctggacgcggacatcaccgtggagagccgcaccggcgacacgtcctcgtcggtgcgccagcgtcagcgggagcgcctgccgcaggtgctcatcaccacgccggagtcgctgtgcgtcctgctcacgcatgagcgggccccggagctgttcgcgtcactgcgctccgtcatcgtcgatgaatggcacgagcttctcggctccaagcggggttcgcagttggagctggcgcaggcccgcctgcgccacttcgcgccgggcctgcgcacctgggcgctgtccgccacgctggccaatctggaagaggccgcccgtcacgccgtgggcaccggccagacgcccacgattgtgaacgcggcgttggagcggcccgtcgttgtcgagacattgctgcccgagtccgtggatgcgttcccctgggcgggccacctgggcttctccatgctggcccgcgtgggcgcgtggctggacgcggagcgctccacgctcatcttcaccaatacgcgctcccaggccgagcgctggttcgaaggcctgcgcttcgcccgcccggagtgggagcacctcatcgcgctccaccatggctccatcgaccgcgaggagcgcgagcgcgtggagagcggcctcaaggaaggctcgctgcgcatcgtggtgtgcacctcgtcgctggacctgggcgtggacttcggcccggtggagcgcgtggtacaggtgggcagtcccaagggcattggccgcacgatgcagcgcgcgggccgcagcgcccaccgcccgggcgccacgtgtcacatcctcttagtccccacgcacgcgctggagctggtggagatggccgccgccaaggacgcgctcctgcgccgcgaggtggaggcccgcacgccgccggacaagccgctggacgtcctggcgcagcacctggtgacgtgcgcgttgggcggcggcttcacgcccgacgccctgcgagacgaggtgcgcaccgcggcggccttcgccggcctcaccgacgaggagttcgcgtggactttgtccctggtccgcgaaggcagcccgacactgcgcgcctacccggagttccggcgcgtggtggagcacgagggccgctgcgtcgtcgcggacgcgcgcgtggcccgcatgcaccg

SEQ ID NO: 5744 - DNA, 579 bp, Myxococcus xanthus
atgatggtggccggcggcccgcccgcgctcaccgtggtggcgccggtggagggtgacgggctggtcaacgtcaccatgaagagcaatggcctgctcaccttcggcagcctggaggcgggcgggaagcgcttccggttggacggaggcgtgggcggcatggactacacgcagggctacctggcgcggcacaccgcgtggcgctgggccttcgcgtcggggcggctggcggacggcacgccggtgggcatcaacctcgtggagggcttcaacgagggcaacgcggacgccaacgagaacgcgctgtggctgggggacaagctgtacccgctggcgcgcgcccgcttcgaatacgacgcgaaggacctgatggcgccgtggcggctggcgacggtggatggcgcggtggacctgcgcttccagccccttcatgtgcaccgcgaggaccggaacctgcgcctcgtcgtgagccacttcgcgcagccggtgggcttcttcaacggcacggtgcgcgtgggaagccgcacgctggagttgtccaacgtccccggcgtcaccgaggaccaggacatgctctggtga

SEQ ID NO: 5745 - DNA, 1158 bp, Myxococcus xanthus
ttctccgtcttccgcaaggagctgaaggaccacctgcgcgaccggcgctcggtgctcacctcgttgatgtggccgctgattggccccgtcgtgttcatggtgatgttcaacctgctggcctcctggtaccggcaggaccggccgctggcgttgccggtggtggggcgggagcatgcccccagcctgatggccttcctggagcgctacggagcgcagttggaagcggcgccggaggactacgagtcgcgcatccgggcgggctcgctggacgcggtgctggtggtgccggacgactacgccgaatcgtactccgccgggcgcaccgccgaggtgcagctcgtggtggacagctcgcgccagtccgcgcgccagtcggtgctgcgcgcgcggcggctgttggaagcgtacgcccacatgttgggcaaccagcgcctctacgcgcgcggcgtctcgccggacctggccattcccgtgcgggtgcaggaggcggacctgtccacgccggagcgcaccgcggcggggctgctcaacatggtgccgctcttcctggtcatcgccgccttcgcgggcggcatgcaggtggccagcgacgccatggcgggtgagcgcgagcgcggctcgctggagcccctgctgctcaacccggcgccgcggagagcggtggtgacgggcaagtggctggccaccgtggtcatggccgtcgcggcggtgctcattacgttggtgggctacatgctggtggtgcggcgcgtgcccttggaggacctgggggtgaaggcccgtttcgacgcgcccgccgccctgggcatggccgccgccgtgctgccgctggctctggccgcctccgccgtgcaggtgtgggtgtccacctatgcacgctccttcaaggaagcgcagacgtacctgtccctcctgatggtggtgcccatgctgccgggcatggtgctggccctgtcgccgctccagccgaagatgtggatgttcgcggtgccggtgctgggccaggaggtgctcgcgggcgaggtcatgcgtggtgagccgctgggcgcgctgccgttcctcatcgcgggcgcgtccagcatcctgctcacggtgttgtcgctggcggtcaccgcgcgtttgttgtcccaggagcgcatcgtcttcggccggggctga

SEQ ID NO: 5746 - DNA, 738 bp, Myxococcus xanthus
atgattgaagccaggaacctgcacaagcgctttggcaagaaggtgacggcggtggaggacgtatccttcacggcggaggacggcgtcatcaccggcctgctgggccccaacggcgctggcaagacgacgacgatgcgcatgctctacacgctggtgcggccggaccgcggcaccgcgctggtggacggcgtggacgtggtgcagcggccgcaggaggcccggcgggcgctgggcgtgctgccggacgcgcgtggcctctatccgcgcctcaccgcccgcgagcacgcgcgctactacggcgagctgcacggcctgtccggcgccgcgctggacaagcgcgtggatgaactgctggacctgttggacatgcgggacatcgcggaccgccgcacggaaggcttcagccagggccagcgcgtgaaggtggccctggcgcgggcgcttgtgcacgggcctcgcaacgtgctcttggacgagcccaccaacgggctggacgtcatgagcacgcgctcggtgcgcacgctgctgcggcggctgaaggacgaaggccggtgcgtggtgttctccagccacgtgatgcaggaagtggccgcgttgtgtgaccgcatcgtggtggtggcgcacgggcgggtggtggcggacgggacaccggatgcgctgcgcgcgagcaccggcaaggacagcctggaggaggccttcgtggccaccatcggcacggaccaggggttgatgcaatga

SEQ ID NO: 5747 - DNA, 1380 bp, Myxococcus xanthus
aggctgtcgttgaagccctgccgcctggaggggctggccacgcaggcccagtgtgggacctacgaggtcttcgaggaccgggcggctcgcacgggccgcaagattcccctgcgcgtggtggtggtgccggcgctggccgcgcagccgcagccggatccattggtgctgctggcgggaggcccgggccaggcggcgtcgcgctcgacgcaggtgctgatggcggtggagcgcatccgccgcaagcgcgacatcgtgctggtggaccagcgaggtacgggggactcgaatccgctgaactgcaagacggactcgccggaagaggggctgtccgcgcggctcgaggaaggcaaggcggcggaggaggtgcgcaagtgccgcgagggctgggacgccgatgtgcggcactacaccacgcccgtcgccatggatgacctggacgaggtccgcgaggcgctgggctacgagaagctcaacctctggggcgtgtcctacggcacgcgcgcggcgctcgtgtacatgcggcagcacccggagcgcgtgcggaccgccatcctggacggcgtggcgcccatggggttgtacctgccgctgttcgcgccccgcgacgcgcagcaggcgctggaccggctgctggcgaactgcgaggcggacgcggcgtgtacccaggcgtatccgaacctgcggcccaggacggaggcgttgctgacgacgctggagaccacgcccgcgcgcactcaggtggcgcacccgcgcaccggtgtgttggaggaggtcgtcctgtcgcgccgcgccttcctggcgcagctcttcgcgcagctctacagcccggagatgtcctccctggtgccgttgatgctggaccgggccacgcagggagactggtctcccttcgtcgcgctcagcgtgggcctgtcggagaacctgggacgcacggtgagccatggcctctacttcgccgtcgtgtgcgcggaggacgcgcccttctacgacgaggcggcgctggtgcgcgagtcgcagggcacctggttcggtccgacgatgggccgcgaagtcctctccgtctgcgcggactggccgcgtgggagccttccccagggctaccgcgagccggtggtgtcgtcggtgcccacgctgctcttgtcgggcgagctggacccggtgacgccgcccgcgtgggccgaggaagcgaagcgcacgctctccaacagcctgcacgtggtggtgcctggcgtgggccacaacacgattggcgcggactgcgcgcgcacgctgatgctggacctgctgacccaagggagcgtggaggggctgtcgtccgcgtgcggcaccaacctcacccgtcctcccttcttcacctccttcgccggcccggtgccttga

SEQ ID NO: 5748 - DNA, 1305 bp, Myxococcus xanthus
atgctcgtgccagtggcaccgctctaccgggtggtggcctgggcagcggatggaacgttctggctgggcgacgtggtgcccgaggagggggccaccacgggcatcgtggaggccgtgctgtctgcccgggcgcctaccggtgtgcgggtgcggctcgcgggagcgcgacccgagcatggcccgttctcacttcgtgtggtgcgtggtgtatcccgggacgctcgcgacgcggagcgcgcgagcgaactgttgcccgtgattcggcatgccgcgccggacatcgcctccgcgctcgcggacggtacggcgcttccacttcccgtggggaagtcgctggagttgctgcccttgcccacggaccccgcggtggggctggtactccggagcgcggcgggaagggaaagcgcgtgggtggaggtgcctctgcgcgaggggcgtgtggagccggcggtgctggacgtgggttcgctctttcccgatggcgtgggtgaggcggtgacgctgcgggggaagctggagctggaaggaacgttccgtccaccggagggcgcgaggctcctggggccgggggacgtggaaatcccgctcgcgcaggatgggcgctttgtcgtgtcggggttgccgtcctgggagccgtcccgcttccgcgtcgaggtggcatcgccagtttccagacgtccggtggccgcgacggaacaggctttcgatttcaggcccgagccgggtgtgcgggacgcagaggtgacgtggcgcgtgaaggcctaccggtggctcgtgctgcgcatggatggcgccatgcgggcacagatagaggcacggacccagaagccctatcccgtgttcgttctccagcggtggcaccacgagaagcagtgggagttggcctcctccggcgcatacatccaggaggaggatgggatggccgtgtccattctggagccggggcgctatcgattgctggtgtccttctctgttcatgaggtctacgccagcaccgccgcggacatgggtgaggacagggtggacggcaccgtcaccttccaggtggacatggaggggaacgattgcgaggtgctcgtcacggatgggcgcaagccggtgttcggcgcgcgagtcaccgcatcaagtgacgtgagctcactgcctcccgcgtggggactcacggatgcgcagggacgttggcggttggggcgcgtgaggccgttcggccttcacctggaggtggaggcggagggatacgcgccctggacaggggaagtcgccgaggcctgccggcgagggggcgaggttcgcgtccagctttag

SEQ ID NO: 5749 - DNA, 864 bp, Myxococcus xanthus
atgggatttccgtccttcttgttgcgcgtggtggtgctggccgtcctggctgttcctacgtgggcccaggcgggctcgtatctgcgcgtcgtcagctggaacctgcgtcacgaggggtggaccgcggagcagacgtatcgcgaggacgcggagcagatctggcggcagtacggcgcgaacagtaattccaacaacggctgtgacctggtgttcctgcaggaggtgatgaatgccagcgtggttccggccatcgtggcggagctcaacgcggtctccggcgtgaagtggcgctatgcgcagacgccgctcatcgggcgctcatcgtacaaggaaatctacgcggtgttgtaccgggaggacacggtgtcactgctgtcatccagtgtgtacgaggacaccggcgacacgttcgagcgcgagccgcaaatcgtccgcgtgcggcacacgcccacgggcgcggactacacgttcatcaactggcacaccgtctggggcaatccctccgaccgcgacgccgaggtgaaacagattggcgcggtgttcaagtcggtgcaggacgccagccgcaccgaccaggacgtcatcctggtgggggaccacaacatggcgtgcacgacggcgtcctgggcgaacctggtggcgctgtctcccacggtggaatgcaaactgaacgtggccaccaccatcaacctcagcggtggctacgtgaatgcctatgaccacttctggatgcagcccgaatacgtgacggagttctcctcggcggggcgcgactacatcgggaacacgcgggacttcgtcacccgcttggcggaccacgcgcccatctacctgacgctgtattccaccagcgatacggattga

SEQ ID NO: 5750 - DNA, 1317 bp, Myxococcus xanthus
atgtcctcccttccagcctcgcaggaccttccgcagcggccattgacccgtgacgacgcccggacgctcacgctggcggcgctggggggcgcgctggagttctacgacttcatcatcttcgtcttcttcaccaaggtcatcggcgagctcttcttcccgcccgatacgccggagtggctgcgacagctgcaggccttcggactgttcgccgcaggctacctggcgcgcccgctgggcggcatcgtcatggcccacttcggagaccgggcgggccgcaagcgcatgttcacgttgagcgtgttcatgatgtcggtgcccacgctgctgattggcctgctacccacctatgagaccgcgggctacgcggcgcccctggcgctgctcctgcttcgcgcggtgcagggcgcggcggtgggcggtgaagtcccgggggcctgggtcttcgtgtcggagcacgtgcccacgcgcagggtggggctggcgtgcggaacgctcaccgcgggcctcacgttcggaatcctgctgggctcgctggtggccacggcggtgaactcactgctgggccccgagcaggtgaacgcctacggctggcgagcccccttcctcatcggcggcgtgttcggcttcctggcagtgttcctgcgccgctggctggcggagacgcccgtcttcgaggagctgcggcggcgcaaggcgctggtgcgggagctgccgctcaaagccgtgttgcgaggccacggtggcaccgtggtgatgtccatgctgctcacctgggtgctcaccgccggcatcgtggtggtcatcctgatgacgcccacgttgatgcagaccctgcacgcaatcaccgccacgcaagcgctggtcgccagcagcgtggccacgctgagcctcacgttcggctgcgtggcgtatggcctgctcgcggaccgcgtgggcgtggggccgtcgctggggctgggctgtgcgttgatgctctcggcgacgtatgcgctgtacctgggcgcgtcgtcgccggaggcgctggtgccgctgtccgcgctggcgggcttctgcgtcggcgtggtgggcgtggtccccaccagcatcgtgcgcgccttccccgcggcggtgcgcttctcggggctctccttctcgtacaacatggcctacgccatcttcggcgggctcaccccgttggtcgtcaccttgatgatgaaggcgtcgcccctggcgcccgcgcactacgtggcggcggtgagtgtcatgggcgtggggattgcgctgcacctgctgcgcgcggggcggggagcggcgctgcaccccgccaccgagcgctga

SEQ ID NO: 5751 - DNA, 534 bp, Myxococcus xanthus
agcgaatggctgaaggcggaagcgttggcgcgggagcaggcgctggacaagcgggcgctcttcctgcggccgggcgactccgcggaccgcttcgggctggtgctccagggcgtcttccgcgcggtgcgcgtctccgctcggggcgaggagtccatcaaggccttccgcgccgaaggtgagttcattggcgcctacgcggagatgttgcagggtcaaccctccatgacggccatcgaggcgctggagccgggccgcgtgctggcattccaggcgcatgaccttcaatcgctggaggccagccatccctgctgggcccagctcgcccggcgggtggcggagcgtcactacatcctgaaggagcgccgcgagcaggagttcctcgacctgtccgcggaggagcgcctggagcgcttctggcaggaacatccccacctgcacgggcgtgtccctcagcgggacgtcgcggcctacctggggatcaccgaggtggccttgagccgcatcgtgtcacgccgccgcaagcgggcggagtga

SEQ ID NO: 5752 - DNA, 1131 bp, Myxococcus xanthus
agccagggtgtcatgggtgagtccgccatgctccggcacgttccctacgagctggtcagcggcggcgaggtgctggcctacgcgggcctgggcatcgcctgtgggctgctcgccttcaccttcgtgcagttgctgcacggcgtggagcactacttccatggccatgggaaggaccggctgtcctcgtggctgggcagcaagccgctgccgctgcgcgcgggactgggcggtctttgcaccggcatcctggccttcgccagccccaccgtctggggcagcgggcacgactacatcaacctggccgcgctgggacggctgcccttcctgttcctcatcaccgcgtgtctgctgaagctggtggccacggccctcaccatcggctcgggtggctcgggcgggacattcttcccggcggcgctcattggcgccatggcgggcggcgccttcggcaccctggtgcacttcttcttcccggagagcaccggccccagtggcgcatatgccctggtgggcatgggcggcgcggtggcggcgctcacccgcggcccgctcacgggcatgatgatgctgtacgagctgagcgggaaccacgacatcatcctgccgctgatggtgacgtgcaccatcgcctcggcgctctgccactacctcaccgagcggaagacgccgaaggtccagagcgacacggacctgctggaggccacccccgtccgctcgctgatggcccacctgacacccgtgcccgcgggcacgccgctgcgggcgctgacggacctgctgctcacctccgaggcgggcaccctgcccgtcctggacaccgtgggccgcatctacggcaccgtgcaggtggagcaactgcgcgaagtgtggcgcgacgaatccgtatacccgctgctggtggccagtgacctggcgcgcaagctgcctgcgctctcccccgacgcgaacctgtcccatgccctccacgtcatggaccaggaggacgtggatgccctgcccgtcagtgtcccggtgggcagccccacctgcgggctgctcacccgcgccgcggtgcgcaggttcctcttcgcgcagcatgcccaggcccacgcgtcgggcaactacccggtcagccccaccgaggcgagctga

SEQ ID NO: 5753 - DNA, 627 bp, Myxococcus xanthus
atggtgctggggcccatctacatcttcgagaatgcctcgccgctggagcccacggcctcggcgccgcgcgtcctgcaacggctgggacagtggttgctgcccaccgcgcacgcccacgacgggcacttcttctccggcggcacggtgctgggcgagtgggaccgtgaggtggtgttcgacctgctggaggaggcgggcgaggtgcgggagctggggcgctcgccgggcatcgccgggctggcgcgctccttctcgctgctgctccagccgccgtcccgggccctgggcgcggaaggggcggcgctgggaggccggtcgatgattctggaaggaaccgcctcccggcaggagacgcacgtcccgttccggatggccctggacttccctccgcccgtcgagctgcaacgcgtggacttcgtgcccatcgcggcggagctcgatgagggcggccgcttcgtcgtggaggtgcagccccaccgctggttcgatggcgcgcacttcgaccgcgtgacggtgcccgagggcggcggggtggtggacctgacgcccgacacgcaggtgtaccgggcgctgacgctcaacgtgcgccgctacacggccttcgccgggacgtgggagcccgcctga

SEQ ID NO: 5754 - DNA, 1965 bp, Myxococcus xanthus
atgttgctggcgcccggcgtcatgctggccaaccacggcggcgagggccacgcggagagcatctacatccgaggcttcgacgcgggagagggcaaggacgtggagctgcgcctcaacggcgtcccgctcaacgaggtgtcccacgcgcacggtcacggctacgcggacacgtatttcatcatcccagagctggtggagtcgctgcgcgtcaccgaggggccctatgacccatcccaaggcgacttcggcgtggcgggcacggtggagtaccagctggggctggcgcggcgcggactcaccgcgtccctctccacgggcagctacgccgcgcggcggctgtccctgctctgggggccgccagaggccagtgaagccaccttcgtgggactgctgctgcgtcagggccacggcttcggccccaaccgctcctacgccaacgcgggcatcatggcgcaggtggagctgcgcgtcggcgacgagtcacggctgcgcttgttcggcaccagctatggctcgcgcttcgcatcgccgggcgtggtgcgggagacggacgtggtggactcccggatgccgtgcgctccagattcggactcgcagttcttctgttcctacgaccccaaccagggcggggcggggcagcgccacatcctctccgctgaactccagtcacggctgaagcgcggcgggcgcttcgtccagcagggctacgtcatcctgcggcagacgcgcatccgcgacaacttcacgggcttcctgctggacaccaccccaccggacggagagcgccagcgcggtgacaacacggaagggtactaccgcggctccaccatgggcctgcggggccgctacaccccgggactgacgctgttaggacagccgcagccactggagctcggctacgtggcccgttacgacgacgtgcgcacgcgctcgcgccggctgagggacagcggtggtgtgccctacgccaccgtcttcgacaaccaggtccgcaccacgaacctcggggcctacgcctcgttgcgagctgcccccgtgtcgtggctcaccctgcgcggcggcgtgcgcctggacaccttcctcttcggcgtggacgaccacaaccggcccaccgaggaccgcgatggtccccgcctccccgacgagtccctggaggcctacggcttcttcgccagccctcgtgcctccgccgagattcgcctgacgcctcgcctcacctggctcaccagcgcgggtctgggcgcgcgctccagcgacgccgccgcgctgtccgacgcggagctggcgccctacgcccgcgtggcctcgggtgagacggggctgggctggcggctggacgggccgctggcgctggaggcacgcggcgccttcttcgccacgcgcgtgtcgcaggacttcgtgttcgacgagacggtgggccgcaaccagccggtgggcgcatcgcagcggttgggcgccttcgtcagcgcgcgcgggacgctgcgggaccaggtggacatccaggcctcgctggcctgggcgcgcgccacgctgccggtgtccggggcctcggcgtggaagctgtgggacgggacggtgatgccctacatcccggagttgctgggccgcgtggatgcgtcgctgcgaggcaccaccctcgtagcgggtcagcaggtggactggaacgtggccctgggacacagcgccatcggcccccggcccctgccgctggaccgctacagcgcgcccatcttcctgttcgacgtgggcacacgggcccggtggaaggcggtggaggtgggcctgtcggtggagaacctgctcgacacgcgctggcgcgagtcggagttcaactacgtgtccaacttccgcggtccggatgcgcccccatcgctgatggccacccgtcacttcaccgcgggcgcgccccgcaccttcatgggcacgctcaccctgcacctggacctccaggaggactcgccatga

SEQ ID NO: 5755 - DNA, 1296 bp, Myxococcus xanthus
atgaccaccctgctgcagcggcagaccaccagcctcatcgacgcggcggagcgggtgcgcgcggcggccgagctggaattcaccttgctgctgctccagtacgctcacgaagtggaaggtatcgggcccacggacatcgggccgcccgtcggggtggacgcgctggtgcgcgaggtgccagagcggctggcccatgtcgagatgtacacggagacggaggcggagcgcgggctggtggcggcttcccgcgcgagcgtcgaggcctacctcaatgcgccggagccggaccggcggcggcggttggcgcaggcggtggatgcgacgcgggcggtgatggactccagcatcgcgcgggcgcgcatggctcgcgacgaggcgaccgccgtgcggagaacggggcggctccttggaacgttgctcgcggtgtcggtgctgacgggcgtggtgctgttcctcgccatcgcgcagacgagcatctaccggccgctggtggccatccgccgcgcgttgagtgcgttcaagtcaggccggcgtgaatcccgggtggcgcgcgcggggccgccggagctccaggagattggcgcggagttcaacgacatggcggagaccgtcgccagtcaggacgcgcggcagctccagttcctcgcgggcgtggcgcacgacctgcgcacgccgctcaacgcactgaagctgtcggcgcagatgctgctgcgggccaagacggcgcctccgccggagaaggtgcgcgattcgctggtgcgcatctccaaccaggtggaccggttggagcgcatggtgggcgatctgctggaccggacgcgcatcgaggcggggaacctggagctgcggctggaggagtgtgacttgcgcgcgttggtggaggaggtggtggagctccaccggccgtccagtgagcatcaccggctggagtactccgtgccggactcgcccgtgccctggcggtgtgattcgacgcggctgtcgcaggtgctcaccaacctggtgagcaacgccatcaagtactcgcccgagggtggggtggtgtcgctgcggctggagtcctcggagcgcgacgtgtcggtgtccgtgacggatgaaggcgtggggattccgcccgacgacctgggcaccctcttcgagccgttcaagcgcagccggaccgcggcgaaggacatccccggcgtggggctggggctctccgtgtcccgccggattgcccgggcgcacgggggggacatcgaggtggagagcgtcgtcggcacgggctctacgttccggctccgcctgccgcgctaa

SEQ ID NO: 5756 - DNA, 420 bp, Myxococcus xanthus
atgaaggtcagccgtccccgtaagctcttcctcaacctgcccgtggccgacctgaagcggtcggtggacttcttcacgaagttgggcttcgagttcaacaaggacttcaccgacgagcacgccacctgcatggtggtgggcgaggacgcgttcgtgatgctcctcacgcatacccgcttcaaggacttcatcaagaagcccctgcacgatgcgacgcagagcaccgccggcacctatgcgctgtccgccaacagccgagaggatgtcgatgagatggtgaagaccgcgctggcgaacggtggttcacccgcggcggacgccatggacatgggcttcatgtacggcgggagcttctacgacccggatggtcaccactgggaggtggcctggatggacccgaaccagatgcctccgcagtag

SEQ ID NO: 5757 - DNA, 978 bp, Myxococcus xanthus
atgaaggaccttccggattctgggaagcaggcatttggcttcgaggcgcaccgctcggcgctcatgggccattgctatcgcatgctgggttctgtctcggaggcggatgacgccgtccaggagacgatggtgcgcgcctggcgcgcgagggaccggttcgagggccgtgcgtctccacggacctggctgtactccatcgccacccgcgtgtgcctggacgccttgtcggcgagcgggcgccgcgcgcggccgatggagctggggcccgcgtactccatcgacgggccgctgacgccactgccggcgaacagttggattgagcccattccggacgcgctggcggtgccgtcggacgtggacccctccgagcaggcgtcactgcgtcagagcatccggctcgcgttcctcgcggcgcttcaacacctgccccccaagcagcgcgcggtgctgctgctggccgaggtcctgggctggccagccacggagatcgccgagacgctggagacgtcggtcgcctcggtcaacagcgcgctccagcgtgcccgggtgactgtgtcggacctgcggctggaagactccgagttccgggtgcctcagtccgacgcgcaggtggcgctgctgaatcgttacgtggatgcgttcgagcgctacgacatggacgccttcaccgcgattctccacgaggaagtcaccctctccatgcccccgtacacgctgtggctccaggggcacgcgtccattcgcggttggttcctcgggcgaggggcggtctgcagggactcccggctggtgaggaccgaggcctgtggctcaccggcctatgggcagtaccacgcgagcagtgacggcgggcccttcaagccgtggtcgctcatcgtcctggagctgtccggtggacgcatcgcggcgatgacccatttcctcgatacggaggcgttgttcccgcggttcggccttccccaggagctccctcggtag

SEQ ID NO: 5758 - DNA, 1176 bp, Myxococcus xanthus
cgggtgaaggtgttgttgctagagggcagtgacgcaccggggggcagggttcgcacggatgtccatgagggctttctgctagacagaggcttccaggtgtacctgtccgcgtatccggagggccggcgcacgttggaccttgaggcgctgacgttgcgcaggttcgcccccggcgcgaaggtgtggcggggtggcaagttgcacacggtcgcggacccgctgcggcgccccgtggaggcgctcgggcacctgtttgctcccgtggggacgttcggggacaagctgcgcatcctggaactgaggcagttggcgctctccggtgaggtggaggacgtgtggcatcggccgtcacgcacgtcgcggcgctacctggacgaactgggcttcacggaggccttgcgtgagtcgttcctgcgtcccttcttcgctggcatcttcctggagcgggagctgaccacctccagccgcttcctggagttcgtcttccgcatgttctcatccggatacgcggcggttccggagtcagggatgggcgccattccagcgcaactgtcggcgcgccttccgtcgggcctgctgcggatgcgcgcgccggtggcggacgtgtggggacaccgcgtgcgtctggcggacggagagttgattggcgccagggcggtggtggtggccacggacccggcgagcgcggtggagctgctgccgggcatggtgccaccggtgatgaaccgggtgacgtgcctctacttcgccgcgccggagccgcccgtggaagggccctggctgctgctcaatggcgagggccggggccgggtgaacaacgtggcggtgatgagcgaggtgtcaccggcgtatgcgccgcggggacaggcgctcgtgtccgtgtccgttgtcggcgccacgccggacctggccacgctgcaagccgaggtgctcgcggagctgacggactggttcggtccggccgtgtccgcatggcggcacctgcgcacctatgcgattccgctcgcgctgcccgcgcagcctccggaggtgttggagccgcctcgccggccggtgcggctgtcaccgggactgttcgtgtgtggagaccaccgtgacaatgcctccatcgacggcgcgctggtgtcgggccgccgcgccgcggaggccgtcctgagagagttggaacgcgaatga

SEQ ID NO: 5759 - DNA, 114 bp, Myxococcus xanthus
atggcgctgcgccatcgcgagcggcccgtggtgggcgtgcagttccatccggagagcgtgcttacacccgagggccccgcgctggtgcgcaacttcctggaagggcggttgtag

SEQ ID NO: 5760 - DNA, 1473 bp, Myxococcus xanthus
tcagcctatcggcagcgcgcggagcagggtgaggcggtgccggtgtcggtggagctgccggcggacctcgatacgccgctgtcggcctatctgaagctgggcggtggttcgcgcggcttcatcctcgagtcgtgttacggcggcgagcggttcggccgctacagccacatcggcgcggagcccgcgggccgcgtgcgcttggaccggaacggtgccaccttgtggcgcggctcgcgcgaggagcgccgggacggcaatcccctggatgtgctccgccagctctggcgcgagctggccgtggcccggctccctggagaggcccccttcctcggcgggctcgtggggtacatgggctacaactgcttctcgtggctggagccctcggtgccggaccggcaccccagcgacatctccttcccggactcggaatggctggtgtgcgaggacttcgtcacgcacgacacccgcaccgggacgctcaaggccaccgccattgcccgtccgtcgctgcacggcagcgtggccgccgcgctgaaggacgcggaggggcgcgcgcaggccatggcggatcggttgttgaaaccactgccaccagaggcctatgcgcccgagccgcgcatgcgtggggacgcggcgcctaccgcgtgctgggaccgcgcggggtatgagtcggcggtggctcaggcgcaggagtacatccgcgccggagacatcttccaggtcgtgctcgcgcgccgcttcgaatcccggggcgcgccgccgccgctgtcgctctaccgcgcgctgcggcgggtgaatccatcgccgtaccttttcctcgtggagctgggcgaggcccgcgcgctggtgggcgcgtcgccggagttgctggtgcaggtgcgcgacggggacgtggtggtgcggcccatcgccggcacccggcgccgtggtgcgtccgaggccgaggacctggcgctggagaaggagctgctcgcggacgagaaggagctcgccgagcacatcatgctggtggacctggggcgcaacgacgtgggccgcgtggcggcgcctggctcggtgcgcgtcgaggacatgatgctcatcgagcgctacagccacgtgatgcacatcgtgtcgcaggtgcgcggcaagctcgacgcgaagtacgacgcgctggatgcgctggccagcaccttccccgcgggcacggtgtcgggcgcgcccaagattcgcgcgatgcaaatcatcgacgagttggaggtccagcggcgcgggccctattcgggcgcggtgggctacctgtccttctgcggcacgctggacgtggcgattgcgctgcgcaccttcttcgtggacggagaccggacgatgtggacctcgggcgcgggagtggtcgcggactcggtgccgtcgaaggaagcggacgagacggaagccaaggcgggcgccatggccgccgcgctgcggctggcgcgcgagggaggtggccggtga

SEQ ID NO: 5761 - DNA, 1221 bp, Myxococcus xanthus
tgctctaaagcagcgtccgcgctgcgccaatggatggaggatgggcgggagaagtacggcatcgcctaccagaagttcatctgcacctccgcggacaacctgggctactacgcgccgtggcggctggcgcccacgctgcgcttcaagccctggcagacgctgtaccggcaactggacggcttcttccacgatgaccgggtgacgtacgccctggcgtacccgtccaagtacctgggcctgcaccccacgacgtgctcgtcggtgttcagcgtgattcccttcctggagctggccttcggcgtctggcacgtggagggcggcttccgtgagctgtcgcgcggcatgatgcgctgcgcgcgggatttgggcgccaccttccgcatgggcacgccggtggagaaggtgcgcgtggacgcgggccgcgcggtgggcgtgaagctcgtgggcggcgaggtgctggacgcggacgcggtggtggtgaacgcggacctggcctacgcggcgcggtcgctgattccggcggaggcgcgggaaggctcgcgactgacggacgcggcgctggagcgcgcgaagtattcgtgcagcacgttcatggcgtactacggcctggacacggtgtacgccgacctgccgcaccatctcatctacctgtcggaatccgcgcggcgcacggaccgtgacgcgctggaggaccggcacgttgacctggaggacccgcccttctacgtgtgcaatccgggcgtgacggacccgtccggcgcgccggcgggccattcgacgttgtacgtgctggtgcccacgccgaacacgggacgtccggtggactgggtgaagacggagcaggcgctgcgcgagcgcatccccgccatgctggagaaggtggggctgaagggcgtgcgcgagcacatccgcgaggagcgctacttcacggcggagacgtggcgggacgacttcaacgtgttccggggcgcggtgttcaacctgtcgcacacgtggctgcagttggggccgctgcggccgaaggtgaagaaccgggacatcgaagggctgtacttcgtgggcggcggcacgcatccgggaagtggcctgctgaccatcatggagagcgcgaacatcgcggcggactacctgacgcgcgaggcgggcaagggaccgctgccgggctggccgtatgtgccgccgctggagccggagtcgcccgttcaagctcgcgcggggtga

SEQ ID NO: 5762 - DNA, 855 bp, Myxococcus xanthus
atgcccttcttcatcccattcgcggtgggtggcctggtgctgacggcactgggcctgggtgtgaggaaggtgctgacggagacgggcgtcaccacgcctggggatgcccggctggccgaggcgcgtgagcggcaccgcggggcggtggccgcgctccgggcggaccgcctccaggttcgcgatggcgtggccacccatggcgcgctccaggcgcgggtgcacgtggaggtgctggtgcccttcggcgcgctgttggagcggctggagcgctgggggcacgtccaggaagccgagctgctcgaacccgaggcgctggaggcgctgcgcgcgctcctgcgcgaatccccgtcccgcgcgacgcggcgaaactggcccctgctgggcgcgggtgccgaggtgcccgccgcgctggagtccgtgctggcgtggctggaccggggctggctggacgaggattcgccgccggtggtgctggatgggacgccgctgtacgcagtcatctcggcccgcgccatcctggcggggagcgctccggaggagggtgcgcgggcgctcgatgaggcctccgcgctgctggctcggacgacggcgttcctgggggcgctgcgcgtgcggctgacggcgctggagcagcgggtggcggggctgcatggacgggcctcggcgcagctcgcctacctggacgcggccagcttcgaggcgggcggcgaggagccccgggagcggctgacgcggctggcggtgctcgtgggccaactcgccgtgctgctgcgcacgcccgtgctgaactcggaggggcgtctgacgcccatgctcgccgcgcgtgcggaggacgacgcgccttccaacggttga

SEQ ID NO: 5763 - DNA, 540 bp, Myxococcus xanthus
cgcaccggccagactccggggcgacgcgaggacgtcatggccaagacgaagctgctgaagcaaggcgatgcggtaccggacatcaccctcaccggcgcaggtgggcaatcggtgcggctgcgagacctggtgggtcagaaggtattggtcgtctacttctatccgaaggacgactcgcccggttgcacggcgcaggcctgtggactgagggaccagtacgaggacttcgtcgccgcgggcgcggaggtggtgggcatcagcggtgattcggtgggctcgcacgagggcttcgcggcgaagcaccggctgcccttcaagctgctcagcgacgcgcgcggcgaggcgcgtgaggccttcggcgtgtcctcgtcgttcctgggcctgctgcccggacgggtgaccttcgtggtggaccgttcgggcatcgtccgcgacagcttcgagtcgcagattcgcgtcggcgagcacgtacggcgcgcgctcgagttggtgcgcgcgctggcgcaggaaggtggcgcgccggcctccgccgcgaagtag

SEQ ID NO: 5764 - DNA, 192 bp, Myxococcus xanthus
atgggcgagtggaccgacaaggccaagggcaaggtcaaggaagtggccggcgtcgcgagcggcgaccgtgagctggaggccgagggcaagcgtgactccgccaagggcgccatcaagggcaagattgaggacgccaagcgcgccatcaaggacgcggtcgactccgacaagccgcgccggggcgagccctag

SEQ ID NO: 5765 - DNA, 1320 bp, Myxococcus xanthus
atgctgcaccgcgagagcatctccagcccgaaggactggatggccggcgcgcaggcctccgcgcagctcttcgaggagaaaccagtgctcggtgggcagatggtctcctcgcggcacaacaacctcatcaccgcgggcacgcaactggacaccgcgctgcgcaacctgggcaagccgctgttcgctggcctccacgcgcgctaccaggggggctgggcgtggatgaaggtgctcatcgagcaggcggagtccgactggcggcacagccccgcccgtggcctgcacggcatcgacctgtggggcggcccggaccaggagccggcggcgcactacctgaagctgggtgagaagcccatcgtcccctgcggcggcggccagtggggcgactacaacggcgacggcgcgccggactacctgggcgtcgacccggctcgctggaaccacgacgtgctgcgcccgctgctcatcgcggacaacatgaacgtggaccacgccaccatcgacctgtgtggcgaggggagctggcagctctactcagaggtcttcacgggcctcggtgggctgtacaatcgcacgtaccatctggtgtccacggtgtacgtccgctacacctactgggacaccgcgacgaatgcatggaagtccgagcgggtgttcacgcaccgcttcaccggaggcgaatcgttaggcgtctttgttcgcgagcaggatcgccccacctacaacccgaacaacacgcggaatccccaggagtggatggcgaagcggtggggccacgtctcgcagaacatcgcgtcgttcgactacgccggggccaatgacttccgcgccgccgtccgcacccggatggtggatgtgctgaaggaacagcagcgccagttctacggcagcatcgccacgcgcatgggccaggcgggagacgcgttgcaggtccaggcgaagcggatgacgggcacgcggctgttgtggcagtcctacgcggcgctggcgttgccgctgtcgctggaccacgacgagcacctgcgcggtctgctgtacggcgaggacgcggtgctgtcgggccacgacacgccgcaggacgtggaagtcaccccggtgctgaacgacgtgatggacatgtacgcgctgttcagcgccacggcctcgcccccggcccacaacatcctggcggacctgcacccggcggtgacgtcgcgtgccgacaggctgaaggccgccatcgacgcctccctggatgcccaggcggaggcgggtggccccgaggcgagcgcctgggtggagtcgacgctgctgcggctgcggctcagcgtcccgcagtga

SEQ ID NO: 5766 - DNA, 1074 bp, Myxococcus xanthus
atgacgccaggcgccgcgcggccgtccacggagcggcggagcgaccggttgcctccgggaggctgcaaggtgccaccttcaccgctacacgcatactcacaaggtgagtcgggtggaagggaaggagggatggagatgaggccgtcacaactttcgaggacggcagtgccgctgctccctccagggctcgcccgggggcagcggggcgtgtcgcgcctggtgctgggaacggatttctcgctgcgctccgagttcgcgctggcgcgcgcgctgcgccttccgctggcgcacgggagcgtcttctgcgtgctgcacgtggcccccgtcctggacgggcaggaggggccaggtgggacgctgtcgggtgcacgctgcctgcgcaaggcggtgagctccgtgtgcaggcggctgcgcaaccgcgtggacatcgacgtgcgcgaggagctcgggcgaggggacccggtggaggtggcgtcggccgtggcgcggatgtcgggcgcggagttggtggtgctggggcgtccccatgtgacgtacccggtgcgcgcgctggccgaggattcgacggtgcggcgcatggtgcgccatctgggcgtctccgtgctggtggtggtgccgcacccggtccggccctacggcaggcccctggtggcggtggacttctcacgcgagtcgcgcagggcgctggagctgaccttgcgcctgtgcccggcgcccgcgctggtggacgtgctgcacgtggtggacacggcggcgcaggaggcggagctgcgccgcgcccatgcgccggccgagcggtggctgctgctgcggcaggagcgggagtatcaggcgcgggtggcgcttggtcgcttcctcgcgccctaccgggaggcgggccgcgagttggaggtgagggtgcgctgcggcgagccggccgaagagggcatcctggcggaggcgttggagcggggctcggatctgctggcgctggccatgtccgccgtggaggcgcgcacgccgctgacagagcaggtgctggcgcgcgcgggctgcgacgtgttggtgtcgcgtcacctttcgcctgcatcctga

SEQ ID NO: 5767 - DNA, 1572 bp, Myxococcus xanthus
atgctgggctcggcggtggtggaccgcgggctgacgctgacgcgcgagctgcttcgcgccaacctggggaacctgctcaatgagcgcatcctccagaaggcgctggcgctggagctgcggcacttcgaggactcggccacctacgacaagatgcagaacgcgcggcgcgaggcgaacagccggccgctgtcgctggtgacgcaggcgttctccatcgtccgcaacaccatcaccctgggcaccttcgccgcgttgttggtggcgttgtcgccgtggagcgtggtggtgctggtggccgcgtcggtgccggccttcatcgccgaggcgcggctggccatggcgggcttccggctctactcgtggcgcgcgcccgagggccgcaagctgaactacctggagtggattctcacgcgggacagccacgtgaaggaggtgaagctcttcgggttggggccgctggtgctgggccgctaccgcacgctcttccagaagttcttcgcggaggaccgggcgctggccttccggcggatggcctggggcctggggctgggcgtcctctcattgggcgccttctatggctgctacctgctggtggcgggccgcgcggcgagcgggacgattaccgtgggcgacatggtgctgtacctgagcgtgttccgtcaggggcaggcggcgttccagggcatcctgaccagcgtgggctccatgtacgaggacgcgctcttcatgagcaacctgttcgcgtacctggacatccccaccggcggcgaggcgacgcgggtgctgccgccgctctctccgccgcgtgggcacgacagcgccatcgagctgcgtgacgtgtccttccgttatccggggaaggatgcgtgggcgctgaagaacgtgtcgctgtcgctgaagccgggacagaagctggcgctggtgggagagaacggggcggggaagagcacgttggtgaagctgctcctgcgcctgtacgagccggtggacggcgacatcttctacggcggcgtcaatctgaaggacatggacgtggaggacctgcgcaaccgcttcggcgcggtgttccaggacttcgtgcgctaccagttcaacgtggcggagaacatcggcctggggcacgtgccggcgctggaggaccgcggccgcattgagaaggcggccgaggagggcggggccagcggtgtgattacggcgctgccacagcagtacgacacgatgctgggcggctggttcgagaaggggcaggagctgtcggcgggccagtggcagaagctggcggtggcgcgggccttcatgcgcgacgacgcggaggtgctgattctggacgagcccacggccagcatcgacgcggaggcggagcacgcgctgttcgagcgcttccaggcgctggcggcggaccggattgcgattgtgatttcgcaccgtttctccacggtgcgcatggcggaccagattgcagtgctccacaacgggcaggtggacgagctgggcagccacgacgagctgatggcgaaggacggccgctacgcgcacctgttccggctgcaggcgcgcggatatcaggactga

SEQ ID NO: 5768 - DNA, 1947 bp, Myxococcus xanthus
atgaagaaggcggacagtctgctggacgagatgccgccgcagctggaccaggcgattccgttgctgcgcgaagtcgtggcggcggagcccgagcacctgctgggactccactccctgagctggtgtttggacccgacgcggagcatggagccgcaccgttgggagcaggagttgaaggccgagcactggcggttgcgcgaccgcatcctcgagctgacgcgagggacgaagcccggcggcgcgctgacgctcgcccatcgtgcacgttcgttggccctgagccagtgggcggaagacttggtgcggcgcaagccgaccgtggcgcagctcgacgaagtggaggccgcgctgaacgaagccaacagccttcgggaactcgtgaaccaccagcgtggacgccgcgggctcgaggcctggcacgcattgacgcaaggcaaaccggagcagggctaccgcgagttgctcgccaaggtggaggagtctcctggcatgtgcgcccagggcgtgatggacgatgacgactcgctcaacttccagggcctggagggcgcctactccgatgagggcttcctggcctggctgcggaagcagaagcccgcggcacgccccgcggggaagaagggcaaggacctggatgccggactcctgctggcggcggggctggatgcgaagccgttcttcggccctggcttcgaagggaacagtcgcatgggccgggtgctggccctggtggcgttgggcgcggacctgaaggcgagggattccagcaagcacagcgtgctccacctcgccgcgatggtggatgacgcggcgctggtgaaggagttgctccgcctgggcgtcgccgccgacgtcgtcgattcgaataagtccacgccactgcatgtcgcggccgagcacggcagcgtgtcctgcatcgccgcgctggcgaaaggcggcgtgcctgtggatgcgctcgatacctcagggcggacggcgctcttcgaggcgcgtcaggccgacgtggcccaggcgctcatcgacgcgggcgcgaatcccaatgcgggcaagggctggacgccgctgcaccagcacgcacggttcaaggagcgaggccccgtcatcgaggtcctgctcaaggcgggggcggatgtctcgctgaagaatggcagcggccagacgcccgcgcaggaggcgctggagcacaagaacgcgtccctcgcccagctcatgggggccaaggcttcctcgggcaaggccggcgcgttggacgtgcagccgctgctggatgcactggcgcgtcagcgcaagacgctgctcaaggcctggtacttcgaggacaagaacgtggacggcgtcgaacaggtcctgaaggggctcgcgctgcaaggtgccacgtcctgggaccagctcgcggcctcgcttcagggcgagctcccctggacggccatggcggtggtgcagctcgcgcgggacgtgctgccggccgaggagaaggcgcctcgcctgtccaagctgccgcgcttcgtgcgcggggacctcgtggtgaagggcgacgtgcacgtcgatgggccgctgctcgtgacgggagacctcacggtggaaggcgtgctgcgcaacgcggggatggaagggatgctggtggtgggcggcacgctgcgcgccaccggtgtggacacggacggcgaggttgtcgtgggcgaggacctggaagcgcaggtggtgtggggccacggcaacgacgcttcgctccgggtcggccgcgtgctgaaagcggacgtggtcatcgcggacgaccacgacatccaggccaaggtgaaggcgaagcaccactacgagaacggcgagttcgacgcctcggacgcggtgctcaagaaggtcttcgtcgcgaaggccttcgcaaagtcggagttggaccgggacaagctgttcaacgtgctgcgcaaggtcggagccgtcctggtgtag

SEQ ID NO: 5769 - DNA, 1173 bp, Myxococcus xanthus
atggtggagcagggcgacggtggcggtccgttgccggcctgggtcgaggcgctggatagcgacgactgggtctatggcacctgggagggcgagaagcggcagatgcggctgtaccgctcgttgaaggacatgctcgacgtgctcgtgccccccgcggaggtggagagcttcggtgagcgcacctttgcccgggcgatgaatgccgtccttcagggggcgctatccggcgtccaggccgacgaggaggacgaagaagcggcggagtccggcgaggcaccgctcggtgcggcggccgaggctgaagcagtcgaagaggccgagcagctcgaggaggcggagctggccgatgaggaggccgccgaagtggcggtagaggaggcggaagtacgtgagctcgcgtacgagtacgacgatggccgcccgtcttcccgttacgaggatggggccggctcgagaaaggcacgcgcgcaggcccagcagataccgctcgccatcggtggcgctggcgtgctgttcccgaaaagtgcgtcgagcagggtgcagggtgtgaagaaggccgccgcggagcccgctcccacgaaggcgcgccccacgaaggcgcgccccgcgaagaaggccgcgattgaagcggcttcggcggagctcccgactggagcggctgaagccatttcggagccggaggctgcgcccaagacggccaccgcgaaggcccccgcccagacgggtgtggcgaagacgtcctccgccaccacgaagagggcgacgaaggcccctaaccagaagcgcactgagaagaagcctgccaccgcgaagagggcgacgaaggcccctgcccagaagggtgcggcgacgaaggccgctaccgcaaaggcccccgcgcggaaggcagcggcgaagaagtccgtcaccgcgaaggctccggctcggaagggcgcggcgaagaaggcccttgctcagaagggtggtgcaaagcgggccggtgtcccgacgagcgcagcgaagaaggcgactgctcagaagagcgcagcgaagaaggcgactgctcagaagagcgcggccaagaagtcttctgtgaagaaggccgctgctcagaagtccggagcgaagaagagcgccgcgaagaagggctcagcccagaagccagcggcgaagaagggcgcacgcggccggtag

SEQ ID NO: 5770 - DNA, 885 bp, Myxococcus xanthus
atggcgtcccttcgcgacattcgcaagcgcatccgctcggtgaagaacacgcgtcagatcaccaaggcgatgaagatggtttccgccgcgaagctccgcaaggcgcaggacggcatcctggcggcgcgtccctacgcgacgatgctggatcaaatcatcgcggacctgtccgcccgcgccggggatgagagcctcagccacccgctgctcacggcccgtccggtgaagcgcgtggagctggtgctcctcacgtcggaccgtggcctcgccggcggcttcaactccaacgtcatccgccgcgccaaccggttcctctacgagaacacgaacctggagagcatccgcctctccaccgtgggccggaagggcaacgacttcttccgcaatcgcggccagaacatccgcaaggacttcggcggcctgtaccagcgcctgaactaccgcgccgccgcggacgtggccgaggagctggtggccagctacctcaatggcgaggtggacgcggtccacatcgtctacaacgagttcgtcaccgccatctcccagacggtgaaggtcgctcagttgctgccgctgcagacgctggggacgccggaccaggcctcgacggcgggctccacctcgctggtggacttcaagtacgagccggaccgtcagtccgtgctggaccgcctggtgccccaggccgtcaacatcaagctctaccgcgccctgctggagagcgtggccagtgagcacggcgcccgcatgagcgccatggagaacgccacctccaacgcgaccgacatgatcggcaacctgacgctcacctacaaccgcacgcgtcaggcggtcatcaccaaggagctgatggagatcgtctccggcgccgaggccctgaagtag

SEQ ID NO: 5771 - DNA, 798 bp, Myxococcus xanthus
atgaggcagcggctgtggttgttcctggggctggtgtgctgcgtcacggggtgtggcttcgaaaccgtctccagcgggtatggaggcatcggcttcgactcgttcggcagcggcacgcagcgagagccgtatggagaaggcttccacctcctgcggccgggcaagtcgctcatcgtctacgacttgcgcgtgcaggagatgaaggacgggctgagcgtcctgtccaacaacggcctggacctcaaggtggacgccagcgtgcgctaccgggtggaccccgcgaagctcttcgagctgcacacccagacggggcccaggtacgccgacatcctgatcgcccccgtggtccgctcggaggcccgcaaggtgttcggccgctacgcgccggaggagatctactcctcgaagcgcgagcagattgaacaggagattttcgaggaggtgacgcgctcgctcgaaggcaagcacgtggtggtggaggccatcctggtgcgggacgtgacgctgccttcggccatccgcgacgccatctccgacaagctggcggaggagcagcgcagccagaagatgcgcttcaccctggacaaggagcgccaggaggcggagcgcaagcaaatcgaagcggaaggcatcgcccggtaccaggacatcgtgcgcaaggggctcaccgaggagtacctgcgcttcaagggcatcgaggccacggagcggctcgcccaaagccagaacgccaaggtcgtcctggtcggtagcccgaacagcgggctgcccctggtctaccaaccggatgggaagtaa

SEQ ID NO: 5772 - DNA, 1446 bp, Myxococcus xanthus
atgagcgctcaagttccgacggcaggcagaatcatccaggtcctcggccccgtggtcgacgtcgagttcccgcccggcggtctccccgaggtctacacggccctcaaggtcaccaacgcgaacctgagcgccgccgctgacaacctcaccctcgaggtggcgcagcacctgggcgagaacaccgtccgcaccatcgccatggactccacggagggcctgggccgcggcatggccgtcacgaacacgggcgcccccatccaggtgccggtgggcaaggccaccctgggccgcatcctgaacgtcaccggtgagccggtggacgagatgggccccgtgaaggcgcaggagtactggtccatccaccgcgcgccgccgcccttcacggagcaggacgtgcgcgtgcagatgttcgagacgggcatcaaggtcatcgacctgctcgccccgtacacccgcggtggcaagattggcctcttcggcggcgccggcgtgggcaagacggtgctcctgcaggagctcatccgcaacgtggccgtggagcgcggtggcttctcggtgttcgccggcgttggtgagcgcacccgcgagggcaacgacctctaccacgagatgcaggacacgaaggtcatccagacggacaacctggaggccagccaggccgtgctggtgtacggccagatgaacgagccgcccggcgcccgcgcccgcgtggccctgtccgcgctgaccatggccgagtacttccgcgacgtggaaggccgcgacgtgctcctcttcgtggacaacatcttccgcttcacccaggccggctccgaagtgtccgccctcctgggccgcatccccagcgccgtgggttaccagcccacgctggccacggagatgggcggtctgcaggagcgcatcacctccaccacgaagggttccatcacctccgtgcaggccatctacgtccccgccgacgacctcacggacccggcgcccgcgacggccttcgcccacctcgacgcgacgacggtgctcaaccgctccatcgccgagctcgccatcttccccgccgtggacccgctggactccaccagccgcatcctggacccggccgtcatcggcgcggagcactacggcgtggcccgcaaggtccagggcatcctccagcggtacaaggagctgcaggacatcatcgccatcctcggcatggacgagctctccgaggatgacaagctggtggtggcccgcgcccgcaagattcagcgcttcctgtcgcagcccttcttcgtggccaaggtcttcacgggcaaggacggccgctacgtgaagctccaggacaccatccagggcttcaaggagatcgccgagggcaagcacgacgacatccccgagggcgccttctacatgacgggcagcatcgacgaggtggtcgagaacgcgcggaagctcgcggcgagctaa

SEQ ID NO: 5773 - DNA, 540 bp, Myxococcus xanthus
atgttcctggctccctcctccgccctggcggaggagcgcaggggacgcgcccgggtgagcgccaacgggctctacagcgtccgcatggtggaagcggcgcaggaccagtgccggttggaggtgacgcaggagagcggccccgtctggacgctgaaggagtgtctgggcacggtggacgacctctacttcgtctccaacgacggcgagcgcgtctgggtggtgtggccgctggtggagaagggcaaggccgtggcggagccgcggacgaagaagtcgaaggcgaagaagcccaaggggcctcccgcctgggcgcgcgtggtggtggcggcgcagtatgggcgggatggccagcggctccaggagaagcggctgaccgagtggctcaacacgcggcagctctccgaggtgcgccagctcacccaccacttcaagtggctggagggcacgctcggaatccccggcaaggggccccggttgacggacgccggggtggtggagttggagccggtgggtggaaccacccgccagctcacgttctga

SEQ ID NO: 5774 - DNA, 114 bp, Myxococcus xanthus
atgttccccgatgagaactttttcgacgaagtggtgctcaacatgggcctgctgatagccctgaaggtggtgggcgtggtgatgctgctcgtcacctatgcccacccgtcgtga

SEQ ID NO: 5775 - DNA, 411 bp, Myxococcus xanthus
atggccaatctgactggggagattgtcacccccgagaagcgcatcctgtcggtgcaggccgacgaggcgattgttcctggcggccggggcctgttcggcgtgcggccggggcacaccccgttcctgtcgctgatggagccgggcgcgctgacgctgatcgagagtggccggcgcgagtcctacttcgtcgcgggcggcttcgtggaagtgggcaacgacaaggtgctggtgctcgccgacgcggccgagcccgtcacgggcatcgacgtggaaggcgcccgtcgccgcatggccgaggcccaggagcgcatgaagggcatgtcctccgaggacgcgcgcttcgagctggagcaggccacggtgcgccgtgaggccgcccgtatcggcgccgccaacaccgcgcgcgcgtag

SEQ ID NO: 5776 - DNA, 381 bp, Myxococcus xanthus
atgagcgttacggcggagaagagtgtctacgagcagctgggcggagagccggcgatggcggcggcggtggaggtcttctaccggaaggtgctggcggacgatcacatcagccacttcttcgaggacgtggacatggagcgccaggccgcgaagcagaaggcgttcctgacgatggtgacgggtgggccggtccactactcgggcaaggacatgcgcgcgggccacgcgcctctggtgaagcgtgggctgaacgactcgcacttcgacgcggtggcgggccacctgaaggcgacgctggaggagctgggcgtggccgcgccgctggtggcgagggtgatgaccatcgcggagagcgcccgcgcggacgtcctgggacgctga

SEQ ID NO: 5777 - DNA, 999 bp, Myxococcus xanthus
atggccaaggtaaagcatgagtccgactggtacccgttggagtccggagagagtgtgctggacgcgctgctgcgccagggcgtctccattccgaatgcgtgccgcgcgggggcctgccagtcctgcctgatgcgggccgtggcagggacggttccagaggccgcgcaggtggggctgaaggacacgctccgggcacagggctacttcctcgcctgtgcctgccggcctccggagggcacgcagctggaagtcactggcgcggaggcgctgcgcatccccgcgcgcatccaggcgctgtcgttgctgtccaccagcgtccttcgtgtgcggctggtgacggacagcccgctggcgtaccacgcggggcagtacatctccctggtgcgcgaggatgggctggcccgcagttattcgctggccagcctgcctcatgaagacgccttggagttgcatgtgcggctccagccgggcggggcgatgagtggctggctggcgcatgatgcacagccgggagacaggctccaggtgcaggggccggcggggagttgcttctatgtgcctggccggcccgagcagcccttgttgctggcgggcacgggcacgggcctggcgccgctgtacggcatcgttcgcgacgcgctggcggcgggccacacggggcccatctggctcttccacggcgctcggacgcccgaggggctctacctcacctccgagctgcgggcgctggcggagcaacatcctcagtttctctatcgtccgggtgtgttggagggcggcagccgggacgtggccgagggagcgctcgatgtgctcatccgcgccgaatgcccgaagccgctgggctggcgcgcatggctctgcggagacgggccattggtgctatcccttcgaaagaagctgttcctggccgggctctcgctgaaagacctccacacggatgccttcttgccgagcgttccatcggggcagcgtacttccgacgccggagcccgctga

SEQ ID NO: 5778 - DNA, 441 bp, Myxococcus xanthus
ctcaccctccatgccgactactcgctgcgggtgctgctctacctggccacgcgcaccgggcggcccgtctccacgcaggagatggcggatgcgtacggcatctccaagcaccacctggtgcgcgtggtgcagacgctggcggggcagggggtggtggacgcgcgagcgggccgctccggcggcgtggtgctggcgcgcgcgccagcggacatccaggtggggagcgtgctgcgcgccgcggagccggacttccacctggtggaatgcttcgaccgggagcgaaacgcctgtcccatcgctcccgcttgtgggctcaagggcgtcctggacgaagcgcgcgaggcgtttctcgcggtgctggaccggtacacgctggcggacctgctccgccgctcgcgcccgaacctgcaggactacttcctccccacctccgaaccatga

SEQ ID NO: 5779 - DNA, 258 bp, Myxococcus xanthus
atgtccggcacgctggagctgtttcatcgcatcgcggatgcaccgtccgcgcaggcccggcgctacatcgtggactacgcgctggaggaccgcgtgcgctttcgcaacgtggccttcgacgaagcggaagcggactggcgcaagcatggcggacataccacgcccgcgctctgggatggcacgcacctgcatcagggcgcgcaggcggtgatggcgcgcttgcaggccgtcgtcaacctggggcgcgacgacgcatga

SEQ ID NO: 5780 - DNA, 486 bp, Myxococcus xanthus
atggaggcggagccgctgacacccgcggccttctgcgaggagctggcgctgtcggcggccgtgcacgacaaggggctggccgaggaagtgcgccacctgccgcgcctgctcacctgggacaccgcgcgcgcgctgacgcagttgcgcaaggtgggcgtgccccccagcgagctgaagggcgtggacgggctgccgccgcacgtggtgccggtgctgctgacgtcgctgttcgccatcctcaaggtgccgcacgacttccgggaggcggtggccctcacgctgcgctgcggcggcgaggcggacgtggccgcggcgctgacgggcgctctgctgggcgctcacctggggacgcgcgccatccccgcgcggctgcgcaagcaggtgttgtactccgaaaacctggtggatacggcggaccgcctcttccgcgcccatcaggtccgcgagacgctggccaccgccctgtcgcaccgccgtcgccgctga

SEQ ID NO: 5781 - DNA, 453 bp, Myxococcus xanthus
atgggagcgcacgtgtggtccgcggagtcatcgcaggaggcgcacgtcgtggatctcgaatcggaacgcctggagcgaagtcaattggagacgctctccacggcggagctcatccggcatgccttggcggagacgcgcctgctggtgcgcgccgaggtgatgcacgccaagaaggagctgcgtgaggagctgaaggccgcgcggaccgcgggaatcctcctgggggcgggcgcggtgctggcgctcacggcgctggccgtcctcttcgtcgcgctggggttggccctgcccatggcccaggcgctgggcgtgctggtggtgggcgtggtgctgctggcgattgccggtgtcttgctcttcgtgggacgcaagcgcgtgcccaagaagccgctgccgcacacacaggaacgcttgaagatggactaccagctcacgcgggagacgctgcaatga

SEQ ID NO: 5782 - DNA, 522 bp, Myxococcus xanthus
atgaatggcaacgaccgcgacgcaggcgagccctcggcaatcgagcggcagcatgaggaccaccgcatcgcccggggcatgggggaccgcaagcaggtggaggagaccgccgaccgcatccgcgacgagctgatgctcacgctggcggagttggatagacgacgcgagcgcgcgctcgacgtgcgctaccacgcgcggcagcaccgcgccgagctgatggccgcgggcgccgcgctgttgacggcggtgggtctgggcgtggggtacgcggtgtaccgcgcgcgcaaccgcgacgagattctgcgccgcaagcgccgcaaggccctggcccgtgcatgggagcacccggaccgcgtggcctccagcgcggagcgccgcccgctgggcgcggagctggggagaaagctcgtcctcatcttcgccagtacgctcgccaccgcggttgcacgaaacgcggtgatgacgctggttcctgcgcgccgcgcccccgcttctgctcagatagtttataagaatcaataa

SEQ ID NO: 5783 - DNA, 1338 bp, Myxococcus xanthus
atgacggacctgctctatgcgcgggcccaaatgggcttgtcgctcgcgttccacatcgtcttcgccgcggcgggagtggcgcttcccgttctcatggtgctcagtgactggaagggccggcgcaccggtgatgcggactatcagaagctgagtcagaagctggcgaaggggacggccatcctcttcgcggtgggcgcggtgagtggcacggtgttgtccttcgaactgggcctgctgtggccagagttcatggggcagtacggcgaggtgattgggctgcccttcagcctggagggcgtcgccttcttcaccgaggccatcttcctgggcatctatctgtatgggcgggagcgggtgtcgccggggatgcacatgtcctccggcgtcatggtggcggtgagtggcgcggccagcgccttcttcgtcacgctggtcaacacgttcatgaaccacccgtcgggcttcacgccgtcggcgtcagggcccatggacgtgcagccgctggtggccatgttcagccccggctggcagtaccagacagcgcacgtgctgctctcctgttaccaggcgagcgccttcgccatggcgggcatccacgccttcgtgttgctgcgccacccgggcgtggccttccatcgaaaggccctttcggtggcgctgccgctggcgtgtgtcaccgcgctgctccagcccgtggtgggggacttgtccgccaagcacgtggcgaaggcgcagccggtgaaactggccgccatggagggtcagttcgaaacggagcgcggcgcgccgctgcgcctgggcggactccccaacgtggagacgggcgaggtgccctacgcggtggacatccccaagggcctgtcgattctcgccttcgcggacccggacgcggaggtgaagggcctgaatgccttcccgcgcgacgagtggccgccggtggcgaaggtccacgtggccttccaaatcatggtgggcaccgggagcgccatggcgctgttggcgttggtgacgctgggctggcggtggcggaagaaggcctggccccacgggcggaagatgatgtgggcgtggctgttgtcggggccgctgggggtggtggccatggaggcgggctggctcgtcacggagtggggacggcagccgtggattcttcgcggcgtcatgcgcacggcggacgcggtgacgccggtgccacacctggccgcgcccttctggaccttcaccgtcgtgtacctgttcctgggggtgacggtggtgctcctgctggtgcggcaggtggcgggaacgctgcccacgcgcgacagcggtccgctgggaggtgaggccaatgccaactga

SEQ ID NO: 5784 - DNA, 1020 bp, Myxococcus xanthus
atgccaactgacgcgattctgggcttcgcggtggcggggaccttcgtcctctacgccctcttcggcggggcggacttcgggggcggcgtctgggatttgctcgcctccggaccgcgcaaggcggagcagcgcgcgctcatcgcccgcgccattggcccggtgtgggaggtgaatcacatctggctcatcgtgggcctggtgctgctgttcgccggcttcccgcgcgccttcgcggtgctgagcgtggcgctgcacgtgccgctgacgttgctgctgctgggcatcgtgttccggggcgcggctttcaccttccgggcctacgacacgcgcggggacgcggtgcagcggcagtgggggcttgtcttcagtggcgccagcgtcatcgcgccggtgctactgggcatgtgcgtgggggccgtggtgagcggcaccatccgcgtggaagggcgggtggtggtgagcggcttcttcgcgtcgtggctcgcgcccttctcatgggcggtgggcgcgctggcgctgagcctcttcgccttcctggcggcggcatacctcactcacgaggcgcacgagcccacgctgcgcgaggacttccgccgccgggcaatgggcgcgggcgtggccgtgtttgtcgcggcgctggcggtgctgttgctggcacgcgagggggcgccgcgcgtctgggagggactcttgcgctcgcccttcgccctggcgctgcatgcgggcacggcggtggcggcggtggcgtccttcgcgctcttgtggacgcgccgctttcaatgggtccgtgtcgctgcggctgtgcaggcggggctcatcgtgctggggtgggccgcctcgcagtacccgtacctggtggtgccggacgtcacgctgcacggcgcggcggcgagccctggcgcgcagcgcttgttgttggtggcgctgggcgtgggcacggccgtggtggtgccttcgctggtgttgctgttccgcgtcttccggcccgcgcccacgccgggcgccggctcggaggtgtga

SEQ ID NO: 5785 - DNA, 675 bp, Myxococcus xanthus
atgtggcggcacaccgcttccgtgcgcagggattgcgccgcggaggacggccacggcttcgtcacgcagaacaccgggctgcgcgcgttccgggcgcgttatcgtgggcccatgttcaactcttccggtaggcggtggggcatcgcggcgctgtccctgggaatgctgggcagcgcgtgcgcggcgcggcaggacgccgcgccatccgctgaagcggctcaggagaccccggccatggcaacgaccttgacgtgcacgctgagcggcccggcgcgggtgcgcgcgggcgaacccgtggagctggtgttcgagctcagcaatcccacggtgcaatccctgcgcgtgctcggctggcacacgccgctggagggcgtacgcaacaaaatcttcgacgtgtcccgtgacggtgactcgctcgagtaccgggggcccatggcgaagcgcgggccgcccacggccgacagctacgtcgccctctcccccggcacgtccgtcgaaggcagggtggacatcgctcgcttctatgacttgcaggcgccgggaacgtaccgcatcgcgttccggggcccgctgatggacgtcgcccgggaaggcgaaccggtgcccgctccgaatggcggattccgcccggcggaagtgccgtgccccgtggtggaggtcaccgtcacgccctga

SEQ ID NO: 5786 - DNA, 600 bp, Myxococcus xanthus
atgccggatggcacgcccatcgtcgccgcgcgcgacggcacggtgcgcctgtctcgtggtgacagcaccaagggtggttgtgacgagaagttcgcgccccacgccaactacgtcgtcatctcccatggcgatggactggagacgcagtacctccacttcagcgcggtggtggtgaagccgggtgacgtggtgaaggagggccagctcatcggcttctccggctccaccggctgggcctgcggcgcgcacctgcacttcaaggtggcgcgtgagagcggcaagggttggaacaacccgtccgtgccggcgcgcatcgctggctacggggacccggtgcgcgacacccgtgtggccgcgcccctctgcaaggacaacggcacggaggcgctcatggcgagcaacggcggtacgcacactccggggcagccggtggtgtccatttcaccggagcgccagcaggcccttcgcggcctcccgcccggggcgcagagcatcctcgacggtctctcccagcctcccgcccagggcggccagggactcaacgaagcgcgcacgtccggtggtacccgcacggcgagcggctccagcgagactcgctga

SEQ ID NO: 5787 - DNA, 897 bp, Myxococcus xanthus
atggacctcttcctcatgtcgccgccgggacgcacgtgggccctgcgtggccgcagcaacttccgcagccgcgaggcgccgcccgtggacgcgcgtcaggcccggagggaatggctggcgctggcccgggacatcgaagcgcgtggcggcacggtggtcgcgttgccgtctccctccgagctcctgacgggcatgccctacgccgccgaatgtggacaggtggtggcgcgtcagggcgccgctccgttgttcgtgctgccgcgggtgatgagcgcgcaccggcaggcggagcgcgagcactgggcgcccctggcccggtcgctgggcatggaggtggtggacccgggcgtgggcatctgggaagcccacggcgacgtggccactttcgacggcgtcacgctgctgttctggggcggccgcacgacgctggacggcctggaggccgcggcgcggtacttccccggagaggtgctgcgcatccaggtccgcgagcccgccttccacggcaacatggcggtgctgccgctgcccgcggtggaccggctgatggtgtgtccggacgtgatggcgccggagtcccatgcgctgctgcgcgagcgcttcggcgagcaccggctgctcctcgtgacggaggcggagattcgccgctacgccaccaacgggctgccggtggggcgtgacgtgctggcgccttcggtggtgccggactcggtgcgggagcggctggaggcgctgggcctgcgcgtggtgtcgctcaccatgcgcgagctgtgtgagaagggaggcggctcgtcacgttgcctcgtgtcgcgcgcggaggtggacgccgcgacgctgaacatcccagacgcgttccggttgtcggccatcgcgagggacatcgatgccgatgggtga

SEQ ID NO: 5788 - DNA, 801 bp, Myxococcus xanthus
atgggtgacgcggacacgctgcctcggcaggcggaggccttcctcgcggcgcaccctggcgcgtcgctggtggcgctgggctcgggtgagcacgcgggctcgttggacttgtcgccgctgggcgtgccggtgacgttcctgcccgccgagcggaacgcggacctcgcgatgcagtacctggcgctgaaccagctcgccttcggtggcatcggcgtgccgcgttgggtgctgtcggacctgtatctgctgccgggcgccattgggctgctgcgctgcccggcccggatgctggcagcccccgtgcgcgagcggttggggctggccgacgaggacccggccattggcgcggcctactacgcggcgccttcggtgacgccagggttggtcattggcgtgtcgctgctgagcgtgctgccgggaacgggggcgtcgccgtgggtgaagctgctcacgttgcagatgctgcgcgcgcggcggctgcgaggcgtggcccagtgggacaaccccagcgtccgtgtccattccaggctgggcccgctgcgcctcgtggggcgagtgcccgggggccatgagtatggcgaacgctccttcgtctacgagtcggagctgacggaccggacgcggctgggcgacgcgatggtgcggcgcctgtcgctgacgccgtcgctgcgtgtatccgccacggacctttcggcgctgagcgcgctgctcgaccgcgcggaggcgggcgaggtgttgcacctggtgcctccgggactggacgcggggcaggtgctggtgcgcgaagggccgctgggctga

SEQ ID NO: 5789 - DNA, 1614 bp, Myxococcus xanthus
atgccgggggtgttgcagttggcccagggcgtctatgcggtggtggcccggaatcgccgtcaggcggcgggcgtggaccgctggctcttcgggcgcgcggtggtgccgcacgaataccggtgggtgcgctgggccttcctgcggttgctgggaggaacgttcctcatcgccttcacctcgctggggcggcaggtgcggggactgtatgggacgcaaggcctccggcccgtggcggagcgcctggccgcggagcgtcgcgaggaggcttcggcgctcgcgaggtggcggcgcattccgtcgctgttctggttggacgcttcggacgccacgttggtgcgtgggtgctggaagggccaggttctgtccctggcgttgctcttcaacgtggcgccccgcttcagcgtgtcgctgctgtgggcgctgtacctctcctacgtggccgtggggcgtgagttcctctccttccagtgggacgtgctgctgctggagatgggactgctggcggcgctcaccgcgcccggaggactgcggccgggcctgggtcgtgacgagccctccgcgctggatgtgttcctcttccggctgctcgtattccggctctacttcggctcggggctcagcaagctccagtcaggggaccggacctggcgcgagctgagcgcgtgcgagcactattacgagacggcgccgctgcccacgcggggtggttggtacgcgcatcatctgccgcgtcggctccagcgggcctcgaccggggcggtgctctggctcgagacggtggtgcccttcctggccttcgggccccggcgcttgcggcagttcgccttctggagcctgagcggcttgcagaccgccatctccgccacggggaactacggcttcttcaacgtccaagcctgggtgctgggcgtgtggctcctggatgacgcggcgctgcggcgggtgctgcctttgaaggacgggcctcccgctcagccacggccttggtggcgtaccggcgtgtccgcgctggtggtgtcaccgctgctggtgttgggggcgtcggaggtgcttcgccggttcgaagggtggcagcggtaccggcccgagcgcgtcggcgcgatgctgacgtggctggagtcccaggcgcggcccctgcgttcggtgaatccctacggcctcttcagcgtgatgacggtgcagcggccggaaatcatcgtggagggctccgacgacggagtgcagtggaaggaatactccttccactacaaggtgggggacccggcccggcctccccggcaggtggctcctcaccagccgaggctggactggcagatgtggttcgccgcgctcggttcgccccctggctggttcgtcgcgttcctggcccggctgctggagggctcgccggacgtcctgggcctgctggcgggcaaccccttcccggaccggccgccccggatggtgcgcgcggtgctgtacgactaccggatgacggacgcggccgagcggcggcgcacgggcatctggtggcggcgggagcggctgggcctctacgtgccgcccctctcgctggcgcccgggccccggcctcgtggacgcattcccgcgctgcaatggcatgccggggcgtga

SEQ ID NO: 5790 - DNA, 750 bp, Myxococcus xanthus
atgaagctggagccgctggagacgaagtacctccgcacgcctgggcagaccgtgaagctggcgtacgaggtcttcgacgcggagggccagcccatgtccgacccgaagctgcggtggaccagctccgcgccggacgtggcgcaggtccaggaaggcttgctgacggtgcgcaagtcggggaagacaaccatcggcgcgacgggtggcaaggtccgcgcggcgttgccgttggagctgaccatcctcaattcgctggacgtgcgcgccccaggcgcggacttcctcgaggtggggcgtgtcatcaagctgcgcgtggtggcgaggaacgagcagggctcttcgttgcaggacgccatgcccacgttccgctcctcggatgagatggtggcgcgggtggaggatgggcagttggtggccgtgcgcccgggcaaggcgaccctgagcgcgacactggggcacctcagccggcacatcgcggtgcaggtggtgccagcggacttcgcgcggctgggcctcaacctcacgcaccacgccttccagcggagggggcagtccgtgcagctccaggcgcgagccttcaatcgcagcggcgtcgtgctggacacggtgccgctggagttcttcacctcggactccgccgtggtgtcggtgtcgcccgaaggccgcgtgacggcggtgggttctgggcgcgcggtggtgtccgtggtcgccggtcggcggcggtcggcggcggagttcgtcgtcccgtag

SEQ ID NO: 5791 - DNA, 1146 bp, Myxococcus xanthus
atgaaggcctacgtcctgtccgacgcgtcgctggcccggcacgcggaccgcttcgtgtggctggaggtgaacaccgacctgacgtcgaacgcggcgttccaggagaagtatccggtggagttctggcccacgctgtacgtcatcgacccgcgtcaggagaaggccctgctgcgcttcgccggcagcgccaccgtggcgcagttggagaagctcttcgaggacggtgagcgcgcgtacaagggcggcgtcaccggcgccgaggccctgctggctcgcggggacgcgctctatgcggagggccgttcggccgaagccgcggagacgctcgtggaggccctggccgaggcgcccgcggactggtcccgccggggccgcgcggtggagtcgctgctgacggcgatgtacggcgcgaagcagcacgaggcgtgcgcgcacaaggcgctggaggagctcccgaagacgccccgctcgctgtcctgggccaatggcgcgctcttgggcatgtactgcgtgctgtcgctgccggaggaccacgcggcgggagcggagctgcgcggcggcctggaggccaaggtggccgaggccctggcgcccccggccatcgagatgtccgcggatgaccgctccggcctgtacgaggtgcgcgtgcaggcgcgcgaggtggcgaaggacacggcggccgtgaaggccctgtcggaggagtggctggcgttcctggagggcgaggccgcgaaggcgcccaatccccaggcgcggacggtgttcgactcgcaccgcatgctcgcggccatgaagctggagacgcccgcccgggcgattcccgcgctcgagcagagcgagaaggacctgccccaggactacaacccgcccgcgcgcctttcgacgttgtaccggctcgtcggccggctggatgacgcgctcgccgccagcgaccgtgcgctggcgcgcgtccagggcgcgcggcggttgtcggtgttgtcgggccgcgcggacatcctcgtggcgcgccaggacacggcgtccgccgtgaagacgctggaagaggccatcaccttcgcgaagtcgctgcccgcctcgcaggtgtcgccgcgcacggtggccgggctggagaagaagctcagcggtcttcaggcctcggcgcggtag

SEQ ID NO: 5792 - DNA, 108 bp, Myxococcus xanthus
atggagcgggtgggagagctggcgcgtgccgagccgttgctggaggaagagcgccgcgcgttcctcgcggcaccgtcccaggagggcaccgcgacggtggcgcactga

SEQ ID NO: 5793 - DNA, 2787 bp, Myxococcus xanthus
atgcgctggctgcggctgctcgcgctcgtcttcgcgctgccggtgcatgccgacgatgccctgtccgcgcgcgtccaagcgctcgaacaggcgggcgtggtcctgcggggcgccgcggcggccgacgcggacctggtgacggaggtggaggcggggctggaggcgctgcctccggcgatgcggcgtccgcccggtggtcccctggaattggtgctgcacccggaggcagcgccgctgggcctgggcgatggctcccccgcgcgtcccgactggacggagggccgcgcgcggttccacctctaccagtacgctccatcggaggaacgccgggccacgctgcgtctgtctcgactgacagaagcggaggtggagcggttgtggcgccggcgcgcggtggtgcacgcggtgatgcagcgctgggatgacgcgaaaggctggagcggcaccccggcctggcgccggctgtcgggttggatgaagcccttcgagcggcccctggtgtggaaggaggaggtccgccttcgctacgccggagctttcagccgcgccatggggcagcgcagcgcctcattggattgggtgacgttcgccgaggaactgctcgtgcccgtggagtccctgcgcgcggacgcgctgccggtggatgaccacgttcgctgccaggagttctccaaggcccgtgcactgacggagcagctggaagcgtcgggcttgggcacgctgccgccgcgcggcgactgccccgccttcgaagcctgggcggagctggagtccctgtcgcacttcgaggtgctgctggtggcctccacgggccgtcagccggagtccctcttcggacacctgctgctgcgcccggtgtggcacgagggcgaggtaccacgggggcctaccttcgaacgggtggtgcaactggtcgcgctgacagggatggagtccaagggcctgggctacgtggtgaagggaatgacgggggcctacgacaccgtcttcctcacggggacgatgggcgacctgtcccacgaggcgctggagctggagcagcgctccatccgccgcttccgcctgcgcctgaagcccggcgaggaagcgcggatgctggagcgggtgtgggagctcgagcgccgcgggtacatgggctactacttcttcacggacaactgcgcgagcgcgctcgtcttcctgctcaacggcgcgctggagggggggcggcagctgcgtcctcccggcacgctttgggtcctgcccaccgccacgctggacaccctggcccgggtgcaggtggaggagccggggggcgagacgtcctccctcctggagcacatcccggatgcgttcgagtccaccggggaccgcgcggtgcgtgcgcgctcggcacagcaggatgcactggacgcgctggccggacatgtcggcgccgatgaactcgcgcgtctccggggcgtgcatgcccggttggagtcgccggagccacaggtccgcgccccggcctatgacgacctgcccggagtggtggccgcgctgatgcactcggcgaagacggcgtcccgcgacacggtccgcgcgcacctgcatgcctacgtggcgcacgcggtgcgggtggagcgcgccgcggtggaccgtgccgacggcgagcgcctgcgaatcgagcgcgagcggatgctcgcgatgaaggtgtcggttgcgggctcggcaagggccggcacggccgagcgccagcgcgtcttcgagaacgaggacgcgctccagcggaggctcgcggtgttggaccgcgccaccctgctgaaggatgcactggcctccgcggagcgccgtcctcccacgcccgaggaactgcggacgttggtgtgggccgagcgaaccgaggccaccttccaccgtgccaccgacgtgcagggcacgctcaatgacggcttgctggcgaccgtggacccggtggccttcctgcacgaggaccggcgccgcaaggtggcggcggagacggcttgggcggaaggcgcgctgcgggagtccggagcggggcgcgtgatggtggccctgggcgtggactttcccgaaggggcagcggcccggcccctggtggggctacgcaccgcgggcatggccgaggcgctgggcgatgcgcggctccacggcttccagccgagcagtgagctgcgggtgctcgatggcgagctgtttctcctgccgcgctggggggtgcccaaggtggtggcctcggacctgacgctgttgggctaccgcacgctgctgcgcgagcttccccagttccgtgactccttctgggattcgctcggctggggggccgaggcccgcgtggcgtcgagcgacgcgcgcctgctgcgctatcgcgcgtcggtgcaggcggaggcgttgatggtgctggacgaggacgcgcgcttctcgcgcttcaccacggtgggcgtgggcggcctggccgcggtgcactggaaccgggatgtgttgacgccggccgcggggccgcgcctgtcactggcgcatcggatggggctgttcggttcgggtgccaacgcggtgcggctggaggcggcctacgcgcccacctggagggtgggggacacacacttcacccacgaggcgggcgcggcgctccagttggaggtgtggctggggcgcgcggggcccttcggcgtgctcctcacgccccgcgcgcaggtccagtgggagggggcgatatcgcccacgccccactgggaagccctgtcgccgtctacgtggttggccggctcggcggagcggcgtctggcacttgggttcgaggtgcgctga

SEQ ID NO: 5794 - DNA, 474 bp, Myxococcus xanthus
atgagctttcgccgcaaactgctgacccttgcccttgtctcttcctccctgctggccgcctgcgtcgtgcagcgtccgttctatcgcgacgtcgtccagcccgcgggctcctcggtggcggccggtaccctggtggacctcatcgtcctggactcggacaccaaccagcccgtgaagggcgccaaggtgatctggggcgaggactcccgttcgcgcgagtcctacgtcacggacgaggacggccgggtgtccttcgacgtgacgccggcgctgctgaaggaaaacccgctggtggaggtcgtgctgcccaggggcgttcggagctaccgcctgcaggtggtgcccgcgacggatgtcgccgcgcccgaggaggcggaggcctctgctgctcccgcgacgcccgaggctcccgccgtgccggaggagacgccggcgacggaggctcccgccgcggcgcctgataccagcaactga

SEQ ID NO: 5795 - DNA, 459 bp, Myxococcus xanthus
atgcccgtccgtccacgcgcgtcctccggggagaagcgctacatcaccccggagggctaccgggcgctccaggaggaactggcggcggcgcaggggccggaccccaaggcgggtgagttcacggagctggaggcgggcgtgcgccgcaaggagcgcgagcggcgcgtacaggagctggcggcggtgctggaggacgtgcgggtggtggagcccgacgcctcgcaggccggccgcgtcttcttcggcgcctgggtggaactggaggacgaggacggcggcccagtgcgctaccgcatcgtcgggccggacgagtctgatgtgaaggcggggcggctgagcgtggagtcgcccctggcccgggccctgctgggcaaggaagtgggcgagtccgtggtggtggatcgcccccgtggccccgtggagtacacagtgacggccgtggactacgccgcgtcctga

SEQ ID NO: 5796 - DNA, 342 bp, Myxococcus xanthus
atgattcgcaaggcgcgcctgctgtcggaggcggcggtgtgggccggggcgtggctgcggcggatgcggatgcgggcgatgttccgctggttccaggcgctggacttgaaaatcaccaacgcgctgccggacccggcgcggtgcaccttccagcgctgggccatggcgcgggccaacgcgcatcacgcggacgtcgtcgtcaccggccacacccacctgggcctgcgggtggagcacggcagcaagctgttcctcaacagcggcacgtgctcggaggggcagttctccttcctcagcctggacacccgggccgcgagctactcgctgcacaccacctggtag

SEQ ID NO: 5797 - DNA, 393 bp, Myxococcus xanthus
atgatgttcctcggctccacggccgcgcatgcgaaggacgacaacgagaagtcgcggttctcccagcagcaccggcatgacggccgcggcggcaacttcggtgtccacgtcgacgcccgccgccacccgggacccgcgccgctgccgccgccgcacgctcggggccgctacgaactgcagacggtgaaccgctgggtgcagggccgctacgagcaggtgtgggtccccgaggtgtgccgcgagcgtaacaaccgtcgctcacgggtgacccggtgcaccggcggcttctacgagcagcgctgggtgccggcccgctacgagccggtccaggagtgggtgtgggtgacctacgctccgggccgggtgcacgtggccagcgccggccgccgctag

SEQ ID NO: 5798 - DNA, 726 bp, Myxococcus xanthus
atggcgaccgcattcatcaccggggctggcatccgcatcggcagcgcggtggctcgggcgctcgggcgctcgggttatgacctggcgctccatgcgaaccgctcccttgagccgctggaagcgctggcggacgaactccgaggcctcggccgtcgcgtcaccctgcacgccgccgacctgagccgcccggaggcagtggactccctggccgcgcaagtacgtgaggcgtggcccgcgctggacgtggtggtccacaacgcgggcctcttcgagcgcaccgacttcgccgccatctcccgcgaccagtaccgcaccatgatggcggtgaacctggacgcgcccttcttcctcacccaggccctgctccccgcgttgcgcgccggcaaggacccgttggtggtgcacctcaccgacgtcggtggggagcggccggtgagtcactacgcgcactattcggtaagcaaggcgggcctcatcatgctcacccgcgcgctggcggtggagctggccccgcacatccgggtcaacgccgtgtcgcccggcacggtggccttccccgaggacttcgacgccgaggcccgcgacgcggtgctgcgccgcatccccatggggcgcgagggcaacgtcgaggacattgcccgcaccgtcgtcttcctcgcccgcgaggcgccgtacatcaccgggcaggtcatcgccgtcgatggcggcaggagcgcacagctatga

SEQ ID NO: 5799 - DNA, 282 bp, Myxococcus xanthus
atggaggagagcgagctggtgctgggctcggggctgctgctgcagttcaagccggtggcccggggcatggccttccactggccgcgcggcttcctgcaccgctacgacaacccttcatccacggagcagacggtgctctgtgtggacaggccgggcttcatcccgtcggatgaggtggagaccgagccgccgccggaggggctgctgcccgtcaccggccactcctattacccgctggatgagcccgcggcgccgggctctctcgcggagcaccaaccgtga

SEQ ID NO: 5800 - DNA, 780 bp, Myxococcus xanthus
atgagtgaggtgggcacgcgcaaggtgctcgtcactggcggtgggacgggcattggtcgcgcggtggcggaggccctgctgcgcgcgggggggcaggtggtggtgtcgggccggcgcgtggaggtgctggagtcgctgacgacagcatggccgggacaggccttcgcgctgccgtgtgacctggcctcgctggaagcccgcgaggggctgcttcgccgtgccgccgggttgctgggagggctggacggtttcgtccacagcgcggggcaggtggtgcaccagccgccgggccacatcggcgaggacgcgcttcgcgcgcagctcgaggtcaacctcatcgcgccgctgcggctgggcgagcaggcactggaggtgctggagccgggtggggcgcaggtgttcatcgcgtccacgctggccacgaggcccgtcgtcaccagcgcggtgtacagcgcggcgaaggcagggctccttcaggtgatgaaggtgctggcgttggtgggtgcggcgcgaggcgtgcgtgccagcgcggtgctgccgggcgtggtggagacggacatggtgcgcgaggtgcgcctggctcccggcgcggggccgctgtccgagcccgagtacgcgcggcggcaggaggcccagcttgcgggcttgcgggcgctgcatccgctcggacggttggggcgccccgaggacgtcgcagaggcggtgcgctacctgctgggcgcgtcgtggatttccggttccgagctggtgctggatggagggctactgctgcgggagtga

SEQ ID NO: 5801 - DNA, 750 bp, Myxococcus xanthus
atgctcctcgacagacggcttcagctcttcgtggtgttggtgggggtgttcgtcacctcgctggtggtgggcgacatcatcagcgtgaagctgttcgaggcgaaggtggggccggtggtggcggtgatgtccatcggcatcctgcccttcccggtgacgttcctcctcacggatatcctcaacgagttctacgggaagagggcggcccgcttcgtgacgtgggtgggcttcttcatggccatcttcgcggtcgtggtgattgccatggccgtgcaggtgccgtgggcgccgctgacgcgtgcgccggacttctcgggtacggtggaaggctcgttcaacaacgtcttcgccggctcacagcgcttcctcgtcgcgtcgatgatggcgtacctggtgggccagttctgcgacatcgccatcttcaacgggctcaagcgactgacgcgcaaccggttcttgtgggtgcgggcgacgggctccacgctggtgtcgcagctcctcgacacggtggtggtgcagtacgtggcgtggacgggcgtgctgcccaactccaccatcctcggcatcatctacacgtcctacgtggtgaagttgctggtcgcggtgggcctgacgcccttcatctacctgggccacgccttcgtcgagcgcaagctgggcatcgcccccctggtgctgggggagaacggtgaacccattgccccgcccgcgccgcccgtcacccaggaggagcagcctcgcgccgcctga

SEQ ID NO: 5802 - DNA, 1143 bp, Myxococcus xanthus
  unsure (1)..(1143): unsure at all n locations
ctctgggtggcgcccaacggcagtgacagtgcttccgccacggagatggcgccgctgcgaacggtgacgcgcgcgctggcgttggtgcggccgggcgaggccatctacctgaagacgggcacctacgccgagcgcctcaagctggaggagaagggtggctcggcgtccagcctgctcacgctgcgggccgcgccgggcgcgaagccggtgctgaagccgtccggcagcggctcctccatggtggacgtgcgcggtgcgtactggagcatcgaggggctcaccatcgacgtggcgggcaatgcctccttcgcggtgctgttccgcggcgtgggtgcccaccacggcgtgctgcgtggctccacgctgaagaacggcaccgcgggcgcgggcgtcaacgtgtgtgagaaggccagtgatgtcctcatcgagggcaacaccatctcccacttcaaccgcaacggagatgacagccacggcgtcatcgtccagacgacggcgcgcaacgtggtggtgcgtggcaacgacatccaccacaactccggggacgcggtgcagtgcatcggccccgagggcggcgctaccatctccggcacgcccttcgacaacctcctggtggaggacaacgagctgcacgagaaccgtgagaatggcgtcgatgtgaagacgtgcactcgcgtcacgctgcgcggcaacatcatctggggccacaagatgtcatccacctcgcgcggcgagggcgtggtggtgcacctgtccgcgaaggacgtcaccctggaggacaacgtcttctacaacaacggccgcgccatcagcatcggcggggtgcgccagggctcgccgcccaccaacatcgtcatccgccgcaacctggtgcgggacggcctgggcggcggcgaggagggcagcggcatccgcgtggacacgacgtcgaacgtgaaggttcatcacaacaccgtctggaacatgcccgggccgtgtctcaccttcggccatggcgacaccggggccagcgccagcctggatgtgcgcaacaacgtcttctccggatgtggngtggcngtgcgcggcggccccgggcgctcgggggccgtggtggacgccaacctctacttncgcaattcgggctcggccctctccggctga

SEQ ID NO: 5803 - DNA, 1671 bp, Myxococcus xanthus
atgcagttgctcgacctgtcgggtgcgcgagagttcaagattttcctgggcatcatcaccccggtggtgctcggcctgtgcgcggtggtgcagccgctggtggtgatgccgtggctgatgaagcgcgccctgagcgcccaggggacgacgcgggtggagcggctcattcgcatcccctccagcatcgccttcgtggagatgatggtgtcgtggacgctgggcggcatcctcttcaacggcggcgcggtgctgctcctggaccggcccgcgtcggtggtgatggtgggcgtggcggtggcggtgagcgcgggcctcttcagcagcccgctggcgtacatgctgttcgaacgggtgatgatgcccacggtgctggacgcctatcagcgcgcgcccagcacgaagcccgcgggtgagggcttcgccacgcgccagctctggctgctgcccgcgatggtggtctccgcgctgctcatcacctgtctggccagcatcgtcacgctgcacctgcgcctggagcgcggcatgggcacgctggcggcggacctggcggcgcagggcgacaccgcggcggccgagcgcgtccaggccacggtgcggccgctggaggcggagctggtgcaaccggtggtggtgctcggcgggtatgcggcgctgggctccatcctcaccgcggcctgggctgcccgccggctggcccggggggctcgcgcggtgggtgcgtccctggaggccctggtggaaggccgagccacgccgccacagtgggtctcctcggatgaagtgggcgacctggcggcgtccacgtggcagctgtaccagcggctccaggagatgccgcgctcgctgcgcgcctccgcgggggacctggccgacgcgggccagcggctgtcacaggccagttcccagcagaaccagacgctgtcgcggcaggccgcggcgctgcaccaggcgcgcgccacggcgcaggaaatccagcaggcgtcccacgtcacgcactcgcgcgccaccagcatcctccaggtggccgagcgcgccgccgccgtgggcaagctgggtgaggagtccctggccggcacggagaaggggctcaccgtcatccgcgacatcgcggccgggctgcacgagcagatgctcgacctggagcaacgcgcccgcgaggtgggccgcgtgtcggaggtggtgaagtcgctggcggaccagtcccacatgctggccatcaacgcggcgattgaagccacgcgcgcgggcgagcacggcaagggctttggcgtggtggcgcggcagatgcgcgacctggcggaccagtccgtccgggccaccaaccaggtgcgcggcttgctggagagcatggccacggccacccagcacgccacggcgatgtcggaccagggcgcggcgggcgtggccgaggccctggagccgctgcggcacagcggcgaacggctgcgcgagctggcgggactgtccaaggagtccgcggcggcagtgcggcagattacggaggccgtgtcgcagcagcacgcgggcgtggaccagctcttcgccgcggtgcgcgaattggatgagctgacgacggacacgctgcggcacctggacaccacgcagcaggcagcctcggccgtgagccacgcgacgggacaggtgtcgcagttggctgaacgctacgtctga

SEQ ID NO: 5804 - DNA, 159 bp, Myxococcus xanthus
atgcgcgggatcatcaccggacgagaggtggtcgccaacctggggctcatctaccgggagttcgggacgggctgcgtgctgcgctgcctgtgggtcatgctgagcgggaagacgacgacgttcctcgaggtcgcgtgcccgccggtggcgaagcggtag

SEQ ID NO: 5805 - DNA, 867 bp, Myxococcus xanthus
atgcacgacctcatgcctttcgagccctacgacatcgatccgaacgacccgcgcgcgccgccccaggagacgtgggacgcgctctcgtccgaggagcgtcaacgtatcgtcgacagccttccatccgaattccccgtttcggaggcaaacccgccggagggcgatttccacttcgaggccaagacgcgtgcccgcgaggtgctcggcagcttcttctcccgcattggtcgcaaggtgtacctggggagcgagctgcccgtgtactacccaggcgaatccatgttcgccccagacgtcatggccgtggtggacgtcgagccccacgcgcggatgcgctgggtggtcagtgccgagggcaagggcctggacttcgcgctggaagtgcacgtcgcgggtgagcggcgcaaggacttggagcgcaacgtcgagcgcttcgcccggctgggtatccgcgagtacttcgtcttcgaccggggccggctacgactgagcggctggcggctggacgaagggcgccgcgtctatcgccccatccttccgcagcacggcctctatccatccgaagtcctgggattggacctccaggtagatgacgagcgtctgcgcttctacctgggaggtgcggccctgccggaggcacccgagctgattgcccgcctcgaacacatggtcgagcgcgtcgaggccagccgcgcggaactcgtacagcaactcgcggaggagtcccgcctgcgagccgaggagtctcgcctgcgagccgaggagtcccgactcctggaactggaaacccagcggcgcgaggacgccgagcgccagctcgccgaggctcgggcggaaatcgcgcgcctgcgtggcgagcgcgcctga

SEQ ID NO: 5806 - DNA, 345 bp, Myxococcus xanthus
atggcacatcccgtgagctacgaggggacggcggagaacttcgaccaactggtcctggagcccaagggcgagctggtggtcgtggacttctggggtgacggctgcccgaactgcgaaatctacgcggcggccgagcccgcgctgctggcggagttgggtgacgctccgatgcgcgtcgtcaaggtgaacgcgtaccagtacgaggacctggccaagcgcttcggactcttcggcatccccacgttcctgctgttccgtgagggcaagctcatcgggaagatgagccagtactacggcaaggagtactggctcggcgtggtgcgggaccacctgccccaggcctga

SEQ ID NO: 5807 - DNA, 888 bp, Myxococcus xanthus
atgtctcgagtcttgacgaagccggggccggtcacggtggcggtcctgacgttgctcgtcgcgatggcctccatccagacgggcgcttcgctggccaagcaagtcttccccgtcttgggcgcggcgggggccacggcgcttcgcgtgttcttcgcggcgctcatcctggcggcggtgttccggccctggcggcagcggctcacccgcaaggacttgcgggccgtggccatctacggcgcggcgctgggcgggatgaacctgaccttctacctggcgctggagcgcatcccgctgggcatcgccgtcgccatcgagttcaccgggccgctcgccctggccatcttctccacgcgccgggcgctcgacttcgtgtgggcgctgctggccgtggcaggcatcctgctgattctgccgctgtcggagacgtcgcggtcgctggactggatgggcgtcttctgggcactggtggccgccacctgctgggcgctgtacatcctcttcggtcagcgggccggaggcaccgtccacggcggcacggcggcgtcgctggggatgtgcgtcgcggcgctgctcgtcatgcccttcggggtcgcgcacgccggcatgaagctgctggacgtgtcgctgcttcccatcatcctgtgcgtggccgtgctgtcgagcgcgctgccgtactcgttggagatgtatgccctcaaggcgctccccacgcgcacgttcggcatcctgatgagcctggagccggcgctggccgccgtgtccgggctgctgctgctggatgagcggctgtcgctggtgcagtgggcggccatcggctgcatcatcctggcgtccgtgggcagctccgcgacgtcgcgcaagcccgttgaagccgtcgccgcgagctga

SEQ ID NO: 5808 - DNA, 813 bp, Myxococcus xanthus
atgttcaggcggctcaccgaggcgctccgcgtcctgacgcgacgctccccgataagcggccccggccccacgccgggtgccccccggcagatgctcctctcagacgtggccgctgacgggcggccccggacgaagaagccggccgcgcgccgctcaccgccacgcaccacccggctggcgcgctacttcgacctccacgacgacttccgcatccccggccggcccgagctgagcgacccggtggcggtggatgtccgccggaagctggactccgtctggctcttcacctccggcgcccgggtgcggagcgtgggcaagctgcgcctggcggtgacgccgcccggactgccgctggacttctcgctcgcgggcgcggggctcacccccgtcgtctccgcgcgggtggcctctgtcttccgggagctggcccccgatgacgtgcagttgctgcccgtggaggtggaggaccgcgacgagccccacttcatcctcgtcgccacccggctggtgcgctgcatcgacgaccgggcctgcgaggaggtcatccactacaccgccgaggacggactccccgagcgcgtggggcactaccgcaacgtccgcggactccgggtcgatcccacgaagacgaacggcgcccgggtgttccgcacctggggctggccggtgagcctcatcgtgtccgagggcatcaaggaggccctggagcatgccggcatcgccggcgcgcgcttcgccgaggtgacgaagccgccgcgcaagccccgccggaagaagacagccgccaagaagtcccggcccaagcgccgctga

SEQ ID NO: 5809 - DNA, 216 bp, Myxococcus xanthus
atgaacccggacaccggtgaggatgaaatcaacatctccgaccaagacctggcggcaaccccaccgctggaggaggagccggacttccgcgacatcctcccggacgagattcatgagttccgccggggtgatgaggaggaagagccgctggagttgacggcacagccgggctaccgcatccgccccatcgacttcgacaagctgccgcaggggtag

SEQ ID NO: 5810 - DNA, 537 bp, Myxococcus xanthus
gaccgcatcgtccccctggagcaggcgccccaggcgcccgtggcgctggtgttcggcgcgggtctggcgcggggggcggtgccctcccccgtgctcgcccagcgactggatgcggccatcgcgctgtggcagcaaggcaaggtgcagacggtgctcgtcagtggagaccagacgaagcccttccaccacgagacgcgcgccatgcggcgctacctggtggagcacggtgtgcccgaaagcgcgatcctgggcgacgaagcggggctgtccacctatgacagctgcctgcgggccgccacggtgttcggcgcgaagcgggcggtgctcgtcacccagcgcttccacctgacgcgggcgctgttcatcgccaactcggtgggcatcgacgcgtggggcgtggccgcggacgaaggacggtcgacgccgtggcgctaccaggtgcgcgagacgctgtcgcgcgtgctggccctggccatggtgatgctggaggtggagcccgcctacccctctggccgcaccgtgctcccggagcgctga

SEQ ID NO: 5811 - DNA, 465 bp, Myxococcus xanthus
cctccccgcggtaggacacggacttaccttgcgggaatggtggctcagacgtcatccggtccgctgctcatcgtcgaagacgacgtggacatctgtgaggcccttcaggcctacctggagctgcacggccacgcggtgcgcgtggcgcgcaacggccgggaggccctggagcagttggcccaacctccccgccccgccctcatggtgctggacatggccctgcctgtcatggacggacaccgggtgctgaccacccgcaaggcgagtgaagcgctggcccaggtgcccgtcatcatcctgtccgcggggatggcggagatgaatccgagagactgggccgtctatgcgtcttcgtacaacgtggcggcattcctgaagaaacccgtggagccccggcggctgctggaggccatcgagcgattcgccccaaagccggcgggctcccaggcgggcacgttcccctga

SEQ ID NO: 5812 - DNA, 1878 bp, Myxococcus xanthus
gtggtggtgacggcgacgcgcaccgagcaggacgtcacctccgcccctgcctccgtcaccgtggtgacgcaggaggacctgaagcgggcgcctgtaggtgatttgacggacgccatccgcctggcgcccggcatcagcctgacggccggcagccagggccgccgtggcatcagcatccgcggcatggattcgagctacacgctcatcctggtcgacggaaagcgagtgaactcgctggaggcggtgttccgccacaacgacttcgacatcggcctcatccccacggagggcatcgagcgcatcgaagtcgtccgcggcgccatgtcctccctctacggctccgaggcgctgggcggcgtcatcaacatcatcaccaagccgattgcgcccaagtggacgggtggcatcgacctgaaggcgcagacgcccaccgtgggcgccaacggcgaggagctccgctccagcgtcttcctcagcggtccgctcatcgaggacacgctctccatgaagctgacgggcggcttcaaccaccgccaagcatggaatggcgcgcgcaacccgggctcgcccgtgctcaacgcggacggtgcgccggtgacgcgtgaagacggcagcgtcgtcaaccacggcgacctggccacgctcgagggccgcaatgaccacaacggccggctgtcgctgaactggacgcccaccgcgcagcagacgattaccgccgagtacggccgcgcgtaccagaaccgcatcggcgagtactacatcggcggctcctacggcgacgcggacgcggtggtccaccgcaacgacgcggtgctgggccacaagggcaagtgggactggggcaactccgaggtccgcggctactgggaaggactggagagcggcgtcgacggcctcacccaggacaacatcgtcgcggaggcgaacgccaccgcgtacctgggcatcaacacgttgacggtgggcggcgaggcgcgctggattgacctcaagtcggacgagttcaccagcggcggcgccagcgtgcaccagcaggccctctacgcgcaggatgagctggcgctgatggacaagctgacgctgctgctgggcgcgcgtctggacaaccacgagaacttcggcctccacttcacgccgcgcgcctacgccgtctactcgcccatcaaccacctcacgctgaaggcgggtgtcggcacgggcttcaaggcgcccacgctgcgtcagatgagcaccgagtccctggtgacgagctgccgaggccgctgcggcatcatcggcaacccggacctggacccggagaagagcaccaacttcgaggtgtccgccaactggaccatgacgtcgtgggccctgtcggcgaccgtcttccagaacaacatccgcaacctcatcgacacgccgcgcggcacgggcgtggagccggtgggcaccgacccgggaacgggcctgcccctgtacgtgccccgcaacgtcaaccgcgcgcgcctgcgcggcgtcgaggcgacggcgagcaaggccttcggcaacgtggtgcgcctgagcgcgaactacaccttcctggagagccgggacctggagaacgacgtgcagctcgcctaccggcccaagcacaccctcaacggccagattgacctgacgccggtggacaagctgaaggccttcgtgcgcggccagtacattggcacgcagctcagcggcaccgaggaagtggaggcctatgccctcttcgacgccggcgccagctacgacatcagcaagaacttcggcgtcaacgcgggcgtcctcaacctcgccaacacccgcaccgaggacgaggaaggctacgtgttccaggagcgcggccgcaccctctacgcgggtgtgaacgcgcggttctaa

SEQ ID NO: 5813 - DNA, 513 bp, Myxococcus xanthus
gtgctgaagctctacaagaaggaaggcaaccggctccgctactgggaggcctgggtgcatgacggcgcactcaccgtgcaccaaggcctcgtgggcgagacgggcgaagaccatcaactacccctccccccggatgaagacccggacatggtcatcgccgaggccgccggtcccctggtggaccagggctatgacgagcctgagcccacggcgatgacgaccctcatcgtccagtacaccgtcgagggcaagggcaccggccacgacgtggagaagcgcgtcgccgtggaggaattgctcacggacgcgctcggctggacgggcaatggcgaggtcgaaggcggtgagctccaggcccagcagctccgcgtctactgccgggtgatggacgccgacgcgggcgtgcgcacggccgtggaggccctggactccgaggacctgctcgaaggcgccaccctgctcatcgccagggacgacgaagaaccgcgggccgtctggcccacgcaagcctga

SEQ ID NO: 5814 - DNA, 771 bp, Myxococcus xanthus
atggacctggagctcagaggaaagacggccctcatcaccggcagcagccggggcattggccgggccatcgcgtcggtgctggcccgcgagggcgtgcgggtgtgcctcagcgcacgcggcgcggaggccctggaggccaccgcggcgcagcttcgcgccgggggcgcggatgtggccaccgtggtgacggacgtggccacccaggccggcgccgtggaagcagtggaggcggcggtgcgcgccttcggccggttggacatcctggtcaacaacgtgggcggcagcggcggcgcgggcgccttccattccgccaccgccgagcagtggacatccgtcctggaccgcaacctcctgtccgccgtgtggtgcagccagcgcgccgtggaggccatgcgccagcagggtggcggctgcatcgtccacatcaactccatctttggccgcgagtacgccaccagcgccccctacactaccgccaaggccggcatcaccgcgctcaccaaggagatggcggtggacctggcgcagtaccgcatccgcgtcaacggcgtggcccccggctccatcctcttccccggcggaagctgggacaaacgccagaaggcggatccagagaaggtggccagactggtgcgtgacgagctgccctggggccgcttcggcgcccccgaggaagtggccgacgtggtggccttcctctgctcggaacgcgcacgctgggtcacaggggccaccctgcccgtggatgggggccaaggccgtgccttctga

SEQ ID NO: 5815 - DNA, 1590 bp, Myxococcus xanthus
atgaccgagcgagaactgtgggagcggtaccagcgttatctgtgcgtcgtcccggccttggacttcacgctcgacgtctcgcggatgcgcttcccggcggactacctggagcggatgcgcccccgcctggaggaagccttcggcgcgatggaggccctggagaagggcgccgtcgccaacccggacgagaagcgcaaggtgggccactactggctgcgcgcgccggagttggcgcccgagcccgcgctccagaaggaaatcaccgacacggtggccgccatccacgccttcgcgaagaacgtgcatgagggccgggtgaagccgcagaaggcgcagcgcttcacgcacatgctgattgtcggcattggtggctcggcgctggggccgcagttggtggcggacgcgctgggcacggcgaaggacccgatgcaggtgtccttcttcgacaacacggacccggacggcttcgaccgcgtgctggcgcaactgggcgagcggctgtcggagacgctcaccctggtcatcagcaagtcgggtggcaccaaggagacgcgcaacggcatgctggaggccgagcgcggctactcggcgcgcggcctggacttcagcaagcacgccgtggccgtcaccggcgccggcagcgagctggacaaccacgcgaagaagcagggctggctgcgcgccttccccatgtgggactgggttggcggccgcacgtcggtgacgtccgcggtgggcctgctgcccgcgcgcctgcaggggctggacatcgacgcgctgttgaagggcgcgcgcgacatggacgcggcgacgcgggagcgtgatgcgctgaagaacccggccgcgctgctggcgctcatgtggcactacgccggtgatggccggggccacaaggacatggtcatcctgccgtacaaggaccggctgctgctgatgtcgcgctacctccagcagctcgtcatggagtcgctgggcaaggagaccgacctggatggccaggtggtgaaccagggcatcgccgtctacggcaacaagggctccacggaccagcacgcctacgtgcagcaactgcgcgagggtgtgctcaacttcttcgccaccttcatcgaggtgctgaaggaccgtgacggcggctcgcaggaagtggagcccggcgtcaccagcggtgactacctgctgggcttcctgctgggcacgcggcgcgcgctctacgagaaggaccgcgagtcactcaccctcaccgtgccggacgtgagcgcgcgtacgctgggcgcgttgattgcgctgtatgagcgcgcagtgggcttctacgccacgctggtgcacatcaacgcgtaccaccagccgggcgtggaggcgggcaagaaggccgcgggcgtggtgctggagctccagcgcaagctgacgacgcgcctgcgcgaggcgcgcgcggaggcccgcaccgccgagcagctcgcggcggacatcggcatgccggacgaggtggagacggtgttcaaggtgctccagcacctggccgccaacccggaccgcggcgtcacgcgcaccccgggggccaccccgacacaggcgcgcttccaggcgaagtag

SEQ ID NO: 5816 - DNA, 906 bp, Myxococcus xanthus
atggacgcagcacacatccccgacctcatcaccccggccatcccggtgttcaccctcacggtgattgccgaggccctctgggtgaagaagcagcgggacgaaggccgtcccatggtgggccacacctggaaggacacgattgccagcatctccatggggctgggcaacgtggccatcaacgtcctgtggaagggcgtggccttcgccggctacctggcgctctaccacctgacgccgctgcgcatgggcaccggcgtgctggcgtgggtgctcatcttcttcgcggacgacctctgctactacgccttccaccgcgtccaccatgagagccgcatcttctgggcgtcccacgtggtgcaccactccagccagcactacaacctctccacggcgctgcggcagacgtggacgccgcccaccagcttcgtcttctgggcaccgctggcgctgctcgggttccacccggtgatgattgtcgtgcagcagtccgtcagcctgctctaccagtactggattcacaccgaggccattggccggctgccgcgcccgctggagtgggtgctcaacacgccgtcacaccaccgcgtgcaccatgcgtccaacccgcgctacctggacaagaactacgcgggcatcctcatcatctgggaccgcctcttcgggacgttcgagccagagggcgagaagcccgtgtacggcctgacgaagaacctggagacgttcaatcccgtgcgcatcgccttccacgagttcgcggccatcacgcgcgacgcggcgaagcccggctccctgaagcagcgcctgagctacgtcttccgcaacccggcctggaagcccgacgccccagaggcgccccagccgcccggggtacagcccccgcccgaagcggcgcgcccctccgtgtga

SEQ ID NO: 5817 - DNA, 1239 bp, Myxococcus xanthus
atgcaccgcggcagcgtggcggaggcctcccaggtggagttcctcacggagttcgcccgccggcgctcgctcgtcttcatcctcaacttcgcggacgagctgtctcccgagtcgcgcgacacgctcaaagcccaggtacgccgcgtggcctccgaacagtacggcctggcccaggaagacgtgcccgtcttcgccatcagcgccctgtcggcgaaggacggccgggacgtgtccggcgagttcggcgccctgctcttccacctgcgcgggttggccacgcaggcggtggccgcgcgcgtgcgcaagacgaacgcgatgggcgcgctggaagaggtgcacacccgcgtggaggccgcgctgaaggagacggacgcgatgctgtcacgcacgcgcgccgcgctggactcggggatggagaaggcggcggagggcctgcgcgcggacttcgacgcgcggctgcggctggcgcacggccacctggcggcggaggtgcggcgtcaggcgggaggccgcttctgggggcccgcggcctggggcctgcggctgtccctctggggcgccagcgggctgggcgcggcggcgctggtggggcggagcagtctgcccgcggggctggcggtggcggcggcgtccaccgtggtggacgtggtgcgcggacacacccgcgccagggccgcggagtccgcggtggtggagcccttcgaggacgacttcagcgcccaggccgcggcgcgcaccgcgctggcggaggcgcgcagcgtggcgcgcgcgagcggactggagcccgcgctactgggcgtccccgacgtggacacgctgttggaggaggtgcgggtggcgagagcgggcgcctggcgctacaccgccaccaccggcgtggcggaggcggtggccggctggtggcgcaccgcgcgctggctggtgctgccgctcatcaacctgccgctgctggccctgctgggccatgtgggctaccgcgtggtgcgggcctacgtggaaggccccctgctgccgttggactacttcgtcaacgcgggggccctcttcatgctgctcgccggagcgggcgcgttgctggcctcagcgagtctcgctggagccgctcgccgtgcgggtaccaccggacgtgcgcgcttcgttgagtccctggccgccctgggcgggaggctgggagagaccgtcgaggatgctctgcgccccgggcgggaggccgcgaagggcctgctggcgctccggtga

SEQ ID NO: 5818 - DNA, 654 bp, Myxococcus xanthus
atgagcgagcccaaggggaaggcgaagcggacaagcgagctggtgcctggcgtccaccactggaccctctccgatgaccgcatcggcggcgcgcgcagtgacgcgtacgccgtggtggacacggatggcgccgtcgtcctcattgacccgctgcccatcgacgaggaagcgctgcgcaagctggggaacatctccgccatcgtcctgacggcgggaaaccaccagcgctccgcgtggcggctgcgcaaggccttcaaggtgcccgtctgggcacccgagggagcacagacgctggaggagcagcccgacttcttctacgtcgcgggagacacgctgcccgggggactcatctcgttccacacccccggccccaccgaggcaatgtacacgctgtggatgcagcaacacccgcgcgccgtcgcgttcatctccgacctgctcacgcacgaggacggcgagacgccggagttcatccccagcgagtaccaggacgaaccgctgcgcacccggcacagcgtccagcgcatcctggaccacctccccgtggagacgctgtgcttctcccatggagcgcccatcctccgcgacggatcccgcgcgttgcggctcgcgctggaagaggacatggagtcgcccgccgcgccagcgccctga

SEQ ID NO: 5819 - DNA, 750 bp, Myxococcus xanthus
  unsure (1)..(750): unsure at all n locations
tctttcggtaagtaccggcttgtccagcagctggcgaccggtgggatggcccagctctatctggcctccatcgacggccccgacgggttctccaagtcctgcgtcatcaagcgcgtcctgccggagtacgccagcctggagtcgttcagccgcatgttcgcggacgaggcgaaggtcgccgcgctgctgacgcacccgaacatcgtgcaggtcttcgacttcgggcgggtggacggccagtactacctggccatggagtggattcagggccactcgttggaccggctgctgcggcaggccctccggagcggccgggtggtagggactcgcgtggcggtggacgtggggctcgcggtggcggacgcgctcgcgtacgcgcacgcgaagacgctgccggatggaacgcccctcatgctggtgcaccgcgacgtcacgccgggcaacgtgctggtgtcgcgcgacggcatcatcaagctggcggacttcggcatcgtgaagagcgccgtcaacgcggagcgcaccgtcgccggggtggtgaagggcaagtacccgtacatgtccccggagcagatcaccagccaggagctggaccaccgctccgacctgtattcgctgggcatcgtgctctacgaggccgccaccgggcgccgcctgttcaagcgcgacacgctggaggccaccatcatggccgcgtcccaggcgaacgtgcccgcgccgtccgaggggacgcccgnctttccccgcggagct

SEQ ID NO: 5820 - DNA, 1632 bp, Myxococcus xanthus
atgaagccctcgcacctgttcctcatcgtggcgctggggttgtccaccaccgccactgcgcagccagacgcgcgcttcaacgtgcagctcttccgtccgtccggcgcgccccaggacctggtcgtggtgcagcagtcgcgtccgctgtcacacctgtccgtctcggccgggccgtacctcagctactcgctcaaccccctgtccctgattcccgagggcggagacctgagcaagatcaacctggtcggcaaccgccttcaactggacgtcatggccaccattggcctcttcgactgggccgaggtcggcgtggacatgccactcatcctcgcccagggcggcgccaacctggaggtcattggcaccgaggggagcgtggagagcttcgtgctcggtgacctccagctcaccggcaaggtggccatcccgggcctgcgccggcccgccgagggcaagggctggggcggcgcggtgacgctcaacgtgagcttccccactggcgcccaggacgccttcgccggagacggcgagatgacgtgggccccgggcctggtgctagactaccgcttcgagaacggcatcctcctggcgctcaacggcggcttctggaagcgcccggaccgcgtcttcagcggcgtgtccgtgggcgacatgatgcccttcggcgtcggcgcggaggtccccatccttcgcggcagcggtgtcaccgcggtgggcatggtgcacggcgcggtggggttgcagaagcaacccgatgagccccggcagattcccgcggaggcgctcttcggcctgcgctggtacagctccaccgggctcaccttcacgttcggcggcggcatgggctgcggctgctccatcgcctcgccctcgctgagcttcttcacgtccatcctgtggattccggcgaagacgcgcgagtgggaggccctggagcgcttcaaggagccgcccgagcccccgccgccgcccatcgacccggatggtgacggcgtgattggcgagtcggatgcgtgccccgacgtggctggccccgtggccaacatgggctgcccggacacggacaaggacggcgatggagtggtcgaccggctcgaccggtgcccggaccagcccgccggcagccgcggcaaggacgggtgcccgctggcccgccgcgatggcaaccgcattgtcatcctggagcagctcaacttcgccaccgaccaggacatcatcctctccgagtccttccccatcctggaggaggtcgcgcgggtgatgaacgagaacaccgaggccgaccgggtgcacgtcgagggtcacaccgactcgcgcgccagcgatgcgtacaacctggacctgtcgcgccgccgcgcggccagcgtcatgcgcttcctggtggagagcggcgtggcggcggagcggctgtgctcgcagggctttggccgctcgcggccgctggcggacaacgcgacggaagaaggcatggcactcaaccgccgcgtcgacttcaccatccagccgccgagcgacggaccgcgtccgccctgcccggaggacgcggaggacaagaagcgcaagcgccccaccaagaaagcgcctgccacgcccaaggcgaagtcgaaggcccccgcggctccgaagccgtag

SEQ ID NO: 5821 - DNA, 216 bp, Myxococcus xanthus
atggccaccgatggcatcaccgtgctccgcgcggatggctgcatcgtgggctacaacatcttcgtgcgacatcccgagacactggccagccagccgtctgtggttggcggcgctcggcggcggaccttcgaggtgctgtgcgcggccctgggcacggagctcaccgccgcgttcatccgctcccaggatggggacgtgagctgcaagcgggtctga

SEQ ID NO: 5822 - DNA, 1743 bp, Myxococcus xanthus
atgagagacccgtacaccctgcgcacctgcctcgcgtccgccctggacgctctgcccgctcccgagcgcttcccggatgcctcggacgccgagctcgcgcgccgtctggccgaacgcctgcgtcgcgacctgctcccccgcctgggctccgcggactcccccctgttgctggtggccatcgccggtcccaacaacgtgggcaagtccacgctcttcaactcgctggtgggcgcggcgctgtcccccgcgaggcccgagggcgggctcaccaagcagtgcctggcggcggcccactcggagacgtggaccgggccgctgaaggacttcctgacgcggcgctatgacatcgtgcccgtggcctccggcgacgcggcgcccgtggaccaggcggggcctccgggccggctgtacctgacgctgtcggacgcggtacctcgcgggctgctcgtcatggacacgccggacttcgacagcgtgtaccgcgacaaccgcgagcgcgcggaggcgttgctcgtcaccgtggacgtgctggcgttcgtggtgagccggcagacgtaccagaacgccgcgctggtggacttcctgcgcgcggccgtggggcatgggcggccgtacctgctcgtctataacgaggccacgcgcgaggaggtggcccgcgggcacctggacaagctcgccgaggacgtgggccacccggcgctggcccgctacctggcgccgcaccagcccgacgtggaggcgggactgaagcccctggccacggagcccctggacgggaagcccgcgctgggagcgctgctgggacaggccgaacacgcgcgcgagctgaaggcccgggcgctggaagcctcgctcgcggatgcgcgcgcggagatggaggccgtgtcgcgagcggcctcggaggcggcgcgggagcccgaccggctccgcaagcgactgcgccacgaactggacgtggtgggggcgcacgcggcgctgaaggccgtgcccgcggacgtgctcatcgacgccttccgcgacgaactggatgcgcgcagtcagttccacaagtgggtgcgcctgcccttccgggggctggccacggcgctcaccttcgtcacgcgcaaggtgcgcgagtccttcaccgcgcccgaggccccgggcgcggacacgccgacccacgcggtggacgagacgctgaaggacggagtgcggcggctggtggatgccttcgctccggaagtggccgcgtggcgcgccgacgcgcagacgcggacgaagctggaggaagccttcggtccggtgacgctggcgaagctggaggagccgctgggcttcgagcccctgcacgcgcacgcggcggaccgggccacgctgtatgcgtactgccgggagttggtctccgcggagcttcagggcgacatgcgggaggagattctccagacactgacgacgctggtgtactccgtgccgtcaggcgcggcggcggcggtgacggtggccacgggcggcatgggccatgacgcggtcgtctgggcgggcaccttgctgtccacgccgctgatggagcgcttcgtggacctgctaggcgcccaggtgcgggcgcgtgtcacgaagaagtgggcggatgcccacggcgcgaccctgtcgagagccctggaggcgcggtacttctccgacatcctgaagcagctcgacgggctggccagcgactggaaccagacggcggcccgcctggacgaggcccgggcaggcttgtcctga

SEQ ID NO: 5823 - DNA, 1170 bp, Myxococcus xanthus
atgaacaagacgtcatccatccaggccgcgctcgcccgggccgccgaggccgcggcggaggcgccgcgctccgtcccggcggaggaccatgtctggcggcggcggctcgtcattggggacccgcaggccgacctggaccaggtcctggccatcctggcgcaccacggactgttgaccggcgagggttggcttcgctccgacgtgcagctcatctcggtgggcgaccacttcgactggggcaagcccgccgagcgtgagtccgccgccgccagtgggctggcgctggtggcgtggctggccgcccacccggcgacccaggcggtgatgctgctgggcaaccacgacctggcgcgagtgggtgagctggccggcttcacggatgcgcgcttcgccgaggcccaggccgaagcggaccgcatctaccagggaggcgctacggacgaagcggcggagcaggcgttcctcgcgcgctggcccgaagttccttccgcggagctggtggcccgcgacttcggcaacttccgcgcggtgcagcgcacctgggtggagcacctgctgcgtgtgaagcgcttccgcgtggcccatgccgcggcccccgacctgctggtgctgcacgcgggcgtcacacaggaggacctggacgtgacgcgcctgcctcccgcccagcgcgaggacgcgaaccaggtggcggcggcgctgaacgcggccctggatgcggcggtggcgggctggactcgaggtccgctcgtcattccgggactgcaccacccaggcgacgcggcccacggcgagggcacgggcatcttcttccagcgccccagcctgctacccgaggacgccgagcgcgtgcgcggcacgccccggcgccgcttcgacccgagacggctgcccacgggcctgacgcaggtggtgggccatacacgcgacaagcgaagccgcgcgatgctggggatgccacccaccggcgcccgcgacggcgtgctgcggcatctcatcacggatggaacgcgcgtggactacgcccacggcgcgccgcatccaccagcacccggcaccgcgatgctggtgttcaccgacggagccatgcgcgagtgccaggccccggactacgagctgttcgacctggacacccgcgcggcggctaccgcgccgaggcctgaagaccgctga

SEQ ID NO: 5824 - DNA, 639 bp, Myxococcus xanthus
atgcaatggctgcgcacgctcgtctgtgatgggccggtgctcctgggctgggtgggcctggcccgcgccgagcccttcaccgagcgcgagcagcgcctgctccaggccctgacgcccgcgctccagcggcggctgaccatggaaacgcggctgcgcgagtcgggcctgatgtccacggcgctgcaggtcgccatggaggcgctggggcgcgccgcctggattgtcagctccagtggccgcgtggtgcacgccaacaatgccggccgagcgcggctggaacggcatgacccggagctgatggagtccctgcgccgcggcgcccagggcattccctgctccggcccgctgaccatgacgccgctgctcaccaccggcctgccaccgcattacctggccatcgacaccggcaccgcgtccagcgccgccgcgcgcgtgcaggccctgtcggcgcgctggtcgctcaccgcgcgcgagtccgaggtgctgacgcacatcatccagggcgagacgaacaagtccatcgccggccggctgggctgcgccgagcgcacggtggaagtccacgtcacgcatctgctaagcaaggcacaggtggaaagccgctcggcgctcatcgcccgcttcttccaaagttcatga

SEQ ID NO: 5825 - DNA, 189 bp, Myxococcus xanthus
atgccctggggcgtgggcacggcgctcgccatctgggccctggtgggcctgggcacgggcgccatcagcgcctggctgggctgggccgcactggccctgggcatggcctacctggccctgggcatgcttcatttcctgagcagggtggtgccccccgggcgcctgcctcgcttcctgcatgtcccatga

SEQ ID NO: 5826 - DNA, 525 bp, Myxococcus xanthus
atgcccgagcgcatcctgacgcaggacccggagaaggcccttgccggtcccaagccgcgctacgagtacgtccgccgggagattcccgcggacctgaccttcaagccagacaccatcaatccggtccacaaccggttcatcgtgagcacgctggtgatggcgttcatcagcctggccctgttcttcctgcccatgttcaacgggctcctggccggcaccttcggcggcttccacgcgcgaaggctgccgcgcgcgctcggcgcggccgccctctccgccgtcgcagtgcccgccgccctcgccttcttcctcttcatcggctcggcgacccagggccacatcttctatggcctgggcttctgggggtacacggcgctctacgtcatcggcatcttcatcggcgccgtgacgggggccatcagccacccgttctggacgagctacaaaattggcgagcccgcccctgtcagcgcacctcgaacccaagtgccagacgccgctccgccgagccggccaaccacgtag

SEQ ID NO: 5827 - DNA, 675 bp, Myxococcus xanthus
atgacaggacagacgcagctcatcggcaagcagggccaggcactggcgggctatctgagtgaagccccgaagggcgacgcgcccggagcggtggtgctcatccatgagtactggggcctcaacggccacacgcgcgacgtggcggaccggctggcgcgagaaggcttcaccgtcttcgcggtggacctctacgaaggccgcgtgacgaaggacgccagcgaggccaacgcgatgctgaaggcgatggcttgggacaaggccacggcggacctgcgcgccgcggtggaggcgctgcgcgcgcgaaagcccggcaccaaggtggccatcatgggcttctgcatgggcggcgcgctgacgctgctggccgccgcgaatgagccggggctcgacgccgccgtgcccttctacggcatccccccggaggaggccgcggacgtgtcacgcatccgcgcgccggtgctcgggcactacgcgaacaatgacgaatggtgctcgccggagcgcgtggacgcgttggagaagaggctgaaggggggcggcgtccccatggagattcaccgctacgacgcacagcacgccttcttcaatgacacgcgtccggaggtctactcaccggacaacgccgcgaaggcgtggcagcgcaccgtggacttcctccacgcgaagctcggctga

SEQ ID NO: 5828 - DNA, 717 bp, Myxococcus xanthus
atgttccaccgcaagggccccaccctccgggagctggccgcgcaggccctcacgtccgtcgagcacggctacgacctgctcgcgcccaagttcgagtacacgccctttcgcacgccggatgcggtgctcgaggccgccattgcccagttgggcgcgcccggcagcgtagacagcgcgctggacgtgtgctgcggcaccggcgcggccatgcgcttcttgcgtccgctcgcgcgggagcgcgtggtgggcttcgacctcagccaaggcatgctcgacgaggcgcgccagcagctcgcgcaggcgccgggcaccgcggcgctggagttcatccagggcgacgcactggcgctccccttcgacggcgcgttcgacgtcgtcaccagcttcggcgccttcggtcacatcctcgaagaggacgagccaaggctcgtcaaaggcatcgcccgcgcgctgcgccccgggggccgcttcctcttcgtcactgcgcacccgccgtcgaagctccgcccgggctactggatggccaagggcttcaacgccgccatgcgcgcgcgcaacgcgctgtggaatccgcccttcgtcatgtactacctgacgttcctggtgccccgggcccgcgcgctgctcgaaacggaaggcttcaccgtcgaggtgcgcgacggactgatgccggagcccttctccgtgctgagcaccgtcatcgccaccaggcgctga

SEQ ID NO: 5829 - DNA, 909 bp, Myxococcus xanthus
atgaacgcctcgtccgacaccgaagccatgggcgtgcaggtccgcgaaggcaccgtccgcctgcgggatggccggcggctcgcatacgtcgagtctggagacttgagcggcctgcccgtgttcttcatccacggcaacccgggctcgcgccacatgcgccacccggatgaccggctcactcacgcgttgggcgtgcgcctcatcactccggaccggccaggctatggcctgtcggactaccagcctgggcgcacgctgctcgacttcccgaatgatttggagcaactggccaacgcgctgagggttggccgcttcgcgctcttcggtgtgtccgccggtggcccctacgtcgccgcgtccgcgtggaagctgggcgagcgcatcacccgcgcggcgctcgtctccggcgcggcgcccctggcccggccgggcgccatggagggcgtgaaccgggactaccgcaacgcgtacgccatggccgcgtggccggagtggctactgcatccattgatggccatgcatgaccggcaggtgcgcgccaatccctcgcgagcgctggcgggcctgcgctcccaggcgtcggcggatgaccgcgcggtgctcgcggacccgcgcatcgccgcgcaggtgcagggctggcgctacgaagccacgcgcaagggcgtggcgggaatacggcgcgaggcgcacatcctcgcgcagccgtggaacgtccccctggaggagattcgaacggaggtggacctctggtactgggagggagacagcatcgtcccgccgcagatgggacggtacctcgcgaaccggattccgcgtgcggtgccccgcttcttccccggcggcggacacttctccatcttctcccactggacggacatcctcacgccgctggtacggcagggaagctga

SEQ ID NO: 5830 - DNA, 120 bp, Myxococcus xanthus
atgagcgcgcccccggccgcgctgcccttcggcgtgctgctgcgcgtcttccttcgctcgctcttcctccaagcctcgtggaaccccaagggcatgcagaacctaaggctggcctacgcc

SEQ ID NO: 5831 - DNA, 927 bp, Myxococcus xanthus
atgcgcctgctgcgctacgcggccccgcgacggcgccaccgcacgcccatcctcttcgtctattcgctcatcaatcgctggtacatcctcgacttccttccagggcgcagcctcatcgagcacctcacccgcgagggatatgacgtctacgccatcgactggggtgtaccgggacaggacgaggagcggctcacctgggatgacctgctcggcgggctcatccagacggcggtgaggtggacgctgcgcgtgagcaagagccgggatttgacgctctacggctactgcatgggcggcaccatggccctggcgtatacgtccctgtaccccgagggcgtccgcaacctcgtggcccaggccacgccggtggacttcagcaagggcggcctctacacgctgtggacgtccgccaaccacttcgacgtggactcgctggtggacgcctacggcaacgtccccacgccggtgctggagagcggtttcctcatggccgcgccggtgcagcgcctcacccggtggctggaggtgtgccgccgcatcgacgacccggagttcgtcaccacgtttctggccatggaacgctggggcgcggaccctgtgcccttcccgggtgaggtgtaccggcagtacatcaaggactgctaccagcagaacctcttcccccagggcctcatggaagtgggcggcgagcgagtggacctgcgccgcatccagtgcgccatcctcaatgtcatcgccgagcacgacaccatcgcgctgccggcgatgagcgagccgctgccctccctggtcagctcgaaggactgtgagacgcggcgctaccccgtgggccacattggcctgtccgcctccagcaagggcgcgacgaaggtgtggccctctatttccgcgtggattggcgcgcgctcgaaaccgatggaaccatga

SEQ ID NO: 5832 - DNA, 258 bp, Myxococcus xanthus
atgcgccagggattcaacgcccgcatccgccgcaatggcctggtggaaggcgcgctgcgcaccctgcgcctgcccaccacctccgaggtggagaacctgcgcgaccagctccgccggatgaatgaccaggtggaggcgctcggcacccagttggaactggtggtggacctgctccaccgtcaggaaggcgcggagcccgagcctgagtcccccgagcccccgcccaaggagcgcgcgccctccaagcgccgccgctga

SEQ ID NO: 5833 - DNA, 189 bp, Myxococcus xanthus
atgacgctctacgcccgcgagggtgtgaaccatctgtggttcgcggacccgcgcattcagttgctcgaggtctatcgtcgggaaggcaacccctggcagcgcctggacgcgtacaccggtagcgcccatgtcgatgccgagcccttcgaggcacgcaagttaattcttggttcactttgggaacgatag

SEQ ID NO: 5834 - DNA, 750 bp, Myxococcus xanthus
atgaacgttctgattaccggggccaccgcgggattcggcctggccattgcccgccgcttcatccaggacggcgcgcgcgtcatcgcctccgggcggcgcaccgagcggttggaggccttgcgcgcggagttgggcgagcgggtgctccccctgacgctcgacatcacggaccgtgaggccgtggagcgggccatccgctcgctgccggcggagttcgccgaggtggacgtgctggtcaacaacgcgggcctggcgctggggttggacctggcgcagtcggcccgcgtggaggactgggacacgatggtggacaccaacgtgaagggcctcctgtactgcacgcacgcggtgctgcccggcatggtggcgcgcaaccggggccacgtcgtcaacatgggctcggtggcggcggagtggccctacccgggcggcaacgtgtacggcgccaccaaggccttcgtgcaccagttcagcctcaacctccgcgcggacctgcacggcaccgccgtgcgcgtgacggacatcgagcccgggctggtgggcggcacggagttctccaacgtccgcttcaagggcgacgacacacgcgccgcgtccgtctacgccaacacccaggcgctgacgcccgaggacatcgcggacgcggtgcactgggtggccacgcgacccgcgcacgtgaacatcaacgtcatgtcgctgatgccggtgtcacagtccttcgggcccctcccggtgaagcgacagggctga

SEQ ID NO: 5835 - DNA, 363 bp, Myxococcus xanthus
ttggacatcttcaaggaattcacctttgaggccgcgcaccggcttcccaacgtgccgcccgggcacaagtgcagccggcttcacggccacagctaccgggtggaaatccacgtgcgtggcccggtgggctcgcagtccgggtgggtgatggacttctccgacatcaaggaggccttcgagcccctgcggctgaagttggaccactactacctcaatgaggtggaaggcctggagaaccccaccagcgagaacctgtcgcggtggatctggaagcgcctgcgtccgggcctgcccctgctcagccgggtggtggtccgcgagacgtgcaccagtggctgcatctatcaaggcgaagacgactga

SEQ ID NO: 5836 - DNA, 1611 bp, Myxococcus xanthus
cgtgctctaagggccagcatctggtcggacgtgctgcacacgaaccatgctggcatccacgaccacttcttcgacctgggcggccactcgctgctggccacgcgcgtggtgtcgcggattcgcgaggccttcggcgtggagttgcccatcgccgcgctcttcgaggcgcccaccatcgccacgctgtcggagcgcgtccaggtgctccaggcccagcaggccggtgaagcaccacccccgccgctccagccctcctctcgcgacggcgagctgcccctgtccttcgcacagcagcggctctggttcctgtgccagatggagccggacagccccttctacaacatgcccgccgtcatccggctgacgggcgcgttggacccggacaccgtgcagcgctgcctggaggcgctcatccgccgccacgaatcgctgcgcacgacgttccggatgaatggccacacgcccgtccaggtcatccacccgcccgccgaaccgaaggtggagaccgtcgacctgcgcggccttccactggagcgccgtgaagtcaaagcgcgccgcctgtccgacgaaaaggcccgccgtcccttcgatctgactcgcggcccgttctgccggatggggctcatccagttggatgaccaggaacacctgctgctgctgaccctgcaccacatcatcgccgacggttggtcgctgtctgtgctcgtccgcgaggtcgtcgagctctacgccgccctctccgcgggccagccgccgccgctcgccgccctgcccgtccaatacgcggactacgcgcggtggcagcgggagtggctgtccggtcccgtgttggaacggcagctcgactactggaagcagcggctcgccggggctccgcccaacctggacctccccacggaccgtccacggcctccggtgcagagcttccgcggcgccacgcaccagggcgtgctgctgcccgtggacgcggccaaggcgttgcaggcgctctgccggaaggagagcgtcaccccgttcatggcggtgatggcggccttccaggcgctgatgcaccgctacgccggcgagacggacatcgtcgtcggcacggacatcgccaaccgcaaccgctccggcaccgaagggctcattggattcttcgtcaaccagctcgtcattcgcggcgacctgagcggggaccccagcttccgggccctgctggcgcagacgcggcgggtggcgctcgatgcctacgctcaccaggacctccccttcgaggaactggtgaaggcgctcaacccggagcgcgacctcagttactcgccgctgttccaggtgatgttcgacctggtgcgcgcggaccgcacgatggcggacgccttcccggacctgcgcgcccgaccgctccagccggaactgctcaccagtccgttcgacctatcgctgtgggtcgctgaatcccccaccggctacaccctggcgctgcgctacggcaccgagctgttcgagcccaccaccgcacggcgactcatgggacattacgtccggttgctccagcacgcgctggaagcgccggacaccgcagtgtccgcgctggagctgctgcccgcgagtgagcgagagcaccgtaga

SEQ ID NO: 5837 - DNA, 812 bp, Myxococcus xanthus
atgagcgacggccagcccaccgagggcctcaccgcggacgaagagctgacgcgaatggcgcgggagctgcgcgccaccggcctcaccctgagcgccattggcgtgggcaccgacttcaacgaggacctgatgcaggccttcgccgagtacggcgccggtgcctacggcttcctggaggacgccgcccagctctccaccctcttccagaaggacctgcagcaggccgggacaacggtggcgcgcggcgtgacgatgaccttcaccctgccccccggaacgtcactgggcgaggtgctgggctaccgcgccagccagtccggcaatcaggtccatgtgtcgctgcccgacttctccgcgggccaactggagcgcgtggtggtgcggctcaacgtcaccggggactcggtggggcggacggcgcgcgtgctggacctgaagctggcgtacacggacctcatccgcgacgcggaagtggccaatgaagcctcgctgtccgcggtggtaaccaaccggcgtgaggaagtgctcgcccgccaggaccgcgaggccaccgtctacgccgcccgggcgcgcagtgccgtcaacatgcagaagtcggccgaggccctgagcgagggccgcaaggacgaggcgaagctctatctgcaacgcacccaggcggctcttcgccgaagccagcgcggtgtccggcagcgccgcggtggcggcggaccaggccgaacagcgggcggtgatgtacgagtacgacagcgcggagggccaacaggcccggcgctcgctcgtgaagaagagcaaggtgaaggcgctcaaca

SEQ ID NO: 5838 - DNA, 504 bp, Myxococcus xanthus
atgctcaaccgtcccacccgcgtcatcctcgcggcgctcctggcggcctccttcaccgccggctgtaacaaggagaaggcgccggccaccgctcccgcggcgcagcaggctgcgggtgagcccgcgcccgacactgtcgtcgcgacgttcggcgacgggcagaagatcacctacaaggagctcagcgagcgcctccaggagccgctggccaacctggagaagcagaagtcgcagctcctgaagcgtggcctggacggcatggtgacggagaagctcgtggatgcagaggccaagaagcgcggcctctcccaagaggcgtatctgaaggcggagatcgacgacaaggtccccgcgcccaccgaggagcgcatcaaggaagtctacgacggtgccgctggccagctgcccgagggttccacctccgagcagatgaagccgcagatcgtggagttcctgacgcagcatcctaagcaggagcgcgcgcagaccctcatcccgagacct

SEQ ID NO: 5839 - DNA, 831 bp, Myxococcus xanthus
atgcagtccggcccgggcctgcagaccgcggcccgcgctggcacccgtcccgaggacgcggcgcgcgcctacctgggccaggtcgcggacctctaccggctgaagcgagaagacgtctccgccgcgccgttgcagtccgtacaccagacgggcaagggcgccgtcatcgtgaccttccgccaggcggtggaaggcgtggaggtgttccgcagcgaggtgaaggtggtgatgacgcaggcgctctcgcccgtggccgtcactggctacctggcgccgagcgagctcaccctcgcggcccggcagcgcaccggcgcgaacgccttccagcgctccgcggcggacgccgtggcggcggcgtactcggaccagagcggcaccccgctggggccgcacgcattcatcgccgtggactcccgcggcggctacacgctgttcgacttcgagcccggcgtgcgcaccgtgatgcccggccagctcgtcgttcccgcgcgcgcgaagaaggtcttcttcaccctgcccgacggcctgcggcccgcctggtacgtggaggtcaacgcgggccccaagagcagcaaggactcagactacacctcctacgtcatctcggccgtggacggcgcggtcctcttccgcaatgacctgcgtgcccacgccgcggagcagacgtaccggtacactgtatgggcggagacggccgcgccgtaccgcccgttcgacggcccccaggggtccgccggctcgcccttcccccggcaggagctggacggctacgacgccccgctggacgttccgcccaacgtcgtggagctgcacttagagcacggaaagcaa

SEQ ID NO: 5840 - DNA, 633 bp, Myxococcus xanthus
atgatgtcccggcccctggtcgccgccacggtcatgggcgcactgcttgatgacgtggcatcgggtctggccattggcatgctcctggagctgttcttcctgggcaccgccaacctgggggccgcgctgccggagaacgacaccctggcggccaccggcaccagcgccgccgcggccacgttgtccgcggccacgggcgcgggctccacgccggccatctggtcgctcgccgtgctgctcttcatcggcctgggacgcgtgggccgcaagggtgaccggctgctggagggctacacggcgcggctggcccgggtggcgctggcctccgcggaggcggggaacatcacccgcgccatgcggcagaacctgtggggcatgtggccccacttcgccgtgtacggctcgctcaccgcgctctgcgcgctgctgggcttcttcatcgaaccgctgctccaggcgctgccccccgtggtggtgcgcgggctggcgtgggcctggccggccatggcgtccgtggcggcggccatcgcggcgcagggcagccacgcgcggcgcgcgccgctcttcgcggggctgggcgcggcggtggtgacggcgtcggtcgtgtgcgtcatcctcctggagggccgatga

SEQ ID NO: 5841 - DNA, 1005 bp, Myxococcus xanthus
cgcgtgggcgttcagcccttcgcggacaagacgttccgcgcgagcaagccggagtcgaaggtccacgaagcgcctccgtccatgtggatggggcccgcgctgctcggcgcggcggggctgatgttgggcctggtgccctgggccatccaacccctgctggccatggcggcggtggacattggcgggagccaggcggggggcctcgagctgtcgctgtggcacggcgtgacgcccgccctggggttgagcgtggggagcctcgtcatcggcgggagcctcttcgcgctgcgccagccggtgctgaagggcctgcgcgccctgaatctgtccaaccacggcccggagcgcttctaccaggcctccctgagcggcctgctcaagctgtcctcgtcgatgacgcgggtgctccagaacggctcgctgcaccagtacatcgtcgtcaccctggccacgttcggcggactgcttgcgctggccgtcttcctgcggctgggggaatggccccggggcgtgtccaaatacgtgctgtctcatgaagtggtggtcctggtgggcatcctggcggcggcggtgctggccgtggtgtcgcgctcggcgctgacgtccatcctcgcgctgggcgcgctgggcctggcggaggcgctgctgtacgtgttcttcggcgcgccggacctggccatgacgcagatcgtggtgcagacgctcaccgtcatcctgttcgcgctcgacttctcgcgcttcccggtgcaaccgcatgagcaccgcttcccatggtgtccgccgtccttgccactgtcggtgggcgggttcatatcctggatcatcttgcgcgtggctggcaggccctcgcacgtccggctgacgtacttgtaatcaacgcagagcgtgccccccggcaagtggctgaacatcgtcagcgtcatcttggtgagcttccgggcgtttcacacctgtggagaggccaccgtgctgctcgacgtccgaactgggtgtctatctcctgtt

SEQ ID NO: 5842 - DNA, 717 bp, Myxococcus xanthus
ccccagctcgacttctcgcgctcgccgttccatgtgaacacccggttgacgaagtggccggcgcggaagactccgcgccgcgcgggggtcagctcgttcggcatcggcggaaccaacgcgcacgtggtgctggaggaagcacctccgttcgagccgagcggccccgcgcgagacacccagctcctcgtgctggcggcgcgcacgccttcggcgctcgacgcgatgtcggaccggctggcccggcacctggaggcccaccccgaactcccactggccgatgcggccttcaccctccaggtcggacggcgcgccttcacgcaccgccgagccctgacctgccgcggccgggacgacgcgctcgccgcgctgcgcggacaccggccgcgcgaggtgtcttccggcagcgccgctgacggcgagcaggctgtggccttcctctttcctggccagggcgcgcagtacgtgaacatggggcgcgaactccatgaacaggagcccgtgttccgccaggccctggaccgctgcgcccggctgctccttccccatctggacctcgatgtgcggcaactcctccacccgtccgaggcgcggcgggaagaggccgaagccttgctgcggcgaaccgcgttcacccagcccgccctcttcgcggtcgagttcgccttggcccagctttgggagtcctggggcatccgcccccaacaaacgggccgcggt

SEQ ID NO: 5843 - DNA, 501 bp, Myxococcus xanthus
atgagcgcgcggcaggccctcaccaacccgccggagttcctcgagttcgaagctccctcgacgcgactggagctcttccgcgaggtggcccggcagtccgtcattgaggccgggcaggcagcccaggccctggtcctcttcccggtcagccatcagggcgagctgctcgccgcgccgggcttcgatccgaagatggacctgttccaggcgcccgacgcgggtgcgcccctggagctggtgttcgagtccggcggagagcgttggccggatgaccgccgcgagggcctccagggcctctccgagcgcgaagccgccgagctggtggcccgcacgctgctcgcccactggggcatcgcgccgaacagcgcggtccaggtggaccgggcgtcgggcgcgccttacgcggtcgcttacgtggacggaatcctgcgcatcaacccagctttcctctacctggcagcagcgtacggtccttcttccctgcccgcttcgctccagtag

SEQ ID NO: 5844 - DNA, 366 bp, Myxococcus xanthus
atgcagggagaatcgactcaagccatggcgcgaatcctcgtcatcgacgaccacgacacgctgcgtgaagggatggctgtcaccctcactcgggcaggccacaccgtgtccgcggtgcgcagtggccaggacggattggccgcctaccgcaaggcaccgttcgacctggtcgtcaccgacctgaagatggacggtatggacggcatcgaggtgacgaagtcgctcaaggcgctggatgccggcgccgtcgtcatggtggtgacggccttcggcaccatcgagaccgcggtgcaggcgatgcagcaaggcgcctacgacttcatcaccaagcccttcccgcccgaggtgctgcgcgccaagctttag

SEQ ID NO: 5845 - DNA, 438 bp, Myxococcus xanthus
gaggcccacttcacgggcagcgcggtggtggtggacccagagggcgcgcgcgtcgtcctgttgcatcaccgcaagctccaacgctggctgcagcccggaggacacgcggatgtcacggacgcgggccacatggaggccacggcgctgcgtgaagcccgtgaggagacgggatgtcgcgtgtccctgcacccggccgcgccccagccgctggacgtggacatccacaccatccccgcgcgccgcgacgagccggagcaccaccacctggacgtgcgcttcctcgtggtggcggagaaccccgacgccctggtgcatgacccggcggagtccttcggcgtgcggtggctcacctgggatgaagccatgacgcatgcggacgaagtgcctctgcgtcgcatgctggcgaaagcccggcgcgtggtggcctccgcgccctga

SEQ ID NO: 5846 - DNA, 1584 bp, Myxococcus xanthus
gggtatgcctccacgttgaacgggaacgagccgttcctggccgatcaccaggtcaacggcaacagggtgctccccgccgtcgcctatctggagatggcccgggccgccgtcgtccaccggacgggcgccacgagcacgggcgacatccgcttgagcaacgtcgtctggtcacaacccatcgtcgtcaacggcgtcaaccgggagatccacctcacgctcgacggagccagtgagggaggtggtgcgttctccttcgaggtgcagacggctggcgcgggacagggcagtagggcggtgctccacagccaggggcaggcgcagcgcatggcgttgccgcgtccacagcgtgtcgacctcggtgccctgagggcggcgtgcggccgcgaggtcgtcgcgggcggcaccctctacacgaactatcagcggctgggcctgcagtacggtcccgcgcatcagagcgttcgtgaggtgtacgtcggcgacgggcaggtgctcgcggaggtcgtgctgcccgacggcgtggcggagagcgacgcctacatcctgcatcccagtgtgctcgacggggcgctgcaggccatcatgtgcctgcatcctggcggtgaccgcggtgagctgcccttcgctctgaaggaactccaggtcttctccgcgtgcgccagacctacgtgggcctggattcgccgcagtcccgacaacgaagccccttccggacgacgggaaggcatgacgcagcgctatgacctggacctctgtgatgaccagggccgcgtcgcggtggtgctgcgggggttctcgactcggccggtgttgacggcgcccgtgcgcgaaagtgccgacaccctggtcggtgatgtcctggtggccccggtatgggagaccgctgtcatcgagccggaagtggccacgccttctgccacgcagcacgtgttggccgtcggcgccacggatgaaatcgcggcaggtctcgcaatccggtgtggacgtgtcgaacgcctggtcatcgacgaaggtgacagcatcgagcgcattcgcgaccggctgcgcgggctggatcgaatcgaccacgtggtgtgggtcgcgcccgaggaacccctggcgttcaacgaggtggctccccggcagtcgaagggcgtgctgtcactgttccgcttggtgaaggcactcctgagcgctgggcacggaagctcacgcctggagtggacggtggtgacctatcgcgcgcagtccacgggccgaggcgatgaggtggaccccacgcatgccgcggtgcacgggctgatcggctcgatggccaaggagtacgggcattggaaggtccggctcgtcgacctgccagatgcgggcgcctggcgggacgctgcgctctgggacctcccgttcgatgcccagggcaatgccgtcgtgtaccggcaggggcagtggcaccggcagaagctgctaccggtcgactgggacgcgttcgccgcgagcacgccctccgtctaccgggatggcggcgtgtacgtcgtcattggcggggcggacgggctcggcggcgtgtggaccgagttcatgattcgcaagcaccgggccggcgtctat

SEQ ID NO: 5847 - DNA, 828 bp, Myxococcus xanthus
gtgttcgagggcgccacgctgcgtgggcgcttctacctggacatgcacccgcgcgacgacaagtacaagcacgcggcccagttcacgctgaccagcgggaagtcgggacggaggctgccggaaggggtgctggtctgcaacttcccccgtcctggcgcggagcccgcgctgctccagcacagcgacgtggagaccttcttccacgagttcggccacctgctgcaccacatcttcggcggccacacgcgctgggcgggcgtgtccggcgtgcgcacggagtgggacttcgtggaggcgccgtcgcagatgctggaggaatgggcgcgtgacaccgccagcctccagacgttcgcgaagcactaccagacgaacgagcccatccccgcggatgtggtggagcgcatgcgccgcgcggaggagttcggcaagggcctgtgggtgcgccagcagatgttctacgcggcgctcagcctggagctgtaccggcgcaagccggagggcgtggacgcggtgacgctcgtgcgcgagcttcaggggaagttcacgcccttcccgtacgtggagggcacctacttccacctctccttcggccacctcgacgggtactcgtccaactactacacgtacatgtggtcgctcgtcatcgcgaaggacctgttcacggtgttccagcagaaggggatgctgtccccggagcccgcccaggcctaccggcgcgcggtgctggagccgggtggttccgacgacgcggcccggttggtgaatgccttcctggggcgcgactacgacttccgcgcctatgaggagtggctcaatcaggcggcgtga

SEQ ID NO: 5848 - DNA, 1285 bp, Myxococcus xanthus; identical to SEQ ID NO: 137

SEQ ID NO: 5849 - DNA, 1122 bp, Myxococcus xanthus
  unsure (1)..(1122): unsure at all n locations
gtgagcctggtgttgctcatcgcatgtgtcaacctggcaaacctccagctcgcgcgggcggcggcgcgcaaccgcgaactggtggtgcgcgcggcgttgggcncggcnccggggcggctcgcgcggcagatgctcacggagagcctcttgctctccgtggccggcggagggctcggggtgctgttggccatggcggtgatgcccgggttgttgtcgctggcgccggacacctcgggtctgctgcccggggacggagggctcgcgggcgcgcaggtgggcatcgatggcacggtgttgggcttctcgctggccgcgtcgctcctcacgggcctgttgttcgggctgttgcccgcgtggcaagcgtcgcgcacggacctccagatggcgctccgcgagggcagccagcgggcgaccctgggcccagggggtgggcgcacgcgcgcgttcctggtggtgggtcaggtggcgttggcggtgatgctgctggtgggcgcggcgctgctcatccgcgggttctccgcgctccagcgcgtgcagccgggcttcgacccgcacggcgtccacgtgctgcggctgtcgctcccggagggacgctacggcacgttgcaggcactggagcgcttcgagacgcaggtggtggagcgcgtgcggtcgttgcctggcgtggaggcggtcgggttcgccacgtcgttgcccatggaccggggccccagcatgtcgttctccatcgagggcaagtacacgggggatgacaacggccccggcgcgggctgggggcagtaccgcccggtgacgccggactacttcggtgtgatgcgcatcggcctcgtccgcgggcggctgctggcggagaacgacgtggcgggcacggagccggtggtggtcatcaacgagacggcggcgcgcaggttctggccgggcgaggaccccctcggccagcgcatccgggtggcgcattcggtgccgtccctccgggacgtggtgccccgcgtcgtggtgggcgtggtgcgggacgtgcgcgaggacggcctgaatgacgaggctcccccggtgctgtacctgccgccgggacagatgtcgcagggcgtcgcgtcgatgatcgtgcggatgattccgcattag

SEQ ID NO: 5850 - DNA, 213 bp, Myxococcus xanthus
acaaggcagaacatccgccagtggctcatccgcgagcggaacttctctggccagggcacgccgccgcccatccctgacgacgtgcgcgtggacctggccgcgaagtacgtggcggcctacgagcacatcaccggcaccacgctgacgctggagccgggcgacgtgaagacccgcatcgagcgcaacctgcgtgagaagggctacctgaagtag

SEQ ID NO: 5851 - DNA, 936 bp, Myxococcus xanthus
gtcggcctcgtcgtcgcagcgcacggacgtctggcggaggagctggtctccaccgcggagcagatcgtgggagagcttcccgcggtggcagcctgtaacatcgagcctgggactcctgtcgaggacatccgggcgaagatgaagcaagcaatcgcccgcgtggatgagggtgcgggtgtcatcatcctggccgacctcttcggaggtacgccctgtaaggagtcgctgatgatgtgtcagcgaatgaatgtggaggtccttgctggcgtcaacctgcccatgctgctgaaggcgaactcgctccgttcggagcagttgtcgctaccggagatggccaaccagctggcttcccacggccagcgcaacatcacctgcgcatccgccctgcttcgcgaggcacagcagccgcgaacttgacggacccgcgcgggtcggcgattcgagactgccgtgatcaccctggtccgcgtcgacaaccgcctcatccatggtcaggtcgtcgaggcctggctcccgttcctcaaagtctcccgggtggtcgtggcggatgacgaggcggcttccagccctctcatccgcgccgccatggccctggccgtccagagcgccatcgaggtgcagattctgcccctgtcccaggtggacttcgccgccctgtccaaggacggtgtgcgcaccctggtgttgctgagggatgtcgcctcggtgcccttcgcgcatgcgcacgggctggccatggatgagctgaatctgggcaacgtccacttcggcaccggccgcaggcaggtctccccgtccgtcttcctggcagaggccgagctgacgacgctccagcagttggccgaccagggcgtccgggtggcggcccgcgcggtgcccgccgagaagcccgtggacctgccggacctccgcgagcggtgggcgaaggccgggtga

SEQ ID NO: 5852 - DNA, 795 bp, Myxococcus xanthus
cacgcgcgggacgtcatcgccgtggggaagatttccggcgcggtgggcaccttcgcgcacctgccgcccgcggtggttgagcacgtctgccgcaagctgggcctcaagcccgcgccggcctccagccaggtggtgcagcgagacaggcacgcggagttcttcaccgcgctggcgctgctgggctcgagcatcgagaagttcgccgtggagattcgccacctccagcgtaccgaggtgcgtgaggcggaggagcccttcaccgcgggacagaagggctccagcgccatgccgcacaagcgcaacccgattctgtcggagaacctcaccggcctggcgcgcctgctgcgcggctacgcggtgagcgccatggaggacgtggcgctgtggcatgagcgggacatctcccactcctcggtggagcgtgtcatcggcccggacgccaccatcctcgcggacttcatgctcatccgcttcgcgcggctgatggaggacctgcgcgtctacccggagcagatgaagaagaacctggacctgctgggcggcgtggtgaactcgcagcgcctcctgttggaactggcgcgcaagggcatggaccggcaggccgcgtacgtcatcgtccagcgcaacgcgatgaagctgtacgaggaaggactcgacttccggcaggccctgctcgcggacgaggacctgcggaagatgatgacgcccgaggagatttccgactgcttctcctcgggctaccacacgcgccacatggacgacgtcttccagcgcgtgttcggccggagcgcgtag

SEQ ID NO: 5853 - DNA, 603 bp, Myxococcus xanthus
  unsure (1)..(603): unsure at all n locations
tgcgcaaatcccccggncgtggtgggcgtggacncggtgatgggtggccacctgcacgtcgtgctcaacccgccgcagctgctcaccgaccccgcgggccgcaaggtggtgctcgcgcactctggcgccttcgccaagtacgtgggccggctggagctggtggtgaagatgcccgaggtgctcggcaccggtgagggcggcgaaatcatcagccaggactaccgcgtgttccccatggacgccctgtggtgcgacgacgccatgcgccgcttccgccacgacaacagcgtgttctgggaggagggccagttcctccgcgacgagcgagtccgtcaggccatccaggcgtgcaagaaccaggaggaccggatgaccacgcatctgctccagccgtacatcctgggcatggacttcaacttccagctgacgtccatcttctcctacgcgccgcgcgacgtgcagcgccgcaacaactccacgggtggtgactcgccgctgggcaacatcgccgcggactccatgcgcaagcgccgccgcgtcgaggcggagatggcgctcaccaactcgctgggcatccgcgacaacctctacgcggctttagag

SEQ ID NO: 5854 - DNA, 941 bp, Myxococcus xanthus
ccgcgcactatccaacgctggaggaagcctgccacggcccaggacggcaggttcggcccacatacccggccggccaaccggctttccgagctggagcggcggcgcattctcgccgtggccaacagcgaggagttccgcgacgtctcgtccaagcagattgtccccaggctggcggacaggggcgagtacgtggccagcgaggcaagcttctaccgagtactgcgcgaagcggggcaactcgcgcaccgaggctgcgccaaggcgcccagggccagggccagggccagggccagggccagggccagggccagggccagggccgagcacctcgctaccgggccgaatcaggtgtggagttgggacatcacctacctgaagggcccggtgaagggggctttcctctacctgtacctggtggtggacgtcttcagccgccgcatcatgggcttcgaggtgcacgaggaagagtcgtccgagcatgccgcggccctcatccgccgctgctggcaggaggctggctgcccgaagggattgtgctgcattcggacaacggtggcccgatgaagggcgctacgctcttggccaccttgcagtggctgggcgtcaccccatccttcagccggccccgcgtttcggacgacaatgcattctccgaggccctcttccgcacgctgaaataccgccccaccttcccgcagcgccccttcgcgtccgccgaggacgcgcgtgcatgggtgatgcgcttcgtggcttggtacaacagcgagcaccggcactccgccatccacttcgtcacgccagacgacagacattccggccacgaggcaacgctcctcgcccggcgcgaccaggtgtatcagcgtgcccgagtccgtcaccccgagcgctggagaggtggcacccgcaactggacgccagcgggccccgtccgtctcgggccc

SEQ ID NO: 5855 - DNA, 366 bp, Myxococcus xanthus
gttcgggcccgtgagctgggcctgccgctggggcgcttcaagcccggcaagttcaacgccatcaccgacgtggagggggtgctcgtcgggcacagcacgttgatacgtggcgagggcccgcttcgtcccgggcacggtccggtgcgcacgggggtcaccgccatcctccccaaccaggggaacatcttcatggagcgcatgacggggggcggcttcgtgctcaacggcgcgggcgaggtcgccggcatgacgcagctcatggagtggggcctcatcgagacgcccatcctcctcaccaacaccatggcggtgggcgcggtgtcggacggcgtggcgcgttacctggtggaccgctaccccggcgca

SEQ ID NO: 5856 - DNA, 282 bp, Myxococcus xanthus
gctctaaagctgacgccgggctggagcgacctggtgctcatcgcccagggcgccggcatggactaccgggggctcatcggcgaaatcatggcccccgccatcccccgctacaaggagcgcgaggcgcgccgcgccgccagcgagcaccccgcttcggtgttgcgcaagagcgtgcccctggaggaggggactcccgccgccgcgcagcccgtggccgcgacggcccccgcaccggcatccccagcgccggagccgtctccgcgcatggacgcgaaggcctga

SEQ ID NO: 5857 - DNA, 1445 bp, Myxococcus xanthus
ctctcaagcatccccgcacgcatcgcctacttcctgaatctgcagggcccggcgctggccgtggacaccgcctgctccagttctctcatcgccatccacctggcatgccagggcctgtggcggcgggagacgaatatggcgctggccggtggcgtccatctgaactcgacgccgacgttctacgtgctctccagccgaggcggcatgctgtcgcgcaaggggcgctgtggcaccttctccgatgaggccgacggcttcgtgccaggggagggcgtgggcgtggtggtgctgaagcggctgtcggatgccatcgcggatggagaccacgtccgcggcgtgattcgtggcaccggcgtcaaccaggacggcaccaccaatgggctcaccgcgcccagcggcaagtcacaggagcggctggagcgggaggtctacgagcgcttcggggtgaacccggaggacatccagatggtggaggcccatgggacgggcacccggctgggcgaccccatcgagttcgatgcgctgacgaagtccttcggcgcctatacccgcaagcggggctactgcgccttggggtccatcaagacgaacctgggccacaccgcgaccgccgcgggcgtggcgggcatcatcaaggtgctgctgtcgatgcagcaccggaagatccccgcgtcgctgcactgcaatgcgaccaacccggcgatcgacctcgagcgcagtccgttcttcgtcaacacccagacccggggctgggacgtggagccgggaaagccgcgctgcgcggcggtgagctcgttcggattcagcggcaccaacgggcacgtcatcctcgaagaggcgccctttcaggaacgacgcatctcgggacaggcgccgggatacctcatcgccttgtcggcgcacaccgcggcccagctgaaggcgttggtggagcggctcgccgcgcacctcaagctcgagcggatcgactgcgatgacatcagcaagacgctgctgctgggacggcgccacctggcccaccgtctggcgtgtgtggtccgtgacgagcgggagctgtcggccgcgttggagacgtggctggcgaagggaagggcgcccggggtgcacgtctcggaggtcaacgagaacacccggcgggagcaggccgaattccggcggtacggcaatgcatgcatccaacagtgcgcggagggcgctccgaccgctgagtacctggagaagctggccgtcatcgcggacctccatcttcagggttacacgttggagctggaggggttgttccgcgctggccgctcgcggcggattcccctgccgagctaccccttcgcccgggagtcgtactgggtggcgggagaaaccccgctcgccgagcgccagcctccaccggcgccgcagcggctgcatcccatgctccatcggaaaccgggcccggaccggatgggaac

SEQ ID NO: 5858 - DNA, 1245 bp, Myxococcus xanthus; identical to SEQ ID NO: 143
  unsure (1)..(1245): unsure at all n locations

SEQ ID NO: 5859 - DNA, 438 bp, Myxococcus xanthus
gtgcccccgctgtccgtgaagagcggcgccaacctgggcggcaaggtggagctggtgggggccacggtggagcccgggcggctgacgcccggagaccaggcgaaggtggcgctctacttcaaggtgctccagcccatggacgacgactacctcatcttcgtccacgtggaggacgcggacggccgcgccgagcgcatcaacgtggaccacaagcccgcgggtggcatgctgcccacgtcgcagtggaagcccggtgagacggtgaaggacgagttccccgtctacgtgccgcccggctcgacggcccgcgcgctgaacatctggctggggttctgggagccgcgcacggactctcggctgcgaatcctcaacccgaacgccgtgcgcaacgacggcaaggaccgcatcctgctgggccaggtgcccgtggcgcgttga

SEQ ID NO: 5860 - DNA, 227 bp, Myxococcus xanthus
atggacgggctgccgtcgaagcccgtggtcaccgtggccaagcccaccgcgcgtcccgaggacgtgggcatcccgcagagccgcccgtcgagccggcttcgcaaggcgttgggcttcaccgtcaacttcgtgttggccgcggccctggtggccgtgctgggcacggtcggccgggtgtacctgaacgagggccgcctcgacgtgtcggccctgtcggtggactccct

SEQ ID NO: 5861 - DNA, 717 bp, Myxococcus xanthus
tcgggcagccggatcgccctgtctgcgccatggccattctctccaggctactccttgcgatgtgcaagtggtagggatagggttttgactgcttgcaaaatgcaagcggtctgcgacaggagtccgccgatgtcactcgtgctctacggtcatcccttttcttcgtacacgcagaaggtcctcatcgcgttgtacgagaatggcacgcccttcgagttccgctgtatcgggccggaaacacctcagcactcggccgagtggtcgcggcgctggccgctgcgcaagttcccgctgctggtggatggcgagcgcgacatcgccgagaccagcatcatcatcgagtacctgcagctcgcgcatcccgggcccgtacgtctgttgcccgcggacccgatggccgcgctcgacgtgcgctttctcgatcgcttcttcgacctgcacgtcatgaacgcggcgcagcacgcggtcgatggcgcgctgacgggggattcggtgaagcgccaggaaggactggccctggccgtgaagaagctggaggtcgcctacgcctggctcgaagggcagctcgccggcaggacctgggccgcccctggcgaggacttcacgctggcggactgcgcggccgcgccctcgctgttctacgcggactggacgcaccggatctccgatgcgtttcccgtgctccgcgcctaccgctcgcggttgcttgcgcgcccg

SEQ ID NO: 5862 - DNA, 411 bp, Myxococcus xanthus
atgacccgtgacgtcgtcacgctcaaggaaacgcagaacctggccaaggcggatgagctgctccggctgcaccgcattcgtcacctgccggtggtgcggcaagagaagctggtgggcctcatcacccaccgcgacctgctgcgcgccgccgcaacccacgccacggacccggccgcgcagccgctctgggccgcggacatcatgacgcgcgacgtgcagacggtgcgcccggacacgccgctgcgccgggcggtgacgctgatgctcgagcacaagtacggctgcctgcccgtggtggatgagggcggcgtcctccagggcatcctcaccgaggcggacctggtccgctacgcccagcacctcatcggcgagcaggaccgccgggagctcgccgccgagttcaatgcctga

SEQ ID NO: 5863 - DNA, 222 bp, Myxococcus xanthus
cagctgccgtcggtgctcgcgtggtgcgcggacccggtgctcgtcctgttcctgggtggcttcacgctggaagtggccgccatgcggcacggactggatgcctcggtggcgcggcacgtgatgcggctgtcgggtggacggcctcggcggctggtgttgctggtgatggcgggcgtcgccttcctctccatgtggatgtccaacgtgaccgcggctttacag

SEQ ID NO: 5864 - DNA, 890 bp, Myxococcus xanthus
gccgtacacggaaggactgcgcctggacgaggcgatgaacccgctcacgctgctggccacggggctctacggccggcaactgcccaaccagaacggcgcgccgctgcggctcgtggctccttggaagtatggattcaagggcatcaagtccattgtccgcatcagcctcacgcgggaggagcccatgacgacgtggcgcctgtccgcgccgcgcgagtatggcttctacgccaacgtgaatccttccgtgccccatccgcgctggagccaggccagcgagcgccgcatcggcgacttcgagcgccgccccacgctgcccttcaatggctacgcggagcaggtggcccacctctacaccggcatggacctgcgccggttctactgagtccccgcgccatggcctcgtctccgtatccctggctcaaccccgcgctcgtcgtgggtggcctgtcgccgctgctgatgctcgccgtccaggggccccggggcgagctggggcccaacgcgattgaagccgcgctccaccagacggggctgctgacgctggtgctgctggtggcctcgctgacgtgcacgccgctgcggctggtggcggggtggacgtggcccgcgcgcgtgcgccgcaccctgggcctcttggccttcacctacgcggtggcgcacttcctcgtgtacgcggtgctggaccaggggctggcgtggggcgcgctgtgggcggacgtcaccgagcgccccttcatcaccgtgggcttcgccgcgctggtgctgctggtgcccctggccgtgacgtcgacgaaccggtgggtgcggcggctgggctttccacgctggcagcgcctgcaccggctggcctatggggccgcggcgctgggcgtggtgcacttcgtgtg

SEQ ID NO: 5865 - DNA, 1294 bp, Myxococcus xanthus
gtgctctcaaggcgcttcggtggccgcccggacgtggtgggacagacgttgatggtggatgaccagctccacacggtggtgggggtattgcccgcgggtttccgcttcgcaccggacgtggaggcgtggaagccgttggtcctggggacggatgagtcggccggaggggtgtggctgcgcgtggtggggcgcctgcgcgaaggcgtgtccgcggagcaggcacgcacggagatgacggccctgggcgccgcgctggtgcgcgagccgggcttcacggaggagcctgctggggtgcggctggtgcccttgcacacgcaggtggtggagggctcccaggcgcggctgtggctcctggccggcgtcgtggcgttggtgctgctggtggcctgcgccaacgtggccaacctgttgctggcgcgggcttccgcgcgggagcgcgaggtgtcagtgcgcgccgccctgggcgcgggccgagggcggctggtgcggcagttcctggtggagagcgggatgctggcgctcgtgggcggcgccgccggactggtcctggcgatgtggggcatggatctgctgcgcgcgctcatgccgcctcagttcgtggatgccgaggctctccgcctgcagccgcatgtcctgggcatcgcgctggttctctcggtggtgaccagcctgctctttggcctggtccccgcgctgcgggtgtcgcgcgcggatgcgcggggcgcgctgggcgggctgcgaggtggcgcaggggccacgcggggcgaaggcgggcgcgtggtgctggtggtcgcgcaggtggccttggcactgattccgctggtgggcgcgggcctgatgctgcgcaccgtccatgccttgagcgtggtgccgctgggcttcaatccccagggcgtcaccgtggtggacctctccctgccatcggcgaagtaccgggacgagaccgtccaacgggccctcttctccagcgtgttggagcgggtgcgcgcgcttccaggcgtgacgtccgcgggcatgtccagcacggtgcccctgtggggacgcaatggtctggcgccggtgctgctgccgggcgaggcggcatcacaggcggactcccgggagttggtccacttccgcaccaccagcgacggctacttcaacaccctgggcatcccgctgaaggaagggcgcaccatcgaagcctggaatgggccgggcaccgcgccggtggtcgtggtgaacgagacgttcgccccgcgctacttccccgggcggagcgcggtgggacagcgcgtgcaactgggtgctcgac

SEQ ID NO: 5866 - DNA, 567 bp, Myxococcus xanthus
gtgctctacagcaacccgggcgcgcccatggtgcgcctgcccctcaagggcgtgtcccggcagagctgcctggtggcgtcgccatccttcgtggacttcgggcccatccgctacgactgcgctgcggcgccccggaagacgtacgtggccaaccggtgcagcagccccgtcacggtgacgggcgcggacatcggcaacggcaccagccaccagttctcgctggtgatgcccatgacggcgcccgtcacgctggggccgggcgcgggcttcgagctggagatcggctacgcgcgcaacgtgcacggacagcacttcagcccgctgtacctgcgcacacccaatgagccttcacccttgctcgtgccgctgctggcggagacgaaccacgagggcatccaggtggaccgctacacgcagggcaccgacagccaactggacgtcctcttcgtggtgtccaacaccaccaccatgcagcagtaccaggaccggctgaaggaggcgattccgcagtggctgcaggcggcccagacgaacggcgtggacgtgcgcgtgggtgtcaccagcacg

SEQ ID NO: 5867 - DNA, 786 bp, Myxococcus xanthus
ctaccgatgtggagagtgaacaccatgccatggaagcagcttgaaatgcgtacacgagcgaaccgctggtgcatcctgctgaccctcggtgggttggcgagcgtgagcggttgccggaccgccgagccctccatggaggccaccgttcccaccgcgcgcgcagccactgagaccttccgggtcgaggcatcccggctggcgtcgaacctgcgactgccggccgagctggtcgcggaccagacggtggacgtgtacgcgaaggtcaacagctacgtgaagcacctccgagtggatatcggcgacgtcgtcaagaagggcgacctgctggtgacgctcgaagcgccggagattgaagcgcagctcgcatccgccagggcgcggtgggccgcgatggaggcgctccatgtcgcgtcgaaggcaagctacgagcgcaccgtgcggaccagcgcgaccgagggtgccgtggcccacgacgcggtcgaccaggcgcgggcgaaggagcaggcggatgccgcgcaggtggtcgccgccaaggcgcactacgacgagctcctggccatgcggagctacctggtgatgcgggcaccattcgacggcgtcgtgacggaacggaacgtggagctcgggacctacgtgggaccctcgggccggggctcgcacaagccgatgctggtggtgcgggccgtccagaagcttcggctccacgtgtcgattccagaggcgtacagcccctatgtccacctggatgagacagtgaagttcaccgtacgctcgctcccggggcgc

SEQ ID NO: 5868 - DNA, 405 bp, Myxococcus xanthus
cgttccggcagcgaccccgccacgggcctgcacgaccggcgcgggctgctgctgcggctggagcaggaggtggcgcgcagccggcgttaccaccgcgcgctcagcctcgccgtgctccggcccgaccggccggtggagccggtgccgtccaacatcgccgatgtcatgcgcaagcgggtgcgccacccggatgccatctcccacctgggcggaggtgtgttcgccgtcgtcctgccggagtgccaggcggaggcggcgcgcgccgtcatcagtcgcatgttgccggatgtggagaaggcgacggacacggagtatcggtcggcggtggcggacgtgagccaggacagcgactcggtcgagaagctgctggagaagctgggcgcgccggcccccgaagagacctga

SEQ ID NO: 5869 - DNA, 558 bp, Myxococcus xanthus
atgcaggactcggacctggagccgctgcgcgaggagccggtgtacctcgcgcaggtggagcgcatcaccacgctcccggacccccatcccacctcgagttcagagctgaagacgctcttcgtggaggaccagagtgaccgtcagaggccgctcgatggggtggacgcgtggaagcgggtcgccgagcgggatgcgcagcggcgcgagcgcgtgaaggccctgctggccgaaggcgcgttgaaggaaggcgcggacttcctgtccgcggggttcatcttccagcacggcaacacgccggaggactacgccatggcaaggcagatgggcgcggaggccgcgaagcggggccacccccgcggcctgtggctggccgcggcggcctgggaccgctggctgatgaacgccaaccttccgcagcgcttcggcacccagtaccgcttcaacccggaatcgaaggagatgacgctccacccggtggaccccaacgtcacggacgaggagcgcgcgcgctggggcttcccgccgctcgcggagattccgaccgtcctgcagcgctag

SEQ ID NO: 5870 - DNA, 634 bp, Myxococcus xanthus
atgcgggaggccatcgacgcgggctccacggacgaaggccgctacgcctcctccgccagctacacgaactatctccagtcccggctgaagcaccatgccggggaccaccggggcgcggtggacgcgctgcggctggccctggccacggatgatgggaacccgctgctgctcacccggctgggggaggagtacgcccgtctgggtgatttgacgcgcgcggagcgcgagctgcgccgggccgtgctgcgcgcccccgcctactaccccgcgcacgtgctcctgggccgcgttctcacggagtcgaagcggttcgcgcgggcccgcctgcacctgcggcgcgcggtgaccctcaagcctcgcgagccggaggcgtatctcgtcctgacccagctccacctggagatgggtgccccggacgaagcggtgaaggtggtggacgcgctggcgctggcgctgccgggggaggcctcggggtaccagcgcttggggttggcgctggcggagcggggcgacacggcgcgcgccgagcgcctgctggtagaggccgccacccgggccccgggtgacgtggacgtgctgacggcgctggcgcaactgtacgaagacaccggccggcccgtgcaggcggaggagt

SEQ ID NO: 5871 - DNA, 213 bp, Myxococcus xanthus
atgagcgcgtccatcgattacagtcacgccgaaaaactacgactcgaactggcagaacccctcttcaaccccctcttgaagaagtgggtgggcaagggcgagctcgattacgaggtctacctcaagacgcccacgctgctgtcgctgcaggcgccggacggcgagcgcgtcgcccacgacgagctgatgttccaggtggtgcagcaggcttta

SEQ ID NO: 5872 - DNA, 411 bp, Myxococcus xanthus
atgtctgaagaaaaagcgcgcgtcctggtggtggacgacgacccggacctgctcgacctcgtacagcgctcgctgagcgcctacggcttcgaggtgctcacgcacacctccgcgctgggtgtctccaacctcgtccgctcggtggagccggacttcgtcctcatcgacgtgaacttccccgcgctcaagggtgacaaggtcgtcaacctggcgcgccagtacgcgctgccgaagacgaagttcatcctctattcagcatccgacgaatcgaagctgcgctcactggcgctcgcgtccggtgcggacggatatatctctaaaagcgtgcagggcgaggagctggcacagcgcctgcgcgccttccacctgaagccccggccgcccacaccgacgcccgctcccaccagctga

SEQ ID NO: 5873 - DNA, 567 bp, Myxococcus xanthus
gcgcggctgtcccgcggcgcggtggagcagacgctgctgcgcgccgtggacgccgtcttcgccctgccggacgtgctggtggtgatggtgctccaactcgcggggcagtcgctctccgacgcgggagcgggcggcggcctgggccccttcggcctgatggtcgtctcgctggccctggtgggctgggcggggcccgcgcgcatgttccgcaaccgcctggcgacgctcgaatcccaggagtacgtggccgcgtcccgggcgctcggtggaggcggcctgcatctgctgcgcgtccacctgtggcccgcgcttcggcccttcgcgctcgcggtgttcctgtcgcggcttcccgccgccatcctcaccgagtccaccgtgagcttcttcggcatcgcccggatggagcccatgtccctgggccgctacctgggcaccagctacgcggccctcatctacgagggcggcggccgggtggtgttgcccgcctgggcgctgctcgtgctgctggtgctcggtgcctcgctcgcctcccaggcgctttccgggcccccccgccgggtgacctga

SEQ ID NO: 5874 - DNA, 462 bp, Myxococcus xanthus
atgtccctgacgcctagcgaagagcttgccaccttcaccgaactcgacacccgcgagcgcgaggagcgcacggacttgctcaagctggagcccgcgcgcgccgcggtgctcgtcgtcgaggatgatccgtcccaccgcgaaatcctcgtggagatgctggcgggctggggctacgagcccctgcccgtgggcagcgccgaggaggctgaattcgccgtgcgcaacaagcgcatggacgccgccatcgtcgacgtcttcctgcccggtcgcagcggcgccacgctgatgtcgcggctgcgcgagcgcttccctcagtccgtcctcatcggcgtcagcgccctgagcgacgcggccatggcgcgcaagtgcaagggcctgggcgcggacctcttcatcggcaaacccctggatcctcagcggctggccgaggccctccagtccaggcacacgagctggcactga

SEQ ID NO: 5875 - DNA, 323 bp, Myxococcus xanthus
ttgctgctggccatgccccagctcggcgatccgaatttctatcgctcggtcgtcttgatgctggagcactcggagtcgggctccatggggctcgtcatcaaccggggggcccccctgacgctcggtgagctggcgcgcgggcagaacctgggcatcgccgccgggcggaaggaacattccgtctacctgggcggcccggtggagccccagcggggcttcgtcctccacgacgacacggagcagcgcgagaagcactcggtgctgcctggcctgttcctgagcgtgacgctggacgcgctaggcccgctcctgaccaaatccca

SEQ ID NO: 5876 - DNA, 1037 bp, Myxococcus xanthus
ctgaaccggggcgtcagtctggctgtgcttgcctcagcccggacggaggacgaccaccacgcggacctgggctgtagcattcagggccccaccgcgcgtcctgtccgccgggcctttttcccactgaagcggcacgtcgccacgctggggcgtgagggagcgctgcacgatgcggaggcgctcttgcgttggctggaagacaccccgcgctatgccgcgctgtgcatgggcaagcagcggcgcatgggccgacgcgtgttgcgtcccgacgtgctgttcccggtggccacgcgacaccggccgcgcgtgctgcaccttcgccaggaggaactgggcctggatgtacccgtgcgtgcgtccgagtggcccgccgtggcggacttcttcgcggcgctcgcgcgcggcgccacgcgcgcggagcttcgggccttcgcggcgctgcccgtgctggcggagttggtggcggacctggggcaggcgggctggctcgtgcgccatgaggcgcccgtggaggtgccttcgcccggtgcgctcttcgtggggcacaacacggtgctggtcgcgggccgcgagggacgcgtgctggtggacccgtacttccggcccgagggtgcggtggacgcgccgggctatccgccgatgcagccccgcgacgtgggacgcgtggacgcggtggtcatcacccattcacatggggaccacttccacctgggctcgttgctgcaattgcctcgcgacacgcgcatcttcgtgccggcggtggcgcgtgagagtctcttctccacggactgtgctctgcgactggcgcagctgggcttcacgcgcgtggagcccttgtgctggggcgagtcccggcaggtgggcgacgtcaccgtgcgcgcgctgccgttctacggcgagcagcccacggatggagaaggcccgtacccggacctcttcaatgagggcaacgcgtggcttgtgcgggcgcccggcttctccgcggcgttcttcgcggactcggggcacgacgtgcgcggagacatggcggcggtgtg

SEQ ID NO: 5877 - DNA, 1314 bp, Myxococcus xanthus
ttcgtcgacggccaggccgttccggaggccgtgcgcgcggaggtggaggcgcagcggctgcggctcatcgaggcgtgcgcggacgaagacgccaccgtgctggagaagttcgtggacgggcgattggaggacatcaccgcggaggacctggagcgcgcgctgcgctcgggcgctctcgcgcggacgctggtgccggtgctgtgcgggtcggccttcaagaagaagggagtgcagatgttgctggacgccatcgtcaactacctccccgcgccgtcggacatgcccgccgtggagggctttgttccgggcaaggaggagcgtgtgtcccggcccgtatccgattcggggccgccttgcgccctggccttcaagctcatgagcgacaaggccgtgggcggcatcgtgttcctccgcgtctactcgggcacgctgcgtgcgggcaccgtcctgctcaaccccgccaccgggcggcgtgagcgggtggggcgcttgatgttcatgcacgccaaccgccgcgaagaagtggcggaggtccatgcgggagacatctgcgcggcgctgggcctgaaaggcgtgcgcacgggcgacacgttgtgcgacccggcggagcccgtggtgctggagtcgctgggcgtcatggagcccgtggtgcagctcgccgtggaggcgcgctcgcccgcggagctgacgaagctggaggacggcctgcaccggctggcggcggaggacccgtcgctgcgtgtgggcgtggacccggagatcggccaggtgctgctgtccggcatgggtgagctgcacctggaggtggtggtggaccgcttgaggacagagcacggcgtggaggcccgcgtgggccagccaaaggtggcctggcgcgacacactccggcgccaggtgcggcaggagtaccgccacgtccgccagtcgggcgggcctggacagtacgcgtacgtggtgctggacgtggggccggcgccgcgtggcgcggggctcgtcttcacggacgacacgcgcgggggcaccatccccaaggaactggtgcccgccatcgagaagggcgtggccggggccatggcccgaggcgtgcgggacggcgtgccgctggtggacgtggaggtgcggctcttggatggggacacgcacgtgcgtgactccacgccccaggccttcgccgtggcgggctccctggcgctccaggcggcggcgcacagggcgggcgtgcagcagttggagccggtgatggaggtggaggtcaccacgcccgaggagtacctcggcgaggtgttgggagacctggcggcgcgacgctgtaga

SEQ ID NO: 5878 - DNA, 603 bp, Myxococcus xanthus
atgcaggccgcggatggggcgctgacgccgtacctcgaacaggtgcgggtggcccttcgcacggggcaggtgcagcgaggcaccatggtcttgggttcggaccggggcccgcggtacttcgactacgtcctgtcgcccgcgctgggggccggcggcgaggtgctggcggtgatgtcctccctgcgggacgtcacggagtcgcgcagcgcggaggagttccgcgagcagttcatcggcatgttggggcatgacctgcgcaacccgctcaacgcgctgtccatgtccgcgcagcagttgcggcgcaagggtgggctggacgagcgccagggcatgctcaccgagcgcatcctcaccagcgccgagcgcatggaccggatgattcgccaactgctggacttcgcgcgctcgcggctgggcggcggcattccggtggtgcgctcgtcgtgcgacgtgttcgaggtggtgcgccgcaccgtggacgaactgcgcgccagccatcctggccgggtggtggaactggagtccaagggcgatggcctggggaagtgggacttcgaccgcctggagcaggccgtgggcaacctggtggccaacgcgccgtag

SEQ ID NO: 5879 - DNA, 710 bp, Myxococcus xanthus
atgtccatgggcaccgagcagccgttctccggccgcctgcgcgtgtcctccaccgtccggggctggggccacacggtcggcgaggaaggggtggacgccctgcgcctgcgcgaggcgcgcatggacctggcggtggcctacgcgccgctcccctggctgttcctctccgccaccctgcccctgcaggcccgcgaggtgcggcacgtcagcctcgcccgggaccgcggctggggcattggcgacgtggaggtcgccgcgaaggtgttcctcttccaggacaaggccttctccgcggaccacctgttcagcgcgttgggcggcgtgaagctccccaccgcgcccgtgctgcgcggtccggacggcgcccaactggccctggacagtcagctcggcagcggctccgtggatccactggccggcctcgcctatcagcacttccgcggcagctggtccttcctggccagcgccaccagcttcttccccacgcgcggcatccaaggcttccgcgcgggtgcctccctccgcaccacgctcgccgcgcaataccagccatcggcccgctgggccctgcgcctgggcttcgacaaccgcctggaagcgccggccgactcgaaaggcgagcaccagggccacacggacagcgagcgccatgagcacacaggcggattcatcggctacgcgtctcccgatgtgatcttcagcccggcatg

SEQ ID NO: 5880 - DNA, 921 bp, Myxococcus xanthus
atgtacgagaaaatcgtgctcgtcacccgccgcacgcgcatggcgggcctggtggagcgcttcaacaccaagaagcaggcgaagttctacgtggagcacgcggggcaggacttcgatgagttcacccgcgaggacgaaacctaccggtgcaacgtggactcgctgcgggagtcgctgtccttcgggctgccggtgcagcaggtggaccggagcctggtgcccaccttcctcttcaccggcaaggaggtggtggtcgtcgcggggcaggacgggctggtggcgaacgtggcgaagtacgtgggggagcagccgctggtgggcgtgaatccggacccggagcgcttcgacggcgtgctgttgccccattcggtttcgggggcgcgcggggcggtgcggcgcgtgttggagggcaaggcggccttcaagcgcgtgacgttggcggaggcgcggctggatgacgggcagcggctgctggccttcaatgacttgttcatcggggcgcgctcccacgtgtccgcgcgctaccggctgcgcaccggggaccaggaggagtcccagtcctccagcggcgtggtggtgtccacgggtgcgggcgccaccgggtggctgtcctccatcttcaacctggcgcgaggcgtgacggcccacgcgggtggggtgccgtgcgcgcccgtgcgcctgggctgggaggacccgcagctgattttcgtggtgcgcgaacccttcgccagccgtcactcgggcgccagtctggtgatgggcgacgtgacggaggagcgcgagctggtgctggagtcgcgaatggcgtcggagggcgtcatcttcagcgacggcgtggaggaggacttcctccgcttcggcgcgggtgccaccgctcgcatccgccccgcgcggcagcgcgccatgttggtggcgggctga

SEQ ID NO: 5881 - DNA, 126 bp, Myxococcus xanthus
atgggcgtgctagcgccgattggccggctgctcttttcggccatcttcatcaccagcggcctgaaccacttcttccagttggaggcgctgatgggcgtggcccaggcgtccggggtgccggagccg

SEQ ID NO: 5882 - DNA, 279 bp, Myxococcus xanthus
tcgggcccggggggccagcaccgcaacaccaccgccagcggcgtgcgcctcacgcatgcccccaccgagttgtccgtcagcgccaccgagcgccgcagccaggtgcagaacaagggcgtggcgctggagcgtctgcgcgagggactcaaggtcctcaccttcgtgcccaaggtgcggcgggccaccaagcccaccgccggctccaagcggcggcgcctggaaggcaagaagcgcacctccgaaaaaaaggccctgagaaacagcaaatccggctggtga

SEQ ID NO: 5883 - DNA, 96 bp, Myxococcus xanthus
atggtccaggggctgagcctgggcgtgtccgaggtgctcgtgtggcgccagggcagcaggcagcccctgagcgtgcgcgtggaggtcgccaagtga

SEQ ID NO: 5884 - DNA, 236 bp, Myxococcus xanthus
atgacgctgctggaggtcagcatcgtcctcgccatcatcgcggtgctggccgcgctggcctacgcgggctacgcgcagctcagcgcgcgggcgggtccgcagaacgcggccgccgacctgtccggcgcgctcgccgaggcccgggcccgcgccgtggaccgtcaggccgacgtgtggctcatcatctacccggacatcaatcacgagggtcagggccgcgcgggccatggcgcctg

SEQ ID NO: 5885 - DNA, 591 bp, Myxococcus xanthus
gtcatcgagggggaacgggagcgggtggaccgcttcgacgggacgacgcgtgtccgattggccgtcgcgcgggcgggcgtctctcccgggccgctcgcgcccgtacggttccggatgaacctgtcgctgcgcggcgatccaccgccgctcctgcccgggcaacgtgtccgggcagagacgaagctgcagccagacgcgcccccatcaaacccaggcgagaaggatttcggagcagcgcgacggcgacagggcgtggccttcaccggtggcatggacgcgcggcgcctgatggtgctctcccctgccccggcgtggcgggtgtcattggaggacacgcgcacgcggctggcggcggcggtccatgcggtgtcgccttcgacggatgcggcggcgctcttcctcaccctggcggcggggcaacgcgcggcgctggatgactcgtgggaagaggccttctctcgcgcaggactggcccacgtgttgagtgtcagcgggctgcacgtggcggcgttggcgctgatgacgctcgcggtgctgcggcggctggtggtgcgcaccggcgagcggtggcggatgctggatgccttagag

SEQ ID NO: 5886 - DNA, 618 bp, Myxococcus xanthus
atggaacgcatcgaacaccacgcgagttttggcggccggcaggaggtgtggaagcacacttcctccgcgctgggcggcgagacgcggttcggcatctacctgccggaggccgcgctgcgcggcgagcgctgcccagtgctgtactggctctccggcctgacctgcaccgagcagaacttcatcaccaaggcgggcgcgcaggagcacgcggcgcgccacggattcatcgtcgtcgcgccggacaccagtcctcgtggcgacgcggttgccaatgacgctgcctatgatttggggcagggggcgggcttctacctcgacgccacgcaggctccctgggcgccgcatttccgcatgcaggactacgtggcccgggaactccccgcgctggtggagcagcacttcccggccacggacgcgcgaggcatcttcggccattcgatgggcggtcatggcgcgctcgtcaccgccctgcgccacccgggccgctaccgcagcgtgtccgccttctcccccatcgtcgccccctcacaggtgccgtggggccagaaggccttcaccgcctacctgggcgacaaccgcgccgcgtgggcggcctgggacgcccttagagcacacgaa

SEQ ID NO: 5887 - DNA, 873 bp, Myxococcus xanthus
cccggcgaccacgtcattccgctctacaccgcggagtgcggccagtgtctgttctgtaagtccggcaagaccaacctgtgcgtggcggtgcgtcccacccagggcaagggtgtgatgccagacggcaccacgcgcttctcgtacaacggcaagcccgtctaccactacatggggtgctccaccttcagcgagtacaccgtggtggcggaggtgtcgctggctcgcatcaacccgaacgccaaccccgagcaggtctgcctgctgggctgcggcgtgacgacgggcctgggcgcggtgaagaacacggcccgcgtgcaggaaggggattcggtggcggtgttcggcctgggcggcatcggcctggcggtcatccagggcgcccagatggcgaaggcgggtcgcatcatcgccatcgatacgaaccccgccaagttcgagctggcgaaggccttcggcgccaccgacttcgtcaaccccaaggaccatgaccgtcccatccagcaggtcatcgtcgagatgacgggctggggcgtggaccactccttcgagtgcatcggcaacgtgggcgtgatgcgcgctgcgatcgagtgctcgcaccgcggctggggccagtccatcatcatcggcgtggccggcgcgggacaggagatctccacccgtccgttccaactcgtcacgggccggacctggaagggcaccgcctttggtggcgtgaagggccgctcggagctccccggcatggtggaggacgcgatggccgggaagattcagctcgcgccgttcgtgacccacacgcgttcgctgaccgacatcaacgaggccttcgacctcatgcacgagggcaagtccatccgcaccgtcgtccgctactga

SEQ ID NO: 5888 - DNA, 1161 bp, Myxococcus xanthus
ccgctgccctcgccgcgacaggtacggtccgacatcccggtggcgctggactccatcatccagcgggcgctcgcgctccagaaggattcccgtttcgagtccgcccatgcgctcggggatgccctggccgggttcctctactcgtccaccccgcgtttttcgcccatgtccgtggcgtacctgctgcgggagctgtaccgcccggacctggaggcgctcgggatgaatgccccggtgccggcctccttcgcggaggagatgtccatctggcgcgaggcgcccccgctgccagcgcccacgcaacacggtgtgccagcgctggacgtggagccggactaccgcaccgaggagagcgggcccgtcgaggtggacgacgcggagaaggaggctcccgcgccgcgtgcgacgcgggtgggcctgttcgccgaaggcagccgcagctcccagtgggtggccggtgtcggcctggtgatggccgcggtgctcgccgtggtggcggtgacgcgggtgggcgccgacgtgctggccgccgccaaggaagaggtgcgcgcgcccgggccacccgtggcgcagcggatcattccgcccgcattgcctcccggcccacccgtggccgcgccctcgaagcccccggccgcggaggaggcgccttcgcgggcctcggaggccatggtcgagaacgcggatgacgacgaggtgtcgggaaacgccgacacgccggatgacgcagccgaggtcgcggccgagcgttccgccgtggcgcgtccggtctccggagtgcggagcggcaaggtcgttccggcggctggcaaggtcgctcgaggacagacgcggcaggcccaggcggcgctgctgggcgcggcgggcaacgccctggcggtgtcgccggtgacggtggggcccgcgcacagggtgctcaccgccgggcgcgccctccagcgtgagggcaagtacaccgacgcgcggaactccgcccgcgagtgcgcccggctcgagcccggcaacgccgagtgctacctgctgctgggggccgtggaggtgaagctggggcgaatcgaggagggggctcgcaactaccaccgcttcctggagctggccccgtcggaccatccgctcgcgagcaccgtcctgcgtattttgcaggaatacgaagcccggtag

SEQ ID NO: 5889 - DNA, 396 bp, Myxococcus xanthus
atggcgaccggagaactgcttgcagtgaagttgtggaacgagtgggggcgcgccatcgcggcgagtcgagggctgacggcactcgacctgtccgcgcgggtgccactcattcgcgccaaaaaggcggtcacgcgcgtactggtttcgctcaccagctcgccgcaaggggggctcggggccgagctgcaggttcgcttcgagaagaagacaccagtcgagctcgagttcatgggcacgacctacgtggcatcgaaagagctcgtcgtcgccgaaggagcgggcacccagcagggtggtcgtgtcaagctggcttcgaacgccatgaagctcacgctgtgggccaccgggatggcccgtatcatcccctcagtgctcgaaaagtcgccgttcatgggg

SEQ ID NO: 5890 - DNA, 291 bp, Myxococcus xanthus
atggacaaccagcacagccggcaggtgctcatcgactacgcgcgtcggacgggaaagccgcttgtccacggagcggtgaacgcggatggcaccttcgggctggtgcgctgggatgagcgcttcaccccggatgccgaggacgcccagggtcaggccacctgcgaaggaggcgcacatctccccttgctggggctgctctccgcgacactggcccgcgccattcaggacttcgtgaagcacggcacgcgccgtgattcgctggtgaacctgagttcggtcctgtcccagtga

SEQ ID NO: 5891 - DNA, 966 bp, Myxococcus xanthus
atggtcatcggctacatgaaggcggcaccgacgacgtacgtgatgcagttcgaggcgggaaaggtggtccgggagggggcggggctctcgttcttctactggaagccgtcggcgacgctggtgtcggtgccgctgtccagcgcggacgtgcccttcgtcttcaacgaagtcacacgggacttccaggcggtgacgctgcaagggcagctcacgtggcgcgtcaccgacccgcgccggcttgcatcgttgctggactactccttgggccccacggggcgctaccactcggacgacccggagaagctcgaggagcggctggtgcaggttgcgcaggtgcgggcgcgctcggtggtgcaggggctgacgctgcgcgaggtgctggtgcgctcggacgccatcgagcagcaggtgctcgcggccctggccgtggcggagccggtgaaggcgctgggggtggaggtcatggccttctcgctgctgtcggtgaagccggcgccggagatggcgcgggcgctggaggccgaggcgcgcgaggcgctgcaacgcaacgcggatgaagccatctacgcgcgccgcaacgccgcggtggagcaggagcggcgcatcaaggagagcgagctggccacggagttggcggtggaggcgcggcagcggcagattcgcgaggcgaagatggccgcggacatcgccgtggaggagcagcgcgccgagttgatgacgcgctggagcgacaacgagcggcaggccgcggatgcccgcgcgtacgcgctggagaagacgctggcccccgtgcgcggggtggactggaagacgctgatggccacgtcggccagtggcggggacccggcgctcaacatcgccctggccttccgggagatggcggagaacgcgcagcgcatcggcgagctgaacgtgtcgccggacctcctgcactcgctggtgggcgcggcgggccgcgagcgctga

SEQ ID NO: 5892 - DNA, 246 bp, Myxococcus xanthus
atgagaatcctcttctgtggggtgggcaccattggctccaccgcgtcggtgctgtgttgcaacctggaggccagtctggtcttcgtcgtcttcggccgggtcgagtccaagatcctgctcgcccaggcctacgtgaagccctccgtcgggaataacaaggccgaggcgctcaagctccaactcctcaacctgcacggggtgaaggcggagtcccacggcgtacggctcacccggggcaacgcgtag

SEQ ID NO: 5893 - DNA, 57 bp, Myxococcus xanthus
atgtccgcgaacgtcccggtgaagctgcacgcccccgtgccgaacacggacatctga

SEQ ID NO: 5894 - DNA, 852 bp, Myxococcus xanthus
tgtccgctggacgcgcgggcggggctctttgccaaggaggattttctgtaccacgcgctgtccattggcgcggagaacggcggcgtggacatggccaccctgtccgtcgaccggctggccgcatgggcgccgctgctgcgggacgcggcgcctcggacgctgctgctggtggggcgcagccgggggcaggaggccctggctgcggtgggcgtgccggacctcgcctccctgcgtggcaggcgattgggcgtgtacccgtatggctcgtcgcactacttcgcgctgtggttgctgtcgcgcgtggggctgcgcatcacggacgtgcgctgggtggagctacccaccaccttggatgcgggacgggcgttgcgcgagggccgggcggacgccgtggtggggctgtggggtgacgtggagctggcggctcgggaccggggaggcgcggtgctggcgacgacggcggatgcgccgcacctggtggccacggtgctggtcgccaggggggacttcgccgcccgctacccggatgccgtgcggcgggtgctgcgggggctcctggacgcggggcaaagtgtgttgaaggacccgacggcgggggcccggatgctgggtgaggtggcgccatacctgggcgaccccattgaagccatccgcagcgcgccgccggccacgctggcggacaatcgggccttcttcgggctttccggcgaggcgcctgtcacctatgacgagctcttccagagcgccgcggcgctcttccagaagttgaagcaagggcctccggtgcctcccgcggaggacacgaaggatttgggggccttgaagtacgtgtcggaggctcgcggcccctga

SEQ ID NO: 5895 - DNA, 447 bp, Myxococcus xanthus
atgacgggcgagccgctgcccatgctggtggccctgggcctggaaggcctctacctgggcgtcatgtcgtccatgaagcgcttccagcgggcggtgcgggcgaacacgctcgacgacccggaagcggcgcgcaaggcgctggacgcgctccaggcggacctggcgccctctcagcgcgagcactaccagcagctcgtcgggctgaaggagaagatcctcgccaactaccggaagctgccgggcggcaaggtgctggaggcggacagcgagccccggttggatgcgctgctgacgtccttcctgcggctcatctccacgctgaaccagtaccgcacgtacctgaacagctccgaccgcgagcacctgcagcgcgaggtggcggagctggaggtggacgtggcgggggagacgaacccgcggctgaaggacgtgaagcagagcccttag

SEQ ID NO: 5896 - DNA, 1125 bp, Myxococcus xanthus
aacggcggcgtcaacctgtccgccggcctgctcggcttccgccaggagctggtggtgcgcggcaccctgcccgtcgcggatgcgccggagtcgatggaagtgctgctgggcgtgcgcgttcccatgcccgcgggcacggaagtctacgccatgggtggccctggcttcggcagcacgccgggcacgccatcgttccgggtgctcgccggcctcaccttcggcacccccgcctccacgcccaacgcatgtgtggagggtcagccgcatgaccccgcccgctgtccggacttcgacctggacggtgacggcatcaagaacgccgccgaccactgccccaccgtcgagggcctgtcggagctgaatggctgcccggacggggacgacgacggcgacggcctgcccaacctggcggaccgctgcccgaaggaggcggagaacttcaacggcttcgaggaccaggacggctgcccggatgacccggacacggacggggacggcatctccgacgccaaggaccagtgcccggaccaggccgaggacaaggacggcttccaggacgaggacggctgccccgacccggacaacgacaacgacggcgtgctcgacaccgccgaccgctgccccaacgaggccggccccaaggagaaccgcggctgcccggacaaggacaccgacggtgacggcatcgtcgaccggctcgacaactgccccaccgagcctggcccggcgaagaaccacggctgcaaggagaagcagctcgcgcagattggcgagaatcgcatccaactgctcgaggccgtctacttcgagaacaacaaggacatcatcatcgcgcgcagcaacaagctgctcgacacggtggccaacatcctcatcgcccacccggaagtggagaaggtgcgtgtcgagggccacaccgacaaccgcggcaaccctgactacaacctggacctgtcccagcgccgcgccgacgccgtcgttcgctacctggtgagcaagggcgtggcccgggagcgcctggatgccaagggcttcggtcccacccagcccatcgcggacaacaacaccacccagggccgcgcgaagaaccgccgcgtggagttcaagatcgtcggcgacgcatag

SEQ ID NO: 5897 - DNA, 1260 bp, Myxococcus xanthus
ggctcggtgtcgcggcaccaattgctgctcggcgtgcacctgccgcgcacgggcaacgggcgcacgaacctgcaggtcttcggcatcctctcgcacctgcggctgcgcaacaacttcacgggcttccgtgtcgacgagcgcggtgacggcctggagcagacgaacaacgccaccacgctgggcgcccgcgccgagcatcggaggtcggtgacggccttcggtcgcccggtcgcgctggagctgggattgggcgcacggcgagacagcgtggagcagacgcagcggcgctaccgcgaatccgacggcaccttcttctcggacgagattgacgcggcattcacccagacggacgtctggggctgggccgaggcccgcatgccactgggccgctggagcttccggttgggggggcgcgcggacgcgttgggtgtggaggtcttcgacgcgctcgccttccgagatccgcgctactacgacggacagggctattcgcgcagtgccttcggcgtccacctgggcgcgaaggcgggcgtggagtacgcgctgggagatgacgcggacgcctggcgcctgttcgccagctacggtgacggattccgctcgccgcaggcacgcagcctctcggagggcgagcgcgcccccttcgtctccatccgaggcgcggagctgggctcgcgcaaggacggcgagcactgggccctgcagctcagcctcttcggctcgcaggtggacaacgacttcttcttcgaccacaccgtgggcacgacggtgtacacgggccagacgttgcgctcgggcgtctccgccgcgctccaggcccgtccactgcaaggactcgtcacctcggtcagcgccacgttcgcccacgcctacgtgcgagcctcggacacgctgctgccctacttcgcgcccttcgtcgcgcgcgccgacgtgggttgggacggcccgctgacctggacggggttcggcggtagcacgctgtcgctgggcacggggctcaccttcatcggtccacgcccgctgcccttcagtgagcgcagcgccaccgtgttcctcgcggatgcgcacgtcgccatccgccggggcgagctggggctgaggctggaggtctcgaacctgctcgacgcgcgctggagggatggcgagttcgtctacggctcgcgtttcgaccctgccgccgcggcgagcctcgtcccggcaagacatttcaccgcggggtcgcctcggatggcctcgctctccctggaggtccacctatga

SEQ ID NO: 5898 - DNA, 474 bp, Myxococcus xanthus
atggcctacgagaacatccggctggagcaggagggcgccatcgcgaccctcttcatcgaccgccccaaggcgctcaacgccctcaacacgaagacgctgcaggagcttgagtccgcgctgaagtcccttcccgcggacgtgcgcgtcctcatcgtcaccggcggcggcgagaaggccttcgtcgcgggcgcggacatcgcggagatggccgcgctcaccgacgcgcaggcccaggagttcggcgccctggggcaccgggtcatggccgcgctggaggcgctgcccattccgaccatcgcggccgtgaatggcttcgcgctcggcggcggctccgagctggccctggcctgtgacttcatctacgcctccgagaaggccaagctcggcctgccggaagtcggcctgggcgtcatccccggcttcggcggcacccagcgcctcacccgcgtggtgggccgcgcccgcgccaagtag

SEQ ID NO: 5899 - DNA, 639 bp, Myxococcus xanthus
ctcctcaccgtgacgaaggtcaccgacgccaaggacgtggacttcgccgtcgaggccgtgacggagagcgagggcctcaagcgcggcatcttcctggacctggacgaaatcgtgcgcccgggcggcgtgctcgccaccaacacgtcgtccatccccatcacccggatcgccgcgtataccaagcgccccgagtccgtcatcggcatgcacttcatgaacccggtgccggtgatgcagctcgtggagatcatccgcggcgccgccacgtccgatgagacgtacgccaccacgcgggtcctcgcggagaagatgggcaagacgacggtggtctccaaggactacccgggcttcatcgtcaaccgcatcctcatccccatgctcaacgaggcctgcttcgccgtcatggagggcctgggctccgtcgaggacatcgacaccgcgatgaaactgggcaccaaccagcccatgggcccgctgcagttggcggacttcatcggcctggacaccgtgctctacatcgccgaggtgctccacaagggcctgggcgaccccaagtaccgcccaagccccctgctgcggcagtacgtggaggccggctggtacggcaagaagaacggccgcggcttctacaagtactga

SEQ ID NO: 5900 - DNA, 1038 bp, Myxococcus xanthus
cctcacgtcgaaggaatagagggttcgatgcatccagagcttgtccgccgcttccacgagccgattcgcgatgaggctgcgcgccggtatggcctgtcgcccgagcagctcaccgagctcacggccttcgagaacttcgtctacgaggcggagaacgacgacggcgaaggccttatcttgcgcatctcgcacagtacgcggcgaacgatcgactacacgctgggtgaggtcgagttcgttcgctatctggccgccgcgcgcattccaatcgcctcgccgatcctctccgagtcggggcagttcgtggagcggatcgaagaccgcgagcccggcagctacttcgtcgccaccgcgttcgagcgcgcgccgggcatcgtcttcgacgacgcgcctccgctcaaggagcgctactggaagccccccctgttccgcgagctgggccggctgttcgcgcggctccacaaccgcgcccagacctacgcgccttcgagccccaggctcaagcgccaggaatggcatgagtacgacgtggtcgacatcgaccggttcgcgcctcccgaggagaagctcgttcgcgagcgcaccgcggcgatcatcgcgcgattgaaccagctaccgcgaacaccggagagctacgggctgatccacgccgatctccacatgcacaacttctgcttcgccgaagggaagatcaccgcgttcgacttcgacaactgcgagtacgcgtggttcgtcaaggacatcgcggtactcctcttctacatcgcgcgaggcgaggctcgagaggcgcgcgacgaagcggccgcttcgttcctggggccgttcctcgaagggtatcgggagctccgacggatggatcgcgagtggctcgcggccgtgccggacctgctcgcgctccagcgctcgatgaattacgcgctgttccaccagtatcgcgacccggccgtgctcgacgagagcacgctcgaccggtgggggcggttccggcgcgacatcgaagcggacacacccgtcctgcagattgatttcaacgtgtaa

SEQ ID NO: 5901 - DNA, 492 bp, Myxococcus xanthus
aagggcgggcgcgtggtggccctgggcgagacgggcctgcacacgggcggcgaggaggaagaagaagccttcctggagcagctcgcgctggcccgcagcctcaagctgcgcgtggtggtgcacacccccaccacggacaaggagcgccacacgcggcgcatcctcacgctcctgcggcagtcgggactgctgccctcgcgcgcgctggtggaccacgccaacgcccggacggtgcgcaccatcctggaggtgggccactgggccgggctgacgctgcaccccgaggcgctcaaggccgagcgcgcggtggtgctggtgcggcggttgggcagtgagcggctgatgctcaactccgacgcgggcgacggcgccggggacatcctcggcctggcgcgcgccgccaacctgctgaccaaggccaacctgtccgcgcgcatcgtccgccgcgtcacccacgagaacgccgctcgcttcttccaggtgggcgactga

SEQ ID NO: 5902 - DNA, 1266 bp, Myxococcus xanthus
cttcaattggaacctcgtgaacgcgctgttcgccggcgagacacggacggcgatgagcgcgctcagccgcctcatctactccatcgtgggtctgtcgggcgtcgcgctggcactcaccttccctgggaagaagagcctgggagccaccacgaccaccacgccgaggacggacatggggattcaccgcagaaccgaagtgcgtccctgactcaggcgggcccgcggttctcacgggcccctgagtccacctcgggtgatacgttcggcgacctacaacgcagcggctccgcctcgacccatccatcccgggcggggccgccgcacgagaaagtcgtcgccatgtctggaatcaccgatgccgagttccttcaggacgccttcatccaggagggcgtcagcccggcgccgggagtggtcatcgcggcctgcaccgtgggcgatgacgaggacgcgcccaagaaccgcgtaggcgtccggcacgacggtgaatggctggagttcagcctctccaatgaggccatcctgtcggtggacgccactccgggcggagaggcctacgtcctgggagagaacggcaccgtcgtccgcttcgactggaagacgcccaagacgcgggatgaactccgtgcatcgcgcaagctcttcaccaacggggcggtccacgacaagggcccgctgcgccgccttcgcgtgctcggcggagacgtgctctgcgccggctccgtgggccaggtgtactggctgcgcgacgaaagcttcgaaccccttccgccactgacggtggacggagaagccgtcaccatcgaagacctcgccggcaacagccgcgaggacttcatcgcggtggcctccgatggatacgccgcccacttcaatggaagcacgtggcaggtactgccgctgccgatccacaccgaactgaccgccatctgcaagctggaacagggctacgccatctgcgggaagagcggagctgtgatgacgggcagcggagacgaatggagcgacctcacgcccttcgacggggaccgtgactactggggcatcgcgagccaccaggggacgctctacgtcgcgcatctcgccggcatcgaccatgcgtccggccaggcgctgcgccccctgggactcccgaaaggagcgccgttgcagttcaccgtgctgcggggcgcctccgacggcgtctggtcgttcgcggaccacaccatcgggcggattcacgacgggcagtggcacacgcttaccagcgggccccgctccccctaa

SEQ ID NO: 5903 - DNA, 156 bp, Myxococcus xanthus
atgcgcacggacgtgtcgctcaacccccacgtctacgcggctctggccgcgctggacctgagcgggcaggacaccgccacccagcgatgggtggacctggtgctgcgaaacttccggcgcgcgggggtgaactggcacgaggccacctttatagca

SEQ ID NO: 5904 - DNA, 99 bp, Myxococcus xanthus
atgaacttcgagttgaccgacatccagagtgaaatccagcggatgacccgcgagttcgcggccaaggagctcatccccaacgcccgcaagtgggacgag

SEQ ID NO: 5905 - DNA, 240 bp, Myxococcus xanthus
gtcctccccgcgcacggcctgctcgcgcactgccgcgccgtggcggagaagatcgtcaagaacagcccgctggccatctccaaggccaagcaggtcatcgaggccggcgccgaccaggacctgcgcgcggcgaacgacatcgagcgcaaggccttcggcgacctgttcggctccgaggaccagcgcgaaggcatgaaggccttcctggagaagcgccccgcgaccttcaccgggaagtag

SEQ ID NO: 5906 - DNA, 1272 bp, Myxococcus xanthus
ctctacggcgcccgccccggccagcccgcggccgccgggcgcaatgtgccccccgccgcggcacaggccacgcctcaagccggccagggccaggaaggcgccaccggcggtccggtgacgctgtcgcagatcatcccagacgagcgcaccaacaagctcatcatcgtcgccagccccgcggccttcgagcgcatccaggacatcgtcgggcagattgacatccccaccagcggcggcggacgcatcaacgtctactacctggagaacgccaacgcggaggagctggccagcacgctccagtcgctggcccagggcaccggcaacgcgccccgtggccgcaccccggtgccggcccgtccgcccggcgcccctggcggccccaccacgacgcaggcggcggagctgttcagcggcgaggtgaagatttcggccgacaagggcagcaactcgctggtcatcgtcgccagctcggcggactacaagaacatcgtccaggtcatccagcagctcgacaagccgcgccgccaggtgttcgtggaggccgtcatcatggaggtcaacctggaccgcaacgcgcggctcggcatgaacctccacagcggcttcagcctgagcacgtcgaacggcgatcaggtgcccggcctcatcggcaccaacacctccggccagggcctgccgccgtccctgtcgctcaccagcctggcgtcctacggcggcttcctcgccggcatccagggccccgtcatccccgcgctggagaagctgggcatcccggcctttggcgtggtgctgcacgccatgcagcagagctcggatgtgaacgtgctctccacgccgcacatcctcaccagcgacaacgaggaggcggaaatcacggtgggacagaatgtgcccttccagtccggcttcaacccgacctcgctgggctcgctcggggccggcgtgggcggcggcgcgggagcactgggcggcggcctgctcggcggcctgggtggcctgggttcgctctacgcccccatcacccgtcagaacgtggagttgaagctgacggtgaagccgcagatcaacgagagcgactacatccgcctggtcatcaaccaacagacggaggagatcgcctccaccgacccggtgctcggccccaccacgtcccgccgcagcgcgaagacgacggtcatcgcgcgggaccaggagacgctggtgattggcggcatcatgcaggaccgcacgctggagagcgtgtccaaggtgccgctgctgggtgacatcccc

SEQ ID NO: 5907 - DNA, 349 bp, Myxococcus xanthus
atgtcccgcctcgtgggcgcggcgctgtccaccgccctgttcatcactggctgtagcgagagcgactacgtccggctgtaccacagtgctgctcgggccccgagctactcggtggacgacatcgagtcccttcgccagatcggccccacctacgtggacaagggcgtgaacttcgccctgtactcggagaacgccacccggctggagctgctgctcttcgaggacccggagagcaaccgcccggcacgcgcctatgagatgacacgctatggcgacgtgtggagcgtctacgtggaaggcgtaggcgtgggacagcactacggcttccgcgcatgggggcccaactggg

SEQ ID NO: 5908 - DNA, 753 bp, Myxococcus xanthus
ttgtccgaagtcaccctgagcgggatcaagaagtcgtttggccagaacctcatcgtgaagggcgtggaccttcaggtgggtgaaggtgaattcctggtgatggtcggcccgtctggctgcgggaagacgaccttgctgcgactcatcgcaggcctggaacaggtggacgcgggcgaggtgcgcattggcggcgcccgggtgaacgacgttccgcctcgtgaccgcgacgtggcgatggtgttccaatcctatgcgctctacccgcacatgacggtgcgggagaatctggccttcggcctgacgctccggaagttccccgccgcggagattgcgtcgcgcgtgcaggaggtggccggaatgttggagctgaaccagctcctggagcgcaagcccaaggccctgtccggcggccaacgccagcgcgtggccatggggcgagccatcgtccgccgccccaaggtcttcctcttcgacgagcccctctccaacctggacaccgcgctccgggtccagatgcgcggcgagctggcgcggctgcaccgccggctgggcgcgacgatgatctacgtcacccacgaccaggtggaggccatgacgctggccacccgcgtggccgtcttcaatggcgggctcctccagcaggtgggcccgccgctggagctctacaaccgccccgccaaccagttcgtcgcggggttcctcggctccccgtccatgaacttcctggaggcgcggcgagagggggctcagttt

SEQ ID NO: 5909 - DNA, 855 bp, Myxococcus xanthus
cggagcccccgacccttcatgcccgttaccgtcgaacagcttggtccccatgacgcggaagcccttcgggggctcctgtcgaaggacccggtccacaacctctacctgctggggttgctggaggagttcggcatcgccccccgcggcagggtgccctttgccttctacggtcgcttcgacagccaggtcctcaccgccgccgtgttcgtgggtggcgacggcgggctggtggtgcccagcgcgagcgatgcgggcgccaccagcgtcatcgcggacgcgctgtcctcgcgcctgacgctgcgctccaccgtgggcgacaaatcgtcggtggacgcgctgctgcgcagcctggccccaggcaagccacgcctgtcgcgcacgcagcggctgttcagcgtgtcggcggatgacctgggccccttcaccaacccgctcttgcgcctggcgaaggaagaggacctgccccggctgctgccattggcccagggctacgtgcgcgaggtgcacgagcgagacccattggccgaggacccgcgcggctacgaggcccgcgtcatccagcgcgtgcgccagcgccgcacctacgtgttggaggagaatggcgcgctggtgttcaaggtggatatcggcagccgctcccagtacggcgcggaactggagggcctctacacgctgcccgccgagcgcaagaagggccacgccctgctgtgcctgggccagatttcccgccacctgctgtcctcgctgccgcggctgaccctgcgcatcgacgagcgggacgagagcaccgcccgcatcgcccgcaaggtcggctacctggccggacggacgtggcggctcgtcctggtggagtag

SEQ ID NO: 5910 - DNA, 279 bp, Myxococcus xanthus
gctctaaggcgagacgtctccggcaggcccgcatgggtcaaggcagaccgggatcgcgtggaccggctgccggccttcctccggttcgacgtgcggctgtccaagtcgtgggtctacgacaccttcagcctggaggcgtatctggacatgctcaacgtcacgctccgtcgggagacgttgggcttcgagtacgagggcggcaacggcttcccgctgcgcaaggacgcggtggggtttcccatcgccctccccatcctgggcgtgaagggccgttactga

SEQ ID NO: 5911 - DNA, 1119 bp, Myxococcus xanthus
atgtcgcaggacgggattccgacgatggtgccgttgcagggcggtggcatccctttcagccggggggccaccgtggccagccgggtggcgctgacgtccccgcggatttcggatgaagccccccatcgccaggcgaaggccgtttcggacacccccgccgtgctgctggtggatgaccatgtgtcgaacctggtgtcgctggaggccatcctcgagccgctgggcatccgcatggacaaggcctgttcgggggagcaggccctgcgcttcctgctgcgcgaggactacgccgtcatcctgctggacgtgcggatggtggggctgagcggcttcgagacggcggcgctcatcaagcagcgtgagcgcacgcgcaacgtccccatcatcttcctcaccgcctacggccgcgatgacgcggagctcgttaccggctacgccaccggcgcggtggacttcctccagaagccctttccgccggaggtgctgcgctcgaaggtgtccgtcttcgtggagctgttccgcgcgcagcagcaggtgcggcgccagtcggagctgctgcggcagaaggaagccgaggcgcgggatgccgcgctgagggccgcgggctacatcgaccggttgcgggatttcaccgcccggctgtcggaggcggccaccgtgccgcaggtgtgccgcgcgctcttcgaacaagggctggtggccgctggcgcgaaggcgggcaccgtcaacctcctggacgcggagggcgaggcgctggaggtggtggatgccattggctacccggagagcgtgctgagccggtggcggcgcatcccgatgacggcggccatgccgctggtggagtcgctgcgggagcagcaggccatctgggtggggtcgccggaggagtggagcgcgcgttatccgctcatggatacgcgaggacttcacgaggcggcgctcgcgctgcccttgctggtgaagggacgggcgctgggcgccattggcctgtccttcgcgcggacccggaccttcacggagatggaccgggccttcttcaccgcgctggcgcatgcgtgtgcccaggcgttggaccgggtgcacctgactgcagaggagcgccgggcccattccgtggcc

SEQ ID NO: 5912 - DNA, 654 bp, Myxococcus xanthus
cgaatccaggccgtgctccgccagcttgcccagtcgcccgatatggaggcgcgctggctccacaccctgtccctgatggagttcatcggcgcgcggaagatttcgcgcaccgtggcggaccggcacccgacgctggaggtgctggggcacctggccgacgagacgcgccacgccttcgccttcaagcgcctgtccgccgaggtcgccggcgcggaaatcaccacgttcctctgcccggaggccgcgggccgctacttccaggcgctggaccacgagctggccacctgggcgacgtcctttacgggcgcgccggacgtctatctgcactacctgctcacgacgacggccatcgaacggcgcgccatggtgctgtacccgctctacaaggccgcgtcccgccagccggccgtgcgcgaggagctggggcgcgtcgtcaccgaggagcagagccaccggctcaccatcgaggatgcgtgtgtcgagcgcctcaccgccgtgggcgccacgctggatgccgcgctggcgctggaagagcggctcttcgcggccttcatcggtgagctggaggccaccgtggcgcgggagtcgggcgcccaggcggccttcgttccggcgcccggcgaggacgtcgcggcgcggtcgcagcaagggtga

SEQ ID NO: 5913 - DNA, 1020 bp, Myxococcus xanthus
aggccccggacgaatactcgatgcagcagtagggcgcgggagttctccccggggccgggaagttggtgtaggcctgacgcgggcgccccacgcgccgagccctcgggagagcgaatgaagacggtggacgttgagagcctcaaggagcggatgacgggcttcatccggtcgctgcaggacgacatctgcggcggcctggagcggctggacggctcgacgcgtttccgcgaggactcctggacccggccgggcggcggcggtggacgcagccgggtgctggaggacggcgccgtgctggagaaggccggcgtcaatacgtccgtggtgtacggcgaactggaggagcagttcgcgcagaagctccagggcgagggccgccacttctgggcgggcggcatctccctggtgctgcacccgcgcaacccgcatgtgcccaccgtgcacgccaactaccgcttcatccagcagggcgggaaggcgtggttcggcggcggcgcggacctgacgccctactacctctatgaagaggacgcggcgcacttccaccgcgtgcaccaggccgcctgtgacaagcacgacgcgggctactacccgcgcttcaagagcgcctgtgacaagtacttctacctgcgccaccgcgaggagacgcgcggggtaggcggcatcttcttcgagaacatgggcggggagctggagaaggagttcgccttcgtccaggactgcggccgggccttcctggacgcgtacctgcccatcgccgagcggcgcaaggacacgccggcgacggaggggcagcgcttctggcaggaggtgcggcgcgggcgctacgtggagttcaacctcgtctatgaccggggcaccgtcttcggcctggagacgcgcgggcgcaccgagtccatcctcatgtccctgccgccgcaggtccgctggcgctacgactaccaccccgagcccggcacgccggaggcacggctggtggaggtgttgcgccagccacgcgactgggcgagaggaggctga

SEQ ID NO: 5914 - DNA, 870 bp, Myxococcus xanthus
tacttgggcgtggtgcccggcaccaactacaagacgaaccccaacgcgatggagtccatcgccaaggacaccatcttcaccaacgtggcgctgacggcggacggcgatgtgtggtggcagggcaagcacgctgaggtcccccacgagctcaccgactggcagggccgcccctgtaagaagggcagcgcgcagaaggcggcgcaccccaacagccgcttcaccgcgcccatgtccaacaacccggcgctgagccccaaggccaacgatccgacgggcgtgcccatctccgcggtcatcttcggcggccgccgctccaacacagtcccactggtgctccaggccttcaactggacccacggcgtgttcctgggcgccaccatgggcagcgagacgacggccgcggccaccggcaaggtcggcgtcgtgcgccgcgaccccatggccatgctgcccttctgcggctaccacatgggtgactacctccagcactggctggacatgcagaagcacatcgcccagctgccgaagatcttccaggtcaactggttccgccaggacaagaacggcaagttcatgtggccgggcttcggcgagaacatgcgcgtgctggagtggatcgtgaaccgcgtccacggccgcgtccccacccaggagacgctgctgggctgggtgccccgcgccgaccagggcctcaacctcaatggcctggacctggcctccgacgtggtggcggaagtcacgtccatcaaggaggacgaatggaagtccgagctgaagagccaggaggtcttcttcgagcagctcggcaccaaggcgccggacgcgctgatgctccagcgcaagctgctgatggcgcgcctggaccactga

SEQ ID NO: 5915 - DNA, 276 bp, Myxococcus xanthus
atgagactggctttcgtgttgtcggtgattctcgcgctagcgccacctgtggcgttcgcacagcgcgggaaaaatgcagcggccctcatcaaggacggcgagcggctgtaccagggaggcaagtaccgcgaggcggcggatgcgctgaagaaggcgcatgaagcccagccccacccgcggctcatctacaacatcgccatctccctggagaacgcgggagagctgcgcgaggcggtgacctggtaccagcagtacgtcggcgccaccgacggcacg

SEQ ID NO: 5916 - DNA, 1397 bp, Myxococcus xanthus
acgtggctgcatacctcccacgcgttccactccgcgatgatggagcccgcgctcgcgccgttcgccgcccggctcgcggacgtcccgctccgtgccccgaaaacgcccttcgtctccaacctcaccggccgttggatttccgccgccgaggccaccgaccccggctactgggtgcgccatctgcgcgagccggtgcgcttcagcgacggcctgaagtgtctgttcgaaaggcacgctccgcatctgctcgaggccggccctggacgaaccctgaccaccctcgcgctccgccacccggaccgcccggccggaagcgtcgcggtctgctcattgcggccccccaaggaggaaggctccgacacgacgttcgtccagcaggccttgggacgactctgggtcgcgggcgtggaggtgaactgggacggctttcacgccggaggccgccgccaccgcgtgcccctgcccgcctatcccttcgagcgtcagcattacctgctgggcgtccaggccgctgcgcggcaagccaccaccgccgaagcggcctccgttgcgcccctggcgagacacgagcgcccgggcatcgccacgcccttcgtggcaccgggcaccgtgctcgaacgccgggtcgcggggatatgggaggagagcctgggcttctcgcccatcgggcggcacgacagcttcttcgaactgggaggccactccctgctcgcgacgcgcatcgtctcgaggctccaggaggagttcggcgtcacgctcccggtggggaagctgttcgagtcacccacggtggccgacatcgcggcccgcatcgaagcgctggagcccacgacgaaccgcgcggacatcccgcggcgcatgcctcgggagggaatgcgggacctgtcgttcgcgcagcagcggctctggaccctggagcagctcacgccgggaaccagcgcctatcacctgccacaggccctgcgcctgcgtggccccctcgatgtctcggccctccaggagagcttccagcagctggtacggcgccatgaggcgctccggacacgattccccgccaccgagggacgcccctttcaggaggtcctcacgagcgccccggtgacggtgcgcacgctcgcgctcgacacactccccgtgagcgaccgtgaagcggcgctggagcaattgttgtccgaggaagcggagcagccgttcgacctcgcccggggcccgctgatgcgcgttgccctcgcgcggctggcgcccgatgagcacgtgctctcggtgacgctacaccacatcatcgcggacggcggctccctgcgggtgctcacccgggagcttgccgccctctacacggcgctgcggcgcggccacgacgcggacctgccggagctgcccatccagtacgccgacta

SEQ ID NO: 5917 - DNA, 718 bp, Myxococcus xanthus
atgctgtacgtggcctggacggacggggagctcacgccggaggagattcgcgccatgggctccgccgcccgcgcgcagccctggctggacctgcgcgccaacaccgtgctggcacgctggctggacccgctggtgccgcccagccccggtgagctggcccaggtgcgcgagcacatccgccgcaccgcggagcgcctgtcccacagcgaacacaacaacctcgccgagctgggcgcgcggctcgcccaggtgggcaacggcgacgagggccttcccgcgcccatgccggagctgacgcgcgcgctggcgcagttggaggagtccctgggcgtctccggcagcgaggccgtccgcgcgctcgtccccgccgcttcccccagccgcgccgaacagggcacgcccacgtccttcgacccggaggcgctgcgtgccgtgctggaccggacctatccggagacgcgcgcccaggtgcgccagtggctggcggacccggcctaccgatacacggacacgcgcgacacggtgaagtaccgggaccaggtgctcgcctggctcaaggccatggccgaccacggactggggcgcatcgccttcccctcgggcaatgagacgagcgcggacctgggcgccttcgtgaccgccttcgagacgctggcctatttcgacctgagcctcgtcatcaaggccggcgtccacttcggcctcttcggcgccagca

SEQ ID NO: 5918 - DNA, 219 bp, Myxococcus xanthus
atgcaggagctggaggcgctgattcccaagcccggggcgctgggcttctcgggcagcgtggagcgtgcgcgacatgagatgcacgggcccttctcgctgccgccggggccggaggccttctccttcgcgctgtaccagtccacgggggtggggctgattcccggacacgcgctggagttgctggagaacggcgcggtcttcgagcgcatgctggcggac

SEQ ID NO: 5919 - DNA, 900 bp, Myxococcus xanthus
atgaagctcgccgagactgctccgatccctgctcccgaagcgctgcccgctgcccccctgtccctggacgaggtacgccgcatcacccagctcctggaggccatcagcgaggaccgcttcctgttggccggcctccccgaggaggaccgcatcgccttcctgagcgccgcgggccgcgtgctgcacccggaccgcgacaccaagtcccggatggcgaaggcgctgcgccgagacaggaagaagacgaagcgcgagcacgaccgcgccatccgcgccacgacggagattcgcaccctgcgtcgctccgccatcttcacggtgccggcgctgcccccgccgcctccctcggaacccgggccagagcgcatcctcgagcagccccgccgctgctacgtctgcaaggccgagtaccgcaagctgcactacttctacgacgcgatgtgcatcgagtgcgcggactacaactacgccaagcgcacccagcgcgccgacctgaatgggaaggtcgcgctcatcaccggcgcccgggtgaagattggcttccaggcctcgctgatgctgctgcgctccggcgcgcgcgtcatcgccaccacgcgcttccccaacgacgccgcgaagcgctacgtccaggagccggacttcgcggactgggcgcaccggctgcacatccacgggctcgacctgcggcacgcgcccagcgtggagctcttcgcgaagtacatcgagcagacgcacgagcgcctggacatcctcatcaacaacgccgcgcagacggtgcgccggccgccgggcttctacggccacctgctgccgggagagatgcgccgcgcggacgacctgccggcggcggcgcgcgcgctgctcgcgggccatgacgcctgcgtctccacggtgcaaccg

SEQ ID NO: 5920 - DNA, 2013 bp, Myxococcus xanthus
gacgacgcagcggacatggctcgcgaggccaccttccacctgcgtgtcgaggagcaggcggctcggacgcccgatgcccccgccgtgtcgctggagtcccaggtcctcacgtacgcccagctcaacgcgaaggcgaaccagctcgccgcgcagctgcgtacgatgggcgtgggcccggaggtccgcgtgggcctgtgcctggagcgcacgcccgatgccatcgtcgcggtgctggcggtgctcaaggccggtggggccttcgtccccatcgacccggctgcaccggcgcagcgcaagtccttcgtcctgaaggactgcaacgcgtccgtgctgctcaccctccagcacctggccgatgcatggaaaccccaggtccggaacttgctgtgcctggataccgaggcctcgaagctggcgtcactcccgacgcggaacgccgtggtgaacgtcctcggggagaacctcgcgtacgtcatctacacgtctggctccacgggcacgcccaagggcgtcatggtgcagcaccgctcgttgctcgccatgcacgcgggaacgacggaggcgttccaggcaacgggagccacccgccagcgcatcagcctcaacgccccgttccacttcgatggggcgttggagccgctggtccatctggcggacggacactgcctctgcctggtgcccgaggagacgcggaaggatccggaggcgatgctggcgtgggtggggcagcagcgcgtggacgtgctggactgcacgcccgcgcagctcacgctcttgctccaggctggactgctggagcagacgcatgtgccctcgcgaatcgtgtgcgcgggagaagcgatggccccgtcgctctggaagcagttggccagcacggagcgcaccacggcgttcaacgcctacggccccacggagagcaccgtctgcgccaccacggcgagcgtccggaacagcaccgcgcccgtgcccgtcatcgggcggcccatccagggcacgcgagcctacgtgctggatgcgcggcagcgggtggcccctgcgggcatcgcgggtgagctctacctgtcgggagacggcctggcccgtgggtaccagggacagccgcagttgaccgcggagcgcttcatccccgacgcgttcagtggaaccccgggggcccgcctctatcgcacgggggacaaggcgcggtggcggcatgacggcacgctggagtacctgggtcggctcgacttccaggtgaagctgcgcggcttccgcatcgagctgggtgaaatcgaagccgtgctgcggacccatgaccaggtgcaggaagccgtggtgctggtccgtgaggacgtgcccggcgacaagcggctcgtggcctacgtcgtcgtcgtggtgacgcccgaggccccggtgaccgcggagctgttgcgtcagcacgcccaggagcggctgccggagtacatggtgccgtccgccttcgtgctgatgggcaccctgcccctcacccctaccggcaaggtggaccggaaggccctgcccgtcccggacgtctcgaacctggccgtcaaacgcgatgtcgagccgcccgcgacgcccctcgaggctcaactggcggaggtctggaaggagctgctgcgtgtccccaccgtgggccggcgcgacaccttcttcgaactgggcggccactccctgctggccacccagttggtggcgcgcatccgcgccaccttcgacgtggacctgaacctgcgtacgttcttcgcggcgcccaccgtggccgcgctcgccgagcgcctgtcctccgcctcatccggtccccggcttccagccctgacgcgagcccggggggacggagcactgccgctctccttcgcccaacagcggctctggttcctggatcagctccagccggggaacgcgtcctacaacatgccgacggcactgcgcctctcgggtgcgttggacgtggccgccttgcagcgcgccgtggacgaaatcgtccgtcggcatgaatcgctcctggagagcaca

SEQ ID NO: 5921 - DNA, 558 bp, Myxococcus xanthus
  unsure (1)..(558): unsure at all n locations
tgctctaaagcagatgctgtggaagggaggggagggattgtggccgagcatcctgaagtgagtgaacccgaggaagcgcgcgcggcatgtgcttccgtgtcggcggtgacagcggagcatcccgctgtcgcgcgcaacgtggcagtcacgggaggggtcgcgtcgctgacgccccccatggacggagcgcccatggcgcaaccggacgcgggggcggcggagcacgtgcggcatcgtcaccgtgagcgcgcggtggtgggcgaccggtggattgcgcgggtgctgcgcgtcggcgcggtggtcagcggcggaatgttcgtcctgtcgctggggctggaggccatgccccaatccgagcgcgtgcacgtcgccatcgacttattgcgaaagggcgccgcgtcactgctgttggtgacgcccgtggcgcggctcgcggtggcgggcacgctgttgggcctgaggggtgagtggcgctacatggcgatggccgtgggcgtgctggggctgctcgccatcgcggtgggcgccggcatccaagcctangaagagcgcgtgtga

SEQ ID NO: 5922 - DNA, 1367 bp, Myxococcus xanthus
atgctggaagggggacgaaaggtgaacatgagcgcagcaaacttcaacgggcagaagccgaccatcgacctgaaagatgcggtgatgctgctcatcgaccaccagagcggactgtttcagacggtgcaggacatggcgatgccgtcgcttcgagcaaacgcggcggcgctggccaagatggcgagcctctcggagctgcctgtcatcacgacagcgtccgtacctcaagggccgaacggacccttgattcctgaaattcatcagaacgctccacacgccaagtacgttgcccgaaagggcgaaatcagcgcctgggacaatccggacttcgttgcggccgtcaaggccacgggcaagaagacgctgatcatcgccggcacgattaccagcgtgtgcatggccctcccggccatcgccgcggttcacgagggctacagagttttcgtggtggtcgatgcgtcgggcacgtactcgaagatggcccaggagatcacgctcgcgcgtgtcgtccaggccggcgtggtaccgatcgatactgccggtgtcgcctcggaactgcagaggacctggaaccgcgcggacgccgaaaagtgggctgagatctacaccaagatattcccgccatatcggctcttgatcgagagctatgcgaaagcgcagcaggtcgccaaggaaggcgagcagctcgactcgcagcgcaagtaggcgacgaaaggagaatcacaatggccagtgaaccaattcgtgaccccgtgaaagatcagctgctgacccccaagaattcggcgttcgtcgtcatcgactatcagccggttcaggtgaactccatcgcgtcgatggaccgtcagctgctcgtcaacaacattgtcggagcggccaaggccgctgtcgtgtacggcctgcccatcgttcattccaccgtcaacgtgaagaccgggctcaacaagcccccgattccgcagctgcgcaaggtgcttgagaagttccccacctacgatcgcactacgatcaactcctgggaggacgtggagttccgcagcgccatcgaggccacgggtcgcaagaagctgattttgacggcactgtggacggaggcttgcctgacatttccagcgctcgatgcgctcaaggctggctacgaaatctatgtcgtcgctgacgcggtgggcggcacctctgtggcggcgcacgaagccggtctgcgtcgcatcgagcaggccggcggcaagataatcagcgtgccgcagctcttctgtgagctgcagcgcgattggtcgcgcaaagagacggtccctgcattcatggacctcttcattcagaccggaggcaccgcgggtatccagttctcctacgactggagcgaatga

SEQ ID NO: 5923 - DNA, 1507 bp, Myxococcus xanthus; identical to SEQ ID NO: 183

SEQ ID NO: 5924 - DNA, 567 bp, Myxococcus xanthus
cgtaaggtgacgctgccggagccgccgcgtcccccggttgtccgcaagcaggtggccgccacgggcgccgccaagggggggcctgagggcgcgcccgtcaccatcgtcgagttcaacgacttccagtgcccgttctgcagccgcgccaacccggcgctggcgcaggtgcagcaggagtacggcgacaaggtccgcatcgtgttccgccacttcccgctcgacttccacaaggaggcgccgaaggcctccgaggcctcgctgtgcgcgggcgatcagggcaagttctgggagatgcacgacctgctcttcgccaaccagcaggcgctgggcgtggactccctgaagaagtacgccgccgacctgcagctggacacggcgaagttcaacgcctgcctggactcgggtgagaagggcgccatcgttcagaaggacctggccgagggcaagcaggcgggcgtgtctggcaccccggccttcttcatcaacggcatcctgctgtccggcgcgcagcccttcgaagagttcaagagcatcatcgacgcggagctgaacgcgccgaagaagtag

SEQ ID NO: 5925 - DNA, 555 bp, Myxococcus xanthus
  unsure (1)..(555): unsure at all n locations
atggtcctcctccaggagccgcccggcttcgctggcttccttgccggcagcctgcgcaccctgtcggtggaggaagtcttcgcccacgtcctgtccggcatccgcagcggcctgctggcggtgcagcacgccacggggcgccgcacggtgtccttccgggacgggcaggtggtgttcgccacctccacggagcgctgggagcggctgggtgcggcgctgctccgcctgggcttgctgacgcaggcgcagctgacgcaggccctgtcgcgcgtgacgccgtcgcgccgcatcggccaggtgctgacgtcggaagggctcgtctccgaagccaacctgtacagcgccatgacgtacgtggtgcgtgaggtggtgctcancctcttcgaactggaggacggcagcttcgtcttcgtcgaaggccccgcgccgatggcggacgtggtgaagctgcccgagcgcacgcgggacctggtcctcaccggcatcaaacgggcggagctggtgtctcgcctgcgtcggcgcttcccggacgacacgcgcgtcacgctggggtcc

SEQ ID NO: 5926 - DNA, 699 bp, Myxococcus xanthus
ctgtgtgctctaaagccccgaatcctcgtcgtcgatgacaatcaggagctgttgtccctcctcacgcagctcttcgaggaggcgggctacgaggtcattggtgcgagccgcggcaagcaggcggtggagctggccaaggcccagcccccggcggcggccgtgctcgacatcctgctgcccgacatgatggggtaccacctcgcggacgcgctgcgtaaggacaacccccagctcccgctcctcttcatcaccggcgtcttcaagggtggcaagcacgccgtcgaggcgcgcaccaagtaccaggccgccggctacttcgagaaacccttcgaggctcagaagctgctcgaggcgatgacgaaggtgctgcctccggagaagcccgctgcagcggccgcgtcgctccaggacgccttcgaggtggagctggacatcgacgtggaggaggaaggcccgcaggacgccatggagctgaccggccgcatcaaggtgacgggcggcggcaacatcacggcggagattcgcggcgccaacctcacggccagccccatgcagaaggtgccggcgacgcaggtgcgtccgcccacgccgggccgtccgccggacccgccgcccgcgggcgcaccgggcagccgccgtggtgaaatccgcgacaacctgccttcgctcctcaccgccttctacctctcccgcgagacg

SEQ ID NO: 5927 - DNA, 741 bp, Myxococcus xanthus
gatatgtggcaacgattcaagagagcaatgcgtagcttcgccgggttcttcgtctcctccatcgaggacccggagttgattctcgagcagaacgtccgtgacctgaacgaccaggtcccgaagatgaacgagtccatcgccatggtccgggcgaacgtgacgctgctggagaaggagaacgccaagtaccaggacgacgtgcgctcgctgacggccaaggtgaaggccgccatccaggcgggccgtgacgacctggccgcgcagtacgcctccaagctccagattgagaaggacgcgctggcccgcaacgagcaacagctggccacggcccgccaggcgtacgagaaggccctgtcggtgaagaaggcgttcatgcgcgagaaggagcgcaagacgcaggaggccatgaacgccatccgcgaggcgcgccgcgccaagtggcaggccaaggtggccgacacgatggagtccttcaccgtggcgggtatcgactcgacccacgatgagatgctgcgcaaggtgcaggagaagtccgccatcaacgaggcccgcatgcagatggccctcgagtcggtggaccacaccgcggcgtccatcgaggaagaggccgagaagatccaggccaacgagctggtgaagcagttcaagatggagatggggctcgtcagcagcccggcgccggtgtccgaggtgggcagcgggccggagaagaccatcggcaagaaggtcggcgtcgagtag

SEQ ID NO: 5928 - DNA, 263 bp, Myxococcus xanthus
atgaggctccaccgcggtccaggtctcttcctcttcctgttcctctgtgtgctcggcgcgagctatgcgctcgcgtcgcgcatggggtacctggatcgcttgcaggagcggtacttcccgtccacgcgtgaggcggtccgcctgtcgccgggagacttcccggccggcgtggcggccccggtggcggacgtggcctccgtgcccctgcggccggtgctcatcggcttcagcccgcgcggtgcctccgcgggcctgctggtggc

SEQ ID NO: 5929 - DNA, 507 bp, Myxococcus xanthus
atggacgcccagcggaggagcgtcgtcggcgcgggcgcggcggtgcggctcgtcggcgcggccctgttcctggccatcagcaccacgctgtggctggccggaggccgggactggggtgtgtacccaccggcgttggggctctacgcgtcggtcgccggcgtgctgttcatgctccgccaacggcgcgtggcccggggcctgggcgcggtgcagtccctggtggacgtggggctcgtgtactggattcagtccacgaccctgcttgtctcgccctttcccgcaggtgtggcgggcttcagcctgggcctgttcgcgctcgtcgtcgccctgagcgggctgggcatgcgaggcaccgtcgtctacgggaccgcgctgttgtccgccgtggcccaggcggcactcatgcggcaggcgagcgtgggttggggcgcggtggccatcgccgtggtggcactggtgctggtggccgtggtgagccactacggcaccgggcggctgcgcaacctg

SEQ ID NO: 5930 - DNA, 143 bp, Myxococcus xanthus
atgctctctcgcttcttggagatgcatgggttcacggtctactcggcgtccgacgcgctccaggcgctcgacgtgctggagcgcaaccaggtcagcatggtcatcaccgactacgtgatgccccataggaccttagagccgcg

SEQ ID NO: 5931 - DNA, 543 bp, Myxococcus xanthus
atggaggcgctggacgcggcagcagaggcctttgagacgggcgacttcgaggcggccctggccgccgccgaccgcggcctggcccaggccccggactcggtggacgccctgcacctgcgcgccgccgccctggtggagctgggccgcctggaggaagccggccgggccttcggcgccgcgctgagggtgtccccggacgacctggaggtgctcctgggaaccgcggactgcctcatctgccgcgcgggcgaggaccgggaggccgtggaggaaggcctgggcttctgcgcgaagggcaagcgcctggcgcagaaggccggcgacgtggagctgctctacgagttcctcctcctggagggcatgggcctgaaccaggtgggcgagtgccgcgcggccctggcgagcctggacgcggcgctggggcacatgccgcgctcggtggacgcgcagttggagcggggcatcgccctgttcgagctgtgccgcttcgacgacgcgaagggcgccttcgacaaggtgctgaaggacacgcccgacgaggcc

SEQ ID NO: 5932 - DNA, 873 bp, Myxococcus xanthus
gggaccatcctcccgcgcgtcctgccccacgtcctgggcatcgcggcactctccgcgctcgtcgtctgggcgtaccggcaaggctatctggatctgcagatctcctcgccggcgccgctgtccctgctgggcatcgcgctctccatcttcctcgggttccggaacaacgcctgctacgaccggtggtgggaggcccggaagcactggggcgcgctcatcattgaactgcgttcattctcccatgaggccatcgcgctcctgggggacgacagcagcggagcgaaggaggcggcgcgcaggttggcgaggcggaacatcgccttcgcccacgcgatggtcgcgcacctgcgcgggaacgacgcccgggaggacatcagccgcctgctgccggagccggaggcctcgcgcgtactggccagccagaaccgccccaacgccctgcttcgggagcacgaccgggagctggccacgctcctccgggagaagcatctcaccgacatcacctggagcgagctgcggacgcacgtccatggcttgatgaacgtgctctccgcgtgtgagcgcatccgcttcacgcccctgcccttcacgtacacggtgctgctgcaccgcaccgcctacctgttctgcctgctgctgccctttggtctcgcggaggcgctgggctggttcacgccctggctcgcggcgatgattgcctacaccttcttcgggctcgaccggctgagcgacgaactggaggagcccttcggcacggagcccaacgacctctccttgctggcgatggcgcgcagcgtggagatgaacctgatggaggcgctgggcgaaccgcagcccgagccgctgaagccccgcgacttcgtcctcccatga

SEQ ID NO: 5933 - DNA, 336 bp, Myxococcus xanthus
atggcaagcgagggaggcagcgtgcggcacgtcatcgtcgtgggtgcgggaccggggggcttgtcggccgccatcaacctggcggggcagggcttccgcgtcaccgtggtggagaaggacgcggtgcccggggggcggatgaaggggctgacgctgggcgcgtcgggcgagtacgcggtggacaccgggccctccatcctccaactgccgggcgtgctggagcagatattccggcgcgcgggccggcggctggaggactacgtcaagctgctcccgctggatgtcaacacgcgggtgcacttctgggacggcacgcacctggacaccaccccggca

SEQ ID NO: 5934 - DNA, 573 bp, Myxococcus xanthus
  unsure (1)..(573): unsure at all n locations
tcccacctgcgccgcaacgccgccgcctactgcgtggtcctggtggggctgctcctcaccgccgtgtcggcgacctatgtgcagcagagcatccacgagcgccgcctgcaccgcttcgacggcgcggtccatgacggggtgctgggcctccagcagcgcctggagctgaaccagtcgctgctccagggggtgcatggactgttcaccggcagccgcttcgtgagccaggaggagttcgacgcctacctggagagcctgaagctgaaccgcagcttcccggagctggagggcatcggcttcgcgcggtggcttcggccgcaggacgtagcccggtacgacgcgaaggtccgcggcgggcaggagccaggccatcccgtgtggcccccgggcccacgcgcggnctacaccgccatcatcatgctgaaccccctgaacgcgcgcacgcagcagggcctgggattcgacatgctcaccgagcccaatcgccgggcagcgatgctgcgcgcactgggcacgaggcgccaggccgccacccacaaggtgcggctcatccaaggctgggaggatgccgcg

SEQ ID NO: 5935 - DNA, 414 bp, Myxococcus xanthus
atgcccgtgaagctctctctcgcgacacgcatcttcctgggctacgccgtggtgctcggcaccttcgggctggtgtccctgttcagcgtgacggagctccaccgcaaccggctggaaatccggctggtgagccagggctacctccagctctcccaggacgccgcggagctggagaccttccacgccacccaggagaaggacaccgagcgcctgattcaagaaggcaacgtcgaaatccgccgcgccttcatccggctggcccggacctacaactcgcccctcatgacccagcggctcgccgccgcccaggccaaggcgcatgaggtgctggcctccgcccccgacagcgaggggcccttcatccggggcctggaggaccgcttcggcgagctccaggcccgctctttagagcac

SEQ ID NO: 5936 - DNA, 1098 bp, Myxococcus xanthus
gcactcgcgggcctgcccgaggtgcgccgcatccgctccaccttgcagttgggcgtcacccagctcacggtggagttcgagccagacgccgactacttccgcagccggcagtacgtcgtcgagcgcgtggcccaggcgcagagcgagctcccacccggcacggacgcgccgctggtctccagcctcaccgggcggctcaacgaggtgttcgagttcaccctggaagcggagcccggcgcggcggagctgatgacgctgcgggatttggccgagttcgaggtgaagaaccggctgctcgccgtgcccggtgtcgccggtgtggagcgcctgggtggctacctgcgccagttccaggtgcagctcgacccggaccagatggtggcgcgcggcatcaccctgaaccaggtggagcacgcgctggagggcgcgaacctgaacgcctcgggcggcttcgtggtgcagggccccatggagtggacggtgcgcgcggtggggcgcgcggagtccgtggaggacctgcgcgacaccgtggtcgccgtgcgcgacagcacgcccgtgctgctgggtgacgtggccgacatccgcgaggcccccgccgtacgccggggcatcgcccaccggctgaagggcgaggtggtgagctgccgtgtcatcaagcagttcggcgcggacacacagcaggtgacggcgggcatccgcgtcgccatccaggagctgaaacagggcctgccgcccggtgtgcagcttcgcatcgtgtatgaccagtcggtgctggtggactccgcgctgggcggcgtcagccgggccattctgctgggcgcggtgctggtggtgctcgtgctcttcctgctcctgggagactggcgcgcggcgctcatcgtcacgctcaccctgcccttgtccctggcgctggcgggtgtgctgctgaagttcgccggcatcggcatcaacacgatgacgctgggaggactggccatcgccgtgggcctgctggtggacgcggccatcatcgtcacggagaacatcgtccaccgcctgcgtgaagcaaagggcaaggcttcgcggcgcgacgtggcgctggcggcgtccatggagatg

SEQ ID NO: 5937 - DNA, 672 bp, Myxococcus xanthus
ggggcagacgcgctgatgtcggacgcgggggacggctcgcttccttttccggtcttcaagccggaagagcgcgtgtgtggcaattgcaagctgttcagcccgcagtcggtggatgagcgccggggctgggtgggcgcgtgccggctgcactcgtggcggggcaactttcccccgtccgcgcccatttgcgacaagtacacgcctcggggaagcgcggccccctcagcggttgcacccgcgcgcgagcggaccgcgcgcagcgtggcgccggtggtggtgcggcgtcgcgcggaccccaacgacgtggtggacctggaagggttgagcatgacgcgtgaagagctgatggacatcttccgggaggcgtccggcttgctggacgcgccgcccctggccaacaagtgggagggcggcacgatgcggctggtgcccgccaacaccgagctgcagcccaaggacctgcccatcgacagcctgttccacaaggtcgtcatggtgcgcgacaggcttcgggtgctggagcagaagctcaacgcgcacccgaagctgtcggacgcggagaaggtggagatgcagagctacatcacccgcgtctacggctcgctcaccagcttcaacgtcctcttcaaggagaaggcggaccagttcgtcggctcgaagagcgaggactga

SEQ ID NO: 5938 - DNA, 504 bp, Myxococcus xanthus
atgcacgcatgcgcgcttccgccgctgtccgagttgtataccgagcaccgccctcgcgcgttggccattgcccgacgcatcgtcggtgataccgccgacgctgaagacgtggtgcaggacgtcttcgcccggctcgctcgccgcgcccccggctacggcggccgcgcggcgtggagcacctggctgcaccgggtcatggtgaacagcagcatcaactggctgcgggcgcgcaagcgccgagacaggctgagccacgacgtccaggagcccctgtcccccgaagccctcgccgtgggcgcggagatggagcgccacttcggtgaggcgatggaggacatcaacgagcagcagcgccaggtgctctacctgcgcgaggtgcgcggcctgagctacccggaaatcgcccggctgctgcgcatccccgaaggcacggtgaagagcacgctccaccgcgcccgccagcgcacgctctccctgatggaagagcgcggccagcagccctga

SEQ ID NO: 5939 - DNA, 1350 bp, Myxococcus xanthus
aagcgcgtggggagcaccgcgcgggagggtggcgccacggtggcgcgctccatcgccggctttggcggtatccgcgaatccattgtcgggtcggccggggtgatgaagaagatggggcggcgtgccgaggagattggcgacatcgtgcagaccatcaacctcatcgcggaccgcacgaatctcttgtccctcaacgccagtatcgaggcggcgcgcgccggtgagcacggccggggcttcgcggtggtggcggaggagattcgagcgctggcggaccgcgcggcggcggccagcgcggacgtggcgaaaatcgtccggggtctgcagacgacggcgcgcgaggcggccaccgcttcgggcgaaggcgtgcgggcggcggacgagggcgcggcgctggcaggggatgccgagcgcgcgctgtccaccatcctcaagggggtggaggacctggggagcaacgtgcgcgaggtgtcgcgcgcctccagcgagcaggtgcaggccacgcaggcgctggtccagggcaccgcgaaggtgagcgaacagggacgggccatcgccacatccgcggccgagcaggcacaggccgcccaggcgctggcgcagggcggcgcggagatgcggcgcatgtcgcggcagacgatgcaggccacctccgagcaggcgcgcgcgctgcgcgacgtggtgcgctccaacgggcagctcgcggaggcggtacagaaggtgtcgcgcgccgtgcaggagcaggcggtggcggcggcggacctggccaagggcacctcccagatgcgccagctcgtccagggcgtgagcggggtggtgaccacccagagccgtgacgtggcgggggtgggcacgttggtgcaggaggcggcggcgtccacccagcgcaccctggtggggctggccgagcaggccaccgccgcccaggaggtgacgcgggccatggaggagacgcgcaagcaggtggcccagtccgcgcgcggcatgacggagcaggcccgcgccctcaagcagagtgaaacggccagccgccaggtggcgaagctggccgcgtcggtgacgcgggccgcggaggagcagtcgaaggcgctcagcgggctggtgcgggaggcggacgaggtgcggcgcgtggcgcggcagacgtcgcgcgcgctggacgagcagacggaggcgctcggtgcgctcacggcctccgccagccgccaggccacgggcgtggccgtggtggcacgcgccagcgcggaggcgacggcggtgatggagggcctggccaagagcgtggaggagattcgtctccgggcgcgggacatcaccaccgccaccgcgcagcaggcgcgcgcgactttagag

SEQ ID NO: 5940 - DNA, 1185 bp, Myxococcus xanthus
agctcaagtgcgcccggtgccagcccctttccccatcaagctcgatgcagtgagcgcgcccgcggcgcctgctcccgccgagcccgccattcctctgccgggtgctgcgtccgccgcgcctcaggccgccgccatcccgctgcccggtgccgcgtccgcgcaagccgccgccatcccgttgcccggtgccgcgtccgcgcagcccgcagccattccgttgcccggcgccgcgtccgcgcagcccgccgccattccgttgcccggcgccgtgtccgcgcagcccgcagccattccgctccctggcgcccccgcgtccacgggtgccatcccgctgccgggcgccgcaccgcccactccgccgcgattccgctccctggcgctcccgcgtccacgggcgccatcccgctgccgggtgccgcgccggcccacgccgccgccattccgttgccaggcgccgcgcccgcgagagccattccgctgccgggcgctcctgaggcgttcagcgccgcgccccacgccgccgcgattccccttcccggcgcggccgcgcctcagcccgccgccattcccctgccgggaggcgccccggaggccgatccgttcgccttcgacatgggcgagcccgcacaggccgccgccatcccgttgccgggaagcgctcccgaagccgacccgttcgccttcgacatgggcgagcccgcacaggccgccgccatcccgttgccggaagccgacccgttcgccttcgacatgagcgagcccgaacaggccgccagcgtcccgctaccgggaagcgctcccgaagccgacccgttcggcttcgacatgagcgagcccgaacaggccgccgccatcccgttgccggaagccgacccgttcgccttcgacatgagctcgcccgcggaggccgccgcggccatgccgcaggcagatggcccgtccggcatggacgcgttcggcgacgactttggcgagccggtccgggacacccgcgaggtgacgcgcgtcgtctccattccactgccgagcgacgcctaccgcgagccgccctccgctccggcgtcgggctacggcgtgaatgaacccgcgggaacggcgcgcgacttcgacttcgagaccgtcgaagcccccgtcgaggacgccgcacagggctacggcgtgaacgcgcccgcgggcaccgccagg

SEQ ID NO: 5941 - DNA, 570 bp, Myxococcus xanthus
atgagtcacgacagcgagatctcctccatcgacgacgccatccgagacatccaggagggcaaattcgtcatcgtcgccgacgacgaggaccgcgagaacgagggcgacctcatcatggccgcggagaaggtgacgcccgagcacctggccttcatggtgcgccacaccagcggaatcgtctgcatgcccatgctggcggagcggctggacgagctccgcctcccgcagatggtgtcggacaacaccgaatcccatcgcaccgccttcaccgtctccgtggactaccgccacgacacccacacgggcgtatccgcggcggaccgcgcgaagaccatccgcgccctggtggacccctccagcaaggccgacgacttcctgcgccccgggcacatcttcccgctccgctaccgcgagggcggcgtcctccgccgggccggccacaccgaggccaccgtggacctgtcccgcctcgatggcctgtccgcctccggcatcctctgcgagctggtgaaggacgacggcaccatgatgcggatgccggacctcaaggtcttcgcccgcgagcacaag

SEQ ID NO: 5942 - DNA, 645 bp, Myxococcus xanthus
gctctaaagtttcagctcctgaagaagacggtggaggctcgctccaccaagtacgaccagacggtcgacgtctccatcaacctgggcgtggacccgaagcacgcggaccagatggtccgtggtgccgtggtgctcccgcacggcaccggcgccaccgtgcgcgtggccgtgttcgccaagggtgagaaggccaccgacgcgaccaacgccggcgcggacgtggtcggcgccgaggacctccagaagcgcatcgaggagggcttcctcgatttcgacaccgtcatcgccaccccggacatgatgggtgtcgtcggtcgcctcggtaaggtgctcggtccccgcggcctgatgccgaacccgaaggtcggcacggtgaccatggatgtcgcgaaggccattcgcgacgccaagggcggtaaggtcgacttccgcgccgagaaggccggtatcgtccacgcgaagctgggcaagtcctccttcgaggtcgagaagctcgaggccaacttcaacgcgctggtggacctggtgatgaagctgaagccggccgccgcgaagggcgtgtacctccagggtatcgccatctcgtcctccatggggccgggcatcaagctcgacaccatggagatcaagacgcgccacggctaa

SEQ ID NO: 5943 - DNA, 399 bp, Myxococcus xanthus
atgatgacgcacgtgcttcgcaatccccgcttcgtctaccgcttcgacgccgccgcctcactcctcatgggcgtggccttgttgctccttgcccccaccctcacccagctcgcgggctggcgcctgccgtccaccttcctgttcggcgtgggcctcttcctgctgccgtggtcggccttcaacctctgggtcgggctcaagcagcccgtcctgggagcagccctggtgcatctcctggtggacgccgcatgggtggtgggcagcgtgctgctcgtcgtcatgcacgcccaggagctcacgcccctggggaccgcgctgctcgctgggcaggccttcgccgtggcgggcgtgctggcgctcaaggccgtgggtctcacgtcgcttcgcacggcggcgtga

SEQ ID NO: 5944 - DNA, 120 bp, Myxococcus xanthus
atgatcaaggagctccacgagaagttctcgaggacgacctccgccgtcgtcgccgaattcaccaaggtggacgtggagacggtgaccaagctccgcaagaagttccgcgaggggcacgtc

SEQ ID NO: 5945 - DNA, 192 bp, Myxococcus xanthus
tctcctctctggggtatcggcctgacggcgggcgtcagcggcggcgaggcctacctgcacgacggccgcgcccgcaacctggccgaggccatcctctggcacggcggcgagggccaggcggcgcgcaacaacttcgccaacatgaacagcacggaccgcaacgcgctgctgacgttcctgcgctcgctgtaa

SEQ ID NO: 5946 - DNA, 1344 bp, Myxococcus xanthus
ggtgagggcatcatcggcggtgtgctcaagcgccgcgccccggtgcggatgaactcgccgaacgggctcaagggcgtgacgcactacgagggcagcggccccgcggtgcaggcgctgctcgcggtgcccatcctggaggccagcggactggtgcgcggcgtgctggtggcggaccggctggcgaacgagcccttcagcgaccaggacgaaaagctgctgtccaccattgccggcgaggtgctgcgctccatcgaggtggagcgggtgatgagctacatccgcaagacgcgcgacgagaaggaccggttcttccgcgccatcgaggagctcaaccgcgcgggcagcccggaccaggtgttcgtggcggtgctggagagcacccggcagctcgcgggcctggacttctgtgcggtgacgctggtgtccgaggtcgacggcaagcgcatgcaccgcgtggtgcgcatgtccggcgtgacggcgcagggccaggcgctgtccggccagagtttcgaggacaacaacgggctggtggccaacgtggtccgctacggggcgccgctgccgggccgcgacatcaaggcgatggaccggcagatcatcttcgacgacgagacgcagattcgcggcctgggtgcgctgaagatcttcccgctggtggcgggggaccgcatcctgggcacgctggtggccggctcgcgcaagaaggccgcgttcgagcaggacgtgctgcggatgattgaggtcatcgccatccaggccgcgcaggcggtgctgcgcgcgcagctctacgagcagatggagcgcatggccaccacggacggcctcaccggcctgtacaaccaccgcaccttccaggcgaaggcggacgaggtgctggcccagtcccggcgctaccagcgcaagttctcgctcatcctcacggacgtggaccacttcaagagcgtcaacgacacctacggccacccgacgggcgaccaggtgctcaagggcgtggcccgcatcatcaagacgatggcgcgcgatacggacatcgtcgcccgctacggcggcgaggagttcgtcatcatcatgccggagacggacgccaagggcgccttcaccatctccgagcgcatccgcgagcccgtgaagccggaggtgttccagacgaagatggggccgctgaggatcaccatgtcgctgggcatcgccacgttccccgacagtgccatggagaaccatcagctcatcgacctggccgaccagtgcctctaccactcgaagcgcaacggccggaaccagtccgtcaccgtggacatcatgcagggagggcgcaagcagctgaaggcggcgaacgcgtcctga

SEQ ID NO: 5947 - DNA, 1101 bp, Myxococcus xanthus
caatccaccggcgccgcgccccaacgccccgagacaggcgcgacgcccgcggcaggtcagggtgccacgcgccccttggtcgtgtccccagccgccggcccgggagcggcccctcccatcgcgggccccggagcgactcctcccatggcaggccccggtgccacagccgcacgcccgcccgtcgccggtcccggtgccaccgccccacgcccggcaggcacggcccccgcggcaggccccggcgccaccgccccacgtccggtaggcacggccccagccgccggccccggagccaccgccgcacgtcccccggtcgccgggcctagcgcccagccccgtcccccgccgtcactgtccgcacagggcgctcaacgcccagccgcgcccgccgccgcggcgacgcccgcgaatgcaccaggggctgaagagatccccgcgctgcgccagctcacgatggcgatgaagcagcagaaccacttccagcgactcgggctgacggagcagacgaactcaagcgcggtgaagatcgcgtacttccgcctggccaagctctaccacccggacacgctcccgcagggggcgccgccggagctggagaaactgaaggcggaggtcttcgcgtatatcggcgacgcctaccgcaccctctccgacgacagcagccgcgccagctacatcgaggagctcaagagcggcggcagcggagacggggtggacgtcaacggcatcctcatggcggaggagctgttccagaagtcctgcatcctggtgaaggcgcgcaagttcccggacgccgtgaagatgctggacgaggccatcaagctgaacccggaggaagcggagttctacgcgtggcgtggctacgcgcgcttcttcacagcggcggacaagaaggccgcccagcccgaagccttccgggaaatccagaacgccatcagacgcaacgagcgctgcgcccccgcgcactacttcctgggcgtcatcgccaagctgagtggtgacggccacggcgcgctcaagcacttcaagcgcaccgtggagcttcaaccggaccacatcgacgcgcagcgagaagtccgcatcgcgtcgcagaagaagtag

SEQ ID NO: 5948 - DNA, 372 bp, Myxococcus xanthus
ctctaccggaggcggctccagggaccgtttgcccgggggggggaggacgtcgccgcgcggcaagggtgtctccagtgccacaccattgacggtacgccgcacatcggtcccacctggttggggttgtacgggcgcgatgagccgctggcctctggaggcagcgtgcgcgtcgacgtggcgtacctcaccgagtcgatgatggacccactggcgaaggtggtcgcgggctacgcgccggtgatgccgtcgttccacggacgcctgagcgcgggcgaagtgggcgcgctcgtcgagttcatcaagtcgcttcagccggaacttccggagccaccatcctcccaggagcccacgtatggccccctcccacgctga

SEQ ID NO: 5949 - DNA, 1368 bp, Myxococcus xanthus
atggccccctcccacgctgagtcccccgtggcggcgcccagctacctggacgcggagcgagggctctggtcctggctcaccacgcgcgaccacaagcgcattggcgtgatgttcctgggcgtgctgctgctgatgttcctgttgggcggcgtgttcgccctggccctgcgcgtggagttgctgacgcccggtgaaacggtgatggggcggctggcctacaaccgcgccttcaccgtgcacggtgtcgtcatggggtggctcttcctcatcccatccatccccacgggcttcggcaacttcctgctgccgctgatgattggcgcccgggacgtggccttcccccggatcaacctggccagcttgtacctctacgtgctccgggcggagatgacgctgtggggcgtgttccacggcggcgtggacacggggtggacgttctacacgccctacagcaccgccaccgggcgggaggtgatgcccgtgcttctgggcgtcttcgtggtggggttctccaccatcatcaccggcatcaacttcatcaccaccgttcacaccctgcgggcccccggtgtgacgtggatgaaggtgcccctcttcgtgtgggcgatctacggcacgtccatcatccaggtgctcgcgacgccggtgctgggcatggtgctggtgctcgtggcgctggagcgggtggcgggcgcggggctgttcgacccgagccggggaggggacccgctgctcttccagcacctgttctggttctacagccacccggccgtctacatcatggtgctgccgggcatgggcgtcatcagcgagacggtgtgcgccttcagccgcaagcgccccttcagctaccgggtgattgtctggagcacggtgggcatttccttcgtggggttcctcacctggggacaccacatgttcgtctccggccagtccaccttcggggcgggcgcgttcagcgtgctgtccatgctggtggccatcttcacggcgatgaagatcttcacctggctgggcaccatgtaccgagggagcctgtgggtctccacgccgttcacctacgtccttggcttcatcttcctgctcttcttcggaggcatgagcggggtcgccgtggccgtcacgtccgcggacctgcactggcatgacacgtacttcgtggtggcgcacttccacttcatcatggtgggcgcgtcgctgatggccttcctcgcggcgctgcattactggttcccgaagatgtgcggccgcatgtacccggagggcatgggcatcgggacggcggtgctcatcatcttcggcttcatcgccaccttcctgcctcagttcctgctgggcaatctgggcatgccccgccgctttagagct

SEQ ID NO: 5950 - DNA, 525 bp, Myxococcus xanthus
atgcctcgtccctatagctttgaccactaccaggttccgaagacgctgccggcgccgaagcgaagcctgcgtcggcaggacaaggcgcggctggcccattccaaggcgcatcccgaggccatggagagccacgagggcgttcactacggcaagcgcttcgcggagacggaagaactctacatcgcgcatcagatggaggcgcagatggaggaactggcgcggcccgagcccgacgccaagttctcccacggcccggaattcaaggcggcacgtggcacgtcgaagggcaaggcgcgcacgacctccgcgcccgtcgtgggaggaacggcgccgattggcgcgctgccgcccacgcgcgagcagccaccgcgcgggcggctgccggagattcgcgaggaggcgcagcaccagttccaggccctgcggggtggcctgggcgacgccgtcaaggccgtgtcccggctcatcctgctgcccgtcacgctcgtccgcatggccgcgggccgcatccttcctctgtcctga

SEQ ID NO: 5951 - DNA, 356 bp, Myxococcus xanthus
gcctgggaggaccagcccgaacacctggcggacatgctcgggctgcacatggcctttggtcccaatgtcgtgcgcaacggccggcgctacggcaacgccatcctgtcgcggatgaccatcgtcaagtcgaggaactacgacttgagcgtgggccgccgcgagcctcgcggcgcgctacgctgcgacttggacatcgggggagggctgcaactccacgtcttctccctccatctgggcctgcgcctgggggagcggcgcatgcaggaggcgctgctgttgtcctcggacatcctccgcgatgccgcgcggaaggacccgttggtggtgtgtggaaaattcaactactgggggccaat

SEQ ID NO: 5952 - DNA, 162 bp, Myxococcus xanthus
atggtccagtgcgcccagaaggccgaggccctgcaggcgcccctgaagcggggcgacgtggagctccggttccaggagggccagtggaaggcctacgacgcggcgaaagcccacctctccaaggggcgcaagagcgaggcgctcgcgcagctcaacgattgc

SEQ ID NO: 5953 - DNA, 456 bp, Myxococcus xanthus
gacgagcacatccgctggtatgtcaacggcatccccaccccactgggcggcacgcaccagtcgggtttgcgcagctcggtggtgaagtcggtgcgcaactacatcgagacgcacggcatcgcgcccaagggcgtgacgctcaccgcggaggacatccgcgagggcatcaccgccatcctgtccacctacgtggtggagccgcagttccagggccagacgaaggggcggctcaacaaccccgaggtgtccggccaggtggacggcgtgctgcgtccggcgctggagaagtggctcaacgacaacaagtccatcgccgagtcagtggtggcccgcatcgtccttgccgctcgcgcgcgcgaggccagccgggccgcgtcgcaggcggtgagccgcaagacggcggtcagccaccggctcaacctgccgggcaagctggcggactgctcgtcccgttag

SEQ ID NO: 5954 - DNA, 894 bp, Myxococcus xanthus
atggacgtcgaggtgaccgccgcgctgagcgtgcgggacggagtcgagttcgcggtccggcacctcgtcgtgctcatggggtttgtcctcgggctcgccgtcgacgtgagcgccgtgaagcacgccatgcggctgcctgcctacgcgcgaggccttcccctcatcctgttgggcgtcccgctgctcgccctgctcgtggtgaacctcctgcccctgcctcccatcgccgccggcatcctgctgttgatggccgtcagccctggcgtgcccagcgtcgcggtcgcggcctaccggcagcgcggcgacttgagcctcacggtggcgctgtccctcaccctgtccctggccgccatcgtgtgcctgccgctctcactccggttgctcagcgagttcttccccgccgtgttcaaggcccccaccaccgtccagctccttgagcgggtcatgctgcccttcctcgtgccgctcgcggcgggctgggcactgcgcgcctggcggccgatgctggccaggcgactgctgcgtcccatgctgtggctcttcaaggccgtgttcgtcgtcgccatcctgctcctgctgttcatcagcggcccgaggctgcgcgacgtggacggatggatggtgctgggcatgttggtgatgaccctgggctccgcgatattgggacacgtggcgggagcgccccggcccgaggacaggaccgcgctcgcgctcgcggcggtcttcggcaatccctccatcgcgctggccgtcgcgacggccagctaccaggacttgcggctgacgcccttcctggccgtctatctggtgctgcgcacgctggcgctgctcccctacctgctctggaacaagcaccacctccggcacggagtgccccaccctggccggacctaa

SEQ ID NO: 5955 - DNA, 1200 bp, Myxococcus xanthus
atgcgcggcgccacgctcatcgaaggcatggcggccgccgccatcctcgccatgggcatcagcggcgtcttcggcgggctcatcttcgccagccagcagaacgccgccgccaaccgcctgtcgcaggccagcgccatcgcctcgcaggtgcgctccggcatccagctccaggggcgcgcccgcctcttcgcggacgtcgggccgctgtccagcgcgcgctgcgccggcgccgcggagacgctcgagctggccggcggcctcgcgaccctgcccgacgcctgcgtcgtggacctggacgccttcgagaccgcggccggagacccgctgctccgcgtggtgcccggctactcgccgggaggagagcgagcactaccgccgcgtcctcgtctggacgccggcgcaggccatcgactcggtcgcggtggtggtgtccttccgcagcgccggccagcgccgctacgtcaagcagttcgtcgcgctctacaacccggcggagaacggcgcgggggtggagctgtgaacgcccccaggacgcacgcgcgccgcggcttcacgctcatcgagttgctggtcggcatcaccgtctcctcggtggtgctgctggcggtggcggggaccatcatcgccgtcaacaacatcttccagagcaacaccgtctccaagacggccgtcgaaggcagccgcgtgggctccgacttcctcaaccgcacgctgcgctacgcgggctacgggctggaccccgccatcgccttcgacttcggcacgatgggcctgccggaggcccgcaaggacaactacacgcaggaagtggaggactggggcaacttcgtcaccgacgacctggccttccgctaccgcgacccgatgttcctgcgccgcggccagctcgacggcaccggggcggagcccttccagttggagctggagcccgccgcgaccttcggccagccgctgcgccaggggcaggccatgctcatcgcctgtccgggcggtcaggactacttcctcgggcggctgacggcggacgttgccgcggatggcaccagcgccacgctgaacaccgcgctcgccgcgggcctccctggcgatgtgcccaagtcctgcatgacggacaccggccgcatgcccttcgtcatgctggtgcatgagaagcggctgcgcgtggaggcgtacggtgggcgcccgtacctggtggtgaag

SEQ ID NO: 5956 - DNA, 390 bp, Myxococcus xanthus
ctgagcttcggcaccttctcgcccccgttggacatccagctttccgcggaccagggccggttgatggacgccatgtacatggaccgctactcgcagcgcaccgtgcgcttcggcgccagcggcaacctggcgtggaccggcatcttcgagggactggcccccacggcctgcagcttctgcagcggcgcgccgcggcggggcgccatcgtcttccgcggtgacggctccgcgcgcttcgtggacggcgcgggccagccagtcatccccgccggcaacggcgccgtgaatcgggccgcgtcgctggcccttctctccaccgacgggcagcgcgaatacctcttcgccgtctccgcgcccgttggcttcgtcgacatgagggtcaaccgatga

SEQ ID NO: 5957 - DNA, 255 bp, Myxococcus xanthus
tgtgcgctctaccgggacggtgaccgcaagtcgaagacgcgcgactacgccatgttgctgctggcgcactcctaccaggaggtcggccagtacgataaggcgctggaagtcgcccgtgacgcggccggcgcctacctcaacagcccgtaccagtcgcagttccggggccgcatcgccacggtgaagcgcctgaagaacccggagagcgcggcgcccccggctccggcccaggcgaccagccagcccggtcagtag

SEQ ID NO: 5958 - DNA, 381 bp, Myxococcus xanthus
atgacgccggagaagctgcctcccgcccccgtggcgctcacgttccgcgagtgcctggatggcgcgcgcgccttgtgggcggatctggagagcgggcgcgagaagctggtgaacgtgtctcccgccaagagcgtcgaccaggaatggatgcgcttccgtaccgcgtggctgcagaagctccgcgtgcgtgagtccgaatgcgcgctcgactcgcgtgagcgggcccccctgcgggaggtgttccgccgcctggtgcgcgtgcaggacctctacgccatccatgcggtgcagtacgcgggagaggtgggcggcgaggtggatgcgctgcatgacgccttgaacaccgcgggccgcaaccctggcgccggccggctgccctga

SEQ ID NO: 5959 - DNA, 549 bp, Myxococcus xanthus
tcaggctcccaccccgggcccctccggctgcagtcggtgcaggtgcctcgccccggcgcggtgctgccgcacgtcgtgtgtccggaccgccgcttcatccgggggctgattctccagacggacaacgcctcaccggcgctgggcgtcagggtgctggcggatccggtggcacaggtgcccggctggccgcgtccaccggcgggcagtgagtccctgggcaccaccgacgacacgggcgccttccgcctggggttggatccgggcatctaccgtgtggacttcatccccacggagaacctaccccgcgtcagccgcgtcatcaccgtgctccccggcgacgacgcgtccgagcaggtgctggccaccttccccctccagcgcggccgcacggtgcggggcatggtgaccgaggccggagcgccctcgccctatgcctccgtgcgcttctaccgggtggcggacctgggagggcgcccgtctccggtgctgctgtcgcagacggtgtcggaccacctgggccgctacaccgccctgctgccggtgcgctga

SEQ ID NO: 5960 - DNA, 318 bp, Myxococcus xanthus
atgggcacggtgaaggaagtgaagcaggccgcgctcgtgctggagacgagcgacaagaagcagcaggaggtgatgacggaccccggcacccgctacgagaagagcggcgtggcggtcaccgcatccgacctcaagcccggcgagcgcgccgtcgtgcacgggatgaagatgaacaacggccaggtgcatgcgcagttggtgaagttcggcaagccgcccgccaagggcacagggaaggaccagggcggcacaggggaaaccgagccggctcccactccaccaacgcaggggaagcgtcacgagcactcgggacactga

SEQ ID NO: 5961 - DNA, 591 bp, Myxococcus xanthus
ggtaccacgacgcatgtggagcggcttgccgcggccctgcgcgcggaggggcactcggtgctgaccacgcgggagccgtctgacggccccgtggggacgatgattcgccaggcgctcacgggccggttgggactgcccggtggggcgggcccgctggcgccggagacgctggcgttgctgttcgccgcggaccggacggaccacctcacggcccgggtgctcccggcgctggcggcgggccagattgtcctgtgtgaccgctacgtcctgtcgtccctcgcctaccagggggcgtcgctgcccatggaatgggtggaggcggtgaatgcgtgcgcggtgtcgccggacctgacgctgttcgtcggcgtggcgccagaggtggcggcacggcgccgcaaggcacgcggcggggcggcggagctgttcgaggcggacgaggcacagcggcggattgcgaagcagtacgtggccgccatccgccgccgggagaagcacgagcgcatcgtccacatcgacggcgaacagggcatcgaggccgtgacggccgcgtcgttggtggagattcgcaagctgctggcccgcaagcgctga

SEQ ID NO: 5962 - DNA, 1415 bp, Myxococcus xanthus
atgactgccacgtaccggctgacgggcaaggtggaaggcggggagctggccgagctgtatcaaggcctcgagcttcccggcatccccgtggtggtgaagctcttccaccccaggacgtccgatccggcctacgcccatgacctggcggagacgacgcggctgctccagcccgtgcggcacccgggcatcctccacgtcgtggacctgggcgtcatccgccagcgcctggccgtggtccgcgaggacgtggacggcttcaccctgggcaccgcgctccagcgcctgcactccaaggacgtggtgctgccgcccaccgtggcgctccacatcatcatccagctcctggaggccctgcatcaggcgcacgaggcgggcgtggtgcacggcgccatcaccccgggcaacgtggtgctgtcgcatgacggcctgcccgcggtgtgcgacttcggcgcgctgcgcgccctcatggccgtgccccaactgcgcaagtcgtttggccaccggggccgcggcacgtaccgcgcgccggaagtcacgcggggcgagccgcactccgcgcagtcggacatctactcgctcggcgccatcgcctacgagctgctcacccagcgtgagcccgtggtgcccggcagcggcggggtgtccacgcggcgcagtgaggcgttgccgccgcccagccgcgtggaccggcgcatcaattcacggctggacccgctcatcctccgcgcactggagcccacgccccagcgccgcttccgctcctgtggcgagttcgccacgtcgcttcgcaatcagctcgcggccagcggcggcatgccctcggcggacgacgttcgccgcttcgtgcgggagctgttccccaacgagatgagcctcgtcagctcggggcctccgccgttcaaggagcccttcacgctggagcccatctccggcgcggagatggacgacctgcgcgcggaggagctcgagaagtccgtggttcagcgagccccatacagccgcgcgctgaccgaggacgaggccaacgcggagacgcagcaggcctccgagcccgcgttcgaggagtaccgcccggagctgtacgagcgggacgtggcggacgcggccacgcgggtgcgggcaccctcgcgcgcgtccgcctccgactccacctccgcgccgggggaggacaccgggcccgctcccgccggaccgctggagcaggggtgggaagcgccgccgggcgccgctccgccgaagcctcgccgccagccgtcgtcggtggggggagggagcggccacacccgcatcgggcgaaatccgcgcctcaaggtcgtggaggacttctccgcgcccgagccggccgcggatgacgagggctcgatctccgtcttcgcgccaggtcgccgcggcgctcggatccgccgcgcccccat

SEQ ID NO: 5963 - DNA, 363 bp, Myxococcus xanthus
  unsure (1)..(363): unsure at all n locations
atggacagccgcgtcgcgcagctcgtcacggcgctcctcgcggagccttcggcggcggagcctggatggacccgcgagcggctcgagccggtggtgcgcagggtggtggaccggggcatcttctcgctcgacgacgtgcgcgtgtacgtgcagctcgccgagtcgctgggggatgacttcgagtcacagcgtcgccacgcgtggatgcgctcgtggctggatgacgcctccgtttcggaccctgtcgcgcgtctgcaccgcgtggtgcgcgagcgccgccgccgcgaggacgtggcggcgcaaaaccagcggaaggaagcgggcttncgncttcgacacgccccgcccggngagggccgctga

SEQ ID NO: 5964 - DNA, 516 bp, Myxococcus xanthus
atgacgcccgtggaccggacctgcaagtccccctccgcacgcagagacgcgcggagcggctacacgctgcacggacagcgcttcgacgacccctacgcgtggatggagcagctcgatgcgccggagacgcaggcgtggatttccgagcaggaggccctcacgcaatcggtgctccacgccctccctggacgcgaggcactgcgcgaagcggtcacccgctccgcgcggcacgcacgcaggtccccgcccattgccgccggtccgggggggcgtgagttcctctggcaggcagaggcgcgcgacgacaagctcaagctcctgctccggcgccacgaaggggcgccgttggagacgttgctcgaccccaacacgtgggcgagcaacgaggtgctcgtcttcgcggtcccctccccggatggcgcattcgtcgcgttcggcaaggccgtgggaagcgcccacggcgcattgattcacgtcctcgaggtctcgacggggaggctgctgccggaccgcccc

SEQ ID NO: 5965 - DNA, 1056 bp, Myxococcus xanthus
atgcgagccaatgtctttcaggctgtgaaccgcttcggcatcgaagaggtggagcgtccacgcgcgggagccggcgaggcggtcatccggatgacgatgaccactgtctgcggcacggacctgcacatcgtccgtggcgagtacccggttcgcccggggctcgtcatcggtcacgagcccgtgggtgtcatcgaggagcttggtcccggcgtgacggactaccgcccggggcagcgtgtcctcgtgggcgcaatcaccccgtgtggacaatgcagggcctgcctgtccagtcacctctcgcagtgcggccacggcgcgggctatgaggccctgggaggctggcgcatgggcaacacccaggatggcgcccaggccgagtacatccgcattcccgccgcgcaggccaacctcgcgcccattccagatgggctcaccgacgagcaggtcatcctcctgtcggacatcgcctccacgggcttcagcggcgcagaggcaggcagcgtgcgcatcggcgatgccgtggtcgtcttcgcgcaggggcccatcggcctgtgcgcctccattggcgcgcggttgatgggcgcctcgctcgtggtcggcgtggacggcgatgaggcgcggatgaagatggcgcagaggatgggcgtggacgtggtgctcgaccaccgtcagcaggacgtcgtagccgaggtgaaacggctcacgggcggcggcgccgacgtggccatcgaggcgctgggcacccagcagactttcgagagcgcgctgcgctgcctgcggcccgcgggcacgctgtccagcctgggtgtgtactcgggcaagctccagttgccctacgacgcgttctccgccggcctgggggactaccgcatcgtcaccaccctgtgcccaggaggcaaggagcgcatgcgccgcctcatggacctggtgcaccacaagcgcgtcgacctgtcgccgctcatcacccatcgcttcaagctcgcggacatccaggaggcctacgccctcttcggcgagcgccgtgacggcgtcttcaaggtggccatccaaccgtga

SEQ ID NO: 5966 - DNA, 453 bp, Myxococcus xanthus
atggagacggggcaggcgtcggcggcgcgcgaggcgatgcctcggtgggagcacctcacccgcggctcgcagcgcgtggtgcggggacaggggcgctcgctggaagaggccttcgagcaggccgcggtggcgttgtgcgcgctggtggtggaccccgcctcggtggaggtgcgcgaggaggtggagctggtgtgcgaggcgacggcgccggagcggctgctggcggactggctgcgcgccatcgtccacaagatggcggcgcgccgcctgtgtttccggtgcttcgcggtgcgcatggacggcacgcgcctcttcggccacgccttcggtgagccgttggaccgggagcgccaccccttcgcgcgagacgtgcggggcgtgtcgctggtggacacgcgtgtgtcccagggcgcggatggcctgtggacggctgagtgcgaagtggagctgtga

SEQ ID NO: 5967 - DNA, 714 bp, Myxococcus xanthus
agacaaggaggcacggacgacatgtggcaggaaggaaatacggacccggacatccgggaggtgcaggtccaggtgggcgacgtggtgctggggggcagcctgggcatcccggacggcgcgcgaggtctggtcatcttcgcccatggcagcggcagcagccgcttcagtccccgcaaccgcgcggtggcgcgtgcgctgcgcgcgcaggggctggccacgctgctgttcgacctgctgagcgaagtggaggaggtgaaggacgcgcgcaccggggagttgcgcttcgacatcccgttcctcgcccggcggttggcggcggtgacggaatgggcgcagcggcagccggcgctggccgtgctgcgcatgggctacttcggctccagcaccggcgccgcggcggcgctcgtcgcggcggccctgcatccggacctcatccacgcggtggtgtcgcgcggcgggcggcccgacctggccggaccggtgttgccccgcgtgcaggcgcccacactgctgctcgtcggtgggcaggacgtgggcgtgctggagctgaacgaggcgtcactcgcgcggatggagggcctgaagggcatccacatcatcccgggggccacgcacctcttcgaggagcccggcgcgctggagcaggtggcccgccaggccgccgcgtggttcctccgcttcctcggcggcgtcggcgcggaggcgcgtgcgtga

SEQ ID NO: 5968 - DNA, 132 bp, Myxococcus xanthus
atgtccatggcggagctggtgcgggagtacccgccgaagcgccagcgggaggaagccttgaaggacgggcgtgagccacagcgccccgcgctcatcggcctggagcaatccgcggcgaagctgcggcgggcg

SEQ ID NO: 5969 - DNA, 864 bp, Myxococcus xanthus
atggacgcggtggtgaatggcgagtcggacctagaggacctggcccggctgcgcacggtgccctggcccgaggcgcccgcgggcacggtgggctccgtcatcgtgtccggggccgctggcaagaaggtgcgcctgttcaagcgcgtgcggggcaacttcatctcgggcggatttcccgacacggtgttcctgtcgaccgctgagatacggcgcggcgtggtgctcgccatcgaggggcgcgacatcgttcgcgaccccgaggaatgggatggcttcgcggacgtggtgctcaccatcggccgaaacaatccgcacgacccggtgttcaccgacaccgtccgcatgcgcgtggcgcccgtggtgctcttccaccacatgacgcccgcctggaacgtcttcgtctccaagcccgccgccagcatcgaagccaaccagttccggcaggcgctgggcggcgtgctcgcggactcaggagagcggatggtctactccgagttcgcggtggatgatttgtgggcgcaggactacttcgagcccgcgtacatgtcgatgcctgcgccggagggccgccagcacgtcatgaaggtcaactaccgcgcgccgcacgtctacaacaccgacgcgaacgcgcccctgcgcgcggccggccgcatcgcgttctggcttcgcggccccgacactgccgccatccagcagtaccagcagggcatgtccatggcctcccagacgctgaactccttcggcaatacggaggtcatcccgccttacgagaaggacggtgtcacgtatcccctgggccggctgttccggggccgggggccggactcgcggccggactatcagcccgaccccagcttcctgtag

SEQ ID NO: 5970 - DNA, 1644 bp, Myxococcus xanthus
atggcagcgaaggaaattttcttccatcagtccgcgcgtgaggccatcctgcgcggcgtccgcaccctgtcggacgcggtcgcggtgaccctcggccccaagggccgtaacgtggtcatcgagaagagcttcggctcccccacgatcaccaaggacggcgtcaccgtcgccaaggagatcgacctcgagaacaagttcgagaacatgggcgcgcagatggtgaaggaggtcgcgtccaagacctccgacaaggccggcgacggcaccaccaccgccacggtgctggcgcgcgccatctatgaggagggcctcaagctggtggccgccggccacagcccgatggacctcaagcgcggcatcgacaaggccgtcgaggtcgtcgtgggcgagctgaagagcctgtccaagcccaccgccgacaagaaggccatcacccaggtggggaccatctccgccaacggggatgagaccatcggcgccatcatcgcggacgcgatggagaaggtcggcaaggagggcgtcatcaccgtcgaggaggcgaagggcctcgagacgacgctcgacgtggtcgagggcatgcagttcgaccgcggctacgtgtccccgtacttcgtgaccaaccgcgagcggatggaggccgtcctggaggacccctacatcctcatcagcgagaagaaggtctcgtcgatgcaggacatgattccgctgctcgagcaggtggcccgctccggcaagccgttgatcatcatcgccgacgacatcgagggcgaggccctggccaccctggtggtcaacaagatccgcggcgtgctgaacgtgtgcgcggtgaaggcccccggctttggtgaccgccgcaaggagatgctgcaggacatcgccgtcctcaccggcggcacggtggtcagcgaggacctgggccacaagttcgagacgctgacgctgaccgacctgggccgcgccaagcgcgtcacggtggacaaggacaacaccaccgtcgtggacggcgtgggcacgaaggcggccatcgagggccgcatcaagctcatccgcacgcagattgactccgtcaccagcgactacgaccgcgagaagctccaggagcgtctggcgaagctggtgggcggcgtggccgtcatcaacgtcggcgcggccaccgagacggagatgaaggagaagaaggcccgcgtcgaggacgcgctgcacgcgacccgcgcggccgtcgaagagggcatcgtccctggcggcggcgtggcctacctccgcgcgctgcccgcgctggagaagctgaagccgggcggtgagcaggacttcggcgtggccatcatccgccgtgcgctccaggagccgctgcggaagatcgccagcaacgccggcgtcgagggcgccgtggtcatcaacaaggtccgcgagggcaccggcgcgttcggctacaacgcccgcacggaggtctacgaggacctggagaaggccggcgtcatcgacccgacgaaggtggagcgcaccgcgctgcagaacgccgcctccgtcgcctcgctgctgctgaccaccgaggccatggtcgccgagcgcccgaagggcaaggccaagggcggcggcgctggtgccggcatgccggactacggcggcgacgacatggactactga

SEQ ID NO: 5971 - DNA, 657 bp, Myxococcus xanthus
atgcgcgtgttgctgacggatgaccaccagttggtgcgggcgggcctgcgtgcactgctggagtcgctgggtggggtgacggtgctcgccgagtgcggcgatgggcatgaggccctgacactcacggacaagctgcagccggatgtgttgctcctggacctctcgctgccggggctcaatggcatcgaggtcgcccggcgcgtgccaaagctgagcccctccacgcgaatcctgatcctctccatgcacacgtcggccgagtacgtggcccaggccttgcgcgcgggtgtggcgggctatctcgtcaaggactcggcggtggaggagctcaaggtggcgctggagtccgtgtggcagggccgcacctacctgagtcccgccatctcgcagaccgtggtggagggcttcctgcgcatcactgacgacgagaggcccgcggcgaatccgctggaccggcttacctcgcggcagcgggaaatcctccagctcatctccgagggaaacggcacgcgcgccatcgccgagcggttgcaggtgagcgtgaagacggtggaggcgcaccggacgcaattgatggagcggctggccatctatgacgtgccctcgctcgtgcgcctggcggtccggtatgggctcgtccccggagagtcgtcgtga

SEQ ID NO: 5972 - DNA, 82 bp, Myxococcus xanthus
atgctgtcgggcctgcgtgacggcacccaggtggtgctgcgcaacggcgaagagtccctgcgcgtcaccaccaatgattcct

SEQ ID NO: 5973 - DNA, 897 bp, Myxococcus xanthus
acccgcctcaagccgggcgacaccttcatcttcgcggggaagaagctggagttcagccgcatccaggacatgaccgcctacgtgcggcccgcgaagacgaaagtcacccagacgccgcgctggggcggcagccgcctgcccttgtccggctcattggccgcggccgttcggcgcacgctggacaccgcgcgccacggcgacgtcacgtcggacgaactggccgcggcctggcccgtgctggacgcgcaggcccgcctgtcccgcatccccgcggcggacatcctactggcggagacgtgccagacgcgcgacgggcaccatctcttcctctatccctttgaaggacggttggtgcacgaaggactggcggcgctgctggcactgcggctgacgcgcctgcgcaaggccaccttcaccctgtcggtgaatgactatggcctggagctgctcacgcccacgcccttccccttcgaggaggcgctgcaccccgcgctcttcacccgcgagcgtctggaggcggacgtcctggagagcgtcaacgtcggcgagctgtcaaagcgccagttccgcgacatcgcccgcatcgccgggctggtgctgccgggcctgcccggcgcgcgcaagtcctcgcggcaggtccaggccagcgcgtcgctgctgcacgacgtcttcatcaaatacgaccccgacaacctcctgctcgtccaggcccgccgggaggtgctggagcaacaattcgaggaggggcgcctggagcggaccttggagcggcttcaagccgcgcccgtggagcgcatccatgtccgccggcccacgcccctgggcttcccgctcgtcgtcgagcgcatcagcgcgagcctgtcgagcgagtccctgctggagcgggtggaacgattg

SEQ ID NO: 5974 - DNA, 645 bp, Myxococcus xanthus
gctctaagggaccgcctggtggaggtggtgcagcgcagcctccaccagtcctctggcacctccaccagcgtgggtgaggtgctggtggtggacgacgactcggccacccgcgagctggtcagccgcaacctgcgccgcgccggcttctccacctccgaggcccgcagcggcgaggacgccctgctcaaggcgcgcgtgtccccgcccgccctggtggtgctggatttgatgatgcccaacctggacggcttcgaggtcctgcgccggctgcgcgcggagaagctccaggtgcccgtggtggtgctcaccggcaagacgctctccgcggaggaagaggccctcttgcgtgacggcttcgccggcttcgtgaagaagggcggccacgcgctggaggacgtcatcgcccaggccaagggcctgctgctgtcccagcgcgccgccagcgccggcaagctggcccgcatcctctatgtggaggacagcgcgcagaaccgcgacatcgtccgccgctacctcaacggccacttcgaagtcatcgaagcggaggacggcgagcacggcttggagcgtgccatccgcgacgccccggacctcatcctgatggacctgtcgcttccccgcctggacggctgggaagtcacccgc

SEQ ID NO: 5975 - DNA, 1407 bp, Myxococcus xanthus
aaccggctgttcctgcgcgcggaggagttcgccagcagccggcccgaggtgacgcgcgtcttctccgtcgtcggcggtttcggcagcggcgcggtcaacaccggcatgatgttcgtcagcttgaagccgcccgacgagcgcatgccgcaggcggagttccagcagatcctccgcaaggagttcaacagctacccgggcctgcgcgcggtggtgcaggaccagtcccagagcggcttcacggcgcagcgcggcttcccggtggagttcagcgtgcgcggctcggaatgggagcagctggtggaggccagccaggagatgcgggagaagctccaggccagcggcaaggtggtggacgtggacacggactaccagttgggcatgccggagctgcgcatcaccccggaccggggccgcgcggcggacctgggcgtgcccatccagtcggtggccacgaccatcaacgcgctggtgggcggcgtgcgcgtgggcaagtacagcaccggcggccggcgcatcgacgtgcgcatgcggctcctggcggaccagcgctccaggccggaggacctctccacgctgaaggtccggacggccagcggcgcgctggtgccgttgtcgtcgctggtgacgcaggaggagcggcccgcgctgcaggccatcacccggcgggaccgtgagcgcgccatcagcgtctacgcgaacgtggcgccgagttcgaaccaggaagaggccctggcgacggtggagcgactggcgaaggagttgccgggcggtgtgcgtgttgtggcgggtggcgccagcgtggccttccgcgactcgatgagcagcctgttcttcgcgctcttcctcgggattggcgtggcgtacatggtgctgggcgcgcagttcaattcgttcctgcacccggtgacggtgctcacgattctgccgctgtcagtggcgggcgcggccttcgccctgttcgctacgggcaccacgctgaacatcttcagcatgatcggcctgttgctgctgatgggcatcgtgaagaagaactccatcatcctggtggactacgcgctgcaagagcgggagcgcggcgcggacgcgatgcaggccatgctgcgcgcgggaccggtgcggctgcggcccatcctcatgacgtccaccgcgaccatgatggcggcggtgccagcggcgctggcgctgggagcgggctcggagacgcgcgcgcccatgtccatcgcagtgctcggtggactgtccgtgtccacggtgctcagcctgctggtggtgcccgccttctacgtggttgcggaccgcatgaagacgcggctgggcgagcggttcggcaagaaggacgatgagacccacgagtcgccgcagcacccggagcatggcgatgcgccgcgcccggcggcacatgggtga

SEQ ID NO: 5976 - DNA, 596 bp, Myxococcus xanthus
atgctgcggggccctctgctgaagcccctgctccagctcgccgtgcccaccacgctggtcctgattgcccagtcgttggtgggcgtggcggagaactggtacgcgagcttcctgggcacggaggcgctggcgggcgtctccctcgtctttcccgtcgtgatgttgatgacgatgatgtccaacggaggcattggcagcggcgtggcctccgcggtggcgcgagccctgggcgcgaaccggcgggaggatgcgaatgccctggtctggcatgccgtggtgctggcgttggccattggccttgtcttcagcgtcctcgcctggatgaccggccccgcgctgtacacggcgctgggtggacgggcgggcgcgttggacgccgcgctccagtattcgaactacgtgttcgcgggctcgattcccttctggctggtgaacctgctcgcggcggcgctgcgcggcgcgggcgaagtgcgcgtcccggcgctggtgaccctggtgggcgccgctgtcttcctcgtcgtgacgccgggggtcatcttcggcttcggcccggtgcccccgatggggctggcgggcgcttggctcgcgatgacgtt

SEQ ID NO: 5977 - DNA, 131 bp, Myxococcus xanthus
atggtggagctcgtcgcgctctccgccgtggcgggggagcacctgctcgtcatcggcccgccgggcaccgcgaagagcgaggcggtgcggcgcaccgcacgtgtcctgggcggctcatacttcgatacctc

SEQ ID NO: 5978 - DNA, 138 bp, Myxococcus xanthus
atgctggacccggtgctggcctcgatgggcgggcccgaggagcgggtggtgctcatcggctccagcctgggaggcctcactgcggcccgagtgccggagcaggacgcccgcgtgtgtgcgctggtgctctttagagca

SEQ ID NO: 5979 - DNA, 162 bp, Myxococcus xanthus
atggccttccgggtgggcgtggacggctggttcagcgaccgttggggcgtgtctgtctccacgggcttccagttctgtgacgtgaagctgacgtccaacgcgctcaaccagtgcgccaagctcatgcagtcggtgattgccgggccggtgttgcgcatctga

SEQ ID NO: 5980 - DNA, 792 bp, Myxococcus xanthus
atggtgacgtgcgacttcaagggcggcatcggcacgtcgtcccgcaagttgccggaggtgctgggcggctacacgctgggtgtgctggtgatgtccaacttcgggaagatgcacaacctgcgggtgggcggcatgcccgtgggtgaggtgctggcggagaagttcaagggcacgcccaagcgcggccagacgtacggctccatcatcgcggtggtggccacggacgcgccgttgctgagccatcaaatcaaccgcctctgcaagcgcgtggcgctgggcattggccgcgtgggcagctacgcggcgcacggctcaggggagattgtcgtcggcttctccacggcgaacatcatcccccggcgcacgcagaagatggtctacaagctgaagctcctcctggatcagcgcctggaccccctctatgaggcggtcatggaggccaccgaggaggccatcctcaacgccatgtgcatggccacgtccatgacgggcgccaacggcaaccactgtccggcgctccccctgggcgaggtccggcgcttcctggacgcctacaagccgattttcgcgtccgtgaagaagcgcccccagcagtcgagcgctccggcggccaaggagcggcccagcaacgaggaccgggagggggacgtgacggtgtccaccgcccggccgacccaggtccggagcgccgagggaatcccgtttcccacccgtccggcaccggacgacaccggcgagccgggggggcccgagggttcctcttccgggagcccgccgggttctgatagttaa

SEQ ID NO: 5981 - DNA, 120 bp, Myxococcus xanthus
atggcccgcagcaagagcaagcaccgtcgcgtgcagatgaagatcaagcaggcctggaagaagcgggccaagaagaacaaggccgaggccaaggccgccgcggagtcgaagaagaagtag

SEQ ID NO: 5982 - DNA, 483 bp, Myxococcus xanthus
acccaagtcaggacttctggacgtttcgcccccttcttcgccgggttgctcctgctcaccaccggaggctgtggcggagaagccccccgctgcacggaatgccccgcggtcgaaggccgctaccggctgcaattcgacacaggcgcgggcgtgcctccggagtgcgcgctcctgggggtggaggttcccacgggtgaagtcctggacatcgcccgctcgggcgaaaacctcaccagccggctggcgggcgtccccgtccggggcaccatcaccacccaggggaccttcctgatgacgggaacgggagtgccctcggcgaaccggacggacaccctgacgctcaccggcagctacctggcgccgctgacggatggcgggacggcgtccatcaacggcgtcctcacgggcagctacgtgcgcgcatccgacacgggggggcagcgctgcaacgtcaacagtccgttctcggcgacccgggactga

SEQ ID NO: 5983 - DNA, 402 bp, Myxococcus xanthus
atgacgggattggctggtgccttgctcgccgtggtggtggcggcggcgagtggatcggcgttggtgccggtgagcgggggcaatgccctgacgctcccggcccagcgccacattgttcgtatcgaaaccggaagcagtcgtccgccgacgtggctggtggccatccagcacgggggcgtggacggcaaggggctggtgctctaccgctccgaggacgcactgcgaacactgcggcgggtgggggacatccagcccaacgccgcgcacacggaccgggcggaactgctggccgtcggcatggatgtggcacttgtctactcctacgaggggccacaactcgcggcatccagtcagcacgacgtctacttccagtggtggcgctatcagcccggggcggatacc

SEQ ID NO: 5984 - DNA, 828 bp, Myxococcus xanthus
tgggtcacgctctgctacaggggcaaggagcgtcatgcctcccaagcggagatgacgtactggcgcgccttcgcggcggagaagctgcgggaggacccggagatgtctccagtggcgctcaagtacgccatcaccgataccctccgcgcgaagatgacaggcacggactccgcgtcgcccgcgaacatcgaacggttcatcgaagacgccatcgggtgggtctcgatgtgttacgagggcaaggagcgtcatgcctccccggcggagatggcgcactggcgtgccttcgccaccgcgaagctcgccgagaacccgaagatgacgccggaggagctcagacacgccatcaccgacgccatccgggcgcaggcgctggggctggacaccctgtctcccgcgaacatcgatggcttcatcatggaggccatcggctgggtgtcgctgtgctacctgggcgcgtcccgtgcccccacggacgaggagatgcagtcctggcgcgccttctcggcggagaagcggcgggagaacccggacatcaccccggaggagctcaagtacgccatccgggatgcggtgcgtaacgagctgacgggcatgagcaagcccgcagagctcaacatcgagcgcttcatccgggaggcctacgaattcatgttccacgcctaccgggggatgccggcgaacatgaagcgcgatccgacaccgcgagaactgcacgagtggcagcagttcgcccgggcccgactccgggaggagccgaagctgtcgagcgaggaactcaactcctacctgctcgacagcctgcgaacggcgctggccaaccagtga

SEQ ID NO: 5985 - DNA, 732 bp, Myxococcus xanthus
atgattggacccctgctcaaggaatggagaacgctgcgcggcaagagccagttggccctgtcgctggaggcgcaggtatcggcgcgccacctgtcatttctggagtcgggccgctccggggccagtcaggaactggtgctgcggctggcggaggccttggggctggggttgagagaccgcaacgccctgctggtggcggcggggttcgcgcctcagttcggcgagcgcggctggcacagcgcggagctggcggaggtccggcgggccgcgggactcatcctcgcgtcgcatgagccgtatcccgccatcgtggtggattcgtcctcgacggtgctcgaggcgaatgcaggcgcgctcgcgatgatggggcagccgcgtgaggcgctcggacaggtcaacctgatggacctcgtcttcgtgcccgggcccgtgcgctcggccattggcaactgggaggagattgccgggtatctgctccaccggctgcgggagggcgctcgcatgcggggcccccgctcacccgtggcatcagtcctagcccatgtcctggcgcagccaggtgtcgaggcgttgaccgcgctgcggcccgccaacgccggctccgtgctggtgcccttgaccttcacccgcgatggcgcgacgacgcactggtacaccacgctcaccagcttcggcgccccccaggatgccctggtggaggaaatcaccatcgagcagttccacccgatgtga

SEQ ID NO: 5986 - DNA, 972 bp, Myxococcus xanthus
atgaagacgcgattgtggttgctcctggtgcccgcgttggtagcggccggctgtggtcccatcgacgaggcagatgagcccgtcatcgatgagctgaccggccaggtgctgctggaggccaccacgaagtacgacatgcaccggctgctggaggacaccgacatcaccggtggccagtggattaccaccgcgcaggtgcaggccttcctccagcagaacaactcgttcctggcgaactaccgggacccggccttcagcaacaagacggccgccgcgctcatcgtcgagcgctccaaggcctttggcatcagcccgctgtacatgctggcccgcatccaggtggagtccagcctcatccagagcggcaactccaacaacctggccaaggccaccggctgtggctgtccggacaccagcggctgtgacgcgcaatacgtgggcttcggcaagcagattgactgctccgccaagaagctgcgcggctacctgacggacctggacgcgggccgtgccaccatctccggctggcgcgtgggcgtgacgaagtccacgtcggacccgtgctcggtgcgtcccgcgaacaaggcgacggcggcgctctacacgtacacgccctgggtgggcgcgtatgccctccagtgcggccgcaccaacgtgggcggctcgtcgctggtgtccgtcgtctaccaccgctacgagtcggcctatgcgtggggctccgcctccggctgctactccgagacggccgacaccaccgtgccggagctcggctgtgtgcagagctcgtcggacgccatgtggcggcagtgccagtcgggcgccttcaccgcgggcagcaccaccaagcccacgaactgcaccgcgtcctacggctggtgctcctccgccacgctgggccgctccgtgccgccgcgcacctgcgtgcagtccacgggcgaccagcagtggcaccagtgcggcgctgtagagctc

SEQ ID NO: 5987 - DNA, 648 bp, Myxococcus xanthus
acgatccctttgtgctctacagtcaacaacctgtatgagagcctctacctcccgctgtccaccgcgcagttccgcgtcatgggcagcgaccgcatccgctccatcgcggtgcaggccgtgagcgacacggccatggacgacgcgatggcggagatcgaccagaagctccggcgtgagcaccggctgcgcccggagcagcccgcggacttcaacatccgcgaccaggcctcgctgctcaacaccatgcaggagacgacgcagacgttctccctgctgctggccggcatcgccgccatctccctgctggtgggaggcattggcatcatgaacatcatgctggtgtcggtgacggagcgcacgcgcgagattggtctgcgcaaggcgctgggcgccaccggcacggacatcatgctccagttcctcgtggagtccctggtgctgtgcctcgccggaggaacgctgggcctgctgctgggcatgggcggcgcggcgatgctccaacgcatggcgggctggacggtggtggtggcacccgaggccatcatcgtggccatcgccttctcggcgaccgtgggcgtgttcttcggcatctggccggcgcggcgcgcggcgagcctcgcgcccatcgagtcgctccgttacgagtag

SEQ ID NO: 5988 - DNA, 236 bp, Myxococcus xanthus
atggcgcagcgggtgctgtccgacgcttcgaacgagggcgaagcgctggtcagcgggggccggattgtcttctgtgccctcatcctgacgcgcttcctggcgctgggtggcgcccacgccgagggcggtgccgcggcggcatggctccagcttcccctgctgctgggcagcatcgcggcgtcagtgatggcgctgtgggcggctcggcggcggatgttcggcgcgaagctgctcgt

SEQ ID NO: 5989 - DNA, 693 bp, Myxococcus xanthus
atgagggcacagaagacaatccggcccccgctgaccagcgcttcgccctcgttcgaagcgtcggacagcacccgctgcgccatctgctccagcgccagcggtcgaggactctcaggcattcatggtaagttgccatgggtggggcgggtccgacatctcctggtcgtcgaggacgccacgcgtcttgcgcgtgcgatcgaggaggcgttgcgctctcgcgtcgagcggtgcacccatgcggcttcgctcgccgcggcgcgtcaggtcctccaatgtgatgcgcccgacgccgtcatcctggatgtcagccttccagatggggacagcatcgagctgctggcgccgctgtgtgagctggagccgctgccgcatgtcatcgccatcagcgggacggcgacggcggagcaggccttccaactcgcgcaggagggcgtgcgtgccttccttcccaagccgctggacctcgcgcggctggagtccgtttggctggagacgctggcgcgtccccccgatctggtcaccgcgctgcgggcgagcgcgggacgggtgcctctgcacggcttcgagagcctcgtccgcgacacgttggtggacgaggccctggcgaaatccgaagggagcgtgcgcggggccgcgaagctgctccgcatctcgcgccagctcctccagcacattctcggcggccggaagtag

SEQ ID NO: 5990 - DNA, 222 bp, Myxococcus xanthus
gagtcccttctcgagctcgccgagggaaccctgcgcatcaaccgcgtcgtgcgccgagtcgaagacaccagttctggcgccgtgctcgaggagcgcaccatcgccgagaaccggcgccgcctgctgaaccccgaggcgcggaagcggacgtgcctgacgtgcggggagaccgcatgccacgcccgcgtcgaagtcccacggtcggaggtccgggcgccatga

SEQ ID NO: 5991 - DNA, 1050 bp, Myxococcus xanthus
atgaacctggttctcgcaccggagcccgccccctggctctcccatctcgcgtcgctgctcacgcgcgaggcggaggtgctggccccctgggcgctgccgaggctgcccgattggggaccactccccacccgcctgcgtcaggcctggacccgccggacgttgccggtgcccgagggcttccgcgtctggggcctgccaggctggggggccgtggaggccgggatgcgagtcgcggcgcgctcgacggcggcgacactccaggcccgcttcaccctgcgcaagcggtgggcgcaggcagcctcggcgctgcttccggcgtcggtggagacggtgctcgcgccagcgctcggtgcccgggaggtcttcgcgatggcccgccgccggggcgcgcgctgcgtgctggtggaggacctgccctccttgagggcactgcacgcggacctggacgccgcggccgcgagacacccggaggaggccttccttcgcaaccaccgcgcctccgcggaggacgtcgcgcggcaggatgcggagcgcgtcctcgcggatgaaatctgggtgcgaggcgagctcgccctcgagcggctgcggctggccggacacgccccggagaagctccgcaggctgcattttccatcggaccgcgaatcgcccccggcgccccgtttgccccagggccacggcccgcacgtggccctcctcgccgggcccgctctcgcgcgcggcggactgcgagaagccttggcggtgctcgacgagcggccccagtggaacctctgggtgcgccccgcagaaggcacggacccacgacacctgaaccacccgcgagtgcggagggtgacggctcaggtccagcgcacgctccagcaggtggacgtggtgctcgcgccagcatggtgtgagagccatctgggcgagctggcgcaggcgccggagcaaggcatccccatcatcgccacggatcgcgccgcgggcttctggccctgtcgggcgattcctcgcggtgatgtgcccgccctcatcgccgaactggacgcgctgaccgcgcgctga

SEQ ID NO: 5992 - DNA, 339 bp, Myxococcus xanthus
atggcctacgtgcgctcgccgtacgtcactggccagcagcggcccattgaacagccgatcgagttcgatcaccgccaccacgcgggtgatgagcagattgactgtcggtactgtcactggtcggtcgaggagtcgccctccgcgggcatcccctccaccacggtgtgcatgtcctgccacgcacaggtctggaacaagagcccgtacctcaccgaggtccgcaaggcgttcttctccgaccagcccatcccctgggtccgcgtgcacaacctgccggacttcgtctacttcaaccactccatccacgtggccaagggcgttggctgcgccacctgccac

SEQ ID NO: 5993 - DNA, 834 bp, Myxococcus xanthus
agcgtggcccgcgcggagggcggcacgctgttcatcgacgaaatcgacaagctgtcgctcaaggcccaggcggggttgctgcacttgctggagtcgcgcagctaccggccgctcggtgagggcaccggtgagcggcaggcggacgtgcgcttcatcatcggcaccaacgcggacctgcacgcggaggtccgcgcgggccgcttccgcgaggacctctactaccgcgtcaacgtgctgccggtgcgcatgccggcccttcaggagcgccaggacgaaatccccctgtgggcgcagtacatggtgaaccgccggcaccgcgagcgctcgccggacggccacgcccggttgatgaaggaggcggagcggctgctggtggggagcccctggccgggcaacctgcggcagctcgacaacatcgtccgccgcgcctacacgctggccatggtggagcacgcggacgcctcgggcgagctggtgctgcacgagaagcatgtcgcgcgggcgctcgactatgagcaggccccgggagcccggccgctgccggaggcgctgcgcgcggccgcgcaggccttcgtcgccgaagcacgccgccgcaatgccccgttggatttggacctggccgatgccttccgcggcatggtgctggggctcgccatccgccaggtggggcgggacgagggcttcaagctgctgggccgcgagagcctggtgaagaaccgcaaccaccacaaggcgctcaagcgcgagttggagaaggtggactcgctctacaaggcactgggcgaggagggctcgcccttctccgacttgctgtcggaggtcgaagccgtctga

SEQ ID NO: 5994 - DNA, 417 bp, Myxococcus xanthus
acgtacttctgcggcgagtcccgggcggacactttcgcctgcgtggagacgcggctgcacgccgagcgcatccgggaggtggccgaggacgcccctcacctgctggtggcgcacgcctacgcacgctgcgtgctggacgtcttcagcgggcatcgccgggcgcggcgaatcacggacgccttcgagttggcggaaggccagggcaccaccttctacggcacggtgcccgaggccgggctggcggccttccgcgtccgcttccactcgcgcatcgacgggctggagctggccgaggacgagacgcgcgaggtggtgcaggaagcgcgcatggccttccggctccacgcgctcgtgtgtgacgagctggcccggggcgccacgggcatcgccgcgggcccccacgccgacgcccggtag

SEQ ID NO: 5995 - DNA, 1293 bp, Myxococcus xanthus
atggacgcgaatcatttgctggagctggtcaagcgctatcaggacaacaaggcattcatctccaacgaggagaccgcgaagatcgcgctggtcgtcccgttcatccggagcctcggctacgacccgagcgttcctcgggaggtccgcctggaatacgcggcggacttcgtccagggggacggcaagaagctgccggaccggatggacttcgccatcttcgaccagacgggcaccaagccgctcatcgtcatcgaaaccaagcccttgggcacggacctcaagtcccgcgcgcagcaactggcgcgctacctggcgcagttgccggagctccacttcggcatcatcaccgacgggtgccactacctcttcttcggggacttggagaaccccaacgtcatggacccggagcccttcttcacgttctccctggaggacacgaagtcggactgggtgaaggtggccaagttcctgtccaagttcagccgtgaagccttcaacgcgacgacgctgattacggacgcggagaacagccgctaccggcaggggatgatcgacaagctcgcgtccgccctgaaagcgcccggtgagcacgaagccttcctcaagtggctcacggaggacatctacaagggaaagcggaccaccgcggtgatggagcggctcgcggacgtcgcgaaggaagccatcgagccgacgctgctgcgggtcatgggcgacgacttcttgaacaagctcaaggagcgcatccagcggctcaacgagggcgcggagcccgcggtggcgcaggagggcgccaacgtggtgaagccggattcggccaggcccttcgaggccgatggccgtgccgcgcccgatgagaagggccgcgccgccgttgagaccaccgagacggaactggagttcttcggcgtggtgcgggacatctgcgtcaagaacggtgccgccgccgaggacatcctctaccgggacacggcgtcctacttcaacgtgtccttcaagcggcccacgaagtggttcgcccggttcttcagcaatggcaagcgcaagagcatcgtcacctgggtgccggtggacgaggcccgtgccattgccgcgggcttcgaggtggaggcggcgcccgcgggtttgggcaccagccgcgtcttcatcgaatcggtgccccaggtctgggcgctgaaggcgctggtgacccggagcctggaattgtccaagacggtgcgtgacgagtcgccgtctccagacgccgccacacacgaggacgggaagcccgccctcaaggtcatcacgggctga

SEQ ID NO: 5996 - DNA, 399 bp, Myxococcus xanthus
ctcatccagtaccccgggacgaacatcgcgccggtgtactcgacgcccggcgtgccggtcgtgttccggccccaggccatgcaggacatcgaggactggctcgtgacgcatggcgagcgggtgatgttcatctatggcgacctggacccgtggaccgcggcggcgttcccgctcggcaacgcccaggactccttcgtgttcacggctccgggcggcaaccacggaagcaccttcaactggcttcccaccacccttcgggaccaggcccaggacatcgtgcggcgctgggcaggcgtcccgtcactgaagcacgccccggtgccgctcccggaggccgacaccgtcgagttcggcccacacctgccgccccggcggctgcaaccgcccccggccccgtaa

SEQ ID NO: 5997 - DNA, 759 bp, Myxococcus xanthus
atgctgctccacaagcacctcacccccgagctgaaatcccggctcgaacggctcacgacacgcaacggctggacgctccggaagaccatccagagtggcctggaccacggagactcccagatgggtgtctacgcgggtgacagcgagtcctacgcgctcttctccccgctgctgcatcccatcatccgggaccattcgggccatgacctgagcggacacacgagtgacttctcactcgacgggctgccccagggcgacctggaccccacgggcgagttcatcctctccacgcgggtccgcgtgggacggaacctggcccggtatgcctttcctccggccattggcgccagggacagggccgcgctggaagccgaggtcgtccaggtcctctccggcctgaggggccacctcacgggcaaataccatcccctggccagcctctccgaggcggagcggctggagctggtgcaccaccacgtcctgttgcagcagtcggaccgcttcctggacagcgcgggcgtcaaccgcgactggcctcgcaaccgcggcatgttccactccgcggacatgcgcttcatcgtctgggtcggggaggaagacgccctgcgcatcatcagcatgcagcccggctcggggctggcgcagacctacctccggctgcagacggggctcgagcagttcgacgggcaggtcgacttcgcccaggactcacgggtgggcttcctcacggggtgccccaccaacctggggacccgcatg

SEQ ID NO: 5998 - DNA, 544 bp, Myxococcus xanthus
atgagcctgggctccctcgcgttggtgctccacgcgcaccttcccttcgttcggcaccccgagcatgaggatttcctcgaggaggactggctctacgaggccatctccgagacgtacctcccgctgctccaggtcttcgacggactggcggaggacggcgtcccgttccgcctcgcgatgacgctgtctccaacgctcgtctccatgctgcgcgacgagctgctgatgagccgctacgcacggcggctggacctgctctgcgaactgggcgcgcgagaggtgcatcggacgcgagacgacgccaccttcggccccattgcccgcttctaccgggaccacttcgagtccctgcgccgcgcgttccatgaccgctacaagcgcgacctcgtcgccgcgttccggcggctccaggacgagggctacttggacatcctcacctgcaacgcgacacacggtttcgtgccgttgatgcagcaggtgcccaaaaccgtcaacgcgcaggtgacggtggccgcgaaccactaccgccagcacttcggcaggg

SEQ ID NO: 5999 - DNA, 1293 bp, Myxococcus xanthus
agcgtggccgacgtgctcgcgaccaacggagacacgcacctgggcggtgacaacatcgacctgcggatcatggactggctgatcaccgagttcaagaaggacaccgggctcgacgtcagcaaggacaagatggtcctccagcgcctgaaggaggcggcggagaaggcgaagatcgagctgtccgccgcgatggagacggacatcaacctgccgttcctcaccgcggacgcgacgggtccgaagcacctcaacgtcaagctcacgcgcgccaagttcgaggcgatgattgacgacctcatcgagcgctcgctggagccctgccgcaagtgtctcaaggacgcgggcgtggagccgaaggacctcaacgagatcgtcctcgtcggcggcaccacgcgcatcccgaaggtgcaggaggccgtgaagcgcctgttcggcaaggagccgaaccgctcggtgaacccggacgaagtcgttgcggtgggcgccgcggtgcaggccggcgtgctctccggcgaggtgaaggacatcctcctgctggacgtgacgccgctgagcctgggtgtggagacgctgggcggggtgatgacgaagctcatcgagcgcaacaccaccatccccacgcgcaagtcggagaccttctccacggccgcggacggccagacgcaggtggagatccacgtgctccagggcgagcgtgagatggcgggcgacaaccgcagcctcggccgcttccacctgacgggcatgccgccggcgccgcgtggcgtgccgcagatcgaggtgacgttcgacatcgacgcgaacggcatcctcaacgtcagcgccaaggacaaggccacgggcaaggagcagaaggtcaccatcacccactcgtccggtctggcgaaggacgaggtggagaagatggtcgccgacgcccgctccaacgaggcggccgacaagggccgccgcgagctggtggagatgaagaaccaggcggagagccagtcctacgcggccgagaagctgctgaaggagaacaaggacaagctgtccgcggacacggcgaaggcgctcgaggacgccgtggcggagctcaacaaggtccgcgacggccaggacaaggacgccatcaagacggcgctcgatgcgctccaggccgccagctacaaggccgccgaggagatgtaccgcgccacgggcggcgcgccgggtgccgagggcgctccgggtgctggtccttccgcggcgccgggctcgcaggccagcgccaagaaggacgacgtggtggacgccgagttccgccagtcttag

SEQ ID NO: 6000 - DNA, 1123 bp, Myxococcus xanthus; identical to SEQ ID NO: 223

SEQ ID NO: 6001 - DNA, 813 bp, Myxococcus xanthus
aatacgctgctgggcctcctcaatgagcgcaccttccggcgcggccacacccggatgcgctgccccctgcgcgtctgtgtgggcgcctccaatgccttgccggaagacgagtcgctggccgccttcgcggaccgcttcctcgcacgcatcttcgtcgagcccgtgccagacccgcggctggaggaattgctcgcgggcggcgcttcactgtggggggacgcggacgcgcaagtcacctcgctggagtccctggacgtggtcgcccaggtcgcgcgtgaggcggacctctccggggtgcgccctcatctggcgcatgcgctgcgcacgttgcgcaccgcgggcgtggccttgtccgaccgccgcgcggtgaaggtccagaagctcatcgccgccgccgcggcgctcgcgggccggcgcacgccagggaccgcggacctgtggccgctcgtgtatgccgtgccgacgaaggaggcccaggcgctcgctcgggacgtgctgcgggacgtgctcgccgggacggagaacccggccctgccggcggcggcgctggaggccagcgcgggccccctggcgcgtgcgcggcgcatcgcttccgcggggcaggcgctgctggcggagcggcccgtggatggcaatggcgaggcgctcgccgcgtggcggctcaagttggagggcgtggcgcgagagatggacgcgggcttcgctcccgagtcgcttcccgatgacttgaaggtgcttcgcgcggaggtggcgggtgtgctcgcctccggcgcttcagggctcgagtcgtccgaaacggaggtggcggtgtga

SEQ ID NO: 6002 - DNA, 276 bp, Myxococcus xanthus
ctctacgtgtcgcgcttcgcggccctggtgccccgcgcctgcgccgtgcgcgtggatgcactcgatgagcacggccagcccgtgacggtccaggcccggggctggtacgcgcgcattctccaacacgagctggaccacctggacggcacgctctacgtggaccggatggagacacggagcttcaccaccgcggagaaccatcgccggtaccaggcggggcgcagcaccgaggagctgcgcgccgagctggggctgccagtgcccgacaaggggtag

SEQ ID NO: 6003 - DNA, 493 bp, Myxococcus xanthus
gtccaggcaggtccctacaccgtccgaggcgtgtccgtgggcggcgtgtacacgtcgctccaggtccccgaactggacgtagtgctcgacgtggggctacccattcgctccttctgtggctcggaccgcatcttcttgagccacgcgcacccggaccatgccagcgggctcggctcgctgctcggcatccgtcggctcatcggcaagggggcaccccaggtcttcctgcccgcggagatcgaggagaacgtccaggcgtcgctcgccgtgatgtcgcggctgcaccacacctccatggaggtgcacaccgtgccgatgttgccaggggacgtgcggcccctggggcaaggtctgttcgttcgcgcattccggacgcatcacccggtgccgtcgctcggctaccagttctttcgccgtgtcgcgaagctccggctcgagcaccagtcactcccgcctcaggaaatcgccaggcggcggcaagcaggcgaagcgc

SEQ ID NO: 6004 - DNA, 576 bp, Myxococcus xanthus
atggacgagacacgcgacgaaaggcccctgctgggccaggatgtgcgcatcgttgcgcctcccttgcagtcagggccccacatggaaacctcatctctccaagaagtcgtcgcgccagaaggcatctgctacggctgcggcaccaagaaccctcacggcctgcacatccaaagctactgggatgaggacggcatccacgtggtggcacgccacacgcccgatgcccggtacagcggctggccggagctcgtctacggcggtctgattgccatgctggtcgactgtcactcgaactggacggccatggcgtaccactaccgcgccgagggccgctcacctggcagctcgccggccatcgaatgcgtcaccggaagcctgggcgtgaagttcatcaaacccacgcccatgggcgtcccgctcaccctccgtgcacgcgtcgagggcgaagtcggacgcaagagccgagtcctctgcgaagtcttcgcgggcgagacgctgaccgcggtgggtgattccatcttcgtccgcgtcgacacggcccagttgaaggccgcggcgcacggccgcgaaggctga

SEQ ID NO: 6005 - DNA, 192 bp, Myxococcus xanthus
atgctcgccatcgcgggcgccgtgttgctgtggtccgggctgaaggcccgggactcgctcgcggagcgggccacggagttgatcaccggccggaacaccgaccgcaccacgctgtatctggcgggaggcggcgcggcgttggtgggcggaatcctgatggtgctcgcaggcggaggcagacggcgccgctga

SEQ ID NO: 6006 - DNA, 2271 bp, Myxococcus xanthus
ctgctctggttcagcgagctgtcccgcgaggacgtcgcgctggcggggggcaagggcgcgaacctgggcgagatgacgcgggcggggctgcctgttccgccgggcttcgtcatcaccgccaccgccttccaggaggccatggcgccggtgcgtgcccggcttcaagcgctctgggcgcaggtggacccggatgacccttcgtcactgacccaggtcacgcagcagctccgtgagcacgtgcggagcgcgcccgtcccggagcggctgcgcgccgccatcctggaggcgtatcagcagttgggcgcggaccgggccgtggcggtgcgttcctcggcgacctcggaggactcggcggccacgtccttcgcgggcatgcacgagtccttcacccacgtgttgggcgaggacgctttgatggacgcgctccgggcgtgttgggcttcggcctacggtgagcgtgtggtggcctaccgcaaagcggaagggctcaccgaggaacccgccatcgccgtggtggttcaggccatggtggatgcggctcgcgcgggcgtcatgttcaccgcggacccgtcttcgggagacaccggccgcatcgtcatcgaggcggcctgggggctgggagaagtcgtggtgggcgggcaggtggagccggatacgtacagtgtctccaagaaggagccttgcgtgcgcgaggtccgggtgggcgacaagagtgtccgcctggtgcgcaatgccgaaggacacacgcagcgcgagacactgagtccggaacaggcccacgagcgcgtgctgagcgacgtggcggtgctggagttggcgcggttgggattgcgggtggagcagcactacggtgcgccgcaggacatcgagtgggcggaggagcgcggacgtttgttcctggtgcagacgcgcccgattaccacgttgggaaagtccgccgtgccaccgccagaggaaggccacgcgggcaaggcgctggtgcagggactgggtgcgtcgcccggtgtggcggccggccgcgtgcgggtgctggcgtcaccggccgagggacggcaactccagccgggcgaggtgctggtggctgagatgacgtcgccggactgggtccccaccatgcggcgggccgccgccattgtcacggaccggggcggcatgacgtgccacgccgccatcgtcagccgggagctgcgaaaaccctgcgtggtgggcacacgcaccgccacacgcacgctgcgagacagcgaggcggtgacggtggatggctcgatgggagaagtccgggagggacaggaggcgccacgtccacgggcggtggaggtgcctgccaccgcatccacggtgggaacggccccggtgctggccacgcgcctctacgtcaacctggccctgcccgcgcaggctcgcgaggccgcggcgcttccggtggagggtgtgggtctgctgcgcgccgagttcatgctcacggaggccctggggggtgtgcatccacgcaagctgattgcggagggtcggaggggtgagttcgtggagcgcatggcgggggccctgctccagacgacgcgagccttccatccgcgccccgtggtctaccggacgacggacttccggacgaacgagtttcgcggactggaaggcggcgctgagttcgagcccgaggagtccaacccgatgattggcttccggggcgcctaccggtacttgcgcgagcccgacgtgttcaacctggagctggaggtgctcgcgcgggtccgggagcagacgcccaatctccaggtgatgctgcccttcgtgcgcacgctctgggagctggaggcgtgtctggagctcatcgcccgcagtccgctggggcggcagcggggtttgaagacgtgggtgatggcggaggtgccttccatcgtctatcgcctccacgattatgcgaagtgtgggattgatggcgtgtccatcggctcgaatgatttgacgcagctcatgctgggcgtggaccgggactccgagtcgtgcgccgagctgttcgacgaagcggacgccgcggtgctggccgccattggcgacatcattcgtgggtgcgaggaagcgggcctgacgtcctcgctgtgtggacaggcgccgtcgaaccggccggacttcgcggagcacctggtgcgcgcggggattacgtccatctccgtggacccggcggcggtgctcgcgacgcagcgggtgattgcggcggcggagcagcggctgctgctggccgcctcgaagcgggcgacgctccagggctgttag

SEQ ID NO: 6007 - DNA, 519 bp, Myxococcus xanthus
atggcatatctcaacccgactcccgcgaacaaggcggagatctacggccctttggctagcatgtacatgacgggcggcaccactgaggactctcataagtacttcagtgaggccctcaagctgcagccgaaggacgaggcgtcgctcgggtggatcgcggagatctactctcagcgcgacggcgcccgctccatgggcgcgcccatcatcaaggagtccctggagaagtcgctcagctattacgaccaggtcatcgccatcaaccccaactccgccaacacctacctcaacaagcgcgtggtgatgggccggctgatggagttcgagcggcagcagaaggagatggcgctgtccgaggcggccgagaacgcgaagaacaaggaagtcgtcgccgaagcgacggctcgcgccgacgagcaccagaagcgcatggacgagtaccaggtgcagttcgcggagatgacgaagaagttcggtgaggcacagaaggccgcgaaggcggcggcgcccgcgcagtaa

SEQ ID NO: 6008 - DNA, 711 bp, Myxococcus xanthus
atgagcatcctcgacccgcagacgggcaagcaacctccacaggtggcgctctcagacaagcctcgccacctctgcatcccacagggcgacaccgaccccatctgggtcgatgtttcggatgggcagaacctcctgctcaacacgaaaacggctgccgatctgcccgccatcgagccgcccccctcctgcgcgccgttcaaatggggcccccggatgtgtcccccccagttggtgaggaggagtcccatcccctgtgaacgcccgcgcgacctgccggacgttcccgggttttcggctcagcatgtctacaagctgaatgacctgaacgtcgtcctgggtgagcggagtcctgggagccgcgtgcccatggcggcggtgttccagcagggccagaaggtcccgttgtggcatggcaacgtcgccgacatggaccccaagatggtgaaggagcgcgtggtggaggtcctcgccttctccgaggacgcactcgtcatggtctacgagttgaaggaggggggagcgcagctcattcgcagagacatgcggacggggagcgtcagttgggacgtccctattcccaactccaagagcggctcgggggcgtccgacatcaagctgcacggtgggcgcgtctacgttccgcattgggtgtggctggatgtcttcgacgcgaagacgggcaacctgattggcaccctgggcaagtggtga

SEQ ID NO: 6009 - DNA, 358 bp, Myxococcus xanthus
atggacacccggcatgtcgtagagcgggccctcgttcgcgaggcgcggcccgaggatgacgcggtggtgggggagttgttggtggatgccttcctcacccagtacgcgaagaagctcccggaagtcgtctatggcgaccagcgcaagcgcgagctgcgggacgtcccgtcccggcgcaaggcggccaccgtgctggtggccgagttggacggtcaggtggtggggcaccgctctctcttcaaggcccgtgcccccggctacgaggtctgggttgccaacgccgatgactttggcgggcctgggccaccgcccgggagtttacccatgggcaccgggggttgggccccagccccctttc

SEQ ID NO: 6010 - DNA, 993 bp, Myxococcus xanthus
cgcgcggcgcaaatgctgcgcgcatcaggccaacccccacgcatgttcgcctgggtgttggctatcgtcattctggccctcgcattgcaattcgtgtcgtgcgtgccggacagtgagcccggcctcccttggaggaggggcacgcgccgatgcggacacacgctcaggaaggacgaccgcgcatggcgcgggggctcgtccccgtcattcagcttctggccctggtggcggcgccagtgcggggagcgcagagcgcctcgcaaggggccacgctcttcacgcagcgctgcgccacctgtcacacggtgggcgcagggcgaccgcgtggggccggacctgcacggcgtcatggagcggcgcgacgaggcatgggtcacccgcttcatcaccagccccggcgccgtcattgacgaaggcgacccggtggccaacgcgctgctgaagcagttcaacggcatccgcatgccggaccagcaactcgctcccgaggagcttggcgccctctacgccttcttccgcgactgcacgaagaagggggagggcggctgcaagccgtcgcccgcggcgaagatgggcacggacgcgacctcggaagaggttgcgcgcggccgccggctcttcgagggcacggaagccctggcgaagggcggtcccgcctgtttcggctgtcatgacgtgcgcgggctgggcgtggcgggtggcggcacgctgggccccaacctcaccttcgccttcgcgcgcatgggcgagcgcggcatgcggcctctcctggcgaagctggacacgccgatgatggccgcgctgtacgcgaaggccccgctggaggaggaggagcaatacgccctcaaggcgtacctcgcggacgtgtcgcgcgacggcagcaagcctcgcacggacagggacttcttctacctgggcctcgtcgggatgctcgcggtgctcgggttcatgggcgttgccttcaacgcgcacaccaagcgaggtcagccgtga

SEQ ID NO: 6011 - DNA, 1623 bp, Myxococcus xanthus
tacaccgtcgagcagttcatggagacgacctccgttctcggtgcgtccttctcctcggatgagaagcgggtgctgtactcgtcgaacgagaccggcgtcttcaatgtcttctccgtcccggtgacgggcggaaagcccacgcaactgacccgctccacccaggacgcctccatcgccgtcgcctacttccccaccgatgaccgcgtcctcttcacgcgagactcgggaggcaacgaactcgtccacctctacgtccgcacgctggacggccaggagaaggacctcacgccgggcgacgagcaccgcgcgtccttcttcggctggagccaggacggcgccgccttctacgtcctcaccaatgagcgcgacgcacgcttccaggacctctaccgctacgacgccaagacgtatgcccgcaccctgctctacgcgggcgatagcgagcatgtgcccggcgccctctccccggacgagaagtggctggcgctggagaagtcacggacgctgtccgacagcgacgtctacctctacgagttcgccacccagcagcgtcggcacctcaccgcgcacgagggctcggtcagttggaaggcggcgaccttcgacccggcgtcctccgcgctgtacctgctcaccaacgagggctccgagttcattcgcgtggagcgccacgtgctcgctacccggaagcgagagttggtggagcaggtggagtgggacgtgctttccacggtgttctcgcgacgcggcgcgtggcgcatcacccgcgtcaacgaggacggccgcaccacgcttcgggtccacgacgtgaaggccggcaggcgcgtgtccctgccagggattccagagggggcgatctccggtgtgagtctgtcccgcggtgagaagcgcatggccttccacgtcgacggagaccgctcgcccggcaacctgtacgtctacgacttcgagacgaagaagctcacccggctgaccgacacgctgggccgggctctggacacccagcacctggtggagtcggagcgggtgcgcttcaagtccttcgacgggctggagattccggcgctgctctacaagccccatcaggccaccgcgaagcagcgcgcccccgccatcgtcttcgtccatgggggaccgggaggacagtcctccaagggctacagcagcttcttccagttcctcgtccaccacggctacgtggtgctcgccgtcaacaaccggggcagcgagggctacggcaagtcgttcttcgcggcggatgaccagcagcacggcaaggcgccgctccaggattgcgtcgaggcgaagaagtacctggccgccctcccctacgtggatggcgcgcgcgtgggcatcctgggccccagctacggcggatacatggtgctcgcggcgctggcgttccatcccgacgtcttcgccgtgggcgtggatgcgttcggcatctcagactggctgagcgcgctgcgagagctgccgccccacaaggaggccctgcgcgaggcactctaccaggaactgggcaacccccagacgcaggaagcgatgcttcgagaaatctccccgctgttccatgcggagaagattcgcaggcccctgctcgtcatccagggcgccacgtag

SEQ ID NO: 6012 - DNA, 807 bp, Myxococcus xanthus
atcatggcgaaggtgaagggcgtgaaggacttgcgggcggagaagctgaccggccttccccagctccgcatcaccgtgaaccgcgccgcagtggcgcgcgtgggcctgacacccggggacgtcatccacgccgtgaaggtggggatggtgggccaggagttcgcccaggtgtggaagggccagcgccgctatgacttgctgctgcggctggcggaccaccgccggggcgacgccaccgccatccggggtctgctggtggacgggcatgacggcacgcgcatcccgttgagccaactggccaccatcgaggagacattcggcgcgggcagcatccgccgcgaggcgggcagccggcgcatcgcggtggaggccagcgtcgcgggccgggatttgggcagcacagcggccgaggtgcgcgagcggctggcgtcggagctgaagctgccgaccggttacttcctggacatgggcggccgggtggagagccagcagcgcgccgcgcaggcgatgacggtcgccatcgcggtggccctgctcgcggtgttcatcctcctctacctggcgctgggctcgctggcggagtcgctggtcatcatcgccacccttccagacgccttcgtcggaggcatcctggcgctgctcatcgccggggagacatggaacgtgtccagcctggtgggcctcatcggcctgtttggcattgccgtccagaatggcctggtgctggtggcgcagacgaagctgctcatgcagcacggaaagcccttcgatgaggccattcgagaggcgagcatcgtccgcgtccgc

SEQ ID NO: 6013 - DNA, 288 bp, Myxococcus xanthus
atgacgtaccgggaagcggtgaacctgggcttcaaccaatgtcgctcgcgtggctatgagtgccgcctgaaggacgcggaccgcaaggggcgggacgtgtggcgggtgaagttccatgcctccacgcggagggcgaagggccacctgcacctggacttcgatgcgtactcgcgcagcctcctgcgggtggatgacaaggtgaaggcccgccgacatgactgggacgacgatgaccggcgcgggcgcgggcgcggcaagaagaaggggcacgcccggcgggatgactga

SEQ ID NO: 6014 - DNA, 834 bp, Myxococcus xanthus
taccgctgccagcgcgccgcggagggcccgccctttggagaccgcttcgcctcgcaaggcagccggggcaacgcgctcgcgcccctgctggcgaagctccaggccgtgaagctgcccaccggactgggggagctgctgcgtcagcggaggcgcgaggcggcgctggtcgccggcgcggtggtgctcctgggcgctggcgccgcgtggctgagccagcgcaacgacgctggcacccgggccttcgcgctgctggaggatgggaagctgaacgaagccctggcgctgatggacgccgccaccgacgaggagaaggaactgccctcgctgaggcgcgcgcgcgtggcggcgaaccatgccaaggggcaccacatcagcgaacggactgcgctcagccacctgaaggaggaggagctcgaggacgtggagccgctcatcctcgacggcctggcggaggactacggcaaggagcctctcaccgtcctggggaatgccctggcccggttcccgaaggaccgcttgcgcgcccactacgaggacctggccgaggaggcgtactccctgcgccagtggggcgcgctgcgctacctggagtttgtgaaggccgcggacggggtgaacctggttcgcgcctatagcgaggcgctgaactccccggactgcgacatccgcacccaggccgccaaccgtctcgcgggcctgggtgacgcggatgccatccccgcgatggagcgcgtcacctcgctccccaaggcgaagggcctcctgggcagcaaggactgcggccacgaagcagcggcgaccgccatcaagtcactcaagcagaagagcgactga

SEQ ID NO: 6015 - DNA, 530 bp, Myxococcus xanthus
atggccctgtggccgtgggccgcgctgcgtggcgccggctttcccgctcaggatgcgctccgtctcgcggctccgacagcggcctccgccgccgatacatggctcgcgtctggggttgagacacccggtgacgcactgcgcaccgtgttcgactcggacctgctgggtatcagcgcggcgctgcgctcgctggcgggggagtcccacctgagcgaggccctcctgtggcagaaccgccatgcctacaagacgggcgtggagccgctggcggcccttcccgccaccgctcggaacagcaaggcccggcagcgtgagcggctggtggcctcctacgtccagcgctacagcaccaagaacgacaccatcggtttctttggtcccgtgggttgggctcggctcacgccgtcgaatgaagggctgcgctggacgcccggacagcggctcgtctcccggcgcgcggtctatttcgagacatggtgcctggatgcgctcagcgccgccctggcgcgcgacgcgttcctgggtcgctg

SEQ ID NO: 6016 - DNA, 150 bp, Myxococcus xanthus
atgttggacgcggtcgacctgtccgccatggcccggggggagctgtccctgcgatatgccattgcgtatcagcagggcactcccgtcgcgctgtgcccgtgtttcatcacccgcagcaagaccatctacacgccctactcgctggagctt

SEQ ID NO: 6017 - DNA, 735 bp, Myxococcus xanthus
ggtgagggtccgcgcacggtcatcctggtccacggttggatggtatcaggcgcggtctgggatgcgctggtggagcgcctggacctgacggggctgcggctggtgattccggacatgcggggctcgggtcagtcgggccggccggacggaggcttcagtctggagtcgctggcgcacgacgtgctggccgtggcggacgccgtggacgcgcggcgcttcacgctggtggggcacagcatgggcggccagctggtgaagtgggtggccgcggaagtgccggcgcgcgtggaggggctggtgctcctcaacacggtgcccgccgcgggtcttccgctgcctccggatgcggcggggctgttccgcacgtcggcggacagccgcgagaagaagcagaccatcctcggactcgcgtgcaagcagttgtcgccggaggccctggaggcgttggtgaaggactcgatgggcgtcagcccggcggccatcgagcacgtcttcgacgcgtggacggcgggtggcttcgccgacaagctggcctcgattacggcgcccacgctggtgttggccacggacgacgccttcctgccggcggccttcctgcgggaggcggtggtgtcgaggattcgcggcgcgcgcctgtcgtaccttcccggccccggtcattacccacaggtggagcgcccggcggagacggcggcgctggtgtccgccttcctcgccggctcccagccggcctga

SEQ ID NO: 6018 - DNA, 354 bp, Myxococcus xanthus
atgagtatcgaggcgacaagtcctcaggacacggagcgctggctgtgcgcggggctgtgcctgattcggcacgaggacctcacggccgacgcgttgacctcggccgtgccgtggctcctcgccacgctcgcggagtcgcctgccctgcccccacccgcgttcatcgcggacctcggccggctcgtcgcgggggttccgctcgcgccctccgcgcccgttcccgatacccagcctcggctgcgcgcggcggtgcgcgcgtatgacgaccacgtgctggcgcgcctggccgcggagccccacctggaggcggtctccaccgccctcgcgcggttgcccgagacgctccggccgtga

SEQ ID NO: 6019 - DNA, 666 bp, Myxococcus xanthus
ccgcgcctgtcgtatttcacgggtcgaggcgtcgctgagaagatccgtctgctgctcgccgagtccggaacggagtacgaggacatcgacctgggcgcctatgacgtgcaggccaaggtgaagacacccgccttcgaggccatcaaggcggctggcatgctggccttcgacaaggtgccgctgtgggaggagccggacggcttccgcgtggtgcagagcctggccatcttgcgtcacgtcgcgcgcacccgcggcctctatgggaaggatgcgcgggagaccaccgcctgcgacatgatcatcgacggcgtcgaggaagtgacggcgcgtgcgcgcagcctgacctcgctcacgccagaccagctctccgagcagctccccatcatcctgggcgaggaactgccgcagtggctcgcgcacttcgagcgcctgctgaagagcaacggcagcggtgatggcttcttcgtcggtccctccgtgacggtggcggacaccagcgtcttcggcttcctggagctgctcgtggacaacggcctccaggatcttctggagagcacctaccctgggctgttcgggttcttcgagcgcatgaagcagcgccccaacctcgcgcggcacctcgccagctccaagcggcaccccgccgtccagctcctcaacggctga

SEQ ID NO: 6020 - DNA, 1689 bp, Myxococcus xanthus
gacggggtccacccgggcgagctcatgtccttggtggcgaacccgcaaatcgcgccgttggaccaggtggagccgttcacgccacccgcggtgacggcgctggtggccaaggcgctggcggtggacccgtcgcagcgcttccagacggcggaggagtttcgcgggcggctccaggcctgcctgatggagattgactcgagcgcgggcccggagagcgtcagccgcttcatgcgcgagctgttctcggcggacttccagtccgagcggcgtctcctggcgagcctcaaggaggtgccgcgcctgtccacggcagaggtccgtgcgctggcctcgatgccggatgatccgctggcgccgaagatggcgcacgcgatgctgccggcgaagaccatccgactggatggcccggtggagccgctgtcgttcttccccacgccccgcagccgcgagggcggtggtccggtgacggacggtgagacgcgcccgggtgtcccgatggacgagtccacccggcccggggtccccatcgaggcgctggaggacgaggctcggacgcggggtgcgcgccaggacacggcgccctcggtggaggtggggccggaggccttcgttcgcggcggcggggtgagtccttcgtctgctccgattcctcgcgcgcccgcgctgacgcgcgaggtccagatgacgtcgatgccgcccgaggcggtgccgccgggtgtggccgccgcgcgtgcgctgcttccgtcgcacatgcggccgaccgagctggcgatgccgagcctgggcgggccgtcttctcccgaggacgcgtccgttcaggtggagtcgacggccgcgaaggccgagtcgcttcggggcaaggcgttcgaggcgagcccgagcgtgattgcctcggtgggcgcgcccacgcccgcggtgccgctgcgtgggtcgcagggcacggtgaactcgcgacctccgccgccaggggccgagccgcgcgcgcccggagcggtgctgccgcgcagcggcgtggtggtgatgcccgcggtcaacgtgcctgctcccgcgccgatgcctcgcacgtcggcgctggagtcgatgccggccgttgaggtctcggagggggctgccggagacgaggacgccgcctcggagcgcgagggcgcgtttgggagtgcgccgccggccgaggcggcattcagcgagctgcatccttccggcccgatgcctcgaacggcttcgatggtgatggccgccgtccagccgcctccgcctggctcgacgccgtctcgcgcgatgtccgcggtgggttcgccggatgaggccgcggctccacgctccaggtcgtcggcgggcatgcccgctgtgggcgcgcaggcgggagtttcgactcgcgccatctcctccgtggaagtcgctgcgttggatgcgcgggacgaggcctcttcggacccggtgtcttccgtggacatgtcctcggagggcgggacgccgccgcgcagggtgtcctcggcggggatggccgcggtgtcgccagcccaggctggcatgacgccctcgcgggacatgtcttcgctggggacacctgcacctccgaagggggcaacgccctcgcgagccatcccccgttgcccctgcatcgggcgcgacggcttcccgctccgcgcccgtggtggacgagcccgtcgcggacgccacccccgctga

SEQ ID NO: 6021 - DNA, 922 bp, Myxococcus xanthus
  unsure (1)..(922): unsure at all n locations
gcgctggaggtggagaaggcggcccgggcggaggactcgcgcatcatcgccttcaacggcgtgggcgccggggactacgtgtccgaggtgtacatggcctccaccgagggcgtgacgggcgcgtactccggcacctacgtgtacctgtacgccgcgccggtggcctccgacggcaacgggctccagacgggttactggatggactaccgccgcttcctggatgacctggacgggccggagtccatcggccgggaggccacgcgccgcgcggtgcggatgctgggcgcgaagcgggtgaagacgcagcaggtgcccgtgttgttcgacccgcaggtggccgcctccttcgtgtcggacgtggcgggcgcggcggacggcaacgccgtgtaccagaaggccagcctcctggcctcgctgctgggcaagcggctggcgggcgcgcacgtcacgttggtggatgacggcctcatgccgcgcggactggccaccgcgcccttcgacggcgagggcgtgcccacgcggcgcacccccatcatcgagcagggcgtgctcaagtccttcctctacgacgcgttcaccgctcgcaaggcgaaggcccgcaccaccggcaacgcgtcacgcagctacaacgggctgccctccatcggaaccagcaacctgtacctggaggcgggcacgaagtcgccggaggagctgctgcgcgaggtggacagcggcttctatgtcaccgccctgctcggccacggcaccgacccggtgacgggcgagctgtccgcgggcgccaacggcctgtggattgagaagggcgagctgacgcaccccgtgcaggaggtgacggtggcaggcagcctgctgcagatgctcaaggacctggacggcgtcggcagcgacctccagttccgcancggcgcggtggggcgcg

SEQ ID NO: 6022 - DNA, 684 bp, Myxococcus xanthus
gtgaagatcctcgtcaccgccaagcgcgtggaagaccccgagtcgaagatcaaggtcaagccggatggctcgggcatcgttcaggaggggctgaagtacaagatcaaccccttcgatgaaatcggcgtcgaagaaggacttcggctcgtcgcgaagcaccagggcgaggtcgtcgtggtgtccatcggtggcaaggaagtgcaggagcagctccggcacgcgctggccatgggtgcgcaccgcgccgtgtgggtgaaccacaccggtccggtggaccagctcggcatcgcggccctgctccagaaggtcgtggagaaggagcagccggacctcgtcatcctcggcaagcagtccatcgacgatgaccagaaccaggtgggccagtacctcgccgagttcctcggctggggccaggccacgttcgcttccaaggtggagtccatggagagcgagcaggagaagaacaaggttcccgccatcgtcgtctccgccgacaagaagagcgtgcaggtgattcgcgaggtcgacaacgggctggccacggtggagtgccagctacccgccgtcgtcaccacggacctgcgcctcaaccagccgcgctacgccagcctcccgggcatcatgaaggcgaagagcaagcccatcgaggagctgacgccgggcaagctgagcgtggatgtcacc

SEQ ID NO: 6023 - DNA, 633 bp, Myxococcus xanthus
ggcaagaagcacaagggcatcacctgcttcgtggtggagggccgccccgaagggctctccgtcagcaagcacgagaacaagatgggccagcgcgccagcgagacagtgtcgctgacgttcgaggacgtgcgcgttccggtggccaaccgcattggcgaagagggtcagggtttcgccatcgccatggccacgctggacaacagccgcccgctgacggccatgttctccgtgggcatcgcccgcgccgcgctggagcactccatggagtactccacgcagcgccgcaccttcggcaagcccatcatcgagcaccaggccatccagttcatgattgccgacatggccatgaacacccacgcggcgcgcatgctcacctacgagagcgcgtggctcttggatgagggcaagcgcaactccctccagtccagctacgccaagtgcttcgccgcggacatggccatgaaggtcgccaccgacgccgtccaggtgtacggcggctacggctacatcaaggagtaccccgtggagaagctgatgcgcgacgccaagctcatccaggtctacgagggcaccagccaggtccagcggctcgtcatcgcgcgggaactgttcaagtagcgccgcggcaccgcg

SEQ ID NO: 6024 - DNA, 315 bp, Myxococcus xanthus
ccggccttcccgtggttgatggtggggtttggccggcccgcggcgcgcaagcaattgcgggtgcaccccacccggttggccgcggcgggcctgctggtggcgctcttcagcggcgtcccttcgatgatggaaggccggcccttcctgtccggaatctgggggcggttgcccgtgccggggacggatggattgaaggtgggcaccccgcagctcttcgacctgggcatctatctggtcgtcctggggacggccatgtgcttcatcctgggcatggcccggggcgaggacaccacggcgccggagatggggggctag

SEQ ID NO: 6025 - DNA, 360 bp, Myxococcus xanthus
atggaactgttcctcgccatcaccgtgggcggcctcttcgcggcggggttctactgcctgatgctccacagcatcgtccgcatcgcgctggggctggtgctgctgggcagcgccaccaacctcctgatcttcaccatcaacgggctgcagcgcggcttcgcgcccctggtgcccgaaggccaggaggccctcaccccgcccttcgcggacccggtgccccaggccttcatcctcaccgccatcgtcatcaacttcggcctgctcgcgctgctgctggtgctggtgcaccgcgccgcgcaggagacggggaccgatgacacgcgggccctgcgcaccgagctgaaggactcccagcgatga

SEQ ID NO: 6026 - DNA, 1049 bp, Myxococcus xanthus
atgacgccctccacgctgctcagcctgcccatgatcctgtgcctgggcgccgcggccgcggggctgctcgccccgtcacgcgcgtggccgcgccggtggctggcgctgatgaccatggtgtccctcgccgtggtgggcgcgatgctgctggtgacggtgcgccgcgaaggcatccagtccatgcaggtgggcgggtgggcggcgccctttggcatcaccctggtcgcggacctgctgagcgccttgctggtgctcgtcaccggggtgatgggcctgacggtggtctcctactccgcggccacgctcccagcgtcgaaggaggcgggcgcctactacccactggtgctggtgctggtgggcggcgtgtgcggcgcgttcctgaccggagacctcttcaacctcttcgtgtggatcgaggtcatgctcggcgccctcttcgtgctgctcgcgctggaggcccgccaggagcagctcgaagcgcccatcaaatacctgccggtgagcctcatgggctcggtggtgctgctgtgcgcggtgggcctgctgtacggggcggcgggcacgctgaacctggcggacctggccgtcacggtgccgggcctgggcacgccgaacctgatgacggccgtgtccatgttcttcctggtggccttcgcgctgaaggcgggcgcctttcccctcttcttctggctgccggcctcgtaccacacgcccccggcggcggtgacgacgctcttctccgcgctcctcaccaaggtcggcgtctacgccctggcgcgcgtgttcaccctggtcttcacgcaggactctcagctcaccagcaccctcctgctggtgatgggcggcctcaccatggtgacgggcgtgctgggcgcggtggcgcagtacgacatgcgccggctgctgtccttccacatcatcagccagattggctacctaatcgccgccctggggctgctcacccggagcgcgctgacggcgctcatcgccttcctcatccactacatcttcgcgaagtcggcgctcttcctggtgagcggggccaccgc

SEQ ID NO: 6027 - DNA, 594 bp, Myxococcus xanthus
atgaagcgcggatggggatgggcgggcgcgctcttcgtggcgggttgggtgtggacgggctgtggctcgggggatggcgcgacgggcaccgagggcatggacgtcccgccctcggaattcccccaagccccggaaggcgatgcaggcacgccggactcgggcacgctggactccgggacaccggacgagcccgacgcgggagaaccggattcgggcacgccggacgacgacggtggcacgccggattcgggtacgccggacgacgacggtggcacgccggacgggggccccgtggaagtgcccctgcccacgccttccgcggcgaactgggagttcttcggccgcgaggcgggcggcccccgcttcatccacggcgtgagcgcggacgcctccggtaacatctgggtggcgggcggcgaagaagcgctcttcctgatgaagaagggtgagcgcaccttccggcgttacacgatggcggaaagcatgcgcccgtacgagtacatgccggacggcagcgcgccgccgggaccgaagtacctcaaggtcatctctgtcgcgggcgcttggaacgacaccgtcttcgtcggctactag

SEQ ID NO: 6028 - DNA, 134 bp, Myxococcus xanthus
atgccgggcgacggcgcgctccactgcgagaacaactgggacagcaacgtaccggaccccgagcgatacaagaacggtgacgccgaccgtgtctcactgcgcgcggacggcacgctcgacgtcgtgcaatgccc

SEQ ID NO: 6029 - DNA, 1110 bp, Myxococcus xanthus
atgggcttcaccgcgggaagcccggtgagccccgccctggcccggcgcgtcctggagcgtccgcccacggagttgctccaggcgggctacacggccctgcgcgaatcaggaaccagcgccgcgctggaccggatgaccgaaggctacgaagccctggcgagcgcggcccggcgcgcccatgccctgctcggcgacgcggagtccttcacgctggagaacctggaacacctccagggcaaggcgcagcggatggctttggagcaggcagtggaggcggcggaggccctgtcgcgaaccctgccgcccaagctccgcgcccgtccggtgagcaccgcaccgctccccatggcgttggaggacgaggccgccttcccacaaggtggattctcctccgtgtccaacgtgggcagcctggagaacctcgtcacatccgagctggtctacatggaggacgagcccaaccttgacctcttcgacgtgcgctatgtggagggcgaactcctctactacacgcgcgacgagagcatctccgttcgccgccggcgcgtcatcaccttcgtcctgccgccggacctcgtggatgcgcgcgtgaaggacgcgggggtccgctggcagcgcgtcgtggtgtcgatgggcctgctgctctgcctcgtgcggcggctctccctctggctcggcagcgaggaactccacttccgagccgtcttcctgcacgcccatgacggcgctgtccccctggaggctgaacgcggcctctgcgagctgctgctgcgcgagtggcgcgcccgtggcacggcggaggtcctcaccgcctccacgctcgacgaggtcctgacggatgcggaagcgcgtgcgaagcgcgcgcgggtggacctggtgctgctcgacgcaagtagtcaagtcgagaggatgtctcatcccggcgcctcccgcgtcgagcggcacgtgctcgacctcagcggcccctcccctcgcgtgcgaaccatccgagacaagcgagaagacctggattctcgaaagtcggaagcgccgatgggcgccgccctcaacaacgacccttgggaagcctgggttggcgtaacgcttgagcttgcgcaagggcttctctag

SEQ ID NO: 6030 - DNA, 276 bp, Myxococcus xanthus
atgccactttctcttgtcgctcaggagccggacctcctgttctacacacgccaggcggccgagcatggcgggcccgtgctggtgttgggagccgccaatggccgggtggtgtgggcgctggcgggagatggctatgacgccgtgggcgtggacccctcgggggtgatgattcgctccgccgaggagcggcggaactcggaacccgaggacgtctcacgcagggcgcgcttaatggtgacggacctccgctcgctgcgcctggacgagcgcttccca

SEQ ID NO: 6031 - DNA, 870 bp, Myxococcus xanthus
tcccgcccacaggtgctcgcgtcccgcctgttcctgcgcgtgctgtacgagggtacgcgcggactgagaggcgtggggctgggggtcctcgggcgcgcactcatgaccttgagtcccaggcagcagacggccgactggatcgacgccatcatcgacaccctggtgcgttgctactcccgggaggcgagcctcccgcgtgctaccgcgcgcggcacctacttcgacctgctgcgctggctgcttcacatgaccagcgacttcgccgtcatcaccgacctggacccagctcccgcctccccggcgcccccgagtccggcccatgccggggatgcagaactcgctgcggaggcggccttcatcgaggagcaccacatccaggtccgctccatcgtaacggtcgcgccccccagcaaggcctggccacccaccttgttcaaggtgctgcacgcgctgactgccttcaatcctccgcaacggctgcggcgcacgcgcgaactccacgaactctggaccagcaagcaccaggtgctgcgtcccaccgacaacgatggcatcgtcaactccgtctcccaggtctggccggacgaggcccgcagctacctgctccagggcgatcatgcggacgtcatcgggcacttcagcgcgcaatgcccaccgtcccaggccagtgtcgcggccaccacgttccgccagtacgacctgctgaactcccccgcgggcttcgatcaacggcggttcatcaggctctggaaggacatcggccgcttcacggccagccagcaacaccgggaagcaacggcgcctcggccgcgcggtggagcgcgcatccaccacatcgggagcgcgccgccgcaccgagcggactcgtga

SEQ ID NO: 6032 - DNA, 228 bp, Myxococcus xanthus
atgcccttccccaacacgaacaacgagacactgacctccgtcgtcgcattcggcgcaaagtccgtctacgtcaccgcctacaacggtcgcatctaccggtacgacggcacgcagtggcaaatcatcttcgagaacacgaacctccgattcaacgacatcgcaggcaccagccccgcagacctctgggtcgcaggaagcaacggacagattctccactggcctcaatag

SEQ ID NO: 6033 - DNA, 549 bp, Myxococcus xanthus
agcgctgtgggaggaacgcaggctttggagcaactccaggcgcctgttcacggccgcgccgtgggcctggtgccggtggactcgccagacgtactccgagtggatgtcgcggaggtcgttggcggcgcggtggagctcctctcagtcacgcgccgcttgcgaggagtgcgggtttccctggagcttccagaggatccggtccccgctaatgttagtcaccggcggctgcagcaggtgctgctgctgttgctggcgcacgcggcggatgcatcgaacgggcagggcgttcgtgtgatggtggattccgctgacgacttcggggacctgccgccccgcttccaggtccaggtcgcgggggcgtcgctgtcctcgcgggagctccaggcggtcttcctgtctccgatgttggtggggccgctgcaccgcaagctggcccgggcccgggagctgacggagtccatgggtggcaccttggaggtggccagcagcgcggccgccggcatcaccgtgacggtggagttgcccgcaccggggatgtccagctggtag

SEQ ID NO: 6034 - DNA, 411 bp, Myxococcus xanthus
atgagcacatccatggcgcccccgtcatccggagaaaagatctccctgcagagcggcaagctgtccgtcccggacaacccgatcatccccttcatcaaggtcgatggccccgtcccttacatctggggtgcgtcacagacggtgtttcacccccgggtgcacaaggcctacaagggcaagaacaaattcgcatggtaagaagtcctgtccggcgaaaagtccttcaaggcggtcaacaactgtctgccggagtagacggttgaggcgttccgcacctatctggtgggcatcaagggccccctgataaccctggtgggtgacggcatccggtcgctgaacgtggtcatacgacacatgctggacatgaacatccgcttgcgctccgtgcgatacttaaagggcgtgcccagc

SEQ ID NO: 6035 - DNA, 520 bp, Myxococcus xanthus
atgcgagcaaggagtggatgtgctctggtgtggctgggactggcgggatgtggggggctcccaggcgaaacagtcgaagctcgcgaggtcgccgcgcaggcatgtcccgccggggtggcctcgcgcgtcaaggtcgtcgttcctccggggtctggctcctccgtcaacgggccctacccggagtccctggtcgatgtgcaggggcagctctacttcgccaccaacttcttcgacggaagcgccgtcttgtggcgcagcaatggcacggaggccggcacgacctgggtcaagaagctggatgcgcaggcggttcccatcggacagacaggcttcgccgggaacctgggcctgttcctgttgagagacggccccaacaccgaggtgtggaagacggatggcacgtcggggggcaccgtccgcctggagacgttcggcaagttcgtcaacctgctcggtgcgctgaacacgtctgtctatctgtattcgatgaaccccagcacgaagcggctgcgcatcgaaa

SEQ ID NO: 6036 - DNA, 798 bp, Myxococcus xanthus
atgggtttcgatatccgcaagaccttcaactctgcccgcgccaacgtccagaaggtagccaaggacgtccagaagaccgtcgaggacaacaaggggctcatcaagggcgccacggcggttgccacccagagcgcgaaggctttcgggtacggcaaggatgccttccagcagatcaagaacatcaagaacggcgccgagggcctgctgaccggtgccaaccgggcgttcgtcagcaaccccacctacgccgcgggcgagttcaagggcctgaccaagttgggcgccggcatgaaggccgccgcgcgctacgcgggcatccctggcgcggtgatgtcgggcgccacggccgtcaaggacatccgccaggccatccgcaccggtagcaaggacgacatcatcaccgccacgcgctcgtcgctcgacgcgaccaaggcgggcctgtccgccgcgacgggcggcatcgtcggcggcaaggtgatgggcggcgtgctcggcggcaccgtcttcaaggacaagctggaggctggcaagaaggccgtcgacgccttcaagaaggcgctccccaacgccagcgacgacgtgctcaaggccgtcaaggacaccgccaccaagggcatcttcgagggtggcaccgcgaaaggcgtgggccgggccgtcaagtccgccgcggccgagacggcgaaggcgaccagcaccctggcccagggcctgactggcagcggcacgcgccaggccgccaaggccgcgctgaagacggcgggcaaggaggccggtgaggcggcccttaagcagggcgcg

SEQ ID NO: 6037 - DNA, 303 bp, Myxococcus xanthus
cgcgacgccctccgcgcctccctgcggaacggagcgccgcagatgggcgacgtggcccggcagctccacgtcagcccccgcaccctccagcgccggctcgccgagcacgccacgtccttccaggacgaggtcgacgcagtgcgccgtgagctggccttcgactacctgagggacgcgcacctgggggtcagcgaggtggccttcctcctggggtattcggagctgagcaccttcgaccgcgccttcaagcggtggacgggcatgacgccccgcgtctggcgcgaaaggcccgaagcgggctga

SEQ ID NO: 6038 - DNA, 492 bp, Myxococcus xanthus
atgctcaagccccatgtcgtcgccctcttcgacgagtactactcctcgcatcagcacccgacgaaccggctgacgcacaagatcgccatcccgctcatcgtgctccacatcgtcgcgatgctggactgggtgcacttgatggcggtgcccgcgattcccggcggctcgctgacgctgggcatggtggtgttggccctggctgccgtctggtacctgcgcgccgacgtgaagctgggcatcatcgtggtgctcttcatggccgcgtgcttcccggtgggccggatgatgcccacgtggagcgtggtggtcatggccgcgttcgcgtggctggtgcaactggccggacacagcgtgtgggaaaagaagtcgccttccttcctcaccaacctggtgcacgcgctggtgggtccgctcttcttcgtcgcggtgctcctgggggactacgtcctcaagccgcagcagcaggccgccaccacgccggtccgcgcgtag

SEQ ID NO: 6039 - DNA, 203 bp, Myxococcus xanthus
atgacgagcttcgccgacaagctgcgcgtctggttgcccctgcatgagaacggcgtcagccgcgccgtgcacttcgtgggggcctacatgttcatcttcgcgttgctcgtcccgctcagcttcgtccggctgcccgtgggtgacgcggcgctcacggcggcgcacgtgctgctgctcgcggtggtcctctacgccgtctccct

SEQ ID NO: 6040 - DNA, 1365 bp, Myxococcus xanthus
ggacgggccatgccgcggtacgagttcaaggaaggcagctccagcaagttctgggaaatcaacctctccggcagcagcttcactgcgcggtggggccgcatcggcaccgacggccaggagaagacccagaccttcggctctcccgccgaggcccagaaggagcacgacaagctcgtccgcgagaaggagaagaagggctacgtcctggccgacaagagcgacgatgacgattccgaaggcggtgggggtgaagagcctgcatccaatccggaactcgaggccgccatcctcaaggacccggacaacgtggacgcgtacctcgtctacagcgactggctccagggccagggcgacccgcgcggcgagctcatcgccatccagcacgcggcctcccaggccagcggcacggaggccagcgacctgaagcgcaaggccaccgcgcacatcaagaagtaccagacgctgctgctcggcgagctggcggccggggtgaagtcggaggagctgtccctggagtggcacctgggcttcatccgctccgcgcgcgtgggccagaaggaatacgactctgacttcaacgtcccggagatggctggggcgctgctcaagcacccctccgcgcgcttcatccgcggactcaccatcggcatggcgagcttcgacggtgagaacgaatacggtgagaccgtccaggcgctcgtcgaggccgggggctcgaagacgattcaggagctcttcatcggtgacttcgagtacccggacgacaccgagatttcctggacgcacctgaccgacatctccgccctgctcaaggtgctgcccgacctgcgcaagctgcggctgcgcggcggtgagttggagctgggcgccatcgacctgcccgagctgcgcgagttcacggtggagacgggcggcctgccgctggcggccgtcaagtccatcgccaacgcgaagtggccgaagctggagcgcctggaggtgtggttcggcagcgacaactacggcgcggaaggcggcgtggaggacatccagcccatcctcgacggcaagggcctgccgaacctcaagcagttgggcctgcgcaactccgagttcacggacgcgctcgcccaggcgctgcccaccgcgaaggtgctcccgcagctggagacgctggacatctccatgggcaccctgtccgacgagggcgcgcgcgccttggcggacaaggcggcggccttcgcccacctcaagcagctcgacgtcacggagaacacgctgacggacgaaggccagtcgctgctgcccaaggcgattccccacgccaacgtgggcaaccagcgcgactacgaagaggagtaccgctactccgcggtgggcgagtag

SEQ ID NO: 6041 - DNA, 399 bp, Myxococcus xanthus
atgcggccttgttctgttggcggctcgggactttcaccctacgggtccatgagttcctccaggcatcacacaactaccttgacgctcacgcgcttcgtcgagaatgagcgactccccctcgacaacaaccgctcggaatcggcgctgcggaaggcggcgctgggccgcaagaactttctcttcgttggccacgaggccgctggcgaaaacctcgcgggcctctacgcgctggtggccacctgcgaggccaaccaggtcaatcccgaggagtacctggccgacgtgctgctgcgggtgcagacgcatcccaactcccgcatcggtgagctgctaccccacgagtggaaacgtcgacgcgtcgccgagccacccaacgcagccctgcagcccagtccctga

SEQ ID NO: 6042 - DNA, 867 bp, Myxococcus xanthus
ctggtggaccgctccgcgtccatgagcttccccgcgaaggtgggaggacgctcgcgctccgaggaagtggccgcgttcctggaacgggccgcgccgcgcctggcggagctgcaggaccgcttcacggtggagctgtacggcttcgacccggagctggcgccggcgacgccggagacgctgatgacgcccgcgcgcgcgggcaccacggacctgctctcggcggtgcgcgccgcggcgggggcggggcagggctcgcgcaagctgtccggggtgctgctgttcagcgacggcgcggacaacaccgagctcaaggcgggcgtggtgggccgggcgcgcgcggcgctggcggacctgaacgtccccgtctccaccttcaccgtggggcaggagacgctgaaggacgtcgccgtggaggggctgaaggtggatgacttcgccttcgtgcgcaactcgctgaccgtggaggtggagattcacggccgcggcttcgcggggcaggacatccccgtggtgctgagtcaggaaggcaagacggtcgccagcaaggtggtgcggatggagtccgcggacgacgtgaagcccgtggccttcaccttcaccccggaccagacggggcgcttcgtctacacggtgacggtgcccaccttcccgggcgaggccgtggcggacaacaacacgcgctccttcacgctgaaggtgattcgggaccgcgtgcgcgtgctgctggtggtgggacggccctcctgggacgagcgctacctgcgtggcctcttgcgccaggacgccaacgtggacctggtgtccttctacatcctgcgcacgctgtcggacgacccgggcgtggtgaacgaccagagtcacctgtcc

SEQ ID NO: 6043 - DNA, 1062 bp, Myxococcus xanthus
gacaccgcgccccaggtggcggtgaaggcgctgcacgaactgctggggctcaagcccgaccacctgccttcgctcaaggcgctggcgcgtgcgtccgaccaggcccgcgacagggcgggcgcggtgcgtgcctatcgccggttggcggcgctcgctcgcgacccggccgaggccgccgatgcgcacgtgcacctggcccggctgtgcgcgcagacggaagacgacatcgccggcgcgcgcctgcactgcgaggccgcgctgcggctggcgccggaccatccggacgcgctgctgctgttgggcgagctgtgccatcgcggtggtgagcacctgcgcgcgctgaaggccctggaccgtctgcgtgaggtggccatgggccgccacgaactggaccgggtgggccatgccgacctgatggccggccgcgtgtgggacgaaggcctgaagcagccggagaacgcgctgctgcgcttccgggaggcggtgtcgctgctgcccggtgagccggagccgctgttcgccgccgcccgtgtggcggaagggctgggccggttgcaggaggcgctcgcgggctaccagcaggcgctggagctggcggggccggcgccgcgctcggaaggggtgcggcacgccgcgcacgccagccaccacgccctggcgcggctgtaccgcacgcggctgggtgaccctgcgcgcgcgcgggagcacctggagtccgcgctggcgttggatccgcgcgacgcggtggcgctggaggagctgattccgtacttccgcgccaccggccgctcgcaggagctggcggaggcgttggagaaggccgcggcgctccaggacgcgcccggcaagcgcgcggcggcctgggccgaggcgggcgagctgtaccggggcaagctgcaacagccggagaaggcggagcggctgctcctgctggcgctggaggcggatggcgaccaccggcccgcgctggagtcgttgctggcgctggccgaggcccggcgtgacggcgcgctgctgacgcggtgcctgtcttcgctggcgcggctcgccacggacccttag

SEQ ID NO: 6044 - DNA, 475 bp, Myxococcus xanthus
atggccgcgctcacggcggacctgcccgcggatgcgcctacggaggcttcgtcgtcggcacggccgtcccgggcctccgcggcggcaggcagcgcgcccgcgccgcgtgagccggcagccccacggtccgagctggaggaggacctggccctctacagcgccgaggacacgctggccctggccacgcgccacgaggcggcggtgcggacggtgcccgccattggcgcctcgttcagtcagcagcagttgcgttccctgggcgcgcgcaccgtggcggacgtcctggacgtggtgcccggcctgtcggtcagcagggatgtgcagggcttccaccgcaccgccattcgtggcctgcgcaatgacgcggaggtgctcttccttctcaacggccaccgcctcaacagcttcttcgacggcaaggcgctgatgaacctgccggtggagagcctggagcgggtggaagtcataagcggcc

SEQ ID NO: 6045 - DNA, 111 bp, Myxococcus xanthus
atggcgctggagtgcgtggagggccgtcaccagaccaccgtgaacgcctggcgcgccggccgcatcaccgagcgctcctgtctgacgaatttgtgctcacggctcgagtgg

SEQ ID NO: 6046 - DNA, 414 bp, Myxococcus xanthus
atgaagggctggaccctcttccctcacctcgtggttcgcaccacgggttttcccttcgattggctggagcggctggggtgcccggaggccgcacgggccgcgcgccaactggcctcggcgcggcgggagctggaggcgctgaaagcccagggccctcgggtgaagcggccatcgcgcgcggtgctgtcggccctgaaggccgggcgcccggtggacatcgagggaatggagtctcccgagctgttcgctgaatggaacgaccgtgcccgggccgcgcaggaggcggaggccacctttcatgcggcgatgaagcaggagtccctggcggtggaggacgcgctgagggccctgcggcaggagccgcgcttcctggaggcggtggccagctccagcccccccgtggcgagagacctg

SEQ ID NO: 6047 - DNA, 1302 bp, Myxococcus xanthus
cccgcgccagtcctttcgcagctcaagccgaacatcccgcaggacgtctccgacctcgtcctccgcgcgctggtgaaggacccggcgcgccgcacgccgtccgccgccgcgatgcgcgaggaaatcgaagcggtgatggcgcatcaccggctcaactcgtcgcccgcggcggtggcccaattcttccgggacacgctgggcgaccggctggtggagttcgcaccgtccgccgtcggcggaacggggagccacccgcgtccggtgccttcgggcagtggcagcggcaacatcggcagtggggagatggccgcgcccacggatggacggacgcccagccggggcagtgtgcccatggccggaagccgtcctgggatgggcggcagtggcggcattcctcgccctggcccaccggttcccccgccgcccccgccacggcccgtgggcgtcgccagcgcggctgtgcggcctcctgcgccgcctccggaggacgactcattccccggcatctccgtgtccgaggacgacgcgaacgaccgcaccgaggtggtgccgctcaacctgggcgcgccgccgcctcggacggaagcgccgcctcggcccgctcccgcgccgcgtgcctctcagccacagcccgccatgcctgcgccgccgccgcgtccgtccgggccggtgccagggctggggcacggggctcacgccagcgcggcccgtcccgcccagccgcctccgccgcggcccgttgctcccgcgagccgcgttcccgcgcccgcgcccgcggagaaaccggcggacaaacagcccccttggaagttgctgggcatcgtcggtggcggcgtcttggtgctgcccgtggtggcggtggtgatgacgcgcgatggcggctcgaacttcgtcaacgtggggcccggggagcacgtctacgtcggcggcctgcgtcacgaggcggggacggaggtgcatgacccgtcgggtggcccgctgctcatctccacggcggtggaggggaagctgcggcggttcggaaccacgcagcagcgcgagggcatcgacgtgcgcacgctggcggacgcctcgccggagcctggtaccacgggcctgctgagcgtaacgggcgcggcccctggctgtgaggtccacgtcggtggcgcgttgctgccgggtggaacgccgctgttgaaggcacgaatcgaagcgggccgggagctggaagtcctggtgcgctgccccagcggcgtcagcaagctgtgggtgatggccgtgcccggacagcaaatcgaagtgaagtcgcaaccgcgaaactga

SEQ ID NO: 6048 - DNA, 849 bp, Myxococcus xanthus
agcgcccgtgtccgacgcgggcacgggcgctgtcgtcgtgcggcggcggtggccgcgggcgggccgggtgccgccgaggatgcatccgcgccgtcctcggtgcgcgccgagaacgacaagtcggagcccgagcgggctcggacgccacgccccgcgtcggtgaagacgtccgcgaagaagccggcggtccccgtcgagcccgccgtcgtctatgccacgccggcgaaggtgctcccgattcagagcgcgaacgggcgctactatgtcgaccggagcatcatcgggcggggcttcctcccgggtgtggagatggacgtgctggggccgttgaagaacggcaagcgcgaggtgctggggcgggctcgggtggtgcggccgggacgcggcgtcgtgatgcggcccacgcgggcgttcatcgaactggatgaccgtgccctggcggcttcgggggacctcttcgtggcggcgcctggacgggatgacgcccccgccgacgcgtcggcgaccgaggagtcccaggcgcaggccgccgagcccgacaagggtgaggaggtggagaccgtcgtggccgcggcccccgcgaagcgcacgctgcgcggccacgcgagcgtgcagggcggggtgggcggcttcctggacccgggtgtggaggtccagaaccgcgagtccatcgactggacggactgctacgtggtgaaggacatccgcaaagcggcgtggctgggcgtcgtgaaggccggggagcggaagacggccagccgtttccgccacaacccgaacttcgacgtgggctccggctacctgggcgtcatctgcaaggaaggcgagctgcgggtgaaggcgcgctga

SEQ ID NO: 6049 - DNA, 516 bp, Myxococcus xanthus
atgcccctggccatggccctggcgtggctcaccgcgtccgccgtgggcgggttgacgggccggaccttctggcgacaggtggccggggtgaagctggtgcacgcggagcacacgcccgggttgctccgcggcctggcccgcgccttcaccacgccgctggacctgctgctgaacggggtgctgatgcgccgccccctggacacgctgctcgggctccacgcggagcccgttgctcccggcgcgggccctcgcctcaagggcgtggcgctccagttgccctggctggcggtgctggcgggcgcggtgtggctgctcgtcacccccaccaaggcggagatgctccagtacctgggccgcacgctgacgggctggcactgctgccacggcacgcgcgaggtgacgtggcagtgccgcacgtccctggaccgcgcggtgcgcaatgcccggggtggggacgccgaggtgaaggcgctcgtcgccgactgccccgtcgccggcgcgcggctggggccctga

SEQ ID NO: 6050 - DNA, 189 bp, Myxococcus xanthus
atggaattggagaccgtggccttcggcggcggcttcgtgctgacaccaccgctgacggcgctcggaacgtggggcctgggcgagctcgcctttggcgagagtcaccattcggaccgagcctacctgggcgcgctcggcggcgcggacctgggcacgctgctgggcgtcatcgtgcacgaagccctggtg

SEQ ID NO: 6051 - DNA, 1350 bp, Myxococcus xanthus
atgccgcgcttcgagtacaccgaaggcacttcgagcaagttctgggaaatcgaacggaaggacaccgtcgtcaccacccgctggggccgcatcggcacggagggccaggagaagacccagaagttcaagcagacgtatgaagcgctgcaggcgtaccagaagcaggtcctggagaagacgaagaaggggtacacgcgcatcaagccgaaggacacggcgcccgcggccaagacgaacccggagctggaggccgccatcctccaggctccggagtctgacgacggctacctcgtctacgccgattggctccagggccagggcgacccgcgcggcgagctgatggccctccagcacgcgcagcgacaggcccagggcgcggagtcctccagcctcaagcggaaggtcgcggccctgtacaagaagcaccagggaacactgctgggcgtgggcctcacgtcgatgctcggcgagaaagccctgacgctggagtggcacctgggcttcatccgtggcgcgcgcgtcgcggcgccggggttcgactcggacgccgacttcgacgtcgtcgaaacactgacgatgctgctccgcagcccctccgcgcggttcctccaggagctgacgcttggcctgccggacaacgacggtgacaacgagtacggcgacctcatcaaggtcgtcaccaggctggcgccgaagacgcttcagcggctgttcatcggtgacttcgtcttcccggacgagtcggagatctcctgggtcaagctggggaacctcgcgcccctgctcaaggccctgccccacctcaccaccttgaggctgcggggcggagaggtgcgcctggggccggtggagctgccggagctgcgtcgcttcacgatggagtcgggcggacttcctcggcccgcggtgcagtccatcgccagtgcgaagtggccgaagctggagcagttggaagtctggttcggcagcgaggagtacggcggacggagccgcccgagtgacatccagtccatcctcgacgccacggggctgccgaacctgaagcacctgggactgtgcaacgcggccttctccgacgagctcgcgaccgtgttgccgaaagccaaggtgctgaagcagttggagtcgctggacttgtcgaagggcacgctgatggacaccgacgcggaggtcctggcggcgaacgcggcggtgttcaagcacctcaagaagctagatgtgtcgcagaaccagctcacgcgaaagggcgtaaagctgctggcctcgttgtgcccggacgtggcggcagggaaccagcgcgacatctacgacgatgacgaaggcggccgatacgtcgcggtaggcgagtag

SEQ ID NO: 6052 - DNA, 1080 bp, Myxococcus xanthus
ttgggcgtggcgctggtgccagggcaccgcgtggagttggtggagaacggcttcatcttcgacgccatcgaggaggagattctcgccgcgcgcaccagcatccacatcatcagctacatctggcgccccggtgagccgtcggaccggctggtgcgggcgctggcggcgcggcggcccggggtggcgtgccgcgtgctcgtggacccattgggcagcgtcaacttcgaggcggtgattcccgcgctggcggccagcggctgtgacgcgcgctacttccggcccatccaaggtgacttcgtggccttggacgcggttcgcctgagggcgcggaaccaccggaagatggtggtgagggatggcgaggtgggcatcaccggcggctggggcatctggaagagctggatggggaatgcgcagagcgcggagtcctggcgcgacatgaacatccgcgtggagggcccggccgtgcgagagatgcaggtcgccttcgcgcagaactggcaggaggcgggtggagacttcctgccggcgacggacttcccggagcctcgctacgcgggggatgcgcgcgccggcttcgtggccagcacggacaaccgcttcctgtcggacgcgcggcggatgacgctgctcaccatcgcggcggcgcaggagcggctctggattgcgaactcctacttcattccctccgacgccatcagtgacatgctgctggagaaggtgaagcaaggcgtggacgtgcgggtgctggtgcccgggcggcaccatgacgtcgggcccgtgaacgcggcgcagcgggcgtcctatgcgcgcttgctggagggcggcgtgcgcatctgggagtacgagctgtcgatgatgcattccaagacgatgctcgtggatgactccctgtccgtcgtgggctccaccaacatggacccgctggcgttgacgacgttggaggagtgctcggtggtggtggaggacgtggcgctggcggcgcagctcgccgcatcctttgagaaggatttacgccactcgcgggagattcactggagcgggtggaagcggcgcgggctcttgcagaagctgggcgag

SEQ ID NO: 6053 - DNA, 1107 bp, Myxococcus xanthus
cccggcaggcctgcggctcacggagccggcaatcccgtgcaggggcgctcgcaggcctgcttgcgtgtgccgcttgcccggacggagtttacattcgcagcgatgcccctcgtgttcctgcccgacgccgagacgctgttcctctgggggcccgaccggctgccacgtgagctcgccggcctgccggagacgggggaccgcgcctccgcgctgctcgtgacgcccgagggattgcgtgaatgcgaggggcacgggctgcccctggccgccaccgtcgagcggctcgcggtggtgcaaacctccgaggccgagtcctttcctggctccatcgccctgtggacgctggccagcaagctcgcgctggagttggtggcgcgcgagcgcgtggtgcccacgctcctgcggcggggcgagcgcatcgaggctcgctgggcggcggccctctccgccaccgaggacgccggccgcgtcgccgcgctcgcccggagcatgccgcccggcgcgcacgccgtccccgcaggcgccaggccaggccgcgccgtctgggccccggacgccttgctgcgcgccttcctcgacgccaccgtcgacgccttcgtgcgcgccgcgcgcggtgcgccttcgttgccggcccggcgcgcggcctcgtgggacgagcgctggcgcgaggcgctcaccggcgcgcgacgcgacttcgcgccggagggcttcgccgagcgctccgtcgtcgatgagctgacgcgctggagcgaacccgcgctcggcgcccgggacaagctgcgcgcctgcttccggctggagcccccgacggaggagcgcgagcccttcgtgctgagcttccacctccagtccccggacgacccaagcctgctcgtcccggccgcggacgtctggaagacgcgcgggcgcagcctggagaagctcggccgcgccttccgtgacccgcaggagtccctgctcgaggcactcggccgcgccgcccggctcttccccccgctggcgctcgtgctggagagcccacgtccccaggcgctcctgctcgagcccgacaccgcgtggacgttcctctcggagggcgcccgcgtgctctcagacgccggcttcggc

SEQ ID NO: 6054 - DNA, 324 bp, Myxococcus xanthus
ctaaagaaggcgcggcaccgcaccatggacgcgtggacactcgaaggctcacgcatcaccgacccggacacgttgagccgcctgcgcgagatgctggcgaacaagagcccgctcatcatcgagcaccgcttctaccgggagacgcgcgccccgcaccgcttcatctgtgacgatgccgacgtgctggacgagtatctccaggagtcacgtcctggagactcgttctgcgtgtggtcctacaagagcctctgccggggcgacaacctgctgctccaggggaagatgccggacgcgcaggggcggacgccgggcggcgtggcctga

SEQ ID NO: 6055 - DNA, 288 bp, Myxococcus xanthus
gcgacggcggtgagcctggacgcacgactcacccgggagaacggccagtcccgcgcggtgaaggtgctccgcgtgcaggacgggacacctgcccacgaggccggactccaggtggatgacttactgctggccatcaaccagcggccggtgaacagcgtggacgacctccagcggctcatggcgctggccacggaggacgaggtgacgctggacctgctgcgcaagggcggtggccgcaagacggcccaggcacggacgcgaccgcgcatggagcccgtggccgcctga

SEQ ID NO: 6056 - DNA, 915 bp, Myxococcus xanthus
ccggggagcccacccgggaggcctcggtctagcacttcgccagggtccaccagcacgcggacacaggcggctgtagcgaggcacccagcgaacaatgatgacacacctgccgctggaggctgcgcgcgcgcggggctggcgccggtgctggacgtggcggggatgcaggccaatgcgctctacctgtccaacgacagcggcaaggcgctggtggcctacgacgccgtgctggaggtggagcccctgcatgaggaggccctctacgcgcgcgcggcgctgctcttcgagacgaagggcgacgacgtggcggcgctgaagaaggcgggcgagggcttcgaggcggtcgcgaccacgtaccccgattcgttccgcgcgcccatggcgaagcggatggtggcgctggtggaggagacggtgaaagcggggggccgcaagcagctgctcgcctcgcgcgcggaggaccgccgcatccgcctgtcgcaggcgcccgctgccgccgcgccggatgcgccgcggccgctgtcgcaggagatggtggacgcggtgaagggcaccgagcgcacgccggagctggagcagggcctggcgaagctggtggacgagggcgaggaactcctggcgaagggccagtaccaggaagcgctcgccaactacacgcgcgtggttcccttccagccggagaacgggcgcgcgaaggcgggcatggcctgggccctggtgtccctggagcgtcccatggcggtgcgcgtgtggggcgtggccgtgcagaccgacccgctctccgtggagacgctgggcgacacgctcaaggccaagggcgacgacaagggcgcgaaggcgctctgggagaagctcgccaccgacgcgccggattaccccaacaaggcgagcctccaggcgaagctgggcaagtag

SEQ ID NO: 6057 - DNA, 591 bp, Myxococcus xanthus
agcccgctggcccccggcgcgtacgtggtgctggacatcggcgccatcgcggaggcctgccccatgggcctcgtgcccacggcctccaccgccgcgctgcacgcgattggtgacgcgctggcgatgacggtactgcgctcgcgccccttcggcacggaggactacgcgctgctgcacccgggcgggaagctggggcgctccgtgcagcgcgtcttcgagctgatgcgcaccggcaacgccaacccgctggtgcgcgacacctcgcccctgtccgcggtggtgggggtgatgacgaagacgccgggccgtccgggcgccgcgtgcgtggtggacaaggcagggaagctggtgggcatcttcaccgacggcgacttgcgccgccgcgtggaggcgggcctcaccgacttcaccgtgcccgtgcgcgagctgatggggaagaacccgcgctgcgtgacgccggagacgctggtgctggccgccgccacgcagatgcgcgagctgcgggtggaccagctccccgtggtggacgtggagggccgcgccgtgggcctgctcgacgtgcaggacctgctggccgcgaagttcgtctga

SEQ ID NO: 6058 - DNA, 396 bp, Myxococcus xanthus
atgcgttacctgaaggcgcgcgaagcggagggcttgcgcttcgacgtcatcgagttcgcggatttccgcggctgggccttcgccgcgctgcaggagaagcacctggggctggccttcgcgcagaccaccctctcggtgcggctgcactcgagctacggcaccctcatgcaccacgagcccaacacgctcgaggtcgagaacctggggcggtacgaaatcgagcggaagtccttgctcgatgcggacctcgtggtggggcacctgccatgcatcgccgagttcaaccggcgtttctacggcttcgatgacgcgtggatgcgcaaggtgcgggtggagtttcccccggtggtcatggagtctccggcggagtcgtcccggccgttcgacgttcccgcg

SEQ ID NO: 6059 - DNA, 261 bp, Myxococcus xanthus
atgaccgccctggaggggctgactcacggtgtggcgtgcctgacagggccgttgaccctgggggctctggatgaacacccctttcagcggttggttcaggtcgcgggcaccggctcgctcggacagattcgctcggcgttggagcgggtcgtcggcctccgggagcgttcgccggaggagtacgcgcagatgctggaggactacacccagacgctctgtgcccaagcgatcaaccactaccttgagttcgcacagccatga

SEQ ID NO: 6060 - DNA, 939 bp, Myxococcus xanthus
  unsure (1)..(939): unsure at all n locations
ttcgcgttggcccccgcgcagatgcccgtgacgnagtcgggcattcccattggcccggatgctccgcacggctacatcccggagaaggtcggcgtcatcgtcggctcgggcatcggcggtatctcttcgctggaagagcagcaccgcaaggggttggagaaggggttcgaccggttgtcgcccttcttcatcatccagatgatcatcaacatggcgccgggcctcatctccatgcggtacaactgcaaggggccgaactgggcgccggtgtccgcgtgtgccaccagtgcccacgccattggcgaggcctggaagtccatccgcctgggtgagacggacgcggtcatcgccggcggcgccgaggcggccatcaccccgttggggctgggtggcttctcggtgatgaaggcgctgtccacacgcaatgatgatccggccggggccagccgtcccttcgacaaggaccgtgacggcttcgtcatgggcgagggcgcgggcatcctggtgctggaggagatggaggccgcgaagaagcgcggcgccaacatcctcgcggaggtggtggggtacggtgccaactcggacgcgtaccacgtcacccagccggcgccggaaggcgagggcgcggcgcgctgcatgcggctggcgctccagtccgcggggatgaacccggaggacgtgggctacatcaacgctcacggcacctcgacgccgttcaacgacgcgaatgagacgaaggccatcaagacggtgttcggcgaccacgcgcggaagatcgccgtgtcgtcgaccaagtcgatgacgggccacatgctcggcgcggcgggcggcttcgagggcgtggtcagcgcgctggcgctggcgcgcaacatcctgccgcccaccatcaaccagacgacgcctgatgccggactgcgacctggactacgtgcccaagca

SEQ ID NO: 6061 - DNA, 450 bp, Myxococcus xanthus
atgctcgtgcacgcgggggtggaccggtatgcgctggcggaccgggtgttgctcctccccacctccatggcggagcagttggaggcgcgctacgcaaggatgtgggcccatgtgcggcgcctgctcgtcgacgtgcggcgctacgagcaggcgttgttgctccggggcttcgaggaggaggtcgaggaccggtgggcccagcggcttccctggcacgtgcccgaggaggagcccgccgccgagccggaggaggggctgcacaccgccgttcccgcgctggagtcgcggtggctcgccgcgttggtggacgtccacgaagggacgccttcgcacgaggcgctcgacacggtgctgacgtgtctggaggatgacggccgcttccgctgcgaggcagcgctggcgctcacccggtggcgggtgtggccaagccgcgtgcagggtccccgggtg

SEQ ID NO: 6062 - DNA, 1134 bp, Myxococcus xanthus
atgggcgcgcctccgttcatcctcatcggcaacccggagaaccggcgcgtcacgctgttccaggacgccctcgccaggcaggggcttccctccgcgcacgtcgtgccctggcgcgagctgctggcgtcgccgggcctcctggcgaacctgccggactcggaggcgctcgtccgcatcgactccacgggcgagaactgggacgtggagaaggccctgctcaagcggggctacgcggacgccgtgggccagggctgctccgtcctgacgccggagcaggtagaccgcctgcccgtggaccgcggccgcattctcagcccccggcagcaccacctgggcttcctgcgagtcctggcggagctggagtccatcttcgcggcgcatccccgctggcacatcctccagaagccctccgccatcgctgacctcttcgacaagcgcatcacctcccgccgctacgccgccctcggcgtgccggttcccgagccgctggacggtgtcacggacgtggaatcactccgcgaacggatgcgggaagacgactgccgcgaggtgttcgtgaaggtgtcgtgtggctcctccgcgtcgtgcctcgccatctaccggcgggggcgctcggcggacacgctgaccaccaccatcgaagtggcgaagacgggctggtacaactcgctgaaggtccgccgcatcgaggccccagcacaggtagatgaaatcctcacgtatctgctgggcgagggctcacaggtggagcgctcgattcccaaggcccggctgggtggcgactacttcgactgccgggtgctgatggtccgaggcgaaccagccttcacggtggtgcggcagagcatgcggcccatcaccaacctgcacctgggcggctggcggggcgacttggacgacttccacgtggccgtgccccccaatgagctcgcgaatgccatgcagagctgccgcacggtagcgcgggcccatgactgcctgcacgttggcatcgacctcatgtacgaggagcacttcaccgggcaccgggtgctggaggccaacgccttcggcgatttgctccccaacctccgccgtgacgggctcaccgtgtacgagtgggagattcaagaagccctgcgtcagcttccgtga

SEQ ID NO: 6063 - DNA, 1833 bp, Myxococcus xanthus
ccccgcatccagggtgacgcgttccagcgcgccgcgaacaccgtcatcgacctggcccaggcgtggaagaagcaccccgcgctggtggaggagtgggtgcgcatccaggacaccgtcttcggcccgtgcgccatcctgccggagcctgacccgcggctggatgaaggcgtgagcgcgcagcagcaggcccgccggcgggacgagcgcgcctaccaggaggcggcctcgcgcttctactgcgacgactatcccggcgccctgtcttcgttccagaagctcgctgcgtcgcaggaatcgccctaccgggcgctcgccgcctacctcgtggcgcgcacccatgtccggcaggcgctgatggagaagaagggtgagtatcacttcgagtcgcgggaagacgccgtcttcctctcgcggctgagcgaggcggaccgggtgctcgatgacgtgctcgcatccccggagctgcggagcgtccatgcgcccgcgcgcggcttgcggagcctggtgcgctaccggctgcgccccaagacctggcactgtgagctgctgtcacacgtgctcgaacccgggacgggcaccgccctcgcctcggagctgggcgacctcgacctgatgttgcgggaagcgagcacctgcgagggcctccccgcgcccgccgaggcgctccaggcgtggctcaacgccatgaaggacacgccctacagcgcggcgcccgatgcggagcgccgcgcgcaatacgacggagccctggcccgctggaagaagacggcgcacttgccgtggctcgtcgccgcgctgagcaaagcgacgccggacgctccgggcgtgccggagctgctcgccgcctccgcgaaggtcgcgcccacgtctcccgccggcctgatggtggcgtaccatgccgcgcggctcttgcatggccgaggcgaggtggaggcggcgcgggcgcggctcgcgacggtgcccgccgagctgacccgggaccttccctccacggacaacctgctgcgcgaggagcggctcgcggtggccagagacctggacgaggccatgcgggaagccttcaacatcatcgccgactatgaaatgaccagcagctactccgagccctacaccacgccgctggccgaacggccccggttcttcagcccgcgtgccgtggccatgctggaaccccggctgacggcgaagcgcatgggtgagctggcggcgggggacatcctgcctcccgcccttcggcggcagctcatgtggaccgccttcgcgcgcgccaccgtcgcgggtgacgacgcgacgattcaggccgtggcgaagcgcctggcggagacggagcccaaggcgaaggcggagctgctggcgctcgtcggcaagcccacgcccgaagagcgtcaattcgaggctcaattgctcctcatgggactgcccgtcgtctccgcgcggctctacccgggcgaggaccggctggcgaacacgcatcccaacctcagcctcaccatggacatctcctaccagcgcaactggtggtgcggcccgaagccagacgcgagcgtgccctccgtacacttcgaggacacgcccgacgcaccggacgcggcgcgggagtggaaggccctccaggacgcgggcaactcggtgccctacttcgcccgcgtcgccatggcctgggcccaggcccacccggaggacccgcgctcgcccatcgccctgttccgcgcggtccgcgccagcaagcgcggctgcggacaggccacgcgcgaggcacgggatgcgttccgctatctccacaagcactacggcaagacgagctgggcgaagcgcacgccctacgtgtattga

SEQ ID NO: 6064 - DNA, 426 bp, Myxococcus xanthus
atgctcggcatcggaggcggaatcgtcctggtgcccgcgctggtgctggggttcgacattcctgtggagcaagccatccccgcgagcctcatgtgcgtggtggccagctcgtgctccgccgccgcgggctatgtgcacaaacacctgagtgacatccgcctggggctgtcgctggagctggcgacggtgatgggcgccatcgctggcggcatggtggccgccatggtggcgccggcgatggtggcggtggtgttcgggctcttcacgctctacgtggcgctgcagatgttgctgctgcgttcgccgcgccaggagcccgccgcgatggacgactacgcgcccgccaactacccgctgggcatctccggctcctttgtggccggtggactgtcctcgctgttgggggtgggcggaggaccgctcaag

SEQ ID NO: 6065 - DNA, 792 bp, Myxococcus xanthus
tatgcgcgcttcggcgccgcgctgccagacctcccgttgtgcgaaggcatccggggtgggctcgccgccttcctgcccgagcgggagctgccgcacttcgcgcggctgtaccatgagcgcgccccggtgggcttcgggctgaagatggcggagctggtggcctccggcgcgttggtgggcacggagcctggcctcgcggtgctcgcgggttacttcacgcacctgtgcctggaccgccgtctgtatccggtggtggacaggttggtggtgcgacaccgccgccgcggtgagcgtgccctggaggcgcaccgcgacatcgaatgggcgcagacgctcttctatctgcgcgagctgcacggcatggagctgctcggcacgccgcgggtgcgggagaagtgtcaggtggtgaagagcctgggcttcccgtggcggggcattggcggcggcctctacgagctggtccgtttgtcctcacaggagcgtgtgggccaggcgcccagcaagtcggaggtcgatggctgggtgcgcggcctgtacgtctccggtctcttcctttcaagtcccatgggcagggcgcgcgcgttgcccgcgtatgcgcggctgtcgtttcaggagctgtaccgcaacgacacgttcgacttcgccgcggaggtggaaggcacgctggacacggcgcgtagcgtcctgcgtcggttgcacggctacatggcgaggggcaccttcacgccccgtacgcgagcccgcttcctggaggccttccccgaagggacgctgggcgctcgggcggcgtga

SEQ ID NO: 6066 - DNA, 1387 bp, Myxococcus xanthus; identical to SEQ ID NO: 256

SEQ ID NO: 6067 - DNA, 1194 bp, Myxococcus xanthus
atggagcccctcttcacgcccgagcaactggcggagattcacgccttccatcggccctactacatccgggccgcagtgggccccttcgccaacctggccctgatgctgctcatgttgggcgtactcgtccaaccgctccaccgcctggccgtggcggccgccgcggggctggagcggcggctcggcttccttcggacggcgccggtcagccgcgccttcttccacgccatggaccggctgtggggcaagcccggctggggcgcggcggtgctcttcgccctcttcacggacctgttcgtgtcgctcgtctacctgccggtggacgtctggttcagctacacgctggagcaccggcacggcatgtccacgcagacgcccgccaccttcgcctatgacatggtcaaggcccagttgctggcggccttcgccctctccgcgctcgtcatcggcatgttcggcctggcgcgcaagctgcgccaatggtggctggtgctgggcgtgcccgtggcactgctgctcctcgtctccggggcactggacccgtatcgcagcaggctcttcttcaaccagaaagcgctgcccgaggggcccctgcgaacccgcatcgtggacctcatggagcaggcggacatcaccttcgccgacgtcctcgtggaggagacctccgtcgcctcgcgccgactgcaagcctacttcgccgggcagggccccacgcgcaccatcgtcctcaacgacatcatcctcaaggaactctcggaggacgaagtgctggccgcggtggcacacgaagcgggccatgtgaacgagtcgaagtggcccgcccgcatcgcctcatcgctgatgctggtggccctgctcttcgcgctcgaccgcctcttgcgcctgtccgcgtcgcggggctggttcggcgccacccacttcgcggacatccgcaacctgcccctcatctccctgctcttcttcctcctcgtgctgacggccaagcccatctcgggcgccttctcccgggaacgtgagcgtgaagcggaccggtatgccctgcggcttacgaaatacgtgtacgccttcaggcgcataatggtgaaggctgcgtgggtcaacaagatggaccccgagcccccccgctgggtcgtcctcaagggcatgagccatccgcccatcgacgaacggattgggtcgcttcccacgccctga

SEQ ID NO: 6068 - DNA, 360 bp, Myxococcus xanthus
tacttgcgctccatcggcgtgggcaccggctactgggcccccgccgcggggacgcagattggttcgctttacgagaacctttacgagcacatggtgaactcacccgcccccgctgagctggatgccagcgaggccgaaatctaccggcaggagctgcggaagaagattcgggtgctgctcaccaagtccatcaacatctacgagcgcacgttggagacggccgagcgcatcggctcgcagagcaccttcgtggaccgcacgcgtgagagcctggccaaggtgaaggccctgctgctggcggacgcggagggcgagcccgcgtcggcggcgccctcctccgggggcgagccccatacctga

SEQ ID NO: 6069 - DNA, 1266 bp, Myxococcus xanthus
ctcctgggcgttcattgtgatgtgtgtggccaggcgctcctgtcctgctcggcgcgtgagacggcgctgcacacgctggcgtttttcgagcaacagcagggcttcctgacgccgcgggccacggtcagcacggacgcggaagggcgcttccgcttcgagcaactggctggcgtgtccttctccgtgtgggcccgcgcgccagggctgggcgtcgcgctccgcgaacgggccgcgcctggagacccggtggagctgtacctgccgccgctgcgcaccctggtggggcaggtggtggacgatgccggccggcccttggccggggctcacgtgcacggagtgtcgcggcgggcgccgctggccttcgagtccacgagcggagcggatggccgcttcaccctgacgggcctgggcgaagggcctttctatgtgctggccacggcggaggggtacctgcccgcggtgggggcccaggtggaggcgggaccacagcccgtgcgcctgaagctgacgcccgcgcgcaccctggaggtccgcgtcacccgaaacggttcccccgcggccgcgctggtgcggctgcgcgcggaccacctgtcgcgggagctgcgcacggacggcactccggtgcgcttcaccggcttgtatccggaccaattggtggtgaccgcggaggccaagggcctggcgtccgtgccccgcgtcttgacgctggacgagcgcgtcacccaggtgacgctggcgctggaggaggcggggagcctgctcgtcacggtggtggatgaagatggacagcccgtgccgcaaccggagctactgttgcgcatgccgacgggggaggttgtccggcaggagcgcgggggcaccggcgcgttggtgacgctgggccccctggccgtgggcaactacgtgctgaccgggcaggccgagggcttccgtgatgcgcagctgcccgcgaaggtgacgccaggggagacggcgctcgaactggagatggagcgcgccaccgtcatcagcgggcaggtgctggatgtctatggccggcccgcgccgggcgtgtccgtgttggtgcagcccacgggcgcgtcgacgctggcggacgcggaagggcgcttcatcgcgcaggtgcccacgccggggctctacgagctccatgcgcaccactcggagtggggtggtggccagctgaaggtgactgcgccggccaccgacgtgcaactggcgctggagcctcgcgcgtcgttggaagtgacagtctccgccgatgtgtcg

SEQ ID NO: 6070 - DNA, 885 bp, Myxococcus xanthus
atgaagctcaccgtgctctatcgaggcccgctgtcgagctgcaactacggatgcgagtactgccccttcggcaagtggaagcacaccgacgaggagctggccaaggaccgcgcggacctggagcgcttcgttgcgtgggtggaggcgcgtacgcaggacacggtgtcggtgttcttcacgccgtggggcgaggcgctcatctggccctggtatcaagaggcgctggcgcgcctgtcgcatctgccgcatgtggagcggttggccatccagacgaacctgtcctgcaagttggattgggtggccggggtgcgcgcggacaaactgggcatctgggccacgtaccacccggagtggaccaagcggcaccgcttcgtggcccagtgcgcgaagctgaccgagctgggcgtgcggcacagcgtgggcgtggtggggttccttcgcttcacggaagaggcggaggccctgcgtgccgagcttcccgcggacacctacctgtggatcaacgcggtgaaggacgggcaggaggagccgtacacggcggaagacgtggcgcgcttcacgcggttggacccgctcttcccggtgaacaacacgcgccacccgagcctgggccgcgcgtgccgaggcggggagtcggtcatctccgtggatggagagggcacggcgcggcgttgccacttcatcgaggaggcgattggcaacatctacgcgccggacttcgactccgcgctgagaccccggccgtgcgcgaagcagacctgtgggtgccatatcgggtacgtccatctggagtacctggagttggaccgcgtcttcggctctggaatcctggagcgcgtcccggccacgcccctgtggaaggccgggcttggggggccaccgtag

SEQ ID NO: 6071 - DNA, 285 bp, Myxococcus xanthus
atgggcggctccttcgaactggagtcggtggcgtacgcgctcgacggcgcgcccgtctacacgcaggtagatgaagagggccacacggacctgggcaagcgcgagctcttcgaggtcttcaacggccgcatcgtccccgggcagcaccagctcgccgtgcgcctcgtgtaccggggcaatggctacggcgtgttcagctacctggagggctacaagttcaaggtgcagtccagctacaccttcagcgcggagccggggaagacgtccaccgtgcctttagagcac

SEQ ID NO: 6072 - DNA, 588 bp, Myxococcus xanthus
atgtccttcatcaattactcatcccgcgaaatcaactgcaagattgtctattacgggcccgggctctgcgggaagacgaccaaccttcagtacatctacaacaagaccgccgcagagacgaagggcaagctcatctccctctccacggagacggaccgcacgctcttcttcgacttcctgccgctgtcgctcggtgagattcgcggcttcaagacgcgcttccacctgtacacggtgcccggtcaggtcttctacgacgccagccgcaagctcatcctcaagggcgtggacggtgtcgtgttcgtggcagacagccagatcgaacgcatggaagcgaacatggagtcgctcgagaacctccgcatcaaccttgcggagcagggctacgacctgaacaagattccgtacgtcatccagtacaacaagcgcgacctgcccaacgcggtgacggtggaggagatgcgcaaggcgctcaaccaccgcaacatcccggagtaccaggccgtggcgcccacgggcgtgggcgtcttcgacacgctcaaggccgtggccaagctcgtcctcaccgagctcaagaagggtggttga

SEQ ID NO: 6073 - DNA, 201 bp, Myxococcus xanthus
atcgtcggcagccgggtcgtgctggtcgtcatctttgacaaccgcaccagcctcggcctcgtccgccttcgcatcaagaaggccagcgacgagctcacgaagatcttcgagagcctggtgaagaagactgacagtcctggagctgggtcgcccttcgccgagatctccgacgacgatatcgacaacctcttcagcgagtaa

SEQ ID NO: 6074 - DNA, 369 bp, Myxococcus xanthus
gggatgatggcggcgctggcgctcgcgctggccgcagtgggcatctacggcgtgttgtcctatctggtgagccagcggacgcgggagatgggcgtgcgactggcgctcggcgctacgcggggcgatgtggtgaggctggtgctccgacagggcctgggctcggtggcgggcggggtggtgctggggtgcgcgggtgcgctggcgctgacgcgggtggtgtccggcttcgtccacggcgtcagcgccctggacccgctgtccttcgtcgccgcgccgctggtgctgctgggcgtgggactggtggcaacctgggtgcccgcgctgcgtgcctcgcgcgtggaccccatcatcgcgctcaagtacgactga

SEQ ID NO: 6075 - DNA, 489 bp, Myxococcus xanthus
atggggaccgtcttcggtgtcctcgggctggtggccgtcgtggctggctggacgtccatggagcaactgattgacgccgggcgtcgtgagttggcgtatcgcgtgttgctcgtcttcttgggggtgcccgccatcatgggtgggctgctgtgctggtggctcgcgccccgcaaaacgcgcaggctcgtgcgaagcgtggaatcggacgagcggaccccgatgctgatgtcggtggagcgcaaggtcttcgggagtggaagcgacgaaatcgtccacttcgtggccacgctgtacagcctgagcgcccatcatctggtgttgagggacgtgcgcctgcgccacgggaacaattgcctggcgtatccctacgacgaaggtgtctccaaggtgccggtggatgtctatggaaggcctggcgaagggccggtcgtcatcgatgcgggctggggattcctgctcccctccaaccggacctatccctggttctag

SEQ ID NO: 6076 - DNA, 255 bp, Myxococcus xanthus
gggcaatatctggtgtggcgcgtggtggggcaggggcttcggatggccgtggccggcgtcctcctggggcttgtcggcgccgccgtgttcgcgcgcagcctgtccagtgtcctgtatggcgtgagcgcgttcgacatcgtcaccttcgcggccgtgcccgtgctgctcgccgcagtggcgttgctggccagttggctgcccgcgcgccgcgtcacccgcgtgccgctgcacgaggcgctgcgctcggacgactga

SEQ ID NO: 6077 - DNA, 852 bp, Myxococcus xanthus
ggcgcagcagcggagcgcctcgtggtgggagtccgcgtcgcccgccgctggcgcctgagtggggtgcgggcatgcgctgaaggtcgagcgacggacagggcatccgtgtatggagaagcccccatgtccccgcccgactcccctcccctggtcgaactgcgcgacgtcacgaaggcctacgccgaaggcgacaccacgcgcgaggtgctctccggcgtgcggctctccttgcgtcgaggcgagttcgtggtgctgctggggcgcagcggctcgggcaagtccacgctgctcaacctcatcagtggcatcgacctggccagtcagggcgaggtccgcgtggatggccgcgacctgggacggatgaatgagcgcgagcgcacgctgctgcggcgcgagcgcatcggcttcatcttccaggccttcaacctgctccccacgctgacggtggaggagaacgtacggctgccgctggagctcaacggccagggcggcgcggaggccagtgtgcgggcgcgggcgctgctcgatcaggtggggctcggcacccgcgccagcagcttcccggaccggttgtccggcggcgagcagcagcgcgtcgcggtggcccgcgcgctggcccatgaaccaccgttgctgctggcggacgagcccaccggcaacctcgacgaggccacgggacggcaggtgctggacctgctggaggcgctgacccagaagggcaacacctgcgcgctggtcgtcacccacgagcccggcctggtggcccgcgcgcaccgcgtcctgacgatggagggcggccggctggtggaggtggagcacacgcccatccgcgcgatgaaggaggcgctgtga

SEQ ID NO: 6078 - DNA, 330 bp, Myxococcus xanthus
atgacgacgaacgtcatctcgctggacgacgcgcactttcaaagggaggtgctggagtcatccgagcccgtgctggtggacttcaccgcgacctggtgcccgccgtgccgtgcgctcgcccttgtgctcgacgcgattgccgccgatttccggggccggctgaaggtgaccagcctgaacgtggacgacaatccggagtccgccatgcgctatggcgtccgcgccgtcccggcgctgctgctcttcaaggagggcaaggtggtgcggcaaatgctgggcgcccagccccgcgccaagctggagcaggaactgcgcacccacctcgggtga

SEQ ID NO: 6079 - DNA, 930 bp, Myxococcus xanthus
gccccgcccctcttggatgacatgctcctcttcaccaaggtggtgccgaccggtggcatccccgcccgggcggagcggctggggctgcgcaagtccacggtgagccgccgcctcgcggcgttggaggagcggctcggcgtccggctcatcgagcgcaatacgcgcgggctccggctcacggaggtgggccgcgactaccacgcccactgcgcgcggctggtggcggaggctcgcgaggtgaatcgcgcgctcggtgagtcgcgcgtcacgccgcagggcaccttgcgcatcgccacgctctcactgctgggcgagctgctgacaccgctcatcgccgagctgctgttgcgcaatcccctgctccgcgtggaagtctcactcgccgaagcgcacgtggacctcatctccgaggagtacgacgtggcgctgcggaccggcccgctcgcggactccgccatggtggcccgaaggctcgggcgccttcgcaccggctactacgccagccccgcctatctcgcgaggcaaggggcaccccggacctcggcggagctgcaaggtcatgcctgcgtcgtgctcgccgcgcccggcaccgacgaggtctggttcttcggcgaaggccgcggcgcgaagagcctgccggtgacgggacggctgcgcgttcccagcgtgcgcgcgggacaagccgccgcgcgcgcgggactgggcgtggtgcggctgcccgcctcgctcgtcgccgaggacgtgcgcggcgggctgctcgttccggtgctggaaaccgaaacgccgccgggcatccctgtcttcgccgtctaccccagcaggcggcagctcccgctcaaggtgcgcgccttcctggcgctgttgagtgaacgcggcgccgcgctcccctgggacgacgccaccgagcccccgtcctcccggagccggtaa

SEQ ID NO: 6080 - DNA, 1432 bp, Myxococcus xanthus; identical to SEQ ID NO: 264

SEQ ID NO: 6081 - DNA, 1299 bp, Myxococcus xanthus
atgctcgaagggtcgccctacgtggcgtacctctacggctaccctcacaagacggcctaccggcccttcacgcccgcgctcccgttggagtccgtctgggcggaggagcggcgcgacgcgctgttcctctacatccacgtgcccttctgcgagatgcgctgcggcttctgcaatctcttcaccgccgccgggccgaagcaggacgtggtggacgggtacctgggcgcgctggtgcgcgagacgaagcgggtgaaggaggcgctggggacggcgagcttcgcccgggccgccattggcggcggcacgccgacgctgctggacgtggcggggttgaacaccgtgttcgacatggccgaaggcgtcatgggcgccgacatgaagaacatccccgtgtccgtggaggtgtctccggagacggtggacgcgcagaagctccaggtgctgcgctcgcgcggcacggaccgggtgagcatgggcatccagagcttcatcgaggcggaggtggccgcggtgaagcggccccagaagacggcgcaggtggaggccgcgctggacctcatccgctccacgggcttccccacgctgaacctggacctcatctacggcatggaggggcagacggaggagagcttcctctactcgctgcgcacggcgcttcgttactcgccggaggagatttatctctacccgctctacgtccggccactgaccttcctgggcaagaaggcgcgggcgtgggacgacctgcgcctctcgctgtatcgcgtgggccgcgacttcctcctgtcggagggctacacgcaggtctccatgcggatgttccgtgcgcgccatgcgccggacgcgggcggtccggtgtatcgctgccaggaggacggcatggtggggttgggctgcggggcgcgctcgtacacgggccaggtgcattactcgtcggaatacgcggtgggctctcgcgaggttcgctccatcatctcgtcgtacagcgagcggtccgaggcgtcgttcggcgaggtgggctacggcttccgcctggactccgcggagcggcggcgccgttacatgctgctgtcgctgctggcggatggcgtggatcttgccgtctaccggcagcgcttctgctccgacgcgctggaggacttcccggagctggaggagctggaggcgcacggactggcgcggaagaatggtggggtggtgcagctcaccgcggcgggcgtggagcgctccgacatgattggcccctggctgcactccgaccaggtgcaggcgatgatgaaggagtacgcctggcgatga

SEQ ID NO: 6082 - DNA, 264 bp, Myxococcus xanthus
atgcagttgcagattcagatggacgaagacgtggccaatggtcagtacgtcaacatggccctggtgaaccactccgacaccgagttcaccctggacttcatttacgtccagccccagcagcccaaggcccgggtgcgttcgcgcatcatcaccaaccccaagcacatgaagcgcctggtggcggcgatgcaggacaacatccagcgctacgaggcgaagttcggccccatcgcgattccagaggaagacggcggcatgcactga

SEQ ID NO: 6083 - DNA, 83 bp, Myxococcus xanthus
atggaggcggacaagcgctacacgctgggcgtggatgaggttctgcccaacgtggcgctcctcaacggccggggcactatgct

SEQ ID NO: 6084 - DNA, 276 bp, Myxococcus xanthus
gtgctcatcctcgatgacttcggccttgagccgctcggcgctccggagcgcaaggagttgctcgaagtcctggaggaccgctaccagctcgcgagcaccgtggtgacatcccagcttgagccgaaagactggcacgccgtcatcggcgacgcgacgctcgccgacgccatcctcgaccgtctggtccacaacgcccatcgcatcaagctgggcggagagtccatccggtacgtggagacaaatttgacgaagggccgcaagcaggccaagggatga

SEQ ID NO: 6085 - DNA, 849 bp, Myxococcus xanthus
ctgctcggggggcgcaagcacttcgaggacaagatttcgcggcccatctccgagggccggcagcacgcggccgaggggctcaggcgccgcatccgccccttcgtgctccggcgtctgaagcgggatgtcgcgcccgagctgccgccgcgcatcgagtccgtcatgcacgtgcagatggatgagcgtgagcgctccgtctaccacgcggtgatggcggccacccggaagcaagtggtggcgctgctgaacgagggcggcagcgtgctcaaggcgctggaggccctgctgcggctgcgtcaggccgcgtgtcaccccgcgctcgttccgggccagcgggccaacacgtcatccaaggtggagacgctggtggacgcgctggagacggccgtctcggaaggccacaaggcgctcgtcttctcgcagtggacgtcgctgctggacctcatcgagccgcgcctgaaggcggcgggcatcggcttcggccggctggacggcaccacggccaaccgcggcgaagtcaccgagcgcttccagtcccaggagggcgagccggtgctgctcatgtccctcaaggcgggcggtacgggcctcaacctcacggcggcggaccacgtctttctggtggacccgtggtggaacccggcggcggaggcgcaggccgcggaccgcgcccaccgcattggccaggagcgcacggtgatggtgtaccggctcgtgtcccagggcaccgtggaggagcgcatcctggggctccaggagaagaagcgggccatcttcgaggcggccttgagcgaagccgccgccgcgacggccatcacccgggaagacctgctcgaactcttctcatga

SEQ ID NO: 6086 - DNA, 668 bp, Myxococcus xanthus
atgcttcccgaatccgccgacgcccggccccaggccgccgccacgctgcacgcgctcatccagcaggaatggcagtaccagttggagcacagcccgacgtacgcgtcggtgcagggcgaccggcgctggaacggccgctgggatgacctgagcctcgaggccatcgcggcggaccaccagcacaacctccaggtgctcgcgaagctgaagacggtggaccgcaaggcgctctccgccgcggaccagctcaactacgacctgttccgccgcgactacgagacgtgggtggaggagcaccgcttcaagacgtacctgatgccggtgaaccacatgggcggcatcccggagggcatcaaacagccgccgggcgtgcagacggcctaccagctcgcggacaacctgcgcttcgagacggtgaaggactacgaggactgggtggccaggctccagggcttcgggacctacgtggaccaggtgctggcgctgctgcgcgagggactgcgtgagaagcgcatccacccccaggtcgtcctccagcggattccgccgcaggtggcgaagcagctcgtggcggacccggcggacagcggcttcttcgcgccgttccgccgcttccccaagggcattgcctccgcggagcagcaacgcctgtccgcggcgggccgcgc

SEQ ID NO: 6087 - DNA, 558 bp, Myxococcus xanthus
gagttctccaccaccgtgacgccggcctacaccggcgaccgcgccgtcagcctgcgctacaccacggacggcaccacgtggacgtactgcgacaaggacggcagcaacgtgggtgggtacacgctgggccagcaacacgccctcacggtgggtaaccacgcggagattgagtactgcaagctccagcacccattcgaaatcgcggtggacgccattgacggtgctcggaccgtttacggtcggctgtaccacggaggcgtcacccctggaggtggccaaggcgctggcgtcgtcgcggaactcggctacggccccgcaagcagcgacccgggtatctcgggctggacgtgggtggctgccagctacaacggtgactcgggcggcgatgacgaatacgccgcgaacctgccggagggcgtgcctgttgggacgtcctacacgtaccgatactcctacaacggtggaccgtactgcttcggcgattggcaacctggcggcgaaccaggtggctcagccaacggcgtgtcgccgaacactctaggcacggtcatcccgtag

SEQ ID NO: 6088 - DNA, 1415 bp, Myxococcus xanthus; identical to SEQ ID NO: 269

SEQ ID NO: 6089 - DNA, 842 bp, Myxococcus xanthus
acgctcacccagggcgaggtgctgcgcgtcgccgtgtcggtctccgaggcccggacctttcgttggtacgtgtaccggatggggcactacggcggcacgggcgctcgtgaactggcgcgcggaggcccggtggcgggtgtgcgccagggcgactgtcccgcggaccggtccacgggcctcgtcgcctgtcgctgggcgcccacgctggagatacccgtcggtgaacactgggtgcgcggcgtgtacgtggtgaagctggtgcgtgaggacaaccaccagcgctacgtgcccttcttcgtgcgcgacgcgaatccgcgtgccgaggttgccgtcctcatccccaccgccacctgggccgcctacaacacctgggggggcaccagcctctatgacgaccgcgaccgggtgatgcgcgagcacggcgtcagccgcgccttccgggtgtcctatgaccggcccaactaccgggggcatggcagtggccacctgctgacggacgacctgagcctggttcagtggctggagtcgcaggacctggacgtgggctacttcaccgacgaggacctggacgccagctacgacttgctggccggcgccaaggccttcttcatgtcgggccacgacgagtactggagcccgcgcatccgcgagcacgcggaccgggcggtggcggaaggccggtcgctgctcaacctgggcgcgaacaatgcgtactggcagattcagatggagccatcccaggacggggcgcctcggcgcatcatcgcctgctacaagggccacgcgaacgacccgtacacgggcgcccagcgcacggtgaagttccgcgagcgcgtcgtggg

SEQ ID NO: 6090 - DNA, 342 bp, Myxococcus xanthus
gcgctcgcggacaccgggcgcacgtcgccgctggggctcaccttcgtggacgcggccgagcgcgaggtgtccatgccctgggcggacgtgtaccgccgggcgaagcgcaccgccgcggggctggcccggctgggcgtgagcgagggtgaccgggtggcgttgctgctgcccacgtcgccggccttcatggatgccttcttcggcacgttgctcgcgggcgcggtgccggtgccgctgtacccgccggtgcggctggggcgactggacgagtaccaccgcgcgacctcgcggatgcttcacgtgacgggctcggtgatggtcttgacggacgttcgcgtgcgc

SEQ ID NO: 6091 - DNA, 258 bp, Myxococcus xanthus
atgacggagattcatcgcatcgtcaccgaggagctggagtggaagggcgcggtggagccctcgcaggacctggtgcgggacctccagttggacagcctgggcctcacggtgctggcggtggggctggagaaccgcttccgcatccgcctgtccgaagaggacgcgcagggcgtgcgcacggtgggagacctggcgaagctggtggcgcagcgggtcgcggctccggtggaacccaggccggaggaggccctgccgtga

SEQ ID NO: 6092 - DNA, 810 bp, Myxococcus xanthus
atggacatgaacgccgtgatcggcacgcacgacctgctcttcatcaccctggacaccctgcgctacgacgtcgccgaggcgctcgcggcccaggggcgcacgccgaacctctccgcgctgctgcccggaggccggtgggagcagcggcactctcccgcgagcttcacgtacgcggcgcaccacgccttcttcgcgggcttcctgcccacgcccgcgacgccggggctgcatccccggttgttctcgatgcgcttcgagggcagcgagacgacggcctcggacacctgcgtgctggacgcgccggacctcgtcaccgggctggcggggcgcgggtaccacaccatctgcattggtggcgtgggcttcttcaacaagcgcaatccgctgggcaacgtgctccccgggctcttcgcggagagccactggagccccgagctgggcgtgacggaccctcgatccaccgagcaccaggtgacgctggccgtccagcggctggaggcgttgccgcgtgagcagcgcgtcttcctcttcatcaacgtgtcggcgctgcaccaaccgaaccggcactatgtgcccggcgccacccaggactcgcgcgagtcgcacgccgcggcattggcgtacgtggactcgcagctccctccgttgttcgccgccttgcggcgccggggccccgccttctgcatcgtctgctcggaccatggcaccacctacggcgaggacggcttcaccggccatcgtctggcccaccccgtggtgtggacggtgccctacgctgaactcctgctacctcgagaaaccgcaccatga

SEQ ID NO: 6093 - DNA, 297 bp, Myxococcus xanthus
gccatcgccacgttgggcgaccggtggaactcgcgcatcatcgtggtgccggggctggcgccggtgacgggcgggccctatcgcttcctgcgccaccccaactatgtcgcggtggtgttggaactggcgtgcgtgccgctcatccacggtgcatggtggacggcgctggtcttctcagtgggcaatgcggcgctgctctacgtgcgaatccgcgcggaggaggcggcgctgggcgaggtgtacgcgcaggcgttctcccatcgccctcgtttcattccggaggtgccacgtggctga

SEQ ID NO: 6094 - DNA, 552 bp, Myxococcus xanthus
atgcgaaagctcaagtaccacgttgccaccagcgtcgacggtttcatcgcccacgaggacgatacgtacggcgccttcatgcaggaccgcctcatcaaggacagcgagcatgtcgcggactacgtcgcgtcgctggcgacctatgcgacggtgctcatggggcggcgcacctatgacggcggcctcaaggtgggggtgacggacccctatccgaacatggacacctacgtcttcagccgcacgatgaaggagagcccgaatccgcgcgtgaagctggtgtcggacgacgcggtgggcgaggtccggcgtctgaaggcgcaggagggcggtgacatctacctgagcggtggtggcgcgttcgccgggctgctgctcgccgaggggctggtcgacgaggtcctgctcaagatgaacccgctgatactcggctcgggcatcctgctggcgtcctcgctgaagcaggtggtggacctggacctcaagtccaccaaggtctacgccaacggcgtcgtgctgctgcgctacgccgtgatgcctcggccgcaggcttag

SEQ ID NO: 6095 - DNA, 552 bp, Myxococcus xanthus
atgcagcagaacgtgaaccagcaggtcgggatggacggcggcgacgaagactttgccgcaatgttcgaggcctctctcaatgagcgcggtggtgacggcatcctgaaggaaggggagatcgtcaagggcaccgtggtccaggtgacgaaggacttcgcgattgtcgacatcggctacaagtccgagggacaggtcccgatctccgagttcaccaaccctcgcggagaggtctcggttcaggccggtgaccccgtcgaggtcctcctggagagtcgcgagaacgacaccggcatggtcgtcctctccaaggagaaggccgacaagatgcgcatctgggacgagatcagcgccgcctgcgagcgcgatgagatcgtcaagggcaccatcgtcggtcgcgtgaagggcggcctgtccgtcgacatcggcgtgaaggcgttcctgcccggctcgcaagttgacatccgccccgtgcggaaccttgaccagtacatctcgaaggaattcgagttcaaggtcatcaagttcaacaagaagcgcggcaacatcgtcctc

SEQ ID NO: 6096 - DNA, 880 bp, Myxococcus xanthus
accaacatgtgcggcgagctcatcaacgcgttcggcaccgacgcgcagcgcgagaagtacgtgacgcggctggcgtccggcgaggccatcgcgggctcgttcgcgctgtccgagcccccatgcgggctccgaccccggcgcgctgcgcaccaccgcggtgcggcgcggggacgtgtgggtcctcaacggcagcaagcagtggatcacctccggcgcgtacgcgggggtgatggtggtgtgggcacgcacgtcccccgccggcaacaagggcttgtcgtgcttcatcgtcgaaggcgggacgaaggggctcatcatcggcaagcacgaggacaagatgggcctgcgctcctcgaacacggtgtcgctcacgttcgaggactgcgaggttccggcggagaacctgctgggcgccgaagggcagggcttcaagctggccatggtggcgctggacggtgggcgcattggcatcgcggcgcaggcctgcggcgtggggcgcgcggcgctcgaggcgaccgtggcctacgtgaaggaccgtcaggcgttcggccagcccattggcgagttccagggcccgcgcttcatgctcgcggacatgcagacgcagttggaggcggcggagctgctgacgctgcgtgcggcgtcgatgaaggagaagggacagccgttctcccgcgaggcctccatggcgaagctcttcgccagcgagatgagcaacaaggtggccgacaaggccgtgcagctccacggcggctacggctacatcgacgagttcccggtggagcggttcttccgcgacgcccgcgtgcagaccatctacgaaggcaccagcgaggtgcagcggatggtgatcgcccgcgagagcttcaagctcctgggctga

SEQ ID NO: 6097 - DNA, 1651 bp, Myxococcus xanthus
tgctctaaaggcatccacttcggcaccgcgctgctgtgcgccgcgcccatgttgaccagcggcgtcctgttctcgctcgtccaccggcggcgccgccgcatcgagccctggggctgggggtggctcatcttcggcgtggcgacgatgcacttcttcgtggccgcgctgatggccctgtcggcgccgccaggggccgccgtcatcgcctcgctgttcctcttcaccaccgccttccatggccggctgcaccgggtgacgccgcgccagcccttcctcgccctgggcaccgcgctggccctggcgctggccctgcccctgcgcggcagcgacgaacacctggccctcttcggcgtcatcggacccgcggcgctcaccgcccagctctatctggggaccttcgccgtgcagcatgaccgggcccgcgcggacgcggagcgcctgcgcgccgccgtgcacgcgcaactgctggagcagcaggagcgcgacgtgggccgcctgtcgcaggcgctgtcggaaatcctgggctaccaccacgacatcgacaacgcgctcatggcggcgggcagcgcggcggacatgctggccgtggtgggcgcgcaccgcccgggccccggccgcaccgagttcgacgacctgctccggcagctcaacgacaacctgacgcagatacgggacatgatgatggacgcccgcaacaaggggcggcgccatgccggcatggagccggagcccgtggagctggcgccggtgctggactcggtgcaggccagcgtgggcctgcgcttcccggacgtggacatccaggtggaggtggagcagccctccccgcccctgcgcgccctgatgcgcggcggcgcgcccacgctgcgccgcgtggtggagaacctggtgctcaacgcctgcgagggcaacggcgaggaaggcgccgcgcgggtccacatccatgcgcgcgtggagccgctcagcgggcgcctggaggtcacgattacagatgatggccccggcttcccgcccggccagctcagccgccccgccgaggcgctgtacaccagcaagtcccacgcgacgggcctgggcctctacaccagcgagtgcctcctgcgcgccagcggcggcatgctgcaccggcggaacgcgacagggggcggcgccgtgctccgcatggtccttcccagggagtaccgatgagcggcggagccctgtaccaggagtcgctgcgcgcgcttcgccggctgggcttgccggaggtgtcggagcgggacgtgctcgcggcgctggaggcggcgcagcccggccccctgtccctcttctacgaggcgggcgcggaggccggtctgccgcgcgaggccctgatggcgcgcggcgccgggctcttcctcagcttcagcgcgggcaacctcgccgacgacctcatcgacggtgagtgcacgtaccacgacccacccatccgcgtggggccgtgcgtgcagttcatcctccagaacctggccttcgccacgctgtgcggcgcgccggcgcaactgccgggcacggtgctggaagaggcggtccgcaccctggcggtggccgccggcccgcaggcgctggaggtgcgcgccagcgactggacggcgccgttgttccgccaggtcgcggagggcatctttagagc

SEQ ID NO: 6098 - DNA, 513 bp, Myxococcus xanthus
atgttcgtgcgaaccgccctcatgatgtccgccgcgctcctgttgggtggctgtgaggtggccagcgagattggcaagccgtgcgcgctggtgcgaaaggcgacccccgaggagtcggcggccaacaacaactccgcaaccatgcccatcctggagcgggagatcgcggcccagcaggacttcatctcgttcggatccgtgaactgcgaggatctgatttgcgttcgggaccaggactaccctcgggccctcaatgaggatggatcactgaacgagaatgctccggcgatgggctactgcagcaagccctgcgtcgagggcggctcgtcctgcgaggtgacggacaccgacgacgtcaatccggacctgccccgccggatgtcgtgccgcccgatgctgctggatcaggacacgctggatgctctccgctccgcggacgaggccttctatcggcggacgttcggcgagaacaactcgcccttcttctgcgccggcgcgctcatcccggattga

SEQ ID NO: 6099 - DNA, 105 bp, Myxococcus xanthus
atgagcggctacaagctggcccaagccaagcaggcggggcggcacctcatcgggctgctgaatgaccaataccggctggccatcatccactaccgggtcggacgt

SEQ ID NO: 6100 - DNA, 660 bp, Myxococcus xanthus
atgaagctgtccacctatctggacgaggtgggggcctcctcgtcgcttccgctcgaaagcgacctggatgaactcgcggacacgatgctggggaagcggccagaggacatcaaccatctggtgggtccatcgctgcttcgggccgtcccctccctgcgagaggacgtccgcttcccggactacgccccccggtggttgaaccgcctcaccgaatcctctgtctggatcgccccgcgcggcaccttcgctcagcttcacagggatcgcgcccacaacctctatgcccagctctccggccagaagcgctggcaactctatgcgccccaccaggcccggcgactccaaccagcaccgctcgactgggccgcggacctgagcggagtggacctcgaggtgggagcggccaggcggatgaccgcgagcgggctccggccggattacgacttcatcctcgaaccgggcgacctgctcttcctgccggtgaactggtggcatcgcgtccacaccgtttccccctccatcgcgttcaacctctggtggtgggacatcccgtcagcggttcgcgtcggtccggtggcggcacgcattgccctggggatgaagctgcaagaggcctattcctccctgcaccgcaggtcccccgcgtctgagcagcgatga

SEQ ID NO: 6101 - DNA, 237 bp, Myxococcus xanthus
atgagcgagtcagggaccggcgtgctgcgcttcgccatcatctggggcagccagacggtgtcgaagctcggcagcgccctgaccagcttcgccctggggctctgggtgtatggcctcaccagctcggtcacggatttcgcgctgatctccgtgctgaccatcctgcccggggtgctcgtggcacccatcgtgggggtgctggtggatcgctgggatctccggaacgcgatgcgtctg

SEQ ID NO: 6102 - DNA, 435 bp, Myxococcus xanthus
atggcgtcgcgcctgcctctgctcgtccaggaggacgcgggcgtctgcgattgggtggcctccgtggcccgctgccggccggtggcggtagtgtccaatggctcggcgcgggtgcagcgcacgaagctggcccgcgcggggctcgcggaggtactgccggatgtctttctctccggcgaggtgggcgcttcgaagccggatgcccgcatcttcgaggccgcgctggcccacgtcggacgttcgccggaagaggtgctgcacgtgggcgacgacccggcgcgggacgtcgtgggcgccgcgcggctggggatggccacttgctgggtgtctcacggccggccgtggccctccgcgctgcctccgcccatgttcacggtggagtgcattccatcgcgcatcgacgacatcgccggagtgctcacgcgatggacatga

SEQ ID NO: 6103 - DNA, 744 bp, Myxococcus xanthus
ctcaacctggtgtgcttcccggatgagctcccgctgaaggtgctgtcgaaaatcctggcgggcggccagtccaaggcggacgaggccggcatccccatcctgggcggccacagcatccgtgaccccgagccgaagttcggcatggccgtcaccggcgtggtgcacccgaagaaggtgctcaccaacgcgggcgcgaagccgggggacgtgctctttctcaccaagcccctgggctcgggcatcgcgaccaccgccatcaagcggggcgtggcgtccaagcagttggcgaagcgggccctgggggtgatgacgacgctcaaccgggccgccggcgaggtgttcgcctccgggaagttcaaggtgaacgccctcacggacgtgacgggctacggcttgttggggcacttgctggagatgatgaccgcggcgaaggcgcgcgccacgctggacctggagcgcatcccgctcatcgccgaggtccccgcgctggcggaggacggcgtggtgcccggcggtacgaagtcgaacctcgcccacgtccacaagaaggtccgcttccccgaagcactgcccgagtgcatccagtgggtgctcgcggatgcgcagaccaacggcggcctcctggccagcgtccccgcacgtcaggcgctcaaggcgctcaaggcgctggaggcggccggcgtggacgcggcgctgattggtgaagtccaggcggggaagccgggcatcgacgtggtgggctga

SEQ ID NO: 6104 - DNA, 663 bp, Myxococcus xanthus
ctgcgggagaaggacgtcgcgctccagatttcgctccgcctccgggacaagctcgaggccgcggggggcgacgtgttcctgacgcgcgagcacgacacgctggtgtcgttgacggagcgcgtggcgtggagcaatgaccacgcgcccgacctcttcatctccatccacgccaactccatgcccacgaagcggatgcgcgcgcgcaccgagggcgtggagacgtactttctgtccgccagcgcctcgggtgacgccgcgctcgccgtggcggatcgggagaacgcggaggcgcccatgtcgcgcgccacgcggacggactccacgctggccttcatcctccaggacctggcgcgcacggaggcgcacgcggattcctcgcgcctggcctacgccatccacccgcgcctcgtgcgcggcacccgcgcggtgaaccggggcgtgcagcaggcgcccttcttcgtcctctccggcgtggagtgcccggccgtcctcgtggaggtgggctacatctcccatcccgtggaggggccccggctgggccggccggagtaccaggagaagctggccgaggcgattaccgagggcgtgctggccttcctcaaggagacgcgccgccgggacgccgcccgggggaccgaggtggctggccccgtgtcgccctga

SEQ ID NO: 6105 - DNA, 915 bp, Myxococcus xanthus
aaggcgccctgtgccttcgctggcctcatctccgcgcagcgtctgctgtccacgccggacgcggccaccgacggccaggtccacctgtccggcctgttgatggtggcgggcggcgcggcgctctccggcgagctcgtctacggcctcttcctgattgtcttcggcgtgctggccagcatcgccctggcgctgggcgtggtggagtccgcggtccccgaaggcgaaccggtgccggtgcgcgcggtgatgggcccgctggccacgggcgtgggcttcgccgtggtgggcgcggtggccttcttcatcctcttcccccgcctcaactggaacatgattggccccagcgcctcgcccggcctgggcgtggccaccgcgggattctccaacaccgtgcgcctgggcggcgcgggcaccatcaagggcaacccgcgcatcgtgctgcgcgccaccctgaccccggacccggagaaggaaacgctcgacgcctactgggtgggccgcacctatgacgtcttcgacggcatggagtggtccaacgcgcgcgccaccagcaacggctccgagttcatgacgacgctgcggccgggccaggagaacctggtccaccagcacgtggagctgatgcccgcgtacggcgcgcgcacgctggtggcgctggagacgccctcgcggctgggcaacgccgtggccaacacgcaggtgggctcccggcgcacgcaaatccacgaactgggcggcggcgaggtgcgcttccgcgactccggcatctcctattcatatgaggcctacagcctcccgcccggcgccagcggcgacgacgtccaggacctgcccccggaggagcaggacgccctgctgtcgctgccggaggggcctgggacgtccgcgtcggccagacagccgcgcgggtgctga

SEQ ID NO: 6106 - DNA, 615 bp, Myxococcus xanthus
tacagctacacgctggagttgagcggcgacgtgccggacccggtcgccgacttcctcttccagcgcaagcagggacactgcgagcacttcgccaccgcgctcacgttgatgctgcgcacccagggcatgcgggcgcggctggccaccggcttcttcggcggcgagcgcgtgacgggtggctacgtggtccgcgcgggtgatgcgcatgcctggacgcacgtgctggtgccagggcgcggcttcatcaccgtggacgcgacgccgccggcccaccgcgcgagccagtcccctcgcctgctggagcagctcatcaacttctatgaaatcgtggagtcgcagtggcgtgacgtcgtcctggactacaacttccgcgatcaactgacggtcgtccgctcgctcactcgctcgcacgaggtcccgaagaaggacgagccggccagccgcgcgccgcccccccgggcctttggtgccgcgctgctcgcggccgccgcggcctataccgcctggcggttgctgacgcagttcctgtcgcgtgagcggcccttggaggccacgcgcttcgtggacgcggtggaggcgcagctcgccttcgcgcgaatacacgcgtcgaggtga

SEQ ID NO: 6107 - DNA, 907 bp, Myxococcus xanthus; identical to SEQ ID NO: 278
  unsure (1)..(907): unsure at all n locations

SEQ ID NO: 6108 - DNA, 1515 bp, Myxococcus xanthus
accacgtcattggcgctggcgggtggcgtcaacgtcatgttccggcccgagatcttcgtggccatgagcaagggcaagttcctgtcggcggacgggtactccaagagctttgatacccgcgcggacggctacggccgtggcgagggcgccggcatcgtggtgctcaagcggctctccgacgcggtccgcgaccaggaccgcgtctacgccgtcattagaggaacgggcgtcatccaggacggccacagcgagtccatgacggcgccgagctctcgcgcgcaggaagcgctgattcgccgcgtctgcgccagcgccgcgttggaccccaccgaaatccatgccttcgaggcccatggcacgggcaccgccgtgggtgacccggcggagctgggtggcctgggcgccgtctccaagcgcgaggacggccagggaccgtgggtcggctcgctcaaggccaacatcgggcacctggaggccgcggctggcgtggccggtctcatcaaggcgagcctgtgcctgcagcaccggcagttgcccccgcaggccaacctgcgcaacctcaaccccgccatccccttcgacacgctgggcatccgcatcccgcgcgcgcttgaaacgctcgcgccccggaaggacgagccgctgcggatgggcgtcaactccttcggctacggcggcaccaacgcccactgcgtcatcgagcaggccccgtccgccgcatcgcaagcccgcgccgatgcaaccccggcgccgctgctcctccccctctccgcccgcagccccgaggcgctgcgcgccctggcgcagtcctacgcggagatgctcgccacgccggcgccggcctcgctgccggacatctgcttctccgcggccacgcgccgcgcccaccatgagcaccggctggcgctgctggcgacggaggacgtggccgatctgacggcgcggctggagtccttcgcgtcgggcaaccccgccgagctgggcgcttccggccggacgctccaggccgcggatgcccggcccgtcttcgtgttcaccggcatggggccccaatggtgggccatgggccgggagctctacgcgcaagacgcgctgttccgcgccaccctggaccgctgcgacgccctcttccagcggctggcgggctggtcgctgctggagcagatgctcgcggacgagcagtcctccaacatggcgcggacggacatcgcgcagcccgcgaacacgttcctccagattggcttgctggagatgtggcggcgcgcgggcatcacgcccgcggcggtgattggccacagcgcgggtgaggtcgcgtcggcctatgccgccggccggttcacgctggagcaggccatgctggtcatatgtgagggcagccgcatgcaggccagggctgggggccagggaaagatggccgccgtgggcctctccgaggaaggggcgcgcgccgccatccaaaagcaaaaggacctggtgtccatatccgccatcgtcggcccctccgccaggttcctg

SEQ ID NO: 6109 - DNA, 534 bp, Myxococcus xanthus
atgaccaccagcccggtggagtacgtcaacgagccgctgcgagtgctcgtcggcacgctgccagaggacctgcagggtcacgtctatgtcgcggggcccagcgtgcacgcgggctcaccggccctggcctcggacgggctcgtgctgcgcctggacttccaggtgggcggcgcccggttcacctccgccaccatgcgcaccccctcgcactacgcgcgccagcaggtggacgcgggcgcgacggcgcgaggccccctgacgcggctgctcaaccgcttccgcaaaacgacgctggcggacgtgtcactcacgctgggcccgcaggagacgcccaacacggcgcccttcctggtcgagggcgagcggatgctgctggtgacgacggacgcgggccgcccgtgggccatccaccccaagacgttgaaggcgtacacaccgctgggctacctgcgcgagtggaaccgcgccctccccacgccgtgggccttccccctgctgcagagcacggcccacccggccttcggccccttgaga

SEQ ID NO: 6110 - DNA, 111 bp, Myxococcus xanthus
atggcggagaagaagacggacaaggtgaagcgcctcaccgagctgagccactgcgcgggctgcgcggcgaagctgcgggcctcggacctggcgcaggtgctggggggctga

SEQ ID NO: 6111 - DNA, 537 bp, Myxococcus xanthus
atgacggggaagatcgatgagattcccctcccggacctgctccagatgttccacacgtccaagaagaacggcgtgctggtggtgcagcgcagcgaccaggaagggcgcatctacctgcgccagggccgcgtgtactacgccgtcatcggcgagaaccacaacctggggccgcagaagagcttcaaccgcatcatcacctgggaagagggcgacttcgagctgcgcccggcggagaaccaggagttcatggtggagctggactcgtccaccgaggcgctcctcatggacgcgctccgccagttggacgaaatcaagcgcctgcagccgagcctcccgacggcggatactgcgctggcgctggcctcgccgctgacgccgccgctcaaggagctggcgccagagctgctggacgtgctgcaactggtgcacaactacggcaccctgaacgcggtgatggaccacgcggacgcggacgacgtcgtcaccgccgaggccgtggtgcaactgctcaagcgggactacatccgagcggcctga

SEQ ID NO: 6112 - DNA, 312 bp, Myxococcus xanthus
atggacacccaaaagacctacgccctcaagttcatctcagggaagtaccagggcggcgaattcccgctgaaggcggacaagcagatcgtcatcggccgctccagtgagctggacatggtgctcggggaggacatggtctcccgcaagcacgcgcgcatcagcttctccgatgggagcatcaccatcgaggacctgggctccaccaacggcaccttcgtcaacggtgagaaggtgaagcagtcccgtctgaaggaaggggaccgcatactaatcggcacctccatcctcaagctcgtgcaccagggcgcctaa

SEQ ID NO: 6113 - DNA, 1140 bp, Myxococcus xanthus
gaaatcgggaccatcgaggcattcgagcggcacctctcggcgggtgtcgggttcgccaacgtcatcatccaagggctggatctccggcggtacacccaggaactggcctccgccaagctcgtgggcgccgtcttcctgggctgtgagctggagaaggatgcgctgaaggccaccgtggagcatggggccatggtgttcccgcccatctccggcgtgccctatcagccctaccgtggcgcgctgtacacgccggaggaactgtacgccggcttcgacccggctcagccggagtcctacgcggacacaccggatgcgcgcatctacgcgcactgggcggcgaacgggcgcggcagtcctcccacgctgctggagacgctggcgcagcggctccacgaccactcggtcacggaggccatgcaaggattgctgtaccggtccgggggcgtgcgcaaggtggtggccatcatgggcggccactccatgaagcgcggccagccggactatcgcgcggtggcttccctggcgcgcgagctggcgcgccgtggcttcttcatggtcagcggcggtggtccaggcgccatggaggccacgcacgtgggcgtgtggttcgcgcggcgcacggaggcggagctggacgcgggactggccctgctcgcgcaggcgcccagctacaccgaccgcgagtggctctcgcgcgccttcgacgttcgcagggcatttcccctgggcgaggacgacctgccgtactgcaccagcctgggcatccccacgtggcactacgggcacgaaccgcccaaccccttcgccacgcatatcgcgaagtacttcgccaacagcgtgcgggaagacggcctgctgaccgtcgccaagggcggcatcatctactcgcccggcagcgcgggcaccatccaggaggtgttccaggacgcgtgccagaaccactacaactcggtgggcgtcatcagccccatgatcttcctgggcaccgagttctggacgcgcacccggcccgtgtacccgctggtgcaccagctcgcgcagggctacgactacgcgcgctacctcatgctcacggattcgcaggaggaggtcgtttgggcgttggaggcgttcgaccgcgaggcgcacctgtccccctga

SEQ ID NO: 6114 - DNA, 726 bp, Myxococcus xanthus
ttcatggacgagcccctcaagcagctactgaccctcgggcgcggctacttcgagaagaagcagtacgcgcaggccgagcaatacctcgcgaagatcgtcgagcagaatccgacgttcgcggacgtgttcaacatgctcggcatcatctaccacgaccaggggcagttcgcccgggcgcagcgcgcgttcgaatcagcgctgaagctcaaccccgcctataccgaggcggcgctcaatctggccgtcatctacaacgacatggggaagtacgccgaggcgaaggaggtctaccaggccgccctctcccagcagaaatccggcccggacgagctggacccctacgtggagaagaagatcgccaacatgtacggcgagattggcgacgtcttcgcctccagcggcgtgtgggccaaggccattgaggagtaccggcgcgcactcgcgctgtgccctcagttcgtggacatccgcctcaagctgggcaacgccctgcgcgacgcgggggacaacgcggcggccctcatcgaatacgagcaggtcatcgcccagaacccggctttcatcccgggacacatccagtatggagtcgcgctgtactcggccgggcggcgggcggaggcggtgcatgtctgggaggacgtgctggtgcgcagccccggtaacaagagcgcgcagatgtacctcaatctggtgaaggaccccggcaaggcggagcaggctggctga

SEQ ID NO: 6115 - DNA, 336 bp, Myxococcus xanthus
acgacggcggcgccccggctccaggcggtggtgtgggccctggagtcccgccgcagggcgctgcaggcggcggacgcggagtccctggggcggctggcgggaccgggcacgcccggagtgggcgggccggagtgggagcaattgcgccaggttcgggcgcggggttaccaggcggaagcgtggtacgtccggctggagcgggacgatgcggtggtgacggagcattggcgccttcagggggcgctgccggcgcggccggtggatacccggggccagcggcaactctcgttgtcgctcagcggtgatgaattcttgttttctcccagcctcatgtag

SEQ ID NO: 6116 - DNA, 853 bp, Myxococcus xanthus
atgcagaacgagctcatccgcgaggaagagaccaagtacggcctcatggccggcgcgggctgggacatcctggagacgctgcgcgtcgaggccggcggcggctacttccagaagggcctggtgcccggcctggcgacgctcggcgtggaagcgccggtgaacgccgcgggcgtgtccggacaaatcgtctaccacgtgggtgtgcccgtcggcaccagcgtggacttccggctctacaagaacgacccggacatctatcagcgcttcttcgcgccggagcagtacccgggcggcctgtcgtacaccgtgtcgctggaaggtagctacctgtcgcagacgctggagaagcccaacgacttcggcgccaccaagccgcagggcgccaccgccgtggccctccaggcgcgcgcgaagtacgacctgctccgcgtcagcctcctcggcctgtaccgcagcctgtccttcatccagttcgaggtgccgggcttcccgccgttccaggacttcccggagggcacggagctgaagccggagatgttcctcgcggtgggcgcggactaccacctgccgaagctgcacttcacgccgggcttcatcatcggtgtgcagcagccggcctcgttccgcagccccacgccggtgctgggcggcaacaacccgccggagaacctcatcggcacgcgcaccgtcgtggtgcgtgacgtgaaccagctcagcatccttccggagacgtgcggccgcggcggcgcggcgtgcaaggcggagcccatctactccgcgaaggccacgttccgctgggacctgtccgactccgtcgccgccgtcggcgaggtctactacacgtacgacacca

SEQ ID NO: 6117 - DNA, 99 bp, Myxococcus xanthus
atgaagcgcgacttcgaggcgaagggcaacgccgcgccctacatggacgcgctgctcaccatcggcaccgagtcccccgacgagcagatctgtagagcg

SEQ ID NO: 6118 - DNA, 1110 bp, Myxococcus xanthus
ctcacggtgcatttcttcgacgtgggacagggggacgccgcgctcatcatctcccccaccggcaagacggtgctcatcgacagcggcccgcccgacgcgcggcaccgcctggagcagcggctgcgggagttggtgaaggagccgctggacctcgccatcctcacgcacccccacctggaccacctgggaggcatgtccaccgcgctgcgctcggtgggggcccggcgcttcatggacccggggttcgaccacccgagcgaggcgtaccgcgacctgctcaacgtcgtgggcgacgaagtgggccaggtgatgacgcccgttcccaacccccaggacccgcgctccctggtcaccattggcctgggggatggcgcggcgctcaccgtgctgtggcctcgcgtgccggaagatcccttcctcacgggcacccgctcggacccgaactccaactccatcgtcgccaagctgacctacggcaagacggcgttcctcttcaccggcgacgccgagccggataccgaggccacgctgctacgcaagcccatcgacctcacgtccaccgtgctgaaggtggcccaccacggcgggcggcactcgtccaccgcggacttcctggccgcggtgaagccccaagccgccgtcatctccgtgggcgcgaagaacgactacggccaccccacctccgcggtgctggagcggctgcgcgcggtgaaggccaccgtgttccgcaccgaccaggacggcgaggtggtggcgaccagcgacggcaacgtcgtctccctgcgcgcggagaagcgcggaggggcgtcggagctggttcccggaggcgtgaagcccggctcggtcgcgctcgggcccatcacccggggaacgcgccggaccagcacgccccgtgggcgcggcgccgcgtccgccccggcggaggcccccggcaccgactccacgcaacgcgacacggacgcgccccgatacttcagcctcaagggcagcaaggtgtttcacaaagagagctgccggaccctgaagcgctccaagtcggaccgcaccgcctattcgagccgcgccgaagccatgcgcgagcgccgccccgccgaggactgccacccatga

SEQ ID NO: 6119 - DNA, 307 bp, Myxococcus xanthus
atgagcttccgcccgcgcgtcctcctccctgtcctgctggcactggccgcctgcaaggaatcaccgccacctcccccgcagccggtagccacgcgaccggcggagccccctcggcgctacttcggtggcaccccggacgggaagctccacgtctacttcttcgacgtcggccagggcgacgccgcgctcatcgtgtcgccggacgggtacaccgcgctggtggacacgggccccgcttccgcggcggagcacctggtcaaccggctgcccgagctgctcacgcagcggctggacctggtggtgctca

SEQ ID NO: 6120 - DNA, 153 bp, Myxococcus xanthus
atgtccgactccgaagacctcttccatttcgtcgaggacattgccaaccaggcgcgccgccggctcgaggcgtggaaggaggggcagacgcccggggcccgtgctcccgcgtcgggcccgtccaccgcccgggtggccatggacacggtgcgc

SEQ ID NO: 6121 - DNA, 189 bp, Myxococcus xanthus
ctaaaggagaatcccggcctggggttccacaccaccggcgaggagcgggcggaggaattccgcgccatcctcgcggacggccacgtcgccgcctacatccgcaggaaccggggccgggacatcgccggcgcctgcgggcaactcgccaatcgcggcgagacacaagccgggaccgatagtacgacataa

SEQ ID NO: 6122 - DNA, 261 bp, Myxococcus xanthus
atggccgttgtcctccgtcttgcccgcgcgggcgtcaagaagaagccgtactaccacgtggtcgccaccgactcccgtaacccccgggacggcaagttcatcgaggccgtgggcgcgtacgacccgaaccaggagccgccgaaggtggagttcaacgaggagcgcctcaactactggctgaagactggcgcgacgccgtctgagaccgttgcggacctgatcaaggtcgccggcaaggccaagcccgctcccgcggtctga

SEQ ID NO: 6123 - DNA, 1203 bp, Myxococcus xanthus
cagggcgccaagacggtcctcgtcagcgggtcgggcaagaacagccccgccgtcatcgcgttggacatcacccatcccgatgacgcgtggtacccgctcccgctgtgggagttcgacctgcggtcctcgaacatcgagcacgccttctccacggccaaggtgacgaccccggaggtgcagttgccagacaactccggcacgaatcacgcaccctccattggccgcttggtgtggggctcggaggcggagggcaagtggacggccgtcgtgggcaccagccaggtgccttcgtcgccgggccgcgctggcgccctctatctcatcgacatgaagacggggcagccgctcaactacggaagctcaccggctggcgccatggcaggcatcatcaccttggacacgggctctggcatcgccgcggagaccgcgctggtggacctggaccgagacggcaactacgacgtcatgtacgtgccgaccaccgcgggcaacgtctaccgcgtcaacctggaccaggtgaacccgaacgcgcccctgggacagaaggtgaaggtctgcaagatcgccagcgcgcccgtcacgctgtcggaccatgacgacgcggccaagggacaggaccccgtctaccagcagattcactccaacctgggcgtgagaatcgtccggaactctggcagccccgtggttcgcttctacttcggcacgggtgacaacccagacgagttctccgacggccccgaaaacaagaacgcctatcgctaccacctgctgggctacgaggacacggacccctccggcacccgcgcgtgcgcgctgctggacccgctctgggtccagcaactggacccggggcaggcggtgtggggcggcgtgacgctcgcggacgacaaggtctacgcgaccacggccgtcggagccgcagcggacgtctgcaacctgagccaggacgagagcggccggttctacgagtccggcctgcttccggatggcaacagcgcccccgcgatgaccagcgcttcgctcggtggccacggcgtgagcgcacctgtggtgcatgacaatcacttgttcatccccacggccacgggagaggtcaaggtgcagggcagcgggaagtggggcaacggcaatgcgaacggcggcgcggcccgctcgaaggtccttatctacgcccccagcccggacgggaggatgccgcagtga

SEQ ID NO: 6124 - DNA, 423 bp, Myxococcus xanthus
atgtccttcgagtacgacgcgctgaacgacgtcgtcaccgcctacttcaccgactgcgtgttggtgagtgaggcggacgtccttcgctggcggaaggaagtcgaggagcacctttccaagtacccgcccaaggtggacctcctcatcaacctggacgggctggtggtgaagttcaccgccggccgcgtcttcggcaaggagcggcgcgaggtgctggagcgctacacgcaccgctcgtatcgcttcggtggtgacgagatgacgcgcatgttcgtgctcaccagcggcgccatcaacggcgcggccgtcaatcactacgccacccgcgacgaggcgctggccgcgctccaggccgagcgcgaggcgctgcgcaagcggggcttttcgcccttcggtggtggcttcgccggcagcaaggtctga

SEQ ID NO: 6125 - DNA, 438 bp, Myxococcus xanthus
atggatgtggtgcctgaggagctggtgctggcaggaaagaaggtggaccccgaggatgcgcggagatccgccgagctggttgcggaggtgattgtttccagcaagctgaacgctcttgaagggcactcactgggctccatccagacctggcgcaatagcgacgaggagaaggtgcaggagatgcggcgccttcttgtgtccggccttggggctcttcctgatgctgtgaccgaaggcatctacgccgcgcacctcgtggcggcgggtgtcaccgccgcgctggccgcggaggcggacgtccggcgaatcttcgaccgaatgattcggctgctgaagcagatgcacgatcggaacccgtcctgggggccgctcttcatccggcaccgcagcgacgttgcgccgcactttctctatccatacccacgccatcgggtgtga

SEQ ID NO: 6126 - DNA, 264 bp, Myxococcus xanthus
atggccatcctgctgatgggcgtcggagcggcgatgctggtcgtgacccagaccagctactccaaccgccgcagtctcagcgccacccaggcgcaactcatcgccgagcaggcgatggagaacatcacgctgctgggctgctcggtgcagcccccgtgcggcaacctggaaggactggatgagagctacgtcctcttccaaacgagcgcgggcgcgctgagcaacgtgcgtcccgccgacccgaccgtcatcgggcgtgagtaa

SEQ ID NO: 6127 - DNA, 1419 bp, Myxococcus xanthus
atcaagcaggtccccaagctctttggcgtcaaggaaggcgacggcaacttcttcgagcggctgtggttcctcgtcacgcacctgggcagcacgcacctggtcacgctgctcgtgggggctggcagcctcatcatgttgctggcgttggaccgcgtgtcgaagcggctgcccgcggcgctggtggtgctggcgctgtccatcgtggtgacggcgctgctcggcctggacgcgcgtggggtgagcgtggtgggcaaggtgcaggcggggctcgtcccaccccaggtgccggacgtggggctcggggatttgctgcgcctcctgcccggcgcgagcggaatcgcattggtggccttcgcggaggccattggccccgcgcgcatgctcgccgcgcgtcacggctacgaggtggatgccaaccgtgagctggtcggtctgggcgccgccaacatgggcgccggactcttccagggattctccattggttgcagcctgtccaagtccgcggccaatgacgccgccggggcccgcaccgaggtctcagcgatgctggccgcgggcttcacgctgctggtcgccctgttcctcacgcctctcttccgcctgctgcccgaggccaccctgggcgccatcgtggtggtcgccgtttcggggatgatggacgtgcgggagatgcggcgtctgcaccggatgcggcgggccgacttcctcggggcgctcgtggcgctcgtcggcgtgctcgccctggacgtcctgccgggcctgctggtggcggtgggcgtgtcgctcttcctcacggtgtaccgcgccagcgtgccgcgactgagcgagctgggccgtgtcccgggaacgcttgccttcggcgacgtgcggcacgcgccgcgcccgttgaccgttccgggcatgctcatcctccgccccaacgagggcatcttcttcgccaacgccacggcgctgcgggacgaagtcatgacgcgggtgcggcatgccgggccctccctgcacgcggtgttgttggatatggaggtgacggcggacctggacgtccctggcgcggacatgctcgcggcgctccacgatgacctggcccgtcgacgggtgacgttgatgctgacgcgggtgatggctcccacgggccggatgctggagcgcaccggggtgacggcgaaggtgggcgcggagcatctctacgcgcaggtcctggacgccgtggtggagcatctggcccgcgcctcggcggcgacacccgaggcacaggggttggtgcgcgacggcttgcgacggctgcgcatgctggtggaggaggccagcaccacgctcgatgcggacgagggcgcggaccgcgagcggctccagacgttgggccggcgcctgggccgggccgagtccgcgctgggagaagagaggcctgggccgcactga

SEQ ID NO: 6128 - DNA, 609 bp, Myxococcus xanthus
  unsure (1)..(609): unsure at all n locations
gtgattcaaggcggcgaggtgggctggttcgcgtcggatgaccgcctctcccntgcttcgtgcgaggtggccgaggccctcctgctccgagccatccacacggaccgctggcgggacgaggacgcggacgtcgcgttgggcgtgcgccagttggtggacgtgcccgtcaaggcgctgtcgccgggcatcaacgacccctacaccgtggtggaggcgttggaccagctcactttcttgatgtgcgagctgagccagatgcggctgggcccccgcgtggtgccagacagctccgggcgccctcgcgtcttccttcgcgctccgtcgctgcgcgactacctggacctggtcacggaccagacgcttcgctacggcgccaccgaacccgctgtcgtgctccggctgctgcggctggcgggagccgtgggccagcacgcgcgacaggcagagacgcgccggacggctcgggagaccctgcaccgcgtcctcgcggccacggagcagggtcagaaggacgcctcgtggctcgcgggtatccgccgttacgcggagtcgctggagcaggcgctggaggggaaaccccttcctccgctgcccgcgattgggttctga

SEQ ID NO: 6129 - DNA, 534 bp, Myxococcus xanthus
agcaagccgaagacgcagccgaagaagcccaagaagccggacgccatcgtccagccgaaggagattccgaaggaggtcccgaaggaagtggagccctccgaagagcctcccgctgaagaagaggcgagcgaagaagtcgtcgagggcggcgtggaaggtggcgtggtcggcggcgtcgtcggtggcgtggtcggtggtgtgattggcggcgtggtcggcggccagcttggcgggacgggaaccgacgtgcttccgttcggtgcgggcatgacgcggccggagaagttgtccggtcctcagcccgagtactctcgtgaggcgctcgaggctcgcgtccagggaacgatgatcgtgaagtgcatcgtcaccgtggaaggtcgagtggagaactgccggatcatcaagcccctgccccacatggaccgggccgtcctggacgcgctggcgtcgtcgcgctacaagccggtcacgttccagggccgtcctgtgcaggtggactacaccttcaccctgaacttcaagctgccgcgctga

SEQ ID NO: 6130 - DNA, 669 bp, Myxococcus xanthus
gcagaaatctgggatcacacgggcctcttcgcccgtatgatcatcttcaccctgggcatcatgtccatcgcctcgctggtcgtgttggcggagcgcatgatcgtcttccgcaagacgcggtctgacagccgcaacttcgccgcgaagatgggtgccatcctggccaaaggcgacctgaacacggccgccaacaccaacctgggcaaggatgtgggccacctgggccgggtgatcaactccggactgacggcgtaccggatcagcccgaacaacaaggacgtggcggtggagtcggtggcgcgcgcgctggagcgtcaggcgcagcgtgaggtccagagcatgaagcgcggtctgggcctgctggccacggtcggctccacggcgccgttcgtcggtctgctcggcaccacgatgggtatcgtcaacgccttccagctgatggcgcaggcgggctccggtggtctcggcacgatctccgccggtatcgccgaggcgctcatcaccacggccttcggtctgctcgtggccatccccgcggtgatggcgtacaacttcctgcagggctgggtggacgcgcgctcggtggacatctccgagtcgtccaacgagttcctggacgtggttgcccgccacctgggtggtggcgcgcagtcctcgaacgccgcctga

SEQ ID NO: 6131 - DNA, 362 bp, Myxococcus xanthus
atgtcagcaggccccaaggggagcgtcaagagcgacatcaacgtcacgccgctggtcgacgtggtgctggtactcctcatcatcttcatggtcgtcaccccgatgctccagcgtggcaagtccgtggagctcccgaaggccaccgagatcgagaaggaaggaaaagggaaggaagccgacccgctcatcctctccatcaccccggacaagaaggtgttcgtggagaacgaccaggtggatgagaaagggctccaggagaagctcaccgcggaaatcgagaaggatccaggcaagaagatcctgctcaagggtgataacgcgctcagcgttggtgacgtgcgcaagggtgctggacgtgggcc

SEQ ID NO: 6132 - DNA, 438 bp, Myxococcus xanthus
aaggacccgtggtggacgttcggcatcgactggtacctggcgggtggtgacgtccaggtactggcgctgcggccggggctggagaagcggttctcgctgacacgaaacgtgacgctcggggtgagcgcgttcggcagcgcggcggaggtctcattgcccacggggcagattggtcaggtgcagccaggggagccgggctacacccccattggcgggaacaacttctacgagggccgcatgcgcaagtgggccttcggcgcgggcggactggctgcgatccaggtcaagctgagtcgctacgtgcatgcgcgcgtccatgggggctatacgcgctacttcgaacaggcggacgggctgcagccggctcctgatgcggccgcattcacggtttcgctcgacggcccgttcgcgggggcgttgcttggactggacctctag

SEQ ID NO: 6133 - DNA, 768 bp, Myxococcus xanthus
acggcgtttcacgacgatggccagacggtgacggtgcggttgtcggacggcagctcggtgacgggcgatgcgctggtgggggcggacgggctgcgctcggtggtgcgtggggcgctgctgggcgacgcgccgctgcgctattcgggctacacgagctggcggggcgtgtgcccagacgtcccgagcgcgacgccgggacttgtttcagagacgtgggggcgtggggcgcgcttcggtgtggtgcccattggcttcgggcaaacgtactggttcgccacgcagaatgctccggccggagagcaggatgcccccggggagacacgggcccggttgcagtccctcttcggcgggtggcacgcgcccatcgcggacctgattgccgcgacggacgaagcgaacatcatccgcacggacatccacgaccggccgcctgccagccgctggagccggggccgggtgactttgttgggagacgccgcgcacccgatgacgcccaacatggggcagggcgggtgtcaggccatcgaggatgccgtggtgctggccgagctgctggccggggagggccccgtggacgcggcgctggcggcctacgagcaacgtcggctcgggcgtgccaacagcttcgtgacgcgttcatggagcctggggcgcgtggcccagtgggagagttcagcggggcgcttcattcgtaatgcgctcttccaactcgtgcctcaagggttcgccgcccggcaggtccgagcgttggtgcgcgacgccgagtag

SEQ ID NO: 6134 - DNA, 1104 bp, Myxococcus xanthus
cggaatttgtcttctgtcggcggaacgaagctcggcatctcgaaaactggtgtcccccggcacccctcgtccgaaatcaggtcagtccatgctcctcgacattgcgccctcgtccgcgaattccgctgttgcccctgtttctgcctgggcttcgtcggagcagacgctggagacgctgtcggggctggcgccgcacacgctgctgacgcatgcggacctctacccgcgcatctgcgtgcgggacccctactacgccctcaaggacgtgacggtgatgggggagggcgagttgtggcgcgcatcccagtgcagcaggacccggacgcggaagcgggccccattggcctgggtgaggcggggcggcacctggcgattctgggctcgtgcgcgtccgcgctgatgtcgcccaaggacggccagcacttctacctggcgtgcggcgcgcgcgggcagtggctgcgcccggagcccatggcccgcgccacggacctgctgtgggggctggcgaaggcggagttcaccggccgccgctcggccaccgggcacacgctgctgtcgctgccggacggcacgccgttcttccgcctggaggtggactacaacgtgctgtccgccgccgccttcacgcgcctgttcggcgaggcccgggtggacatgcgccgcgagccgcgccgcgacgacggcatgcagcgcacccccgaggagtgggccaagctgcggcagaacccctacagcaagccgctggcgctgcgcgactggcggccggatggtgagagcctgtcggccacgctggggccggtgacggcggagatgtgcaaggggcacttcgcgttgcacccggtgatgccggtggccgtggtggccagtgggatgacgcgcgtggccaccacgctgcttcgccggctggaaggcgcgccgtgggcccgctgcatggcgaaggacgtgcgcctgaaggcggacaccctggcctacgcgggccagacggtgacgttcggcgccgttcgcagcgcgcacgacggtgacgcgcacaccttcacctgccaggcgtcggtgggcgagcgcgtcgtcgccgaactggacgtcacctatatccgcgtggactga

SEQ ID NO: 6135 - DNA, 726 bp, Myxococcus xanthus
ggtgtgtgtatatgcccatttgcacgcggcggacattgccgcggtcttcacgggagagcgcggcggcgtactatacgttgtggccttgtgtcacgcgggggttctcgccccggttctgctccaagaggtgagaggaggcgccccaccgtgtccaacaagggagagctagaggcccggctcgcgccggtgcaccccggtgattcggtgcgcgggctgttcttcaagtcggtgttcagctttgtccaccagcaggcgggcctggcggcactgaagacagtgcgccagggggcgctgggcgcggcgtacaccgacctgctcacgtacccggcgcgggacttcctgacgctcctctaccgcgcggcggacgcgctggagccgctgctggggcccgaggacgccgtcttccacgcctgcggagagaaggacgtgacgcgcttctccaccgggccaggcatgctcatcttcggaatcatctcccgcggggacccgcagaagctcttcgcgggcgcgcagatgggctacggcgcggccgtcagctacggcagccgcgactacgtgcccaccggccccacctccggcacgctgcacatgcgccgggacatgctgccgcccgcctaccacgagggcatcctcaccggcgcgctgaaggtgctgggcctgcaaggcaccgcgcgcgcgacgccgcgaggcatcgacagcgcggactacgacatccagtgggcttga

SEQ ID NO: 6136 - DNA, 930 bp, Myxococcus xanthus
atggatggccgcgaggtgctgcgcttcgagggcatgtgtgacgcctccggcgcggtggcgctcggcggcagcctgttcgtcgtgggcgacgatgaggacaacatcctccgtgtctacgacgcgcgccggggcggtccacccgtgcagagcgtggacctgtccccggacctggagctgcccgcggcgaagaagaagcccccggaggcggacatcgaggcagccaccgggctgggctcgctgtccttctggctgacgtcccacggccgcaagagctccgggaagaaggcgcccagccggctgcgcttcttcgccaccaaggagacggacgcggggccccggctggtgggccggccgtacacgcaactcctggatgacatgctcgcggcgccccaactggcgcgcttcgggctggacggggcggagacgaaggcgcccaaggcaccgggtgggctcaacatcgagggcatgacggccatggcggatggacgcaccatcctcgtgggcttccgcagccccgtgcccgacgggaaggcgctgctggtgccgctgctcaatccggttgcgttggtggaagagggcgctcgggcccagttgggcgagcccgtgcaactggacctgggcggcttgggcatccgttcgctgtcctggtggcgcggccgctacgtcatcatcagcggtggcacggcgggagagggcacctcgcggctgttcacctggcgcggcggtgaggacgccccggtcgccgtggaatcggtggacctggcgggcctgaacccggaggccttcttcacgccggaggacaccgaggaaatcctgctgctcagcgacgacggcgccgcgcccgtggacggcgttgagtgcaagcggctgaaggacccgtcgcgcaagcgcttccggggcgtctgggtgcggctgccagaatcgccgtga

SEQ ID NO: 6137 - DNA, 174 bp, Myxococcus xanthus
atggactaccagcagctcgcgaagagaatcgtccagcgcgccaagcgcaagggtgctcgccaggcggaggccttccttgaggtgggccgccagagcagcgtgcgcgtgcaccaggggcagattgaagacctcacccagtccaccagcaagggcgtgggcgtgcccgtggtgctc

SEQ ID NO: 6138 - DNA, 1530 bp, Myxococcus xanthus
tgtaggctgtcacataccccatcgtcttcactgcgggagtcccgaaatatgccccgagcgtctgcgccctcgaagcgcgccctctcattgaagctcgccccaccggtggcccggcggcccacgcccgtcgccctgctgccccagccgctggtcgagcgcctgctcgccgtggccatggagcgggggggcgacttcgcggaggtgtacgtcgagcgcacgctcaccacggcggtgcggctggaagaatcccgcatcaagagcgcgcagacgggcctggtccagggcgtgggtgtgcgcgtcatctccggcggcaaggtgggctacgccttctccgacgactgggatgagtccgcgctgctgcgcgcggcctccacggcggtcatgattgcccagggcggcggcgccgagcgcagcttccccgtgcgccgcgccgcggtccccagccactaccacgtcagccccccgctgatggacgtggaggtgtcgctgaagacgggactgctcatgcgcgccgacaaggccgcccgcgccttcgacgcgcgggtgaagcaggtcaacggcggctacgtggaccagacccggcgcatcgccgtggccaacacccacgggcgctacaccgaggacacccaggacctgtgccggatttcggtgatggtggtggcccagggcacgggcggcgagcggcgcaccggcatgtacggcggcggcggacgcgtgcccttcagccactgggacaccttctccccggaggacgtggcccgggaagcggcgcgtcaggcggtggccacgctgggcgcggtggactgcgtggccggcccgcagacggtggtgctggcgccgggctggagcggcatcctcctgcacgaggcggtgggccacggcctggaggcggacttcatccgcaagggcacctcgctgttcgctgggaagctgggtgagaaggtggcgtccgacctggtcaccatcatcgacgacggcaccgtgtccagcgggcgcggctccatcaacatcgacgatgagggcaaccccggcgagcgcaaggtcctcatcgagaacggcgtcctcaagggctacctctacgacagcctgaacgcacagctcatgggccagcgcagcaccggcagcgggcggcgcgagtccttcaagcacctgcccatgccccgcatgacaaataccttcctggccccgggcgaccacgcccccgaggacatcctcaaggaggtgaagcgcggcctgtactgcgccaccttcggcggtgggcaggtggacatcaccaacggcaacttcgtcttcgaggtcagcgaggcctatcaaatcgaggacggcaagctgggccgtcccgtgaagaacgcgacgctcatcggcgtggggccggaggcgctgaagaacgtgtcacgagtgggctgcgaccccatgccggacccaggcatgggcatctgcgggaagaatggccagtccatgcccgtgggcgtggggctgcccaccgtgcgcatcgacaacatcaccgttggcggaaccaaggtcgcctga

SEQ ID NO: 6139 - DNA, 894 bp, Myxococcus xanthus
gtgacgcattcttccctgccgggatacttcgggcccctgttcgccgtgttcctgttcgtgctcggcttgtgcgtgggcagctttctcaacgtcgtcatcgcgcgggttccgctggaccagagcatcgtgcgaccacgctcgcgatgccctcggtgcgggcacgtcctggcgtggtacgagaacatcccgttgctgtcctggcttgcgcttcgggcgcgctgccggggctgcggcgtgcccatctccgtgcgttacccgttggtggaactcctgacagggctcctgttcttcgcgtgcctgcgccgttttggctggacgtacgaattggtgccggcgctggtgctcgtatccttgctggtgccgctcgccttcattgacctggaccattggattctgccgctgtccatgacggtgccgggaatgctggcggggattgccctggcgttccccctggggatggacgccttccgtgatgcgctgatgggtgcggcagtgggcttcctgtccttccggatgatggagtacgtcggatggaaggtgttccagcgagaggcgctgggcgcgggggacaagtacctcgttgccatgctcggagccttcctgacgtggcgcgcgctgctgggcgtcctgttgttcgcgtccatgcagggggccgtggtgggcatcctgatgcttctgtcgacagggcgcgctggacctcgcacggagaacacccaggatgagccggcgggggatgcgcccccgctcacgatgacctgggagttcacgcagccgggcctcccgctctggaagcggttgctgttggttccggtgtgcctgctggtccagcccatccctgatgcgcctttgtaccaagagggtgggttagaacactgggaaagggagcgcgacagc

SEQ ID NO: 6140 - DNA, 783 bp, Myxococcus xanthus
cggggagattcagtaatgggggccttcgctgccatggcgtggaatgggttccgcgaggcgcgtcgcaaccgggtgacggtgctggtcgccgcgttcgccctgctactcctcctggccacgacgctcgtcacggaggtcacggtcagcaccttcgacagggtggtgacggacttcggtcttggggtgatgagcctgctgcttgtcttcctctccgtctacctgtcgtccgggctcatcagccgggaaatcgagcgaaggaccatcttcttgatggtgtccaagccgctgtcgcgaacccggttcttgctggcccggctcgctggcaacatgttgactctgggcgtgttgctggtcgcgatgacgctgctgttctgggtgcagctcgcccttcaccgctcacccatcacccagccgcagctggccgcgctcggagggctctacctggagttgttcgtcctcaccagcgccgggttcctgatgtccactttcgccagccagcttgtctccgcgctggtgacaacggggttgtacttcgcgggtcacctctgctcggacatctacaacctgggggccgcgtcgaaggtggagctcatccaatgggtcagcaaggccacctactacgccctgcccaacctggagcgactgaacttccggccgcgcgcgacctatggcatcgaggtgacggcggtggagctgggctcggccacgctctacgcgctggggtggggagcacttttctgcgtgctggctgcgattgtgttcgagcggcgcgacttccgctga

SEQ ID NO: 6141 - DNA, 741 bp, Myxococcus xanthus
gcgccctggtaccagggcaagggcgcctatggcggcatcgtcgcggggtcgacgctgcgcgcgttggagcacaccctggcgcaggcccagcagccgggccgtcccgtgcgcacgctcaccgtgcacttctgcgcgcccgcggtggagggggaggcggaaatccagacgcgcatcgaacggacggggcggctcgtcacgcacgcgacggcgcgcatcgagagcgccgcgggtgtgctgtgcgtggccaccgccacgttcggcacctcgcgcggcggcgcgacggagtacttcgacgtgaagcgcccggtggtgccgccgccggaagacgtccccgtggtgccggacgacgtgcccatgcccaccttctgcagcttcttcgagtaccgcttctgcgtgggctcggcgccgtactccggcgcggacgtggcggagacgggcggttggcttcgcccgcgtgagcccatggtgctggacgcgccgctgtgcgtggggttgatggacgcctatccgccgtcggtgctctcgcgcgtggatggtttccacgcggcggccagcgtggacttcaccgtgcacttcttccacgacctgccgcgcccgggcctgcgcgaggacgcccacttcctgcgcacggggcgctcacggcaggcggcggagggctactccgaggacttccagcagctgtggacccaggagggtgagttgctggcccagtgccgccagttggtggccgtgctcggttga

SEQ ID NO: 6142 - DNA, 540 bp, Myxococcus xanthus
  unsure (1)..(540): unsure at all n locations
tttccgccttccgggctcacgccntatgaaaacgtgcgggtgttgctgctgggccaggacccctaccacgggccgggacaggcgcatgggctggccttctcggtgaagccgggggtggcgccgccgccctcgctggttaacatgttcaaggagctggagagcgacgtgggcgtgccccgcccgaaggacggctctctgattccctgggcccggcagggtgtgctgctgctcaacgcggtgctgacggtgcggcaggcgaagcccaacagccacgcggggcacggctgggaggacttcacggacgccgtcattcgcgcggtgagcgccaaggacgacccggtggtgttcctgctgtggggccgctacgcgcagaagaagaagaagctcatcgattcgaagcggcacgtcgtcatcgagggcacacacccctcgccgctgtcggccagcaatggcttcttcggcagccgtcccttcagcgccgtgaatgaggcgctggagtcccacggccgtccgcccatcgactggcgcctgtccgcctga

SEQ ID NO: 6143 - DNA, 1323 bp, Myxococcus xanthus
  unsure (1)..(1323): unsure at all n locations
tgaaaggaagctggtgcacaaaccccgncggtggctgggggncgctgtcgcccctggcacgcggtggagctgttccgccacaaccacctgcatggcttcctggtgctgggcggcgtgttcctggtggtgacgggctgtgaggccctctacgcggacatgggccacttcggccgcaagcccatccaactggcgtggttctccatggtgctgccggcgctgatgctcaactacctggggcagggggcgctgctgctgcgcgacgcgagcgccgcgcgcaatcccttcttcctgctggcgccgtcctggctgctgtacccgctggtggcgctggccacggtggcgggcgtcatcgcctcgcaggcgctcatcgcgggggtgttctccctgacgcgccaggcgatgcagctgggctacagcccgcgcatggaggtggtgcacacctcggcggaggagatggggcaaatctacctgcccggtctgaactgggcgctgctggtgggcgtggtggcgctggtgctgggcttccgctcctccagcgcgctggcgtcggcgtacggcatcgcggtgtccacggccatggtcatcaccaccctgatggcctacgtggtggcccgggagctgtggggcgtgcggcggtgggtggccattcccgtggtgggtctgttcctgtccgtggagctggccttctttggcgccaacgcggtgaaggtggcggacggcggctggttcccgctgctgatggctgtcgtcgtcttcacgctgatgacgacgtggaagcgggggcgcgacatcctggcggccaagctgcgcgcgtccagcatccccctgaaggtgctgctgggcagcttcggcgaccaccctccggtgcgggtgccgggcacggccatcttcatgacgggcaacgcggaaggcaccccgcccgcgctgctgcacaacctcaagcacaacaaggtgttgcacgagcaggtggtgctgctgaccatcctctccgaggagctgccgcacgtgccgcacagcgagcgcgtggaggtggagccgctggagcagggcttcgtgcgcgtggtggcgcgctacggcttcatggagaacccgggcatccccgacgtgctgaagcgctgccgcgagaaggggctccagttccaactgatgggcaccagcttcttcctgggacgggagacgctgattcccaccaagcgcccgggcatggccgtgtggcgcgaggcgctgttcgcctggatgagccgcaacgcgcgcagcgccaccgcgtacttccgcatcccgcccaaccgggtggtggagctgggcgcgcaggtggagttgtag

SEQ ID NO: 6144 - DNA, 1905 bp, Myxococcus xanthus
  unsure (1)..(1905): unsure at all n locations
tctgctgccgctggtgaagaagttgtgccaccggctgctcgtcatcgcgggcggcaaggccatggcgctgggcagcctggaagacatccgcgcgcgactgagtggcgcggaaggggagcacgcctcgctggaagagctcttcgtccgaatcaccagctcgggaacccaggcgccgtgagcttccctcgcgcggtggccttcctctgggccgcgacctggcgcaatcgcatccggcggcagttggagcggctgcgcaagccgcgctacctcctgggcgtgctggtaggcgcggcgtatctctattccgtcttcttccggcgtttggacttccgtgggtcggcgggcacggtgcccgaaggtgtgcggttgttcgccgagttgtcgctggtcggctccgcgctggggacattgttcgccgcgtgggcgctgggccgggaccggccgtcgctgaccttctcggagacggaggtggtgcaactcttccccgcgcccgtttctcgtagggccctgctgcaatacaagctggtgcgcgggctcctgggcacgtcgctgggcgcgctgttcgccacgctgttccttgggaggaccatcagcccgcatcccgccctcttcttcgtgggggcgtgtctggccctgggcacgctctatctgcactcgacggcggcgtccttcgtgcgcacgcggctgtcggcatggggcctctggggccaggtggtccgctggggcgcggtgggtggtgtcctggcgctcgtggcgctggcggtgttcacctcgctgcgagagcacccggtacccgaggacctgtcgtcaggccgcgcgcttcgcgggtggttgcaggcgctgacggtgtcacccggcgtggcggccgtgttgtggccgggccggctgctggtggcgcccgcgctggcgcagagcgtgggcgacttcctgtgggccctgccaccggcgttggcgctgatggcggcgcactacggctgggtgctctgggccgaagttccgttcgaggagacggcggtggtgcgcgcggagtcccgctcacgggagcgcatgctgcgggcctcggggcggatgacgcgggtgggctcgctcacgttgagccgccctccattccggctgctgcctcgaggccgaccggaggtggcactcatctggaagaacctgattgcgcgcaagcggatggggggcgggttcgcggtgttcctcgccttcatcatcctgggcggtgccatcgcggcgatgatgggcgacacgcgtctgttcacggacacgcggcgggtgctcgggccggtggcgctggcgttgtcggtgatgctgacggtggtggggccgagcgcgttccgcatggacctgcggatggacctgcccaagctggacctgctgcgcgccatgccactgacagggcggcaggtggtgcgcgctcagttggcggcatcctcgctggcactggcctcgttccagctcgcgctgttggccgtggcgctcgtcctggggcccggcgtggaggcctcgcgcctgggcggctggtggtggcccggagggctggcgctggcgttcctgcttccggccgtgtcgctgtcgggcctcttcgtgcagaacgcggcggtggtcctctttccctcgtgggtaccggcagacacaggcgagcgggcacgcggcatcgaggcgatgggccagcgcctgctggccgtcgtgggcacgctggtggtgatgctggtggggttgattcccgcggggctggtggcgctcgtggtgggcctccctgtgtcgacgctgttgggcccctgggccctgcccgtggcgggcttcgtcacggcgggggtgttggtgggaaaggtgtgnctgggcgtcatggcgctgggccacgccttcgagcgtctggatgtctccgaggaccggccagaatag

SEQ ID NO: 6145 - DNA, 765 bp, Myxococcus xanthus
atgcagctggccattccgcatgctccccggcaggtccgactgacgcaggtgcccggcgccgtggggcgcgtggtacgaggcgtcctcctgggactggtggccgtggcgttcctgggcaccggcgccggctgggctggacgctacttcgtcgaagagcagggcttcgccgcgcgggcggaggaagtggaggggctggtggtggcctcccgccttccccccctggacgcccgggatggcgcggaagccaccctggaggtgctctacaccttcgcggaggcggagcactccgtgtccggcatccggaccttcgcggagtacgccgagggcctggggcggggcgctcgggtgacactgctggtggaccccgcgatgccggaccggccgcgcgaggccggcttcgcccgctcccgcgcgatgcgcgtggggctgctcccctggggcatcggactgggcgtgctggtggccgtggggtacttcgcgtgggagatgcggcgcctgtggcgctcggaggtggaccccctccggctgggcgcgctggtgtggctgacgccggacgggcccctgctggaggcccggagcgaggtgtcctttccggcccactatttccggcaggacgtgaagcacgcggttcgcgcccgggtccggccggggcgggcgcccgtgcgcaacggggagaaggtgctggccgcggtggtgccccggcagcctgggtgggcgcgcgtcatcgaccaggacctcgcgggggtgctggggtggctgcgctga

SEQ ID NO: 6146 - DNA, 657 bp, Myxococcus xanthus
atgaaggtgggattcattggcctgggcaacatgggactgcccatggcggcgagcctagcggccgcggggcacgagctgacggtgtggaaccgcaccgagtccaaggccgcgccgttgaaagagaagggggcgcgggtcgcccgcagccccgcggaggcggctcgaggcgcggaggtcgtcttcagcatgctggcggacgatgcggccgtgacatccgcggtgttcggccaggacggcctcctggcgggactggcgccgggcgcggtgcacgtctcgtcgagcacgctctccgtggcgctttccgaacggttggcggaggcgcatgcgagcgccggccagcggtatctcgccgcgccggtgttcggccgccctaccgccgcggcgtcgaagcagctgtgggtggtggccgccggtccgaagcaggacatggaccgctgccgtccgctgctggagacgctggggcgcggcctcaccgtgctgggtgaccgtgccccggcggccaacgtcgtgaagttgtcgggcaacttcctcatcgcgtcgatgatggaggcgctcgccgagtccttcgccctgacgcgcaagtccggcatcgagccgaaggtgttcctggaggtcttccagtccgtcttcgcgcgcgcacccatcttcgaggggtac

SEQ ID NO: 6147 - DNA, 1509 bp, Myxococcus xanthus
gcttctcggaatctaggagcccccacctttcgtcacgagggagcaccccgtcgcatggcccaggcacccgccgcgcagagcaacaagttcccgccgcaaatccccttcatcatcggtaacgaggcgtgtgagcgcttcagcttctacgggatgcggaacatcctcacggtgttcctcatcgactacctgctgcgcacgcagataccggacaacgcgctgcgggaggccgaagcgaagagcttgatgcacacgttcatggcgggcgtgtacttcttcccgctcatcggcggctacctggcggaccggttcttcgggaagtaccgcatcatcctggggctgagcctggtgtactgcctgggccacgcgtgcctcgccatcttcgagaacaacgtcacggggttcttcacgggcctggcgctcatcgccattggcagtggcggaatcaagccctgcgtggcggccatggtgggggaccagttcaatgagtccaacagccacctggtgaagaaggtcttcgccatcttctactggaccatcaacttcggctcgttcttcgcgtcgttgttcatccccctgctgctcaagcacttcgggccgtcggtggccttcggcatccccggggtgctgatgttcatcgcgacgttcatcttctgggcgggccgtcacaagtacgtccgggtgccggccacgggcgccaacccgcacagcttcttcaaggtggtggccagcgcactgcgcaaccgcggccagggcggcggctggctggacggcgcgaagcgggagcaccccgaggaggccgtggacggcgtgaaggcggtgttccgggtgagcgcgctgctgctccccttcgtgcccttcttctggatgctcttcgaccagaaggcgtccacgtgggtggtgcaggcccggtccatggacccgcaggtggggccgttcaccttccaggccagccagatgcagttcatcaacccgctgctggtgatgattctcatccccttcctgacggccgtcgtctacccagccttccagcgcttcggctgggagctgacgccgctgcggcgcatgcccctgggcctggtggtgggcgcgctgtcgttcatcatcgccggcatcttccaggtcacgatggaaggcggcacgacgctgaacatcgcgtggcagattctgccgtacatcgtgctgacgctgggcgaaatcctgatgtccaccacgggcctggagttcgcgtacacgcaggccccgcgtgagatgaagggcaccatccagagcgtgtggctggtgacgaacacgctggccaacgcggcggtggccatcaccgcgaagctcaacgtcttcacgggctccgggcagttcttcttctacgccggcttcgccctggtggccgcagtgggaatggccctggtggcccgccgctacgtggtgcgtgactactaccagacgtccgcgcccatccccaccgaggagcgctccgctgccggcgtgacgcccggctcggcgaagtccgcgtag

SEQ ID NO: 6148 - DNA, 453 bp, Myxococcus xanthus
  unsure (1)..(453): unsure at all n locations
atcccggtgaagatgagcatgggcctgctgttcctctccgccggcttcctcttcatgctgggcgcctccagcgagagcgcctcgacgggcaagccgncggcgtggtgggtggtgatggcctacctgctgcacaccatgggtgagctgtgcctgtcgcccgtgggcctgtccatggtgaccaaggtggcgccggcgcgcatcgtttccgcgatgatgggcgtgtggttcctcgcgaacgcggcggccaacaagctggccggtgtcttcggtggctactcggagaagctgggcgagttcagcgtgttcctctacatctccgtgggaacgggcatcgccggcgtgctgctgctcgtcgtgtcgcccatcctcaagcggatgatgcacggcacggacgaggtgaagcccgccgcgcccacctccgcgcagcagggcggctcggtggcggcggcctga

SEQ ID NO: 6149 - DNA, 528 bp, Myxococcus xanthus
  unsure (1)..(528): unsure at all n locations
gtcgcccaggtcctccgtgacatctccctcctgctccagctccagggagaaagcgggttccgcgtccgcgcctatgacatggcggcggaccgcatcgccgggcttccccaggagctgggccccctggtcgcggaaggccggctggagagcctcccaggcatcggccgcgcgctcgccgagaaaatctccgagctggtgtccaccggccggctcggctacctggaggagctgcgggcttagtttcctcctgggctgctggagctgacgcagttgcccgacgtggggccgaagaaggtggccacgctctggcgtgagctccaggtgagcagcatcgaggagttggagcgggcctgccgtgagggccgcgtgcggcaggtccgcggcttcggcgcgaagagcgaagcgaagatgctggaaggcatccgcctgtaccgncgcgcgcgcggggagcgcaagctgctgggcgaggtactgccggtggccacngcgctgctggagcgggtgaaggccgcgccnggcgtggtgcgc

SEQ ID NO: 6150 - DNA, 492 bp, Myxococcus xanthus
atggcacacgaccacgaccacgaccacgaccatgggcctcacgggcaccatcatcatgaccacgggcctcatgggcaccacggtcatgaccacgaccacacgcatcatcaccacgaccaccatcatcatcacccgcacggccacgaccacggcccggcggaggagcacaaggcgcgagcgccggtgcatgtcagcaccttcatcgtgacgtgctcggacagccgcgacgcggcgcgcgatgagagtggccaggtcctgcgcgagggcctggaggcggcgggccacggcattgctggcaccctcgtggtgaaggatgacccggaagccattcgcggcgcgctggattccgcgcgcgaggcgggggcccgggccgtgttgttcaccggaggcaccgggattggccggcgcgactgcacggtggagacgttgcgtccgctgttcgagaaggaactgccagggtttggtgaacttttgcggatgctgtcctaccga

SEQ ID NO: 6151 - DNA, 318 bp, Myxococcus xanthus
atgacgaagatcaagctgggaccggcggacttcgccgagagggaaatgcggggctacgaggtcggcaagcgcaacgtgtgtatcgcgaagatccacgggcgctacaagggcctggatgactggtgcaaccacgccgggtgtctgctgtccggcggtcgcatcgaggacaacatggtcgtctgcccgtgccatgaggtcggtttcgacatggacaccgggcgcaacgcgacctcgccgggggtctgtgacgaccagccgacggtgcaggtcgcggtcgaagacggctcgctcgtcatcgattggcccgacacgccctga

SEQ ID NO: 6152 - DNA, 1068 bp, Myxococcus xanthus
atggaaatcatccgtcagcagaacgaggacctggaccggctggcccaggagctggcggtggccaagcgcaacgaggaggagcgcgcccgggaagccgaagccgccgcccgcctcaagagcgagttcctggccaacttcagccacgaaatccgcaccccactcaacggcatcatcggctactgcgacctgctgatgcgcgaggagggccaacggctgacggcgcacggccgccgcgacctcaacgtcgtgaagacgaacgccaagacgctgctggcgctcatcaacgacatcctggacctgtccaagattgagtccggccgcgtggaggtcgtcaccgagcaggtggacgtgcaggagctggccgaggagtgcctggccacggtgaaggagtacctcaagggcaaggacgtggccctcaccaccaacatcgacccgtccgcccgcatgctccgctcggacgcgctgaagctgcggcagatcatgctcaacctgctcagcaacgccgccaagttcaccgacgcgggcgaggtggcgctgagcctggtgcccgcgggcagcgaagtcatcatgacggtggaggacaccggcgtcggaatcccctccgacgagctgcccttcatcttcgagaagttccgccaggtggacggctccaccacgcgcaaggtgggcggcaccggcctggggctggccatcgtccgcgagctgtcccgcgtgctgggtggcaatgtcaccgtgacgtccacgctgggccgcggcaccaccttcacggtgcgcctgcccaccacgctggagacgccggacaacggcggcgggccgcacctggagcgcggcgtgcccgtgtcggaagtggcccagcacgtgggcaccatggcccagccgggcagcacggtgctggtggtggacgacgacccgctcatccagcagctggtggccggacaactggagcccgccggcttcaaggtggtggtggccgaggacggcatcgccgccctcaagcgggcccgcgagctgcggccccaggccatcctgctggacatccacctgcccaagctggacggctggtcggtg

SEQ ID NO: 6153 - DNA, 609 bp, Myxococcus xanthus
aagggcgtggacggcctgaacccggtggagcacgccatcctccccgaccgcatcgaggccggcaccctgctggtggcggcggccatctccggcggcgacgtgctggtgaagcgcgtggtgcccgagcacatggacgcgctggtggagaagctgcgcgaggccgggtgcacgattaccaccgagggcagcggcctgcgctgcaaggcgccccagcggctggacgcggtgaacatcaccaccacggagcatccggggttccccacggacatgcaggcccagctgatggccctcatgtcggtcagtcaggggacgtccgtcatcagcgagaacatcttcgagaaccgcttcatgcacgtgccggagctgcaccggctgggcgcggacatcaccatccaggggcccaccgcggtggtgaagggtgtgaagggcctgagcggcgcgcccgtcatggcaacggacttgagggcgagtgcgtcactcatcctggccgggctgcgagcggagggccgcaccgacgtcagtcgcgtctaccacctggaccggggctatgagcgcctggagcgcaagttgagcgccctgggtgcggacatccgccgcgagaaggcgtag

SEQ ID NO: 6154 - DNA, 1800 bp, Myxococcus xanthus
atgcactcgcgcctcgtcatcgtgctgcccgtgctgctgctgctcgtcccgagcgcggtgggggccgccaagcgagacgaggccgaggaggcctatcagggtgctcgcaaggtctactacgcgctgaaggacgacgcggcccggcgcaagctgcgtcatcactggctgaacgtggtggcgcgcttcgagtccgtggccgcgcgcttcccgaagtcggaccgcgcgccggatgccctgttcacggcggcggagatgctccaggagctgagccgcatctccttcgtggaggacgacctcaaggcctccatcaccgactacaccaagctgctggagggctacccgaagcaccggctgtcggatgacggtgcgctggcgctcgcgaagattcacgtccaccggctggaccagccggagtccgcgcgcaaggtcctgacggagacgctggccgtcaacagcaagggtgaccgggctcgggagatgcgggagctgctggcctcgctgccgtcgcccaaggccccgccgccgccccctcgcaaggccgcgcctgtcgtggcgaagagtgattcctccgcgtcgggcaagacgagcaccgctggcaaagcgaccgccatggccgactccggcaagagctccgcgtcggtggatgcctccgccaagggctccgtgtcgagcaaggccgtcgcttcggcggagacgtccgcgtccgggaagggctccgccccggacgatacctccagcgcgggcaccagcgacacgtccaaggccgttgcctcgaccgacacgtccaaggacgcgcagccggcgccggccgtggaggcgtcggggcccgcggagcggccttcgtccagcctggtggccgccatcgagaagatggcgcgcgagccgtcgcccaggattccccagaaggagccgagcgcgcccgtgaaggaggacgcgcgcgaaggcagcctggacgcggccgtcgccgccgccatggcctcgaagcccgctgccgcggagccgccgcgtcccatcacccgtccggtggacgacaaggtggcgcaggcccggctgaaggccgtggccaagcagtcgcgcagcatggagctgacgctggcggagcagctcggcctgaaggtgcggcgcgtggtcatcgatcccggccacggcggtcacgacacgggcgccatcggcaagggggggacgcgcgagaaggacgtggcgctgtccatctccctcaagctggcggaggagctgcgtgagaagggcctggaggtggtgctcacccgcgacgatgaccggttcatccgcctggaggaccgcgccaagtacgccaacgccgagcacggtgacctgttcatctccgtccactgcaacgccgcggagaagcgcacgctgcgtggcatcgagacgtacaccctcaacacgtcggcggaccgctactccatccgcctggccgcgcgggagaacgcgtcctcggagaagggcatcagcgacctccagttcatcctggccgacctggccaccaaggcgaacacggaggagtcgacgcggctcgccacccaggtgcagcgcagcctcgtggggggcctctcccgcaagtacaagggcatccgcgacctgggccacaaggaagcgctcttctatgtgttgttgggcgtgaagatgccggccatcctggtggagacttcgttcctctccaatccagacgaagaggcacgtctcaagtccaatgtctaccagaccgaggtcgccaaggcgattgcccatggcgtggaggagttcctcggagaccgccgccgcgtggcgaaggtggactga

SEQ ID NO: 6155 - DNA, 390 bp, Myxococcus xanthus
atggattgccccagctgcaacgtcgagatgtccgatctcgagggggatgatcagacgttgcgaaagtgtggagattgcggcggcctttggattgacgtcgcggacctcaaccgggtcctgctccacaacaacctccccgggctggagagccagggcggcaaggtggatgcggaggcactgaccggtcagtgccccgagtgccaggtcgacctcgtccgcgtggacggtggcgaccgccaacatccgctgcattacgacacctgcgagtcctgcggcggcatcttcctggaatccgaattccaggacgccaccgacgtgaaggtcgcggtcgaggaaatcatcgcgttcttccgccacttcggcgcgaagcggaagatggccgctctgtag

SEQ ID NO: 6156 - DNA, 600 bp, Myxococcus xanthus
cggccacgtacggcatgcactccacccagaccaatggctgccgcccgggcgcggaagctcaccctgaccggcatcaaggaagcacgcagcgtccgcgtggaggacaagcgcgggctccaggtggtgcccctcaagcccggacttcggggcgcccgcttcacgctggaggtgtcggagcgcttcccgggcgccaaggacgacgcgcccgtgtgcgtcaccgacatcgtcttctacgctggcgggaaggccctcaatggcacctggctggcgcccaagctgcgctacaacggccggctggcgccgctgctcggcacctggttcggtggcctgaagggggcaccgcaccgcttcctgtccttctacctggacggaacctacagcctcaccgaggagcccctggagggtgaggtgtccacgacagtcagtggcgcctacacgctgtccggagagaagctgtccctggacgtccccccgcacgggcgggtgacggtgcgcttcccgcgaggggactccgaggggacacgcccgccggatgcgtcactggcgttcgacgggcccgtcgccgaggcctggggcgaggagttccgcagccagcggtga

SEQ ID NO: 6157 - DNA, 606 bp, Myxococcus xanthus
  unsure (1)..(606): unsure at all n locations
tcaagaggaggactggccttcgaccctggcggcgcgcgccggggggggcctcaggggacgcgggggcaccccgggctccacttcgtgcgcctctccgcagcggaagggcaccggcacttcctggagcgtgccctgcccgcgcgctggctggccgacgccgcgctgcgcacccgcgccctgcgccgcttcctggaagcagggcccgcgctccgggagatggggctgatgtaccagttgctggccctgctccggcgcacgcggccggatggacgcttcgtccatccgctgaccgtcgtcgacctgcccgccacgggacacgcgctggcgctggccgccttgccccagcgcgtgctgtccctgatgcccggagggcccatcggacgcgacgtgcgggaggggctcgacttcctccaggatgcggcgcgcaccgcgatggtcctcgccagcctgccggagccgctgcccgtcagcgaggcgctcaccgtggccgccgagctgcgccggctggagctgccgctgtccgcggccgtcctcaaccggatgccggaggaccccttcacgcccgagtcccgcgcccgcctgcaccggatgctcgccgngcacgga

SEQ ID NO: 6158 - DNA, 412 bp, Myxococcus xanthus; identical to SEQ ID NO: 30

SEQ ID NO: 6159 - DNA, 1444 bp, Myxococcus xanthus
acgcccgtgctcgtcaccgaggacgcggtggcggacacgctgcccgtctcgcaggcgctcgtgttgtgcctggactccgaatgggagcgcgccgccgggcgtgagtcggacgcgccgctcgaatccgtctcttcggcggaggacctcgcctacctcatctacacctcaggcagcaccgggcgccccaagggcgtcctagtggagcaccggggcgtggtgaactacctgcactgggcccggaaggcgtatgccgtcgacgacggcgcgggcgcccccgttcattcctcactggccttcgacctcactgtcaccagcctgctgctgccgctcaccgcgggcaggcccgtgacgctcgttccggaagaggacggcgtggaaggcctggccaccgcgctccgcacgagcgcggacttcagcctggtgaagctgacgcctgcccacttgcagatgctggccgcgcagcttccgcccgaggcgcgcgcgggccatacccgcgccttcgtcatcggtggcgaggcgcttacctccgccaccgtggagccctggcggcagcacgcgccgagcacgcggctcatcaacgagtacggccccacggagacggtggtgggctgctgcgtccacaccgtggaggcggacacgccggtggaaggcgcggtgcccattggccgccccatcgccaacacgcgcctctatgtcctggacgccgccctcaggccggtgcccgcgggtgtccctggcgagctctacatcggaggcgaaggcgttgcgcgtgggtattggcgccggcccgagctcaccgccgagcgcttcgtgccggacccattctcctccgttccgggtgcgcggatgtaccgcacgggcgaccgggtgcgtctgcggccgtcggacgtgctggagtacctgggccgcgtggacttccaggtgaaggtgcgtggccaccgcgtggagccgggcgaggtggaagccgcgctcatcgagctgccgggggtcgcttccgcggtggtggtcctccgtgaggacggccccgggcccccggctggtgggctacgtcaccggccacgacgcgatgccagagacggagcccctgcgcgcatcactggcacagcggctgccttgacacatggggcgatctgcgctccctggtctggctcaacttgcgttaagggcaaaagcacatgtggaccggcaagcactagctgcgccagatgcccccggggcgtctgacgaagacttcggaacagcgtgtacttgcaccgattacgggctgcctcagttttgtgaagaactgctgcgcatacgcccagttggaggccggcatgatttcttacaactgagaggtgaatccctgctaacaggccacctgacttcgtgtgcccgacagcggctgggagccacagctaaccgggaatcccctatgcgctcaacgcacaacatggcggcgcta

SEQ ID NO: 6160 - DNA, 1502 bp, Myxococcus xanthus
ggccgcgcccgaagccaacgcgcccgaggccgccctcccgcccgcggagtccgcggcgggtgcgtccgacgaggagctggccctggctccgctgacgcgccccaccgtgaagccggtgcgcttcctcatcgtcagcgaccccatgggcgcgcgcgtgacgtaccaggggaaggacctgggcgagacgcccctgaacctcgaggtggctccgaatgccagcggcgtcgcggaagcgacgctgaccttcaccctggacggctaccagcgcgcccgcgccgtcgccaggggcgcgggccccgaagagcgcttcacgcagaagctccagcccaagaagaaggcgagcacgcggcctggaaaggccccagactcgtcgccctacaaggacgacccgtacaattgaaaaccctgacagccttcaaacgagcgggcctcctcgcgatgtgtctgtgcgcgggggaagccctggcggacgcccgccttgaggcccggcgccacttccgcagcggcatgagcctcatcgcccagaagcagtacgacgcgggcatcgccgagctcgaagccgcctacgccatcaagccgcaccccaacgtcctcttcaacatcgcccgcgcctaccaggactcgggccggtcgaaggcggcgctggaggtgtaccagcgctacctcgccagcaatccgccggacgcagcctccgtgctgcccatggtggccgcgctggaggaaaagctgaaggccgaggaagcacaggccaccgccgcgcaggacccgtcgtcgctgcccatgccgccgccccccgcgggcacgcagtcgcagcagcaactgagcgcgctgctggagcggctggagaaggccattgaacgggccgaggccatgcccgtggggagcgccaccattcccggcctgacgcccagcggcgtcgcctccgccagctcggacgacgcggtcggcggcgtggacctgggcgcagtgccctacgaagagcgcgtggtgacggcgagccgccgcgcgcagtcctcgctggacgcgcccaacgccaccaccgtcatcaccgccgaggacatccgcctgtcgggcgccacgtcgctgccggagctgctgcggcgcgtgcccggcgcggacgtcatggccctgggcgtgggcagcgccaacgtgtcgctgcgtggcttcaaccaacgcatcgccaacaaggtgctggtgctggtggacggccgcacggagtaccaggacttcctgggcctcaccatctggtcctccatccccatcagcttggaggagattgagcgcatcgaggtcatccgcggcccgggcagcgcgctgtacggcgccaacgccatgctcggcgtggtcaacatcatcacccgcgcgcccggcaccggaccgcgcgcgcagttcaacgtcaccggcggcaccggtcacaccgccgcgggctccttcgtcagccacggcggctcgggcacgatgcgctaccgggcggcggcgggctattcgcagacggacaagtg

SEQ ID NO: 6161 - DNA, 1293 bp, Myxococcus xanthus
atcacctcgctggcgccgctggtgcacgcggtgaagggcgcggtggtcaacgtgaaggtgcgcgcacggccccgcaggtcagccgccatgcagcgcctgccacccggcatggcggagcgcttcggcctgccgcccgggttcggcggtgaaggcaacggcccggcgcgacagggcgcgggctccggcttcatcatcgacgcctcgggcatcgtcctcaccaacaaccacgtggtggaggacgccgaccaggtgcgcgtgaagctggatgacggacgtgccttcgacgcggaggtgatgggccgcgacccgctcaccgacgtggccctgctgaagctgaagggggcgccgggcaacctgccggcggtgccgctgggggactcggacgcgctgcgcgtgggcgacgccgtcatggccattggcaatcccttcggcctggcgtccagcgtgagcgcgggcatcctctccgcgcgggcccgcgacatccaggcgggcccctatgacgaattcctccagacggacgccgccatcaaccccggcaactccggcgggccgctcttcaacatgcagggcgaggtggtgggcatgaacaccgccatcgtcggcggcgccacgggcatcggcttcgcggtgcccagcaagctcatccaggcgctgctgccgcagctcaaggagacgggcgtggtgcgtcgcggctggctgggcctggccgtacaggacctcacgccggacctggcgcgggcgctgggcctggaagcgatgaagggcgcggtggtggcgggcgtcaaccgcggcagcccgggtgagcgcgccggcctgcgcgaggaggacgtcatcacctccgtcaacggcaagccggtggagtccgcgggcggactgacgcgcgccgtggccctgctccagcccgacagccgcgtgaaggtgaacctgctgcgcggtggcaaggcgcagtcgctggacgtcaccctgggcacgcggcccgcgcagaatggcgagcaagaggtacttccgcgcaacgcttccgcttccgcgccgaggcggctgggcgtgcaactgtcggacgcgcgggacggcggcgcgcaggtagtcgccgtggagccgggcagccccgccgagcgcgggggactggtgccaggcatggtgctggtccaggtgggcgaccagaaaatcgccagcgtgtcggacgccgcccaggcgctgacggccgcgaagcccggcgccgcactgctcctgcgcgtgcgcatgccggggtcggagtccacgctgctgcgcgcggtggaagtcccggagcgctga

SEQ ID NO: 6162 - DNA, 387 bp, Myxococcus xanthus
acgctgaacttcggcacgtacgatcccatcatcgtcaactccgcgctgggcatcgacctgttcggcacgggcacgctgagcgtgcagtgcaccctgctcggcaccgcggtcatcaccctgggccagggcctgcacccggcctcgggctcgacggacgcggccccgcagcgccggatgcgcaacacggcgtcggcggactaccttgcgtacggcctgaaccaggacgtcacccgcctcatcgggtggggtaacaccgcgggctccggcctgccgttcctgggcacgggcctgcccgtccccgtgctggtctacggcacggttccgcgcggtcagaacgttccctctggcacgtacaacgacaccgtcgtcgccaccatcaccttctga

SEQ ID NO: 6163 - DNA, 2026 bp, Myxococcus xanthus
cccatgacgctgcgagcccggttgttgttggcgcaggcacccctggccctggcgctgttgttggtgggcgtggtgaccgtggtgacgttgtcccaactggggcgttctgggcctcgggtgcttcaggacaactaccgcagtgtgctggccgcgcaggagatgatggcgcagttggagcgcatggacagcggggcgctcttcatcatcgcgggtgagcggcagcgcgggctgacgcagcaggcggcgcagcgcgcgcgcttggagtcgcagttgcgggtgcaggaaggcaacgtcaccgagcccgccgaggatgcggcgacgctccggttgcgcacgtcctggcggcgttaccaggaggcctatgacgggttcctcgcccagtcgtcgccggagggggcgcgggaggcgtacttcggtgttctcgagccggccttccaggaggtgaccggagcggcccgggccatcctggacctgaaccaggacgccatggtgcgcaagagcgaggcgttgcagcggcagagcgcgcgggtgaacacggtgatggtggcggcggtgatggtggccttcgtggtggggttgttcgcgtcgcagtcgctgacgcaccgggcgctccgtccggtgtcggtgctgtcacaggcggtgcggcgcctgggcgagggcgactacgcggcgcgcgcggtggtggagggacaggacgaaatcgcgcaggtggggcgggacttcaacgccatggcggaggcgcttcagcagtaccggcgcagcagcctgggtgagttgctccaggcgcaggcggcatcacaggcggccatcgacagcctgccggacccggtggtggtgttcggcgcggacggagggctgctcaacgtcaaccgcgcggcggaggacgtgctgcggctgtcgctcgaagcgggcggggacatgctggggcaggtggtgccggaggcgcgcgcggtgctggagcgggtgcgtgagcacgtgttgacggggcgaggggcgtatcagccgcgcgggtacgaagaggcggtgcgggcgccgctcccggacggggaccggtggctgctggctcggggaagtccggtgcatggcgagtcaggggaggtggtgggggccacggtgattctccaggacgtgacgcggctgcggcgcttcgacgagctgaagaacgacctggtggccacggtggcgcacgagttccgcacgccgctcacgtcgctgcgcatggcgctgcacctggtgacggagggcgtggtggggccggtgacggagaagcaggcggacctgttgttcgcggcgcgcgaggactccgagcggctgcagggcatcgtggatgacctgctggacctgtcgcgcatccaggcggggcagcttcagttggagattcgccgggtgccggcggaggaactggtggacgcggcgctggacgctcagcggatggcggcggaggagcgcggggtccaggtgtcgaagcaggtggggctggacgtggagccggtggacgtggacccggagcggctggggttggtgctggggaacctggtgggcaacgcggtgaagcacacgcccccgggaggcgaggtggaggtgcacgtgtggcaggaatcgcacggggtgcgcttcgaggtgcgcgacacgggggaggggattgccttggagcaacaggcgcgcatcttcgagaagttctaccgggcacccggcgcgcctgcgggaggcgcggggctggggctgtccatcgcgaaggacatcgtccaggcacacggcggggacattggcgtggtgagtacccccggccagggaagcacgttcttggtcacgctgccccgcggaaaaggtcggccgcgagcgtgtgacgcgaagtcgtcgtcagcatcgagacacccaaggggagtcagagcctctgtacgtgcggctggcctgaaagcagactcaacgctggaatactggcgctatcgcgtgtctatctgcgccccagtcaaggcgggtccgcgtagggatgaggcgttacagaccctccacgttcaggcctcag

SEQ ID NO: 6164 - DNA, 2037 bp, Myxococcus xanthus
ggtcaggccaagcagtaccccatggcgccgggccgcacgggcatccccgagcggcgtgagtacaaggtggtcccggaccacctgggccgtggccgcgaactggtggacgtctccaagaacaaggagcgtggccagcgcaagcgcaccagcggtgatacgcagagcgtgtccaagcaggaactgacggacatggtctggggccgcgtcaccatccccatccgtggcaagaagcgcaagcccacgaagaagggcgccaagacgcagatcacccagatggccgaggagaagaaggtcatcaagctgcaggagggcatctccgtgtccgacctgggccagcgcatgggtgtgcgcagcgccgagctcatcaagaagctgatgggcctggggaagatggccaccgcgaaccagttggtggacgcggacacggcggagatgatcgccggcgactacggctggaagatcgaccgcgtgggcttcgaggtggaggactacctgcccgaggtggagacccgtcccgaggacgagcgtccccgtccgccggtcgtcgccatcatgggccacgtcgaccacggcaagacgagcctcctggacgccatccggaaggccagcgtcgcgcagggcgaggcgggtggcatcacccagcacatcggcgcgtacagcatcaccaccgcgcgcggtgacgtgacgttcctcgacacgccgggccacgaggccttcacgtccatgcgcgcccgtggcgccgacgtgacggacatcgtggtgctggtggtggcctcggacgacggcgtgatgccccagacggtggaggccatcaagcacgcgaaggcggcggaggtgcccatcgtcgtcgccatcaacaagatggacctgccgaccgcgaacctggaccgcgtgaagaaggacctggccacccacgaactcgtgccggaagagtggggcggggacaccatcatggtgcccgtctccgcgaagacgaaggagaacctggaactcctgctggagaacctggccctccaggccgaggtgctcgagctggcctccaacccgctccgtccgtcggtgggcgccatcatcgaggccaagctggaccgcggccgtggccccgtcgccacggtgctggtgcaggaaggcacgctgaagctgggtgacgccgtcgtcaccggctcgcactacggccgcgtccgcgcgatgacgaacagccgcggcgagcaggtgaaggaagtgaagccgggctactgcgccgaggtcgtcggcctgtccggcgtgccgggcgcgggtgacgccatcaacgtggtggcggacgagaaggcggccaagcagatcgccgagcaccgcaacatgaaggagcggcagaccgagctgtcgaaggtcagccgcgagtccctggagcagctgttcgccaagacgaaggcgggcggtggtcccaaggagctgcgcgtcgtcatcaaggcggacgtgcagggctcggccgaggccgtcaagcaggccgtccagaagctctccacccacaaggtcaaggtggaggtggtccactgccgtgtgggcgccatcaccgagggcgacgtgatgcgggcggcggcctccaagggcgtcgtgctgggcttcaacgtcaacccggagtccggggcggaggccgcggccaaggcccaggaagtggtgctcaagagctactccatcatctacgagctcatcgacggggttcgtacggagatggagggcctgctggagcccatccgcaccgagcgcaagctgggtcgcgcggaggtgcgcaacaccttcaacgtgccgcgtgtgggcaccatcgccggtgcggcggtgctggatggcgtcatgaagcgcggcgccatcgtccgcctcatgcgcgagaacaagcagctgttctccgggaagatggcgtcgctgcggcgcttcaaggacgacgtcaaggaagtcgcgcagggcttcgagtgcggtatcggcatcgagagcttcaacgacctcaagcccggtgacatcatcgaggcgtacgagatcgtagagactcggcagagcctcacc

SEQ ID NO: 6165 - DNA, 1098 bp, Myxococcus xanthus
ttccacgtggccggctttcccgtccggctccatccgctcttcttcgtcgtcgcattgatgacgggctggacgctcatctccgagcccgcgcggctcgcgttgtgggtgggcatcgtcttcgtgtcggtgctgctccatgaactggggcatgcgctggccttccgccgctacggctgtcccgctcgaatcgagctgcacggaatgggcggcaccacccagacccacgacgccgcgcacctcactcaccagcagtcggccttcgtgagcttcgccgggccgggcatcggcttcctggcgggagggctcatctggggtctgtcgcagctcgttcccctgggtgagccgggcggactggcggaccagggcgtgcggcagttcctgtgggtcaacatcggctgggggctcttcaacctgctgcccatgcagccgctggacggtggacatctgctggcggacctggtgcgcgcccgcagcggctaccgccacgaacggggggtgctcggcgtgggcatcgccacggcggtggtggtgctggggctggccatctggtcgaagcagctgtggatggggatgctggcgatggtgctgggggtgatgaacctcgagcagctccgccgcacgccgaagcggcgccccgccgagcggcggttcgccctcccccgcctggtccgcaagcccgaggcggcaccggcgggcgccatctccatcgagcagttgatggacgagctgcgcggaacgccccgccccccaggcgcggccgatgcagatgatgacctggagggccctcatgatccggccctggtgggcgagatgctcctggacaacgggctgccggagctggccgtgggctcgctccaatccgccttcacgcaggcgcccctggcgcgcaccggccatgccctggtgctggcgctgctgcacaccgggcggctccaggaactggcctcgctgctggacagctcgcacgcccggcagctgtccgaggacacgctggccctcatctccgaacacgccgggacggtcagtgaggccccactcaccgagcggattaccgcgctgcggcacgggcggactacaggcacggatgagccccgctga

SEQ ID NO: 6166 - DNA, 372 bp, Myxococcus xanthus
atgccccctccggccctgaccctcgtcgcccctacgccgtcgcgccgtgcggacccggtccgggtggcggtggaacagctcgcccgctcactgcctgcgcgcactgacgcggctgtgctcctggacctgctggaggatgacctccgtgagggattggatgcgcttggcgaggtggaggcccatttcacggacctgctcgacacgcttcgcacggaagcggtgacaccggccgcgctggtggaatcgggtgatgacctgcgcgtccttcaacagttggattcactccacgacgccgtcgtgcggctgcgcaagcgcctgtcccaggccgcgagcatgaatcggctggcacatgcgccggtgcgcagccgctga

SEQ ID NO: 6167 - DNA, 225 bp, Myxococcus xanthus
tgctctaaagacgactacaagacgcgcttgttggggagtggcacggcgtcgggacgtggcgaggagggccgcatcaccgtgctgcgctccgtcatcatggacccctggattaccgaagacctccagggtcggccgttcctcgacaccatcatcgaggagctgcgagcggccgtgatggacgcgctcaacgagatgcgcggcacctcatcgaagtgctcgcgctga

SEQ ID NO: 6168 - DNA, 636 bp, Myxococcus xanthus
tgcgatacctcgaacggcggggggcgcagcgtctacatcaaaggcaacctgttccgggactacgcccacgaggtggggcacgtcctcgggctcgggcacggcaaccggcgcgattccacgacgggcaagcaggtgaggtctgccgactcgagcacgtacatgggcaagtttgcgtcagacaactacaacctcccacagctccactggttggggtggacccagaaggaggagctcgtcaaggtcaactcggccatcgacaacggtggttccattgacgtcacgctccgtccggtgggcgccaatgcccacagcaccagcagcctccctctaggcgcggtctgggaagttcccgacaccgagcagcggctgttcatcgccgtgccaaaggcgcggaccaacagctcgaacgagattgagggcggcacggtgttcgtgtaccgcggctccagggccgtgggctgcacgggcatctgcctgggaacgcttcagttggcgcggttcagcgccaaatcgaacaacgaacacgaagcgaccggcatcttcgtcaagccggtggcctacaccagccatttcatccaggaagacggaaagcgcatcgaggtgttctcctccgtcacgctgcgcatcaggcggtag

SEQ ID NO: 6169 - DNA, 1044 bp, Myxococcus xanthus
atgacgcggcgctcacgcgcggaggacttcctggagctggtggagcggggcaggcgtggccggctcaagctctacatcggcttcgcggccggggtggggaagacgtaccggatgctggaggaggcacacgcgctgaagcggcgcggcgtggacgtggtgctgggcttcgtggagtcgcatgaccgcgcggacacgcaggcgctggtggagggcctggaggtggtgccgcgcaagcagtactcctaccgcgacgttaccgtggaggagatggacctggacgcggtgctcgcgcgcaagccccaggtggcggtggtggacgagctggctcacaccaaccttccggtgtgccgccaccgcaagcgctatcaggacgtgcaggcgttgctggacgcgggcatcaacgtcatcggggccttcaacgtccagcacctggagagcctcaacgatttggtggagcgcgccaccggcgtcgccgtgcgggagacactgcccgacagcttcctcaaggccgccgaccaggtggtgaacctggacctggcggtggaggacctgcacgagcggctccggacggggaagatctacgcgaaggacaaggtgccgcgggcgctggagcgcttcttcacggaggagaacctggccacgctgcgcgagctggcgctgcgtgaggtggcggagagcctggaccgcgccaccgcgaggccgcctccgggagagggagatgaaggttcgcagcggagcgcggcctggggccgggtgctggtggcgctgtccagttatccccggcacgcggcgacgctgatgcgccggggctcacggatggcgggccggctgaacacggactggttcgtcgtgtacgtggagacgccgcgcgaggcgccgcacctcatcgacgcggaggcgcagcggcatctgctgacgaacatcgagaaggcgaaggagctgggcgcggaggtggtgcgcctgagggctcgagacccggtggagggcatcctggacttcgcgcgctcgcacggcgtgggtcacatcatcgtcggccgttcgcat

SEQ ID NO: 6170 - DNA, 933 bp, Myxococcus xanthus
catcctcccggcgctcttcatgggcgtgttcccgcagattgcgccgctcaacgtgatggggttgtcctccccgttcagcgcggtgctgtcggccgtcatcttcaacgcgctcatcatcatcctgctcatccccctggcgctgaagggtgtccgctaccgcccgttgggcgccgaggccctgctgcggcgcagcctgctgctgtacggcgtgggcggcgtcatcgttcccttcgtgggcatcaaggtcatcgacgtgctgctcggcgccgtgggtctggcgtgaaaggacttatccccatgttctccacattcctcacggccctgcgcacgtgcgtcgtcacgatggtgctcacggggctgctgtacccgctggccgtcaccgggcttgcgcagctcctctttccgggggaggccaatggctcgtgggtgaaggacggccggggccgcgtggtgggcagcgcgctcatcggccagggcttcacccgggcggggtacttccatccgcgtccttccgccgctggcgcgggctacgacggcgcggcgtcctcgggcagcaacctggggcccacgtcgctgaagctgaaggaacgcgcggcggccgagctggagcgcctgcgccgggagaatccggatgcagcggggcccgttcccgccgagttggtgacgacgtccgcgtctgggttggacccccacctgtcgccggagacggcgcgctggcaggcggcgcgggtggcacgggcccgcggcgtggcgctggagcgggtgctggacgtggtggacgcgcgggtggaggggcggaccttcggcgtgctgggcgagccgcgcgtcaacgtcctgctgttgaacctcgcgttggacaggcgcttcgggccgcttccggacgcggcgccgggcgtggggggcagggcctcgccgggccagggcgcaccttga

SEQ ID NO: 6171 - DNA, 1172 bp, Myxococcus xanthus
cgcagccactggagcctggaccccgaagtcgtcttcctgaaccacggctcgttcggcgcctgcccgacagccgtcctccagcgacagtccgagctgcgcgcgcgcctggaagccgagccggtgcgcttcctccaccgcgaaatcgagccgctgctggatgacgcccgcgccgcgctcgccaccttcgtcggcgcggacgcggacgacctgggcttcgtccccaacgcgacggcgggggtgagtacggtgctgcgctcgctgcgcttcgccccctggcgacgagctgctcaccaccgaccacgagtacaacgccagccgcaacgcgctggacttcgtgaggtcgcagtgagagcgccaaggtggtggtggctaagctgccctggccagtgccgtccgcgcagtcggtggtggacgccgtgctaccccatgtcaccccgcgcacgcgcctgttcctggtggaccacgtgtccagtcagacggccctggtgatgccgctggagcaactcgtcgccgcgttgcgcgagcgtggcgtggagacgctggtggatggcgcgcacgggccgggcatgctgccgctgtctctgcgcacgctgggtgccgggtactacacgggcaactgccacaagtggatgtgcgcccccaagggggccgcgttccttcacgtccggcgcgacctccagtccgccatcaagcccctgtccgtgagccacgggcacaactcccggcggacggaccgttcccgcttccggctggacttcgactggacggggacgcacgacccttcggccgtgctctgcgtgcccgaggtgattcgcttcatgggcgggctgcttcccggcggctggccggaggtcatggcctcgaaccgggccaaggtgctggcggcgcagaacctgctgtgcgcgcggctgggcacccagcccacctgccccgaggacatggtcggcagcatggccacggtgacgttgccggacggcttccccgaagtcccccagcccccgctctacgtggacccgctccacctgcgcctgttcgacgaataccgcatcgaggcgcaaatcaccccctggccccgtccgccgcaccggcatgtgcgtctctccgcccagctctacaacacccccgccgactaccaggccctgggcgatgctttggaagcgctgctgcgttga

SEQ ID NO: 6172 - DNA, 543 bp, Myxococcus xanthus
atgtcgctcgcgccgactcaggatttgttcttcttcccgtccatgttgacgttggagcccggggagtcccgccccatccgggtggggagctcctcggctccacaggataccgaacgctccttccgaatcgtcgtggaggagcttcccccgctgcaaccgtccaccccgacaacggggttgaatgtcctcacccgaatctcagtgcctgtctttgtcgcgcccaagaagaagaccgttcaaggccagatcgcggaagccgtgctgcgcgagtcgaagttccacgtccgggtgcagaacccgggcacggtgaacttcttcatccggaaccttcgggtccgggggctcgacgccaagggcaagcggctggtcgagaaagaggaacccggctggtacgtcctggcgggcgacgcgcaggtgtatgccatggagatcgcgggcaaggtctgccgcaaggtccgcacggtggaagtggagatggagaccgaccagggcgtgctccgtcagacctcccccgtggagtctcccgctccctgcgctcgctga

SEQ ID NO: 6173 - DNA, 123 bp, Myxococcus xanthus
atgtccttcgtcggcggagaccaggccgaagcgaacggtgtcgtcgggtacgtcctcaagtccgacctggagcactacaaccccaagaagtcccaatcgggaaagctctccatcgagatttga

SEQ ID NO: 6174 - DNA, 143 bp, Myxococcus xanthus
atggaccgcgcgctgctcgacttccgccgcgccggcgtggaccgcgacgacgccacccgcgccaaggtgaagtcgctcaacgaggagttgctcaagctggggcagcagttcagcaagaacatcgccgaggacgtccgcaaggc

SEQ ID NO: 6175 - DNA, 813 bp, Myxococcus xanthus
cgggggcaggtgtgcaagcgcatcggccgcaggctgaaggcgctggggcttccagacgcaggggcctaccgcgcccggctggaggccgagccctcggagtgggacgtgctcgacgcgctgtgccgcgtcaccatctcccgcttctaccgggacgcgcgcgtcttcgaggtgctgcgccatgacttgctccccgcccggctggagtccctgcgctcccggggcgaggccacactgcgggcgtggagcgcgggctgtgcttccggcgaggagccctacacactgtcggtgctcttccagttggggctcgagcctcgattcccgggagtgcgtttggcgttggtggcctccgatgcggatgcggggctgctcgcgcgggcggcgcggggctgctatccgcgcggggccttgcgtgagctgccgcgtgcctgggcggagcgtgcctttccggggcccggcgacgaaccgtgccttgcgccggagttccggcgggcggcggacttcctccagcaggacttgcgctcccagatgcccgacgggcccttccacctggtgctgtgccgcaacgtcgccttcacctacttcgcgcctccgcttcaacgcgaggtcctgtcacggctggtggcgcggctggtccctggcgggctgctggtgattggcggccatgagtccctgcccgaaggagacttcggcctgacgcgcgccgccggcccgctgcctgtcttcgcgcggacagacgtctgagaccgccgggctctattcacgaattcgtccggtgcgagcattctccgtcgctgggccgtgctcccctgacgt

SEQ ID NO: 6176 - DNA, 1495 bp, Myxococcus xanthus; identical to SEQ ID NO: 311

SEQ ID NO: 6177 - DNA, 495 bp, Myxococcus xanthus
aggtgcgttccggtggccgtggccccttcgaacaagcggggggctggggcgcggatttcggcggcggcgccatccgacgccacctccgcgaaggaggccgaggtcctgcgccgctacgaagcgggagatttggcggcggcccgggacctggcccaggcggagaagctcaccgcgctgcacgggcagctcatccgtttcgagaccgccgaggcgcaggcgaagaaggccctggcgcagcgggacttcccggaggccattgcccaactgacgctcgccatttccgtggacgatgccctggcacatggctggagcaaacacggaccgcccctgcgcaagcagttgtcgcgactccatgtccaggtcggcacggagcatgccgccgcgggccgggtgagcgaggcgcgcgccgccttcgaacaggccctgaagcacgacactggcaaccgcgaggcccgcgagcaactcggccggctcaccggcgcttcagccccctga

SEQ ID NO: 6178 - DNA, 534 bp, Myxococcus xanthus
atggccatcgccgtgggcctggtgctgctcggcatgcagtggaaggacttgtcgtatttcctgtccccaagcgtgccgctgacgttgggggcggaaggggcgtaccgcttcgaggcgctcgtttccaaccgatacgcccaggtgcatggcgtgcccacggtccggggcgcctatgagcgcgcggacggcgcgctgtatgtcctcgtggggctgcgggactcgcccttcgtggtgcgccggccagcgctcccgggggagcagtggacggatggccgtccgccgccgcagcccgaccagcgtcccttcgccgtgcgaggacggctgctggcgcaagcggatgcccgtcgctaccgcgatgcgctggccctgatggagcgcatgggcgagctccaaccgcgggacggccggttgtggctgctcatcgaaggcgagcggcccggcacggacagggggttgctgctcgtgtgcctggcgctggtcaccttcgtggtgctcaacgcgatgctgctggtcagggggctgaagcgccggtga

SEQ ID NO: 6179 - DNA, 486 bp, Myxococcus xanthus
agcttcaagactggtgacaaggcggtctacccgggccagggcgtcggtgaagtgatgggtatcgaacacaccgaggtggccgggcagcgccagtccttctacgtgctgcgcatcctggagaacggaatgcggatcatgatcccgatcaacaaggtcgggtcggtcggtctccgggagatcatcagcgaggaggacgtcaagcaggtctactccatcctcaaggagaaggacatctccgttgactccacgacgtggaaccgtcgttaccgggagtacatggagaagatcaagacgggctcggtgttcgaaatcgccgaagtgctccgcgacctgtacctcctgaagggcgacaaggacctctccttcggcgagcggaagatgctggataccgcgcgctcgctgctcatcaaggagctgtcgctggccaaggactgctccgaggacgaaatcgagtcggacctgaagaagatcttcaatctggcctga

SEQ ID NO: 6180 - DNA, 1279 bp, Myxococcus xanthus
tttgggaagtacctccttctggaccgcatcaacattggcggcatggcggaggtgtggcgcgggaagcagttcggcgcgagcggctttgagcggctcgtcgccatcaagcgcatcctccccaacatcgcggaggacgacgagttcatctcgatgttcatcgacgaggcgaagatcagcgtccagctgacccacgccaacgtcgcgtccatctacgagctgggcaacatcctcggcagctacttcatctcgatggagtacatccccggcaaggacatgcgggccatcttcgaccggtgccggaagaagggggagcccgctccagtgccgctggtggccttctgcgtgtccaagatgtgcgagggcctggactacgcccaccggaagaaggacgggatggggcgggagatgaacatcgtccaccgcgacatctcgccgcagaacgtcctcatctcctacgagggcgaggtcaaggtcatcgacttcggcatcgcgaaggcggccggtaaggcgaccaagacgcaggccggcatcctcaagggcaagttcggctacatgagcccggagcagatccgcggcctgccgttggaccggcgctcggacgtgttcgccattggcgtgtgcctctacgagatgctgaccggtgagcgcctcttcgtgggtgacagcgacttcagcgtgctggagaaggtgcgcaaggcggaggtgccgtcgcccaccacgtacaaccggcgcatcccggagacgctggagcgaatcgtcctcaaggcgttggccaaggacgtggacgagcgctaccagtacgccagcgagctgggcgacgacctgcagcgcttcctcatcaccagcgacaccatcttcagccgcaaggacctggcgcagtacatgaagtccacgttcgcggaggacgtggagcgagagaagcagcgcctgctggattacgcggacatcaagccgcccgacggcatgcaggccgcgctggaagccgcgtccttcaacagccccatcatgccctccgcgccgccgccggcgcccgtgccggtggtgcagccggtggcgccgcagccccggatgacgggctccatgccgacggtgtctccagggggcgtgcgtcgctcgcccacgctggccgcgctgccgaggctgacggccgccaccgccgcgccccctcccgacgaggacgagggcggggcgacgcagcttgtctccagcgaccacgagttcgcggacacgccagagcccaccacgcagccgggggccgcctcgggcgtgctggagagct

SEQ ID NO: 6181 - DNA, 249 bp, Myxococcus xanthus
atgctcatcaccgagggcaacgacatcggtgttccgctggacctggtcctgcgtgcgaacctcgccaagtccggcgtctacatcgaaggcatggtcggaccctggctcgtgtttggccgtggcgacaccttccgagcgcatgctgcgtttggctttggccttcagggcaaggccgcgagcattggtctcgaggtgggttacctggagcccaacccgaccattggtctgcggatcggctacaagttctga

SEQ ID NO: 6182 - DNA, 177 bp, Myxococcus xanthus
gacgacgagctgagcgagtccatcgacctggccaccgagaagctgatggagcagccccgggcacgctgggccaagcccatgcggaagaacctgctggcgttggaggcagagacggagctgcgctgccgggtgccagcgtcgaagggcgatggcaacggcgcggcccatgatgcgtga

SEQ ID NO: 6183 - DNA, 2172 bp, Myxococcus xanthus
atgctgcgcggcagcgacgtgctgctccccgcggccacgctcgaggcccatggcgtggacctggtggcgctcgggggccgccaggaagtcatcgaaggaaagacatacatcgccgcgcggtccctggagcccgaagggcgctgcaccctgaacgagcggaccgtcagcctgtcgtgcgagctgcccgcgtccgccttcggacagacgcgcatcaacctcgggccgcaggcgccgtcggactactccgtccgcggcagccccagcggcttcatcaactacgcggcccacgcccgcaacacctcgctgaccttctttggagaggccggcgcgtcggtggggcggggcctgttgacgacgcaggcgcgatggcggcccggctccgtgcccctgcgggggctcacgcagttgtcgttggacttccccaagcacatggtgcgcgccatcgcgggtgagtccacgggatttggcggcgtgctgggtggcggcgcggtggtggccggcttccacctcatgcgcactttcgagctgaatccgtacttcgtgcgcaacccgatgcaggacttcgcgggtgacgtcgccacgccgtccacgttggaggtctacgtcaacaaccacctggtgaagcgcaccgagctcccgcccggccccttccggctggagaacctcacggtgccccggggcgagggcaacacgcgctacgtcatccgggacgcgttcggtcgggcgagcgaggtgaacacgtcctactatctcagcgggcagcagctctctccgggcgtggtcgactaccggctttccgcgggcatcgagcgggagtccgtcaatctctacaacttcgacttcggccggcccctgctcctgggcaacttccgcatgggcctcacttcgtggctgacgccgggcgtgcggttggagctggcgcccaacgtcgtcagcaccggcgccatgcagctcatccagttgcctttcggccaattggagctgtcacaggccatcagccgcagtgagcggcgaacggggctggcggcgggcatcgtgtacgggctccagcgccgctgggtgggtggctccgtcttcggacggggcatgaacgcgtcctacacgcacaccagcctcaagctggatgacgaccacccgaccctggagacgggcggctcgttgttcctggcgttgggggagagtgtcagcgtgggcgggcaggcgatgctgtcacgctaccagcgggacgggtggacgacgtggctgggcgccaccacctccgcgcggctgaccgactggtcgacgttgtccttctccgcaagccgcagcaactccgaacgaggcggctccgccatcgaggggatggtgtacctgaacgccatcttcgattcccgcaccacgggcacggtggggcactcccaggcgctgcgcgggaaaggcaccacatcggtggacatcgcgcgctcggtgcccatggagggcggcctgggctaccaggtgcagggccgggtgggggcggtggaccaggcgatggcgcgcgccgacttcgactccaacgtgggccgcgtcagcgcgggcgcggagtgggtcgaaggacggatggcgggcatggccgaggtcgccggcggcctggtgctgattggcggacgcgtgcgtcccacgcgcgcggtggaccagggctacgcgctggttcgcgtgaagggcgtggaaggcgtgggcgtgcggctcaacaaccacgaaatcgggcgcacggacgccagcggcgagctggtggtgacgcggctccaggcctacaacgccaaccggctctcgctggcggaccatcaggtgccgctggacgtctacatcccctccacggagcaggtggtggccacgtaccagcgaggcggcgtggtgctggacttcaagacgcagacgatccgcgcctaccggggcaaggtgaccatcgactcggcggaggacacgcgctggctgtcctacggtgagattcgcgccgagaaggacggagagaagtggagttcgcccattgggtggaatggtgagttcgaactggtgggcctgcccgaagggcgtctgccggcgacagtcgtctaccccaagggccgttgcgcgacctcgctggaggttccatccctcgagggcaaggtcattgacctgggaaccgtgaggtgtgtccatgacgaggcgaaatag

SEQ ID NO: 6184 - DNA, 1331 bp, Myxococcus xanthus
ctcgtcctcatttcccaggagcatgatgtgcgttcctttcaacgtggtgcgctagaccttcgccccgtcgtcctcacccccggtgtctcccgctacgcggagggctcggtgcaggtggagttcggccacaccaaggtgctcgtcacctgctccacggaggagcgcgttccgccgcacctgatgggcaagggctccggctgggtgacggcggagtacggcatgctgccgcgcgccacgcactcgcggaaccagcgtgagtccgccaagggcaagcagacgggccgcaccatggaaatccagcggctcatcggccgctccctgcgcgccgcggtggacctgtccaccctggggcctcgcaccctgacgctggactgtgacgtgctccaggcggacggtggcacccgcaccgcttccatcaccggggcctacgtggcgctggtgctggcgctgcgctcgctgcagaaggccggaaccatctccaagctgcccaagctcacgccgttggcggccgtgtccgtgggcatcgtcaagggcgaggtccgggtggacctggactacgacgaggactccaccgcggatgtggacctgaacctggtggccaccgcggacggccgcatggtggagctgcagggcacggcggagcaccagctcttcgaccgcaaggccctggacgccatggtggatggcgggctggccgccatccagaagctgacggccgcgcaggcgcaggtgctgggatgacggtgaagccccggctgctgttcgcgacgaccaaccagggcaagctgcgcgagctgcgtggcctcgtcggagacgcggtggaggtggtgtccctggcggacctgccgcctgtccccgagcccgtggaggacggcgccacgttcgaggagaacgcggtgatgaaggcccgcgcctacgcggacgccaccgggctgctcaccctggcggatgactccggcctgtgcgtggacgcgctgggcggacggcccggcgtgcagtccgcgcggtatgccccgggggacgaccgggcccgctacgagaagctgctgaccgagctgaccggggtgcccgacgcccagcgcaccgcgtccttccgctgcgcgctggcgctggtggggcccgggggaggggaggcgaaggtggaggtggggcagtgcaacggccgtatcggccacgccccgaagggaagccatggtttcggctatgaccccgtcttcatccttccgggcggcgaccgtgccctggcggagctgacgccggaggagaagtcggccatttcccaccgggggaaggccttccagaagatgaagccccacctgctgggcttgtag

SEQ ID NO: 6185 - DNA, 339 bp, Myxococcus xanthus
caggggctcaccaaggcggacgccgcgaagcgttggggggccgcgcaaatcaaggagtggcgccgctccttcgacgtgccgccccccaacggcgagtccctggagatgacagcggagcgcgtgttgccgttctatgagcgcgccatcgccggagacctgcgcctggggaagaacgtgctggtggtggcccacggcaactccaaccgttccctggtgatgaagctggacaacctcacgggggagcaggtggtggggctggagctggccaccggggtgccgctcatctacgagatgtcgccggacggagaggtgctgtccaagcgcaccgcgtccccctga

SEQ ID NO: 6186 - DNA, 669 bp, Myxococcus xanthus
atgaaggccctgatcacctccctcgctctcctcttcgcccttccctccctggatgcccacgcccaggcggagatgcgccgtccgcccagcccgccgccggggcagcagatgccgcagccgcaccatccgcaccagcccaactacccgccgcagcactccggcagccaggtggtggtggaccggcgggagttgaacgagcgcctggaccggctggagaagctgctgaaggaagccgagcagcggatgaaccggcaggagcgcaacaagttccgcaacgccaaggagacgctgaactccgtgcaggacctggtgaacagggcgccgctgctggccaccgtcctcccgcctccggcgccgatgccgcccccgcagccggtggtgcggcccatctcggacagcgagctgcgccgcatccactcttccatctccctgcagaccttcgccgaggacaagatgcgcgtgctcgtctcggcggcccagcaccactacttcctggtctcccaggtgggccagctcctgggcaacttccagttcacccaggacaagctggccgtggtgcgcgagctgaagccgtacatccttgacccgcagaacagccacacgctctacagccacttctccttctccagcgacaagaagcggctggacgacattctctcgcagcgctga

SEQ ID NO: 6187 - DNA, 531 bp, Myxococcus xanthus
tctaaagctttagaggatcgggcggtggcgaagggccgcgatggggagttcgtctcggcctcgctcttcctgcgcgccgcgaacttcttcctcaccttcgtggacggcagccaccacgcgaaggagatggtgctcttccagacgatggtggcgcaccggctgccgctggcgcccgggctgctggcccaggtgtccggcgagcacggcaccggcagcgagcacgcggtggccatgctctgcgcggcggaggcgatgctgcgtggcggggagacggaccccgcgcgcatgctcgacgcggcggatgactggttgcgcctgtaccgggggcacaccgcggtggaggaggcgcaggtgttccccatggcgcggcggctgctgcccgcgggaatcctggaccggatgcggacgcgcttcgcccgaatcgaggcgtcgcatggctcgctggcggatgccgcggatgccatggagcgcgccttcacgccccccccggcgggacgtctcttcccgcgcggaccggtgtgctcgttctag

SEQ ID NO: 6188 - DNA, 2657 bp, Myxococcus xanthus
atggcgcggatgccgcccggaagcatgacggcggtggcttgcgcggaagagaaggtgcgtccgctgctgacgggggcgttgtcgctggccgcagtgaatgggccggaccggtgcgtggtgtccgggccctcgggggacgtggaggcgctggagcacgagctgagcgcgcggggcgtgggcgtgttgcggctgcctgcgcggcatgcgttccactcggcggcggtggagccggtgatggcggagctgcggcgcgtggttgcgggtctgcgcctgtctgcgccccagcgtccatacatctccagtgtcaccgggacgtggattcgcccggaggaggcgacggacccggattactggctgcgccagatgcgggcaccggtgcgcttcggggacgggctggagacgctgaaggcggacgggtgcgacgtgtttctcgaagtcggcccggaccaggcgctgaccgccctggcgaggctggggctgcgagggcaccgaggacgcgccgtggcgtcgctgcctcgggcgggctcggtcctggatgcacatgccgcgttgatggaggcgcttggaacggtctgggcgcaggggctcgcgattgactggcagcgcgtctacgcgcacgagtcacgccagaaggtggcgctgcccacctatcccttccagcggcagaccttccggaccccgctgcccacctcagtggtggcccggccggagacgtccgcggcggtggcggagcgccccgcggaagccggaggcacgccccacttggaggcgccagcggagcaggccggggcccacacggacgtggagcgcaaggtgctggccatctggcgcgagcggctgggccggaccgacttcggcatccacgacgacttcctggaactgggcggcaactcgctgatggcggcgcagttgttgacccgcctgcgggaggccttccctgtctcactccccttgagtgacgtcttcgacgcgcccacggtggcgggcatttcggctcgcatccaggcgcggctgggcacgcccgggacggcgtccacggagccggtcctgccgccactggtccgcattccgcgtggcggagcgttgccgctgtccgtggtgcaggagcgcatctgcgcgctggagcaggcgctccccggcaacgcggccctgaacatgtatgtggtgctgcggctgcatggcgcgctggacgtggcgctgctggagcggggactggaggcggtggcactgcgccacgaggcgctgcgcacgtcctatccgcgtggcgagggcgctccgagcgtctgcatcgccccggagctgaagttgccgctctccgccgaaccgctggaccccgcggcgtggcagccgcgcgtgcacgacgaggtggcccggccgttcgacctggagcacgggccggtcgcccgcgcccggctctggcgactggctccggaggagcatctgctggccgtcaccgtgcaccacgtggtgtgtgacacgtggtcgctggtggtgctcgcgaaggagctgggggaccactacaccgccttcatgcaggggcggccggtggcgctgtccaccttgcccgtgcagtacgtggactacgcggcctggcagcagcaggcgctgaagagcggcgcgttcgcctcccaggtcgcggcctggcgcgggcgtctggcggcgttcccgcgtccgctcgagctgccggtggaccggccgaagggggacgggcccgcgctccgtggccagtgcttgcgcgtgggcttctcgcgcgcgctgtcggcctcggtccaggcgttcgcgcagcgagagggtgtcacgccgttcatggtgctgttggcatcctggaaggcgctgctgtcgcgctggacgggccgggatgacgtcgtggtggggacgcccattggcaaccggagccggccggagctggagccgttgatcggctacgtggcgcactccgtcccgttgcggacggacctgtccggggacccacccttcaaggagctggtggcgcgcgtgcgcgaggtgatgatggatgcctacgcgcaccccgacgtgccgtatgagtcgctggtgcgggaaatcgagcccgcgaaggacaccggccgcggccgggtcttcgactcgatgttcgtgctgcacagccggttcaatctgaacctggagctgccgggtctgcgcatgagcctggcggagctcgagaacggtccacccgagttcggcaccgtcctgtcggacctgtccgtgggtctgggggagtacgagcacggcttctccggtaccgtcgactacgcggaggagcgcttcgagcgggacaccgtggagcggatggtggcgcactggaccgcgctgctcgaagcggcggtggcggagcccggcctgtccctctccgcgctgccgctggagcacgctcgggccagtcaggcgctggcctcggagcctgaggcatccgcatcggtggtgacgccgatcgcggcgctgcttcgggctcgcgccatggcggacgcgtcccaggtggcgatgacggcgccggacgggcggggcgtgacgtggggcgagttgcaaggggccgtggggcgtctggccgccgtgctgtcggaccgaggcgtaggacccgatgcgctggtggcggtatgcctggagccatcggtggagcgcgtggtcgcgcagtgggcggt

SEQ ID NO: 6189 - DNA, 531 bp, Myxococcus xanthus
tccaagcgcttcaatggcgcgcgggaaaagctaacccaggtggatcggaagaacgtgctccgggaccacgcgttgatggatgcgatggtggagaaggagcgccgccaggtgctggacggcttcaccacccagcggggcgccgccggccgcgtggcctgggccctgggcctgagcccgtcggagctgcagcgactggtctccatgctgtcgctgacggaggacgtggaggccctgcgcgagcgcttccgccgcgaggccctggccacgccccacctgacgcaccggctggacctgctcgggcgcgagaagtacctgaccgacctgggcatccagaagaagttcgccgacacgctccgcaaggaactggagcggctcgtcggcgacgtcctgcacgatgccggagacctgcacgaactggcggatgccgttgcccgcaagcacggcgccccctccgagctcgtcttccgcgccttcgagcgattgggactggcggacggactgcgcaagcagctgctggccggctcccgctga

SEQ ID NO: 6190 - DNA, 1197 bp, Myxococcus xanthus
atggtgcctcgctcgcgcagacggctctaccggcctgctccagacatccggaaccgcgaggacccgctgtccatccacgtggaggcgctcttcgggaagctgcgggagttggcgggagtggcgcacgagacggccgcgggcctgctccatggcgacccggtgtccgaccgcgggcggagcgtggtgggccaggagccgctgcgcacgcgctcgtggctggccccgcttcgcgaccacctccgctccgactcgctcgtcttccggcacgcgctgcgcgtggggctggtggcgacggcggcgctggtggtgacgcgggcgctgggcatccgtgacgcccactgggtgagcctcaccgtcatcgccatcctccaaccgtattcggccatcaccgaggagcgcgcgctccagcgcgtcggcgggacgctgctgggcgcatgcctggcggcggtgattgccacgcgcgtgcattctccctccgcgctgctcgccgtcatcgtcctgctcacggcggtgtcggtgtccctcctgcccatcaacttcggtgccttccaggtcctgctcacgcccgactacctgctgctggccacgttgagctcgggggactggagcctcgccggccagcgcgcgctgggagtgctggtggcctgcgcgctggcgctgacgggcgcgtggctgctgtggcccatgccggagcgccgccgcttcccggaagccgcggcgaccgcgttacgcgcggatggtgaatacctgcgcgaggtcatctcccgacgcagcggcacccggcccgaggtgggcgccgcgcggcgcaccttcagcctggcgctgctggacgcggaggcctccttcgagcggctcaccgccgagtaccatggcccgccccagcagctcgagtcaggcatggccgtcatcacctatgcgcgccgcttcgccaccgtggtgacggccctgggcatggagcggccggaggcggaggttcccgaccagttgaagcagttggcgcaccaggcggggcgcgcgctcgacgaactcgcggacgcgctcacggaccggcgcgtgccgccgcccctgccgccgttgaaggtgtcgtgcaagacggatgaccccgtcttcggcgcgttgctcgaacgggtgccccgccagttgggcatgttgcacggcgccgtgtcgcggctcagcagtggctcggtcctgcggtga

SEQ ID NO: 6191 - DNA, 589 bp, Myxococcus xanthus
ttcaagagcaactgtagggaggacatctgcgggacggccgcgtgatgatcaatggcgcggcgcatggtcccctcagcaggggcgggggtgtgtcagctctacatgcgccgctttccggacggtgcgctgctggtgatcgagccctggcgcgcgcggtcgtttcctgtgctcaaggatctcatcggcgatcgcagcgcgctcgaccgaattattggcgctggcgggttcatctgggtgccaacgggggccgcgcccgaggcgagcacaccgtccgtcttgtaacagaacgccgactgggcgatcgacgcctcggcttgcatcggatgtggggcctgagtcgccagctgcccgaacgcctggtccgagctcttaacctgcgcgaaggtctctcacctgacgctcctgcctcatgggccgtcggagcggtagcggcgggtgctctccatgaccgcgctgatggatgaggagggctttggcaactgcacctggcacgcggagtgccaggcggctgtgcccgaagtcgatcagcatcgatgccatcgcgctcatgaaccatgaatggctccgggcatcgatcgcatcccaacgc

SEQ ID NO: 6192 - DNA, 201 bp, Myxococcus xanthus
atgcggcgagaagacgcctaccagcgggagggacacacggcgcggactctggtgcgcgagcccgacctgcgcatcgtcctcatcgtgatgaaggccggcgcacggatggcggagcatcgcgccagcgaaaccgtgtcggtccacgcgctctccgggcacgtgcgacttcgcctgcccgacaggactgtggagctgccgttc

SEQ ID NO: 6193 - DNA, 273 bp, Myxococcus xanthus
atggcggggccgggcgcccagcgcttggaatacaacctctacgtggacgcgacgcgcctcatcgtctgggggaacggcacgtcgggcacggggcgctatgggcccgtcgtccccttgttcggcgtggaggtgacggtgcccatcttcgggcgcatgctggccggacaggccatccccgcggggggcctatgcggacaccgtggtgattacggtgcctttctgagggcccggtccctctgtccctggagcaccgccagcaggtgtccgccctga

SEQ ID NO: 6194 - DNA, 1338 bp, Myxococcus xanthus
atcgccaacgacttcgtcatcaccaaggtgcgcttcaagcggcaggacgacttcgcgccggcgcctcgcacctgcgccggcggagccccctgcttcagtgaggacgtcccgggggcgtgcacgccggaggacgggcccgagcccaccatcgcctattcgctggcggtggattgccgcgtctgccgtccccacccggacaccgggcagatggagtgcgtggccaatccgaattcaccgacgtggttcccggtccacttccccgacacgtcgccgcccacgcaggaggtggagctggacatcatggccatgggcttcaccggctcccagctctgctggaaggtggacatcaccagtcccaacgagcagtgccgccccatcatcgacgacgtcgaagtgggctatcaggccatccgcgccggcagctactcgcgagcctcaccgtccgcgctggccaacgtcatcgtctggggtgtgaacgagacgccgggcagcgcctggggccggggtggggcatggccgggctccggcatgcccgcgccaggcatccgcgcctatgacggacagaaggacttcaccctccgcggccggctctacttccgctcgctctatgacccggaggagccgagcgtcacccgggccgttcagcggtgggacgcgggcagagtgatggccctgtccttcggcaccaacggacatcgcgacgacccgctccagcgcaagctctacacgatgggcgcgtcgggtggacgcagcaccatcaccgacgagatgtcggacaccagcagtaacagcctgctcttcccggacgcgctctgcgacgaggagcggaatggccggtacctctacgacctcaacaatgacgggaagtgcggcacgccctccagcgagtccgatgagaagcgcatcacgggcgtcaccaacgaccgcaacttcctgcgtgagtggctgtatggctgggaggaccgccacgccccaggcacccgtgacgaccgtcggccgtgggcgctgggtggcatcaacatgtccacggtcgccatcagcctgccgccgtacctcgacacctgggccaacaatgcccgcgcgagcgagcgcgacctgtatcgccgcaacttcctggagccgctggcggaccggccgaccgtggccttcgtgggcaccatgaatggatacctgcacgccttcgacgcgggcgaattccgcaactccacgcatgacccgtgcaacagcaaaacccaggcacgcggctacttcgagacgacgacctgcaatcaaaaccagatcaacagccgcgactacggctccgggccaggagcgcttcgcctatctgccgcgaatgct

SEQ ID NO: 6195 - DNA, 834 bp, Myxococcus xanthus
tgtgctctaagggagccggccgccgaacccgctgccgccgcgaacgcgggcaaggtccgcttcaagctcatgagccagccctccggcgcccgcgtcttctaccggggcaaggagcgaggcgtcacccccttcaccctggagattccgtcgggacaggatggctccgtcacggtggagctgaccttcgcgctggagggctaccagatggagaccgtcgtcacgggcggtaccggcgaggtggtgctgtcgcagaagctgcagaagcgccggggcggcgccggcggcagccggcacgtcgaggtggcctccgtgagcgcggatgagacggcggaggaagtcgagccggtggccacgccgggcggcatgtccgcgccggtgatgctcgcccccacggcctcgcccgccacggagctccctgtcgcggcggccgtcggtggcgccacggccgcggcagccgacgcggctccggccaagggctcggcgaccgggctcgcgctgccggtccttcccaccgcggcggtggcctccgcgcgtggcgacgtgctcccctacaacgaggacatgcctcgcccggagatggtcgaccagggcaaggacatcatctacacgcgcgaagcgatggccgcgaagtcgagcggcgtgatgattgtccgctgcaccatcacccagcagggccgcgtggagaagtgccggatcatcaagtccgtggcccacatggagcgcgcggtgctcgatgccctcacgtcccggacctacaagcccatcgtctacaagggctacccggtgaacgtggactacaccttcagcatgcgcctggtggcaccgcgccgctga

SEQ ID NO: 6196 - DNA, 663 bp, Myxococcus xanthus
  unsure (1)..(663): unsure at all n locations
tgtggattcgccgcgagctcgagctggggcacatctcccgcttccagggcgctgcgcgccagcctctggattgcgcgctaccacctgggcttcgtgtccatgcaggacgccgtcgcgcgcgcgattgcccagctcgccggtacgcccgcgaggccgctccaggagcgcaccgccgtgttctacgaggaacaggtgcggccgctctatcggcccggggcctgggccgtgctggacgcgcaccggcgtgccggggagcggctcgtcctgctgacgtcgtccacgggctacctgtcggagctggtggcgcgggagctgggactggacgcggtgctgtgcaaccgcttcgaggtcgatggcgcgggcctccacaccggacgcgccctgggcaccatctgcttcggcgagggcaagcgcgtctgtgccgaggcctatgtgcgcgaggcgggcgtggcactttcggcatgcgccttctacaccgattcgtattcggacctgtcggtgatggaggtggtggggcggcccgtgnccgtccacccggaccaccggctgcggcgccacgcccggaagcggggctggccggtggtggactggggcgtgccgcccggcggcgatgtgccggccgttcctcccgcgcctcccgtggtgccctctaccggaccctga

SEQ ID NO: 6197 - DNA, 318 bp, Myxococcus xanthus
ctaacggctatgcgcgttcgcggcacggcgcgcaacgcggagggcgtcgagcggcgcttcgacgcgctgacgagcctgcccaagcccattcagggcgtgcgcttcgagaagtcgctggggatggaggcgggccgtgtgcgcatcgccgtgaagctggggacgtggctgggccgcattgacttcgccaccgcgaccgatttggacgcggatggcgtctacaccttccccgccgacagccaggcgcagaacgcgctggtgcgcggcgtggaagacaccactgcctacgtcgtgacgtgggtggaaggagctgcgcaatga

SEQ ID NO: 6198 - DNA, 801 bp, Myxococcus xanthus
atggcgtgcagcgacggcgcgggcacggtgacgttcaccacctatggcgaggactacatcgagaaggagattcccgcggccgtgggtggcgaggacggcatcgtggacggctggacggtgcgcttcagcaagttcctcgtggtgctcggcgaggtgaaagtcggcaaccacgacgagaccgccatcgagatgatgcaggcgcgggtattcgacgtgcacaagcccggcccggtggtggtggagacgttccgcgacgtaccggcccaggagtgggaccacgtcagcttcgccatcgcgcccaacaccaacgcggttgcgggcaacgcggacgccgcggacgtcacgcggatgaaggacggcggctactccgtctacatggagggcagggcgaccaagggtgagcagaccaagcgcttcgcctggggcttcaccaccaacaccgtctacgagcactgcgagagcccgggcctgggcgcgggcgtaacggtgcccaaggacggcgaggagacagtgcagctcaccatccacggcgaccacctcttcttcgacgacctgcagtcgccggacgcgcagatgcgcttcgacgcgctggccgccgcggacagcatgggcatcgcgggtcccgacggagaggtgacgcttgaggagctggcggcggtggacctgacggagctgccggcagggcagtacggcacgggtggcgtgggcaacgtgcagacgctgcgcgacttcgtcacggcgctgacgcgcaacctggggcactaccgcggcgaaggtgagtgcgagccccgggcacgctga

SEQ ID NO: 6199 - DNA, 1190 bp, Myxococcus xanthus
gtggtggtggcggcgccgagcgatggcccgggagcgaatcctctcggcttcgctcgccgggtcgtctccgttaccgaggtggatgacaccctcgtcgtcgagacagaagccgtggctctccaggacatcgtcacgggggagatgcagttcacgttcgactactcggaagtgcagaccgtcgacatctcgaagctcgacctcgattgggccgccaggcacctgtatgtcgacgcgaacatcatgtctcccagggcggagggcaatcccgacgacgagccgctgcccgaagccgaggaggaaggggacccggcgctccccggagaccccttcctgggctctatctggaacgcgatcaccgcggtgggagatgcactgggcggcgcggccaaggcggtggctgccgcggcggtggatgtctggaaggcggtgacggtcgaggggattaccacgggcgtggagatcaaacccgaaatcaagaacaactactcgagcgccttgttcaagctcgagtatgagaagagcttcaacgaggcggggaagaccccaatcaagctctccctgaagggcacggggaactcgtcggtggactattccttcaacccgggtgtgcaggtgggtgtgaaggtgcctcccatcctgggagggagccaatcgacctccatgtggctgaacgtggatagcaagtccaggctcaaactcgatgtcgaggccatcctgaacgccaagattgaatccgcggacggcctgacgggcaagaagctccaggacaagctcgcggagagaacgaagttcgccgaggacgtcctcgcccaggcgaaacagaagtatctgggccatccggacatgcggcccgcgggtggatggaagcgcaacatcctcgtcacgaagccggcggtgcagaccatcttcgccgggcccgtgccggtcgtcctgacccagaccctccaggttgatctcgagtgtggattcgaggcgaaggcgggcgtcaaggcgaacgtgagcttcgagcacaacaccaccttcaagttcgaggctcgctatgagaacggagaggtgacgacgacgccggcccagttcgagaagaagaagaacaccgacatcacggtgaccggcgaaggcagcctcgtggttgtctgcgggctcattccccgcatcaacgtgtacgtgtacgacgcgctcggaatgaacgc

SEQ ID NO: 6200 - DNA, 1365 bp, Myxococcus xanthus
gcgccagacacctacgtggcctcggccgaaacctacggcgccccctcgcggacctggacaccggtcatcgcgcccgacgtgcggggtggggccgtcgccgttgccttgcccacgggcgaggtcctgctcgcgggaggcacggccgccaccacggccgagcgctacgaggacgtcctcgcgcctcccgcctggcgtccggtcgtctccgcgccggagacgctctaccagacctgccccaccgtcatcgaaggccagggcttccggggcatctcgggcgcgtccagcggcagctacctggactcgccaacggacttccccctggtgcgcctgcgcgccgccgagggcgggcggctctggacgcttcccgccacggacatgtccaccacgcgcgcgacggtgcgggtgcccgcggaggcgccgccgggcccgtatgccctgtccgtcttcgccaacgccattccgggtggacgcatggtgacggtgcgcgccaacaccgcgcccaccgcggacgccgtgcgcatcgccacgatgaccggcgtcccgcaggacatcacgctcaccgcgaccgatccggacgcggaccagacgttgacgtggaccatcgtcacgcctccccagcatggaacactgagcggcacgccgccgaacctccggtacacgcccaacccgggttacgtgggcgccgacagcttcacctaccgagtcagtgactgcggcctggacagcaacgagccctcggtggacatcgaggtggaggccacccaacccctggccatcacctgccccgaggacaccaccatcgaggcaacagggcctgacggcgctccaggcaactggccccccgccaccgtgacgcccggagcgggcggacccgccacgctcacctattcaccggcggagggcagcacgctgccgctggggaccacgaccgtcaccgccaccgcggaggacgcatccggcacgcaagtcacatgcaccttccaggtcgaggtgcgggataccaccccgcccgcgctgacgtgccccgccgacatccggacgacctccgatgatgcgtcgggcacgacggtgaccttcgagctgcccgaggccacggacggcgtctcgacgccctccgtcacgtcctcgccggcatcggggagcaccttccggcacggcaacaacaccgtcactgtcaccgctacggacgccgcgggaaatgaagcccgctgcacgttccaggtcacggtccaggcaacggtcatctccatcgccggaggcggctgccaggcctctggcggtggcgctgcctcgtcgctggccatcctggtggttctggcatcgtggagcggactgcgtcgccgctcgcgtcacgcctcgcactga

SEQ ID NO: 6201 - DNA, 313 bp, Myxococcus xanthus
atgctcatggccgggtatgagcgcggcatcctcctgctcaagggcagtgatggccaggagcgctccatcctcgactaccgcgtctccggctggctcgcgggcgcctggtctcccaccgaccggctggagctgtccgcgcggctgcccgtcatcatccaccagggcgggaatggcgcggacacgctggtcggcgtctccgcgccggacgccttcggcctcgggaccccggagctgggcgcccgctacgcgctgctgcggcgcgaggacagcgcccccctctttctcagcctgggcctggacgtgggcacgcccg

SEQ ID NO: 6202 - DNA, 333 bp, Myxococcus xanthus
atggccaagggaatcgcccggagcgagctgtaccgcaagtggctggcccataagctcatcaatgacctgccgcgcgtggcgcggaaccgctgggatgacttcgagccggatgacgtgctgcggcatgtcggattgaccacctacaagccggcgcgcgcgggcctgggcggcctgggcatcttcctcctcggcgtggccgcgggtggcgtggcggccctgctgctggccccgaagacgggcaccgagctgcggaccaccgtgaaggacaaggccacggcctacatgaacaaacagaacgtcaacatgggccaggagcgcaccgcgaacgcctga

SEQ ID NO: 6203 - DNA, 511 bp, Myxococcus xanthus
atgtcccaagactcgagactgctggagaagatcgcccaggtggagaagggtggcgcgcagaagtaccacgccaagaacgcggaggcgggcaagctcttcgcccgcgagcgcatccgtctgctggtggatgaaggctccttcgtggaggacgcgaagctcgccaacaacctggacccggacctgccctcggatggtgtcgtcatcggcgtgggcaaggtgtccggacgcaccgtggccatcagggccaacgactccacggtgaaggccgatagctggggagtccgcacggtgtagaagatcctccgcatacaggagacgggccgagacctgcgttgcccgctgttacacctggtgcattcatgcggtggccgcatcgccgacacggtgcagatgttccccggccggaggggcaccggccgcatcatgctacaaggacgtgcacatgtccggattcgtgcagcaagcgagcctgcttttcggtccgtccgccgccggtggcggggacatcccc

SEQ ID NO: 6204 - DNA, 1665 bp, Myxococcus xanthus
gccaacgccgtgggctacaccagctacccggacaacgtggtggaggccttcatcgacgaggcggccgaggcgggggtggacgtgttccgcatcttcgacagcctcaatgatctgggcagcatggaggtctccacccgccgcgtgctgacgacgggcaaggtggcggaggtgtccatctgctacacgggcgacgtcgccaaccccaagcgcacgaagtacacgctggactattacgcggacctcgcgaagcggattgaagactccggcgcgcacttcctctgcatcaaggacatggcgggcctcttgcgcccgcgcgcggcggccatgctggtgcggcgtctgcgcgaggtgacgcgcctgcccatccacctgcacatgcacgacacctccggcaatggcatcgccagctacctggaagccatcgagcagggcgtgcacgtggtggacgtggccctgggcagcatggcgggcctgacgagccagcccagcctcaacgcgctggtcagcgccctgcgcggccacccccgtgagacgggcctggccaacgcgcgccttcagccgctggccaactactgggaggacgtgcgcgagtactacgcccccttcgaggccggcctcaagagcaccaccagcgaggtgtactaccacgagattcctggcggccagtattccaacctccggccgcaggtggcggaactgggcctgctgggccggtggaacgacgtgaaggacgccttcgcgctcgtgaacgtcctggtgggcgacatcccgaaggtgacgccgtcgtcgaagatggtcggcgacttcgccatcttcctgctcaagaacgacctcacggtgcgcgcctccacgctggcggaggcggcctcgctcacgcgccagaggctgattgaacaggcgccgcgcctggacttccccaccagcgtggtgggctacttccgaggtgagctgggccagccgcccaacggcttccccgaggacctgcgcgccgccgtgctcaagggcctgccccgcgtggagggacggccctccgccagcctgccgccgctggacctggacgcgctccagcgggagctctccgcgaagacaggacatgcgctcacccgcgtggacgccatctccagcgcgctctatccgcgcgtcatcgccggctacctggaagacctggggcgctacgaggacgtgtccatcctcgacaccccgaactacttctacggcatggaggtgggacaggaggtctgggtggacctggagccgggcaagacgctggtcatcagcctgtccgcggtgggcgagccggatgaagagggcgtgcgcaccgtctacttcgccctcaacgggcacacccgcaccgtgcacgtgagggaccgcagccgcgccgccaccgtggagacgcggcgtcaggcggaccgcgccaatcccagccacgtcgcggcgagcatgccgggcaccgtcatcgcccttcatgccaaatcgggagacgccgtggaggcgggcgcgcccctcgtcaccctcgaggcgatgaagatggagacggtggtgcgggccccgcgcgccggcaccgtggaggaggtggtgcccgcgctcactgtctccgttcagggcggacacctgctggcggtgctccagggacagagggaccgggccctcagaaaggcaccgtaa

SEQ ID NO: 6205 - DNA, 315 bp, Myxococcus xanthus
cgcgcgaaggacctcatcctcaccgccggccgcatcaacgccgcagaggccttcagcgtgggcctggcgaaccgattggcgccggaggggcacctgctgcccgtggcgtacgggttggcggagtcggtggtggagaacgcgcccatcgccgtggccacggccaagcacgccatcgacgagggcacgggcctggagctggacgatgcgctggcgctggagctgcgcaagtacgaggagattctcaagacggaggaccgcctggagggcctgcgcgccttcgcggagaagcgcgcgcccgtctacaagggccgctag

SEQ ID NO: 6206 - DNA, 1368 bp, Myxococcus xanthus
agcctgctcgccgcgtgtggccggctcgcgctcgacgaagccgtggacatcgtcctccaggtggcggacgtgctcgcctatgcccacgcgcgccaggtcatccaccgcgacctcaagccggagaacatcatggtccggcagggcatgcgcggctggcacgtgaaggtcctggacttcggcatcgcccgaatcaccgacggcgcgacacggctcaccgtccagggcgcggtggccggcacgccgcgttacatgtcccccgagcaggccatgggcctggacgtggacgcccgcgcggacgtgtacgcggtgggcatcgtcctcttcgagctgctcaccggtcagcagcccttcgacggcaacagcgtctccgaaatcatgcagaagcaggtccaccagcccatgccacgactggcgcaggtggcggcggacctccaatatccaaccgtcgacgccgtcatccagaaggccaccgcgaagcgccgcgaggagcgctacgccaccatggaggccttcgcgtcggacctggtcaacgcgttgcctaccctcaccagccggcgcgccgtcagcggcatcaaccccgccatcaccggcggtggcctcgaaccggcgcgaccggccacgctcctctttggcacggagggctccgaggccaccctggtgcgcgccgccccggcggaggccgcgccggtgacgggctccgcgcccattccgctgacccagcccgccgcgccctccgggctccgggtgggctcagagggcttcaacaagacggcgcacgcggcctccccctacgcggcgccgaagcgctcgaagtccagcgcggtggtggggctgggcatcgcgggcgtcctgctcctgggcggcgtgggcctcgtggccctccggggcggcagccgcgacgacgtcaaggagggaaccctggttccagtcggttccccggcgcaaccggcgtctcccgtggcgccccccgccaaagaggccggcgcgtcacctcacgccaccagcgggacggtggagacggcgcccgacgatgtcgcgacccggcagctcaaggtgctcgcggcgggacaggccatcgacatcggcaatgacttcaacgaaggccggctggacagcgcgatgaaacggctggcccaggcacggagcctgggattggacgccgtcgagcccgagctggcggcgctcgcgggcaaggtggaggacgcctcgaagcgcatggcccgcgcccgagccctggagaacgacggcaactgcgagacggccatcaccctctatcgcgccctgaagcgcgaccatccgcagctcgtggaggcccagcggggcatccggcgctgccaggatatgctgcctccggaggtgtccgactag

SEQ ID NO: 6207 - DNA, 528 bp, Myxococcus xanthus
atgggggatagcgccgctgtggatggctatgcgcgcatccacctggagcatctgaagcccagtccgcccatccccggcgcgcccacgtccttgacggactacaccagcagcatgccggacgtggcgcccgcccaagcctacgcctacttcgtccgtcacccatcggcggtgttcgaggccgccggcatccgcgtccgcccggcgacggcggcgctggtggatggcgcgaagttgttcctggaggaaaagggttttccgcccgtgtgggcgcccatcaccgtgcgcctggagccgggcgcgaacacgctgcacatcaccacgttggatgggcacccgctgcgcggcacgaatcgcttcgtcttcgccgaggacggcgcggggggcacgcaggtgcgtcagtactcggccttccagggcagctcgcccgcgacgtcggtgggcatgacgctgatggaccccatcgagcggcagcacgacatctggcgcgcggtgcatgcgcacctgcatgacacgctgaggcctcgctga

SEQ ID NO: 6208 - DNA, 411 bp, Myxococcus xanthus
atggcgcccgtgctgcggacgacgcctcccgggcatgacgtgattctctatgacgggcactgtcgcctgtgcggtggggcggcccggcagctccagcggctgctgggcgggacggggacgcgcctgcgctcgtttcgggaggacggggtgctggcagccttcccgggtgtcacggcggaccgctgtgagcgggccctgcaactggtcctcccggatggggccgtggtggaggggctagaggccattgtcctggcgctgggccgacggccgctgggacggctgctccgcgtgtactacgtgccgggcctgcggcagctcctggatgcgctctaccgcgtcgtggcccgccatcgcttccgcatcgcgggacgtcaatgcccagacggggcgtgcgtggtccacttcaaatag

SEQ ID NO: 6209 - DNA, 475 bp, Myxococcus xanthus
cggcacttcttcaccgagctccgggatgcctacctggagcgagagacgctcttcacgcaactggagctggcgctcctggggcgcgagcacgtgctggtggtgggcccccccggaacggccaagagcgccatcgcgagcgccgtcctggggcgcatcatcgacgagcgcacgggcttgccgtcgctcttctccaagcagatggccgagtccaccgtgcagacggacctcatcggcccggtggacttcaaggtgctcacggagacgggacgcaccgagtacctcaccgacgaaggcatgctgggctccgagcacgccttcctggacgaggtcttcgacggccgggacatgctgctgcgctccatcctcaacgtgctgcatgagcgggagctgaagcacggccgccgggtgacgacggggcgcatcgagtgcgtcgtcatgacgagcaaccggtatctctccgaggtgctggcgcgct

SEQ ID NO: 6210 - DNA, 408 bp, Myxococcus xanthus
atgggggagtgggcggtgaaggaccccatcgtcagcgaccttgtgacgaccaccgcgcgcgccatgtacaaccacaacaccacgcgcggcatccgcttcaacatgttcgcgggcgccaaggggacggtgtactcggggctcctcccggggcaggacgacgacgcggtgtcgtaccactccacgggcggcgtgtcgggcagcgcgggcggggcctactgcaacccgtccgactggttctgcaacgacctgaccactggcaccaccgcctgtgaggggggccgtgccaagtggaccaaccacttcgtgaagttccgcgacgacggcgaatcccacggccatggcgccaacgggaagtgggaaggcatcgtcggcaaggtgcgcgccgacatggtcaccaacgcgaagtag

SEQ ID NO: 6211 - DNA, 210 bp, Myxococcus xanthus
  unsure (1)..(210): unsure at all n locations
cccgtggcgctccacatcttcgggcagnacgcgcgcatcctccggcagcagacggagaccatccgccgcttcggcacggaggcttatgcctccacgaaaatcgacgtgttcggtcccggcatcctccgcttgctgcgcgccgccgagcgcgagaagcctggcgccgtgggggacgcggtgcatgaaacacgactgaagatgcggacctga

SEQ ID NO: 6212 - DNA, 471 bp, Myxococcus xanthus
atgttcctggcgggagtcgcggggctgatggtggcgtgtggtggcgactccggaaaccgtggccttccggaccccgccagcgagccccctgacaacgggtcgcttccggacgcaggcctgcccacgaacggcacggacggagggacgtcaccctacgcgggaaccggcccaggtccccctgacggcggcgagcccgacggcggcccaccgccgcagtccaacctctgtgagcccaccgcgggcgagccacgctgggtgctcgaaggcgagcccgtctccgccaccgtgacgtgcaccaccggccatgccgcgccggacacgcgcttcgtcgtggacaacctgccgcccggcgcccggttctatgcggccacgggcaccctgagctggacgcccggcaaggaccaggccgccgtgaggcacctcacgctccgggaagagagcaccggcgagacgggcacgctcaaggtcggg

SEQ ID NO: 6213 - DNA, 237 bp, Myxococcus xanthus
tggcagcgcgagtggcgcgtgccgggcctgctccgcttcaccgagtacgacgtcgccgccctcttcctgcccgaggagctccacgacaccgcccgcgagttcttcacctgggccgtgcgcgagaaggcgggccccggctacttctgcccctgcctggacccgctgtggaagtcggaccagatcgccgaggcgctcgcgaagcacgcctctgattccgtgcgactcaaagccggatag

SEQ ID NO: 6214 - DNA, 639 bp, Myxococcus xanthus
caggagcccgtgcgcgcccgggatgagttcctcagcgtgcgggcccatgagctgcgcacgcccctcaccagcctgcgcctgcacctgcaattgctgctgcgccaggtgggcggctcgaaccaggagccgcccgcggagctggcgcccagggcccgcgtgctgggccgccagttgtcgcggctggtggggctggtcaacacgctgctggacgtgtcgcggctggccgcgggccggctgtcgctggagccccgggagctggacctggcgcagatggtgcggcagatggcggaggccttctccgaggagttcacccgcgccggcagcacgttgtcgctgcacgtggacggaccgctgctgggcgaatgggattcgctgcgcctggagcaggtgctggtgaacctgctctccaacgcggtgaagtacggcggcggccagccggtggaggtgtcgctcgccagcgagggcccctcgtcggtgctcgccgtgaagaaccagggcattggcatctccgaggacggcatggcgcgcctgttccgcaagttcgagcgctcggtgtcgtagcggcactacaacggtctgggcctgggcctctccatcacccgtcaaatcgtcaagcccatgggcgggagcatctcagtg

SEQ ID NO: 6215 - DNA, 1407 bp, Myxococcus xanthus
atgtccaccgccgcgctccccgccgacttcctccaggccatcaccgagggcttccccgccgactttctcacccgggagccaggggagctccaggagtacggccgcgattggacgcgcgtctatgcgcccgcccccgccgccgtggcgcttccccggacgacggacgaggtcgcccggctgctggccctgtgtcaccagcatcacatcgccgtggtgccctccggcggtcgcaccgggctggccggcggcgcggtggcggcccggggcgagctggtcctgtccctccagcgcatgacgcgcatggggccggtggacctgctcggcaacacggtgcgcgtgcaggcgggcgcggtgacggaggccgtccaccaccactgcgcggagcacggcctcacctggccggtggacttcgcctccaagggctccagcacggtgggcggcaacatcgccaccaacgcgggcggggtgaaggtcatccgctacggcctcacgcgccagtgggtgctggggctccaggtcgtcaccgcccagggggaagtgctggagctcaatggcgcgctggagaagaacaacaccggcacggacctgcgccagctcttcatcggcagcgagggcaccctgggcgtcatcaccgaggccaccctcaagctcacccagctccccggcaagcaggacgtgttcctcttcgcggtgccggacgtggcggccgtgctgcggctgttccgcgacgcgcgccggcagaacgccttcagcatctccgcctacgagttcttcaccgacaggtgcatggcccgcctgggccgccaccgcaagctgcgcccgcccttcgagacccccagcgagtgctacgtgctgctggaggcggaggcgaaggacgccgccgcggtggagggctggctgggctcgctgttcgagcgcgagctggtgacggacggcgtccaggcgcagggcgcggcgcaggcggccgagctgtgggcgctgcgcgagggcatcagcgagagcctctccgccaccggcctgccgcacaagaacgacatctccctgccggtggcggggctggaggccttctgcgcggagctggaggccctcttcagcgcgcgctacccgggctgggaaatctgcctcttcggccacatcggcgacggcaacctgcacgtcaacgtgatgaagccggacgccatggacaaggcggagttcctggcccacacgaagcaggcggaccccaccatgttcgcgctggtgcagaagcacggcgggagcatctccgccgagcacggcgtcggcctgctgaagaaggactacctgggctactcacgcgcgccggcggagctggccctgctgcgcaccctcaagcgggcgctggaccctcgaggcatcctcaacccgggcaaggtcgtggatgcctga

SEQ ID NO: 6216 - DNA, 736 bp, Myxococcus xanthus
atgaagatggcccggcaaacgcccctcaacgcggcacaccgcaagctgggggcccggatggtcgacttcgctggctgggacatgcccgtccagtacagctccgtcatcggcgagcatgaggccgtgcgcaccggcgtcggcctgttcgacgtctcccacatgggcgaggtggagttctccggtcccggcgccctggacacggtcaacgcgctcatctccaacgacctggcccgcgtcgcggacgggcaggcggtgtatgcgggcttgctcgacgagcgaggcaccttcgtggacgacgtggtcgcctaccgcttcagccccgagcgcatcttcatctgcgtcaactccagcaaccgcgagaaggacgtcgcgtggatgaaggcgcacgccaagggtgtggcacccgtggaccggagcgacgactacgcgcagattgccgtgcagggccccaaggccaccggcctggtccagcgcctgacgaagacggacctgtcgaagattggcacctaccgcttcgccgagggcgaggtcgccggggcgaagtgcctcatctcccgcaccggctacaccggcgaggacggcttcgagctgtacagcgcggccggggacgcagtggcgctgtgggacgcgctgctcaccgagggccagcaggacggcgtgaagccgtgtggcctgggcgcccgtgacagcctccgcacggagatgaagtacgcgctctacggcaacgacatcgatg

SEQ ID NO: 6217 - DNA, 489 bp, Myxococcus xanthus
atgaagattcgtaatcggttgaatccttccgacccgtgcttctccttcgagttcttcccgccccggacggacgagggcgaggcgaacctgctcaaggcgctggaagacctggcgaccctgcagccgggtttcgtctccgtgacggaaggcgcgggaggcagcactcgggcgaagacggtggagttggtgctgcgcatcaagcaggaggcgggtatcgaggcgatggcgcacctgacatgcggggggcactccccggcggagctgcgcaccgtgctggagcgcctgtcggccgcgaaggtggacaacgtcctggtgctgcgcggagacccacccaagggccagacggtcttcgagcccgcgcccgggggtttccgctacgcgtcggagatggtgcgattcatccgagaagaggatttcaacttctgcctcgggggagcgtgctatccggagggccacgtggagacgccctcccgtgacgacgacctgcgt

SEQ ID NO: 6218 - DNA, 90 bp, Myxococcus xanthus
atggtcaccgagcgcatcggcgacaccttcgtgaagcagctgctgctggccttcctggacgacccgaagatcgcgacggctctgcagggg

SEQ ID NO: 6219 - DNA, 942 bp, Myxococcus xanthus
cagccggacgaggcggtggagggactcatcccacgccatttccgccacgccttcgaacggcgggcccggctggtggacgacccgcgcttctgccgcgtcgtcaacgatgacggggacggtctgcccggcctcatcgtggaccgctacgacacgcacttcgtggtgcagacgctcacccgtgccatggacgcgcgccatgaggaactgacgcgcgcgctggtggaggtggcgggcgcgggcgcggtgctgctgcgcaacgacacccttcgccgcaaagcgctgggcctgcccacacagcgcccccatgtcctgtacggcaccccaccccgttggtgccggctgctggagatgggggcccgcttcaccgtggacctcacatacggccagggcacgggctacgcgtatgaccagcgcgaggtccgccgcttcgtggcgcgcatggcccagggctcgcgcgtgctggacgccagttgcaacgtgggagggctcttcgtccacgcgggggtgcacggggcccggcacatactcgcgttcgacgccgacgcggacgccgcggacctggcgcgtgagaacgcggaggccaacggcctgctgggccgggtgatggtggagacgggcaaacccctccaggtcctccgtgcggtgcgagacaccttcgacctggtcctgctggacacaccggccgtggcgaccggcgaggaattcgtggagttgctgcgtcacgcgcttcgcaggacgcgccacggtggatggttgatggtcaccgggtaccatccacccctcccccaggacggctttgacgacctggtggccaccgcctgcgagggcgaggcccggatcgccacccggctggcccgccctggcctgccgccagaccacccgaccctggccggatcccatggggccgagcacctccacgcaatggcgttggaagtcagctga

SEQ ID NO: 6220 - DNA, 738 bp, Myxococcus xanthus
ctctacaggctgggcacggtcggctactaccaccacgcgccgcaaatgctgcgcctggagtcgtcgtccgtggcgagctacgccgcggtcgacctcaccggcgtgtatgacttgaacgccgagtgggcccaccgagaggccgaggtcggcaacccgcacgcgggacgggtggtgcgtgagaccttgttcgtgcgtccgctcgacaccctgattgtgttcgaccggctcgaaagcgcacgggatgacgcctcggtggccaagaccttcttgattcatttcccggagcagccggtgctcatgggcaacacctggtccgcgaacagtggcgggcagcagctgcgggtcagcaccctggttcctgccaatccggtccggcgaatcgtcgacgagcgcggcccggtgcgcggcgatggcacctacccgtacccggtgggccagttccgtggagagattgagacccacgggcaggtggtgagtcacttcctgaacgtcgtgcaggccaaggatgtggccgacagctcggcgctgcagctcacgctcgacgagacggcgaccgcgtacagcgtgacgttgagtcacccaacccgcggaagcgcggtggtccgcttcgagaaggggattgagagcacgggcggcagcttcggctacgccgccagcggcgcggttactccggcgccgctgcgcgcgggggtgcaagcgatgacggtcaccccaagcgggccggtgtggggaccgtga

SEQ ID NO: 6221 - DNA, 333 bp, Myxococcus xanthus
cgggttgcactggcgatttcgcgccgcggcatgtattcgttgactcccgagtcaacgagccgaacccgtcacgaggtccccatggaattccagctcaccgacgcccagcgcgcgctgcaggacgcggcacgcaagttcgcccgcgaagtggtgcgtccgaaggccgcccactacgacgagacggccaccttcccactcgatttgctgacgaccgcgtgggagctggggctgctcaacatggcgatacccgccgagtacggcggcgtgggcctgtcccatctggaccagaccatcgtcgccgaggagctgagctggggctgtgcgggcgtggcg

SEQ ID NO: 6222 - DNA, 672 bp, Myxococcus xanthus
atgaagttcttcatcgacagcgccgacgtggaggagattcgcaaggcccacgccatgggctgcgtggacggagtgacgaccaacccgtccttgctcgccaaggtgggccggggcctggaggagaccatccgcgaaatctgctccatcgtggatggccccatcagcgccgaatgtgtgtccatggaagcggacgagctcatcaaggagggccgctccctggcgaagatccacgacaacgtcgtggtgaagattcccatgggcgtggagggcatgaaggccaccaaggcgctgaccgccgagggcatccgcaccaacgtcacgctgtgtttctccgccaaccaggccctgctgtgcgccaaggccggcgccacctacgtgtcgcccttcgtgggccggttggatgacatctcccaggacggcatggagctcatctcccacatcctggaaatctaccggaactacgagcacttcaacacgcaggtgctggtggccagcgtgcgcaaccccgtgcacgtgctccaggccgcccgcctgggcgcggacgtggccacgctgccctacaacgtcatcacccagctggcgaaccacccgctcaccgacgccggcatcaagaagttcctggccgactgggagaaggtccccaaggccgccaagccgcccgcggccaaataa

SEQ ID NO: 6223 - DNA, 387 bp, Myxococcus xanthus
atggcccgcccttcccgctccgccgccaagaagccccgcctgcgcgccctccccggccgtcccgcacagccacctgccgtcctccccgacgcggaggccacgctcgcctacgcgcggagcgtgctggaggccgaggcccgcgccattctcggcgtgacggaacgtctgggagacgacttcctgcgcgccgtgcagttggtgcgcgactgccggggccaggtcatcgtcactggcatgggcaaggcgggccacatcggccagaagctgtccgccacgctggcctccacgggcatccgctccgtgtacctccaccccgccgaggccgtgcacggagacctgggccgcgtgggccggggcgacgtcatcctcgcgctgttcaacagcggg

SEQ ID NO: 6224 - DNA, 348 bp, Myxococcus xanthus
atgtctcgccacacacgcatcgagcggtaccgcaacatcggcatcatggcgcacatcgacgcggggaagacgacgctcaccgagcgcgtcctcttcttcaccggtcgcatccactccgtgggagaggtgcacgacggagccacggagatggactggctgccgcaggagaagcagcgcggcatcaccatcacctccgcggccaccaccgcgttctggcaaccccggcaggggatgggcgcgggtgtgccccaccgcatcaacgtcctggacaccccagggcacgtggacttcaccatcgaagtggagcgctcgctgcgcgtgctggacggcgcggtcgccgtcttcgac

SEQ ID NO: 6225 - DNA, 1618 bp, Myxococcus xanthus
agggccaccttcgtcgtggaggatggcgcgcaggccgaggcgggcaagcgcgtgcaggtgcgctacacgggctacctgccggacggccgcagcttcgacgccaccggcaacgggcccgccatcggcttcaccctgggcgtggggcaggtcatcgcgggctgggatgaaggcatcgccggcatgcgcgtggggagccgtcgtcgcctcatcatcccgtcgtccctgggttatggcgccaccggctcgggcagacggattccgccgtacacggtcctcatcttcgacaccgagctcgtgtccgtccgctgacggaggcgaggaactccgctcgccgacgtgctataggatttccttgtcttccgggaagttcgggtcggcgtggaccggcctggatgttcgtggtgacccggaatgggggaggcgagcgatgtcgcggtccgaggcggagatgagtttggaaggcccccgagcagcagtcccgggggagggcgcgttccacgggctgctcacgcagccgtcgtccgaggtggcggcgcagctctacgaggagctggggagctcccaacgcgagcggctccagaaggaggccgcgcaggccgcggtggcggagcgccagcgtctggcggaagtcctgcgccaggcccgtgacttctcgggcgccgcgcgcctgctggatggctgcggcgccgcgggcctggtggcggagctgtacgtccagggcgggcgttacgtggacgcggcggaggcgtacctgcgcgcgggtgaggtggagcgcgccgcagccgccttcgagcggggcggcgccatggagcgcgcgctggaggcctaccgcggcctgggcgcgcgtgaggccatggcgcactgcctggtgcgcctggggcgtccgtacgaggcggcgcagctctaccgcgagctgggccagccgcacgcggaggtggaagcgctcgcgagcgttccctccggtgacccgcgtcacctggagtccgtgctgcgcatgtgcaagctgctggatggcgagggcttcacgcggcgtgcgctggcgctcctggccgacacggtgcgcggcacggagtcggcacggggagacccggcgctggcggcggagaaggcccggctgctgcgccgcctgggcatggacgcggaggccgaggccgtcattgcgcgcctgccctcgaacgcggcggcgccggaggccaatggctaccactacttgaaggccatccccatcttcggagagctgtcgctcgatgacatgaaggacctgtaccgcgtggcgcggcaggtgctcatcccggcgggcggggtgctgctggagaagggctcgccgggcagcggcctcttcgtgctcctggagggcgaggtggacgtgttcagcgggccggagacggatgcgcgccggctcaacacgctggggcctggcgcctacctgggagaaatctccctggtgcaggatgccccggtgtccgcacacgtccgcgcgcgcacggcggtccgcgccctgcgcgtcacccgcgcgggtttccagcactacctggacacgcatgacgcggcggcgctgcgcatcttccgcctcttcacgcacaacctcgcggcgcgcgtgcgggcgctcagcacctga

SEQ ID NO: 6226 - DNA, 1104 bp, Myxococcus xanthus
atgctcgcttctccactgccatccctggtgtcctccctgttgttgtcccaggccccttcgccggagccgtctcccgatgccgaagccccgggcctgctgtctcgcctggaggtggaaggcggggtggacgtctacttcggctacaacaccaatcgccccgccgacggtgccagtttcatccctggcacgggcaccaccgcccggcgggacaacgaggtctccatcaacctcgcgtcgctgggcgtgtcgctcgcgcccgagcccgtgggcttcaaggtgttgctgggcttcggcaccggcatcgaggtgctgcaccaggccgagccggaaggcccggccatcgggcccgaggtgtggcgccatctccagcaggccacggtgtcgtacgcgacgggaccgctcacgttggaggcgggcgtctatcccagtcacatcggtctggagtcgttccagtcgcggctcaactggaactacacgcgctcgtggatgggtgagctgtcgccctactaccagtccggcctcaagagcacctgggccttcgatgacgcgtggagcgcgcagctccacctgctcaatggctggcagacgattggagagaacaaccgcggcaaggcgctgggcacgcaggtggcctacgcgggcccgcggctatccaccgccctcaacaccttcgtgggagaagaaggtgacggtggcctgcgactcttcgtggacgccgtggccacctggaaggtgacgcacgccttcgcgctggccgccacggcggacgtgggccggcaggcgcgttccggacagtcggcggccctgtggtacgcggcgggcttcaacgcgcgggtgcaactctccgacgtcgtggccgttgccgcccgggtggaggcctatcgcgacgaggacgggctcatcacgggggccgtccagacgttggcgggcggcaccctcaccctggagttgaagcccgcagaacacctggtactcaagatggaggcgcgccgcgacacctgcaccgcagacgtgttcaccggccgcgccacgggaggggatggcgcgcccatgctcgaggacgccgagacgctcggggtgctcagcgccgtcgcctggttctga

SEQ ID NO: 6227 - DNA, 390 bp, Myxococcus xanthus
atgaacacgaagttgtacgtcctgggcgcggtgctgggcgccgccccgggcctgctgccggtggtgtcggcgccgccggtggcgtccacgcaggagtcgcgtcaggactcgcgcgggacttctcgaaagggccggggaggcccggcgaagggcgcatccgctcccgtccatccggcgggcgtgacgccacctccagaggcgaaggacgcgctggagacccagggggcggtccccgacgaaggccgcacgaggggtggaggccagagcaaggctccacgccatccgtgcgaggccatcaccatcatccaggtgccctgcgatgccgagcaggaggcctgcgagtacacgtactggcactgccccgaggtcgtgaatccgctccgggcgtga

SEQ ID NO: 6228 - DNA, 420 bp, Myxococcus xanthus
atggccacgctcgccggcggtcgtccgcaagggctggagcagtcccgctccgacgtggcggccaacctggagctgcttcgcgtggcccggcgcgtccacctgctgatggtgcacgagctccagtcacatggagagacgcctcggtcgcaggacgcgtggcgcgccgcgctccagaagtccggcgccagcgaggtgcgggtgtacacgcgcgccttcctccccgtacatccccaggtcgcctggctgctctccgagagcgcggtgccagacccgctcgtgccggggcagctcgcggtgcacgtgacgccggatggcgtgggcttctcggtgcggctggtggggctccaccagggccaaccggcgctcctcaaggatgacctaggggcaacgctggttctgcgaggcctgtacaacccggac

SEQ ID NO: 6229 - DNA, 174 bp, Myxococcus xanthus
atgctggagtactcgctgttgaactggattctcgtcgtcgcgctcatcatcggcgcgtcggtgaaggtccgttggtcggaggaccggcagtccaacgtcatcgacctgttcatggaggcgtaccagatttattacgactccttctacttcgtgctgaacctgccgttcccgtga

SEQ ID NO: 6230 - DNA, 534 bp, Myxococcus xanthus
atgcgcatgctggtggcccgggagggcgatgagattcgctatgacgccatctcccgtctctacatcggcacgggcttcggccaaccccaggagtattcggacgaggcgctccagcacgtgctcaagcagcaggaggcggacgcgaagaaggctcagtccgcgccgccggagaagcaagcgccgctgcccaagggcgtgaagcccacgacgcgctcgggcaaggagtcccggttgatgacgctggcaggcaccgtggcggccgtccccgtcgaagtcgtcatgaagaacaccgtcatcaagcggatgtggctcagccgtgagattccgctgctgaacctggccaagattgagattcccggcatcggtcacgccatggaagtggcggagtacggaatcgacgccaaaccccgcatgcgcatccccgctccagacgcaccgaagatcaagctggagtacgcggatgctatactcgatgacctgcccggcgacgcggacgacgggcatggacacgacacctctgaggacacgccgtga

SEQ ID NO: 6231 - DNA, 456 bp, Myxococcus xanthus
gctctaagggtgggcttcaccgcgctgcgggacttgtgggtgcgtccgcccaagaagccggcgcctgggctggtggcgctggaaggtgcgctctacagccaggacctggccacgcgggatgacccgggtggctcgcagagccgcaccacgctcgtcacgggagaactgacgaaggtgcagcagcaggtgaacgcggagctggagcgccgcggctacgcgcccgtgcggcagtccgcgctcaagatgggcggcggcacgcagctgaccatggagcacgcccgcaagggtgagcaggtggtgacgacgctgtcgcccacggatgagggggtcaccgcggtggtccagatgtggattggctcggaccgcccggacgcggtgcccaacgatgatgccgtgcgccagagccgcgaggcctacgagcgggaccaggcccagaagaaggagggcgcgaagtga

SEQ ID NO: 6232 - DNA, 741 bp, Myxococcus xanthus
atgatggcgttcagtggcaaggcggcgttggtgacaggtggcacgcgtggcatcggcgccgccatcgttcggcatctggcaaagggaggggcggacgtagccttcacctatgcgaactctggcgacaaagcggccacgctggtcggtgaactcaaggcactcggccgacgggccgtggccatccaggcggacaacggagaccccgacgccgtccgtggcgcagtcgaccgcgcggcgtccgagttgggccgcctggacatcctggtcaacaacgccggcatcttcccttccggaccgttcgaaaaggtcacactcgaggaactcgacaggacgctggcaatccacgttcgaggcgtgttcgtcgcgtctcaagccgcgctcgcgcacatgccgcagggtggccgcatcatctcgattggttcctgcttcgcgcagcgcgtgccctatggcggagtcacgctctactcgatgagcaagtccgccttgatcggcctgacgaagggcctggcacgggaagtcggcgagcgcggcatcacagtgaacgtgatcgaccccgggtcgacggataccgacatgaatccggcgaccgggcccgccgtcgcggccgagttggcgctcatgtcccttaagcactacgcgcagcccgaggacatcgccgccaccgtcgggcacctggcgagtgccagcgggcgattcatcacaggcacctctatcgcggtcgatggtggcttttcggcttga

SEQ ID NO: 6233 - DNA, 642 bp, Myxococcus xanthus
atgcgagtggccgacgccaaggtgttccaggcgaaggccgccgaagccatcaccgccgcgggcggcgccgaagcgaagcccaccacgcgtggaggggtgacgacggtgcatgtcgaccgcgacatgggcggcagcatgggctacgcgctgaagggcaaggaggtctgcgccttcggcgccatcgagcgcggcggcgcggacctgctcaaggagtccgtccggctggtgggcaaggcgcccgcgcgagatgcccggctgggcaaggtaccgggcgtggcattcgtcgtgtcgggcaacacggtggtgggcctggacggaacggccaacgcgctgcaggtggatggcgtgacgacgaagttgcagttgccagtcttccaggcgcgaggcaccagcccttacgcggcgatgaattcggagggactgctctcctcgcgggcgtccatctctcccatgggggtgttccagacggtggacacgatgcgctccacgctccaggtcctgtgccccacgtgcccgaaggagcagatggtgtccatggcgaaggccgtgacgaagcagctcactggccacatgttggtgaacatggaccacgtccaggtgcgcggctcactgcgcgcgatgtcgacgcgcttcttcacggtg

SEQ ID NO: 6234 - DNA, 270 bp, Myxococcus xanthus
atgaagaccaagaaggacctggccgtagacttcatcaacaccatccggacgatggagccctccgcgctgaatgcgctcatcgtcaaggaggcaggtgaagagctggcccagttcttcctcaattacagtgcgaatctcatctccaaggacccgtcccgggtgctggagaacacgtcctcgctgatgctgatggggtacctcatccggacctacgaggagaaaaacacccagtccacccagggcaccttccagtcctacgcgttcgcctga

SEQ ID NO: 6235 - DNA, 729 bp, Myxococcus xanthus
atgctcatcgacatgcacgcccattcccacctgtccaagggttgcgagctggaccctcgcgccgtgttggagcgggccgccttgtttggcctggacggtgtggccttcaccgagacgaacacccaggacggctgtgacgagctcttcgagattggcgcgaagtcgaagctcaaggtcttcgtcgggctggagctggtgacggatcgtggacagtacctgtgcttcttcccgaagccggagctggccccggagccggtgcagatgtggggcagcaaccgcgagaagccgtggagcgccgccgagtgtcttcccaaggtgaaggccctgggcgccgccatcgtcgccgcgcggccctatgaccgggactcgcagaatccggccatggacttcatccgctccctcggcgtgctgagcgccgtggagggctacaacgcccgggtgaagcagacgtccaatgacctggccgtggaggccgccgcggcgctgaagcttccctgtgtggggggcagtgacgcccggggttcgcttgacgaggtcggccggggcgccacgctcttcaagcggccggtgcagacgcaagccgaactggtggccgagctgcagaagggtgatttctggccggtgatggccggcgaccttccccggcttacgcgcccgggagaggcccaggccgcgcgcaagtccggtggtggcggccggggtggtggtggcaagcgccgccgtcgttag

SEQ ID NO: 6236 - DNA, 186 bp, Myxococcus xanthus
atgttcacgggcgtgaaggtcttgtccgccaccaaggcgaaggagcgcgaggagctgggtgagaacgtcacccgctggctgaagagcaactccgacctggagattgtggaccgggtcgtgtgtcagtcatccgacagcgaattcccctgctccactctcgtgcttttctacaagcacggcaagagc

SEQ ID NO: 6237 - DNA, 981 bp, Myxococcus xanthus
ttgaagctcgcgacgctcaaggacggaacccgtgacggccgcctcatcgtcgtcaagcgggacaacacggcctatgcgctggccaccaacgtggcgctcacgctgcaagccgcgctggacgactgggagacgaaggaaccccaactgcgcgcgctggacgcccagttggaggcgggcacggtgcagagccgcccgctggacgtcagcgccctgcacgcgcccctgccgcgcgcctacgaatgggtggacggcagcgcgtacctcaatcacgtcatcctggtgcgcaaggcgcgcggcgccgagcccccggagacgttgaagacggacccgctggtgtaccagggcggctccggggacttcctggcgcccaccgccgacatccccctggccgacgaggcctggggcctggatttcgaaggcgaggtctgcgccatcctgggcgacacgccccagggcacgaaggcggagaacgcggcgccgcacgtcaagctgctgatgctggccaatgacgtgtccctgcgcaacctcatccccaacgagctggccaagggcttcgacttcttccagagcaagccggccacggccttcagccccttcgcggtgacgccggacgaactgggcgcggcctggcacgacgggcgcatccacctgcggctgcgctcggtgctcaacgggcagcaggtgggcgacacggacgcgggtccggagatgcacttctccttcttcgacctcatccagcacctgtgcaagacgcgcagctacacggcgggcaccatcctggggagcggcaccgtgtccaacgcggaccgcgagcgcggcatctcctgcctcgccgagcgccggatgattgagacgattgagcagggcgcgcccaagacgcccttcatgaagccgggcgacaccatcgacatcgagatgacggacgccgagggccgtagcgtgttcggccgcatctcgcagaaggtggtgaaggttccatga

SEQ ID NO: 6238 - DNA, 1458 bp, Myxococcus xanthus
atggaggagttgctgcgggactgggtgtatcactccgcgttcgcgctcaacttcggcatcggggacagcgacggcagcctggtggccatctggccgccgctgggcgtggcggcccaaccgatggcgggcgccaacttcgccgaccgctcctacttccgggacgtccgcagcaagcgcaagcccgtggtgagtggcgtgttcgcgggccggggctcggtgacgggtcccgtcatggtcgccgtctcgccgttgctgcggcaacagcgcttcgaaggcttcacgttggtggccatcaacctgcctcggatgcgaccggtggcgcaggagcgcctggctcccggtcagcgcgcgctgctggtggacccggacggcaacgtggcctttgacaccggcgccacgcccgggccggagccacagtccctgaagggcaccgcgctgggggagctgctgtcgacgctgcccgccacgggcacccgcacctacgacacggagccccaggcccccccgttgcggcggaccctggaggcgcggcacctggccaccgcgccgctgctccaaccgggttggcgcgtcctggtggaacatccgatgcgcgacatggacttcagcgtcatcggcacctacagcgcgctgatggccacgctggcactgacgctggtgctggccattcccatcacccgcctgctgacgcgcatgctctccaggccggtggaagccgtgtcccaggccgccggccgcatggccgcgggcgaacgcgacgtgcgcgcctttggaacgcgccaccgcgcaggcgccatcgaggtggagaagctgggcctggccttcgacgagatggcggcccggctccagcggcacctggaggaagtggagcgcgtcagccaggccaaggcggccttcttctccatcgccagccatgagttgaagacgcccctggccaccctcaagctgcgcttgcagcggctgcgtccggacaccgtgcgccagcaggacctggtcctcatggaccggcaggtggaccggctggcgcggctggtcaaccaactgctggatgtgtccgagctggccagcggccggctgtcactggcgcaggtgcccctggagctgtccgcgctggtgcggcgggtgtcggagcggcgcgcggcgtccgcgccccagcacccactgaagctgagcctggagcgcgtggacggttggtgggacgagccccggctggagcaggtcgtctacaacctggtggacaatgccatccgctacagcccggagggcggaccggtggaggtggtgctccggcgggagggcaatgacgcgctgctggaggtgaaggaccggggcgtgggactggggccgcgcgggggcgaggagctcttcagccgggcgcttcgcggcagcacgctgtccaccatcagccgcgtggagggcctgggcgtgggattgtatttgagccgtgaaatcatcacc

SEQ ID NO: 6239 - DNA, 534 bp, Myxococcus xanthus
tgctctaaactgagcgtgcgcgaggcgatggagcacttcggagcgcaccgcgacatcatgcgggtgctgcagacgctccatgacgtcggcctgggctacatccgcctgggacagccctcccccaccctgtccggcggcgaggcccagcgcatcaagctggcccgcgagctggcgcgcgtggccaccgggcgcaccctctacatcctcgacgagcccaccaccggcctgcacttcgaggacatccgcaagctgctgtccgtgctcaaccggctggtcgaggcgggcaacagcgtgctcgtcatcgagcacaacctggacgtcatcaagagcgcggattggctcatcgacctgggccccgagggcggcgcgggcggcggcaggattctggccgctggcacgcccgagcaggtcgccgaggtcgaaggcagccacaccggccgctacctgggccacgtgctgaccaaggcccgcagggcccgcgtgggcgtgcgcgtggacgacccggtgcccgtgaagaagggcgcgcggggctga

SEQ ID NO: 6240 - DNA, 357 bp, Myxococcus xanthus
atgcgctggaaggtgaacaacgagacgcggcaacggctgctggcggaccgggccgacaaggccacctcgttcctccaacggttcaagggactcatggggcgccgctcgctggaggtgggccaggggctccatatcgtcccctgtaactccatccacactttcttcatgcgcatccccattgacgtgctgttcctggacgcccagggccgcatcgtcaagcagatgcccgccttgccgccctggcgtgcgacatccgtgtatttccagtcacgctcggtcctggagcttcccgcgggtgtcctcgcggccagcggcacccaggaaggcgacgtgctgagcttcgagccggttccttga

SEQ ID NO: 6241 - DNA, 765 bp, Myxococcus xanthus
atgcgcatcgaggtagctggcagcacccacgttgggatgaagcggaatcacaacgaggacaacttcctgatgctcccggaagagtttctcttctgcgtggcggatggcatgggcggccactcgtctggcgaaatcgccagccgcatcgcggtggacgagctcggcgaattctacaagctcacgtccaaggaccaggactgcacctggcccttcaagatggacaagacgcgcaactatgacgagaaccggctcgccaccggcgtcaagctcgccaacgcgcgcatcttcgagaaggcctgctccgagtccaagtacaagggcatgggcaccaccatcgtcacggtgcacttctcccagagcgccgtctacgtgggccacgtcggcgacagccgcgtctactacttccgcggcggcgccctgaagcaggtgacggaggaccactccctcctcaacgactacctcaaggcgaagaagctctcgcccgaggagattgagaacttcccccacaagaacgtcatcgtccgcgcgctgggcatgaaggagaacgtccaggtggatgtctcccgcgtggagccgcaggaggatgatgtcttcctgctctgctcggacggcctgagcggcatggtgacggacgcgcagatgcaggaaatcctgcagcgcacgccggagctggagaaggcctgctcgcagctcatcgacatggccaacgccgcaggtggcaacgacaacgtcacctgcgtgctggcccgctaccacgccgcctga

SEQ ID NO: 6242 - DNA, 240 bp, Myxococcus xanthus
atgctcgagcccctggcgcgtcctctccacctggtcctcgtttctccccagattccccccaacaccggcaacgtcgcccgcctgtgcgccgtgacgggctgtcggctcatcctggtggagcccctgggcttctccattgacgaccggcagctcaagcgggcggggctggactactgggacaaggtatttctccgcctgtatccaacctacgcggcctatgcggcggactacccggacgcc

SEQ ID NO: 6243 - DNA, 342 bp, Myxococcus xanthus
gtgcagcacgtgctcgccgggcacgtgcggctggagtggctgggcacgtactcaccgttggcggggaccgtgcgcggcgcgagtggcacctgggcgcacgcggaggcccgcctggacggcacggcggagggcccggtgtacctgggacgggccagcgcggtggccgccggagccgccgtggggccgggcgtgtcgctggagccgggcgcgaaggtggctgcgggggcgcggctctcgcgagccaccgtcttcgaggacaccgaggtgtcctccggggagtcgctctccgaggtgctcgcctggggcgcgcaccggattgccgcgccgctgaaggggcgctga

SEQ ID NO: 6244 - DNA, 870 bp, Myxococcus xanthus
atggctcagaatggcaagaagaagatcggcctcatcggcggcggtcagatcggcggcaacctggcgctgctcgccgtgcagaagtcgctcggtgacgtggtgctgtacgacatcccggcggccgagggtctggtcaagggcaaggcgctggacatcaaccagctggccgcggtcgacggttacgactgccgcgtgaagggcaccacggactggaaggacgtggctggctcggacgtgatcatcatcacggccggcatgccccgcaagccgggcatgtcccgcgaggacctgctcgagatcaacctgaagatcatgacggacgtggcgggcaacatcaagcagcacgcccccaacgccttcgtcatcaacgtggccaacccgctggacgcgatggtgttcgcgctccacaagatcgccggtctgcccaagcacatggtcgcgggcatggcgggcgtgctggacaccagccgcttcaagtgcttcgtcgccgaggcgctgggctgctccatccgcgacgtggaggccctggtgctgggcggccacggggacgacatggtcccgctcgtccgccacaggacggtgggcggcgtgcccctgacggagctgatcgccaaggacaagctggacgccatcatcaagcgcacccgtgagggcggcccggagctggtcggtctgtacaagacgggcagcgcctacttcggccccgcggcgtgcgccatcgccatggcggagagcttcctgcaggaccgcaagcgcgtgctgccggccgccgccctcctggagggccagtacgggatcaacggctacttcttcggcgtccccgtgcagatcggcgcgggcggcgtggagaagatccacaccgtcgagctg

SEQ ID NO: 6245 - DNA, 729 bp, Myxococcus xanthus
gctctaaagatcaagccggtgtcccacgagggcagcgaccggctgatccgcgccgccatccagtacgccgtggaccacaagcgcaagagcgtcacgctggtccacaagggcaacatcatgaagttcaccgagggcgccttccgcaagtggggctacgagctggccgcccgggagttcggtgacaaggtctacacctgggaccagtgggaggccaccaaggccgccaagggcgaggacgccgccaacgcggagcagaaggccgcgctggccgccgggaagatcctgatcaaggactccatcgcggacatcaccctgcagcaggtcctcacccgtccggatgagttcgacgtcatcgccacgctgaacctcaacggtgactacctgtcggacgcgctggcggcgcaggtgggcggcatcggcatcgcgccgggcggcaacatcaactacgtcacgggccacgcggtgttcgaggccacgcacggcacggcgcccaagtacgccgaccaggacaaggtgaacccgggctcggtcatcctctccggtgagatgatgttccggcacctgggctggtacgaggcggccgacctgatgatccagggcatggaccgcgccatcgccagcaagacggtgacctacgacttcgcccgcctgatgaagcaggaagggcagagcggcgtctccgaggtcaagtgctccgagttcgggcaggccatcatcaagaacatgtag

SEQ ID NO: 6246 - DNA, 1476 bp, Myxococcus xanthus
  unsure (1)..(1476): unsure at all n locations
tccaagctgggggccctctctccagacgggcactgttacacgttcgatgcccgcgccaacggcttcgtgcccggcgagggcgcgggggtgacggtcctcaagccgctctccctggcgctcgcggacggcgacgccatctantgcgtcatccgcggcagtgccatcaacaacaatggtggcagcaacggcctcaccgcgcccaaccngaaggcgcaggcggaggtcatccgccaggcctgcgccaacgcgggggttgagccggcggaggtgcagtacgtcgaggcgcatggcaccggcacgcagttgggagacccgctggaggcacaggctctgggcgaggtgcttggcgcgggacggcccgggggcaagcccctgctcatcggctcctgcaagacgaacatcgggcacctggaggccgcggcgggcatcaccgggctcatcaagaccgcgctgtgcatcaagcaccgcgtgcttccggccagcctccactacgagaagcccaatccgctcatccccttcgaggcgctgggcctggcggtccaccacaccctgggagattggccggagcccgaccggaagctcatcgcgggcgtcagttccttcggcttcgggggcgcgaactgccacgtcgtgatggaagaggcgcgtctccccgaggcacggctcctccacctgtcgggtgagacgacggaggcgctgcggggcgccgcgcaggggctgctcgaccgcgtgacggcccgggagcacctgccactggccgagctgctccgcgcggccgaagcggacgcgggcacgcatgcgcaccgcctgacggtgacggtccggacccggaaggaccttcgtgcgggcctggagaacttcctggcgggagtgccgcgcccgggcgtgtccgtggggacggtggcggaggacgcggtccgtaagccggtattcgtctattcgggacacggctgccagtggccccgcatgggcctgccgttgctggacaccgagcccgtgttccgggcgacgctgctgcgctgcgatgcgctcatccgggagtacgaaggttggtcgctgctggaagtgctggccgctgacgacgcggcggcgcggctgagccggctcgacatcgggctgcccgcgattgtgtcggtggagatggccctgacggacctctggcgctcgtggggcatcgagcccggcgccgtggtggggcacagcatcggcgaggtgtcggcggcgtatgcggcgggagttctggacatcgaggacaccatccgcgtcgtctgcgccgagagccgcctgatgcacacgcaggcgggcaagggcagcctggcggtcgtgggcgtcccgtgggcggaggcggccgaactgctcgtgggctacgaggggcggttgttccgcgccatcgactcgggcgcgggttcgacggtgttgtcgggggatgtggacgcactggccgaggtgctcgcgtcgctgcaacagcgtggagtc

SEQ ID NO: 6247 - DNA, 645 bp, Myxococcus xanthus
ctctacagctactggcgctcgtccgcgtcctggcgggtgcgcatcggcctgcacctgaaggggctggagttcgagtacgtgccggtgcacctggtgaaggacggcggcgagcagaacagcgccgcgtaccgggcggtcaatcccatgcgcacgctgcccacgctggagtggacggaggcggatggcacggtgcgccggttgtcccagtcgctgccggtgctggagtacctggaggagcgcttcccggcgcccgcgctgctgcccgctgacgcgttcctccgggcgaaggcccggatgctggcggagatggtgaactccggcatccagcccctgcagaacctgtccgtgatgcagcacgtcaagcagtcgctgaacgcggacgacaaggcgtggtcggcctactggaacacgcggggcttggaggccctggaggcggcggtgcagtccacgatggggcgcttctgcgtcggggatgcggtgtcgctcgcggacgtgtgcctggtgccgcagctctatggtgcgcgccgcttcggcgtggacctggcgccataccccacgctgctgcgcatcgaagccgagtgccaggcgctgcccgccttccaggccgcccaggccgaccggcagccggacgcggttcccgcctga

SEQ ID NO: 6248 - DNA, 1499 bp, Myxococcus xanthus
ccgaggctcgatgacggaggtccccgagaccacgcccgccggccccgagacgccgcctcccctcctgggcatgcgggtgaagggacctccccacgtggagctgctccggctgaaggacggcgcggtgaatcccctgctccaggagggcgacgaagttgcgctccgactcaggagcggaggccagcgctatgcgctggtcgtcgtcatggacagcgagaaactggtggaggcactctggccacaagcgggcctgcagagcggcgagttggccaccgcgcagcccgccccgttgttccaggtcacccagggggatttcgtggtgcacgcgctgtattcggagacaccgctgcggctcgacacggttcgggactggttgagcacgctgcgtccggagtgccgcgccgcgccgatgcccgcggcctgtctgtcgctcgccagcaccccgccgggcgtggcgcatgcggccgtgtcgctccaggtcgaggcccgtccatgacgctcgcactgctcctggcggcggtggtggcggcacaacccacggcgacggacgcggatggaaatccgcgccggttcgccctggcggtgggcaacaaccgaggctccagcgcggacgcggtgctgcgttacgcggagcgcgacgcgcacaatgtgatggacgtgttgtacgaggtgggcggcgtgcggcgggacgacgcagtgctcgtcctgggccatgacgcggacacggtgcgccaggcggtggcccgcttcgagcgccacctccagacgcaggcacggaagggcgaccagctcttcgtctacgtctccagccacgcggacgcgggcgagctgcacctgtccggcacgaacctgcccctgcacgagctggtgcgcttcatcgagcgcgcgccggtgagcgtcgcgctcctcgtggtggactcgtgtcagtccggtgaggcggtgcgactcaaggggctgaagcccatccccagcgtcctggtcagcgtggagcggccggagctggcgggacgggtcatcatcaccgcctccgctgcggatgaagccgcgcaggagtcggacgcgctcggaggctccgtcttcacgcaccacctggtcgcggcgctgcgaggagcagcggacgtctccggggatggtcgcgtcacgctcgcggaggcctatacttactcctacgcgcggacggtggagtcctcgctgatgtcccgcgcgggcgcgcagcaccccagcttccacttcgacctccagggaaagggagacctggtcctctcctcccccgccctggccacgtcgctgttgacgctcgccatcgacgagcccggagattggactgtgttcacgctggcgggagagcccttcctgggcaacctgcgcaagggcgcgggcgcggccacgctcgcactcccggcgggcggctacatcgtcaccacccgcggcgaacactccgcgatgacggcgcgcgtgcagggtgcccgacgccggggcgcgcccagctcacacgggcc

SEQ ID NO: 6249 - DNA, 174 bp, Myxococcus xanthus
gtgctctcagggcatgccttgttgggaggggcgcccaaccccgtgacgtccatccagggcgtggccgtccaggccgtgttggaggcgggcatccgggcgcaagagcgtggcggcgcacatggcctggacctatcggaggcggagcgtgccggcttcgacgcaggcgctgcttga

SEQ ID NO: 6250 - DNA, 1149 bp, Myxococcus xanthus
atggaagtgctgggcgaccccgatgtgtccaatctgtccggtgctctggagcggctggcggagttgctgacggactggggcccggcgccgggcctgcgcttcgacgtgaaggccttctccgagcacgtggggaatgaactggctcggctgtcggagaacacggagcaggacgccgccagcgcccgtcgcgagctgctggtgggaacggtgcgcgcgctcggcacgcctgcgttcctggaggcgctcggcgccgcgctgatgtccaagatgtccacgcctggactgtccgccgaggaccggcgggccatcggcgtgggcacactgctggcctccgcgtccaagcggatgggcaaggcccggccggaggacatccccgtcctggacgtcgtcttcgacgtgcagttccgcgagtggagcgccaggcacaaggagctgtcccagaagtaccaggcgctggtgaaggggctcgaggaggagtccctctccgacgaggcgaaggccgcgctccaacaggctcgtggcggcgacgtgggcgcgctgctcaagtacgtgcaagaggacccggagctggccgagcgcatcgctcgcgaggccaaggagcgcgccgcccgcgtggaggcgtggctacgggcctcgacgacgccggccgtcttctcgcccgaagaggagctgtggctcacgtgcgcgctctgggacccgatgcaggcgctgaaggccttgcccacgggcacggagccctcggtgcgccgggacgcggtgacggcgctgatgcgggcggtgaagggcgcgctcgacgaggacttcctcgtggggctgctcgaccggctgcgggagaaggcgaaggatgcggccgcggatgacgccacccacacggcgtacatggacgccgccatcgccttcgaggcggagcccgcgcggatgacgctcgccgcgctgctcacggcacggaaggaagcagaggggcgctcgcccgaggagatggtggcgctggccgacctcaaggcgctcaccgcgtggacgccggaggccttcgagccctaccgcgagctgctgctgagcatgggcctgcctgccgccgccgcgcgcatcgagcgctgccagtcatggctcaaggagcatccggtgacgctgcgcaccgagcaggcctga

SEQ ID NO: 6251 - DNA, 471 bp, Myxococcus xanthus
catggcaagtgcctcacgctcggtatcgaactgatgctcgctgccgacatcacggtggcttccgaggacgccaccttcgagcagattgaaatcgaccgcggcatcttccccttcggcgggggcacggcccgctgggtgcggaccatgggttggggcaacgcgatgcagtacctgctgacgggtgatgcgctcgacgtgcgtgaggcgcatcggttggggctcgtgcagcgtgtcgtctcgcgcgaggccctgatggagacggcgatgggcctcgcggcccgcatcgcgtcgaagccgcccctcgccatcaaggcgaccatcgagagtgcgcggacggccgtcctcgaaggggagcgcgccgcggcggcgaagctcctgccggccatccagcagctcgcgacgaccgaggatgtgcaggaggcgctctccgcccacttcgaacgccggcccgcgaccttccgcggccgatga

SEQ ID NO: 6252 - DNA, 327 bp, Myxococcus xanthus
ccgatgaagtacctcgtctacgtcaaggatcgcatttcgggcccccagccacaggaccccatcgccctcaaccgcgctgtccgtgactgggtgggcgctcgcctccaggacggcaccttcgactgtgcctactacgtcctcccgaagatgggcctctgtatcctcaacgccgactcgcatgagtcgctgctgacgctgctgcgcgcctggccgtccttcgcgttccaggagttcgaaatccacatgctggcggacgtgcgccacggcatcgacaacaacttcgagcgcctgcagaaggctcagggccagagcgagagcgcggcctga

SEQ ID NO: 6253 - DNA, 837 bp, Myxococcus xanthus
gaacccctggttcctgagcgcatgccgctcgacaaccgccgggccttctacgagcgcatcgaagcgaacaataaacccgtcatcctcaccgacgccatgaagggctggcccgcggccgagcggtggaccttcgactacttcgccacgaagtaccgcgacgtgagcgtccccgtggagtggctgcaatacaacgccaaggacacgggcggcgtggagcgcgtgggccgcgtgcggaagatgagcatgcaggagtacgtcgacacgctgaaggcgaagggcggcgaaacgccgggctacctcatcggcaatgacctgttccgcaccctgccggagctgcaccaggacgtccgcttcgacgactacgccgtccagcgcaagctcaccgagcagctcttcttcatgggcccgcgcggcaccttcacccagctccacctggaccgcgcccacaacctgcacgccgtcatggtgggccgcaagcagtggcagttgtattcgcccaagcgggacgcggagctgagcccggcgaagctcagccacccgtggtccgtcgtgagcgcccacgacctgacgccccacgggggcaaggcggaccagctccccggcggccttgtccccgactacgacttcgtcctggaggccggggagattctctacctgccctacggctggtggcaccgcgtgtacacggtggaggacgccatcgccaccaactactggtggtggacctggtcgatgctggccaggctgggcccgaagctcatcccctccattgccctgagcgcggtgggccgcatccgcaagcagcagaagctgggccgcgagtaccgcgagcagtaa

SEQ ID NO: 6254 - DNA, 537 bp, Myxococcus xanthus
cagcactcctcaacggctccggcgcatgatgtgctcgacgacaagcgcaacctcgcgctgctctgggagcacgtgacgtcgcccgcgctgtccgaggcggaacaggagttggtgcgccggaacgtgccctggtcatgccgggtcgaacggacgcacgtcgagcgggacggggcgcggtacctgattccggagctgctggcctcgcaacgcgagtccctggtcctcaagccgggccgggactacggcggcgagtccgttctggtgggtgggacgacctccgccgcggactgggacacggccgtgcgcaaggcgctcgacgtgggcggctgggtggcgcaggagcgcgtgcacccgacgcccctccatacgctgggaccggaaggcacggtggtgccctacatcgccgtctgggggctcttcgtgctcggagagacctacggcgggcacttcctccgcatgtgccccatgcggcggggcactggcgtggtgaacgtcgcgcagggcgccatcgtgggcgccctcatcgaactggagtga

SEQ ID NO: 6255 - DNA, 512 bp, Myxococcus xanthus
ctgcgggagctggcggggttgttcctccggctggggacgttcgccttcggcggaccggcggctcacatcgcgatgatggaggacgaggtggtgcgccgccgcggctggctgtcgcgcgaggagttcgtggacctgctcggcgccacgaacctgattccggggcccaactccacggagctggccatccatatcggccatcggcgcgcgggctggcccggcctgctggtggcgggcgcgtgcttcatcctccccgccttcttcatggtcgcggtcatcgcctgggcgtacacgcgattcggcacgctgccgaaggtggacgccgtgttgcacggcgtgaaggccgtcatcatcgccgtggtggcccaggcgctctgggggttgctacgcaccgtcgtgcggacaccgctggccgccagcgtgggagcggctgccgtggcggcggctttcatgggcggcaatgagctgctcctgctgctcctgtcggggctcgccctgctcccgtggcgcgcatg

SEQ ID NO: 6256 - DNA, 390 bp, Myxococcus xanthus
atgcagtaccgggtgggagcctggcggccgacggcggacctcgccctcaacatccagcccatggccttcctggaacggcgactcaacatcggctcgaacctggcctacacgagccggggcatctccgagttcaacggcttcgtcggctaccagcacttcgtcaatgcctgggtggtgccctacggtcggttgatgatgggcacggcgacacgcgcatcacgcgacccgggcttcaacgtcggcgcggaggtgggcacgcgactggccctggggtacttcggccacgtcaacgtggcggctggcatgtaccgggcgagcggcaactacatgtccgtgggcgtgggcctcaacggcctcttcgtgctgctgatgctgctgcacgcaccttga

SEQ ID NO: 6257 - DNA, 888 bp, Myxococcus xanthus
acgaacgggacgctaatggcgcgttggcgcggccagcaagccgttctgtcgccatccgtcagtgcgcgggcggcggggggcctgcacgcttggaccatggacgacacaccttcgctgctcccccggctgcacctcttcgagttcacggaccagacctgggtccccgacgcgctgagagacttggtgaccgactacctccacaccatcagcacgcgcctgggcatcttcgacgcggcgacggaaatcctggcgcgcgggctgaacgcggcgcagggcccggagctggtggacctgggctccggcggccgaggccccctgccccgcctgcgccaactgctcgcggagaagcacggcatcgacgcgcgcgtggtgctcaccgacaagttccccaacgcccaggccgccgagcgggcgcgggcagagggcgtgcagtacctggaacgctcagtggacgcgctccaggttccggcgggcctgcggggcatgcggaccctcttcaacgccctgcaccacttccggccagacgaggcccgcgcggtgctcgaggacgcccaggcccgcggcgttcccatcgccgcgttcgagacggtacgccggacgcccccggccatcctgtccatgttgctggtgcccctgctggtgctgctgttcacgcccatggtgaagccgctgacgccgctgcggctgctgctcacctacgtggtgccggtggcgccgctcgtcatcttctgggacgggctggtgtccgcgctgaggacgcatcagcccgacgaactccggcggatgacggaggccctggcgcgcgagggctacacctgggaggtgggcgaggcgaaggccccgggcaaggccgccatcacgtacgtgcttgggcggcccacacgctga

SEQ ID NO: 6258 - DNA, 277 bp, Myxococcus xanthus
atgggcacgcaactggtgatgtacgaagaggagttcaccaagatcaacgccgtttgcgaccggcttaccaaggacgcgaacgcgaaggtggtcttcctcgtcgacaagaacgggcagctcatctcctccgcgggtcagacgcagaacatcgacaccacgtcactggcctcgctgacggccggtaacgtggccgcgatgggtggcctgaaccaagctgattggggagaacgagttccccaaccagttccacgagggggccaaggactcgctgtacatg

SEQ ID NO: 6259 - DNA, 420 bp, Myxococcus xanthus
atgcaggggctgcagttggaggcgcgcggtgagttgccggtctcgctgtcggtgcgcgacgccacgggcgcccgggcggaggcgacggggttctccgccggtggcgcgctgctggtgccgctgcggcgagcggagcgctggacgggcacgctggtgctggacttcgagcacgtgcaggacacggtgacgctggaggatgggacgcagtcccggcagcggctgcggcggatgggcgcggcgctggagctggcgtggcatggcggtgtccggacgacgcggcaggtgcccgtgccggtggtggtgcccgggagcgtgcggtttcatgtgctggacgggcggacgggcgcgccgctgcccggagcgcgggtcatggtggagggcgaggcgcacgtggcggatgcgcaaggcctcgtcgaagtg

SEQ ID NO: 6260 - DNA, 786 bp, Myxococcus xanthus
atgccaaggacggtcaccgccacgcgctacgtgacgccactgcgggagggcggctcgctgccggccatcatcgaggcggacgacgcagggctctacgtcgtgaagttccggggcgccggacagggcgccaaggcgctcgtcgccgagctcatcgccggagagctggcccgggagctgggcctgcgggtgccggagctcgtcctggttgagttggacccggccctgggacgcaacgagccggactccgagattcgtgagctgctcaaggccagcgcgggcctcaacctggcactggactaccttccggcgtcggtaacgttcgacccggtggcggaccccgcgcccaccgcggcggaggcgtccggcatcgtcgccttcgacgcgtacatcaccaacgtggaccggaccccacgcaaccccaacatgctgacctggcaccggaacctgtggctcatcgaccacggggcctcgctgtacttccaccattcgtgggacgactgggaggcgcgcagccagggccgcttcgcgcccatcaaggaccacgtgctgctgccgtgggccacggcgctgacggaggccggcaagcacctgggcgcgcgcatcacccgggaggtggtggagcgcattgtcggggccattccggaggcgtggctcacgagcaccgagtctcccttccccaccgccgaggcgcaccgcgccgcatacaccacctggctgctgcgccggctggaagccgtgcccgcgttcatcgaggaggcggaccgtgcccgcgcccagctcgtttga

SEQ ID NO: 6261 - DNA, 240 bp, Myxococcus xanthus
atgattcgcggccacctggagagcttccgtcgcgtgtgtgagggcgggaagggctcggggcccattggccagctatcccagaaggagcgctggcactgggtggtggcgcctcgcagcaccatcatccagacggggccggtgcactccggcctgtgtaccgagccccaggcggcgctggagcacctgctggacacggtggtgcggatgaagcgcgctactccgtcacccggcggccggtaa

SEQ ID NO: 6262 - DNA, 165 bp, Myxococcus xanthus
atggggccggtgacaattcgcgtggaggaggaggtcctccgcgccatcgggatgacgctggcggaggcgctccagcaactggggacaccgctggaggccctgtcgaacgaggacgccgggcccctcgcgatgagcacgctggccggtggcgggtggaagcagtga

SEQ ID NO: 6263 - DNA, 489 bp, Myxococcus xanthus
atggtgcgcacggcggtcatcttcggcgggctggccttcgcgctgctcgtccccgcggggctcgtcgtccagaaggagcacgtgctgcgctcgggtacgccggtgctgctggagctggcccccgtcgacccgcgctcgctgattcagggcgactacatggtgctggactacgccatcagccgcgagcgggacgcgaatcccgtcaccaccgccaaggacggaaacatggtgctgcggctggacgcgaatggcgtgggctccttcgtgcgcttcgacacgcccgacaccccgctggcgcccggcgagctcaagctccggtaccgcctgcgcaaggagcgcttccgcctgggcgcagaggccttcttcttccaggaaggtcacgccgaccgctacgagggcgcacgctacggcgagctgcgcgtggcggacagcggctccagcgtgctggtgggcctgagggacgcacagcgccagcccctgggccgctga

SEQ ID NO: 6264 - DNA, 594 bp, Myxococcus xanthus
gtgggcggcttcgcgctggacctgctgattctgggctgcgcggcgctgatgtacttcctcttcctggagcaggcccggctgcgacggggaaccccgggcgagctggtggggccggtggccttcgcgctcgcgtgcgccatccccggcgtgctgctggcgcgcggcatgcgggacgtggcccggcacctcttcgacaccgtctccgcgctcccggatgcggtgctgacactggggctgacggtcctgacgctgtacacggcgtggcgggtgctgcgtgagctggcgctggagcccaccggcgtggcgggcgcggcggtgttcgcggcgctgacgctggtggccgtgctcacgccccatacaccggcggtcatcaccgccgtgggcatgctggtgctcggcttccaccggcgcagcaacgtgctgctggggctggcggtggcgtacctgctcgcgtccggcagttggtactactacgacctgggcctcacgctgctggccaagtcgctggcgttgatgggcagcggcctggtgttcctgggcctgcgttcgttcctgctgcggcgcttccccgccccggcgtcggaggtgcggtga

SEQ ID NO: 6265 - DNA, 660 bp, Myxococcus xanthus
gcgccccaggaggggcaactctctcctgaaatcacccagaacggcacgttcctgggctcgccgcagtacatggcgcctgagcaggcgcgcaatgccaccgacgcgcgcagcgacgtgtactcgctgggcatcgtgctcttccagatgctgatggggcgtccgccgttcatcgcgcgcgaccacatcgagctcatcttcgcccactacaaggaagccccacccaccttccagcaggtgcggccggacctccacatcccgccggaaatcgaggcggtggtccgccgctgcctggagaaggatccggcgcggcgctaccagacaatggacgagctgctggagggcctgcgcgaagcgagcatgtccgcgggcggcaacagcggcatcttcaagcggcccggcggcgcgacgacgacgggcccctacccgtcccccacgctgttctccaacgtgggcaacaacaccgaatccggtgacacgctggcggtggacatcagcgtggaggtgccccgggacgtcaagcgcgcccggcagcgcacgctgctcacgggtggcctgggaggcctcgtggtggcgggcctcatcgcgggcggcgcggaaaacttcatgtcgaacaaggaagcggcaccaccggcccccgcgccccaggcggaggccccggcg

SEQ ID NO: 6266 - DNA, 1035 bp, Myxococcus xanthus
atggggacgaatcgacagacgtggctggcgttgacgctgaccgtggtgggcctcctcgcggggtgttcgccgggcgcgagccccacggaagaggacgcggacggggatggggtcgcggacgcggcggactgcgctcccggcgatgcgaaccggtggcggatcctggaaggtcacgcggacgatgaccgcgacggcgtgggcgctggcgcgctgcgcgaggtctgcgctggcgagcaactcccggagggctggagccagcagagcggcgactgcgctccgggcgacgcgacccgctggcgggagcaggccgggctctacccggaccaggacaacgacggcgccaccggcgagggccccgtgacggcctgcgtgggagacacgctcgagggctaccgcgagcaacccggcgcgccggactgcgacgacaacgccccccgcttcgccgcctccacccagctctggccagacgcggacttcgacggcatcggcaacggcgagcccatctcccactgcgcgggcaaggacctgccccggggctacgcggcggtcgacggcgactgcgcacccgacgaccgcgcgcgctcgacgtggcgcgactacacccaccgggacgcggacggcgacggcttcaccgtgcccgaggaaggccgggtctgctccggcatgacacttcccgccggctacgccctggaggcgcgcggcctggactgcgacgacacgaacgccgcatggtggcagaagcgcaccgtctacgcggatgtggacggagacggcttcggcagtggtgaccccgtcatgcggtgcacgggccgcacggcgcctcccggctacgcgctggactccgttgactgcgcgccggaggacgccacgcggtggcagtggcgctcctatgcccaccgggactcggacggtgacggcgacacggtgcccgaacagggcgtgacctgcagcggcgcggcgcttcctccgggctatgcccagtggcccaccggtcatgactgcaacgaccgcgatgccaccgtcatggtgacctgg

SEQ ID NO: 6267 - DNA, 624 bp, Myxococcus xanthus
atgagcagcatcgcccaccagcacggcttcctgccggagacgctgtggaacctgccggagaatgccgtgctgcacgcgaagcagcgccagcgccacgtgctgtaccccggagacaccatcaccctgccgccccggcgggcgcgagacgaggaggcacgggccggacgcttgtaccgggtgcgccgcaagggcattcccgacatgctgcggctgcgcttcctcgacgtcgacgaagagccccgggtggggctccccttcctcctcaggctcaggaccttctcgggggagagcgtccgggacgtccggggcgagctggacggggacggctatgtccaggcgaccatccctcccgatgcggacctgggggagctcatcctcgggacggggcccgaccgcgagacctatcaactcgagctcggccacgtggacccgctcggcaccttccccgggctccaggaccggctggcgaacctgggctacttcagctgctgcgagcaggacagtgagcaccacccggtgactcgccaggccctggagcggctgcagctggcgtatggcctgaagcccaccgggaagctggatggcgccagccgcgagctgctgaaggcactgcacctgtcgtaa

SEQ ID NO: 6268 - DNA, 1302 bp, Myxococcus xanthus
gtggatggcgtggagtccaagggcatccacgtcaccgcgggcgcggacatctccgtgtatgggctcaaccggctcctgcaaacgacggatgcgttcctgggcttgcccaccgcgagcctgggcacggactacgtggtgcaggcctatccgaacgtcaacgtcgtcaacggctcgcagttctccgtcgtggccacggaggacgcgacggaggtgaccatcacccccgcgagtgtggtgggcaaccacgccgcgggagtgcccttccacgtggcgctgaacaaggggcaggcgtatcagcttcgcagcacgggggccgcgccctcggacgtctccggaacgctcgttcatgccacgcgcccggtggcggtcttcggcgggcatcagtgcgccaacatcccggatggcaccacgatcgcctgtgactacctggtggagcagctccccccgacctcgacgtgggggcggcgcttcgtgaccgtgccgctggccacacgcctcggcggggacaccttccgcttcgcggccgccagggacggcacgcaggtgagcctcaacggcgcggtggtggcgcagctccagcgcggccaggtgttccagacgaacatccagggctcggcgagcatcaccgccaacgagcccatcctcgtgacgcagtactccaatggctctggcttcgatggcatcccgtccgacccgttcatgatgttggtgccgcccttcgagcagttcgccgcccagtacaccgtcaccactccgagctcggggttccgcagcaacttcgccaacatcgtggtccccaacgacgtcgtggccgaggtgatgctggacggagcgctcatcccggcgagccagttccaggccatcgggaccagcggcttctccggggcccagctccccgtcgcgctgggggcgcaccgcctgtccgcgccgcagcccttcggcgtcatgctctatgggttcgatgcctacgactcctatggctacccgggaggaatggccctggcgcccgtggcggaggtgagcaagctcacgctgtcgcccagagagggcgtcgccgtcgtgggggacctctactgcgtgacggccacggtccaggacgccgcggaccggccgctcgcgggcgtgcgagtggacttcgcttcgtccggagtgaactccgccttggcctccgtgaacaccaccgccgacgggcaggccgagttctgcttcgagggcaccgcccccggcgaggatgcggtgaccgcgagcatcggctcggtgaccgaccaggtgcgggtgacctggacgaagcccaacgccccg

SEQ ID NO: 6269 - DNA, 783 bp, Myxococcus xanthus
atggctcaagagcctctccatatcgcctcggagttcccggccccgtcggtggaagactggcgccggctcgtggacaaggacctgaagggcaagcccttcaccgcgctccagtcgcagttggaaggcggcctatcgctccagccgctctacacgcagcaggatgccgccgtcgcgccgcccggcgtggccccctacgtgcgcggcacccaggccctgggcctcaccgagggtggatggctggtgtgccaggagtacagcgagccagacgtgacgcaggccgccgaggccatccgcacggacctggaccggggcggctggggcgtgtggctccacctgggcgacacgcacggcgttcgcgtaccggatgccgaggcgctgcggcggctgctcgcccatgcgccactggacacgacgcccgtccacctggagcccgagtccgacccgctggccgccgcccagcgcctgctccacgtcgcggagcagacgggcgtgtcccgcgcggcgctgaagggcagcctcggcgtggatccgctcggcatcctggcccgtacgggctcgctgcccatggggctggacgcgacgctttcccaggccgcgcccctggtcacctcgctgcgtgaagccgcgcccggcctccgggtgctgctcgtgtccacgcgcgcctacgcggacgcgggcgccacatcggtgcacgagctgtcctgggccatcgacacgggcgtggcgtacctgcgcggactggagcgcgcgggcgtcttccccgacgctcgcggcgcgctccgt

SEQ ID NO: 6270 - DNA, 426 bp, Myxococcus xanthus
gcgcagcgcaaggagagccatgccgccgaggccgccgccgtcgcgtggttctacatccggggccacgtgggcgttcccggcaacgagcgtgtggacgccatcgccgtggcctattccaaggggcgtgacgcggggctctacaccggcccgctccacggctacggcgtggcggtgcacgacctgccggaggacatgtcactgcctccagagaagcccaaggaacagcgggaggcagcggccaaggcctactcctacctgagccaggtgggcagctccgtgaagcgccacgcctcctgggccgcgtgtgagcgccgggtaaaaggtgtgtccggcgcccgtttcaagaagacaaagagcgcgttggatgaagccaaagtgctggaggactggggcttcaagggacaggacgtcccgtcggaagactga

SEQ ID NO: 6271 - DNA, 1218 bp, Myxococcus xanthus
ccgtcgtggaatcacgctgtgccagcagcgctgttgctgatggcgcccttcgacctcctggcctcactggccatggacatctacctgccagtcgttccggcgatgcccggaatcctcaacacctctcccgccatcgtccagctcaccttgagcctgtacatggcggtgcttgggctcggccagatggtgtttggcccggtctccgaccgcatcggccggcgccgagtgctgctgacaggcgccctcctgttcgcggtcacgtccttcctgctcgcgggggcctcggatgccgcgatgttcgtcggccttcggctcgtccaagccatgggggcatccgcggccctcgtcgccacgttcgcgacggtccgcgatgtctacgcggagcgccccgagagcgcgaccctctacagcctgttcagcgccatgctggccttcgtccccgcgctcgggcccatcgcgggggcgctgctcatgcagcgctggggatggcgagccatcttcatcacactcggagtcctggccacggcggcgctgctccaagccttgccgcggtggcacgagacgcgcccggcgcagggccttcagtcacgtcccgcgttccggcacatcctgcgcagcgccacgttctggacgtacaccctgggcttcagcgcggccatgggctccttcttcgtgttcttctccacggcgccccgggtgctcatcggtcaggccggcttctccgagctcgggttcagcctggcgttcgctaccgccgcgctcgcgatgattctgacgacccgcttcgcgaagcgcttcgtggggagttgggggctggcgggtagcctcacgcggggcatgggcatgttgctgctcggggcggggctcctgacggccggacagctcctggcaacgcggtcgttctggacgttagtcgcgccgatgtggctcatcgcggccggcatcgtgttctccgtttccgtcaccgcgaatggcgcactccaggcctttggcgatgtggcgggaacggcggtcgcgctctacttctgcatccagagcctcatcgtcggcgtcctcggcacgctgatggtcgtcctgctggacggcgacagggagtggcccctggtaggatacgcgtccctgatggcaggggtgacgttgacggcgcttcagcgcctccagcgccgacaacgcgtcctgacgaaacccgcgatggcggaaagccccgacgccccctag

SEQ ID NO: 6272 - DNA, 921 bp, Myxococcus xanthus
ccttacctccctcatcttcgacaccatcgacacggtgctgacccgcgcgaaggaatccggcctgcgccccgagcaggtggcggaccggatggtcgaggagcggctggccggctgagcgctcacgcacgcagtgcgtgtgttgccgcgatacaaaggcgacgtctggggtgtggccggatgtggccaccgtgcggccctcggagtatgacggggccgcacacaccccagccggagttcagcgccgtggcgaccaaacggcagagcaagtccaccgagaaggcctcttcgaagaagtcccctgcggtccaggcggagaagctcgtctccattcccgcggacgtcgtgttggcgccgcaggtggaggccccgcgccagccgacggggaaggaccagtcccgaggccggtccgcgtccagcggcgtgaaggagctgtcctggaaggagttcgaccgcgcggtccagcagctcgcgggttccattcaggagacgttcgaaccccaggtggtggtcggtgtggcccacggcggcgtcttcgtgggcggcgcgctggcgggggcgctcggctgtccgttcttccccgtgcgcatcagccgccgaagcagggaccggggcagcgccgcgcctcgcacgtcgaaatcgccgcagctcgccggggagatgcccgcggagctgaaaggccgtcgcgtgttgattgtggatgacgtggcctccagcggtgacacgttggagctggccaccgccctggcgcgcgaggcgggcgcgaagaaggtggccaccgcgtgcctgatgacgaagcccggtggcttctcgccggactactcggcgctctccaccgcctcgctcatggtcttcccctgggactacgagccgtccaccggcgacgcgcgcttcgacgaggacccggacaaggctggcgcatga

SEQ ID NO: 6273 - DNA, 372 bp, Myxococcus xanthus
ctcatgtacgtggacaacgaggacggcaagagcctcaccggcattgatgccagcaccctcgatgtggcgcgcacctatccgctgggcttcacgccggccatggccgccaccgcccccaatggggacctctgggtgacggacaccgacaacggcaaggtcatcttcttcgccgcaggtacgacgacacgtcagggggaactggccactggcgccggagcccatggcatcgcgttctccgctgatggcgccacctcattcatcaccaaccagaccgcggggacgctcagcatcgtcgacgtcgcctcgcgcaccgttcggaagacgctcaccgtgggcactcagcccaacggacttgtcttccgcaagaactga

SEQ ID NO: 6274 - DNA, 1399 bp, Myxococcus xanthus; identical to SEQ ID NO: 367

SEQ ID NO: 6275 - DNA, 900 bp, Myxococcus xanthus
atgaccttcttcgattcgctcgccgcggatgttcgcttcgcgctccgcaccttccgccgctcacccggcttcgtcgccgccgccgtgatgtgcctggcgctgggtattggcgccaacgccgtcatcttcagcgtggttcacggggtcctcctccggccgctgccgtacgcggaacccgagcggctggttagtctcgtcgaggtgcgcccccagggctatggcggcccggtgtcctggcccacgttctgggcctggcgccaacacagcccggccttcgaacagatggcggcattcacaggcggcggcgtcaccctccaggcccaggatgcgcctgaacgcctccaggctcttcgcgggacggctgacttcttcacggttcatggcgtgccgcccttgctgggccggactttcgcgctcgacgaggacctgcccggccaggccccggtcgcggtcctcagcgagcgcctctggcgcgcccgttttggcgccgacccagccgtcctcggccgttccgtgagcctggatggcctggcccacaccgtcattggcgtgatgcccgcgtctttcgatgcgtccaccgacgtgtggctgcccctggtggctccgccggacgccgccgctcggacccggtccacggtgctgaccctccgggcccggctggcgccaggcgtttcgctggcctccgccgaggcccagttgaagcaagtcgccgcgaactccgcggcggcccaggcggaatcccaccgggaccggagcgcccgggtcattccgctcgatgaaagccagacgcagtcctggcgggcgccgctccaggtcctgctgggcgccgtcgccctggtgctcctcatcgcgtgtacgaacgtcgcgaatctgctgctggcccgcgcgggcacccggcgg

SEQ ID NO: 6276 - DNA, 453 bp, Myxococcus xanthus
atggcgctcacgggatgcggcgaggacgacacgtacacctacgacgtgacgctggacgcggagacgcttgcccaggtgccgacggagtgcagcgagttggtcgaacctgcccagggccccgcggtcggcctggacgcgcagcagcgctggacgattcgccgcggggagatggactcgatgttcctcgaggtccccgacatcgacttccagacgccgaacaacgcctacgtcatcaacggcgacggcgagccggacgtgctcatgggctcggtgggcgcggacggcggctaccagttcatccacatccagacgcgcctggatgaggagcacaagctgtccgccctgggcaacgagcacgccttccgcatcgccatccacaacaaggacctggatgacaccatccagggcactgtctgggtccgcaacgagcacgtcgagcgggactatagagca

SEQ ID NO: 6277 - DNA, 762 bp, Myxococcus xanthus
ggagccaaggacttcgaggccgcggctgccgcaacgctccggcggctgcaggccgtcgcccaggaggccgttgcgtccagtcggtacgcagcccggggccgggtgttgcgaggcatcgtccacctccgccccggcgaggcctaccgcagtctggccgcactggaggtaggggctgcggagattacggatgccagtgtaggcacgcccttcttcacctccgccacggcctggcgcgcggtggtggagcaccggtgcgcggtctccatcgacgtgaatgtcgggacggtgcagccccatgcgcccaacgcccccgtgacgggagacccgagcctggcgggcttcaacagccatgagagccggcagcgcttcctgggccgtcatgcgacacacgtctgcgtgcttccgctgcgcacgccgggtggggacatcgagggcatgatttcgctggaggcggactgcctggccgcgatggggcaggacttcgtctggctggaggcaggggaccggctccaactgctggcggacgtggcggcgccgtacctggcccggctgccgcagcggcccgtggcccggccggaggtggatgagttcctcccggtggtggggcgctccatggcggagctgctgcccatcctccgcgtcttcgcgctgcaggatgagaccatcctcatcagcggcgccaccggcgcgggcaagtcacggctggcgcgctggtgccacgagcgctccaaccgccgcggcaagcccttcgagacactggac

SEQ ID NO: 6278 - DNA, 1248 bp, Myxococcus xanthus
gaaagtggaccccggagattgcccgccgttcctcccgcgaggaggacccagcgccaggaggaagggctggagctcatcgcttcggagaacttcgtctctccggcggtgatggaggcggtgggctcggtgctcaccaacaagtacgcggaaggctaccccggcaagcgctactacggcggctgcgaggtggtggacgtcgcggagaacctggccatcgcccgcgccaaggacctgttcggcgcggacgcggtcaacgtgcaggcgcactccggcagccaggccaacatgggcgccttcatggcgctgatgaagccgggcgacaccatgctgtcgctggacctcaactccggcggccacctcacccacggcgccacgttcaacttctccggcaagctctacaaggtcgtccactacggcctgacgcgtgacacggagaccatcgacttcgcgcaggtggagtcgctggccaaggagcacaagccgaaggtcatcgtcgtgggcgccagtgcgtacccgcgcacgctggacttcgcgaagttccgcgagatcgccgacgcggtgggcgcggcgatgctggtggacatggcgcacatcgccggcctggtggcggcgggcgtgcacccttcgccggtgccggtggcggacatcgtcaccagcaccacgcacaagacgctgcgcggtccgcgtggcggcctggtgctgagccgcgagccctacgccaaggccatcaacagtcagatcttccccggcatccagggcggcccgctgatgcacgtcatcgccggcaaggcggtggccttcaaggaggcgctgtcgccggagttcaaggcgtaccagcggcagattgtcgccaacgcgaaggcgctggcggaggcgctccagcgcgcgggcctgcggctgacgtccggcggcacggacaaccacctgatgctggtggacctgcgccccaagaagctcacgggcaaggtggccgaagaggtgctggacaaggccggaatcaccgtgaacaagaacatgattccgtttgacccggagaagccgatgaccacgtccggtgtccgggtgggcacgccggccatcaccacgcgcggcatgcgcgaggcggagatggcggtggtggggcggctcatcggcgaggcgctggacgccgcgcaggacgacgccgcgctggcccgcatcaaggggcaggtgaaggagctttcgcaggggttcccgctctacgcctcgcggttgaagtagattggcgag

SEQ ID NO: 6279 - DNA, 147 bp, Myxococcus xanthus
atgaagggcgagctcgtcacgggcctgcgggagtatcacgagggagacgaggttcgtgtcacctacggcgatggacccggaggtctggtggcgcaccgcgtggatgggatgccggggcccggtgccgaacctccgcgtcagcaagag

SEQ ID NO: 6280 - DNA, 525 bp, Myxococcus xanthus
gagcagaacgcgaagcggatggagaaggtgattgcggcgctgacgtccgcgggtatcgcgcggcgggacatccagacgcgtaactactcggtgtacccggagtacgcgccgccgctgccgaaccagacggagccgaagctgaagggctaccgggtgagcaacctggtgagcgtccacgtgaaggacctgtcgcgggtggggaacctgctggaccaggccctggcggcgggcgcgaaccgggtggactcggtgcgcttcgggctgagccgccaggaggcggtgcagggcgaggccctgcggcagacggtggcgcgggcgcgcaagtcggcggaggtgctggccgcgtcgctgaacgtgaagctgggcgcggtgctcgacgcgagcacggtgacggagccgccgcagctctacccggcgcgcttcgcgatggccgaggtcgcggatgcccgcgcgatggcgacgcccatccagcccgaggagcagacggtgcaggcgaaggtgacgctcatcttcgccatcgagtag

SEQ ID NO: 6281 - DNA, 348 bp, Myxococcus xanthus
atggcgtgcctcgacacctcgatacgcggcacctacgtgagcagcgtggtgcgcttcctgaggacgcagctcccccgggagagcgcggacctgaaggagcgggagctgcgcgcacgggccgagcgcggcatcgacgccgcggcccggcatggcatcaccgcacgctgggacgtggcccgcttcatcgcctgccagctctgcctgggcgagcacttcgacacggacccggcccatgcctggccccaggccgtgctcgcgcggccgtacctcacgccttcccggaagatggactggattgagcgccattacctgcggccccgtcgcgggcgctcccctaccgtgccctga

SEQ ID NO: 6282 - DNA, 280 bp, Myxococcus xanthus
atgccggaattcaaggtcgacgcacgcggtcccatcgaaatctggaccatcgacggcgagagccgccgcaatgccatcagccgcgccatgctgaaggagttgggcgagctggtgacccgcgtgtcttccagccgtgacgtgcgcgccgtcgtcatcaccggcgcgggcgacaaggccttctgcgccggcgccgacctgaaggagcgcgccaccatggccgaggacgaggtccgcgccttcctggacgggctgcgccgcaccttccgcgcgatcgagaaga

SEQ ID NO: 6283 - DNA, 873 bp, Myxococcus xanthus
atggccacgcctctgcgctccatctcgcaccgactctcccggtgggccccctggctgcccgccatcgcctacgtggcgctcctgcttccgctcgaagccttgggacgcggaggtggcggcgagcactactcccgcccctcgtccggcaacggtggtggccgcggcggcggcgacggggacggcgtcgcgctctgggtcgtctaccagctcttcagcctggtcttccgctaccccaaggtcatgctgccgctgctctgcattggcggcatcgtatactggctgtaccgccgcaacctgcacccggacgccaccacccggaaggccctggagcagcgcgaggcgtatcagcgcacccaggtgtcccagcgtgacgtgcaaggctgggtgaacgccctgaagctgaaggaccccgctttcgagctggagccgatgctcgacaagacgaagtggctgttcatggagctgcagcaggcgtggttcctccgggacatgacgccggtgcggcccttcctgtcggacgccaccttccagcgcttcggcgtgcaactggagctcatgcgcgcgcagggcgtgcgggacgccatcaccgacttcgaggtgctggacctccagctcatcggcctggaccagagccagtggttcgacagcatccacgtccgtgtccacgcgcggatgcgagacaccgacgtgcccgtgtccttcagcgacgcgcaggccaccgaggccgcgcgcaaggtccccagcgaggccttcacggaggtctggaccttcgtgcgcaagccgggggcgcagacgcgcatcggcgcggacctgttccagggcaagtgccccaactgcggcgcgccgttcaacggtggcgcggacaatagataa

SEQ ID NO: 6284 - DNA, 996 bp, Myxococcus xanthus
gcgtactcggaccggccggtgccgttggatggctcggtggcggaggtgctggctggcgcagtgggagacgcgtccgcgcgctgcgcggacctgggcttggtgacgccgccgtcgctggacggagacgcgaaggcgctttcgctcgtgacgtccatcgacctgctcgtgggggcccgggacgtggaggcctggagccgaggtgagtacgagttggtgatgggcgacgtgcacgacacggcgctggtgtggggctgggcgctccagttccacgaggcgcgcggccgggtggagagcgccatggtgcgggcgctcggcgccttgagcaggccggtgcccctggtgacggtgttggcgtcgcggcgcacgggcctgcttccgtcggagttcccggggcccgtggtggagctgggcggtgtcagtgcccgcgcctccgcgtggcggctgccgctggatgacctgttcgtggagagtgatggaacgcgggcgcggctggtgtcgaagcggctgggctccgaggtgtgtctctacaacggtgagctggacagtctggtgcacaccgccttctccctgccgcgcatccgtccgctgcgcgtgtcgctgggcgagcacacgcctcggttgaccctgggcggtgtcgtggtgcagcgcgagcagtggcggctgtcgcaggcggagcgggaggcgctgctcgcgggccgcgatgactcggcgagacttcgcgcggcggtgagcgtgtggagcgagcgcgggatgccggactgcgtcttcgcgaagttcaaggacgagcgaaagccggtgctggtggacgtgcgcagcccgccgctgctccgcgtgttcctcaacctgctggagcagaaggaggaggtcatcctgtcggagatgctgccctcgccggaccagctctggctgcgaagtgcctcgggtgggcgccataccgtggagctccgttgcacgctgatgtggggctcggagtccgctgccggagcgcgggaatga

SEQ ID NO: 6285 - DNA, 1101 bp, Myxococcus xanthus
atgaggctgctcgtcctgccacctcaccgcgacgtgacgctcgtgccagaggcgccggaagggtggcagtgtgtcgacgtggcgcgcgacttctgccggcgcgtcttcgcccacgacgcggtggaggccgccgccgccgcacgcgagcgagcgcccgcgaccgcgcagacgatgcgagagctgctgctgttgcgtgccgcccagtcgctgcatgcgcgtgcggactcgagtgtgagcacccgcctgcgagcgctgggggcggtgctctccgccatttcggggccgcccgacggggtgcacctccggctggacgatgtggagctggaaggcggcacgaccgagcggagcgcggacgtcttgcgctccttggaccagctcgcgtcgtatcgggaggacctgaccctcgccgctgctcgcttcgctgaggccgagcgcgtgcggctctggctcgaacgcgacctgcaactgcctgccgcggcctggctggcgcgggcctgtccggagcaggtgccgctcgaagtcgcggggcccttcgcctgggcgcaccgggccgtcctggctcaactgtccgtgttccagcgcgccaacttcgtggacgcggccccacttcgctggcgcgtgtcgcccggattggatgaggcggtttccacgtcacgcgtctggctttccgaggcgctggacgtgagggccacccctccggacacggtgcgcgccctcacgggaggcgcggaggcgtgggcggggcatgtgtcgctcgattcgctcctgcatccggaccgtgctggtggaagagcggctgcaagggtggcccgtccgtgggggttctttgcgccgtggacagcgacgcctggctcgaccccttgggtgcgcgcgtctcccgagaggcgctggctcagggcactcgccggcttcgggacgcgggggtccacctcgtggcggagtggtggatcggcgcgcccggcgtcgacgaagcggacctcgacgcgacgctcgctgtgctggacgcggagccggtgttcgacacgctcgcgggagtgcgtcccttccactggccgcggatgccttccgaaagtggccgcccgctgctgtggccagacgtga

SEQ ID NO: 6286 - DNA, 147 bp, Myxococcus xanthus
atggacgcgcggctggcgccgaagctcgccggcctcgttcggcccatggaagtggccagcgtgctgggggccgttccccaggcgcagcgggagaagctggtggacacactggtggccaggtcggtgctgacgagggtgaacggatga

SEQ ID NO: 6287 - DNA, 607 bp, Myxococcus xanthus
atgagcgagccctggacgttgggcgaggtattcgtgctgcggcacgcgggctttccctttgactggctggagtcgctggggatgtctcaggcggtgctggatgacgtcgcccgcttgctcgaggccgaggacgcgctcgtggacgccgtgcgcgcggagaagggcgcgtccggcgcgcaagccctcctcgatgcgctgtcccaggggcgggagccccgaatcgacgcacggctggggccctcgtgtcaggacgcatgggctcgctaccaggagcgtcgcgagtccgttcaggcgggttacaccgcggaacgaaagacactgcgacggcaactgcgagagcgagccgcggatcccgccatccaggaggccgtgttcctctccagcccggcgatgttcgacaacgtctgggtgcgctacctgcgcggcggggagcggccggacacgtccgatgcatgccgggtggagcggcaggtgtacaccaacctccagagcttctgcacgaagaacgaaacaaccagcttcttcggccccatttcatacggcgagcgaaccaccgaggacggctacgacgtgcgcacggtgcccagcgcacaacacgaggccgccg

SEQ ID NO: 6288 - DNA, 1221 bp, Myxococcus xanthus
gccctgatgctgttcgcctcggcgggcatgagcctgcttgcgatgtcgaacgagctcatcacgctcttcgtcaacatcgaggtcctctccctctccacctacgcgctgacgtcgtacctgcggcgtggcacgcggccgagcgaggcgggcttcaagtacttcatcctgggcgccttctcgtccgcggtgctgctctacggcgcggcgctgctgtacggcgccaccggcaccacccacctgacggccatggccggtccgctgtccaccgccatgtcgtcgcagccgggcctggtgtacgcgggcatcatcctggtgatcacgggcttcgccttcaaggtcgccgcggtgccgttccacatgtggacgccggacgtctacgagggcgcgccgacgccggtcaccgcgctgatgagcgtgggcgtgaaggcggccgccttcgcggcgatggtccgcgtgttcttcatggtgggcaagggcgtggacccgcagatgctgctgggcctgttctccgtgctggccttcctcaccatggtggcgggcaacctgctggcgattccgcagcgcaacgtgaagcgcatgctggcgtactcgtccattgcccacgccggctacctgctggtgggcgtggccgccctcttcgtcaccggcccgggcgagcagttccgcctgctgggtgcgtccgcgctgacgggtggcaccccgctgggcctggcccgcgcggaggcgctgcgcggcatcctctactacctgctggcgtacacgttcagcgcggtgggcgccttcgccatcgtctccgtcctggagcgtcgcgaggacgaggagaagggcaccgcctgggacctggagcgcttcagcgggctggcgcagcgcaagccgggttgggccttcgcgatggcggccttcatgctgtcgctgggtggcatcccgcccaccatcggattcatgagcaagctgctcatcttccaggccgccgtggatgcgggcctcatcggcctcaccatcgtcggcgtgctctccagcgcggtgggcatctattactacctgcgcgtggtggtctacatgttcatgcggccggtgccggagggcgcgcaggcgctcgagaagagctggtccaccgaactggcgctggtgctgtccaccgcggcggtcgtgattctgggcatcatccccggtcccatcatgggctggctggagcaggccagcagcatcttcggccagtag

SEQ ID NO: 6289 - DNA, 249 bp, Myxococcus xanthus
tgtgctctacagttggggatgatggacctgcgccccggtcctagcttgtttcccttcttcgcggtgtctcccgggcatgcgcggacactgctcgaagaggccttcggccagttggaggagggcgcgtcctcgctgaatgtcacggtggcggaagacgcgcccctggtgcacctgttccgggatgcgggagcgcagacgcgcctcgagacgctggagcttcgcggcctgctggtggacgcggcgccctga

SEQ ID NO: 6290 - DNA, 678 bp, Myxococcus xanthus
atgggcgccaaacggtacctgttcacgttcggcctggcggcagggctggtctccgcgctcctcctgggggggatgctgcgagccgtgtccggggcgccgcttccgaatgccacctgggcggtggtgctgctcgccacgcccgcgctctatctggcggggggatacctcgcgtggttccgctgggcggcgcagcggcggcaggtgcgccggcaggtgatggcgcggctggcggagggcgacctcaccaccacggtggggccgcgctatgaaggccacgaggacgtgcgccgcctcatcctgtccctgcggcgcgccctggcgcaggtgcagcgggtgacggccaacctgcaccgcaccagcacggacgtgagcgggcaggcccggatgctgctggaggccgcgcggcggcagggcggcgcggtggagcgcacgctggaggccgtcagcggaatgggcggcagcctccaggtggcaggcaagcgggtacaccaactggaggtcttcgccgtcgacaccaccggcgcgctgctggagatgacggagcggctggagcaggtggtggactcgctggcccaggtcaacaccttcgcccacaacaccacgtcgctgatgcaggccatggccgaacggatggccaacatcgccgcgtccggtgacgaactgggccgcttgagagca

SEQ ID NO: 6291 - DNA, 576 bp, Myxococcus xanthus
atggaggcgctggaggtgggcgactcgcgcttcaccgtggccgcgcctggggagcggctgcgcgcgcctcccgagcttttcgcggacggactgcccgtggagggggcccgaggcgcgctgtcgctggagccgccgctcgacgttccagcgcggccggcggggctgacgccgtggaatgcggcggcggcgcgggcgctggctgccgaggtccacgcggccttcccggagaagacgcccggtggtgcggactggagcgaggacggcgagggcgaggcgggcgggtgcctggcgcacgcgctgcgcttcgcggcgggggcccgtgctcggggcgtgaaggtggcgctggtgcacgggctgctggtggtggacggcgggccggcgcgcccccacgcctgggtgcgcgtggcgctgtcgaagggcgggacgttggatttggacccgacgtccctggacgaggtgtcaccgcagacgcacctgcccatcgccctggcggaggcgcagggccccgcgctggaggcgggggcgcgctggctgtcgctgctgcgcggggcgcaccgggtggtgcgccggccgtga

SEQ ID NO: 6292 - DNA, 1638 bp, Myxococcus xanthus
atgcgtatcccccggaccgacgcccgcaggaagctgctcggcgcgctgttgtgtaccttctccgtcgcggcctgtggaccggcccaggagggcgagcccgccggcagcggctccaccgagcagcccgtcgtctatggcaacgacgaccggatggacgtgtacgcgcaccccgacgccaccctgcggcagtacgccatgcaggccagcgccgtcatggtcgacccgtacgagattgacgactcggaccccaacaacgtcgtcttcgacagccccaccctgggcgaatacgtcaacctctgcgcgggccagcgcttcatcgacgacccgtcgcccgggtactgctcgggcacgctcatcgacgatgacctcctcctgaccgccggccactgcgtggaaaccgcggccgactgcagggatttcaagtgggccttcaacttctaccggcctgacgcgaactcggtgcagacgatgaccacgcaggacatcttcagctgcaaggagattgtcgtgcggcgggataacacctccagcggccgcacgctggactacgccatcatccgcctggaccgttcggcggcgccgcgcttcacgcccgcgcccatccgcccgggcaacgccgccatggcggtgggcgccaacgtggccgtcatcggctcgggcagcggcatcccgctcaagattgactcgggcggcagcgtccgcaacggccgcgccagcacgctggactacttcgtcgccaccaccgacaccttcggcggcaactccggttcggccgtctacgacatgtcgagccacaccatcgccggcatcctggtgcgcggtacgacggactacgtctaccagggcagctgccgcgtcgtgaaccagtgcgcggagaccgggtgcagcggcgaagacatcacctacatccgcccggccatcgaggcgttctgcgccaccaacaccagcgtccggctgtgcaacaccacgccgccgccgccgacgtccttcgacttcacggccagcaacacccagaacgccaccgtgaacaccacccgccacacggtggagctcaccgccggccagagcatcaccgtgggcacctgcggcctgacgggcgccagcgccaccggcgacacgtggctgcgcgtcaatggccccagcggcatcgaggtcgcctccaacgatgacggctgcgccacgggccgcggctccaacgtgactttcacggccggcgcggctgggaactacgaaatcatcgcgggctgctacggcaacaccagctgcagcggcacggtggcgtggaccattggcacggcgacgccgccggccaactccggcacgttcaactacagctcggtcaactccgacagcgcgcggcagaacaccaccaacgagaacgtcaccctcacggccggccagagcctctccttcggcacctgcaacgtgacgggcgcctccggcacgggcgactcgttcatccgcctgtacaacgccgccggcacgcaggtgaagttcaacgacgacggcgccggctgcggctcgctctcccacgccacctacacggtgccggcgggcgcgggcggcacgtatcagatccgcgcgggctgctacggcaacaccagctgcagcggcacggtgggctggaccgttcagtag

SEQ ID NO: 6293 - DNA, 2208 bp, Myxococcus xanthus
gctccccgccggggcttggaaaagcgagggagcctcccgtacaagggggctcgcatgaagcgtttccgccttcctcgacgcctgacgctccctgcgctgctgatggcagccgcatgtggtgagtctgactccatcccaatccggacctgcgacgtgacgttgacctacgcaccgcagcagtccgtggcgggcactgttcgggtcatgggggaatggaacaacttcgccgccctgtctcagcccatgaccgaccggggtgacggcgtgttcacgctccgcctggatgggctggagccgcgcgcctacggctaccgcttcgtggtgggcgacaagcaggagatggacccggagaacccgtactcgcgctgggttcgcgcggaggagtattcgcgcgtcatcgtcccggactgccgccagcccgtgctggagctgaaccgcttcacggtgacgcccgagggctcgctggacgtggccgtctcctacctcgatgggacggacaaggcgggtccggcggtagatggcatggtgctgtcgctggacggcacgccccggccggacgcctatgacgccgcctccggccgtttcatcctgaacgtgcagggcctggagcagggaaagcaccacgtgaaggtggtggccaaggacagccagggccgcgaggcggagtcgctctatctgccgttctgggtagagccggagcgcttccgctgggactcggggctgatgtacttcgccttcacggaccgcttccacaatggtcggctggagaacgacgcgccggtggcggacgtggaccccatcgccaactatcttggcggggacttcgcgggcatcacccagaagctggaggaggggtacttcgacgcgctgggcatccgcacgctgtggatctcccccgtggatcagaaccccgaggggcgcttcatcggcaccggcggtaagtactacaccggctatcacggctactggccgtcgaagccccgcgagacgcagcaccgcttcggctcgctggaggagctgcgcacgctcactgcggccgcgcacaagcggggcatccgcgtcatcgccgacctggtgctcaaccatgtccacgaggagcacccgtattgggcgaaccatgcgcgagacggctggttcaacacggccgccagttgcgtgtgtggaacgcaggactgcgactgggaagccaagcgcctcacctgcaagttcacggactacctgccggatttcaactggcgctcgtcggacttcgtggaccagttcgccgcggacacgctctggtggctggagcaggcagacttcgacggcttccgcatggacgcggtgaagcacatggagcaggtggccgggcgcaccctccgcgggaagctgaaggagatcaccgcgatgacgggcaccgagttctacctggtgggcgagacgtacgttttcacggatgggcgccctcagattgcccgttacatcagcccacgcgagctggacggtcagttcgacttccccctgtactggcccgtgcgcgaggccttcgcggacggcaagggcttgcagcgtgtggacgacgccgtgcgcgccaacgaggaggcctatgtgccgggaacgctcaattcgcccttcctgggcaaccacgacgtggcgcgcttcatctcccaggccgcggggcaactgcacgagggagggagtgatcccttcggtcccaaccgcccgtccacggtggtgacggatccggccgccttagagaagatgaagtacggcttcgccttcgtgctgacgcagccgggcgtgccgctggtgtattacggcgacgaggtcggcctgccgggcgcggcggatccggacaaccgccgcttcatgcggttcggcagcacgcttgcgccgctggagcgggagttgctcgacttcgtgcggaagctggggcaggcgcgccgggcgcacgaggcgctgcagacgggcgcgcggcggaccctgcgcgtggagaacgacctctacgtgttccagcgcgatctgccgaacgggaagggtgctctggtggccatcaaccggagcgccgtggagcgctcactggtgttggagttgatgggaagcctggccgcgagcagcggcacctacgtggacatcttctccgggcagacgctgcagctcaccggcacggagacggtgctcgtcgtcccgccgcgcggcgtcgctgtctacgtgccccaccaggagtaa

SEQ ID NO: 6294 - DNA, 1278 bp, Myxococcus xanthus
gttcccgcagcagatgaaggtggactacgtccgcgtctacgcgaggcccacgtgagggtcgcgctctgggcgctgacactcctgctggtggcctgcaaggtggaaccccgcccacggccgcccggagtgctgttcgtctccgtggagcaacagagcacctgggtgcgcaacttcaacccgctgttcgcgggcgcgggcgctcgttggcccacgcgcgcgggcgtctacgagtgccttgaaatcttcagccccgcggtgggccagtggacgccctggctggccaccggccacgcgtggtccgaggaccgccgcacgctgcgcttcaccctgcgccccggcgtgcgctggtccgatggaagacctttcaccgcggacgacgtggccttcaccttccagttgctcgagcagcacgcggcgctggacgcgggcggcgtgtggcgcttcgtggaggacgtgcgcgcggaggacgcgcacacggtggccttccagttctcccgcgtctacatccccggcttcgcggagctggcgcagcagcccatcgtcccccggcacgtctgggagaaggtggcggacccggtgacgttcaccaacccgcagccggtggccaccgggcccttcaccgaggtcaccgtcttccgcaaccaggtctacgagctgggccgcaacccgtactactggcagcccggcaagcccgccgtctccgcgctgcgcttcttggccttccccaccaatgaccaggccaacctggcgctggtggaaggggaagtggactgggcgggcaacttcgtccccgccgtggaccgcaccttcgtcgccagggacccggcgcaccacggccgctggttcccactctacggcagcaccgtcttcctctaccccaacaccaccctgccgccgctggacgacgtgcgcgtgcgcaaggcgttgagcatggcgttggaccgcgagcggctggtggagatcgccatgtacggctacacgcggccggcggacgccaccgcgctcaacgacgcgtacgccacgtggcgcgacgcggacgcggcccagggtgcttgggtgaagcacgacctggaggcggcgaagcggctgctggacgaggcgggcttgaaggaaggcccggacgggctgcggcgcaaggcggatggccagccgctcgcgctggacatcgaggtggtgggcggctggtccgactgggtgcgcgccggacaggtggtggcgcgggacttgcggaagctgggcgtgcaggcgcagctgcgcacctacgagttcggtgcatgg

SEQ ID NO: 6295 - DNA, 714 bp, Myxococcus xanthus
atggccaagggtgtccttgggaacgatcccttcaagcgcggcgccgcgccgcgccccaccgaatcctccacgccgggtggcgaggaaaaggccgccgccgcggagacggtgacgaagaagaagccggggcctggcgggacggcgcccgcgaaggccggtggcaaggcggctgccgcgaagtcgcgcaagcacgagggcaagaagacgtccgggaaggccaagggaggcaaggcggccggaggcatgaagggcgccgccgcggctgcccggcctccggcgcaggcatcggggccgcgggctcccgcgccgcaggccgaaaggactgaggcagcggacgccgcgctgtcgccgcgcgaacccgccccgtcccagcaggcgcggacgccgcaggccccccagacttctgcccacggcgcggacgacgccgtgcgtcccctgcgcgagcccgcggtgtccgcgccgctcacgctggattcacaagcccccggcccggtgaacgatgccggtgtccccacgccgaagcagcgcgacgtggaccttgccttggcggaagccctggcagccgacgtggccgaagccgccgccaccgccgcggtggacgcggcgctgggcgcggaggccggccccgacgccgaggtcgagcggctcatggccacggagtttgcgaccgagctggccgaagccgcggtggaggaagcgctggagcggggcgct

SEQ ID NO: 6296 - DNA, 942 bp, Myxococcus xanthus
agggacggctgcgcatcgcgggtaacgggcgcgagcggcgactatgggcggctcctgctgtctcggctggaccaggatcccgacgtggagagcatcctcgtgctcgacgtcgtccgtccggagggcgacaaggtggagttccaccgcgtggacctcacccggtacgatgccgagagcgagctcaccgacgcgctcaccgagcgccccgtggacgcgctctatcacctggcgttcctgttcggacccatccgcaacggctccctggcgcacgagctggaagtcatcggcaccatgaacgtgctgacggcggcgggccgctcccggctgccccggctggtggtgccctccctgacggctgtctacggcgcgcgcgggaacaaccccgcgatgctgcgcgaggactcggcgctccagggttgcccgcacagccgcttcgtcaccgacaaggtggaggtggaaggccaggtgcgcgccttccgggagcggcatccggaaatgcgcgtgctggtgctgcgcttcgcgccggtactcgggccctcggtggacaacccggccacgcgcttcttgaagaatcccgtggtgcccacgctgatgggcttcgatccgctctggcaggggctgcacgaagacgacgccgcgcgtgccttgcacctggccctgcgcgcggacgcgtccggtgagttcaacatcgtgggccgcggggtgatgccgatctccggcctcattcagcaggcgggcgcacggccgctccctctgccagggcccttgtttcgggccggcctgcatacgttggacgccgtgggcgcgggcacgttgcccgtggccctgctcgactacatccattactcatgggtcgcggacggcgagcgcgccgagtccgcactcggtttcatccccctccaccatgtcagagacgccgctgcggcgctgaagaggagctag

SEQ ID NO: 6297 - DNA, 1654 bp, Myxococcus xanthus
atgtccgccgggatcaacacctacaagaccgaccttcgagagatcttcttcacgctgttcgagcagttcggcttcggccaggtggccggccaggcgccgttcgatgcctggggtccggacgaagcgaaggcggtgctgtcggagacgtatcgcttcgcgcgcgaggtgctcgggcccctcaactcggtgggtgaccgggagggatgccgggtggagaacggcgccgtcttcacgccgacgggcttcaaggacgcgtggaagaagctctacgagcagggcttcaagacggtgggcgtgagcccggagcacggcggccagggctcgccgatgatgctccaggtgacggtggaggagctgctgtcgggcgccaactcggcgttcaacatgtaccccggcctggccttcggcgcggcggaagttgtcgcggagtgcggcacgcccgagcagcagaaacagttcgtggagcgcatgctcaacggcacgtggggcggcaccatgtgcctcaccgagccgcacgccggctccgacgtgggcgcggccaagtcgacggcccgccgcaacggcgacggcacctacaacatccgcgggacgaagatcttcatctccggcggcgaccacgacatgggggacaacatcatccacctcgtgctcgcgcgcattgacggcgcctcgccgggcaccaagggcctgtcgctgttcatcgtccccaagctgcgcatcaacgcggacggcagctcgggccagcccaacgacgtgggcgtgggctccatcgagcacaagatgggcatcaacggctcggccacctgtgtcatcaactttggtgagagcgacaactgtgtcggcgagctcgtgggcaccgtcgagcacgtcggcatgagccagatgttcaagatgatgaacggcgcgcgcatcgccgtgggcatccagggcattggcctggcgtccgccgcgtactacaacgcgctggactacgcgaaggaccgcaagcagggctcccacttcaccaagtggaaggaccccaccgcgccccgcgccgccatcatcgagcacccggacgtccgccgcatgctgctggacatcaaggcgcatgtggagggcatccgctcgctgatcatcaagctggccatgcacctggacaaggcgcgccaactggccggcaaggatgacgacgcggccacctaccacaagggccaggtggagctgctcaccccgctggtgaaggcctacagctccgagcaggcgttccgcctgtgcgcgcaggccatccagatctacggcggcgccggctacatccaggactacccggtggagcagtacacccgcgactcgaagatcttctccatctacgagggcaccacccacatccaggccatggacctggtgggccggaagatgggccaggcgggcggcatgcacttccagcagttcatgggcgacgtgggctccttcatcgaggcccaccgcgagcacgccgtctacggcgaggccgtgaagtccctggccgcggcgcaggaggccctgatggccagcgccatggtggtgttcggctggtcgcaggacggcagcaagttcccgctgattccgctgtccgccaaccgcttcctggacatgatgtcccaattcgccagaggctggctgctgcctttagagcaca

SEQ ID NO: 6298 - DNA, 291 bp, Myxococcus xanthus
atggcgcggctgtatcgcgaggacgcggtgcgcggtacggaccggctgatgcgcgtcatctacgacgggctgccggtgttgcatgacccgctgacgacgctgctgacaccgctgcttcaatctgtctcggaagcgcggatgcgcgcggggtacatgcgccgtgtggagctcggctcgctgacgccgcacgaggacgggcgcccggtgcgggtgctggaggtgggcgtgggctcgggggcgaacctgccgctcctgcgtgacggcttgccgccggggctcgacgggctgtag

SEQ ID NO: 6299 - DNA, 1140 bp, Myxococcus xanthus
cggatgcggtgcgtggcggggcggctgttgatgcggctgctcgatgcgttcatctatgcgcaccaggcgctgcccgttctctggtccggcctgcgtgcgttgaacctgtgcgagccggcgggcgcgtcgccggagctggcgcggggctacacgagcatggcggtggtggcgggcacgctgcccatccggtcggtggcggagacgtggtcccgccgcgcgttggaggtggccgagcgcgtgggcaaccccgcggacctggccttcgtgctgtgtcgcaacgccgtgtatggcgcgtacgtggcgcggtgggcggaggccgaggcgtggctggagcgggccatgggtatcgtcgactcggtgggcgacgtgcggttggcggaggagtgccgcgcgctgctgacggtggtgtcgtgctaccaggggaagttcgcgcgggggctgccgctgatggagtggctggagcactcggcgcggcggcgcggagcgctccagacggagcactgggcgctgcactaccaggcgcacatccatttacggttgggcgactacgcgaaggcccgcgccgcgctgacccagacgctggcgtggacggaagcccagggtgggcagacggaccgcatcatcgtggaggggacgctggcgctgttgcggctgcgtgaaggggacgcggaaggggcccgggccgcggcggaccaggcgctggcgagaatgtcgtccggcaagcccgtggcgcacttcgtctacttcggtgtgatgacggtggcggaggtgctcctgacgctgttggagcggggcacggatgcctcgctggtggcgagcgccaaggccgcgcgccgggaggcggaggtcttcgccaaggtgttccccttcggtgaggccgcggcgcgcttgtggcgtgggcaggaggcctggctggataacgacgccacgcgggccttcgaggcgtggcgccggtgtgtcgctgtcgcatcgaggaaggggcagtccttcgaggaggcccacgcgcgggtggcgctggccaggcacctgccattggaggacccggcacggtgggtccatcagcagcgcgcggtggagttgttcacccggctgggcatgcgggatgagcaggcccgcgcggaggcgctcgcgcgttcatga

SEQ ID NO: 6300 - DNA, 1341 bp, Myxococcus xanthus
tcaagcatccaccacctcgcggtggatgccgtgtcctggcgcgtgctgctcatggacctggagacggcgtgccatcagctcggccaggggcagccggtggcgctgcctccgaagacgacgtccttccaggcctgggctcgccgcttggactccttcgcggccagcacggagctggagcacgaggccgactactggctgagccagggtgaagacacagcgccgctccccgtggacaccacggacggcgacaacaccttggcctccgcacgcacgttgacggtggcgttggacgccgaggagacccggctcctgcttcaggaggtgccgacggcctggcgtgcccgcatcgacgaggtgctgctgacggcgctcgcacaggcactctccacctggacgggacagcgccggctgcgtgtccaactggaaggccacggccgcgaggacctgttcgacggcgtggacctgagccgcaccgtgggctggttcaccagcgcctacccggtgacgctggagctgccccgggatggcagcgtgggtgacgaactccgcgctgtgcgtgattccctgcggcaggtgccgcgcaagggcctgggctacgggctggtgcgttaccttcgccaggacgagcaaggcacccggctccgtgcgcagccggaagcgccggtggccttcaactacctgggccagctcgactcggccctgcccacctcgtcgctgctggcgcccgcggacgagcccttcggcgcgcagcagggggcgctcggccagcggcggcaggtgctggaggtgaatgcacacgtcctgggcggcaagctggaggtgtccttcacctacagcgaggcgctgcaccagcgcaccacggtgggcgcactggcgcagggctacgtccacgcgctccgggccctggtggaccagcggcgcggcgaggacgcggcgcggttctcccccgtggacttcccgctggcgaaggtgacgcaggccacgctgaacggcctgatgcagtcatacccggagatggaggacctctacccgctgtctcccatgcagcagggcatgctcttccacgccatgctcgaccccgactcggggatgtacttcgagcgcgcggcgtggacgttggacacggacctcgaccgcgaggcgctgcgcgaggcctggcagcaggtgatggcgcgctaccccatcctccgcaccagcttcgtgggtgaggaactggaagcgccgctccagctcgtgaaccgtaggtccgtgctgccgtgggacgagcaggactggatccacctgtccgagccggagcagcagacccggctgtcagcctggatggacccgggccgggcgcca

SEQ ID NO: 6301 - DNA, 825 bp, Myxococcus xanthus
atgttcaagaactgcatcgcccgtgctgcgattcttgcgaccactgctgtccttgccaccggctgtggctccgacgttccagaagaaagccttgaggctgacgcgctcggcacgcgcagtgacgcgctggagagcatccagttctggcacgactttcgcgcgtacagcggcgtgtcggacgagtgtaacggattcaatgtctccgaaggccggggcctggggcagtggacgagccaggttcgcctggacaccgactcccggccgcaggggtgctggcagaagttcggcatctatgacccctacggtgagctgagcgggctgtcgctgacggtcagcttcttcgggcagggcaacccgacctccaacgggcagtgcgacaacccggggacgtacgtcgtccccgtgggccctgtgctcaactgggccggtccctggggaatcgataccaccgacgcctatggtggctgcgtgcagacgttcagcatctccgggcgcagtgacgtggcgctggatgtgcggttcgacgcggaccgacacaatggtcagtgcctgaacgctgggatgcacacggtgacttcgagcaatgccgtcaccctgacgctcgacatggacaatcgtttcggcggttgctaccagaccttccggctccggaagatgacgtgtggcgacaacatctgtgaggccggtgagacctgtccggccgactgcaatcaatgcggcgacggcatctgcaatggctcagagaaccgatttacctgccccgaggattgcagccccgtcatcccgggcgagtgcgcgattttctgcccgcccgagttcccctga

SEQ ID NO: 6302 - DNA, 303 bp, Myxococcus xanthus
ttcacgtccagcgcaattccggcagaagccgctcaactcgtcggacaacgctccatcaactccgtgccgtacgtgtgcgacatcgtaaagttgatcgtcaaggatcattcgggtgccgatttcgaatcgatcacccccgaagcccggctcatcgaggacctggggatggactacctcgaccacattgagttcgtcatggatctcgaggacaccttcgtcatcgaaatcccagacgaggaagccgagaagatcataacggttggggacgcgtgcgattacgtcatcaaaaaccttcccgactga

SEQ ID NO: 6303 - DNA, 1722 bp, Myxococcus xanthus
atgtccttcatcggttggtcgcaaatcctgttgttcttcgccttggtgctggcggtgacgaagccgctgggggcctatctcttccgtgtcctcgaaggggacacccgtccgctgccgcgcgtgctgggccccttggagcgcctgctgctgcgcctgtgcggcgcggcggaccggcacgaacagacgtgggtggcctacgcgagctcgctgctggcgttcagcctcttcagcgtcctcatcgtctacggcctccagcgcgtgcagcacctgctgccgctcaatccgcaagggctgggagcggtggggccggagctggctttcaacaccgccgtcagcttcaccgcgaacaccaactggcagtcgtacgcgggtgagtccacgctcagctacctcacgcagatggtggcgctggcgtggcagaactttgtctccgccgccgcgggcatcggtgtcgcgctggcgctggcgcgtggtttcacccgccggcccggtccggacggacagaagacgttgggcaacttctgggtggatgtgatgaacgccaccctctacgtgttgctgccgctgagtctgctctacgcgctcttcctggtgtcgcagggcgtgctccagaacttcgcgccctatgcgcaggtcgtgacgctggagggcgcgagtcagacgctggcgcagggaccggtggcctcgcaggaagccatcaagacgctgggcaccaatggcggcggcttcttcaacgccaacagcgcgcaccccttcgagaaccccacgcccttcaccaacctggtgcagatgctgtccatcttcgccatccccgcggccctcacgtacacctacgggaagatggcgggagacacccggcaaggctgggccctgctctcggcgatgtccgtcctcttcctcgtaggcgtggccgcggtgtacgcggcggagtcccaggccaacccggcgttgagtgtcgcggggcaggtggcgcaggcgggaaacatggagggcaaggaggtgcgctacggcatcgcggcctcctcgctcttcgccgccgtcaccaccgcggcctcgtgcggcgcggtgaacgcgatgcacgacagcttcacgcccctgggcggcctggtgcccatggtcaacatgcaactgggcgaggtcgtcttcggcggcgtgggcgcgggcctgtacggcatcctcgtcatggtggtgctcagcgtcttcatcgccgggctgatggtgggccgcacgcccgaatacctcggcaagaaaatcgaggcgcgggagatgaagctcgcgatgttgtacgtgctcgtcttcccgctcttcacgctgggcttcagcgggctggcggccgtgctgccgcagggcgtgtcctcgctcaacaacgcggggccgcacggcctgtccgaaatcctctacgcgtacaccagcggcacggcgaacaacggcagcgccttcgcgggcctcaacgccaacacgcccttctggaacatcaccctgggcgtggcgatgctcggcgggcgcttcctgatgatggtgcccgcgctggccatcgcaggctccatggtgggcaagaaggtggtgccagcgggcccgggcaccttccccacgcacggcgtgctcttcaccggtctgctggtgagcgtgattgtcatcgtcggcgcgctcacgttcttccccgccctctccttgagccccatcgtcgagcacttcctcgccggggctggaaagcgctactga

SEQ ID NO: 6304 - DNA, 378 bp, Myxococcus xanthus
atgccattccagatcaccgttcactcgcaggaccgcatcctcgaggttgtctatcccccgcaagtcactaccgcggacctggccgagtacctggccgacgtgaagaaggccatcaacgacctggccggtgagtggtccgccctggtggaccagtcccagctccgggtgatgcccagcgacgtggtgacggccatggccagcctcaacgccttcgcccagctccacggcatgaagcgctccgcccgggtcgtcagtgacgccccctccggactccaggcctggcggatgacgaagcgcgccatgctgagcatccccacccgcaccttcgagacgcggggggaagccctccagtggctgcgcgaccccgacgcggactga

SEQ ID NO: 6305 - DNA, 1839 bp, Myxococcus xanthus
tgcccatcgcgggacggtgctcccccgcggggtggcgagctgctcgtcgcgctggacggcgacagacgccagctcgcgcgcaacccgtcggagccacctcgcgtgggttcgttgccggagcatctggcctacgtcatctacacgtccggctccacgggtactccgaagggcgtgctggtgccgcatcagggcctctgcaacaccctgggcaccatcatccgggcgcatgacgtgcggccagggcggcgtgtgctccaggcggcggcgctcgggttcgacgcgtccgtcctggaggtgctgtccacgctggtggccggggcggagctgcacctggcgccgcgcgagtcgctgctgccgggagcgccgctgcgcggactgttggagtcgcggggtatcaccacggtgacgctcacgccttcgtccctgtcgcagttggagccggagggccttcccttgctggagacagtcatctccgccggagaagcctgctcgccggagctggcgcggcgatggaagccggggcggcgactgctcaatggctacgggcccacggaggcgtccgtctgcgcgacgctctccaccgagctggacgtggagcgcccggacatcggccgtcccgtcgcgaacatgcgtgcgtacgtgctggacgggcgggggcagcccgtgcctccgggcgtgccgggcgagttgtacctgggcggaccgggcgtggcgcgtggctacctgggacggccggagctgacggccgagcgcttcgtcccggatgcattctcgggagaggcgggggcgcggctgtaccgcacgggcgaccgggttcgcttcctcgcggacgggcgcctggagtacctgggccgtaccgacttccaggtgaagctgcgtggcttccgcatcgaactgggggaagtggaggcggtgctgcgccagtaccccgacgtgcgtgacgcggtggccctcgtgcgcgaggacacgcagggagcgcggaggctggtggggtacgtcgtgcaagccgcggagctggacgcatcggcgctgcgctcgttcatgaaggaacggttgcccgaccatctggtgcccgctgccttcgtcgcgctggacgcgcttccgctgtcacccagcgggaaggtggaccgggcggcgttgccggctccggacgccgcgcgcggaggcaacgcgaaggtgttcaccgagccgcgcacggaagcggagaaggcgttggccgcgctctggacgcaggttcttggcgtggagcgcgtgagcctgcacgacaacttcttcgagctgggcggcgactccatcctgggcatccagattgtctcccgggccaaggccctggggctggagctggagccggccatgctcttcgagcggcagacgctcgtggagttggctgccgccgccgggacggcgaaggcaggcacggcggagcaggggctggtggaggggcccgtgccgctgacgcccatgcagcgcatcttcttcgacgagtgggcgttacctcagccgcaccactacaacctggccgcggtgctagaggtgcgccgcccggtggatgccgcgctgctggaggaggcgttgcgggcgctggtgtcgcaccatgatgcgctccggctgcgcttcacgcgggcgccggaaggctggcgtcagtccatcgcgggcgtgcccgagcgagtgcctgtaaggcgcgtggacctgtcttccgtgctggaggcggagcagggcgccgcattggagtccgtgggtgcggaggtccatcagagcctggacctgggcgagggaaagttgatgcgcccggccttgttcgagcggggagcgggccgatcctcccggcgaccggctctc

SEQ ID NO: 6306 - DNA, 727 bp, Myxococcus xanthus
aaaaatcccacgctcctggcctgggtggccaagatggccgagatgacccagccggacagcatcgtctggtgtgacgggtccgaggcggagaagaagcgtctgacggaccaggcggtgaaggagggcatcctcatcccgctgaacccggagaagcgccccaacagctacctccaccgctccaacccgatcgacgtggcgcgcgtggagcacctcacgttcatctgcacgccgaacaagacggacgccggcccgacgaacaactggatggagcccgaggcggcctacaccaagctgggcaacctgttcaccgggtgcatgaagggccgcaccatgtacgtggtgccctacgccatgggccccatcggcagccccttcaccaagctgggcgtggagctgaccgacagcatctacgtcgtgctgaacatgcgcatcatggcgcgcatggggaagcaggcgctggacatgctgggtgacagcgacgacttcaaccgcggcctgcacagcaccggcgacgtggaccccgaccgccgctacatctgccacttcccccaggacaacaccatctggagcttcggctccggctacggcggcaacgtgctgctgggcaagaagtgcctcgcgctgcgcatcggcagctacctgggccgcgaggaaggctggatggccgagcacatgctcattctgggtgtcaccagccccaagggtgagacgacctacgtagccgccg

SEQ ID NO: 6307 - DNA, 1791 bp, Myxococcus xanthus
atgaccatcgccatcgtcctgggtgttgtcgtcgtcgcgctggtgctgttctcgttcgacacgcttcccatcgaggtcagctcgctcgtggtggtgtgcctgctggcgctcaccggcgtgctcacgcccgtgcaggcgttcgaggggttcagcaacgacactgtcatcttcatcttcacgctgctcgcgatgacgcagggactcgcatcgacgggcgtggttcagttggtgggtcaacggttggccttcttcgcccgtttcggccatcagacgttcgtcatggcgatgatggtggcggtggcggccttctcctctgtcatctccaacacggtgacgacggcggccttcctgccggtggccatcggcgcggcccagcgcgccaaggtgcccaagagcaaggtgctgctgccgctggcgtacgcctccatgttgggtggcatggtgttcctctacggcacctccaccaacctggtgatgtccgcggcgatgcagcggctgggcatgccgggcatcggcgtggcggagctggcgccggtggggctgccgctggcgattgtcggcatcctcggggtggtgctgctggcgccgtggttgctgccggcgcgcgagggccgcggtgccatggaggactggacgctgcgcgactacctcacggaggcggtgctgcctccggactcgcgctacgtgggcaaggagctgggggacatctcggaggggctggggctgcgcgtcatcggcatcatccgcgacggcgaggccctgtccgcggtgccggggtaccggctgcgcggcgacgagcggctgctcatcgagggcaaccgcgaggcgattctgcgggtgaaggacctgcgcggcatccagatccgcccggacgtgcggctgtccgacgaggagctgcacgacaaggactccatcctcatcgaagccagcgtgccgcccgacagcccgttggtggggcgcagcttgaaggagacgctcttcgtggagcgctacggcctggtggcgctggccctgcaccgcaagcccgccatccagcgcgtcaccaagctccagctcctgggccgcaccttcggggagcgctcgctgtccatgctgccgctgtcggtgggagacgtgctgctgctgcgcggcgcgcgcgaccgggtggacgagctggcgcgggcgggcaacctgacggtactcagcggccacgagtaccagccgccgcgctacggcaaggcgctgctggcggtggtgctgttcctgggcgcgctggcggcgggctcgctggacgtggtgccgctgtcggtggcgggcctcaccggcatgttgctgatgattgccactggctgcgtggacccgcgcaccgcgttccgcgtggactggcgcgtggtgctgctcatcggctccatgatggcgctggggctggccatggaggtgagcggcgcgggcgcgttcgtgggagatagggtggcggcgctgggcgcattggggggcccgcgcatggtgatggtggtgctgatggtgctgaccatcgtcctgtccgcgccgatgagcaaccaggccgcggcgctggtggtgctgccagtggccatcaacgccgcgcagcagctcggcgtggacgcgcggcccttcgccatggcggtgacgctggcggccagctgttcgttcatcaccccgctggagcccagctgcgtgctcgtgtacgggccggggcactaccgcttcacggacttcttccgcctgggcacgccgctcaccgcggtgttggtggtcctgctcacggtggccgtgccctgggcgtggccgctg

SEQ ID NO: 6308 - DNA, 444 bp, Myxococcus xanthus
cgtgtctcgtgggatcagtacttcatggacatcgcgacgcaggtggcctcgcgcgccacgtgtgatcgcaagcacgtgggcgccgtcatcgtccggggcaggaccatcctgtccaccggctacaacggcgccatccgcgggctgccgcactgcgatgacgtgggccacatgatggagaacggacactgcgtggccaccgtccacgcggaggccaacgccatcatccaggccgccaccaacggcgtcagcatcgacggggcgaccatctacaccaccgcctcgccttgctggccgtgcttcaagctgatcgccaacgcgggcctggtgcgcatcgtgttcggcgagttctaccgggaccctcgcatcttcgagtacgcggcccggctgaagctggacctggtgggtctgggcgatgccgcccggcctcccgcctcgggtgtctga

SEQ ID NO: 6309 - DNA, 738 bp, Myxococcus xanthus
cgcatgacgcgcaaggagcaggtgcggcgcatcctcccgcacaacgtgcggctgcaactggcctcgcagggcagggtgctcagcacggcgtcgggcgtggtggtgggcgccgagcgggacgcgaacggagccacggttgcctgggtggtcaccaacgcacacgcggtggccatggacgggatggaggctccggagctgcgcgtgctggtggaccgccgcgcggagtcgctggagcaccggggcgaggtggtggcgatgggcgaggtgcctgacctggacctcgcactggtgcgcgtgccggggctggacctgcccgcggtggagctggcggacgacgcggagctggagctgggcgaggacgtggtggtggccgcctcgccattcggccgcgcgctgtcgctgtccggcggcatgctgtcccaggtcgaatgggacaaggcatcccagcgcccgaagatggtgaagacggacgcccccatcggctacggcgcgtcgggcggcggcatcttcagcctgacgacgggccggctgctggccatcgtcgagggctaccgcaccgcgaaggtggacttcgaggtgcaggaggagaactacagcttcgacgtgcccatgcccggagagacgttcgccgcacccagcgcgaaggtgcgccacttcctccaggccaagggctttggccggctgctggcgcgcaagcccgcgacggagggtggactcgcacactccgccgggcgttag

SEQ ID NO: 6310 - DNA, 264 bp, Myxococcus xanthus
atgcccttcctgactgcgctggcgatgagtggctgcgccgacaaggacccgaactcgttccccgtcctcgaaaaggacgccgtgttcgtcgtgaatggtggcagcaactccctcagcgtcattgacgtggagcggcaggaggtcaccagcacccttcgattgaaggacatgacctatccccaccacatcagcctcagcccggaccggagcctgctcgtggtggcggtccccggcatggacctgagcggcgggcacggcggcggg

SEQ ID NO: 6311 - DNA, 933 bp, Myxococcus xanthus
tggcccgagcgcgcctcccagttggacatcacggtgctcatcaccggggagacggggacgggcaaggagttggtggcgcggcccatccaccacgacggcccacgcaaggaccggcccttcattgcggtcaactgcggcgcgctgccctccgaactcatcgagagcgagctgttcggtcacgcccggggcgccttcactggcgcggtagagaccaaggccggtctcttcgaggcagcctccgggggaaccatcttcctggacgagattggagagttgcccctgtccgttcaggtgaagctcaaccgcacgctccaggacaaggaagtgcgccgtgtcggagacgcggttgcgcgctgcatcgacgcacgcgtcatcaccgccacccaccgcgacctcaaggccgaagtgactgcgggccgcttccgcgaagacctctactaccggctcaatgtcttcccggtgcatctgccgtccctgcgggagcggcgcgaggacatccccctgctggccatgcacttcgtacagaaggcggcgaagacctaccggcagccggtggatggcctggagccggacgcgttgcgtgcgctcaccgggtacacctggccgggcaacgtgcgccaactagagaatgccatcgaacgcgcggtggccatcaccactggctcccgagtgggccctgacgcactcccccctgaagtcacgggcggacaacagggagcactgcccgtagaccatctggtgaagatgcccttccgggaggcggtggacctggcgcgggaccgtgcatcgcgcgattacctcatcgccctgctgcgggaattcgggggcaatgtgacgcgggctgctgaacgcgcgggcatggagcgcgagagcctccaccggctcctcaagcgctttggcctgcgttccgatgacttcaaggagtcaccctaa

SEQ ID NO: 6312 - DNA, 444 bp, Myxococcus xanthus
tatgtgcccgaggacgtcctggctgatttgcgagagaaggtccctgcggccacgtccgtgtccctgctgcccgcgcatgacctgtatgtctcgtcgcatggcgggcccgcctgggtgacggaccccaagcaccatggcatcgaggttccgacgtggggctccgccaagggcggcaccctgggcgaggccgcccacatcttcgtccgccccgtgctggatgcggagcggctggtggggctgtgggagttcgacccgaaggcggacgacgtggtgttccacaccttcgagccgctggcgcccaagcggcgcaaggccgtgcaggccctggccgaggacacggccacgttccttcgagaggacttcagcctcgcgcgcagcttcagcctggacaacgaggactccgtgcagaagcgcgcggacttcgtgaagtcgctgggggagtag

SEQ ID NO: 6313 - DNA, 165 bp, Myxococcus xanthus
atgccggtggcgggctcggtgaccctggacgcggtgaatgatgacttggccgcgggccgcttcgtctatcgctacagggatggcagtgagctgacctgcaccttcaacgtgcccgtcgccggagcgggccgctggctttttggacggggactacgacgacgatga

SEQ ID NO: 6314 - DNA, 387 bp, Myxococcus xanthus
acgggtggctgcttttgcggagcggtgcggtatgaggtgagcgcgccgctgacggcggtgacgtactgccattgttcgaagtgccgcaaatggcatgggcacgtcggggcctacgcggctgtggaccgggatggcttccggctcacggcggagcacggcctcaaatggcacaccgtttcgcccacggtgcggcgcggcttctgcgtcgagtgcggttccagtgtgctgttcgatgaagcgccttccgcgaagatgtcgatttgcgccgggacgttggagtcgcccaccggcatccgcgagaaggcgcacatctacctgggcagcaagggggactactacgacatcactccgggcctcgtggagtacgacaccttccctgggaagtga

SEQ ID NO: 6315 - DNA, 429 bp, Myxococcus xanthus
aaggcggacgtggccaagggcttcgtcctggacggctttccgcgcacgccgggccaggcggacgcgttggacaagatgctggggcgcctgggcaagcagctgagcgccgtcatctcgctcgaggtgccgcacgcgaagctggtggagcgcggctccggccggcgggtctgcccggtggacggcagcgtctaccacgtctaccagagcccgccgaagcgggcggggtactgtgacaagtgcaataccgggcttgtccagcgcccggatgatatgcccgaggtcatcgagaagcgccttcagaagtacgactcggagacggcgccgctgaaggccttctatgagaagaagggtctgctcaagagcgtggacggcgtgggcacgcccgagggcatctacgaggagatcaaggccgctgcgggcaaggcctga

SEQ ID NO: 6316 - DNA, 480 bp, Myxococcus xanthus
atgaacaacaagaacccgtcctcctccgccgcgacgctccccgagggcccccgcctctccctggccctggtgacgaaggacgcgcccgccgcgctcgacttctacacacgcgccttcggcgcccgggagaagtaccggctcaccgagccgagcgggcgcgtgggccacgcggagatggacctgggcggtgtgacgctgatgctcgcggacgaatacccggagtacgacatcctgagcccccagagccgcgggggcacgacgtgctcgctgaacctccgggtggatgacgtggacgccgccgcccagcgtgccatcgacgcgggcgccaccctggagcgccccatccaggacgagttctacggcgaacgctcggcgcacctgagagatccgttcggccatcgctgggccctcaacgcccgcatcgagaacgtgtcccccgaggagatgcagcgccgcttcacgcggatgctccagggctga

SEQ ID NO: 6317 - DNA, 462 bp, Myxococcus xanthus
atgaaaatctgggtcgatgccgatgcctgcccgggccccgtccgggacatcatcctgcgtgctggccagcgcgtgaaggtccacactgtcttcgtggccaaccacgcgctctccctgccccggttggcctatgtctccagcgtgcaggtgggcgcgggcctcgacgtcgccgaccggcacatcgcccagcaggcacagccgggagacctggccgtcacccaggacattccgctcgccgcgctgctggtgcccaagggcgtcgtggtgctggacccgcgcggagaggtcttcaccgaggagaacgtcgccgagcggctctccgtccggaacttcatgcaggagcttcgggagagcggcgtgacgaccggaggcccggacggatactcggctcaggaccggcagcagttcgcaggcgccctggaccgggagctgacccggctggtgaaaacggagcccaagtaa

SEQ ID NO: 6318 - DNA, 183 bp, Myxococcus xanthus
ctctccgccggagtgacgcccgggcaggacgtgctgtgggtgagcgagggcggagcgcagccccccgaggagctggcctctcgcttcaccacggtggaaggccccgtggagttcttcggtgactttcgtgggcgacggttgcacaccttccaggtgtggcggctgcgagcgcgcaagccctga

SEQ ID NO: 6319 - DNA, 1032 bp, Myxococcus xanthus
atgaaccgctcccggcggctcgtggtggaggccctgggctgcggactgctcgtggtcgcgctggagggcgcccaccacggcgccgagcacctgggcgtgagcgccacggatggacgcctcttcatgtccctgggggcgggcgcggtgctggcatgtctggcctacgtgcttcaaccgctcacgggcgcgcacttcaatcccgcgctcaccttcgcggatgcgctcgaagacggcacaccgtggcgtgacgtgccgctgtacgtgctggcgcaggtgggcggtgccgtcgcgggccggtgggtggcccacgtcatgtgtcatgagccgatgctcgtcggcgcgagtgagcccacggccagcttggcgcagttcgtcacggagctggtgtccaccttcgggttgctcgtcatggtgcgcggctgcgtgcggaatcgccctaccgcgattccgctggtcgtcgccggctatctggccgccaccgtctggttcaccgactcccgggccctggcgaacccggcgctcatcctcgcccgggcgttcagcacccgccccagtgccatgcactccatggacgtggagtccatcatcgccgcgcaactgctgggcgccgcgctcgcggtgctgctcttccgctggttgcagcggacgccgcgaatgaagcaggcccgcgtctggcccatcgtcttcgaatgctcgcggccggaggtcgcgcagcaggccgtgggcatcttcaaccacctggcctcgccccagcgcgcgcgggccacgacgcaatggcacgctggcgatgacacggacctgccaccgctcatcgtccggctggtgctcgcgggagaacccacagagccatcacaccctgacggtgtctcctggcagctgcgggtcccagccgacgcggtgaccaccgaggagccccggctccgcgcggagctccgagcccccatccgccaactccttcgaaaccggggctggctgcggctccatgccgtcggagacgcggcacgggaaggccccagcgggccgcggccctaa

SEQ ID NO: 6320 - DNA, 216 bp, Myxococcus xanthus
gcgcggggctggctccagcacggcgaggtggtgcactaccccacgcacgcggacctcgacgaagagcacgcggaaggcttctaccggcagttggatgctccctacgagacggacgcgggggccgccgagattgagcagggcctgacgttgggcgggcacctcttcctggggctgtacgacgcgctgttccgggcgcgtcaccgccggctggattag

SEQ ID NO: 6321 - DNA, 987 bp, Myxococcus xanthus
gcgctgacggacgcgattcacctggcgcggcaggtggacctgcgccggtgcgagcaggaggaggccccgcgcctcttgcaggagtccgtgccggcgcttcggaacgccgtcctcgcgggggcccaggcgatgggctccgttcgcgcccattacgaagaggatgaggacccgccgggcttcgtggccaacacccggcggcagcgcatcgcggacctggccttcatggcgcgcctggacctgggcgaacggctggagcggctggggatgatgacggccaccgaggcaccctggaacatcatcgccatgtgtggcagcgcccggcgccgcctcttcaagtgcgccgccgcggtggaacgtgcgttgtgcgcgcacgaggggctgacgccccggctggaaggactcctcacccaggagctggagcggtcgctgaaggtgcgtcaggcctacgtgctgttccgccgggggctgctcacgcgcgcggagcccacggcaccgtggctggcgcccgtgctgcgccgggccgcggtgtgcttctccgagctgacgggccgggaaatctacgaggacctgcgcatcgaggaccgcaccgagctgcggcggctccaggcggcggtgctggactggctgcgcgggcaggacggccatgacgccgtgtccggccggaggctgtggcaggacgtcgcggtgttcgccgagctgctcacgcaggtgaacctccgccccgagctgcgtgagcacgaccaggcgctgctgggctcactcctgctcagcctggagctggacccttcgctgagcgccgagcggctggcggagctcgcccatcccctgttgggcgtggacgacgtgctggacgactgcatcgagaatcccaccgccgtggagcgcgcggagtggcgggagacactggagcggctcgccacgggcctcctgggcgaacacggcgcggtgcctcttcccgaacaggaggcactggccgccccccgttga

SEQ ID NO: 6322 - DNA, 1242 bp, Myxococcus xanthus
catgaaactcgccgcttgttcgccgcggagccaccggtcgtccggcgcgagctccggacgggggcttccgggacgaagtcgggcgtgccgcagacgcggcagcgcacgggcgcgctctccggcaaggtggtgtacctgagcccgggtcacggtttcacgcgcagcgcgccgctgaaccgctgggccactcagcggccgaacacctgggccgtggtggaggacctcatctccgccgaggtcctcaaccagtacctgctgcccatgctgacgggcgccggcgccaccgtggtgcccctgcgggagccggacctcaacgggcacatgtccatcgtcgacgacgggcaggccggctattcggaggacggcgacgtcttcgagtcctccgctcagcccggctggggcacgccgccgacacccatgggcaacgcggtggagcccttctcgctgggcacgacgcgggtgatggcctccgcgcgcagcgccaccgcgagcgcgacgtggacgccggagattcccgcggagggcagctaccacgtctacgtctcctacgcggccgaccccacgcgcgcgccggacgcgcactacgtggtgaagcacgcgggcggtgagagccacttccgggtcaaccagcgccgtcacggcgggacgtgggtgctgctggggcgcttctatttcaaggcggggcagcacccggattccggcgcggtggtggcgctgaacgacaccgcggagggcggcacgctgtcgctggacgcggtgcgcttcggcggtggcagcggcgtcatcggtgacgcggcgatggcgcccctggcgcggccccgctacgaggagtccgcgcgctaccacgtgcagttcagcggcgcgcccttcacggtgtacgcacccacgggggccaacgcgctgaccaacgagcgcaacgcggacgtcaccgcccggcctcgcttcgccgcgtggctgcacgaggagggcgaggacgcggtgtacgtggcgtggcacaccaacgcgtccaccacgggcaacgtgtcggggacggaggcctacgtgtacgggcccaacccggtggacggcacgctcaacttcaccggcttcccgggcagtgacgtgctggcgcgggcgctgctggacgagctggcgcaggacatgcgccgcgaggtggacccgagctggcgggtgcgcaacctgcgctcggcgaacctgggcgaggtgaaccccacgcacaacaatgatatgccgtccgtgctg

SEQ ID NO: 6323 - DNA, 1771 bp, Myxococcus xanthus
atgccttgcgtgccgctttcgctgcctgtgttgctcgtcgccacgtttctcgcggccgcgccttcctcgtcggaagcgtcgtctgacgcgccggcgcaggggctcgcgtcggccatcgacaactacgaggacgcgctgattgacgaggccctggcccggcatggacgggtgctggagccggcgccggagggcaagattctggaagaggtgttggtggccaccgaggacgtggtggccgaaatcgaccccttcccggacttcctcaacatcttccatgcccggacgcgggacgacgtcgtccggcgcgaggtgctgctccaggtgggggcgccgtactcggacgtgctcgcccaggagtcggcgcgcaacctgcgcgggctgcgcctgttctccatggtccgcctggtggcggtgaaggggcgcacgccggactcggtggcgctgatggccgtcaccaaggacatctggtcgctgcggctcaacagtgacttcgcggcggtgggctcgctgctccagtatctgaagctgcagggcacggagcagaacttcctggggcgcggcaagcgcatcgccgtggacttcgtgctgcggcaggacaccctcagtctggggcagagctacaccgacccgcgtgtgctgggcagccgctggtcgctgagcgagtccatcgccgtcatccaagggcgggagacgggcaagacggagggctcgcgcggcaacctcgcggtgagccggccgttgtactcgctgtccacgccctggagcgccagtgcctccgtgtcctggaacgtggagaccaaccgcgtctaccggggcgcgtccatctggcagttgccatttccaggcgggcccgcggtgccctacgtctaccggaccgaagaggtggtgggcggcctctcgtacacgcgctcgatgggcacccgctacaagtggaacgtgggcggcaccgtgggggcctaccattacgcctacggcgcgccgctggcgtccggcctgtccccggagcagtcggagtggttcaaccgcaactacctgccgcgcgccgaggacgccggctacgtcggcctgagcctgcgcgccttcgacgcgcgttacgaggtgctgcgagacgtggactcgtacgtcctggccgaggacttccagatgggccactgggtggcggccaccctgcgctacgcgccgccggtgtttggcgagcaaagccacttcgtcgaaggcgggctggcgctgcgctaccgcctgcggctgggggactcgctcaccaccgcctccctgtcgggcgccgtccgccggccgctggggcctgggggcgcgtggaccaaccggcgctgggcggcggagttgattgaggtgtcgcccaaggtgctgggcgggcgcttcgtggcgcgcgggctgctggatgtgaatatcgacgacctgttcgaccgcatccacctgctgggcggcgccaacggcctgcgcggcgcgggcgcggatgcgtactccggccggcggctcctgctcttcaacctggagtaccgaagccgccccatcgtcgtgaagacggtgcacctgggcggcgtgctcttctgggactcgggcagcgccttcaatgaccggcccgccatggtgcacacggtgggcatgggcctgcggctgctcttcccgcagttcaacgtcctgcccttccgcgtggacttcggctacgtgctcaacgacgcccggccgccggtgggcagccgcttctccttcgcgggcgggcagatgacggacgtacggcccaacttcatgg

SEQ ID NO: 6324 - DNA, 1542 bp, Myxococcus xanthus
atgctgcgaggagagcgcgccctgcgcgtgcgtcaggtcatcgccaccgggcaaggcatcgaagggggcgacccgctcttcgacgtccgccccgtgtggatggccagcccgcagaccgtggcgcaaatcttcccccgccgccccatcttcgacgtcgtcatcttcgacgagtcctcgcagtgccggctggaggaggccctgcccgtcctcacccgcgcccaccgcgtggtcatcgccggtgacccgaagcagttgccacccacgcgcttcttcgaatccgccgtggtgcagaacgctgagcaggaggccgaaagcgagcagggcctcttcgaggagcagcaatccgaggtggaggacctgctgtcggcggcgctcaacctcgacatcgaccagtgctacctggacgtgcactaccgctcccagaacgcggacctcatcgccttcagcaacgaccacttctacgacaagcggctccaggccattcccgcgcacccgtcccacagcgtgccccacgcgccattgcggctgctccccgtgggcggcacctatgagaagcgcaccaacctggtggaggctcgcgccgtgggctcgctggtgaaggagttgctctcacggccgcagccgccgtccattggcatcgcgtgcttcaacctcacccagcgcgacaccatcaacgacgtcctcgacgagatggccgccagcgacgcgtccttcgcggcgcggctggccgaagcgcgcgtgcgcaggggctcgggttcattcgaggggctcttcgtgaagaatctggagaacgtccagggcgacgagcgggaccacctcatcatcagcaccacctacggcccggaccggcacggccgcttctaccggcgcttcggtccgctgggcagcgcgggcggaggccggcgactcaacgtgctggtgacgcgagcgcgggagcagattcacctcgtcacctcgattccgcgcgagtcctaccagtccgcgccccccgttgaagcgggccggcagcccaacggcggctggctcctcttcgcgtacctgcgcttcgcggaggccttggagtcggcctatgcccaggacgcccaacgcgagcccgaggacaccgtgtccgaggcgtcgcggcccgccgagacagcagaggtgttcgtgaggcccacggacgcgggctcggccttcgcgcaagccctggcaggacatctggccacgcagcaccgcgtgtcctcggaggtccactggggcaatgacggcttctgcgtagacgtcgcactccggcaccccacccgcccgggcgatgtcaccgtcggcgtgctgtgtgacggcacgcgctaccccaaggccgcggaccgcgtggagtgggacctcttccgcacgggcgtgttggaaggccagggctggcagctcgtgcggatgtggacgccctccttcttccgcgaccccgagggtgccaccacccaggtcctccaggccgcgggcgacaagctgatgcgcgagccttccgcctcgcctcaggcggccatgtccgcgcggggcgtggtgcactga

SEQ ID NO: 6325 - DNA, 192 bp, Myxococcus xanthus
gcgcgggagggcgtcgggcatgtttggttcgtggaccctcaggcgcggacactggaggtgttccggctgagcgggggacggtggctcgaactgggcacgtggtcagacgacgagcgcgtccgcgccgagccctttgaagcggtggagttggagctcggcgtgttgtggttgccggaggcgaacgcgaagtga

SEQ ID NO: 6326 - DNA, 219 bp, Myxococcus xanthus
ttgccgaaggatgattccatcgaagtcgaggggaccgtgatggagcccctcccgaacgcgatgttccgcgtggtgctggacaacggccacaaggtgctcgcgcacatctcgggcaagatgaggatgcacttcatccgcatcctcccgggtgacaaggtgaaggtcgaactgtctccgtacgacctgacgcgcgggcggatcacgtaccgggcgaagtag

SEQ ID NO: 6327 - DNA, 681 bp, Myxococcus xanthus
ctctacagagctgctcatgagcgctgggtgcgcccgcgcttcaagccgaaggcctcggggcgcgagttcgacgtggcgcccacggaggataaccccgtcatcatcgccggcttcggccgcgtggggcaggtggtgggccgcctgctgcgcgccaagcgcatcggcttcaccgcgattgacgccagcccggagcagattgacttcatgaagcgcttcggcagccaggtcttctacggagacgcctcacgtctggacctgctgcgcgcggcccgcgcggacaaggcgaaggtgttcgtgctggccatcgatgacatcgaggcgtcgctgcgcaccgcgcgggccgtgcagcaacacttcccccacctcaccttgttcgcccgcgcgcgcaaccgcgtgcatgcctacgagctgctggacatgggaatcgaacgggtgatgcgtgagacgttcctcgacagcctggagatgggcgccggggtcctccaggagctgggcctcacgtattcggagagccggcgcgcccaggaacggatgatggaacacgacgagcgcctcctgcgcgagacggcccggttccaccgcgacgagcaaaagctcgtggagttggccgacaaagcccgcaaagagctggagagcctcttcgagaaggacgaagcggagcaccccgacagaaccgcgtga

SEQ ID NO: 6328 - DNA, 547 bp, Myxococcus xanthus
atggcccggctgctcggcggcgcggcgcggctgcaggacgacgtgcgccgggtgtgcccggagctgctggagctgagccgtcacctgcacttcgaacagcccgtctccgagcagccctccgtccgctacgagcacgcctggccggaagcggagacctgcctcgacgtgcgcgtgcgcccggtggagggcggcctgctggtgcactgccgtgacatcaccgaggagcgcaaggggcgcgaggcgctgcgccgcaacggcgaggtgttccgcgccatcctcgaaggcaccacggacgccgtctacacgaaggacctggacggccgcttcacgatgatgaacgcggcgggcgcgaaggccgtgggctaccgcgccgaggacgtggtgggacgcacggacctcgagctgttcgacccggcggtggcgcgcaccaacgcggcgaacgaccgcgaggtgttcgccttcggccgcaccgtcacctacgaggacgcgcagccgggcgtggacgggccgcgcgtgtggctgtccaccaagggcgtgctgcgtgacg

SEQ ID NO: 6329 - DNA, 1242 bp, Myxococcus xanthus
atgaagaagcgactgggtgacatcctgctggagcggggtgtggtggacgcgttgcagctccactcggcgctggcgtaccagcgcaagtggggcgtgcctttggggcaggtggtggtggaccagcgcttcagcaccacgcagcaggtgttggaggccctggccttccaggcggggatgcagacggtggacctggacgtccagccaccggacgcgagcctgacctggctgattccggagcgcgtggcggaggcacaccgggtggtgccgctgaagctggaagggcaggggggccgggactcggtgttggtggtggccatcgccgcccccgccagtctggcgtccctggacgcggtgaagagcgtgtccggcaagccccgcgtggtggcgaagctggcgtcggatgcgtccatccgccgggccattggacagctctaccggggtgaaaccggtgaggcagtgcctcggcgtcccggcatggagagcttctcgctgccagaggcggacgagagcatgcccatggtgctcggcggcagcatggcggagctgacgaacatggaggctcctggcggtgaggatgggctgccgctgctgagctcgctggaagaggtggtcgtccaggcgcaggcggtgcccgcggagatgaggcggctggtgcaggccatccgcgccatgcccgaaccgctggccgctgtcgcgcagccgctgcccctggaggcagggcgccccgaacaggccgcgacgcctgccacgacggagggcttgcacctgacgcatgtctctcggcctgggtccacgaaggcgccgttctccgcgcgcgccatgcagcgcacggccggaacgcggaaccacgtcccctcggcgttgcccgtgctcacggccgcgcagccggtgcccatggctcaggtcctggtgtacggctggggtgaggaggccaccaccgggctggtgcgagtgatgtcccaggcgggcctgcgggcgcaggtcgcaagcacggaggagctgctcgcggcgaacgcggcccaggtcgtggttgcgccgctgccggcgatggagtcgctgccgcgtccggtccacgcgcaggtactggtcgcgggcaagatgccggaacaggacctgcctcgcgcccaggcggtgggggcccgcggcttcctcgccgctccggtggatccggatctcctcctgcgcgcggtgcgccggctggcgcgccccgctggtgacgcggacctcaagcgcgccagctga

SEQ ID NO: 6330 - DNA, 306 bp, Myxococcus xanthus
gtgttcggagcgatcagccatccggcgcggcgccgcatgctcgacctgctggtcgatggcgaccgcccggtgaattcaatcgccgagaacttcgagatgagccgcccggcggtgtcacagcacctgcgcgtgctgctcgatgcgggcctcgtcaccgagcaacggcacggcagggaacggcggtaccgcctcgtgccggagcgactggagccggtacgcgactggatcgctcactaccaacggttctgggacgactacttttcccgactgcggtggcaccttgagaaaggcgacaagcagcaatga

SEQ ID NO: 6331 - DNA, 201 bp, Myxococcus xanthus
atgtgcctgggcgaatgggtggagctccttcgggagaaggcgggcggggtgccgggcctggggggcgtgggagaaggcctggcgggcctggtcctggaaccggccagcctccagccctacctgcacttccggcgagggcgctacacgcgcaacctcatctaccgggatgccaggttggaggtgctgctgaactctctagag

SEQ ID NO: 6332 - DNA, 366 bp, Myxococcus xanthus
atgacgctacgacgactcggtggtggactcctcggggcggtactccttctgacaagcgtttcgggctgcacccggcgcgtgccgcccgtggatgacaatccggcccccgtgccagagcccaccgccaccacgacagtgtacgtggccgagcgcatccggacgctggacccggcgaagccccaggtgcaggcgctcgcggtgaaggacggcaaggtgctggccaccggcaccaaggatgaggtgctcgccgccgcgggcaaggacgcgcgcgtggtggacctgggcagcgccacggtggtgccgggcctcaccgacgcgcacgggcacctggcgggcctgggccgcggcctggtgacggtggacctg

SEQ ID NO: 6333 - DNA, 705 bp, Myxococcus xanthus
atgcggatgagcaagacgaagcaacagacgctggggctgacgatgggcgcggtgctcgcgctcacggcctgcggtacggagcccatggagccgtcgcaggcgcccgtggagacggacgcggtggagggcgtggacgcgcaggctgcggacgcgaagccggtggacatcatcgcgctggagaagcagttgcaggagagcagcctggcgccgccggcgcagtgcaatgacccatcctgtgagggcggcggtggtggcggtgagcccgaccccgactggccctactacacgctgttctggcgggcgaacctgctgtccctgaagtgcatcaccacgtcggacatcgacggcaacgacgaagcctggctggaggcagaggtcaccggcgacaatcagtccgaggtcatctggaacgacgattacatgacgccgaacaagcgggtggagtggagccccctgaattcctatccgccgccgctgcagttcacgacgcaaacggtgggcgccggcggcaagctggtggcgctctgggacaagagcatgcacatcttcgatgtgcaggagcagattggctggaccacgctgcgtggccagacgggcaccttcacctcgattctcgaaggccacggtggcaagtacgagctgacctaccaggtggagtccacgggctgctcgccgcgctcgcagccctgccccaccaacctgtaa

SEQ ID NO: 6334 - DNA, 522 bp, Myxococcus xanthus
cccatcacctccatgttcctacacggcggctggggacacctgctgggcaactgcctcttcttctgggtcttcggcaacaacgtcgaggacagcatgggccgcctgcgcttcgtggtgttctacctgctgtgcggactggccgcggcggcggcgcacctgctggtggacccgggctcgccggtgcccacggtgggcgcgtccggcgccatctccggcgtcatgggcgcgtacctgctgctctatccacgggtgcgggtgaacatgctgttcatcatcgtcatcttcatccgcgtcttccccgtgcccgcgtgggcggtgctgctgtggtggttcggcgtgcagctcttcagcggcctgccccagctcaacacggtcagcgcggaggcgtccggcggcgtcgccttctgggcgcacatcggtggcttcgtggcgggcatggcgctcatcaagctgttccagaacacgcgctacacgaaccagcgcacgtcgatgcgccaccggctccatcccaaccatccgtga

SEQ ID NO: 6335 - DNA, 415 bp, Myxococcus xanthus
atgaagtcgcgcatcacggttgcctggagcaccgtcgcgtccctcctggccgtgctgcctggaacggcggcgcatgcccacgccggcctcccggagacatccaacgtcaccctccgccgaggccacccccaggacttcttctccgggacgacgttcggcgcggtcatctcccgcgacagcggcaagacctggcgctgggtgtgtccggatgccatggggtatggcggatggcgcccggaggcctacctgtggcgggagaccggcgacatcctcgccgccaccggcagcgccctgctgcactccccggatgagggctgctcctggcgcacgcatcccttcttcaagtcgacctgggtgacgggggctggcggccccaccccacccgatgaaccgcgtctttccatgcccgtcaccc

SEQ ID NO: 6336 - DNA, 606 bp, Myxococcus xanthus
atggaatatcggcagctcggcggctctggcttcaaggtcccggtgttgacgctcgggacgggaacctttggaggccagggggacttcttcaaggtgtggggcagcagcggggtcgaggaggccacgcgtctggtggacatcagtctggaggccgggctgaacatgttcgacagcgcggacaactactcgcgcggcctggcggaggagattctcggcaaggccatctccggccgccgggagaaggtcatcctctccacgaagggcaccttccgctcgggtgagggaccgaacgacgtgggctcctcgcgcttccacatcacccgcgcggtggaggccagcctgaagcggctgggcaccgactacatcgacctctaccaactgcacgccttcgacgcgctcacgcccgtcgaggaggcactgcgggcgctcgacgacctcgtgcgcgccgggaagattcgctacatcggcgcgtcgaacttctccggctggcacctgatgaagtcgctcgccacctcggagaagtacggcctcgcgcggcacgtggcgcaccaggcctactactcgctggtgagccgggagttcgagtgggagctgatgcccctcgcc

SEQ ID NO: 6337 - DNA, 384 bp, Myxococcus xanthus
atggctcgtatcgccggcatcgatctgccgcccaacaagcgcgcggtgatctcgctccagtacatctacgggatcggcaacaagtccgcgcaagacatcattgctgcggcgggcatcgatcccacgacccggaccaaggacctcaccgaggagcaggcccgcaagatccgcgagatcatcgaggccagctacaaggtggagggcgacctccggcgcgaagtcaccatgaacatcaagcggctgatggacctgggttgctaccggggtcttcgtcaccgcaagggcctgccggttcgtggccagcggacccacaccaacgcgcgtacccgcaagggtccgaagcggggcatcgtccgggcgaagccggcagctccggcccggtaa

SEQ ID NO: 6338 - DNA, 1365 bp, Myxococcus xanthus
atggcccgcgtgggccagggcgcctcgcagaaggcggaggcccaggcgcgcaccgggcgcgacctctccgagtcggtggtgcggctgagcgccgccctggaggagctgcgctccgccaacgtggtgctcaccaaggcagacgcctccatccgcgaggaagtcgcccaggtgcgcgaggacgcacgccgggtcatccgcatcggcgacgggctgacgcgaacggtggaccaactgggccacgaagcagagggcctggaagcggaggtgtaccacttcaagctccccacgccccactccggcgggacgctgcgcgtgggcatgcaccaggccgcgtcgctgcgaaaccgccaggcggtggacccgctcttcagcgtggagaaccaggtctccgagctcacctcgtgcgtgttctccacactggtgcgcagagaggacggcgggctggagcccgacctggccgagcgctgggacgcagacccttccgcgcgccgctaccgcttctacctgcgccgtggcgtcaccttccacgacggcacgctgctaacggcgagcgacgtgaagcgccacctggagcggctgctggacccggcgctccgctcgcccgaccggagcctcttggaggacgtggagggcgcgccggagtacgccgctggcatggcgcgcgacgtgtccggcctggaagtgctggacgaccacacgctggagattcgcctccgcgagcccaaggcgttcttcctccagttgatggcgctcaccgccaccgcggtggcccggacggacgccaacgggcggctggtgggcaccgggccgttccggctcctcgccctggaacccgagcacgtggtgctggagcggaacccctcttactggcgtccgggcggaccgatggtggaccggctggagttcctgctcgccggttctcgtaaggaagcggtggcgctgctgcgccagggggcggtggacctggtgtcgttcctcgacacggagcatgtggagctgcccggcctggaggccttccagcttgccgcgagcaccacgccctccacggccttcgtcgtgctcaaccaccgggaggcgcccttcgacgacgtgagggtccgtcgcgcactccgcgcgggcatggacatcccggccatggtgagccagttccaccccggcgcgcgcgtggctcgctcgctgaccccacccgagctgatggatgacgcggacatgggacccgcgcccgtaccggacgtggccctcgccgagcggctgctgcgagaggcaggcctgcgcaggctgcggctgacgctccaccgtcccaccggcaatgaccactccgcggagggacgcggtgcttcttccgcccgctgcttcaggcccggg

SEQ ID NO: 6339 - DNA, 678 bp, Myxococcus xanthus
atgtcgggtggtggtgcgcgctacgagcgctatgagcgggagcagttcgagccggagcagttcctgctcgacgtgcgcaaggagaagattgatcgcgtcgtcagtcaccggacgcgcaacttcacggtggtcctggaccggctggaggacagcttcaacatggccgcggtgctgcgcacctgcgagtccatgggcgttcaggaagtccacatcatcatcaacccggaagcgcccttcgtccccaactcgagggtggcccagggctgcgacaagtggctggacgtgaagctgtacaggacgttcgccgagtgccgcgagcacctgaagtcccgtggcttctcgctgtatgcctccgccattcaggagggggccaccagcctctacaccctgcgcttcgacgggaagatggcgctggtgttcggcaacgagcggcgcggcgtgagcgaggacgtgctggccggcgtggacggcacgttctgggtccccatgaagggtttcagccagagcctgaacatctccgccgcggcgtccgcctgcatcagccgggcgattgcctggcgggacgagcacctgggccagtcgggggacctgtctcccgaggatgcccaggccctgcgcgagcgcttctacgtgctggccatcaaacagaggaagcgcctgttcaagaaggccccgtga

SEQ ID NO: 6340 - DNA, 555 bp, Myxococcus xanthus
ctgcgtgaccgcggcatccgtgtgtatcccgtgtcctgcgccaccggcgagggcatgcagccgctgatggactccgtggcggaggtgctgttcacggggcgcaccgagaagctccacgtggagattcccgccaaggcggctcgggcggggaaggccaagacgaaggccgcggagaagaaggctctggctcgcaatgcgggcgcagctgcggcgacgaagtctgcgacgaagaagtctgcggctgcgaagaaggccgtgacgaagaaggctccggcgcggaaggcgggtgcagtggcgaagacgtccgcagcgcgcaaggcaggcactgctgcggcgaagaaggccccggctcgcaagtcgggcaccgcgcccgtgaagaaggccgcggcgaagaaggccccagctcgcaagtcgggcaccgcgcccgcgaagaagtccgccgtgaagaaggcatccgcgcgcaagagcggctcgtcgggcaaggccgccgcgaagaaggcatccgcggccacgaagcgcgctccggcgcgcaagtcgggcggcgggaggagctga

SEQ ID NO: 6341 - DNA, 578 bp, Myxococcus xanthus
cccatcaactacggccgcgcggacgcggcggcgccgacgggtgtgacgctgcgttggtccgggccggaggtgctcacggggcggaacaccttcgcggcgtcgtggctggtgcagggactggttcgcgccatcgccttcgaccccgaggtcgccgcgtggctggtgctgcgtcgcaaggccttcgcggaggtgccatcgcgcaagacgctgcccgcgccggagagcgcggaggcgttgctgccccggctggtggaggcggtggatggaacgcgcacgctcgcggggctcgcatcatcgctgggcgtggccccgggcatggcgcgcgaggctgcgcggatgggctgcgaaaagggactgctgacgcatcagctcgaggtgcccgcggccacgcatcacccggtggacgacctggccgagcgcgttgcgggcctgccgtgttccgcggcccggcggcacgtggagggcttgagcgcgctgctggcgttgatggccgggtatggcgccgcggatgccgcggggaagatggcgctccaggccgccttcgcgaagcgcgcgaatgagcagtggggcgtggcgcc

SEQ ID NO: 6342 - DNA, 2558 bp, Myxococcus xanthus
  unsure (1)..(2558): unsure at all n locations
ggacgcggctctcgagtcaccctgtccatgcccctggcgccctcgccggccaagccgcttctggcgagccccgggggtggaaagtcgggccgcccccccgcgcgcaaggatgtcgaggacaccgagccccgggattcggcccagattcgcgtgggccgctaccacatcctggataccctgggcgcgggcggcatgggcgctgtctacagcgcctatgacccggagctgcaccggcgcgtggccatcaagctgctgcacccggacgccaacccggcggcgcgctcggacggctcgtcccggctgcttcgcgaagcccaggcgatggcgcgcctgtctcacccgaacgtggtctccgtctacgacgcgggcacgttcgcggggcgcgtcttcatcgccatggagcgggtggacggcctgtccctgcgccactggctccgcgccgagcaccggacctggcgagaggtgctcgacatcttccgccaggcgggccgagggctcgccgccgcacatgccgctggactggtccaccgggacttcaagcccgccaacgtcctggtcagcaaggacggccgggcgcaggtgacggacttcgggctggcccgcaccaccgcggacctcgacgcggccgaggcgggccggggcaccacgcccgcgctgccgcgcctcgccccggaagacctgctccagacggcgctcaccgaggccgggctcgtcatgggcacgcccgcgtacatgccacccgagcagcacgaagatgggcgcatcgacgcgcgcggggaccagttcagcttctgcgcgtccctctacgaagccctctacggacagcttcccttcaacggcaagcgcccggaggattacttggaggaagcccgcgccggccgcgtgcgcccaccgcctcggggcagccgcgtccccacgtgggtgctgcgcgccgtgacgcggggcctgtccccggctcccgaagcgcgcttcccgtccatgggcgtgctgttggatgcactgggcgcggacccgctggcggcctggcgccgccgtggcgcggtggccgccgcgtccatgctgctcaacagcgtggtcgccgtcacctggctcctggtgggctcgcagcgggacggcccgtgtccggatgccgaggcccggctcaccggcgtctgggacacggcacgccgggcggaaatccagaaggccttcgccgccacgggcaaggtccacgcctccgccgccttcgaacgcgtggcgacgaccctggatggcttcgcgcgcgattggacgcgcatgcaccgcgaggcctgcgaggccacccgggttcagggccaccagtcggaccacgagctcgcgctgcgcatggcgtgcctggaccggcgccactcggccctggtggcattgacgggcgtgctcgcgcagacggatgcggaggcgttgaacgccgcaccggacgcggcccagcgactgcctcccatcgccgcctgcgcggacgtggacgcgctctggcggggcctgtcggagcccgaggggcagcggcagcaggtggaggccctgcgcgcccgggtggaccgggccacggccctggtggacgccggccgctacccccaggcgcaggaagaagcgaaggcggtgctgtccgaggcgcggcagctcggctacgggccggtgctggcggaggcgctggagctggagggccggctcgggctcgtcgcgggggatgacgctcgcgccgccgcggccctgcgggaatccctcttcaccgcgcaggcgcaccgtcatgaccacctggcggcgcgcgcgtcggcgcggttggtgaccgccgtctcctccgaccccaccctggagtcctggacggtggagcaggcgcgcgcgtccatccaacgcgcgggcggtgcctccgaattggaggccttgctccagacgagcctgggccgcaacgccttcctccgaggccagtacgcccaggcagtggaggcctttggccgctccgccacgctgcgcgagcaagagctgggtcccgagcacctgctcacgttggagtcgctccgcaaccaggccgcggccctgtcccgcacgcccgagacggagcgcgccatgggcctgctgcaccgcgtgctggagacgacggagcgcgtgctcggtccggaccatcctcagacggccatggcggccaacgccatgggctaccacctggtcatcgtccgccgcttcgaggaagccctcccctacctccagcgcgccatccacctggaggagcagtcgctggggcacgacagcgccacgctgagctatccgctcaacaacctggccgaggccctggaagcgctcggccgcaacgcagaggcccgccccctgcgcgagcgcgcgctcgcggtggacctgaaggcctacggccccgagcatccggagaccgccaccgacctggccctgctcggcgcgctggccctgcgcgagggaaagccgcgcgacgccatggactacgcccgccggagcatcgcggcctacgaggccttccagaaggaccacctggacacggncgctccgctcaccacgctggggcctgccctgcacgc

SEQ ID NO: 6343 - DNA, 591 bp, Myxococcus xanthus
atgccgcgctcccgctccctgttcgccgcgctcaccttcgggctgggcgccttccacggcggctgcatcgcctacaacgattcgtgccagcccctggtggaggaccccgacgccgtcgtgggctacctggccgacgatgtgctcctcgacaaggtctacacgcggcacgacaacaatgcgctgggccagctcgtcgcggatgccctcctgcacgcggaggatgactccacccgccctgcggtgctgggcgtcgtcaacggcggctcgctgcgccaggaaggtctgtgcgtcacgcggaccgagctgcgccagggcccgctcacggatggcgtgctccacgagctcatcctcttcgagaacctcgtcgtgacggtggaccttacggagaaggagctcgtggacatgctggagctgtccgtgggcgcgctgtacctggaagggcagagcatcgcgtcgccctctggcgccttccttcacgtgtccgagggcagctcgctgcgcgtggactgcggccagccgaaaggctcgcgcgtgcgcgaactgacggtgggtggggtgcccgtgacgctgcccgcgcgcgaagacgcctga

SEQ ID NO: 6344 - DNA, 1776 bp, Myxococcus xanthus
cgcggccctggctccgctctctatggcgccggtgctttcctgggcgtggtcaacatcgtcacggacacgtcggacggcgttcgcaccgccgtgtccgtcggcggctacccgggacaagacgaccggctcgccgtcacggggaacggacacatctccgcggggcacaccgctgggaatctgcgcgtcttcgcggacatcgacgtgtggagccaggctggtgactccaccgtcatcgagaacgacggcctggacgacgagtcgcgctcgcaggggctccgcgacgtgacggaccccgcggggcgcacccgagacgagcgcttcctcttcaacgcgggcgcgggcgtcacctacgccatgggcgacgcgggccgcctgggggcctccgcgcgcttcctcaccgagcgccgcagcgccctggtgggcctcttcgacacggtgggcgaggactccaagctgggctggaacgtcttcctcgcggacctgacctgggagcgctcctttggacccgacgtgacgctccgcgcgcgggccgcgtatgaccagcagtccaccgaccgcttcttccagatcacccctcacgacttcagcgccggcacgggcgcgaaccgcctgttcgaagagggcatgcaggagcagacgcgcgtctccgtgcgctcgctcaccggctccgtggacgcggacgtggccctgggcgcctacaaccgcctctccctgggcgcggtggtggatcagcagtcgctgggcgaatacgactacgtgacgaactacaccctggacgcccaggtgcgtccggacggcctgacgcggccggagggcctggtggacctgacgagcggcgccgcgtcccgccgcctcaatgtgggcctgttcgcgcaggaccagtggaccgtcgtcaacgcgctcacgctcacgttcggcgtgcgcatggacgccacccagttgcccacggtggacgcgtccggcgccatcaacggcacccgcttcgtgcccaccctcaatccgcgcgtggggctggtgttcgcggccaccgacgcgctggtgctcaaggccctctacgggcgtgccttccgcgcgcccacgctgcaggagttggtcgagcgcattccggacacggagtacaaccagggccgcttcgaggggaacccgcgcctccagcccgccacggtggacaccttcgagctgggcgcggacctcatccagtcggcgggggacgcgcgcgtgcggctgcgtgccaacgcgtacgtggccctcttcggttcgcccatcgtccccgtggacacgtcgggcaacatcgtcccgctgcgcaaccgtgagctgggcgtgcgcgtgtacggcgtggagggcgaggcccggctggaggcctccaagcgcgcgtatgcgtggctcaacgccagcatctcccgcgcggaggacctggagctgcccgcccagtcccgcctgctcaccgacacgccgcaggcgcgcttcaacgccggcgtgacgatgcccatcggcgcctatgtgaatttcgacgtggtggtgcgcacgggcgcggagcggcgcaacaacagccgctccgtgctggagctcatccgccgctacaagattccgtcctacagcctcatcaccgcacagctccgcaccgagcccatcctggagcacttcgaggtggccctggtggcgcacaacctgttcgacaacgaccttcgcgacgacgtgccccgtccggaccgtgtccccgggctgctcccgcgcgagggcatgtccggattcctcaccgtgagggcccactactga

SEQ ID NO: 6345 - DNA, 687 bp, Myxococcus xanthus
gctctaaaggcgcaccatcttccggcatctggagaagctggaagcggagaagtcagggcggcccctgccgcccgaggagggagacgagctgctctaggggagcagcccgtccggatgatggaagcgacgacgcggcgatactcctggagacgagagctgtggctgctgatggccgcgggctgcgccgcgtccggctgcctcatcccccaggacgacacgctgctggacgccgtgccggacttcatgaaccggccgccgcgcatcatcgacagcctggtggcgccccagcagcgcttcatctcggacttcggcgcggacggctgcgacctcaccttcgaggtggccgtcgaggacccggacgtggacgaccgcatcgtcgtgcactggtacgtggactacaacccgcaggacccgcgcggcccctaccgccagtatgagttggccagcacccgcgaaccccggcgctcggaccggggcacgctgctcatcagcctcgcgtccgccaacaacccgctgagcacacccggcccccacctggtggaggcgctggtgaccgacgcggagctggtggaccgcgtggtgcggccccggccagtgcaactgccggatggcaccaccatcaacaacccgggcttcgtcgtcacctattcgtgggtggtcaacaccgtccagggagactgtcggtga

SEQ ID NO: 6346 - DNA, 1767 bp, Myxococcus xanthus
gttgttgacagtgcgcaagcaccgttccaccgccacttctcaatccagaaatgcgcatctactttccgtcgtccctcgtcagtgggtgctggattgcccgcatgccgggtcggcttcacggcaggagctcgcatgaaggtggttcttcgtttcggtgcgctggcggtgggcgcggtgctcatcactggcggggtgggagaggcggcggaaacgcaggcccgcaagggggggaagaagcccgctgcggcgtccgcgtcgaagacctccggtgcgtccagcaaggcgggcgggaaaaagaagtccgcgaaggcccaggtcgaccgcaaggcagaggagaaggctccgccgccgggggttgcgccggaggacgtgcggcaggggccggcgcgcgttcagcccgcgtcggcgaagttcgcggagctgccccgcatcccggacgccaagcgggacgcgctggcggacaagaagcgcgacgaggccattgccgccttcaagcgcctcatccccaagctgcgggacggcaatccgcagaaggcggagatgctctaccgcctgtcggagctctactgggagaagtccaagtacctctaccagttggagatgacgcgcttcctcgcggcggagaaggaatacgacgcggccgtggcgcgcggcgagaaggtggagccgcccaagaagaaccacgcggacagcgagcgctaccgcaccgaaacgatgggcatctacgaggacatcctccgcgcgtacccggattatccccagcgcgacgaggtcctcttctccatggggtacaactactacgagctgggacgccgcgaggacgcggtggcccgctacgaggagttgatccgcgacttcccgaagtcgcagttcgtgccggacgcgtacatccagctcggcaaccactacttcgagaacaacaagctcatccccgccaaggagaactatgagaaggcgcgggactcgggcgtgccgaaaatctacggctacgccgtctacaagctgtcctggtgcgactacaacaccggcgactacgagctggggctgaagaagctccacgaggtggtggactacgccgcgaagagccctgagttgggtgacctgcgcaccgaggcgctcaacgacctgaccgtcttctacgtccagttggaccagccgaaggaagccatcgcctacttcaaggagaaggcgccggcgcagcgcgtgggccgcctgctggccaagacggccgcgggcctggtggacgcgggccacttcgacagcgccatcctcgcgtaccgcacgctcgtggacgacgagcccatgggcgccaacgcgccggagtaccagcaggccatcgtccgcgcccacgaggggctccgccagcgccagttggtccgcaaggaaatgaagcggatggtggacctctacagccctggtggcgggtggtggaaggccaacgagggcaagacggccgtcctgcgaaacgccttcaacgtcactgaagaggccatgcgcgtcatggtcaccgagtaccaccaggaggcgcagaagacgcgccaggtggagacctaccggctggcgcgtgacatctacaagcagtacgtggacgcgttcgcctccaacgcgaacccggacttcgtggcggactccgccttcaacctccgcttcttctacgcggagatcctctgggctttggaggagtgggaagcggcccgcggccgagtacgacgcggtggtggccttcaagattccggaccgcgacaccgcgcgcgaggtcaccaacaa

SEQ ID NO: 6347 - DNA, 339 bp, Myxococcus xanthus
ctccagcagtgggggattccgcgggagcgcatcgtcacgtaagggcgcagccggaatacacgggagaacgcggtggagtccgcgcgcatcatccaggagcgagggtggaagtccctgctgctggtgacgagcgccgcgcacatgccgcgcgccgcgggttgcttcgcggcggtggggctgcgtccggacctgttgccggtggactcgcgggcgtcgaacacgccgctgcggcgcatgagctggttgccgaggtctggggccctcaacctgagcaccgacgccctgcgcgagctggcggggcgtgcggtgtatcgcgtgcgaggctggacggcgccttga

SEQ ID NO: 6348 - DNA, 441 bp, Myxococcus xanthus
atggctgacgagatcaatacttcggctgcggcgtccacgggcgccgagggcgaggcccctgccgcgaagaagtcgaagcgcaagggcaagaagaacatcctcaacggcgtggtccacatccagtccacgttcaacaacaccatcatcacgatcacggacgtgtccgggaacgtgatctcctggtcgtccgccggggcgcgtggcttcaagggaagccgcaagtccaccccgttcgcggcgcaggtggccgctggcgacgccgcggcgaaggcgatggagcacggcctgaagaacgtgtccgtgttcgtgaagggcccaggcgcgggccgcgagtcggcgctgcgcgcgctggccgccgccggtctgaagatcaacctcatccgcgacgtgacgcccatcccgcacaacggatgccgtcagcccaagcgtcgccgcgtctaa

SEQ ID NO: 6349 - DNA, 900 bp, Myxococcus xanthus
gtcaaggtggacgcggtgctcgggggacatgaccacgaggcgctggaggaccgcagcacgggcacgcccatcttcaaggtggcggcggacgcggtggacctgggccggctcacgctggacgtggacgcggcgacggccacggtgcgccaggtgacgtggcagacgctgccggtgacgcggcaggtgccggaggacgcggccttcaacgcggccatgcagccctatgccgcgctgttcaaccagctgtccgagcacgtaggccgctcccccgtgcccctggaagcgcgggccgcgatggtgcgcacccaggagacgaacctgggctcgttcgtcgcggatgcgttccgcgcggcggccagggcggacgtggcgctggtcaacgccggggcgctgcgcgcggacgcggtgctgcccgcgggtggtgtcacccggcgggatttgcacgccatcctgccgtacgcggatgagctggtggtgctggaggtgaagggggacacgctgcgcgcggcgctggagaacggcgtcagcctcagccgcgaggactcacggccgggccgctttccgcaggtgtccgggctggagttcaccttcgattcggaccggcccgccggacagcgggtgctgggcgtgaaggtgggcggcaggccgttggacaaggcggccacgtaccggctggcgacgctgagcttcctcgccagcggcaaggacggctacgacatgctgcggaaccagccgtccacgccggccagggtgacgggtaactcgcccctggacgtgctggcggaggcgttccgcaccggcacgccgtcgccgcatgcccaggcggatggccgtatctcccggctcggcactggcgccctggctcccgacgcgcgtcagccgcccgcgccgctgaagtag

SEQ ID NO: 6350 - DNA, 450 bp, Myxococcus xanthus
atgaccaccgtcgagatcatcttcctgggcgtctatttcagtctcttgtgcgtgctgggagtctacggctcgcacaggtaccggatggcgttcctgtactaccggcacaagttcaagctgccgacgccgaagggcgcgctggagtcgctgcccaaggtcaccatccagctccccatcttcaatgagatgtacgtggtggagcgcctggtggagtcggtgtgccgcatcgactatccgcgcgacctgctcgaaatccaggtcctcgacgactcgacggatgagacgtgtggcatcgcccgggcgtgcgtggagcgtcagcgccagaaggggcatgacatcgtctacatccaccgcgtcaaccgccagggcttcaaggcgggggcgctggagaacggcctgaagctggcgaagggccagttcgtgccggtgttagacggccttagagcacgt

SEQ ID NO: 6351 - DNA, 937 bp, Myxococcus xanthus
cgggagatatcgctcaagccttatcaggccgtggtggcgcgtctccagtccggggcacatcagcttacacccatcttggcagggcgggcagtggaccgggcgcttagcgcgtcgtaactggacgtgtcgttcgtcgcgctccacgggtgcatggggtaggacggccgggtccagggcgtgctgtagttgttgaacctgccgaactcgggctcgggggtcatgtcgtcggcgttggccatgaacaagcccttcgacaagcggttgttcagcttgcacatcctggccacgctccatggctacacggtggagcgcgaggacgcgtggcgcgccctggccctgctcggcgacctgggcttccagtgagtggtgaagcccgcgtacgacggctcgtctcatggggcttgccttggtacgtgaaccggaggcgcttgcgttcgcggtggcgcaggccagccggttcggcggcgaggccctggtggagcgctacgtggcgggccgggaagtcacggtgggcatcctcggaggccaggtgctgggcagctgcgaggtggccacgccgcgcgagggcttcgacttcgacgccaagtacaagggcggagccgcgtacttctgcccaccccggctgtctcccacccgcgtggccaacgtggaggccctggcactggcggcctaccgcgcgctgggctgccgcgggcaggcgcgggtggacctgatgtgctcggacacggagaacgacgtggtgctggaggtgaacacgctgccgggcttcacccccaccagcctgctgccgaaaatcgccgccagggccgggttggacttcgccgcgctgacggagcgcatcctggcgctggccacccgtgacgaagccggtgtcctggaggctcccgccgtggagactccgccggacctgggcgtgcctcgccgcgcggtgagctga

SEQ ID NO: 6352 - DNA, 1365 bp, Myxococcus xanthus
atgctgtccacgcctgccttcgcggccgctcccgcctcggcgcccaccaaggaagcgcctccggccgccgccgcgcccaagcccttcaaagtccccgtccgcacggagttcacgctcgacaacgggctggaagtctcgctgctgccctacggcgacatgccgaaggtcgccatccaactggccatcgacaccggcaacatccacgagaaggccacggagacgtggctggcggacctgacgggaaagctgctgtcggagggcaccaccacccgttccgcggagcagcttgcccaggcggccgcgcagctgggtggttcgctcaacatcggcacgacgatggaccagacctatgtcggtctggaggtcctctccgagtcggcgccggacgccgtggccctcatcgcggacgtcatccagaacccggccttcccgccggcggaggtcgagcgcgtcaagggcgacctcgtgcgggagatggccatctacaagagccggccgggtacgctcgccgacgagcggctgctccagtcgctctacggtgaccacccgtatggccgctacttcccgccggaggcccagctcaagggctacacgccggaggccgtccgcgcgcactacgacgccaacatcggcgcggcccgggcgcggctgtacgtcgtcggccggttcgagccggcgccggtggaaaaggccatccgggacgcgttcaccggctggaaggccggcgcggcgcgcctccggaacgtgcccaagcagaaggtggcgaaggcggtccagttcatcgaccgccccggctcggtgcagtccacggtgcgcgtggcggtgaagggcctgccgccctccagcccggactacgtcaagcagacggtgatgaacacgctgctcggtggctacttcagctcgcgcatcaccgcgaacatccgcgaggcgaagggctacacgtattcgccctacagcgatgtgtccacgcacctggaggacgcctactgggtgcagaacgcggacgtgacgacggccgtcacgggcgagtcgctgaaggagatcctcaaggaggtggccaccctgcgcaagacgccgccgcccgcggacgagctgagcgctgtccagagctatctggcgggctccttcctgctccagaactcgtcgcgcagcggcatcatctaccagctccgcttcgtggacctgcacggcctgcctgattcgtatctgcagaactacgtgcagtcggtgatggccgtcacgccggagcaggtgcagcagctggccgcgaagatgctgacgcgtgaggcgatgaccttcatcgtcgtgggcgaccagaagttggtggcgccgcagctgaaggtcgtatcccccgcgctgaagtga

SEQ ID NO: 6353 - DNA, 807 bp, Myxococcus xanthus
ttgcttggcgccatggagccggcgacgtgcgcgccgcacttccgggcgaaggtgcatggcacatatgcactggaccgggcgttggcgggccgttcgttggatttcgtgctgctggtgtcctccaacgccacggtgctgggtggcctgggattgggggcctacgcggcggccaatgccttcctggatgcattcgcggcggcgcgctcgcggaccgggggcccgcggtggctgagcaccaactgggatgggtggccagtggatgccgccgagggcgcgaaggcggtccagaccagcatcgaccagttcgccatgacgcccgacgaggcggtggaggcctttcgccgggtggtggaggcgccgctggaagggcaggtgttggtgtccacgggcaacctggacgcgcgcgtggcgcagtgggtacggcgcgagggcgcgggcgcgaagaaggacgcggggggcacgttgcactcacgtcccgcgctgggcactgagtatgtggcacccaccgatgaggtggagcgcgcgctcgtgcgtgtgtggcaggagcagttgggactggagcagttgggcattcacgacaacttcttcgacctgggagggaattcactcctgtggctgaagatcgtcgggcggatgaagcgggagctggggcgggacgtgcccctcaccagcgtcttcgaggcccccaccgtggccaccctggcgaagaagctgggacagggaccggccccagcggagaccaccgccttcgagtccagccagagccgtggggctcaacgcagagagcgtcgcagccgtcgcgaatag

SEQ ID NO: 6354 - DNA, 702 bp, Myxococcus xanthus
caggagttcgacgacgccgacgtcgccatcatcggcatggccgggcgctttcccggcgctcgggatgtggacacgctctgggccaatctccgagagggggtggagtccatccgcttcttctccaaggaggaggcccgcgcggccggtgtgtctgaggagcggctggaggacccgtccttcgtgcgagccgcggccatccttccggagccggagtcgttcgacgcggccttcttcgagatgccgccacgcgaggcggaaatcacggacccccagcaccgtgtcttcctggaagcgtcctgggaggcgttcgagcacgctggctattcaccgcgtgactacgtcggcgccatctccgtgttcggcggcgccacgctcaacacgtacctgttgatgaacctggcgcggaacccacgcgtgctggagtccttcgagccggtgcaggtgaacatcggcaacgggggcgacttcctggccacccgcgtctcgtacaagctcaacctgaggggagccagccacaccgtgcagagcgcgtgctccacctcgctggtggcggtgcaccaggcttgccagagcctgctcaatggcgagtgcgacatggcgctcgcgggcggtgcatccgtcaacgtggggttcttcaacgggtaccggcacgcggagggtggcatggcctctccggatggccactgccgccctttcgatgcg

SEQ ID NO: 6355 - DNA, 312 bp, Myxococcus xanthus
atggcggccttccagtcgttgcagcagcatgacctgccgaagctgtacgcggccgaggcggctggcgcggcgagcggcgcgtcgcctgcgggcgcttccagcgcgaagcccgccgagcctgtcgacgtgaagctcgcgcaggcgatggccaccgcgctgaaggcgctgccgcgcgaggcggtggacaggttcctccagaagttcgccgtccagcgcatccgggacatccctgcgtcgaagggcgagctggcgcgcgccttcgtcgactccctcgtcgccgaatactccgcggagagtgttgcgaacgtggac

SEQ ID NO: 6356 - DNA, 408 bp, Myxococcus xanthus
ccagtgtgctctaaagacgaggaaggactcgacttccggcaggccctgctcgcggacgaggacctgcggaagatgatgacgcccgaggagatttccgactgcttctcctcgggctaccacacgcgccaggagcctgcgttctacttccgtcgccgggcgcatgacccggacgacaagtgggtgctggggcagcgcatccccggtcagcggagcgtggcggatggggagcaggtgttggacctgctggcgcgacacccctccaccgcgcgccatgtcgcgagcaagctggcgcggcgcttcgtctcggacacgccgccgccggcgctggtggagcgggtggcgaaggtgttcctcgactcgggcggggacctgcccaccgtgtaccgcgcgctcttcctgtcgctttag

SEQ ID NO: 6357 - DNA, 1587 bp, Myxococcus xanthus
aacagccgcctcctggccgagcgcctcaagcaccaggtggagtccgccgggctcgccacgcggctgttccgggccagcgactatccggtgcgggagctggccaaggagaagctgctctgcgtggtcatcagcacccagggagatggcgacccgccggacgacgcacgcggtttcagtgagttcatcctcggcaagcgcgcgcctcgcatggaggggctgcgctacgccgtgctggggctgggagactccagctacccgcgcttctgcgaggtgggccggcggctcgacgcccgcttcgcggagttgggcgccagccggctgttggagcgtgccgattgcgatgtggacttcgagcccgtggccaagggttggctcgaccaggcctacaccctggcgcgcgaagcactgactccgcaggcgacggtgacggccacggtcgtgccgctgcgggagccgcacgccacgcccgcgttcaccaaggaagcgccctacacggcggaggtgctgctcaatcagcgcatcactgcacgcggcgcgctcaaggacgtgcggcacctggagctgtcgctcgcgggctccgggctggaatacgcccccggcgacgcgctgggcgtgtggccccacaatccgccggagctggtggcgtccttcctgtccgagctgcgcctcgacggagaagcggcggtcacccgagagggccgcacgctcccgctggcgcgctggctgagtgacgagttggaaatcaccaggctcaaccgccccttcctggagcgacaagccacgctgtccggcagcgcggcgctgcacgaagtgctcgaaccgggccgcaccgaggccttccgcgcactgctggcggggcatcaggtcatcgacgtactccgcgcccacaaggccacctgggacgccacggagctggtccagtccctgcgccggctgacgccccggttgtactcgattgcctccagccccaagcgcgtgggtgaagaggcgcacctcacggtggcggtggtggactacacggtgttcgacctgcggcacttcggcgcggcgtcgtaccacctggccacgcgcacgggcggcaccgacacgttccgcatcttcatcgagccgaacgaacacttccagctgccgcaggactgccacacggacgtgctgatgaccggccctggcaccagcgaggcgcccttccgggccttcgtccacgagcgcgcggagaccggagcgaagggccgcaactggctcttcttcggtgagcaacacttccgcacccagttcctctaccagacggagtggcaggaggccctgaagaagcagacgctgcaccggctgtcactcgccttctcgcgggaccgcgctcagaaggtctacgtgcagcaccggctgcgtgagtccggacgtgacgtctacgaatggctcgaaggaggcgcccacctctacgtgtgcggcgacgcccagcgcatggccccggatgtccacgaggcactggtggacgtcgtctccacccacggcggcaagagccgcgaggacgcgcacgcctggctcgaatccctgcgcgagcagcggcgctacctgcgcgacgtctactga

SEQ ID NO: 6358 - DNA, 627 bp, Myxococcus xanthus
atggctcgttacactgccagcgcctgccgtatctgccggcgcgaaaacctgaagatgtacctcaagggcgaccgttgctacacggacaagtgcgccattgagcgccgcccctatcccccgggtcagcacggccagggccgcgtgaagttctccggctacggcgtgcagctgcgcgagaagcagaaggtcaagcgcatgtacggcctgctagagaaccagttccgcggctactaccaccgcgcgtccgccgccaagggcaagacgggcgacaacctcctgcagcagctggagcttcgtctggacaacgtggtgttccgcatgggcttcgcggacacgcgcaacgaggcgcgccagctggtgcgtcacggtcacttccaggtgaacggccgcaaggtgaacatcccctcgttcgccgtgaagccgggcaccgcggtggaggtggtggagaagagccgcaaggtgctccgcatctccgaggcgctggagacggtggaccgccgtggcattccgcagtggatctccctggacaagaaggcgttcaagggcacggtcaccacggttccgaaccgtgaggatctgacgatgcccatctccgagcagctcatcgtcgagctctactcgaagtaa

SEQ ID NO: 6359 - DNA, 1112 bp, Myxococcus xanthus
atgagccaccagcccaagcctctctccgaagtggagcacatcaagacccagagccgcctgctccggggaagtctggcggagagcctggaggacccggtgacgggcggcctcgccacgccggacaccaacctcatcaagttccacggcagctatcagcaggacgaccgcgacgtgcgcgaggagcggcgtcagcagaagctggagcccgactacagcttcatgctccgcacccgcctgcctggaggcgtgtgcacaccggcccagtggctggtgatggacgccctggcgcgcgagcacgccaaccacacgctgcgcatcaccacgcggcaggcctttcagttacacggcgtcatcaaggatgacctccggcccaccatcgcccgcatcaacgaagcgatgatggacacgctggccgcctgcggcgacgtgaaccgcaacgtgctgtgcaaccccaatccggtggactcgcgcgtccacgagacggtgtaccagtgggcggtgcgcatctccgagcacctgctgccgaagacgcgcgcctactacgaagtctggctggggaaggagaaggtggccggcggtgaggacgagcccatctacggcgccacgtacctgccccggaagttcaaggccgccgtggcggtgccgcccctcaacgacgtggatgtcttcgcgcaggacctgggcttcatcgccatcatcgaaggcgacgcgctcgtgggcttcaacgtctccgtgggcggcggcatgggcgccacgcatggtgacgcggccacctatccccggctggcggacgtcgtcggcttcatcccgccggagcagacgctcgccgtcgccgaggaggtggtgaagattcaccgcgacttcggggaccgcaccaaccgcaagcacgcgcgcctgaagtacgtcctggaggagcgcggcgttccctggttcacggcagagctggagaagcggctcggcttcccgctccagccagcgcgccccttcgttttcgagcacaacggaaaccgcttcgggtggacagagggccatgacggccggtggcatctgacgttgcacctgaacagcggccgcgtggcggaccggcccggcgcgccgaatttgacgggcct

SEQ ID NO: 6360 - DNA, 1134 bp, Myxococcus xanthus
ggcggggatgcgatgaagtggcggatcgccagcgttgcgttcctgctgggggctctgtcgtcggggctcacctggttgtccgtacaaccggtactcctccggctgttggacgcgctccgccgctgggtccccgaaggaagcgcggaagaagcgacgctggctcgtgtgcaaggcctcctaccctgggtgttggggctcgacctggtcgcgttgacggtcctcacctacgtggtgctggacctgatggtgggacgcccgctgcgccgcaccgaggcggtggtcgagcagttcggtcggttggactgggaggcgcatctggttccgacccagggaggaacgctggtgtctcgtatccagcgcgccttgcagcggatggcggaggcgctccgcgaagaacaggcgctcactcgcgcgcaaatggcgtctttgcgcgcgtcgcatgcccaactggctcgcacgcagacagagttggttgcttcggagcgcatggccacagtcggacggctggccgcgggcgtcgcccacgaagtaggcaacccgctggcgggaatccttggctacgtggcactggcgcgtgtcaaggcggacacgccggaactgaaggacttcctggagcgtatcgaccacgaagtgcagcgcatcgaccgcatcatccggggcttgcttgacctgggacgccccggtgtcacgtcgctagggccggtagaggtaggcccggtggtagagacgtgtgtgcgcctggttcgtgcctcccctgagttgtcgggcgtgacggtgacgctcgacctggagcctggagcgcttgcacgcacggacgcaggcccgctttcgcagattgtcatcaacttgctgctcaacgccgcccaggccatgggggggcagggacgtgtgcgggttgccacgcggcaggcggcgggtgaagttcgtttgctcgtggaggatgacgggacgggcatccccgaggacgtcatgccgcgcctgttcgagcccttcttcacgaccaaaggacgtgaggggacgggattgggactggcggtgtcgcagcgcctggcgcaggtcatgggcggcaggctcgaggcagagaacatccccagtggtggagcccgtttcaccgtgtgcttgcccgtaccctga

SEQ ID NO: 6361 - DNA, 370 bp, Myxococcus xanthus
atgcccctgttccgcaccattctcgttgccgatgatgagccctccatccggcacatcctcacgttggtgctcaccggccacggttaccacgtgcgcgcggtggccgatggcgaggacgcgctgaaggaactcgccgcgcgtgactaccacgtgctgttgtgcgacgtgcgcatgccaaagaatgatggactcgtcgtcctgcgtgagggcctggattcgcaccccgcgctgacggcagtagtgatgagcgcctaccgctcgcaggaacaggctctacatgccgttgcctcaggagagttcgactacgtccagaaaccatttaaaccggacgatatagtgtttgtactccgtaaggcagaagaacgggagc

SEQ ID NO: 6362 - DNA, 912 bp, Myxococcus xanthus
atgtcgctcgtcattcgcacgcgcgacccgggcaaggtccccgacgaactgctcgcccacattcagactgcgctcggcggccagcgccccgacggcgaagagttcgtcgacgagctgcaacgcgtcgtctgtgcgcggcagctcgcgagcggcttcttccaccgctggcggtaccccgacgtccagggcgttccgcaggaccccgagctgatcgttcggtggttcgcgcgtcggcaggagttcaaccgggagctacgcgagcgcctcaagcgccccgccgagcatctcgactccccggggctcctggtgcgcgccgcgattcgcgctcaccagtccccgccctacgacggggaactgccgacttggcgcgcgatgtcgtggccctcgtgggcggagatgcacaagcacgtcgtccacgtcacggaagccgtgtggctctccgacttcattgtgcgtgacgcggcgaagtgggcgctacgcaaggggcagccgggaatcgtctgggttgagttcccggagcttggccagcgcatcgcgaaggcggcgggcgtgcctttctacggcggcggcccggaagcgtcggcgaccatcatccgggagagtgggaagcggtccatcgtcgcttcacttcgtgcccacgggacgggcaagaacctgacgatgttctcgcgaatgctgttcgtgaatccaccggccgacggcgctgcgtgggaacaggcaatcggccggtgccaccgacagggacagctcgccgacgaagttgaggtcgagctgtaccagcataccgacgagctagtcggagccttccagaaggcccgcgatttcgcccggttcatcgaacagacggagggcacgccgcagaagatatgtcttgcaagctacgacaaaggtgccagttctagtcagcagtag

SEQ ID NO: 6363 - DNA, 1158 bp, Myxococcus xanthus
atggcgcaggtgccccccggcacgctggtggtgctggcgcccacccaccgcagctacttcgacttcctgttgactagctacctgtgcttccagcacccggagctgggcatctcgatgccacacatcgccgccgcggaggagttcggccgcatccccgtggtgggcccgattctcaaggactcgcaggccttcttcatcaagcgcggcgtgggccgcgaggtgccggagctgggcgaggaactgcgccggctcaccgagaagaacgcttcgctcatgttcttcgtcgagggtcagcgcagccgcgcgcggctgatgctgccgcccaagcgcgggatgttgcgcgcgctgcagaatacgaagcgccagttcgtcgtgttgcccgtcgccatctcctacgaccggctcccggaggaggcgtccctgtcggaggaactgtccggcaagccgcgcccgaagatgacgctcaccggcgtgctgtcgtggctcacgaagctgacgcgtggccaggtgcagttgggccgtgtgcatctgtcgtgtggcgcgccgctggcgctcaacccggacaccgacgtccgcgcgatgagccatacgctcatggcggagctgcagcgtcacaccacggtgagcagcttccatctgcgcacgttcctcgccgagaacccgattccgggcgtggatgaagcgtggctgcgcgaggccatcgagcgccgcggaggccgcgtgctcgacagcgacctgcccgtccccagctccctgtctcccgcgctggcacactcgctccggaatcagtggcagcactggttcgccggtgatgtgctggcccggcagcccggcaaccccgcgctggaggaccacctgtcgcgctaccgttggtgcgccacgccgctggccgagctgagcgacgcgcgcgtcgacgccgtggtgaaggcgctcttcgagcctgtcgtgcgcgactaccaggaagcgacgaaggtgcgcgcgcctgatgagctgaaggccgtggcggtgacacaccggccgcacctcgatggcgtggtgcaggcgctggtctcgcgcgacatcgtgaagcccgcgggtgacaacttcgagtgggggccgaacgcggcggagctctcgcagttccatgaggcatgcgcctggcgcggggtgcagccgtga

SEQ ID NO: 6364 - DNA, 741 bp, Myxococcus xanthus
atggtgcgcttcaacatcgacagctcgctggccatggtgcgcgccgcgaaggcgctcgacgcccggctggtgctggtgtcgacgtcaggcacggtgggctgcttctcccatccgaccatcgaggcggacgagcactccctctacgccgaggcgctcgtgggccggtggccctactacctgtcgaagattctcgccgagcaacagtcacggaagctggcgaagcaactcggcgtggagatgacggtggtgcggcctccggtgctcctcggccccggggacaccttgggccgttcgacgaccaacgtggcccgcgtgctgaacgggcgcctccccttcatccccacggggggcatcgccttcaccgacgtgcgggacgtggcgcatgcgctcgccgtgctggcgaagaagtccgactggcgggacacgtaccacctgtccggcaccaccctgcctctgcgcaccttcttcgagcgcgtgggcgaggtcgccggcatccgggtgaaccgtcccggcgtgccgacgctcgtcgtcgacgggctcgcgaagctcggcgcccacgtgccgctcaagaagctgccggaccccgtggtgctcgagatgtcgacgtgccactgggggttcaagactctgtggagccacgaggagctcgactaccggccgcggagccaccggcagaccctgagcgacacggtggcgtggctgcgcgaggcgcaggcgcggcagacgcccctggcgggctga

SEQ ID NO: 6365 - DNA, 408 bp, Myxococcus xanthus
ggagacatcttcgtcgtccacacccctcggcttgacgcctacacggcggtccaggtgaccgccctgaaggtcgaggggaaacacgagctggcctgtgtgctggcgttggattgggtaggcccctccctgcccgacgccgccgcggtggcggccatggctcccgcccacttcaacttcttcttctggaaggaccactgcgtccacgtctgggcgtccgccgaggttcctcgcggcttcacccgggtgggccaccggccgcccctcgtcgtcgaggacgtcaacagctacagcggttggccatccggcagcgccctctacagtcagcgccgctgggaggccatcccccaggcgcagcgcgacgccttcaagcagatggtcgcagcacccgaccagcaagtgctgttcacg

SEQ ID NO: 6366 - DNA, 1678 bp, Myxococcus xanthus
gtgttgaccgcgcacgcgcgcgacgccgctggcaacttcaccacctgggcgccgatcctcgtcaccgtcgccaacgctgttgtcgacaccacgcctcccgaggtgcaggtgaccgcgcccgttgcgggagaggcggtcagtggtcccttcacggtgcggatgagcgcgagcgacaacgtgggcgtcacccgggtccacgtcgagctcgacggcgttcaggtcggctcgccggacatggccgcaccctggtcggtgacgctcgacaccgaggcgctccagccctatgggctcaggcagttgaccgcggtggctcgtgatgccgctggcaatgtcaccgtctccgcgccggtctccgtcaacgtgagcgcgccacctcccgacgtcacgccgccccaggtccaaatcgtcgcgcccgagagcggcgtgacggtgggcggtaccctccaagtcagggtcgacgcccatgacaatgtgaggattgcgggcgtgcagttgcaggtgaacggacaggacttcgggcgcgaagacctcagctatccctattggatcaacgtctccaccaccctgctgggggacggcaccttcccgatgacggcggtggcgcgggaccgcgccggcaaccggaccacctcggcgccagtcatgttgaccatcgccaacgggccgcccgtggtgctcgatatcccggtggcgcatcctcgggtgtggttcacggcggaccggctggcccgggcccaggcgtacttcgcgcagaacccgtacacgcccgtcgcgaacgtacaagcgcccgagcaggccatcgatgcggcaatgcactcgctgctcaccggcaccccggcgtcgtgccgcgccgcgattgactgggcggtgcgcaccgagattcccatctccgagaacacggtgtcgagcgatccggcccgctggtacggcgaggcggccatcctcacctacgactggtgtttcgcccacctgcttccggcggagcgcacgctcctgatcaaccggtggaacgtcgccatcgagtcgctcaacgacaatccgtggggcggcatcggcatggagggcaacaactactacacggggtacttccgcaactcgctcctgtgggccattgccagctggcatgaaaaccagccgttcgccaacgagctcctgcagtacgcgatgaaatcacgctgggccttctcgctgcggccctatctggatgggccggcggcgggtggcgcaccgcacgagggctcaacctacggccgccggacgttcggctacatgacggtgccgttcaccacgctgggcctgtatggccacgacatgtggaaccagaccgactacttcatggcgtcggtcttctggtccatctactcgaccacgccggggcccagccggaggggccaattccagctgttcgagaccttcccattcaatgacgacgagcgctggctgaaccggtggaatcccagcaacaccgcgcagacgttgctgggcagctacttcgccccgctcatcggggagtggtcggaccagcccatcgcgggttatgccaagcgcttcctggagctcaccggccatccgattgacgaccggctcatccggtacgtctacagcgacacgctggcggcggtgccgtctcgtgacctcgcggagctgccgctcgactaccacgcacctggactgggca

SEQ ID NO: 6367 - DNA, 1523 bp, Myxococcus xanthus
gtgctggcccctgactcccttgtcctcgacggtcgcttccgggttctccgtccgctgggctcgggcggaatgggtgaggtctaccttggcgaacaggtctccctgggccgcaaggtggccatcaaggtcctgcaccatgacctccacgcccaggccggcatggcggagcgcttcaagcgcgaggcgcgcctcctctccgccgtggagcacccggccgtggtgcgcatcgtcgacttcggcgaatccggcgaccacgcctgcctggtcatggagttcgtcgaaggtgagagcctgtacgacgtgctcacgccgggccccatgcccccgggccgcgcgctgcccctgctccagcagttggcggagggcctggccgccatccacgacaagggcatcatccaccgcgacctgaagccggagaacgtcttcatctccaagagcgcccggggcgagcaggcccggctcctggacttcggcatcgcccggttggtcgagccagacgccgccagcagcgtcagccagattggcgtggtgctgggcacgccggagtacctgtcgccggagcaggccgtgggcgcgaaggtggacacgcgcagcgacctgtactcgttcggcgtgctgacctaccgcgtgctgtccgggcggctccccttcgacgggcccctgccgcgaaacttcctgtcgcagcacgcctccgccgcgccgctgcccctggaccgcgcggcccccacgctgtcgcgctatgtgggcctgctgtcgctggtgatgcgcctgctggagaaggacgcgagcaagcgtccccagagcgcgcacgaactggccgacgcgctggccgcggcgcactccgccctctccgccttcacgcccggcctgggcacccctgcctacgtcccgcagcccgggagtggcgccacgccctcctcgggcacgtcggtgttcggcaccgggagtgcctcggggagcagttcgggccccacgggcacggcggccttcgcgggagtcgctccggcgccgcaggcgagcagtggtaccgccgcgttcggcgtggcctccagcagcggctcggcctcgggcgccctgccggcggcctccccgcacacggggacggcgtccttcggactgaagtcctccggcggcgtggccgcagtgacgggcggcaacgcgtcggtggtgaagccgcagaacctcacggtgatgctcaccgacatccagggcttcaccgagcgcaccagccggcagacgcacgaagagaacgcgcggatgctggagacgcacgacaagctgctgatgcccctggtgaaggagcacgacgggcgactggtccagaagcgtggggacgcgttgctggtggtgttccgctcccccaccgcgggcgtgctgtgtggcatggccatgcaggaccggctgtggcgccacaaccagacggtgccggaagtggaccgcctcaacgtgcgcgtctgcctgcacgcgggcgaggtgctcgccacgccggactccgtgctgggcgagcccatggaggtcatcga

SEQ ID NO: 6368 - DNA, 357 bp, Myxococcus xanthus
atgggcgcgctggcgctggtgccggatgtcgaggtccgcggggccacgggattctccacgcgcgtgctgcccgcgctgtgccaactggcggcggtcagccgcggctacaagatgccgacgctggacaccgcgcgcctgtcggctgcggaggtctccagcacgggcctgcgcctgcgcttctccgcgggaggactgccgccgccgtcgcccccggacgaggagctgctgctcgcactggaaggcgcgcgcgccttcgcggacgccgaaggcctcatcgcgcagggccggctggccgacgcgcgtcaggcgtatctccaggccggtgacgcgcaggacgcgcacccggtcgccgccgag

SEQ ID NO: 6369 - DNA, 1023 bp, Myxococcus xanthus
atggctgatacgttcgttgcgaagaactggcgtgacctgatcaagccccgtcgcatggaggtggatcaggacagcgccacccccacttacggtaagttcgtcgcggagccgctcgagcgcggtttcggtacgacgctgggcaactcgctccgccgggtgctgctgtcgtcgctgcagggcgccgccatcaccaccgtcaagattgaaggcgtggaccatgagttcacgaccatccccgaggtgtccgaggacgtcacggacgtcgtgctgaacctgaaggaagtcctccttcggatgcacacgaacgagacgaagacgctccgcatcgaggcggagggccccaaggaggtcaaggccggtgacatcatcaccgacccggacaccgagatcctcaacccgggccaccacatctgcaccatctccgagggcggcaagctccgcatggagctgacctgccgccgcggccgtggttacacgccggccaacgtgaacaaggtcgccggttcgcccatcggcaccatccccatcgactcgctgttctcgcccatccgcaaggtgaactaccaggtcaccaacgcgcgcgtcggtcaggtcacggacttcgacaagctgtcgctcgaggtctggacggacggctccgtgtctccacaggacgcggtggcgtacgcggcgaagatcatcaaggagcagctcaccgtcttcgtgaacttcgacgagacggaggagcccgtcgtcgccgaggcgccgaaggaagaggcgaagctgaacgagaacctgttccgctcggtggatgagctcgagctgtcggtccgctcggcgaactgcctgcagcaggcgaacatcaagtccattggcgacctcgtgcagcgcaccgaggccgagatgctcaagacgaagaacttcggccgcaagtctctgaaggagatcaaggagatcctcgcggagatgggcttgtcgctgggcatgaagctggagaactggccgccgaagcaggcgccggctcccgcgcagccgaaggcgtag

SEQ ID NO: 6370 - DNA, 117 bp, Myxococcus xanthus
atggtgacggtgcagccgttgggcgtggaaacggccggcgggacgtgggcaccggtgctgctggcgcgtgtggcgcgctggtaccgcgacagccgcggcgtgcgccggcagaaccag

SEQ ID NO: 6371 - DNA, 132 bp, Myxococcus xanthus
atgagccaggactccgcgcagggcgccgtcgactccgtggacggcgtgagtcgcatgttccggccggacaccaagtgctgcacgtactcaccgagcctgcccaactacctggtgggcgcgctgctgtccgat

SEQ ID NO: 6372 - DNA, 804 bp, Myxococcus xanthus
atgggccgcctggggggcgccctcgggctggcgctccaggcgaagcgctggcccgtgcgcatccactcccgcacggatgaaggccgcgagcgcgcggaagcgctcggcttgaagacggccgctcccgcggacctgaagcgggcccgcgtcatcctcctatgtgttccggacgcggcggtacccgccgtcgcacaggcgctgtccaccaccctcccccgcacggccgcgctggtgcacacggcgggcgcgctctcgctcgatgcgctgggcacggccaagggccggagtcgcggctcgttccatccgctctgcgctgtctcctcgccacgtgactcgctggtgggcagcaccgtggcggtgagcaccccgtcacgcacgctgcgggaggtactgcgacacatggcggcggacgcggggctccgcgtcatcgaggtgccagaagcccaccgcgcagcctaccacgcgggcgcggtgctgagcgctggaggcctggtgtcgctggcggatgctgcggtggcggccctgggcgcagcgggaatcccgccaacggacgcactggcggccctgttgccgctgatgcattcggcactgaggggcttggagacccggggtctcgcggggggcctcaccgggcccatcgtccgcggagactccggcgtggtggcggcgcacctggaggcgctccccgcggacgtcgcgcccctctatcggctgctgtcgcggcgcgcgctggggctggccggagaccggctggagcccacgtcgcgcgccgcgctggaacggctgctcaagccgtcaggatga

SEQ ID NO: 6373 - DNA, 118 bp, Myxococcus xanthus
atgcgcaagctcaccacggagtccctggagctctactaccccgcccagctccggggcgcggccctgcgcatggcgtgcggctggagggctgcgtggcccgcctccaggagctgtagag

SEQ ID NO: 6374 - DNA, 1269 bp, Myxococcus xanthus
atgcaggtcgccgctgccctggagcaggccaccggcaagccagtcgatctgctcaaggctccctgggtggagattgaacccgccatcgcgcagctgacgggcggccagttccaggtgaacaagccggagcaccagacgctcgcgctgggcctggcgggggcgttcgccctgcggctcatccaggagcaccaggccttctggttccccaaccgggactcgccggagggcgccacgctgggcttcccggaggccatcatcatgctgtcgccgttcggcgcggtgatggattcgctggggcagggcaagctggcccgcctggaagacctggctgcggacatccgccgttcgctggggcaggcccgctttggcggcagcccggcgcaggccctgggaggccaggcgcccaagctgacgccggtggactaccagcgcctcttcgaccccgggttcctccagttcgtcgtcctggacccgaagaaggccgccacggccctggagacgaagccggacgggctcgctcgggacgtgcgcaacgcgctgggccgcacccagccgccgctgccgcccgaggcgcgccagcagttcgaggggcagatcgtgcagtccctccagcgcctggacaccaccaagtcgctcatcgaccaggccgagcgcgcgccgcgtctggcggagttgatggcgcacctgttcggcaccatcggtgggacaggctcggcgcccgaggacttctggcacgacctggtgctgccgctgctgttcatcggcaccccggccagcttcccgccgctggacgaggaggagctggagatgttccgccagggcgcggacccgctgccgctcttcgtggacctggtgccgcacgcgcacaaggcccccgacgagggcctgctgggcgcgttcgagatgagtgacatcggactggtgcacccgggcttcggccgggtgggcgcgcttcgcctcatccgcatcaacgcctcgcgcatccagccgctgctggagcagttcgaccccgcgaagacggcggagacgctccagcgcttctcggagtacgtggcgaaggcggccggcaagcccgccaccgagtcgccgcagggcaaggagatgctgcaggccgcgctgacgctgctctccgacctgaagcgctccgtgacgcaggttcagggcggcgagctgtccctgcgccggctcaccgaggccgaggccgcgtccgaacaggccctggccgtggtgcgcaaggccctgcagggttccatcatcctgacggcttga

SEQ ID NO: 6375 - DNA, 1901 bp, Myxococcus xanthus
atgaacacgaagcgcgacggcgccccgtcgcaggataccccctcctccttcgcgctcccggtcgtcacggaccggcctgccgccaggtccgacgttgtcggcgaggcgctcgagcacgcggccgccaacgcctccccctccgagcccggctatggccagacgtactggcgcagcctggaggagaagctcggcacgcccgactacctggaagcgacgcggccggagttccccgtcggcgcggacctggctcccacgggcttcgcccgccgcgagttcatgcacctgctgggcgcctcgctggccctggccggcgccacggcgtgcagcacccgtccggtggatgagcgcatcctgccgtacaccaagacgccccccgagctcgtcccgggcaacccgctccactacgcgtccggcatgacgctggccggtcacacctccggtctgctcatcaccgcccgcgagggtcgccccgtgaagatcgagggcaacccggaccacccggtcaaccagggcgccgctggcccctgggagcaggcgttcctcctgtccctgtacgacccgagccgcgcccgcgtgctccgtcagggcaagagcccccgcgccctccgcgtcctgcgcgaggagctggtcaacgccgccagcaaggccgccgccaatgacggtggcagccgcgtgcgtttcctgtccgagcccggcaactcgccgctgaccggcgacctgcgcagccgcatcctgaagaagctgccgaacgcgcgcttccacagctacaccgcgcagacgcacgacacgcaggacgaggcgacccgcgcgctcttcggcggacagcccgtttcggccgtctacgacttcgcccaggcggacatcgtcctgtcgctggacgcggacttcctggagagccgcccggagaacctgggctacgcgcgccagttcgccaaccgccgcgacccgaacaacggtccgctcaaccggctctacgtggccgaggcccgcttctccatcaccggcggcatggccgaccaccgcctgcgcgtgaagtcgcaggacgtgctcgcggtcgccgccgccgttgcccaggccgtgggtggccccgccgcctcgatggctggcgccgccgccaacaaggcgtcgctgaagtcggaccacaacgcgtgggtgcaggccgtcgtcgcggacctgcgcgccgcgcagccgggccgcaccctggtggtcgcgggtgagcgtcagccggcggcggtccacgcgctggcccacgccatcaacgccgcgctgggcaacaccggcaccacggtgaagtacgtgcagtcgtccatcgcggagcaggagggcctgagccaggtccgcgcgctggtggaggacatcacggcgggccgcgtggacacgctggtcatcaccagctggaacccggtgttctcggttccggcggacacgggtctgaaggagctgctggacccggcgaccaaccccaaccgcggcaacctcaccgttctctacacgggcctctacgaggacgagaccagccagtacgccgactggttcgtccccgcgacgcacccgctggagacgtggagcgacggccgttcgttcgacggcaccgtggccattgcccagccgctcatccagccgctctacaatggcgtgccggagtccgagctgctggcgatgttcctcgacgagccctaccgccccgcgtaccagatgctgcgcgactactggcaggctcagtccgagggccaggctaacttcgaggcccactgggagagctgggtgtcggacggtgccatccccggcacgcaggccgctccggcgcagggcgctccggacttcggcgccgcctcctcgttggtgacgggctacacggcccccgccacgggcgagctcgagatcaacttcgtctacgacta

SEQ ID NO: 6376 - DNA, 2133 bp, Myxococcus xanthus
atgcaggctgatcagcgggggcgcgtgctggtggcggccgacaaggaagcgggcgatgcgctcatggagcggctcacgtcgagcggctaccagtgtgcgtcggcggagaaggagagcggtctggcccaggtcgcggacacgttgcagccagaggtcgtcctgctggcggtgacggcgaagcgggccgcggagatgctggagtcgctgcgcaaggtggaccggctccagcgcctgccggtgctggtggacctgggccgcgcgcgctcggcggaagctttcaagcggctggcggtggacgattggatccgcagcgccgacgaggtggtgccccgtctggaggccgccttgcgcgcaggccggctgcgtgaccgggaagagcggatccgcctgcggatggggatgctgctggaaatcacccaggcggccaccagttcgctcgagctggaggagatactccgcatcgccgtggacaaggtcggccgtgtcaccgggacggaccgttgctccgtggtgctggtggagggcagccatgcccgcaccgcgaaggtggtggccacgcaggaggacccgagcctcgtccagttggacatcgaggtgatgcgctacccggagctgcgccgcgcgctggagacgcgggaatcggtggtcatcgaggaggcgcagcgcgacccgctgatggcggaggtccgcaccaacatcctgccgctgggcgtgaagtccatcctggtgcagcccctcatctgtcagggcgacctgctgggggcgctgttcctacgggtctcgcgcgctgacgcgtcgttcggccgggacgagcaggagttcgcccaggcagtggccggcgtgctggccaactccatccgcaacgcgcgcctgcacaccgcggtgaagaagaagcgcgaggacctggaggaggcctacgtccagcgctaccaggaactgaacgaggccaaccgccggctgaaggagctcaaccggctcaaggacgaaatcatcgcggtgtgcagccacgacctgcgcgcgccgcttcaggtgctcctggggcacggccggctgttgcaggaggggccgctggagccgcagcagcggcagtcctccgaggcgatgattcgccagggaaagaagattctcggcctggtggagtcgctgctggagaagggcaagggcgaggcggcgcggctgtccatcgagcctcgcgtcctggacgtggcgcagctatgccgcgacgccgtcaacgaactggagattctcgccgcggaccggggcgtgtccctgcgcgccgactgcccggacagcctgatgctcatcggtgacgaggtgaagctgcacgaggtgctgcagaacctcatcaccaacgccatccaccacgcgcgccaggacggtgaggtggtggtgagcacccagcgcttgggccgcccggatggggacgcggccaaggtgtgcgtgcaggacgacggcgtgggtatcccgccggacgagctgcacctcgtcttcgaccgctaccgccacggtggcaagggtgggaccggcctggggctggccatctgcaaggagttcgtggagctgcacggcggtgaaatctgggcggagagcccgccggacaccggttgcatcttcgtcttcacgctgccgctggcgcaggaagcgccgcgcaacccgcgcccgccgcccgccgccgcgtccacgccgcaggagcagccgcgcgtgctggtggtgcaggacgagccggacatcgccgcggtgctgtcgcaggtgctgcgctccaagtaccgcgtgcaggtggcgccagacggcgcggagggcctggctcgggcgaatgcccagcggccggacctggtggtcatgtacgtgttcctgcccaacctgactggtctggatctggccatggcgctcaagtcctcgtcggacaccgcgcgcatccccgtcatcctgctgtccgcccaccagggtgtgacggagaaggtccgctcgctcaacgtgggcgcggtgcactacatgagcaagccgttcaacgctagtgcagctgctcagcctcaacgagtgcgccctcaagctgccccacggtcagcgggagcatcaggagaaggagaagagcagcgcctcgcagcggcgctacggcagcgaccccgcctcggg

SEQ ID NO: 6377 - DNA, 501 bp, Myxococcus xanthus
cgcgcgcgggcggcaagctcgctgagcgtggataaagtgtgtcctcaccgcttccgcctgccggtggcccccggggtggccgccagccgcctgggacgcgagcccgactgggacgtcacgctggccgcgtggcgtcggctgtgcgggggcaacgccgtggtggagggggcagggggcctgttcgtgccgctggactcgaagcacgacgtcatcgacctcattgccaccttgcgcctgccggtgctgctggtggcgcgcgcgggcctgggcacgctcaaccacgccgcgctgtcgctccaggcgctggccgcgcgccgcattcccgtgcgggccgtgctgctgtcgcgcgggacgtccgcgaaggatgtttcggagcgcgacaaccggcggctcctggagtcgcggcacggcgtcccggtgctgggaccggtgccctatcttcccgacgcgcggcgccgccatgccgcgtttcgccgcgcgctgcggccgttgctgccctga

SEQ ID NO: 6378 - DNA, 279 bp, Myxococcus xanthus
atggcggacatcatcgacctcacgttcctcgcggacgtccggcggttctacaagaagctcatcgaccagagggggctttcctacttcctgcaaaaggaagggcctcggctctttcacatcgagccctccaaggtggaactcgtgctccggaccgctctgcgcacgcgcgaccctcaacttccccggcctcacgacaaggccatcgagcactgccgcaaggaggttcgccgcgacctgattcgtcgtgtcgcgaacgccatgctgcaaacgggcctgtga

SEQ ID NO: 6379 - DNA, 907 bp, Myxococcus xanthus
aggctccgcgccagcgggcgtcccctcctggacctgacggaatccaaccccacgcgtgtggggttgcccctgccggacgcggcgctcctggcccccgaggacgccttctcctacgaacccgagtccctggggctcgcctccgcgcgacaggcgctggtggcggacttcgcggcgcggggcgcccaggtttccgaagcgcacctgctgctgacctccagcaccagcgaagcctacggctggctcttcaagctcctgtgcgagccaggggacaacgttctcgtcccggccccctgctaccccctcttcgagcacctcgcgcgcctggagggcgtccagacgcgttcctatgccttgccgcgcgcgcatggcttcggcctggacgcgggggaggtggcttcggcgtgcgacgcgcgcacccgcgcggtgctggtggtgaaccccggcaaccccaccggccacttcctgcacgacggtgaactggcggcgctggcggacgtgtgcgcgcaccgccagctggcgctcgtctgcgacgaagtcttctcgcccttcgcatcggcgccggcgcccgggcgcgtggccaccgtggcggggcgcgcgctgccgatgctcaccttcgccctctccggcctctccaagtccgcggggctgcccggactcaagctggcgtggacgcacgtgggcgggcccgcggcgctccgtgacgaggcgctggcccggttggactgggtgggggacacgtacctgcccgtgggcacgctcgtgcagcgggtcctgcccgcgctcctggcccatgcgccgcgcttccaggcggcggtgctggagcgggtgaggggcaaccgccagcgcctgctcgcggcccggcctcgcgacgccaactgggacgtggtgccggcggagggcgggtgga

SEQ ID NO: 6380 - DNA, 420 bp, Myxococcus xanthus
atgcgccataaggtcggacagaggaagcttcaccgcagcacgagccaccggctcgcgatgctcaacaacatggtgacctcgctgctggagcaccaggccatccgcaccacgcttcccaaggccaaggaggcccggaagatcgcggagcggatcatcaccctgggcaagcgtggcggcctcgccaacgttcgcctggcggctcgtacggtcaaggaccgcgacgtgctgcagaaggtgttcggcgagtacaaggaccggtacgccagccgtcccggtggctacacccgcatcgttcggctcggcttccgccggggcgacgccgcggagatggccctcctggagctcgtggaccggccggagaaggccgctcccgtcgacaccgaggcggctgcgcctgcggaagagacgaaggcggagtag

SEQ ID NO: 6381 - DNA, 411 bp, Myxococcus xanthus
agccgccgcacacgggggcagcgccagtacctcatctccagcatggggctggaccaggtctcctacttcgtgtcgcagcgcttcgttgacgagaagatggcgggtgcgttgaaggaggtcgtcacgcagcgcgagcaggtggatgcgctggcgaaggacgagcagcgcctgcaggaggagcgcaaccagctcttccgggaccaggagcgcatccgctccaacatcgagtcgctgaagagcggggcatcgcaacgcgagctggcggaccgcttcgtgtccaagctcaacgagcaggaggaccgcctggaggccattgccagcgagttggagaagctggcgaaacagcggcaggaggcgcagaaggcgctcaaccgccgcatccaggcgctcagctacacggcggacctgtaa

SEQ ID NO: 6382 - DNA, 249 bp, Myxococcus xanthus
atggtgctggggatggcgcggcgcatgtggcgctcctactgcgaccagggggagctgctgcaccaggaggagaacggcacgggcatgctgctgctgcgccagttcacctaccagacgccggtggccctccatgagatggcggggggcttcagggcgtacctggaatgctccagcgccaagaatccgcgcgtggaaatcgtcgcgccggacaaggatgggacgctgcgctggcgcatcgtctccgggtag

SEQ ID NO: 6383 - DNA, 1305 bp, Myxococcus xanthus
tcctccgcgttccagggtgagtggctgctgggccgcggctgggaccagaacgactggccggagaaggccttcccgtcgcgcgccgacctggacaagcgctttcccttgcggccggtggcgctgagccgcgtggacggacacgcgctgtgggtcaacggcgaggcgctgcggcgcgccggcatcacccgcgacacgaaggacccggcgggcgggcgcatcctccggggtgagggcggagagcccaccggcatcctggtggacaacgccatggagctggtggagtccgtgctgccgcccgccacggacgcgcagcacgcggcgcagttgaccgcggcgctccagcgcggcgcgcaagtgggcctcaccggtgtccacgacgcgggcatggacctgcgcaccttccgcctgctccagcgctgggacaagggaggcaagctgccgctgcgcgtctacgccatggcggatggacagacgggcgaccgggagacgtacctgaaggacggcccctatgaggggcgcatgctcacgatgcgcgcggtgaagctcaccctggatggcgcgctgggcagccggggcgcggcgctgcaccaggactacagcgacgaacccggccaccgcggtctgctgctgctgtcccccgaggagtacgaagcgcgcgtgcgcgccttcatggcgcggggcttccaggtgtgcacgcatgcgattggagaccgggccaacacggtggtgctggacgtgctcgcgcgcgcggccgaggccaccggcacgctccagtccggccggcaccgcgtggagcacgcgcaaatcatgcgccccgaggacatcgaacggctgggccgcagcggcttcatcgcaagcgtacagcccacgcacgccaccagcgacatgccgtgggcggaggcccgcgtgggagcggagcgcatccgcggggcctacgcgtggcagcggctgaaggcgtccggcgcggtgctggcgttgggcagcgattttcccgtggagcgccccaacgtgctggcgggcctgtacgcggcgcgcacgcgtcaggacgtccggggcctgccggaaggcggctggtacggggagcagcggctgagcgggcaggaggcgctggagggcttcaccgtgggcgcggcgcacgcatccttcgccgaagcccggcgcggccggctccagcccggcatggacgcggacttcgtggccctgtcggtggacccggtggacgggcccgtcaccgcgctgcccggcgccgaggtgcggctgacagtggtggccggcgtggaggtctaccgcgccttccagcgctga

SEQ ID NO: 6384 - DNA, 1227 bp, Myxococcus xanthus
ccgctcgttttctatgcacccgggcagtcctggccggcgccggggccgcacgctcccaccgtgaacagtcccagccattccatttcgcaggacgcgggcgagcgcgagcgctcgcatgaggcgatgggcgctgtgcgcaacgggctccaactcggtggctcgctgctggccacgtacgccatcgccatgggcgtgcgcttcctgctgccggcccacctgggaccggagagcttcgggcgcttcaactacgccgacagcttctccgccgtcttcttcatcgccacccacctgggcctggagatgtacatccgcaaggaggtgtcgcgccggcccgagcacgccagcgacttcttcggcagcacgctgctgctgcggctgggcctcaccgcggtgctgatgggcgccatggcgctggtgatggcccacttcgacgagccgcccgaggtgcgccagctcgtctacgtcttcgccctggcccagtcgctcatcatcatcaacgcctccgtggccgcgctgctgcacgccaagggcaaggtggcggggctgtccgtctccaacatcgtcaccaagctggtgtggggcgggggcctgctggccgtcgcagtggcgggcctgccgctgccgtggctggcggtgccgctggtggcgtccgaggcggtgaagctgggcgtgggctggtacctggcccgcgagcacatgggcctcaccttcaaggtggacgtgccggccacgctgaaggtgctcaaggccagcctgcccttcttcatcaccggcgcggcgctggcggccaacgggcgcctggacgtgatgattctgggcatggtctccagccacgaagaagtgggctggtacggcgccgcatggaacatcgcgggcctcaccttcttcctcaacccggtgttcggctgggtgctgatgccgctggcgtcccgcgcggccgagcgctccgaggcggagctgacgaacctgacgcgccgctcgctggagggcacgctggccgtcaccgtgcccatgatgatgctcatcgtcctgggcgccccgctgtgggtggggctgatgggcggcgcgttcttccaatgggccatcccggtccggctgatatctgtgctgttcgagctggacattgctcaccatagcgctcggccagcgtcatgccatcatgcatggacagtggtgggtgacagtaatcagggtcaatgtcagcgtggtcctgatcggtgttctcag

SEQ ID NO: 6385 - DNA, 237 bp, Myxococcus xanthus
atgcggggactcgtttccacgctggagagcatctcgggcagggaggaggcgaaagtggcgcggccgctgcttggcagcgcggcgggactgcttcgccgcacgtccgaccggctggagaacgaaaccaccgaagagctgctcgcggatgcccagacacaggtccgcgagcggcccggactcttcatcgcggggtgcgtggccgcgggcttcgtcctcggccggctcatcaagtcttga

SEQ ID NO: 6386 - DNA, 1002 bp, Myxococcus xanthus
atgtgcgccgccgtggccgtccctcctgaactccgcaccgccgtcagtcatcccccgccgccgggccccgccgtcgccttcaccatccggctgggcgaggcgctgcaccgctacggcacgcccgcgcatcgcctggagctgctgatgcagcgggtgtcggagcgcttcggactggaggggcgcttcttctccacccccacgtccatcttctcgtccttcgggccgccggaggcgctgcgcacctcgctcatccgcgtggaaccgggggacatggacctggagcggctgacgctgctggacacgttggcggacgacgtcatccacggtcaggtgcccccgacggaaggggcccagcgcgtggacgccatcctcgcgcagcccgagcgcttcggccccgcgctccagctcctgtgctggacgctcgcgggcggcgccgcggggcggttgttcggcggaggcctcaaggagatggcggtggccgcgttcagcagcctgctaatcggcaccctgaacgtgctcacccggaagcagccctccacggcccgggtgttggagccggtggccgccatcctgtcctccgccgtcgccgcgctggccgcgagcctgatggggccgctgtccgcgcaggtggccacgctggcgggcctcatcgtcctgctccccggcctgtccctgacggtggccatcaacgagctggccacccgcaacctcatctccggcacctcacggctcacggcggcggcgctcgtcttcctccagttgggcttcggcgtggccctgggcagccggctgtcggtggtgctgcccgagccgcccgtggcgccgttgccgcccgcgctgccggactggactcagttgcccatgctgctggtggccatcttcgcggtgtgcgtgctcttccgcgcgcgccccagggattggggctggattgccggagcctgcaccttcgcctttgggggggcccgtctgggctcgctgctgctgggggctcagttgggcgcc

SEQ ID NO: 6387 - DNA, 246 bp, Myxococcus xanthus
atgcctcgcgcccaggcggaagcggccatccgtgagggacgggtgacgctcgatgggcgggtggagcacgagcccttcgcgccggtgcgtccggagatggaagtgcgggtggacgggctggtgcggaacctggaggcgcccgtgttgacgttgatgttccacaagccagcggggctggtggtgcacggctcggacgcggagggcgtgggcaccgtgttcgagtgtctgcgtgagcggctcacttag

SEQ ID NO: 6388 - DNA, 2199 bp, Myxococcus xanthus
atgaacgacttccgcgacgcgcacctgctgcactcgtacgaggacgcggggacgcgcacggtgacgcattacgggcagctgccgctgtggaacccgtgggcctgcggcgggcagtacacgctgggcagtccgcagacgcgcgtggcgtctcccacgctgctcgtgtccgcgctcatgggcgctcggccagcggagccgctgctgttgtgggccttcctcgtgctcggcatggagggcttcttccactacgcgcggcggcgcgtgggctccgcgctgggcgcgctcgccgcggcgccgctgttcggcctggccggcttcacggcgctctcgtggtccattggctggctcaacttcgcgggcttcctgctgctgccctggctgctgtggggcacgcgccgcgcggcggagggccatctccggggcgccgcggtggtggccggcaccttcgcggtgctgctgggctttggcggcacgtacccggtgcccatgggcgcgctcttcgtcgcgctggaggccggacgcacactgtacgggctgcgcgggacgccgcggcgcaagtccgcgctgtgggccctgggcgccaccgccgtgttcaccctgggcgcctgcgcgttccggctgtggccgctggtggagaccatgcgctcggcgccacgcatcatggcgggcacgccgggcaactccgcggaggcgctggcgcgcatgctgctccagatgccggcgagctccggctacagcgacccgggcaacttcttcctcgcgcccgcggtgctcgcgctgattccgctggccgcgtgggcctggcgccgcgcgctgtacccggcggtgctggcggcgctgtgcgtgtggatggcggcgggctactccgcggtgccctcgctgttcggcgcgctgcggctgctgcccgtcttcggaacgctgcgctatccggagcgcttcctcgtgcccgcggggctcttcctggcggagctggtggcgctggggctcgccgtgctgctggtgcgcgtgtggcgcgtgccggccgcgcgcacggcgacgtcctggtggcccaccgccgcggtggtggcctgcgtcgtcatcaccgtgggctggggcttccaggtgcgcgccttcgaccggctcagccgctggtcgcagatggtgcccgcgcccggccccgtgcccgaggaggcagagcgccccttcgctcaggcccgcggcaaccgctgggcacagggttacttcctggcgctcaaccggggctccatcgcctgtggcgaggcgtggccggtgcccatgtcggagcgcctgcggggcgacctgccccaggaggagtacctggaggacgcctccgcgggcaccgcgcgccgcgtggagtggacccccaaccgcgtcacggtggacgtgacggccacgcgccccacggtgctgctggtgaaccagaactggcacccgggctggaagtcctcggagggcgaggtggtgtcccaggacgggctcctcggcgtgcgcgtggcggaagggacgcaccacgtggtgctgcgcttcctgccgcgctccggactgggcggagcgctggtctccgcgctcgcatggctgggcctgggcttcgtggcctggcggctgcgcgggcggctggggcccgcggccatcggcgtggcgtgtgtgccgctggtgacctggggcgtgctgctggcgacgtcacctgagccgctggcgcgcgcggtgcccctcaacgcggatggctcgccgatgcgcgtggcggcgctgccgcccaccgcgaagcccgtggatgcgcgcttcgacgtgccggtggagctggtgggcgcggagataccgtcggcgccggacgcggaggggctgctccacctggtgctctactggcgcgtcaccgggccggtgccccgctccgcgggcatcttcgtccacttccctggcccgccgggcagcaagcggaagaacgcggaccacccggtgttgggcggcacctacttcttcgccgaggccccccgggacacgctcctgcgggacgccttctcggtgtccacgaaggactgggacgcgggcgagcggaaggtcctggtgggcctgtggcacgccgggggtgatggctcacgcatcggcggacggggcgcggacgacaagccgctgacgtcgtcccatgtcgaggtgggcacactcgcggtgccgcccaaggcacagtccgaggaaaagccctga

SEQ ID NO: 6389 - DNA, 426 bp, Myxococcus xanthus
atggccgatgagaagcactgtcccggtcccgtgaaggagggccagcctacgtgcgcggacgccagcacgctggcgctcgccacgggtgaccactggaacggcccggccatctcctccttcttcctgggcacgcccacggccgaggtcatgggccgcatgggctacgccgcctccgccctgggcaaccatgagctggccttcggcaaggaggccttcctcaagaacccgcggcgcgggtggcttcccgttcctcgccgccaacctcaaggtgaaggacccggcgctggcgggcgacctgtccatgccggcgttccagattttcgagcgccgcggcctcaagattggcgtggtgggcctggcgtccgagaagacagtccgcaccgccatgccgggccgcgcggatggcctggaagtgacgggctatga

SEQ ID NO: 6390 - DNA, 353 bp, Myxococcus xanthus
atgccgggccgcgcggatggcctggaagtgacgggctatgaggaggcgctcaccaccgccattccggaggcccgcaaggccggcgcggacgtggtcgtggtgctcgccgacgagtgcgtcaccgacctgcagcccgcggtggcgaagcacccggagtggaaggtggcgctggtggccggtggccggtgcgcgcagcccgtcgagctgaaggacggcgcgaccagcttcgtgtcgctggaccgtggcttcggcaagtacctgcgcgcgcacgtcaccttcgacccggcgaagcccgagggtgagaagctgaccggcctggataccaaggtcgtcgaggtgtcgggcggggcgcc

SEQ ID NO: 6391 - DNA, 600 bp, Myxococcus xanthus
ttcatcgccatcgcgggcaacatcggcgccggaaagacggagctgacgtccttcctctgccggaagtacgggttgacgccctccttcgaacccaacgaccagaacccctatctggcggacttctacaaggacatgaagacgtgggcgttccgctcacagctcttcttcttgacgcacaagttccgcctgcaccgggagctggagcgcacctcggggacggtgcttcaggaccgcaccctctatgaggacgcggagattttcgccaagaacctccaccggcagcggctcatcgacaagcgggactggaagacgtactgcgagctgtacgagacgatttcggagtcgttgcggccccccgacctgatgatctacctccgctgcccagtgcagacgattcgtgagcgcatccgcatccgtggccgggccatggagcgggacatccccacccgctacctgcagcgcctcaatgccctctatgaggagtggttcgagggctaccgcctgtcgccggtgctcgtgcttcccacggacaagctcgactatttgaccaacctggtggaccgcgtggacctcttccggcagatcgagaagcacctgtga

SEQ ID NO: 6392 - DNA, 846 bp, Myxococcus xanthus
atgagcctgccgttccacatcggtggagcgctgctgggcgacccggtcgcacgcagacaatacattcgtgtcgggtttcttcaatccattgcagctctggcattggccctgagttgcatgacttccggaactgaagcggcggaaagcgccagcaagcgggagtcccgagccgaagcgcgcgccaaggcggcgcggattcgagaagtcgccgaggccctcgtcgaccagcacgacaagaaggaggcggcagctgccacccggcgtgcgaaagaggttgaagctcagaccatccaacgcctccaggaaatcgacgcgcaggttgcccggcgcaagcaggccgccgcgcagcgcgctggcgaggggacgccctcaggtcccgaagtgcagcccgagcccacagccgtggtcccctctctgtcgggagcgggcgacgagtcccccgagagcgcctccaccggagaggcagaggacgtcgcgggagccactccggacgcccagaagccctcccccatcccggcggacacgcccgatgcgaggctggagcagcgcatccgggacgttgaggccgcggcccagggggccgatgcgggcacgtccctggcgaaggccatcaccgcgctggtgatggaggccacgaaggacctggattcggaggccccggcgtcctccgccaaggagcgcaccgatgccacggaggatgctccccacaccgccgaggacacccaggcgcctgttcacgaaaagagcacctggacggtgaagggcctctccgtgtggggcctggccttctgggcggcgctgttcgccgcgctgcagttggcgcagtgggtggtcatcttgagaggg

SEQ ID NO: 6393 - DNA, 273 bp, Myxococcus xanthus
ctgccgccgcaccccggcgggcatgaggcggacctggagcggttcagcgaccggccccacctgtccagcgtggcgggccgggggcacgaggaccagcgccggatgctggagcggggcctgggcaaggtgaaggcggcgcccgaccggctggagcgactcaaggcgctgctgcaccgcgagtccgccatgctctccctggtggatcaggtgaacgaggagacgaaggaaatcatccgccgcatgtgggacgcgcagaaggacgagggctactag

SEQ ID NO: 6394 - DNA, 477 bp, Myxococcus xanthus
atggcggccctggacccggatgatccgaaggacgaggcgaagctggacacgcttctgcagcgctgggcggatggcaaggccacgctgcgggacgtgcgtggctactcggacgaagagctctacgccatcgccaagacggcctactacttcttctatcaaggccgggtgagcgaggcgcgcacgctcttccagggcctgtatgccgtcaacccgacggacgcctacttcgccaaggccctgggcgtggtggagatggcggctgggaacgggcagggggcgctggcggccttcgacgtggccgccaagctgacgccgcatgatccgtccgtttatgtggggcgcgcggaagtgaagctggccatgggccagaagccccaggcgctggaggatctgcgccgagcggcggcgatgcagccgggggatgaccccgtggtgcgcaaggcggcggccatgatctccgccctgagccgccgctga

SEQ ID NO: 6395 - DNA, 482 bp, Myxococcus xanthus
atgcctccggaggccccgcccgaactggtcgccaagcgcgagcgtctcgtcaccgagctggagaaccaggcgaagtccgcgacgggtacgctgcagcaggtgatgcggaagatgtccgcgctgctgggcaacaccaagcccggtgcttcgctgagcttccagctctaccaggacgtgaaggacgcctttacccggcacctgaacgaggcgacgaagacgccggccctggccaccatgccgcccgtgctggtggagtccgtggagtggatgcaggcgtacctgaacgcccgcggcttctccaccgacgaagccgctgcctccgcgcccgccgccacggcggctccggccgccgcggccaaggcccccgtcgggccggggggggcgaaggacgcctttgagacgagcagcaataagcacgcgtcgttgacgggggacgtgccgcctccgccggccgcgcccccggacgtcaaggccgagcagaa

SEQ ID NO: 6396 - DNA, 561 bp, Myxococcus xanthus
atggcgggcgtgggcaaggccgcgctcctgggtgcgattggcggcgtgttcggcgcgggcgcgggcgccctcatccagaacgccgtcaagagcgtggcccttcagttcgtggccaacatcgccgccgatgcggtgctggaagtcgccacccagctcatcacgggtgagttctcctggcatgcgctgggcatgtcggtgctcatgtccgtcgtcaccggcggcttcggcgaagtccctcgcatcaagcgcgtccagcaacggtggatggctcgcggcgcgggcgtcgtgcctggctcacgggctcgcgctttccgcgagtccatcgctccccggcccacagcggagagcgatgccgcaaccacggcaagcccccgccccgaggcagagactgacgcccccgacaggctgagtcccgaagccgaggctgacgtctccaggacaccacggcccgagtcggagaccgacggacccagcacgccacgttccgaggaagaaaccgacgtctccacgacgccacgacccgaggaagagtcagcgtcccccttgagggaccgaaacaga

SEQ ID NO: 6397 - DNA, 2460 bp, Myxococcus xanthus
ctaaagacggccgcccctcccggcggcaccgagggcgcacagacctgcgcgggcggcggcccccagaacgcaacctgctacacggaggccattgaagaacccgagggcgagcccgaacaagagcctcccgagccagcgcccacggagtcacaggaagccgcatccagcgtcagtcccgatgccgaggagcgagacaactgccccattgaggaagccatctccgagcaggcgccctcctccacggaagccgcggcgcccgcgcagtccacgctggacagcaacgcttccacccctgaatccgctggagcttccgcggaaggggcccccacgggtgacgccacggccgcaccgtcctcggaggcatctgggggcaacggcggggcaacggcggaagacgccgcgaatgaggccgctcgtacgccgctggacgaagccatcgacacaaccgaagtccagcggtgggatgccgtggcagcacatggcagtgcgtccgcctcgctcgccaatgccggagccggtgccatttcgctccggggcggcgtgcagttcgtcccggcgccaggtgcgacgtcggcggacgacgcgcgacgtgttgacgcgaactcacgcgcggacgcgttcttccttcaggcggccaatcgaatcgaggacgcggttctcctgacgcgggatgatgttccagcccgcatcggcgcgctcgccgagacgtacaagagcgcgatctccgcctccatggaggaacagaaggcggccatcagcgccagcgtggagcaggcgcgcgtcgccgccaccgcccaggccgagggagcccgccagcaagtcctgtccgagcattccaccaccgtctccaccatccactcggagaccgacagtgcgatcgagtcgctccgggccgcctacgactccggcctgatgctcgttgacgagcaggagtccaccacgctggacagcgtcaactccctctacgcccaggcccgcattgcccacgaagcactcggcccgacagtgggcgatgagtgcgtccaactcggcgaggagtacgcggaggaatacgaagactgcaagatcaacaagaaggacaggttcttcgcgggctacctgaccgaccgccgcgccgaggcccagatgaaggccgcgcgcgagacggccaagggctatcgcaagagcctggtggacacggccacgaagcaggccggcgaggcgatgaaggggcgccagttggaccgctgcggcgtcatcgccgcggcccgccgtgcccgcgagacgctcgacacgcagtacgagcaactcgtcgccgcgctcgaaagcagccggacacaagccctgacgcaggcggagaccacgcgcgactcgatgatggcctccgtcgactcggccttcatcgccgagttggcccggctggaccgccacgaacacgaccagcgtcagtccgtgaatgacacgggctacctgcaacaggtcctcatcgagctggcggccttcgcctcggcgacgtccatccagagcgccgtgacgggcgccatcgacaccctggtgcaggcgctcacgggcgtgcgcgacctgttctccacgcagtccgctccagagggcgaacaactggagcgcatcctcgggcaagccatgggcgggctcgaaggcgggctggatggcctcgtctcccaggtggagcatggagccgccggcgccctggagcgcgtggacggcgtggggaaccaagggctggaggccatgctgcggctgggccagtcctccgaggaagcgacagcggccctggttgattccttcacggcatccatgggcgcattggcggcaggagcgaccacaagcttcggccagcagcgcgacgcgttcaccacgcaagcacaacaggtggcttcggacggagccaccggcctggagaccgtggccaccggcttccagacgacctgcacgacgattctcacccatgtcgagagcgcactggtggactccgcggatgcgctggaacagagcctccgcgactccaaggcgcagctcgactgcgacattcccgtccaggcccaagaggcggcgtcgaaggaacagcccgcctggaagggcgtgctggcggtggtgctcatcatcgccatcgtcatcgtggtggcgctggtcgtcggcccggcggtcattcagcgcggtgggtgcgcagccgagcgcgctgggcgccaccgcggcagccgcgaccattggaaccatagtgggtggtgccattgtcggcgcggcgacgtcggccgccatccaggtcctcaacaactgggcgtcgggcgagcgcctcatggcgggcgtgggcaaggccgcgctcctgggtgcgattggcggcgtgttcggcgcgggcgcgggcgccctcatccagaacgccgtcaagagcgtggcccttcagttcgtggccaacatcgccgccgatgcggtgctggaagtcgccacccagctcatcacgggtga

SEQ ID NO: 6398 - DNA, 1920 bp, Myxococcus xanthus
cgctctaaagaggagaagaggccgcgcaagcgccagaagaaaccgacgccgaaggcccagaacccgaaggagaaggagaaggaggccagctccgacaacgaggacgaggacgaggacgaggccagctccgacaacgaggacgaggacgagggggggccggccccactccgggggccttcgcccgacttcgagtactacagcagcgatgacgacgagacgccgctgggcccgattgagaccagtaaccagggcacatacaccgccaggaaggagttcgaggccaccgtggccttcctccgggccgtgcaggacctcttcgagaacctgtcgaatcactaccaggtctgccaggcgacggcggagctgctcaagataccccaggggcccatccaccagttcacggagaaggcgctctttcacaccatcaagaacaagcagaagatcgccggacagaacaggggctacgagttccgcatctccaccccggcgcagtggatggccctggcgaagctcctgcggaatgcgcagtaccgcccctgcgacatcatcgtggagctctggcccaaggccgcgcgcaaccgcatgtgcatccggggtgggaactcgctcatcagcccctatacgggcatggcccgcacctggccttcactcgcgctggagctgcatcagactgccctcatgctggggctcgaggtctgcgcccgggtgctcaagcaggaggtgcgccccaagggcatcgagcgcatcggacatcagttgctggccgccatcatgctccgtgcctacaggggccagggggcggaggtcttcgacttcctcgtcggcaacctcgggctcggcagcaaggatatggagcgcctcgaggagttcatctccgagttcttcgccctgtccttcggcgtggagtccgagcgcctgttcctcacccacctcgaaacgctgctgcacctggagaacatcgccaacggcttcaagttctccctgaacccgaagattcgctgctcccggggcggcacgcctggggtggtgggccagcacctcttcaacttcctgaatgtcttctccggcatccgggagattggcggcgagaaccagcacgtctacatccccgccaggctcgagaagacgccccatggcaaggagaaggacgtcgcgaagtaccagggcttcgtcctcgagaaggaaatccagcaggccctgcgcttcaaggacatgcacgggcgcggcaagagcaagcgctcccgaggcaaatccatggtggcgggcggggcgggcttcttccacctcaagcccttcctgggaggccagaacaagaagggcaatccctaccgggacttcaccacccggacggtcatcgagggcgtctggaatcagctccggccggtggctcccgaggaggaccgtgggcagctccatgcggaccggctggagttcatggcctgcatccgcatctacaacaccctggcgaacttcctccgcaggagcacccagagcatcacccgggggtactgggaccagcgcttccgcttctacggaggcaatacgcgcatggatgcggagtggctggtggggtggatctccagcctcctgctcggtcgcaggtcgtatgattacgtgagcacgatctggagccagagcctgcccatgctggggagcacgctcgcgtttccggacgtcgtgcagcaactggtggagcgggcctttccccagctcatgggtggcaagcgcctgaccctggacccgtcccatacgtatcagcggcacgggttctgctccgggatgagggtgttggaggcagagcagctcatgcggaccctgctgtccgccggctgggtgcttcaggagcgcaagtacggagacgagtggctcggcaacgagcacatggaggagctgttcctgcaccacctcgcggaggcgagc

SEQ ID NO: 6399 - DNA, 1002 bp, Myxococcus xanthus
atgaagcgttggcaggcgaagcaggcgggacgggggcacctggaactggcggaggtggcgattcccgctccgggtgccggtgaggtgttgattcgcgtgtcggcggtttccctcaactaccgcgagaagctgatgctcgacggggggggctacctgacggcgcaccagcccttcacgccggcttcggacatggcgggcgtggtggtcgcggcgggcgcgggcgtgcagcgcttcaaggaaggggcgcgcgtcatcgccaactttcagacggactgggtggacgggcccgtgccgcgtgggacggtgcgcagcctgggcggaaacgcgccgggcgtgctggccgagtacgtcgtcatgccggagcagtggctggtggcgtctcccgaaacactcgatgacgtgcaggcgagcacgctgccgtgcgccggcctcaccgcttggacgtccctggtggagctgggcgggctgcgtccggggcacaccgtggtgacgcagggcacgggcggcgtgtccctgttcgcggtgcagcttgccgccgccatgggcgcggaggtcatcgtgctctcgggggacgaggacaagctggcccgcgtgaaggccctgggcgccgcgcacggcatccatcgtcgccacaccccggagtggcacacggcggtgctcgagctgacgcgaggcgcgggggccgaccacatcctggagttggtgggtggggacaacctgggccggtcggtgaaggcgctcgcgtcggatgggcgcgtctcgctcattggcgtgttcgagggattcgagagccgcttcccggtgcagcccttgttcatgagctccggcgtcatccagggcatcttcgtcggacaccggcgcgggctggagaacctggtgcgcgcggtggaccggctggcattgaagcccgtggtcgacactgtctattcgctcgatgcgctgcccacggcgctcgaacacctggaccgcgggccgtttggcaaactggtcatcacggcttga

SEQ ID NO: 6400 - DNA, 919 bp, Myxococcus xanthus
atgagggaccgccttgggggcgtcttcgcctttgtccaggccgtggacgcagggagcttcgcgctcgccgcggagcgcatgggactctcgcgctcggccgtggggaagagcatcgcgcggctggaggagcgtctgcagacccggctgttccagcgcaccacgcgccggcagggccctcaccgaggacggccaggccttctacgaacgatgcgtgcgcgcattggcggagctcgaggcggcggagacggcgctggactctggacggcgcgcgcccacgggccgcctgcgcgtcagcgctcccgtgatgttcggccggcactgcgccgcgccgctgctgcgcgagctggtcctccagcatccgggattggagctggaaatcgccttcagcgaccggatggtcgacctcgtcgaggaaggctacgacctggccctccgcgtcgcgccactggcggaccacgcgggactgacggcgcgccggctgggcgtccagacgatgtccgtctgcgccgcgcccggctacctgaagcgccacggccgcccgaagacacttgaagacctgggcgagcacgacgcggtcgtctacggccgcaacggcgtcaacaagccctggcgattcccggacggacaaggcggcgagcagcgcatcgccgtccaggcgcgcctgcgcttcgacgacgtggagaccatcatggacgccgcggtgcagggggccgggctggcgtggcttcctcgctggctcatcgccgagcacctgagcagcggaagactcgtcgaagtactggaaacgcagcgcccctatggcaacgaaatctacgcggtgtggcctcagagcaaacacctgacctcgaaggtgcgcgcggccatcgacctcctcgtcgcgcgcattcccgagcgactggcggacacccactcccgctga

SEQ ID NO: 6401 - DNA, 234 bp, Myxococcus xanthus
tccgaggaggtccccgcgcgtgagctgccggcggacgtcaaggtctccgtgtgcacgcgcaaccagcgtcagccggtggagaacggcgtggcgtgcctctacttcttcccgcagggctacacggagaaggcctacgtctacgtgcagcagggagacaacgtctggacgctggacgtgtcgccgctcaccggcaaggtgcagattgtcgccgaggcgctggaggtcccccgatga

SEQ ID NO: 6402 - DNA, 1173 bp, Myxococcus xanthus
atggaggtctacctgctggcgacggagcaggagggcccggctcccctcgatgcactgcgcacgtccttcgcgaacgatgaggtggagttcaccccggacgcggacggcgagggtttcaccctgcgggcggacggctccgaggtgctggtgcgtctgacgcggggctccgagggactgccgcgcttccgcaaggaggtgttcagcggcagcccggatgccttcgagcggctggggcgcgccaaggcctactaccacctgtccgtggagccgggcggggcgcagcccacgctgcctgttttcgaggccctgtgggccgtgcgcacgctgctggagcacgtgcagggcgtgctggtggacctcaccgccttcaagctccacgagcccgacgacgtggcggaaatcacggagctggacttcgacatccgcgaccatgtccacctccatcccgtggaggcgacggagggggacacgcccctgtgggtgcactcgcacgggatggagaagttcggggcccggcccctggaaatcttccacctggccgagaaggacctgctggccgtggagagcttccttcacgagctgtgcaccgacctggcctttggacaggggccggcgctgcgcacccaggtgggtaccagcgaggggcaggtcttcacgctcgtgccctcggaagaggcccgcgccaacctgctgggcgtccccctggacaccttcgagggccatgaggggctcttcctcaccgtggtgtccccgctgggccggcacaacacgtcccagctcctggagccctaccgtgagcgcttcgagaaggagccggaggagcagacccaggccatgcggcgggaggcccaactggtgctcccgtccttcctggcgcgcttccagcgcaagggcctgatggagccgctcaccttcctggtgcgtgctcctttcgatacccatcccgaagggaacaccgtcacggagaacctgtggctggaggtcatgggccgggacgagggctccgtggtgggcaagctcgttgatggcgcggtgcatacaaccgagtggcgcaagggtgcccacgtagaggtcgcggagacccaggtcaatgcgctggccatcagccgggaaggccgggcgttggacgagcgggaactccgtgaactcctgaacgccgaacggccgatgtag

SEQ ID NO: 6403 - DNA, 1287 bp, Myxococcus xanthus
acctaggaagccaccatccgccgcaccgcccacggcgttccccacatcaccggaaaggacatgggcagcgtggcgtacggcaatggctatgccttcgcccaggaccacgtctgtatcctcgcggatcagatcctcaaggtgcgcggtgagcgcgcccgcttcctgggcatgggccccggcagcacctacgcgggcagcgacttcgcctaccgctcgctgggcctccatgcgcgcgccacggagcgcatcagcacgcagcccgccaccctccaggccatgctcaagggctacgcggccggcttcaaccgctacatcgaggagacgcccaaggagcaactccccgcgccctgcaccggcgccaggtgggtgcggcccatctccgatgtggacctgctggcctacgcctacagcgtggcgctgacgggcagcagctaccaggtcgccctcgccctcgccgcggccacgccgcccgacgtgacggcgaccaccctgggcacgccggaccgcgaccacgtcaaggtccagcggcccgaactgcaccaggtgggcagcaacggctgggccattggccgcgaccgctccgccaccggccacggcatggtggtggccaacccgcacttcccctgggaaggcgagctcaagctgtgggagagccacctcaccgtccccggtgagctggacatctacggcgtgggcctgctgggcgtgcccgcgatcctcatcggcttcaacaacgacgtggcctggacgcacaccttctcctccggccagcgcatgacgctgtacgggctgcggctggtgccgggcaagccgacctcgtactactacgacaacgaagagcgggagatgacctggaaggacgtcaccatcctggtcctgctcgacaacggcacgctcgtcaacgtcacccgccgcatgtacagcagccactacggccccatcatctccatccccgacaccgcggagtggaccgagcagtccgtgctcacctaccgtgacgccaacctggagaacgacaccctgctggcgcagttcctgggcatgaaccaggcccgcagcctggatgatttcaaggccgtctacgcgcgcgagcagggcatcccctgggtcaacaccatggcggccgaccgcgcgggcaacacctggtacacggatgccacgcccacgccgaacctgtcccaagcggccctgaccacctggaacatcgcccgccagggcgcggacctggccaccaccgccatctggcagcagatgggcctggtgctgctcgacggcagcaacagccag

SEQ ID NO: 6404 - DNA, 852 bp, Myxococcus xanthus
atgaaacgcaccttggtgtccgcggcgctcgccgcctcctccctcgcgttcctggcttgcgacctggatcagctcacctccgaccacgtcatggtcggcacgttgctctccaccccggaggtggaggtctccgcttccgcgttggccggctatgacgcgggcaccttcagcccggacggtggcgacgtgctcgccctgcccgcgcagacggccgccatcgtcttctttggcagcaagacgggtgagaactcgcagccctccggcctggcgggggccgacatcacggtgcagccggtgggtggcgaggccacggcgctcgcggacgagggctccggcaactaccgccgcaccagcgtgggcgcgtccaacttcacctaccagcctggcgccacctaccagttcatcgcgaaccggggtggcacgcgctacgtgggacaggtggacgacgcgccgatgaaggagaccatcgccgcgctgcacccgcccgaaggcttcctgcgcatcgacgcgagcacgcccctgtccttcgaccggccggcgcccccggcgaatacggaccgcacgctgggcttcgtcaccgtcgtgcccctgagcgccgagggcgcgcagggcgagccgacgtacaccaacctgccctccacgccggtccagttcctccaactggtgggcctgccgggcccgtaccgtgaggcccgcgtgacgattccgggcaccgcattcccccagcgcgagcagacctacctggtcatcttccacgccgtgcgaatgggcggcgccgaatccggcaacctgttcctcggcagcgcgctgctggcgggcaccgccgaggtgggcgtcgtacgcacgcgctag

SEQ ID NO: 6405 - DNA, 1020 bp, Myxococcus xanthus
gcacgcggccctggacggggccaggggcctccattcgcgccggcaacggccgcgggtgggggccttcccgtttggagccggttagagtcctcgcccgtgagcgagacgacgcagggtgggatggtgaagcacgccggggccagcgagggcgtgagcccggacgcggcgctggcgcggctgcgcgcgctggagacgctggagtccgggtatgaggcgtggctggagctccaggtggagcacgcggcgtcgcgcctgcgcttccgtgaggagcgcgagcggctggagcagcagggctcgttcctgttgggcgcggtgcgcgccgcggggctgacaccttcgtcgggcgccgagcccgcgctggtgactccgcccgccgctccaggggacttcctgcgggacgcggaggacaagctgacgcaggcccgcgacgcgcttgcccggcgagagacggagagcgaggcgaagcatgccgaggccttcgcggagattcgtgccacgctcaaggaccgcgtccagcgctacctgagcgcgagccgcccatccctgacgttgctgctgcgccgtgtggggacggaacgcgcgattctccatctggagcgcgtgtccggagacacgcccgtgctgctgtgcttcctgttcgcggccaggattccgtcccggtacggcttcctgctggatgacgcgaccgaggacgtgtcgctgccgcccgcgccgctctatgcagacgcgggcgtggccgcggacgaagtgcgtccggacgcggtggggttggagtcgcgcgtgcggggggcaggggaggtggtgccgctgaagggcttcctccccgtgttcgtttcgcgcccttcgggaggcgaggacttcttccggctgcttcagcggggcgtggtgctggaggtggaggtcgcggacgggaccgccttccgcaacgtcctctcccgcgaggagtccgagcgcttcgcggggcacctgctgcgcctcaagctggaagggcgcatcgggctggacatcgaagtgggctga

SEQ ID NO: 6406 - DNA, 1432 bp, Myxococcus xanthus
aaccgcgagctgctggccctggaacgagagaccgcgcccgcgcgcatggcggagctcgtggcgtccctgctgcgcacgctgcacagcgtgaagggtgcggcgcgcgcggccagcgccacgcgggtggagacggcctgccaccgcatggaggagttgctggagcaggtgcgggacgcgggcgccggcacgcccgacgtgtacgagctgtgcttcaccaccgtggacgcgctcgacgacgcgggccggcgcctggccgcgcgggaggacctggcgggctcgcccctggagagcctgctgccccagttggagcgcgccgccggacgccgggccggcgcgcccgcacccacgagcgccgcgccgccaccgtcgcctccgcccatgctgacggacgcggtgccgtccccccccgccgccgcggccagcgtggagccgcatccaagcggcggcgcgtctgccggagccgaagcgctgcccgtgcgcgtctccgcgcagaagctggacgcgctgctggcacgcagcggtgagctgcgcgtggcgacgctccggctggaaggccgcgcggacgcgctggagtcggtgcgagaggcgctggcgcaggcccgcgaggcggtgctcggcacgcccggcgaacaggcgctgctgcgcgcggagacggagctggcgcgggtgacgctggagctggcggcggaccgccggacactgggcggcgtggccacgggcctggacgacgaggtccgccgcgcgcgcaccctgtccttcgaggaaggctgcgagggcctggagcgcgccgcgcgcgacgtggcgcgcagcctgggccggcaggtgcggctggagattcatggcggcgcattggagctggaccgctcgctgctacaggggctgcgcgagccgctgctgcacctggtgcgcaacgcggtggcgcacggcctggagggccccgaggaacgccagcgactgggcaagcccgccgagggacgcctcctcctcaccgcgcgactcaagggcagccgcgtcgaggtgacggtggatgacgacgggcgcggcctggacctgggggcgctgcgggagcaggcgcgcgcccggggcctgcgagtgcctgaaagtgacgaggaggccgcgcggctggtgttcctggccggcctgtccaccgcgacgaaggtgacccaggtggctggccgtggcgtgggcctggacgtggtgcgcatgcacgtggaggggctgcgcggcagcgtggaggtgacgacccagcaaggccagggcacccgcttcatcctggacgtccccctcacgctgagcacgctgcgggtgctgctggtatcggcgggcgggcagacgctggcgctggccagtgagagcgtggcgaggctggtgcgcctggcgccccacgaggtgcgcgacgtggaggaccgccccgcgtgggcctctgtagagc

SEQ ID NO: 6407 - DNA, 606 bp, Myxococcus xanthus
atgctccgcaagctccccgttctgctggttggtgttcttggtctggcctcttccgcgggcgcgcaggaggcgcggcggcctccggagcaccgctctccgacgcccgcctgggcgcctcgcggcgtgctcctgggtgtcagcgcccaggatgggctggtggcctcccagacgaaggtgcagtggcagttcaccttctaccaggaccgcaaggacgccttcgccttgctactggagggcagtctctcgtgggggctcgcgttccccgatgccgaggagggcaagccgcagaacgcggtgcgctcattctaccagcacagcccgcaggtgggtgtgggttaccggaaccacctgcccggccaggtgcactggggcttccaggtcaccggcggtcccgtcttctacggcgcggacttcgacggtgggctggagaaggaccggcgcgtggcgggcctcatcgagggccgcgtccacctgggctatcagttcggggacatcgccggtgggctcgctgtggggtatgccgaggcatttggctacaagcgccgcagccttggccgcttcttcgtaggtggcccgatggtcgggttgttcgtggattggcgctag

SEQ ID NO: 6408 - DNA, 513 bp, Myxococcus xanthus
atgcccgagccgctcagcgcccatgtgtcgcgatacctccgcaaccgagaagtcttcgagcggaacctgccagccgcgctgctcgtcttcactccagcgacggaggaagacagcggcggggacggggaggagtaccgtctgaagacggtgacgaacgcggggaaccccacgctgggggccagcgggcccttggtgtttcccgtcgtgaaatcgcggacgaacgccttcgggcggggcatcaccgtggggcggacgggcaataacgacgtggtcctggacgacgggagcgtgtcccggttccacgcctggttcagccaggaggaaggccatgcgggcttcctgctgacggatgccgggtccaagaatggctcctgggcggggggcgtccgcctcgtgccccggaaggccgttccggtggcggatggagcgcggttgcgcttcggccaggtggaggtcggcttctacacgaccagcggttttatgcggatgcttgccgtgaggatggctccctga

SEQ ID NO: 6409 - DNA, 1248 bp, Myxococcus xanthus
ctgaccgacgtcggccgcaggcggcagcacaacgaagacgcgatgctggtggatgcggcactcggtctctacgtggtggctgacggcatgggcggtcactcggccggcgaggtcgcgagcaaccgggccacggaggtcgtcaagcagcacatctccgccaaccgccatctgttgaaggacctgggcatcaacccgacgccggacagccgctccgcggcggcggcgctcgtcgaggtgtccgtccagcgcgcgtgcgcggacatctaccggacggcgatgtcggacgcgaccaagcgcggcatgggcacgacgttcgtgtgcctcgcggtaggcggcaacaaaggcgtcatcggccatgtgggtgacagccgtgtctacctggtgcggcatggccagtgtcaccggctgacggaggaccacacgctggtcgccgcgcagctcaaggccggcacgattaccaaggaccaggccgccaactcgcagtaccgcaacgtgattacccgcgcggtgggcatccaggagtccgtccaggtcgacacgctcatcgtggacctggtgcccggggacatgttcatcctctgctcggacggcctgcacggctatgtcgaggacgaggaggtccttccgctcatcgccggcatcgcgcccgcggacctgcccaagcgcttcatcgacgtcgccaacgagcgcggtggcaaggacaacatcaccgcggtggtggtgaaggtcgcgggcgaaggctccagcgtcagcgaggagtcgagcgaagcgcagtcgcgcatggaggcgctgcgcaagattccgctcttccgtcacctcacctacaaggaacagacggcggtgctgtccatcgcgaccacgcgcacgtatcccgcggggcgcgaaatcgtggtggaggggcagccgggcgaggagctcttcgtcgtcatccggggccgggtggccatcgagaagaacggcgtggagatcgccgagctgcgcgcgggtggccacttcggagagatggggctcatcgacaacgcgccgcgttcagcgacggtgcgagcgacggagcccacgcgcaccatggtcatctcgcggccggacctgatgggcctgatgaagcgcgagtccatcctcgcggtgaagatgctctggagcttcgtccaggtgctcagcgaccggcttcgcgccaccaactcggagctcagcgaggcacggcaggaactggccgtggcccaggcgattgctccgttcgccgaggagtag

SEQ ID NO: 6410 - DNA, 381 bp, Myxococcus xanthus
atggcgagggcggtgggcggcgacgtggtggtgaagttcctgggcgaggtggttgagctgcgccatgagctgagggcgacgcagggggacatcgaaggcatggcgatgggcatggagtccatgcgagccggcatggcgaccatgcggtcgaacatggcggccatgcagtcgaacatggactccatgatgggcaacatggagacgatgatgtcgaccgtggagtccatgatcgtcgggctgcgttccgtgtcgggacgcatgagccggatggaggcccatgcgggccgcatggcccggctgctgacttccatggcggattcgacccaggagcgtttcgagcgggtcgagaagcgcctggatgacctcgaagacaagctgtag

SEQ ID NO: 6411 - DNA, 204 bp, Myxococcus xanthus
atgccagtcgtgacagtccgggccggaaacaaacagcgcccgggaaggttcgacgtactcgtccgcaagaccacggagaaggtctccgacctgctggaggagagtgaccgggtgctcgtggtctacgagcagggctgcgcgagcctctactacgagcgcgaacgcgacgtgccccacccgcccgcggtgaaccgcccttcctga

SEQ ID NO: 6412 - DNA, 2364 bp, Myxococcus xanthus
atggcggacctggcccgccggccggtggacgcgcagcgctcgcgcgagctgttcaccgagctggagttcttcgccctcctcaaggagctgccccagcaggacggtgtcgccggggcacccgatgaggtgaaggagaagcccgcgccgctggcggtgacgccgcggctggtgggcgcggacgcggagctcgcccaactggcgggcgccgtgcgcgaggcgggcgccgtcaccctgattcccgcctacgagggctcgcctttcggcgcgaagctggtgggcctgggcgtggcgctgccggacgggcagacggcgtatgtgccactgcggcacgcgcaactcggcgtcacccaggtgcggccggaggccttcaccgcggccttccgcgaggtgctggaggacgcggcggtgaagaagggcgggcatgacctcaaggcgctcagcctggtgctggccaacgacggcatcaccctgcacggcgcacacgacgacgtggagttgctcagctacctgctcaacccgtcccgccgcgagcacgcgctggtggacctgtcgcgcgagcggctgaacacggagctgccgccgctgccgcccgccgcggagggcaagcgcggcaagaaggaccgcgcgctggcggaccacacggtggaggaggtggccaccggcttcgccatccgcgccgaggccgcgcgccggctggcgcccgagctgtggaaggaactggaggcggcgaagctggcggcgctggctcgcgacatggagttgccgctgttgccgctgctggcgcagatggagcgcaggggcgtgctgctggacaccgccgagctgtcgcgcacttccgtgaaggtggacgccgccgtcgaggcgcaggtgaaggaggtctaccggcacgcgggccgcgagttcaacatcggctccaatccgcagttggtggaggtgctcttcacggagctgaagctgcccatcatcaagcggggcaagacgggcccgtccgcggaccaggaggtgctggagaaactgtccgaggagcacccgctgccgggcgccatcatcgagtaccgcagcctgtccaagctgaagagcacctacctggacacgctgcccacgctggtggccgccgacgggcgcattcacaccacctaccaccaggcggccaccgccaccggacgcctgtcctccaccgacccgaacctccagaacatccccgtccgcaccgacctgggccgggagattcgccgcgccttcgtggccgcggaagggcaccaactggtgagcgcggactacagccaggtggagctgcggctgctggcgcacatcgcgaacgaccccgtgctcatcgaggccttcctccatgacgaggacatccacacccgcaccgcggccgaggtgttcggcgtggccaaggagcaggtggaccgcgagcagcgccgcgtcgcgaagatggtgaacttcggcatcggctacgggctgtcacccgacgggctgggggcgcggctgggcattgcccaggacgtggcccgcgacatcatcgagcggtacttcacgcgttacgcaggcatccggcgctacatggaggagactgtcgatagggcgcgcaagacgggctacgtggagacgttctacggccgccgccgctacatggcggacctgaactccaagaaccgcggcgtggcccaggccgccgagcgcgccgctcatcaacatgccgattcaaggcaccgccgcggacctcatcaagaaggccatgctggcggtggacgaggcgttgacggcccagaagctgcgcacgcggatgctgctgcaggtccacgacgaactcctcttcgaggcgccagacgcggaagtggagcaggtgaaggcgctggcggtgaaggccatgtcctcggtggccgacctgaaggtgccgctcaaggtagaggtgggcgcggggcgcagctgggcgtacgcgcactgacgcgcgggcagggcggggcggcgcgaaaaaatacgggaggagcgcccacccccgtaggcgcccctcccgcatgctccacccgcggcccccacagccgctgctgcacaccctgcgacaaatgcgccgacccgtccgaccggcgagtcgcgtggacccccatccacgcgtcttgccagcggctcgcggtgcgcgctcaccactccccagcgggagcacgccttcccacaaagcgcgccatgggcccccacccaggcacactccctcccgccggtctcggacgcgctcgtttccgggcacgtcaagtcgaacgggccggccaacccctacacgccctcagtgcattgccgtacgtccgtctcccgtgtccggggacacgcgccgcgtccgggaaggacgctcgaagtactccttag

SEQ ID NO: 6413 - DNA, 1741 bp, Myxococcus xanthus
gcgtcgctgctggacgcctcactgctcaaacccgcgatggtggacagcctgcgaaagctccacccgcgcgacgtggcccgcaaccccgtcatgttcgtggtgtgggctgggagtctgctcaccacggtgttggtggtgaaggatttggtggcgccgcgcccggatgccgcgccgctgggcttcaccgtgcaggtgacgctgtggctgtggttcaccgtgctcttcgccaacttcgcggaggccgtggcggagggccgcggcaaggcccaggctggcgccctgcggaagatgcgcaaggagaccaccgcgcgccgctggaaggacgggcgcgaggagcgcgtgcccgcgccggacctgcgcaagggggacgaggtgatttgcgaggccggggacctcatccccggtgacggtgaggtggtggagggcatcgccagcgtggacgagtccgcgattaccggcgagtccgcgcccgtcatccgggagtcgggtggtgaccgctcggcggtgacgggcggaacgaaggtgctctccgaccgcatccgcgtgcgcatctccgccaaccccggcgactccttcctggaccggatgattggcctggtggaaggcgcggcccggcagaagacgcccaacgaggtggcgctccacatcctgctggtggggctcaccctcatcttcctgttggcgtgcgtgacgctggtgccgctggcgctctactcgggagtgccgctgtcgggcacggcggtggtggcgctgctggtgtgcctcattcccacgacgattggcggcctgctgagcgccattggcatcgcgggcatggaccggctgctgcgcaagaatgtgctggccatgagtggccgcgcggtggaggcggcgggtgacgtggacacgctgctgctcgacaagacggggaccattaccctgggcaaccgcatggccacggagttgctccccatgccgggtgtgcggatggaggagctggccgaggccgcgcagctcgccagtctcgcggatgagacacccgaggggcgctccatcgtcacgctggtgaaggacacgtacaagatgcgcccgcgcgagctccaggcgcaccacgccaccttcgtgcccttcaccgcgcagacacgcatgagcggctgtgacctggtggacccgcacccgcgcagcatccgcaagggcgcggtggacgccatcgtcacgtacgtccgttcccagggcggcgcggtgccggatgagctggcgcaggcgtcgggccgtatcggcgacgcgggtggaacaccgctggcggtggcggacggtgcgcggctgctgggcatcatccacctgaaggacgtggtgaagggcggcatcaaggagcgcttcgaccgcttccgcgccatgggcattcgcacggtgatgattacgggcgacaacccgcgcaccgccgcggcgattgcacgcgaggcgggcgtggatgacttcctggccgaggccactcccgaggccaagctggccctcatccgcaccgagcagggccgcggcaagctggtggccatgacgggcgacggcaccaacgacgcgcccgcgctggcccaggcggacgtgggcgtggcgatgaacaccggcacccaggcggcgaaggaggccgggaacatggtggacctggactccaatcccaccaagctgctggaggtggtggaggtgggcaagcagttgctgatgacgcgcggcacgttgacgaccttctccatcgccaacgacgtgg

SEQ ID NO: 6414 - DNA, 1161 bp, Myxococcus xanthus
atgccgcgcgcgctggcgcaggccgcgctggagcgcaaggagttggtccagacggatgacgtcctctgcgcgcccctggtcgcctcaggcggcatgcccttcggcgtgctgtacgtgacgcgggcggagccgaagttcagtgagggcgagggccagttgctcgcggcgctgggacggttggggggcgaggcctacaccaccgtgcgctcccgcgtggatgcggagccgcccgtggccgcgctctccgggacgtcccggccgctgcgggccttgctggagctggcgcgccgggtggccgccagcgccgcgccggtggtgattcatggcgagccgggcgtgggcaaggcgctgctggctcgcttcgtccatgcgcgttcgcctcgggccctggggcctttcatcgtggtggactgccgggagccggccgatgccgtggaggaggcgctgttcggcagggccagcgcgcccgggcagccgcctgtcgtatccgcgctgctgcgcgcggatgggggctcgctggtgctgctccacgtggagtcgctcgcgcggcctgcttcggagcggctggcgagggccctggcgcgccgttcagcgcccgcgcggcaaggcggcgaggagcccgtggacgttcgggtgctggccaccgcgcccgcgtcggtgtcgttgctggcggcgcgcggcgacgtggaggcctcgttggctcgggcgctgtcgggcttcgagttggacgccccgcccatccgcgagcggcgcgcggacgtgctgccgctgctggagcagttcgcggcgcgcgcggcccgccggattcgcaaggagccaccgacgctcagtcccgaggcccggcggctgctgacggagtacgggtggccgcagaacctgcgggagctggagctggtgggggagcgcctgggcctgctgtacgcggcgagccgagtgggcgcgctgcaactgcccccggagttccaggagggcggcgacgagggcgcgaagacgttgcagggacgcgtggcccggctggagcgcgatgccatcgccgaggccctgcgcgaggcgtcgggaaagaaggtccgcgccgcggcgctgctcggcatcagccggcccacgctggacaagaagattgaggagtacgggctcgcggtggagcgggggcgccgggagtga

SEQ ID NO: 6415 - DNA, 2484 bp, Myxococcus xanthus
tcccctatgatcgggtgccgaccacctaacctgaacgcgtgcgcgaaccagcttgcccacaagctgccagcccatggcgttggtccagaggcccgggtggggctctccctcccgcgctcgttggagctgctggtcccggtgctgggggtgctcaaaacgggcggggcttatgtcccgttggatccagactacccggccgagcggacggcctacgtgatgccggacgcgggcgtggccgtgctgttgacgcagtcctcggtgcgcggccggcttcccgcggggcaggtgcggtcaatcctgttcgatgaggtgcgcgccgaactggccgcgttgccctccacgccgccgccgcggccggtgctctccacccggttggcatacgtcctctacacctccggctccaccgggcgtcccaagggcgtgatggtgacgcaccagaacgtgctcaacttcctccagtcgatgcggcgcgagccggggctgcggccggaggacgtggtgctcgcgctgacctcactctccttcgacatcgcggggctggagctctttctgccgctggcggtgggggcccgcgtggtgattgcgccacaggcgtggcaacgcgatggggcactgctggccgcggggttgactcggtgcggcgcgagcgtgttgcaggccacccccgccacctggcagatgctgttgcaggccgggctcccggcgggcctggggctgcgggccttctgcggcggagaggccatgtcccgcccgctcgcccgcgcgctcggagaagtggccgggagcgtctggaacctgtacggccccaccgagacgaccatctggtccgcggtggagcgcctccaggacgaggaggccgacccgtcactcggacacgccatcgacaacacggagttgtacgtcctcgatacgggcggacgcccggtgccggtgggcgtcgccggcgagctgttcattggcggagagggcgtggcccggggctaccttggccagccagcgctcacggcggagcgcttcgttccggatcccttctcggccaggctgggggcgcgcctgtaccgcactggcgatctcgtccgctggcgggagggcggggggctcgagttccttgggcgcatcgaccatcaggtgaaggtgcgtggtcaccgcatcgagctggcggagatcgagacgacgctcgcagggcatccggcggtggagcaggcggtggtcgttgcccgggtgcacgcggcagaggatgtgcggctggtggcctacttcatcccgcggacgggtcaggacgggaggaatgtgcaggcgctgcgccagtggctctcggagcggttgcctgggcccatggtgccgaccgtgttcgtcccgctggcctgcttcccgttgacgccgaacggcaaggttgatcgccgcgcattgccagctccggattggggggccgcgccacggggagcgggggcgttcgtcccgccgcggagcgccaccgagcgcgccgtggcggagctctggcgcgagctgctgggagggagtgcggtctccggcgtgttcgacagtttcttcacggtgggcggacactcgttgctggcggtccggttcgccatgcgggcgcgcacgaccttcagggtcgagctgtcgcttcaggcgctgctcgaacagccgaccatcgcggggatggcagcggtcatcgacgcggcgttggagcgctcgccagttccgaggggggaggcggaggtggatccgatggccgacgccgtgctgccacccgggctcgaacctcgtggcacgttgcccgcgcggcctcgcccccctcggcacctcctgctgactggcgcgaccggcttcgtgggggccttcctgttgaaggagctgctggatcggctgcccgcgcgcatccactgcctcatccgcgcggctgggcgcgaggaggcgggggccaggctggaacgaaagctccgcgcctatgggctctgggaggagcgctttcgggagcggattgaacctgtcccgggagatctggcggagcccgggctggggctctcgtccgcgcagctcgaagcacttgccgggcgggtcgacgccatctaccactgcggcgcggtggtgagcttcctctacccgtaccgggagatgagggcgcccaacgtgcaagcgacgcaggcgcttctggagcttgcgtgccggggccgcccgaaggtgttccaccacgtgtccacgctgtccgtcttcccgccgcatcttcgccagggagggggcctgctcgcggaggatgatgccatcgagggggcgacgggtttccgcaccggttatgcccagagcaaatgggtggcggagcggttggtggcgcaggcccgtagccggggcatgcaggtcgccatctaccgtttgggcaacgtgactggccacagccacacgggcgtctggaataccccctacttcgtcacccggagcctgaagagcttcatccagctcggcagcatgccggtgttggatggc

SEQ ID NO: 6416 - DNA, 3273 bp, Myxococcus xanthus
cccgaggatcgcatcctccagttcaactccctcagtttcgactccagcgtggaggagatcttcctcgcgctttgcactggcgccacgctcgtcctccgtgacgcggcgatgctcgataccgtggagggcttcctcgccgggtgtgaacggtgggcggtgacgctgctggacctgccgaccgccttcttccacacggtggtcgccgcgatggccgagaggggactcacgcttcccgcgtcgcttcgtttcgtgatcgtcgcaggggaacgtgtgcgcgccgaccgggtgacgcagtggcaccgccacgcgccaccatccattcacctgatcaacgtctacgggccgaccgaagcaacggtgtccgccacctgccacgacctgtcggctgcgacgacaacggggctggaacgacgtccccatcggacaaccgctgcggacgatgggagcctacgtcctcgatgggcggcttgaacccgtaccggcgggcggcgtgggggagctgtggttgacgggtgagggactggcccgaggctacttccgcgatcccgcgctgaccgccgagcgattcatggcggacccgcacgccaccacgccgggcagccgcatctaccgcaccggcgatctggcccgcatgcgtgcggacggcgtgctggagtacctgggacgcgccgacgaccaggtgaaggtccggggcttccgcgtggagctgggtgaaattgaaaccgcgctccgcgcctgtgagggcgtccgcgacgccatcgtcctgctccatggggagaacgcggggaaggaggcgcggctcatcgcgtacgcggttgccgcaccggaagtggcgccgtcggccttgcgcgctcagctcgccgcgcggctgcccccctacatggttccggccgcgatcgtccggctcgccgcgttcccgtatggctcctccggaaaggtggaccggcgcgccctgcctcccccgccctcctcgactgagggagaggcccgtcgatcgaagaccgagcggatgctcgccggaatctgggcggatgtcctgcagctcgaccgcgtgggcatcgaccagggcttcttcgagttgggaggccactcattgctggccatgcaggtcctcgcccggctccggagcacgttcggggtggaactgccactcagggccttgttcgaggagggcaccatcgcggcgctggcggcgcgtatcgagcaggccggaaacacccccgccccccgcgccactccgccgctcgtccgcgccagccgcagcgcaccaccgccactgtccttcgcgcagcaacggctgtggctgctggcccagatggagcccggcagcgccgcctacaacatgcccgggacgctccacctcgttggaaggctcgacgccgccgcgctcgagttctccctgagcgagctgacgcggcggcacgaaatcctgcggacccgcttgctcgagcgggatggtgaaccggtccaactcatcgagcccgccgtgaaactgcctttcgaggtggatgacctgcgcgcgctgccgcccgggcaacgggaggctcgcgcggcggagctggtccgcgcagaggccgccctccccttcgatctctcacgagcgccgctgatgcgcgcgcggctgctccaactgggcgaagaggagcaccgcctggtggtggtactccaccacgtggtgtgcgacgcgtggtcgctagacctcctcttccgggatctggcggagttctatggcgcccggagcgccggacgtgaggcggcactgccagcgctggaggtgcagtacgccgacttcgcggtgtggcagcgcgggtggctcaatgacgaagtgcaagcggggcagctcgcgcattggcggagggtactggagggcgcgccggcggagcttgagctgcccctgtcccgccgggcgcgctccagcgtccccggtccggccggcgtcgtccggcgccccctgcccgcgccgctgatggcctcgttgcacgcgctctgccacgcagagggcgctacgcccttcatggcgatgctcgccgcattcgaggcgctgctgtaccgacacaccggccaacgagatctcgtggtcggcacgccggtggcgcaccggacccatcgggcacttgaaggggtggccgggttcttcgtgaacacgctggtcctcagaaaccaccttcccgagcacgtcactttccagcagctcgtggcacgggtacgcgaggtggccctcaccgccctcgcgcaccaggatctgccattcgaaaagctggtggaggcggtccggccagtccgcacgtccagtcggccgcccttcctgcagctcatgttcctcctgcgagacacgcccggcgggggccccacgttgccgggcctgaagacctccttcgaggaggtgctgcccgagcaggcgaagttcgatctcctgcttgagattgagcaaaggggcgatggctgggtggcgagctggcagttcgacaccacctggctcaccaccgaggcggtgtcccgcatggccgagcacttcgagcggctgctccggggagcgctggagcaccccggcgcgccgattgcgcggctcccgctgctcaccgagccggaggtggcggtgatgacccgggccaacagcaccggacgtgggtacccgcgcgacgcgaccatccaccagcgcttcgaggagcaggccacccggaccccacacgccgtcgccgtcgagttggacgaccagcgattgacgtacggggaactcgctcgacgcagcaaccagcttgcgcatcacctccggcgccgcggcgttggacccgacacccgggtgggactgtatgtgcgccgctcattcgagagggtgatcggcatgctgggcatcctgaaggcagggggggcatacctgcctcttgagccgggccacccacgggagcgcctcacgcggatgctgacggacgcggacgcgaggctggtcctcaccgaggaggccttggagccgacgctcgagggcatcctcgcggaccggctctgcctcgacgccggatggtcgtccatcgccggtgagtccgcgggaggcgtgccggacgcggcgggagccgagaacctcgcctacgtcatgtacacgtcgggctccaccggccagccgaagggcgtctgcatcccccaccgggccgtggtccgcctcgtcaccgcccccaactacgtgacgctgtccgcggaggatgccttcctccacctcgcgccattctcgttagatgccgcgacgctggagctctgggggcccctgttgaacggtgcccg

SEQ ID NO: 6417 - DNA, 528 bp, Myxococcus xanthus
gtggattcgggcgtggggcgcgtgcacgactattccccgtggaatgaaccgcgcagcccgatgcacgcgcgcggcgaggcctacggccgcttcctggtggagcacctcaagccactggtggaccgcacctaccgcacccggccggagccgcagtggacgggcgccatgggctcgtcgctgggcggcctgatttcgctctacctcggatgccgctatccggaggtgttcggccgtatcggcgccctgtctcccaccgtgacgtggggcgccaaccagctcttcggcgcctggtcggcgcacagccgccgttggacgcgcatctacctggacgcgggcgcccacgagtacacggacgccagcggcgtgcccgtctactacggcgaatccacgcgcgccttctacgagcacctcaagcacctgggctacgcggaccacgaactggcgctggtgttggatccacatggcgggcaccacgagcgggactggcagcggcgcctgccatccgccatgcgctggctgctggggtga

SEQ ID NO: 6418 - DNA, 573 bp, Myxococcus xanthus
atgaagcaccgcgggacggttcccctggagcaacggctcgtctacgtccaggtggtggagggcctgctcgagcacgggctgcgcggcagcgtgtcgccccgcctcaagcatcggttgcggcaggcgggcatcgacctggaccggccactgctgccgggctacccggtgctcctgtggggaaagtgcctcgacgtcatcgtcgaggagacccttccgggcctgccccgggaggaggccttccgccagctcgccgagcgccacgtgcagggctacgggcgcaccgtcgtgggccgcgcggtgtacggcgtgatgcggctgctgggcccccgccgcatggtgcagcgcctgccgcagacgctgcgcgccaccgacaactacacggaggtggagctcaccgagcagggccccaccacctacgccatgcggatgaactcgcgggtggacgcgcccggctacgcggaggcgctcttcgaatccctgctgcgcctgggcggcgccgagtcccctcgcgtggcgcgcatccacgaggacgcggacagcaccacctaccagctcacctggacggagcgctga

SEQ ID NO: 6419 - DNA, 372 bp, Myxococcus xanthus
cgtctgccggacggccgcttcatggtgctggaggccaaccttcggccgcccggcggcttcatggtggatatgatgaactacacgtgtgacatcgacgtgtaccggctctgggcgcgggtggtgacgggcgacccggtggcggactttcgcttcacgccgcgctaccacgtctgtcacagcgcgcgccgcaagtcccgccgctaccggcacccgcacgcggacgtggagaagaagctgggcacgtcgctcatcctccaccgcgagctgccgagcatctaccacagcctcctgggcgaggagatgtacctcacccgccacgcggacatggacgccctgcgggacacggtgcgcttcatccaggacaaggcgtag

SEQ ID NO: 6420 - DNA, 792 bp, Myxococcus xanthus
atgttcgggctcgtcggcattgtctgcgcctcgggtgcgccttccatcgccgaggcacaggtcccacccccgtcctgggtgcgccagctcggcgcccaccacgacgagcaggcccacgccgtggccgtctcgggcacgagcgtctacgtagcaggccagacgaccagccagctcggtgccgacccgcaagccggcggccaggacgccttcatcgcccggtacgacaccgccgggaacctccagtgggtccgccagttcggcaccgcgcggacggaccgcgccaccgcggtggccaccgacgaggccggcaacgtgtacgtggccggcaccaccttcggcagcctcgacttctacaccaacgcgggcggcatcgattacttcatcgccaagtacgacgccgccggcaaccgtcagtggctgcgccagaacggcacgcagatggatgatttcgccaccggcctcgccatcagcgcgcccgacaagctcttcttcaccggctacaccggcggcagcttcgccaacggcggcaaccccaacaactacgacatcgtcgtcgccctctacgacacggcgggcaacccgtactggctccagcagtacggcacttccgcgagcgacatggcgcgcggcatcgccgtcacgcccacccacgaggtgtacgtcgtcggcaacacctacggcagcctcgacggcaccaccacgccggtgagcagcgacatcttcctgctcaagctcaacatcctcggcgcccagcagtgggtccggcaaatcgacgcgggcgagctcgatgat

SEQ ID NO: 6421 - DNA, 351 bp, Myxococcus xanthus
cgactcgtgcgctacacggcggcggtgcatggcggttcgtcggcgctgcagttcgtggtccccatccaggtcgccgagcgcttcacgctcgagaagttcaacatcccgagcggcaactactcctgctcgtaccgggtgcggggccacggcaccatccggcatcgcagctactcgagcgctggctggagcccggccaccgacttcctcaccgtcgacagcgacgagtggcagccggtgttcttccgcatcacgggcaacgtgcgtgactggcgcctgttcttctatccgagccgcagtgaagccgaccgcgaccacctccaggtcgacgacgtcgtctgcacgaaggactaa

SEQ ID NO: 6422 - DNA, 469 bp, Myxococcus xanthus
ctacgcttttcggaagaggtgcgccgcgcgctctagtccggccaaccgctggtggccctggagacgagtgtcgtggcccagggccttccgtatcgggacaacctggccgcgggcccgggcgtgtgaggaggccattcgtcgcgctggcgcggttcccgccgccaccgccatcatcgacgggcagttgtgcgtcgggctggaggagccggagatgcgccggctggcggagggcaaggaacgcctgctcaaggtggcgtctcgggacttcgccgtcgccatggccacgcgcgccacgggaggcaccaccgtgagcgccacgtgtgagatggccgccgccgcgggcattcgtgtcttctccaccggtggtattgggggcgtgcaccgcggggcgtcggagcacttcgacatctcccaggacatcgccgcgctggcgcgcttccccgtcgccgtggtgtgcgcgggcgccaag

SEQ ID NO: 6423 - DNA, 1149 bp, Myxococcus xanthus
aatcgtctggcccgggaaccctctccgtatctgcgccaacacgcacacaaccccgtggactggttcccttggggggaggaggcgctcgcgaaggcgaaggcggagaacaagcccatcctgctgtccgtgggctactccgcctgtcactggtgccacgtcatggcgcacgagtcgttcgagtcacccgagacggcccggctgatgaacgagggcttcatcaacatcaaggtggaccgcgaggagcggccagacctggaccagatttatcaaggcgtggtgcagctcatggggcagggtggcggctggccgctcacggtgttcctcacgccggacctgaagcccttctacggcggcacctacttcccgccgcaggaccgctacggccgtccgggcttcccccggctgctgatggcgctgcgggacgcctgggagaacaagcaggacgaggtgcagcggcagtccggccagttcgaggagggcctcggtgagctggccacctacgggctggaggccgcgcccgcggtgctgacggcggcggacgtggtgggcatgggccagcgcatggcgaagcaggtggacgcggtccacgggggcttcggcggcgcgcccaagttccccaacccgatgaacttcgcgctgatgctgcgcgcgtggcgaagaggcggcggcgcgccgttgaaggacgcggtgttcctgacgttggagcgcatggccctgggcggcatctatgaccagttggggggcggcttccaccggtactcggtggacgagcgctggctggtgccccacttcgagaagatgctctacgacaacgcgcagctccttcacctctacgcgcaggcgcagcaggtggagccgcgccagctgtggcgcaaggtggtggaggagacggtggcctacgtgcgccgcgagatgactgacgcgggcggcggcttctacgcggcgcaggacgcggacagcgagggcgaggaggggaagttcttcgtctggcgcccggaggaggtccgcgcggccttgccggaagcgcaggcggagctggtgctgcgtcacttcggaatcaagcccggcggcaacttcgagcatggcgcgacggtgctggaggtggtggtgccagtgtcggagctggcgcgggagcgcggcgtctcgcac

SEQ ID NO: 6424 - DNA, 609 bp, Myxococcus xanthus
atgctgtgcggtgtggggacggtggccgcggtgtggcggctggcgcgcgacgtccatggcgacgcggcgacggcctggcgggcggcggcgctgtggagcgtcgtccccgcgggcgcgctggccggcgtgtggcccacgcccgactcgcccctgctcctgttctggacgctggccctgtgggccctgtggcgggaacgatgggtcctggcgggactggccggagggtgcgccctgctgtcgaagtacccggccgtgctgctgggcgtggcgttcctcatcgccacggtgcgagcgcggcgcctgccctggggagcgtggcgcacggcgacgctggcgggcgccttcttcgccccggtggtgttctggaacgcggaccatgactgggtgggcttcgccttccagctcagccatggcctgggccgcgactggcgcagcggttggagcaccttcggcgagttcctcgcgggtcagctcgccctgggaggccccgtgctctttcccctcgcgctggtgtacggcgtgcgcggtccgcgcgagcacttcctgctgcgcatggcggcctgcgtccccctgctcttcttcggctacgcgtcgctgcgcgcaagggct

SEQ ID NO: 6425 - DNA, 462 bp, Myxococcus xanthus
atccgcacgctcttcgacctgcacctgctccgcgacccggacctcttccaactcacgctgaacatccccgccggcatggaggagattcccgtcccgccgctcgtgctgctccccctggcggagaacgcggtgaagcatggccccgccgccggccaccgcggccccctgtccctggacgtcaccgcgcggggacacgaggtggaggtcgccatcgagaacccgggcccctcccgggggccttacgaggacaggctggtgcttaccatcagggaccagcgcctgctcaagcactccgggggcggctgtgatatccacggcgcagacgagatggacgaccacatggtgatcaacacggtgttgatggacgcccaactcatgcaatgggtgttccagaccgatcggttcgagtactcgcctctgacgacaatccagtattggaacttccgcttcagcagactttga

SEQ ID NO: 6426 - DNA, 1032 bp, Myxococcus xanthus
atgcccgtgctcgcgcccgacctgcacttctccgcgttggtgccccccgaagggctcgcgcccgacctgggtgcgctgacgccgcgcatgccgctgcatcgtgcgctggccgggtttctttcgcccctcgagcagccggcgctggcggcggacctggtgaagctggcgccggatgcgttccacgccacgtccttttcactgcccctcttctggaacgggcggctggtggccactctccacgacgccaatcacctggcgctggcggaccagtacacgccggcccagtccatctactaccgcgtggtggtgggccctcgcgcgaagcgggccaccgcgctggtgacggtgtccgagttctcgcgcgacgagctcgcgaagcacctcaagctgtcgccctaccgcctccaggtgattcacaacggggtggatgcccgcttccagccgccgacccaggccgaggccgccgcgttccgcgaacggtacgagctgccagcgcgctacgtggcggcggtgggcaacgccaaacgcttcaagaacctggcgctgctgaaggatttcgccggggagttgccggtgcccgtggtgctgctggcgggcaagggcgcggtggcgcacgagctggggcttcacgagaacgtggtcgatttggaggagctgcccgaggaccagatgccgctgttctacggcgcggcgtcggcgctcctgctgccctcgcgctacgaaggcttcgggctgccggccctggaggccatgggcgcgggctgcccggtgctggcgtcggatacgacggccctgcccgaggtcgtgggcaacgcggcgttgaggctctccccggacgacgcggcggcgtggcgtgaagcgacgctgcgcgtgcttcgcgacgacgtgctgagccgggagctggtggagctgggccgggagcgcgtggcgcgcttcacctgggacgactgtgcccggcgcaccctggccgtctaccgccgcgtgctggaggccccggcgcccggaggctcgcgcgggacgcctcgccgttag

SEQ ID NO: 6427 - DNA, 1134 bp, Myxococcus xanthus
  unsure (1)..(1134): unsure at all n locations
gtgcgcgcctatgtcggggccagtggggtgctgtgcctgtggcaggcggcgtcgcccgccgtggcgctgctgacgggcgcggcggtgtcgtgnccgcgcggcgcgcggtacggccaggtgctggactcggtggcgggcgccgcggccgcgtgcattggcgccgtgggcgtgccgtggctgctgctggcgggcgtcctcgcgggagggtggctgctggccgcgctgctgggcgtgttccagaaccgggtgcgctggtccgtggagctgccctccttcctcaagctcaacctggggcgactgcacgagaacttcggcaccgaggagtctccgcgctacgcggcgggtggcttcttctcccaccggcttcgcttcgcgcacggcgccatcgcggcgctcgggcccgcgctgtcggtgctgggcagcgcggaccaggcgcggcggcgcatcctggcgggggcggtggtgatggggatgctcatctccatctacaacgccttcgcgcgcgcggcgctgggcgcggcattgctcgtgagcgtggtggcgttgctgctgctggtccagggctccgcgcggaagatggggttggcgctcctgttcgcgctggtggccgtcgtctccatgagcccggcctggcgcacgcgaatggagaaggcgctgggcaacatctacggcggagagcgcgagcacgccatggccgtgggctggagcctggtgcgtgaatacccgctgacgggcgtgggcttcggcaaccacaagccggccgccctggccacgcaggacgagacgggcatcaccgacctgctggccaccgattcgcacaacctctggctgacggtgtgggcggagacgggcctggtggggctgttgctgatgctggcgatgcacggcctgctggggcgcgccctcatccggcgctaccgtcagggctccatcgcggccacgggcgccctactgtcctgggtgggcttccacatcctcgcgttggtgcactacctgccgttccactccagcgtgtacctgtccttctcgctcatctggggactggggctgtgcgagggcagtgaacgcctgcgcggccgggaggcccgtcaggggcacctggagatggaaggcgcgcccgggcccacgccctaa

SEQ ID NO: 6428 - DNA, 2523 bp, Myxococcus xanthus
accgcgccccacaccttgctggccgccctgctcggagagaaggcccaggcccggctcgtggtgaagccgccgcctcccgaggctcgcccgcgcaagggctccgcccaggcccgcgccgctcgcgcccaggacgacgatgccacggggacggatgccgacgacctgctggacgcggcgcccacggccgcgcacgcactggacgaaaaccacgtcccttcccgcgacgtggcttccgacgccgcgcttccgctggcccccccccaagggccttcccgccacgcgcgtcccgacaacgcgcctccgccggatgaggcccccgcgccttcccgcgcggaggaggaacagcaggacctgctccgcaagctggccaccatcgtcgaggacgcccgtaccttcgagcaggacaccggcgcgcacgtccttcacgtgggctttcccctgctccacctgccacccggcgccaaggacaagcgcggcttcggcacccggcgaatcctggcccccatcgccttcatccccgtgcggctcacgctcaagaagggccgcgtgccgtcggtggagctggaaggcgccgaggccggcgtggaccgcgtggcccccaacaccgcgctgctcgcctggctggagcagcagacaggccagcggctgggcgacctcttcgcggatgaagcgggcgaggacccgtggcgcgagctgaacgagttggtggccgccgtgtgcaaggccatggagctgcccgcgcccgcccccttcacgccggaaaccctcctggccgccattccgcgtggcgacgatgcccagccccaggccgccatcctccccagcgccgtgctggggctgtatcccctgtccaatcagagcctcgtggacgacatgcgcgcgctcatggacggagagcccatctccggcccgctggagagcttcctccgcgtggatgtgtctctcggcctgcccccgggacacggcggcggcgagcccaacctggaggggctcaagcgcacaggcgaggagcggctcgtcacactcgcggacccgtgccaggcgcgcgcggtgcggctggcacgcagcagccgggggctcgtcatccatggacctccgggcacgggcaagtcgcagaccatcgccaatgccattggcgaccacctggcgcgcggggagcgcgtgttgcttgtctgcgacaagcgcaccgcgctggacgtggtgaagcaccgcctggaccatctcggcctgggacacctgtgcgccgtcgtccacgacgcccagcgtgaccagcgcgacctctacatgggcatccgcgagcagctcgacacgctgccggagacacggaccgacgcggccgtggccaaggaactggcgcgcatcgacacggagctccagtccctccatgacgaactgacggccgccgaccgcgccctctccgagcgccccgacggaggcaccgcgccctccttccacgagctggtgggccagtggttctccgtggaagcccccgccgcgctcacgcccgctgtgtcgagcctcgcccacgcacggctgggcgacgtgacgccgcacgagcgcgaggtgcgcgaggtgctggagcgcggcggcaaggagggctatccggagaacccgtggcgcgaggccctgggcggggagctcgccacgtacctggcgacgccgctggccacctaccgcgagcgcctgagcgctatcgacagcgcggcgcgggacgcggatgcgctcgtgtcaccagacgtgcctgtcttcggcgcggaccctcaggcggagggcgcggcgcgcggcgccttcgcggagaagctggcaccactgctggagtcggcccgtccggacgtcctcgcgcgctggggctcggcgacgccggacgcggtccaggccgcgcggatacagctcgacgggctggcgacacaacgacaggtgctcgcggaagggccgctggacgcggagctggcgctggtccaccgcgagcagccgcaggccttgagtgtgctggccaccgcgatggccgcgctgggctcgtacctggacatcgcgcgcaagtggtacgcgttcttctacttcgcgcggaaggccggggcgcgccgggtgctccagcaattcggtctgacgctgagcatcctcgccgcggagcgcgtcacgcggttcttcacgggcgtgaaggcccgcgcgctgctcaccgagtaccaccgcaccacgctcgtcccgggcgacaccgcgacgcttaccgacgactccttgtcccagacgcttcgcacccacgcggcgctcttcgagctgctgcaggagttggagcgcacgcccttgctcgcgtcgtgccgggacgcggtgcgggcagccctgacggcggacgcggaggctcgcgcggcgctgctggcgggcctgcggctgtccgcggcccgaggcgacgccgtcgcgcggctggaggcccggctcaccgaagcggggctcttctccgcgtcgtggctcgactcgcgctcgcgtggcctgcgctcgggcgagcgtttggcatccgtcacccccgcc

SEQ ID NO: 6429 - DNA, 1575 bp, Myxococcus xanthus
gtgctggaacggctggtgtcgccggacccgaagctgcggccccgcagcgcggacgaggtgattgccgagctctgcgccgccaccggtgagccggtaccgcccgagtccgccgccacacgcgagagcttcctccaggccgcgcgctacgtgggccgggtggaggagcaggcgcggctgtccaccgtgctcgagtcagcgatggtgggccgcggcggcgcgtggctggtgggtggggagagcggcgtgggcaagtcgcggctcctggaggagctgcgcgcgctggcgctggtgaagggcgcggtggtgctgcgaggtcagggcgtggcggcgggtggcagcccgtaccaggaatggcgtccggtgctgcgctggctggccatcctcaccacgctgagtgagcgcgaggccagcatcctcaagccgctggtgccggacatcgaggcgctgttggggcaccccgtcgcggaccccgccgaagtgggcgcggacatggtgcaggcgcggctgctccaggtggtggaggacgtgttcgcgcggctgacccagcccgtggtggtggtgctggaggacctgcactgggcgggcgatgagtcgctgcttctgctctcacggctcgccacgcgggcgttgacgctgcgcctgttgctcatcggcagcttccgggacgatgaggcgccttcgcttccctcggcgctgccaggcctgtcactgctgcggctgcctcggctggacgctcgggaggtctccatcctcagtgagtccatggtgggggcacccggagcccggccccacctggtggacttgctgctgcgcgagacggagggcaatcccttcttcctcgtggaggtggtgcgggcgctggcggaggaggcgggagggctggaccggcttggcgacatggcactgccggagcgcgtcttcgctggcggcgtgcgcaggctggtgcagcggcggctggagaaggtgccggttccatcgcgggagttgctgcaggtggccgccatcgtcgggcggcaggtggacgtgccgctgctccagcaggccgcgccggatgtggacgtggagcactggctgacggactgcgcggcggcggcggtgctggacgtggcggatgggcgctggcgcttcgcgcacgacaagctgcgcgaaggggtgctggatgatttgcccgtggacgcgcggcccgcgctgcaccggcgcgccgcgctggcgatggaggcggcgcatgggcagcgggcggagtggacggcggcgctcacctaccactggggcatggccggggacgcgctgcgtgaggctcgctatgcgctgcgcgcgggcgaggatgcccttcgcgtgggcgcctgccgcgaagcactgcctttcctcacccgggcgctgatacgggtgaccgaagtgggtggcgacgccatgacgttggggcacctggaggcactcctggcggagacgcgcttccagttgggggagctccagtccttccgtgagcatgcggagcgtgcgctgcggcacttcggttggcccgtgccgtccagccgcatgggctgggcgctggggacgtttggggcaggcctgctg

SEQ ID NO: 6430 - DNA, 264 bp, Myxococcus xanthus
atggcgaaaggcggacagacgcccccggcgcccggctcggcggaggcacatgccgcctgggcccggaaggaggcgggcgacgtggcgggggcgcggcgcgacgccgagcgaatcctcgcgggcaacccgtccgccgaggaccgcgcggaggcggaggagctgctgcggtgcaccaccaccccgcgcgccctgtacggcttcgccctgctcgccgccaccgtcttcgtgctcctgctcgtactcgcaatcgtccgatacgcgtaa

SEQ ID NO: 6431 - DNA, 633 bp, Myxococcus xanthus
atgctgcccatgtgggccggcatcgtgtgctgtgtcgctggcgtgacgttgctcgtcgccggtgggggcaagctgttccgcgtgctcgcgggccccatcggcgcggtgctgggcctgctgtggacgcccgtgctcgtcatgaagctgggcctgccggacgtggcgaagatgtccaccatcgccgccgcggtgctgatggcgctgggcttcctgctccccacggccatcaccttcctgggcgtgggcgtgccgctgggcctcgtggccgggcagatcgccgggcagcaggacttcctgctgggcttcgcgccgggcttcatcatcggcgggctggcgggcgcgatgctgcaacgcccggtggccgtgatggtggcctccgcggtgggtgcgtggatgttcgtcatcggcgcgctcgcggcgctccaccaggtgggcggcgtggtgcaggcggtggccagcaagccctggggcgtcatcatcgccgcgggcctcttcgccgtggccggcgcggtgtaccagctcgccgtccggccctctcccgaggaggcggacaagcttcgcgcggagcgtgagcggctcaaggtgcggcaggcggagcaacatgcgctcgaaaaacggtggggggtcaagtag

SEQ ID NO: 6432 - DNA, 271 bp, Myxococcus xanthus
atgtccgtcatcggccggcgcgacatgaacgcgccctccctggacgccctccggcgccgcgccgctcgtggaggcaaggagaacgtggacctgaaggccagcggcttcttcaaggagaacaccaaggtccgggtggagctgcgaggccagccggtgcaggtgggccgcacgtatcactggcgcatcgagcgccggggctcgctgctgcgctggttcgtcgacggcgagctgatgctggagctggacgaccccttcccgcctgtagaggtcc

SEQ ID NO: 6433 - DNA, 549 bp, Myxococcus xanthus
atgtccgccgcgcgcgccgagccgctcgtgaaggacaagccagacggcccgctggggaaacgcctggcgggagatgcgtcgaaccacctcctcaatggcgtctccatcctcaaggagctggtcgcggatttccgacggagcgaccgcttcttcaaatacaaggcgtccatcatcgccggctggctggtgatgacggtgacgagcctggccattgcgtgcccgggcagtacggtgcgcaagggggacatggacgcgcgcctggtgctcagtgacaggttggaccggccctcggtcaccatctggaacgagagcaaggagccctggtacgacgtcaccctcaccgtcaacggtcagtaccaggcggcggtgctgacggtggccccaggtgagttcatcaccatcacccccaagcagttgatgggctccagcggcgccgcgcccgcggacctccgcttccagtccatccagatgcgcagccgggatgacagcgcggacctcacagcggacctcaacgccgcctgggagcgcattcacaagccgcagcagtag

SEQ ID NO: 6434 - DNA, 348 bp, Myxococcus xanthus
atggcgcgggtgctgccgcagagcccgctggccgaggtgccgtcgaagcacgtggtgttcaagtccttcttcctgttggacgcggcacccgggcgggtgctcaacaagccccagttgatgggctgcaacctgggcaagcgcgccgcggtgctgtactcgcagaacgacctggccggggcgtggagccgcaacgagtcgggtgactacgagttcgacgtctcgccgggtggcgagccccagcgcgagctggcggtgcggttgggcatcaacgtgtgcatgtatgccctctgcctggactacaaggacgatgccgtccacctgccgctcatcctcaacaagcggcgctga

SEQ ID NO: 6435 - DNA, 1212 bp, Myxococcus xanthus
tcccggtacgtggacatcgaagacctggcccgggcacgcggcgtggacccggccaagtacacggcgggcctgggcgccagggagatggccgtcaccgaccccggagaggacaccgtggccctcgcggccactgcggcggcccgcctcatccgtcagcaggacgtggacccgtcccgcatcggcatgctggtggtgggcacagagacgggcatcgaccactcgaaacccgtcgcctcgcacgtgcagggcctgctgaagctgccgcgcaccatgcggacctatgacacgcagcacgcgtgttacggcggcaccgccgggctgatggcggcggtggagtggattgcgtccggcgcgggcgcgggcaaggtggccgtggtggtgtgttcggacatcgcgcgctacgggctgaacaccgcgggcgagcccacccagggcggaggcgcggtggcgctgctggtctccgagcaacccgacctgctcgccatggacgtgggcctcaacggcgtgtgcagcatggacgtgtatgacttctggcggcccgtgggccggcgggaggcgctggtggacgggcactactccatcacctgctacctggaggccctgtccggcgcttaccggggctggcgcgagaaggccctggcggcggggctggtccgctggtcggacgcgctgcccggcgaacagttggcgcgcatcgcctaccacgtgcccttctgcaagatggcccggaaggcgcacacccaactgcgcctgtgcgacctggaggatgcggcggacgcggcggcttcgacgccggagtcgcgggaggcgcaggcgaagtcggccgccagctatgacgcccaggtggcgacttcactgggactcaactcgcgcatcggaaacgtgtacaccgcgtccctctacctggcgctggcgggcctgctgcaacacgaggccggcgcgctggcgggacagcgcattggcctgctgtcctacggcagcggctgcgcggccgaattctactccggcacggtgggcgagaaggccgccgagcggatggcgaaggcggacctggaggcggtgctggcccggcgcgagcgcgtctccatcgaggaatacgagcgcctgatgaagctgccggcggatgcgcccgaggccgtggccccgtcgcccggagccttccggctgacggagattcgcgaccaccgccgccagtacgccgaagggaactga

SEQ ID NO: 6436 - DNA, 489 bp, Myxococcus xanthus
atggcggacctacctgcccgcagaggcggaagcatgctgggagccccacgcggctgggaccccttcgagcgcatgcaggagctcttgggattcgacctcggccggatgctcggcccccagggcacacgggaaggcggcttcgtgcccgacttcgaggtgaaggagacccaggatgccttcatcttcaaggccgatgtccccggcgtggaggagaaggacctggaaatcaccctcgcggagaaccggctgaccatcagcggcaagcgggaagaagagcgccgcgacgaaggcgaccgctactacgcctacgagcgcaactatggctcgttcagccgcaccttcacgctcccccggggtgtgaatgccgacaacgtccaggcggacttcaagagtggcgtcctcaacgtgcgcatccccaagaagtccgaggagcagcccaagcgcatcaaggtcggcggtagcgaacgcagtgagaaggcgaaagcctga

SEQ ID NO: 6437 - DNA, 516 bp, Myxococcus xanthus
  unsure (1)..(516): unsure at all n locations
atgatgcgccgcgcccttcccctccccttcctggccaccctcctcctgctggcgtccgcgtgcgcgaccaccggcgcggcgccagcggaggcggacattctccaactcgtgagtgatcagacggaggcctggaaccgccaggacgcggtggcctggtccaaggacttcgccccggacgcggncttcatcaacatcgtgggcaccgtcttcgaaggccgcgatgaaatccaggagcgccacgcgggcatcttcgccaccatcttcaagggcagccagagccaggtcaccgtgcgcaaggtccagttcatccaggaggacctggccattgtcgacaccacacacgaggtgacgggccatcccggcctgccccccggcgtccaggacaccgagcccggcctgctgcgcacgcagatgcggtacgtgatgaagcacgtgaacgggcagtggcaaatcatggccggccagaacacggacgtgaagcccaggccccaggcggccgcgccccagacgccctga

SEQ ID NO: 6438 - DNA, 1176 bp, Myxococcus xanthus
gtgctgccgaccttcgggctcgccgcggcgacgtggctgtggacgcgcgaggcgtcacggcccatcagcatcctcatcacggacttcgggacgggtgttcgcatcgtcgtgccggcgagcgcgctggtggcgatgacgctcgcggcgcgtcagggcatcctcatcaagggggcgcagtacctggagcggctggcccaggcggacaccatcgtcttcgacaagacaggtacgctgacgttgggtgtcccggaagtggtggacgtcattcccgttcggggctgggacgcgcgcgaggtgctgtcgctgagcgccgctgccgagctgcgtcagtctcatcccgtggcggaggcggtgcgcaggcacgcccagacgcaaggcgtagaggtgccgcagcccgaggcgggactggaggagttcgtcctggggcggggcgtctgcgcccaggtgaacgggcgccgcgtctgcgtgggcagcgcgcgctggatgcagcagcaaggtgtggacgtgacggacgcgggctcggcgctggcccggtccgtgccgcgcgatgtcgccaccctgtgggtcaccgtggatggcgcgctggccgggtgcatcagctacgtggagacactgcggccggagagcgcgggcgtggtgcagtccctgaaggagaacgggcgcaggcgcatcgtgctgctgtccggggactcgccgtcgcgggtggcggaggtcgcgagccggttgggcgtggacgaggccatcgcggagctgcttcccgaggacaaggccacgcaagtgcgcacgctccggcgccagggacgcatcgtggccatggtgggggatggcatcaatgacgccccggcgctcgcgctcgccgacgttggtatctccttgaggggggcgacggacgtggcgctggagacggcggacgtggtgctgctgcgaggcagcctcgatgacctgttgctggcgttcgacgcaggccgcgacaccctggcccgcgtccacctggggctcgggctggtgctggtgcccaatgccgtggccatggtgctcgcggcgctgggatggctgccgcctgtcgccgccgccgtggtcaacaacggctccacggtggtggctggcttcgccgcgctggcgccgctgttccgtcaggcgcgcgccgcccagcgcgaggattccaccacccactga

SEQ ID NO: 6439 - DNA, 384 bp, Myxococcus xanthus
ctgctgatggccctgataccggtggtgctgggcgtgggcttctggaccctcgccaagggtgaggagaagacgttccgcatcgtcacgccccaaggcttcaagtccatgcggggtgggatgacgacggagcaggtgcgcgccgtgctcggacggcccatcaccctggagcgggacaccaacggggcggagtgctaccgctacgggcagcccaacttcgtcaacccgcagttcctcatctattcggtctgctacgaggacgggaagctgcgggacgtgaagacgcaccagtactccgcctggaacgtggaccccgccacggggacgttcgcggcgccgggcgaggagcccgcggacgcggcgcccgtgcccgcgcaggaaggctga

SEQ ID NO: 6440 - DNA, 1116 bp, Myxococcus xanthus
ctctccagtggaggtggcggcacgcccaacgtgtgcgcggcgccttcctgccgcccctacacctgcggcctgctgggcaaggattgcggcaccgtgccgaacgggtgtggcgggttcctggagtgtggcacctgcacggcgcccgagtcctgcggagcgacgggcgttcccaacgtctgcgcggcgagcgcgtccgtgtgcgtggaccggaacctgggcagcgtgttgccggtgatggtgaagggctccaccgcgcacgcgggggatgaccatcagtcctcgtgcggagggagcggcgcgccggaccggggcttcctgtggacggcgcccaagagcgcgctcttcaccttcgacacggcgaagtcggccacccgctcgctcgtctccgtgcgcagcggcggctgcgggggcgcggagctggcgtgcgcgaaggacggcatcagctacggcggcggcgcgcgtgtttcggtgccgctggtgcagggacagacggtgctggtggtcgtggactcggcgagcctggaccggttcagcgcggggtacttcgagctgcacatcgatgagctgcgggccagcgaggcgggctcctgcttcgacggcatggacaatgatggggaccgctgggtggactgcgcggacacggactgccacgacgcgccgggctgcagcggccgtggctgcgcgcaccatgacttgggcagcgcgctgccggtgacgttccacggagagacggcgggttccggtgacggcttccaggggacctgcggcgcgctgctccagcaggaccgcgcgcacctgtggacggcgccgcgggcgggcacctacgtcttcgacacggcaccgagcgagtggggcaacgcgctctacgtgctcacgggttgccggggcacggagttgggttgcgcctccaacgcgaacgggagtccccaaggctcgcccgccgtgaaggtgacactggcgcagggccagacggtgctggtggtggtggacggcatggcgaatcccgaccaggacacgcccatccggtacacgctccacatcagcgaggacgccgccacggagacgggccggtgcgcggatggcgcggacaacgatgcggattccaactgccagtaa

SEQ ID NO: 6441 - DNA, 342 bp, Myxococcus xanthus
atgctgcactccaccatcgaggcgcgctggggctccccgaaggcctcgcgggtggtgggcgacgagaaaatcgagcacgcggagcaggagcaccaggagatgacgaagctcctgggtgacatcgtgcggatgcgcgacgacatgaacgcggtgaaggccaaggtcggcgcgctggagaaagtggtcaagcgacacatcgcggacgaggagaagaacatcctcccgcaggtggccaggaacatcaccgagaaggatctcggcatgtcctgcaaggacctggtccgcgaggcctcccggattcggcgtgaggagatgagagactggggcggcgcgtccctctga

SEQ ID NO: 6442 - DNA, 978 bp, Myxococcus xanthus
atgggaatcggcggaatcatcggtggcgcggcggatgccgctcgacgcgcggcggaagcggcgaagcgcgcggcggaggcggccgcgaagaaggccgcggaggcagccgcgaagaagaccgcggaggcggcggcgacggcgacgaagaccacggagcagattgcgtcggtcgccaagaagcacacgcaggacgtcttcgagcgacacgaggcgccgggcgacagcgggcgcgacgtgaagcagaaggaccgcgagacggtgggcgacttcttcgaggacctgaggaccaaggcgggcgacgcgctcaaggacacggcccagaaggtgggcgaggagctgggcaaggcgacggacgtcttggccaacgggctggaccagttggggcaggccatccaggacgcgccggcgcagaatccggtgcaggacttcgcccaggacctcgccgggggcatcctccagggcgcggccggcgtggtgcgcgactcggcgaagaccgtgggcgcggccaaggacgcgctcaacttcaacacgcaggtggaacagctcaagccgggcgagagcgtctccgtgggcctcaatgccgaggtggatgtctacgccgtcggcatcaccggcaagggtgacctgaccgtcagccgtagcgccgaggagggcgggggctacaccgtctccgccagcggagatgtgggtgcgggcatcatcgggaagatgggcggcaagggggcggcggacgcgagcgccagcgtgttcggtaccgcgggcggcacggtggagtacaagttcgacaccctggaggaggcccagcgcgccgccggcatcatcgcggccaacgccgccgtgtcgggcgcctcggggcagaaccccctgctgggcctggggttgaacttcgtgctgggcgacccgcggtcggagctggcgggcctgcgcgacaatgtgagcgcggtggagttcgagctgggcgcggaggggaacccttag

SEQ ID NO: 6443 - DNA, 408 bp, Myxococcus xanthus
atggccgacggcttcagccggctggtgacgcagcacctgcaactggcgcgcatggagctggccgaggacgtcaaggccacgggcctggacgtggcgatgatcgtggccttcgtgcccttcatcctcgtgggttatggcttcgtgtgcgcggcgctggcggcgtggctgtccacgtggttgggatgggccggagcgctggctggaatcggcctgctgaatctggtgggaggcgcgggcggagcgatgtgggcggtgaaccggctgaaggcgcgccggatgatggatgatacgtcgcaggagctctcgctcagcatggccgcgctcaccaacgccgcccccagcgcatccgtgaacgcgctccaggggacgaaccgtgaaatcttcaaggagcccccgcatggccggtag

SEQ ID NO: 6444 - DNA, 744 bp, Myxococcus xanthus
gcgcgggcattgatggagcagatcgcggatccgttctccggcttcccgaaggccgccgaggccaagctggaagaaggcatgcgctatctgaaggacctggatgcgccccaacacgccatcctcgccttcgaggagatcctgctcgactacccggacgtggcggtggtgcacgccctgctgggcctggcctaccaacgcctggatgacgcgggtcgcgcggtggatgagttcaagcaggccatcgaacgcgccccccgcgacggcaagaaccacttctatctgggcgagctctacctggcgcgccagcgccccgacgcggcccgagtctccttcgagaaagccgtggcgctccatccgctgctggagaccgcgtggttccacctgggtgacatccacctggagcgcagggacctcacggccgcccgcgagtccttcaccgtggccaccgcactggcaccggaagccgtggctatgcgaggcaagctggcgctcgtgtaccaactggaaggtgacttcgccgccgccgagcgcgagctgcgccgcgtggtcgaaaaggacccggagaacatggagttcagcctgcggctggggttgctctacaccgagcaggcgatgaaggcctcgcgccccgaggcgcggaagactgcggccagcgaggccgagcgttggctgatgaaggtgctggagacccagcctgaaaacgcggtggcgtcacgcgcgcttcagcaactcaaggcacagtag

SEQ ID NO: 6445 - DNA, 222 bp, Myxococcus xanthus
atggccggtagcaatggacagcccaaggcctacagtccccgcagcagcgcggacctgcgtgccgaaatcgagcgcacgcgcgccgagctggccacgtccgtgagtgcccttcgcgaagaagtggccgtggccgccgactggcgccagtgggtgagccgcaatccctacgcgtgtgtaggcgcggcgttcgtggtgggcctgtggttgggctcgcgcgactga

SEQ ID NO: 6446 - DNA, 201 bp, Myxococcus xanthus
atggagatgaatccgcagcagatggccgacagggcgcgtgagcttcaggaccgcgtggtgccgcagatagacgaggcccgtcagaacatcgtggacctgaacaaccgcgtggtgagcttcatccgcgccaatcccggcacgtgcctgctgggcgccgtggccgtgggtttcctcgtcggacgcattgcctcgcgccgctga

SEQ ID NO: 6447 - DNA, 435 bp, Myxococcus xanthus
atgacgacgtttccaggtgcatcgggcaatggcacgccgcaggacccgcagggcggcggcttcgggcagcgagtggaccacattggcagcgacgcgcagcagctctggtccgacgcgcgcggcgcggtgacggacttggggcagacgctggacctgcgggggcgcgtggagcgcaacccgtacgggatgatggcggccgccgtgggcgtcggctatctgctgggcggcgggctcttcacgccgctgacggcgcgcatcctccggctcggtgtgcgcctcgcggcgctgccactggtcaaggatgaactgttgggcatggccgaatcggccttccagggctatcagactggacgtggtatggctggtccgggcccgcagggctccgccgcggcgaacgccacttccgcaggcactcctcgcccgccgacgtactga

SEQ ID NO: 6448 - DNA, 237 bp, Myxococcus xanthus
atggtgaacttcaacaacctcaagaagctggacaaggacgacctgctgcacctggtgggcctggagacgcgtcgggacacggtggacacgctcctgcccgtcgtgggcgccttcgccggggcatcctcgtgggcgcgggcctgggcctgctgctggcgcccaagtcgggcaaccagctgcgcgatgacctccgtcagcgcctgcacagcggccaggagtacctgtccaacgcggtcg

SEQ ID NO: 6449 - DNA, 717 bp, Myxococcus xanthus
atgctggagagccccggcattcagtaccacgggcgtaaccccgactacgtgctgcgagggctgttgcgctgcggcctgtgcggcgaggcaatgacgcccggcagcacgcgcaagggcgagcgcgagtaccgctactaccgctgcgtcacccgggacaagcaggggaaggaggggtgccgggccgctccccttccggcagccgccctggaggacttcgtcgtcgctcagctgcgggaagtctcggtaggtgacggcttcgctgcccaggtgcatgcccgcctcacggcgcggctggaggagaaacaccaggccctgcgcgccgagcgcgcgcagttgccgagggacttggccaagcgtgctggggagtccgcgaagtgggtggactccctctccaagttggagggcccagcccggcgcctcgtcgaggagaagctgacggccgcggaagaggaggtcgccggcatgcgaaagcggctggcggaggtggagcgcgccctggacgccattgagggggagagggtggaggctgcgtgggtggcccaggccctggggaacttcgacgcggtgtgggacgccctcacctctacgaatcgggggcgcctgctgcgggccctcgtcggccgggtggtggtgaacgaggcgacgggcaaggtcgacgtgcatatggcccacgttggtgaggccgcagtgactgggcgcgaggaggtggcggcgtga

SEQ ID NO: 6450 - DNA, 276 bp, Myxococcus xanthus
atgctggccctggctcaccatgtggagtccgccattgggcggggcctcgtggcgagcgcagcggacgtcgcgggtcaactcggctttacccgagcgcgtgtgacgcacctgctggacttgctgctgttggcgcccgacatccaggaggaggttctcttcctcgaggcggtggagggagaggagcccctcagcgagcgaggactccgggccattgcacactcggggacgtgggaggagcagcgcgagcagtggcgtgaggtgaaagcttcattttga

SEQ ID NO: 6451 - DNA, 558 bp, Myxococcus xanthus
atgcagaacgacatgaagggcatcatccaggctgcggtggcggaggcggtggagaaaacgatgagccggcaactggagctgcaggagcggcaactggaactgctggggaagattgcgcagttcctgggcattgagtccggctcggctcatgcggcgtccgcgccgaagcgggcccccgtaccgtctcccgcgtcgaagcgcatacccgcgcccgcgccaacgtccacgccgaagcgcacgccctcggtgtccgtgcggaagtatgtgaggccggaggctgcgccgaagcccacgcgggccggccccgcgccccagaagagccgggggcgcccgcgcgcagcgggacgcactgcgacggccgcagcccccagcgccagtcccagccccgaggcgcccgtctccttcgcggtgggacaggaggtgcgctacaagcaagggcggggcgccttcacggcgaaggtgaaggccgtcgacgagaaggcgaagacggtgacggcggagcgcgtctccgacggcaagcaggtggtgcgccccttcgacaaggtgacgcccgcctga

SEQ ID NO: 6452 - DNA, 598 bp, Myxococcus xanthus
  unsure (1)..(598): unsure at all n locations
ctgctcaagcggctgcccctgctcgtcgtggcagtggccatcgtgaaggccaccgcgcagttcctccagggcgggctgatgcagcggctgggacagcgcgtgatggcggacctgcgcgggttcctctacggacggctgctcggccagccgcccgcgttcttcgagcggcggcactccggtgagctgctggcgcgcttcaccgcggacgtgcccctggtcgagttctccgtgacgcaggcgctcacgtcctacgtgaaggacgggctgcaaatcatcgcgctgctcgtcacctgcttcctcatcgacaagacgctgttcctcttcaccttcgtcgtcgtgccagtgacggtgctgcccatcaaccgcttcgcgcgctcactgaagaaggtggccacgcgctcgcaggagcggctgggctcgctgacggcgctcaccgccgagcagctccagaacctgcccgtggtgcaggccttccgcggacagccgcgggcgctggaggccttcgaggtggaggcggacaagtacctgggggagatgcgccgctcgctcttcctgcgcggcgcggtgagccncacggtggagctcctgggcatcgccg

SEQ ID NO: 6453 - DNA, 441 bp, Myxococcus xanthus
atgtcagcggcggcgggtcagaaacgcgactactacgaggtcctgggcgtccagaaatctgtctccgcgcaggagctcaagagcgcgttccgcaaggtggcgctgcagtaccacccggatcgcaatccggggaactcggacgccgaggagaagttcaaggaggcctcggaagcctatgaggtgctgagcgaccctgaacggcgggcgaagtacgaccgcttcgggcacgcgggcaaccccttcgacggcttcggtggcgccgggggcgggttccagggcgtcaacatcaacgacatcttcggcgagattttcggcgacatcttcggcggtggccggggagggcggcggacgagctcgcgtggcgcggacctgcgctacaacctggaaatcaccttcgaggaagcggccttcgcctgacggcgcaatgggaccattccacgc

SEQ ID NO: 6454 - DNA, 351 bp, Myxococcus xanthus
atggccgagtacttccgcaccatcggttatacggacatcaaggcgcgcctccccggcttcatgcctcctcccatcctgtcggggaccatcgaggaccatcgccccgacttcacctgtcggcagtcggattcggctcgcacgcccatcatcctggaaatcgtcaccccgcacatggtggacgagcccacggcggagaaccgctggagcctcttggccagcgccgcgaagctgtacaacgcggagctccacttcgtggtgcccaagtgggccgcgacgggcgcggtggaccccggactcaaacgcaggctggcccggatggagctgacggccaaccgcgtgtggaccgtctga

SEQ ID NO: 6455 - DNA, 795 bp, Myxococcus xanthus
atgcgcaagctcttttgcattttcgtggcgggcgtctggacgctcttctgtttcccccttgccatcttggcgatgctgctcacgctcaacccatcgcgctccgtctgggtggcgcgcgagctctggtcgcccgtgctgctgtgggcagggggcgcgaagctggaagtcatcggccaggagaacgtggacccgaatcggcccaccatctacgtggccaaccaccagtccaccatcgacatcccggcgcacttcctggccgtccccatccctttccgctacgtcgccaagacgcagctcaagtgggtgccccttatcggctggtacctcgcgctcgcaggccacgttttcatcaaccggtccaaccgctccaaggccatcgcctcgctcaacgcggcagcggccaagattcgcggcggcaccagcatcttcctgtatccggaaggcacccgctcgacggacggccgcgtcctgcccttcaagaagggccccttcgccctggcgctgaaggcccgcgtccccgtctgccccgtcaccatcgagggctccggcgacctgatgcccaagtccacctggaacatcacccccggtcccatccgcgtgaagattggcaagcccatcgacacgaccacgttggccgagaacgaccgcgaagggctggcccgagccgtccgcgccgtcatcatcgcggacagcctgtccctcgggggcaagggcggcgacgtggatgacgccgtggccgccgcgggcgccgagggcgtcagagacgcgcgcgcccgagccctctcctccccctga

SEQ ID NO: 6456 - DNA, 609 bp, Myxococcus xanthus
atggaggacgagtggctctggggctgggaccccacgccgggcatcgtctccgtgtgggcggagcccgacggccgcgccttcgtctggcgccgcgtccccaagacgggggagctgcttcgcgaggacgtgcgcttccgcccgtggttgctgctcgcgtccctggaggacctggcgcacctggggcctcggctgcgtccggagtcggatggccccgcgcgctaccgggtgacgtggcaggaactcgaagggcccggtgcgttgcgctacctggtccgcggagatgacggccgcgcgctcaccagcgcggtgctggaaggcgcgtcacgccgcctgggccagccggtgagtcacctgaaggagctgggcgcgaacacggtgctcgcgctgcctccggaggagcagtacctcacgatgtcgggccgcacgtatttccgcgacctcgccttcgatgcgctgcgccgcatgcagttcgacctggagaccaccgggttggacccggcgcatcaccgcgtcttcctggtggcgctgcgaggcccggacggcgcgacggagacactcgaagcccagggggatgacgactcggcggaggcgggacctgctctaccacct

SEQ ID NO: 6457 - DNA, 807 bp, Myxococcus xanthus
gatgcaacgcgcaagctctccgctgaaggcatggaggcgacgctccaggtgctggagtccttcgctcgcgaggcgcgcgagctgggcgccgaaggcatcgctgtgtccgccaccagcgccgcgcgtgacgcggagaacggcgcggagttcctcgccgccgcgaaggcgcgcgcgaatgtgacagtggaaatcatctccggtgccatggaggcggagctgtccttcgccgcggtgcactcggacttcgcgtcggacgcggcgggccctctgctggtgctcgacattggcggcggctccacggagttcatctacggcaaccgtggcggccacgtggacttccggcacagcttcgacgtgggcgcggtgcgcatgacggagcgcttcgtcggcgctgacccgatgacgtccgaggaccgcgcgcgtgtcgaagcccacctgcgcgacaccttccgcgccctccccgccccgccgcccggcgcggccctggtgggcgtcgcgggcacggtgacgacgctgtacgccgtgcagcacgccatccacccttacgtcgcggagcaggtccacggcggcacgctgtccgtgggccagctgtccgccctcgcggaccggctgtgcgccatgccgctggaagcgcggcgtgccctgcccggcatgcagcccaagcgcgcggacgtcatccccgcgggtgccctcatcttgctggagtcggtgaaggcgctgggactggatgcctgccgcgtcagtgacaggggcctgcgctggggtctgctcgcgcaccgctttggagccggagccacctcttcatga

SEQ ID NO: 6458 - DNA, 1210 bp, Myxococcus xanthus
  unsure (1)..(1210): unsure at all n locations
tatgcgctgctcatcctcaccctcatcaacctggtcaactacctcgaccgctacatcgtcgcggtggcgctgccagacatccagaaggaattcggcatcaacgacacgcagtccggcctgctgggcaccatgttcatcgtggtgttcatgctggcctcgccgctgggcgggttcctcggggaccgctacccgcggcggctgctggtggtgggcggcgtggttctctggagcctggccaccggggccagcgggctggccacctcgttcggcgcgttgctcctggcccgcgcggtgattggcatcggcgaggccggctacggcgccgtggcgcccagcatcatctccgacttgtacccgcgcacgcagcgcacgcggatgctggcgttcttctacatcgccatccccgtgggcgccgcggcgggctacggcctgngcgggtggctgacgcaggcctactcgtggcacgtcgccttcttcgcggggggcgtgcccggggctgattctgggcgccatggccttcttcatgccggagccccagcgcggcgccatggatgggccggacgcgcaggcgaagctgcccttcatggtgggcctgaagggcttggcgcggaactcggccttctgggcggtgacggccgggtacacgctgatgacgttctccattggcggcctgggcttctggatgcccacgtacctggtgcgcgagcgcggcctggcgcaggacagctcgggcttcatcttcggtgcgattactgcggtggccggcctgctggggacggtggcgggcggctggcttggcgacaagctggaccgcaagcgcgagggcggcggactgtggatgtccggcatcggcctgatgctggcggccccgtgcatgtacctggcggtgagcctgaaggccgtgggccccaccttcgcggcaatcgccctggcgcagttcctcatcttcctcaacagcggccccatcaacgcggccatcgtcaactgcgtgccgcccgcgttccgagccttcgccatgggactgaatgtgctgtgcatccacctgctgggtgacgcgatttcacccacgctcatcggcaccatcgcggacgcatccagcctgcacaccgccatcgcggtgaatgccctgcccgtgctcctcggcggcttcgcgctgctgctgggcgcccggctgttccgtgaagcagtgcccctcgcgcgtcagggctga

SEQ ID NO: 6459 - DNA, 1320 bp, Myxococcus xanthus
cggtctacggattccgtgcgtgcggtggtggcgctgtgtctccgactcttctaccgggtgaaggtgaatgccccggcgctggagccggacggcccggtgctcttcgtgggcaaccaccccaacggccttatcgacccggcgctggtgttcatcctcacgcggcgcaaggtgaccttcctggcgaaggcgccgctgttccggatgcccgtcatcggctggctgttgaaggggttggacgcgctgccggtgtaccggaagcaggatgacccggcgaagatgggcggcaacgagggcacgctggaggccgcgaagggcgcgctggtgcaggggcgcgccatcaccatcttccccgagggcaagagccactccgagcctgggctcgccgagctgaagacgggcgcggcgcgcatcgccgtgagcgcggcgaaggcgggggctccggtgcgcatcgtccccgtggggctcacctacgcggagaagcacgtgttccgcagcgaggtgctcatcgacgtggggcccgccatcgacgtgcaggacttcctgcccgcggacgccgcggcggaacccgatgccgtccgcgccctcaccgagcgcatcgccagcgggcttcgcgcagtgacgctcaacctggagcagtgggcggacctcccgctggcgcaactggccgagcagctcttcgccttcaagcagggtggggcgctcgatgcggagcgcctgcgactgtgggcgcgcggcgtccagatgttccgcgcgcaggagccggagcgcttcgagtccctgcgcgcgcagctcgccggcttccggcaccgcatggcgctggtgcaggcgacggggctggaggacctggcgctcgtgtaccggccggggaacgtggtgcccttcgtggtgaagaacgtgctggcgctggcgctgggcctgccgctgttcgccctggggctgggcctgttctggctgccctaccagttacctcggctcgccagccgaaacgccgaactggacgtgcaggccacggtgaagttcctcaccgccttcgtggtggcgctggtgtggtggggcgtgctgacagccgccgcggcggtgtggggaagcgcgctcctgtccgtggccgtcttcctcgctgtgccaccgctggcgctgttcaccctctacttcgccgagcgctgggagtcgctccagcgcgacatccgcgtgttcttcacgctgggcaaccgcgcgcgcctcaagcgcctgctgctcgcggatggcgagcggctggccttggagatggagcgcctggccgacgagtaccggccaaggctggatgccgccgctcagccctga

SEQ ID NO: 6460 - DNA, 1095 bp, Myxococcus xanthus
ctggtgcgctacgccctctggcgccgcatcttctgtggtgagggctgggcccgcatcggtcccgaggtccgcttgccggggcccgtgcgtccgcgcaccatcaaggacgatctgctccagcgcgtggtggaacagccgctgccggaggcgccgctcccggagtcccagacggagcggctggccattcgctactcgttccccaactggttggtgcagcgcctggcccaggtgtacccggaggatgtgctggaagggctgctggcgtcgctcgatgaggagccgtcgctgcacttccgcgtgcggcccccggggacccgggacgcggtgctggcggcgctgaaggaagagggcgtcaacgccgaaccggtggccgcggcgccggatgctgtgcgggtgacggactccagccaccgcgtcttcgagactcggatgatgaagtccggccggctccaggtgcaggacgtgggcagccagctcatctccgagctgtgccgtccccgggagggctcgctggagggcttcaccgtggcggacgtgtgcgccggcgcgggcggcaagacgctggcgttggcggacttcgtcgggccccagggcagggtgctggctggggaccgttcgcggcgtcggctggctgaggcgcgcgagcgcgtgcgccacttctctctccggcaggtcgcctttccgcatccgcttccgctgtccgacgcggacgtccttctgatcgatgcgccgtgcagcggcacgggttccctggcgcgcgagccggatcagaagtggaagctcaccgctcaggaaatcgccaagtaccaggccacgcagtcagagttgctggatgaggtgtcacgccaggcgaagccgggggcactcatcgtctatgcgacctgctcggtgatgccggaggaggacgaggcggtggtggaggccttcctcgcgaagcatccggacttcacgctggagccggtcgaggacgtactcggcgcggagcgggcggcgctcgccgcgcaggggccctatctgaaggcgttgcctcccaaggttcccgggggaggattcttcgcggcccggctgcggaggacaggggcggggccgggttga

SEQ ID NO: 6461 - DNA, 1494 bp, Myxococcus xanthus
  unsure (1)..(1494): unsure at all n locations
acgtaccgcctggacgacaccgcgcagnacaacctcctgtcggactactggggtgacgtggagagcgtgcagggcgtctacccgaaggtgcgcttccagtacctggtggacatgccgcaggcacggcccctgtattggaacaagagcaagctgaccggcgtggcgagcgcgcaggagacgctggacgccggccgcgtgctgtaccgctggaacgccaagcacgtcgccaaggtggtgccggagcccggcatgcccggctgggcggaggtggcgcagaacctccacgtctccacctaccagacgtgggagcaggtgggccgctactggtggggcctggtgcgcgaccagctccagcccaacgcggagctgcggcagacggtggaccaggtgctccagggcgtggaccggaagaacgagctggcggtggtgcgcgccatctacaacttcgtggtgacgaacacgcgctacgtggcgctggagttcggcatccacggcttcaagccctaccgcgtggaccgggtgctggcgcgccgcttcggcgactgcaaggacaaggcgagcctcatccactccatgctccaggtggcgggtgtggagagccggctggtgctgctgcgcatgcgcaacctgggctccattggcgaggagcccgcgagcctcgcggccttcaaccacgccatcgcctacgtgcccaagttcgacctgtacctggacggcaccgcggagttccacggcgccaacgagctgcccagcgcggaccgggtggccaacgtgctggtggtggagcccaacggcaagagcaccttcctcaccacgccggaggcgaaggcggcggacaacgccacgcgcatgtcgctggacgtgacgctccgcgcggacggcggcgctgaaatcaccggctccagctccgtgggcgggcagcacgcgcccgactaccgccgcgcctaccggccggaggccacgcgcaagtccaccttcgagcgcgcctgggcgcagagcttccccggcctcacggtgcacgaggtgaagctgagcgacaccacgcggctggatgacaacgtggcgttggacttcaagatgagcatcccgcgctactcggaggtgctgcccaacggcatgcgcttcctgcccttcggcaccgggcgcacctaccagcaggcctatgcgtcgctggcccagcgccgcttcgacctggtgatgtccagcccgtggaccaacggtttcctcctgcgctacgcgctgcccgcgggctggacggtggcggagctgccccaggccgtggaggagacgacgaagttcggccacatcaagctgagctaccgcctggagggcggcaagctggtggccgagggcgaggtggccctcaccaccgcgcgcgtgtccgcggacgactaccccgcgttccgcgagttcctcggccgcgtggaccgcgccttcggccgccgggtgttcatccagaacgcggccaaccgcaccgcgtcctcgacgccgtag

SEQ ID NO: 6462 - DNA, 2178 bp, Myxococcus xanthus
gattctctccttcgagagtatctctccctcttcttcagcgacccgaagggccaggcccgcaacgcggcgcagtacctgcgggacgtgatggaccacttcggcaccaccacggtgccgcaccccactggcaccatccgacgcttccaggtcttcgacgtacccggcagcgaccgggacgaccgggtggcgggccaggaggaggtgcagaacgccatctaccggttgctcggcaacttcgtgcgggccggccgtatcaacaagctcatcctcctgcatgggcccaatggcagcgccaagtccacgctcgtcaatgccctgaaggcgggcatggaggcgtactcgcggctgccccagggcgcgctctaccggctcgcctgggtgttcccgtcggagaagctcatcaagggctccatcggcttcggcgagcgggactccgccagtggggagatgaccaccttcgcgcacctggacgcggagtccatcgacctgcgaatgccgtgcgagctgcgggaccacccgctcttcgccgtcccgcccggcgagcgccgcaggctgctggagacggcgctcaagaagaagggcctgggcaacggggacggggagagtggcgacttcatcctgtccgactacgtgcgggacggcgagctgtgctccaagtgccgccgcatctacaccgcgctgctcaattcctacggcggggactggctgaaggtgatgcgccacgtccaggtggagcgcttctatgtgtcgcgccgctaccaggtgggcacggtgacggtggagccgcagatgagcgtggacgccgtcgtccagcagctcaccgcggaccgcacccagctcaacgtgcccgcgccgctgcacagcacggtgctcttcgagccgcacggccccctggtccacgccaaccgcggcctcatcgagtactcggacctgctcaagcggcccctggaggccttcaagtacctgctgggcttcagcgagacgggcgaggtgccgctggagcccttcgtcctccagctcgacgaggtgctcatcgcgtcggcgaacgagaagcacctcaatgccttcaaggagctgccggacttcgcgtccttcaagggccgcatcgaactggtgcgcgtgccctacctgcgccgctaccgcaccgagcagcagatctacgacgcgcagatcacctccaccaccgtgggcaagcacgtggcgccccatgccacggaggtggcggccatgtgggcggtgctcacccggctgaagaagcccattccggaccgctacccgcaggacgtgaaggagctcatcgaccaggtgacgccggtggagaagctgcacctctacgaggagggcgcgccgccggaccggctgagcctggccaacaccaaggagctgcgcaagctgcgcgaggacctgttcacggagtcggacgcgtaccccaactacgaggggcgctcgggcgccagcgcgcgcgaaatcaagacggcgctcttcaatgccgcgcagaacaccgactacaagtgcctcaacgcgctggcggtgctggaggagctgtccgccatctgcaaggacaagagcgtctacgagttcctcttgcaggaggtggtggacggctaccacgaccatgacgccttcgtgcggctggcggaggcggagtacctggaccgggtggactcggaggtgcgcgagtccatgggcctggtgtcggaggggcagtaccgcgagctggtggagcgctacatccagaccatcagccactgggtgcgcggagagaagatgcgcaaccgcgtcaccggggtgatggaggcgccggaagagcagcgcatggtggaggtggaggtcatcatcatgccgcgcggcgaggacgcagccgacttccgccggggactcatcgcctccatcggcgcgcaccggctggacaacccggacgcggtcatggactacggccgcatcttcccggacatgttcaagcgcctgcgagatcactacttcgaggagcgcaagcgtgtgctgcgcaagaacaaggagaacgtcctcaagtacctgtccgaggaccgcaaccagctcaccgcgcgcgagcagacgcaggtgcagagcacgctgaagacgatggcggagcgctacggctactgcgagtcgtgcgcgaaggacgccatcctcttcctgatgaagaagcgctacgcgtga

SEQ ID NO: 6463 - DNA, 471 bp, Myxococcus xanthus
aacgcgtcgctgcgggagaacatcaccctgagcgacccggagctggacatggaccgtgtcgtggaggccgcgaagctggcccacatccacgacgacatcatggccatgcccatgcagtacgacacgccgctgacggaccggggcctctccatgtccggtggccagcggcagagactggccctggcgcgcgccctggtgcgcaggcccgccatcctcctgctcgatgaagccaccagcgccctggacgccaccaccgaggcgcacgtgcagcaggcgctggcgtccctgaagtgcacgcgcgtcgtcattgcccaccggctcagcacggtgcgcaacgccgacaccatcctcgtcatggaggccggccaggtggtggaggtcggccggcaccaggagctgctggagcgccagggcacctacgcggccctggtgaatgcccaacgggaggagcgcgccgtggcgacgggctga

SEQ ID NO: 6464 - DNA, 1455 bp, Myxococcus xanthus
atgaacctgcatgactacagccgctttgacgcagtgggattggcggagctggtacgtcggaaggaagtcacgcccgaagagctgctccgggtggcggtggaggccatccacgccgtcaacccggcactgaacgccgtcatcgacacgcgagagggcgacgccagcgaggcgctgaagcaaggcattcccgagggccccttccgaggcgttcccttcctcatcaaggacattggcctgcacgccgcgggtgtgcccaccgacatgggcagccggatggcccaggggacggtgttcccccatgacagcgcgttgatggcgcggtaccggcgcgcgggcctggtgctgctgggccggacgaacgcaccggagttcggcaacaacgccaccacggagccggtgctgcacggccccacgcgcaatccgtgggacgtgaagcgcagcccgggcggctccagcggcggctcggcggcggcggtggcggcgggcatcgtcccggtggcccacggcaacgatggtgggggctcgctgcgcatccccgcggcgctttgcggcgtcttcgggctgaagcccacgcgtggccgcaactcattggggccggacgcgggtgacttcatcttcggcatgggcatcgagcacgtgctgtcccgcagcgtgcgcgacagcgcggcgatgctggacgccacccaggggccggaggtgggcgacccgtacttcgccccgccgccgcagcgcccatacctggaggaagtgggccgcgcgccgggccggctgcgcatcgcgctgatgacggaagcccccatgggctcaccggcgagcgccgaatgtgtggaggccgctcgagcggcggcgcgcctgtgtacggagctgggccatgacgtcgtcgaggccgcgcccgagcacgacggccaactgctgcacgaggccgtctgcaccgtctggtcggcgaccatggcgtccctggtgggcatgctgggccagttctccggccgcgacccgggaccggagctgctggaggccaccacctgggcggcggtgcgccacggccgcgagctgaaggccacggacctgcaacgggcgctcggggtgttcaacctcgtgtcacgtcaggtgggcgccttcttccagcagtatgacgtactgctgtcgcccacggtggcggcgccgcccttcccgctgggcctgctggacgccaacgcaccccggacggcccgcgagtggtacgaccacgcgttcggccactgcccctttaccgcgctcttcaacgtcaccgggcagcccgccatgtccgtgccgctgcactggagcgcggaggggctgcccatcggcgtccagttcgccggccggtatgccgccgaggccacgctgttccaactggcgggccagctcgagcaggcgcggccctgggcccagcggacgccaccggtgcacgtcacccggcccgcggagtcgccgtga

SEQ ID NO: 6465 - DNA, 627 bp, Myxococcus xanthus
gccgtcacgatgggacagctcaaggtccacacgcagctcgcggcggaaggtgacccgtgcacgggtccgaccctgtgtcagcccgggctcgtctgtgagggccgcccgggtgacggctccagcccttatggccgctgcgtcgacgcctcgtacttccccggctacggcgaggtgtgctcccgcttcgtcgcgtgccagaccccgaagtcggtctgcatcggtctggcgtcgggctcggtggagggctactgcgccccggcgtggatgggcagctccttcaccgagtactcggacctgcggctccagtcgacgaacccgctggtgacggcgccgctcgtcgcggtggggttggccacggtgcccatggacatcaacgtggagctggacatcgtccacaccgcgccgcaccggctggtgctgacgctggaggacccgggtggtgagacggccctgctgtgggacggtccgaacgagggcacgccgccctcgcgcatcgtcgtgacgcggggcatcccgcgcgacggcgccgtcaatggtcgctggaagctgcacatcgccaacccgtccggggtgggcagcggcacgctgcgctcgtggacgctgaagctcaccagccgctacgactga

SEQ ID NO: 6466 - DNA, 765 bp, Myxococcus xanthus
atgtcgctgcgcttcaccatcgcggcgttggccatgggcgcgctgctcctcggcgtcgaaggctggaagccgcttccgcgcccggtgttcctcaagctgctggggctcgggctggtgggcaacaccgtgtaccaggtgtgcttcatcgtcggcttggcgaacacctcggtggcgaacagcgggatgctgacagcggtgacgccggtgctggtggccacgcttggcgccgtgttcggcgtggatcggctcacccgcccgctcatcgcggcactggcgctgggcgtggtggggatgctgctggtgctggggggacgcggcgcgtccgaacatggagcgtccttgattggcgacgggctcatcgtcggcgcgagcctctgctgggccatctacacggtgggcatccgcaccgtgggtccggaggtgtccgcgctgcgcatcaccgccatcagcatgctcacgggcgcaccgggcgtggtgctcgtgggcgtgcccgagctgctgcggctggagaccgagaacatccgcgccggcgcctgggcgggcgtcgtgtactcggcgctggtgccgctggtgctcgcgtacttcacctggggccgcaccgtgcagaaggtgggcagcagccgcgcggggctctacaacacgggcatccccgtggtggccgccctcacggcgtgggccgtgcgtggagagcagcccacctggatgcaggtgctcggagcggggctcgtcctctccggcgtgctgctcagccggcggaagtcgtag

SEQ ID NO: 6467 - DNA, 1796 bp, Myxococcus xanthus; identical to SEQ ID NO: 455

SEQ ID NO: 6468 - DNA, 84 bp, Myxococcus xanthus
atgggggtcatcctccggctggggcgcttcgtgggagcggtggagccgggtccgcatttccggatgccttttgggtggtccgca

SEQ ID NO: 6469 - DNA, 1014 bp, Myxococcus xanthus
aaccgacgaatcgtgctcgcatcccggcccgaaggacgtcccactggggagaacttccgcatcgaggacgtctccgtaccggagcccggcgaaggtgagctcctgctgaaggtccagtacctgtcgctggacccgtacatgcgaggccggatgagcaccgcgaagtcgtacgcccgcccactggacctgggcgaggtcatcgtcggcggcaccgtcgcccgcgtcgtccgctcccgacacccgggctacgcggaaggcgacatcgtcctctcctactcgggctggcagacctattcgctgtccaagggtgaaggtctgcgcaagctcgacccggccgccgcccctgtctccaccgcgctgggcgtgctcggcatgccgggattcaccgcctactcgggcctcttcacgattggacggcctcagcccggtgagacggtggtcgtcgccgcggccagcggtcctgtcggcgcgacggtggggcagttggccagaatcaagggcgcgcgagcggtgggcatcgcgggcggaccggagaagtgcgcgtacgtgcgtgacgagcttggcttcgacgccgtcgtggaccaccacgctccggacttcgccgagcgtttgaaggaagcctgccccaagggcgtggacgtttacttcgagaacgtgggcggcgcggtctgggacgccgtcttcccgctcctcaatccgttcgcgagagtccccgtctgcggcctcatcgcctggtacaacagcacgggtcccttcgagggcccgaaccggctgcccctcgtcatgcgcgacgtgctctccaagagcctgacgctgcgaggcttcatccagacggagttcgtcagccagctcccggatttctaccgggacatgagcgcatgggtgcgcgagggacgcgtgcgctaccgcgaggacatcgtcaacgggctcgaccatgcgcccgaggccttcgtcgggctgctggaaggccgcaacttcggcaagctcgtggtgaaggtggacgaaacggcatga

SEQ ID NO: 6470 - DNA, 207 bp, Myxococcus xanthus
  unsure (1)..(207): unsure at all n locations
tcacgcacggcatcggngcccttgcatcacttcatggagcacgcgacccccgcggttgcggcggtgccaggcgttggcggactgctgggcgcgctcgtgccgtctctgatgaacgcggtggccggcgtcatcgcgggtggcctcatcgttctgctggtgacgggcgccacgcgggccttccagtccgtacgggccaagccgagctga

SEQ ID NO: 6471 - DNA, 213 bp, Myxococcus xanthus
ctcaaggcctttcaccggattggtttcgagcccgacggaaaggtccacttccagtatcaggtggtggtgcaggagagccccgtgggcgagccggaggtgtcctgcatcgcgcggggtgacttcgacggcgacgggctgaactccctctaccgcgttcgtctggatgccaacggaatgacgacgcccatcgaggtggagcgcgagggcgaatag

SEQ ID NO: 6472 - DNA, 744 bp, Myxococcus xanthus
atgggcggccaggagcgcgcgccggtgaagtcggtggcggagctggtgccaccgggcctggaggacacgccggggcaggaggcattgggccagcgcttcgggtcggacgcggcgctgctggcctcgcatctgtcgcctccgcaggtgccaggctcggagcgggccacgcggctgtgggcgttctacacggcctacgccacggcggcggcgcggcacccgccccagcccgaggcgcgccaggccttccgcgaggcgctggaggggcagggcttcggcgagctgcgggacgcgcgcaccggcgaggacggcgtgacgcggggcctgtgggtgatggaagcccgcacccccgccgaagcccggacgcgagccgccgaggtgcggctggatccgcctcccgaggtgcgccactcggaggaagccgcggcccggccagccgagcagccgctcgtccaggcggccggcgcccgcgcggccacggcccttcacggcccggtcatgcccgcgctgcgtccgcgcgacgaggcctcttcatcggaggacgcgcagcaagacggggatacccagcgccgacgcgggacgaaccgccgcctgggcgcgcggatgctgtggaacgtgctgcaccgcttccgcgcggggccggacgacggggcggtggcggaggggcagtgggaccgggtgacgtttggcgcactgctggtgctgctggccatcgcgctggccgtggcggcgctcgtcagcctctag

SEQ ID NO: 6473 - DNA, 606 bp, Myxococcus xanthus
gacgacctcactctcgtcaagcgcgtccggaccggcgaccagcgcgctttcaaactcctcgtcgagcgttaccagcgcaaggtgtacgccgttgcgttgggcatgctgaaggacaaggaggaagcgatggacgtctcccaggaggcgttcgtcaaggtctacaagtatctggaccacttcaagggcgactcgtccttctacacgtggctctaccgcatcaccgtcaacatctgcatcgacgtcatccgcaagcgtggcggaggcggcgaggtcgtggagttcgacgagagccagtccgtggacctgtccgaggcccgaatcggcgccctgggcagccggctgggcaccaatccccagaagagcgccctgcgccgcgaactggcggagaagatccaggaggccctggccacggtgccggagaagcatcgggccatcctcctgctgcgggaaatcgagggcatgtcctacgacgacctcgcccgcaccctggacatccccaagggcacggtgatgagccggcttttccatgcccgggccaaggttcagaaaatcctcagtgaatacctggagttggacgaagcgaagagcggcgtgggcagtgattga

SEQ ID NO: 6474 - DNA, 549 bp, Myxococcus xanthus
atgcgggccgtgctggaggagaagctcaagctggacggcgtgcggtgggacgagttcgtcctcaaggacaacgtgggcaacctgctgcgcggccgttttcgggccctgcgcgggcaggtgggctacaagctgcccgcgattcttgagagccgggtgcatgcgccggtggaggcggaggaagtcctcttcggtgacgacgcggaggcggacgcgttcatctattcgctcttcgcggacctggtggcgggccgcgtggacgagcgcgtgttgtcgcaggtgctggaggcgggcggggtgtacccggacgacgcgctgcgggtgcgcgaggcgtggaagaagattccggtgggcgacccggtgcgccgcatcttcatccacctggacaggctgacgccccccgcgcacttcacgccctacggaccgcgcgtggtgcccatcttcaactacttccaggccgcgctggtgctgctggcggacgcccacctgacggcacccgaggtgctgaaaatcgcagtggagatggtgcagacggcgggccacaacattatc

SEQ ID NO: 6475 - DNA, 852 bp, Myxococcus xanthus
cgcatctccgtgcagcacgcggcggacttcatcggcatggacgagaagccaggcgaggcgctggcgcgcaagccgaacgcgtccgtggcggtggccgcgcggctggtggcggagggcgaggcgcaggcgctggtgtccgcgggcaacacgggcgcgggcgtgctggcgtgtgcccggcacttccagctcattcccggcgtgcggcgcgcggcgctggccacggtgtacccgacgcgctcggtgcgcggcgcgaagggggacccgttctccctcatcctggacgtgggcgccacggtggaggccaccgcggatgacctggtgacgttcgcggtgatgggctccgcctacgcgcgcatcatctcccagaacgagcgccccaaggtggcgctcctgtccaacggcatcgagccgcagaagggcccgccccgcgtggtggaggcccatgcccgcctgtcggagatgaaggacatccacttcatcggcaacgtggagggcatcgacatcccgaagggcaccgcggacgtcatcgtcaccgacggcttcgtgggcaacgtctgcctgaagatgctggagggcgtccacgacacggtggtggagctggcccagtacgcctacaaggagagcctgcggtggcgcgcggggctcgcgatgctgtccagcggcatccagcgcatcaaggacatcaccgactggaaccagtacggcggggcccccatcctggggttcgataaaatcttcatcaaggcacacgggcgttcgaagtcgtgggccatcgccaacgcgggcaaggtcgcggcgaaggtggtgtcgaacaacctgggcgccgccatccgggaaggcctgaagaagtga

SEQ ID NO: 6476 - DNA, 570 bp, Myxococcus xanthus
atgagcgcccccctctcctggaaggccgcgttcaccacgctgctgctgtcctccgtccccgccgcggcccagggctccgccgctgctccgaagcccgccacggcggctccggcgcagcagggcgtgacgctccccaaggccaccaccgtcacgctgaagaacggcgcgaagctccagctcgtggagcgcaaggagctgccgctcgtctcgttcagtgcgtgggtgcgcggcggcgccctgggtgaccccgctggcaaggaaggcctggccgcgctcaccggtgagctgctgcagaagggtgccggcggccgtgacgcgcgccagttcgccgaggccgtggacggcgtgggcggcgagctgcaggtggccgccaacctggaggccctggtcatcagcggccagttcatgtcgcgcgacaccgggctgatggtggagctgctcaccgacatgctcacgcgcccgcgcttcgacgcgaaggagctggagaaggtcagcgcgcgcaaggcctctgagatcgccgccgcgaaggatggcgacccgcgcatgctgagtggcgcgcacatccaagcg

SEQ ID NO: 6477 - DNA, 1263 bp, Myxococcus xanthus
atggaccgcaagtccctgtcgcgcgccgcgctgtcggccgcgctcgtcaccgctctgtccgctgccctgtccctggccgaggagagcccgattctcaagcccgtggagaagcccgcgcccgccaagacggcgacgccggccgctcaggcgaagcccgctccgaaccagaagcccgcgcagccggcgccgtcccagcagcagcaggtccccgccgccgcccggccggagattgaagtggtgttcgtgctggatacgacgggctcgatgagcgggctgctggagggggcgaagcggaaaatctattccatcgcctcgcgcatcgcgcagggccgtccgacgccgcacctgaaggtggggctggtggcctaccgcgacgtgggcgacgactacgtcacgaagcgcttcgacctgagcgacgacctggacacggtgttcgccaacctgcgcaagttcgaggcgggtggcggcggggatacgcccgagcatgtggggcgcgggctgggcgaggccgtgtccaagctgtcctggagcaagaaccgcgaggtgatgaaggccatcttcctggtgggggacgcgcccccggcgcagcgcaacgacgactgggacttcaagcactgggcgaagaaggcccgggagaagcacatcgtcgtgaacaccgtgcggtgcggcggggatgcagagacggaggcgtcgtggcggttcgtggcgaagctgacggacggcaccttcgactccattgaccagggcggtggcatggtcgccgtcgccacgccgtatgacgcggagctggcgaaggtgaacgcggagctggccaccaagacgctctacacgggccgcagggaggtccaggcggagaacatggcgcgcgccgcttccatgggggcgctggcgccggaggcggcggccgagcgcatcagctacatgaagaagacgcgcggcggtggggccgcgggagcccccgcgagcagcgcgcccaaggcggtgggcggcgcggtggacctggtggaggcgccgtccgcgctggatggcgtgaaagcggacgagctccccaccgagctcaagggcatgtccaaggaggctcaggtcgcgaaggtgagggcgctctccgaggagaagaaggcgctggagaagaaggcggagacgctggccgcggagcgcgaggcgtggctgacgaagaacgctcccgagaaggaggacgccttcgacgccaacgtgatgaagggcgtgaaggcgcaggccgcccgctacaacatcgcctactga

SEQ ID NO: 6478 - DNA, 1276 bp, Myxococcus xanthus
cacgaggccacgcttcccaacggcctccaggtgcggttgctcgccaaccaccaggctcctgtcgtcagtctctacaccgtgttccaggtcggcagccgcaacgagcggcccggcatcaccggcatcagccacctgttcgagcacatgatgttcaacggggcgaagaagtacggccccggtgagttcgaccgcgtcatggaggccaacggcgggcgccaacaacgccttcacctccgaggacgtcaccgtctacatggactggttcccgcgctccgcgctcgacgtcatcttcgacctcgaggccgaccggctccagcacctggccatcgaccccaaggtcaccgagtccgagcgcggcgtcgtgtactcggagcgccgctccgccatcgacaacgacaacatgggcgccctgatggagcaggtgcaggccaccgccttcgtggcgcacccgtaccagttccccgtcatcgggtggccgtccgacatcgagtcgtggcgcatcgaggacctccagcgctactacaagacgtactacgcgcccaacaacgccacgctcatcttcaccggcgccgtgacgcccgcggaaatcttcgcgctcgcggagaagtacctggagcccatcccctcccagcccgcgccggagcccgtccgcaccaaggagcccgagcagcagggagagcgccgcatcgtcgtgaagaagcaggcccaggccccgctcatccaactggcctaccacggcatctccggcaaggacgcggacgtggaagcgctcacgttgctcctgagcatcctcaccaacggcgactcctcgcggctgcaccgccgcctcgtcgaggaggagcgcgccgccctccgcgtcaacacccacttcagcccgggcttcgacccctcgctcgtctgggtctacgcggacttgccgcccggtgctgacgtcgccaaggtggaaggcctgctcactgaggagctggcccgcgtcgtcaaggacggcgtcagcgacgccgagctcaagaaggcgcgcaacatcaccctgtcccagttctggcgcagcctggagaccaacaacggccgcggccgcgcgctgggcgccgcggagacgttccgcggtgactaccgccagctcttcgacgcgcccgaccgctatgagcgcgtgacgcgtgacgacgtccgcaaggtcgccgcgcgcatcttcaactcgcagcgccgcaccgttggttggctcgtgcccgccgacgcgcaggccgccacccccgactcccgcaaggaggcctcgcgatga

SEQ ID NO: 6479 - DNA, 666 bp, Myxococcus xanthus
atggacccgacccgcatcttcgtcgtcgaggatcaaccccagctcctcaagaacctggtgaaggtgctggccaccttccccgaactggaggtggtaggcacctcccaggaaggggaggccgcggtggaggacatcgtccagctccgcccccagctcgtcctcctggacctggagttgcccggcatcaacggcatccaggtgacccagcgggtgaagcgccgcgccccggaggtggagatcctcatcctcacgtccttcgatgacgagacgaaggtctacgaggccatccaggccggggcctccggctacctggtgaagcgggtggggccggagaagatccgctccggcatccaggaggtgatggagggcgggacagtcttggagcccatcatcgccaagcgcttctggaactacttccagtccgttcaggcgaagtccacccaggcggagaagaagctggagaacccctgggcgctcacgccgctggagttcgaggtgctgcgctacgtggccaagggcctgtccaacgccgaggtggggcacgtgatgacgctggagcggcggacggtgcgcacgcacctgtcgcatatctaccggaagatgggcgtcaactctcacgtggaggccgtggtgatggccctgcgtgcgggtgtcgtggatctatag

SEQ ID NO: 6480 - DNA, 525 bp, Myxococcus xanthus
ttgtccgtggcccagcaccggtatggacgccggttgggcatcgcggcggccatcgccggggtggggttggtcaccttcctggtggctgcatggcagctcgggggggattccgcacccgcgccggaggaggccccgcgggaggcgaaggccgaggccgcccccgtgggcccaccgcccgccatgcccatcgcgccgccggtgccggtgccagtgcgtccgccgccgcccgctccagaagccgcgtcgcgagggggcgaggaggacgcggcccccgagccgaagcctcccccgaagtctcagcgcgcgtatctcaccatcaccaccaatgtgccggcgaccgtctacgtcgacggcgagcggctgagccgccgtacgcccctcaaccgataccccgtcaaggtgggcacccggcgcatcaagctggtgtccgtcgccaccggtgagcccaaggagctggacctgcgcatcacgcgggggcagcacctcaaggtcctggtggactcgttcacgtctccgaggcggtga

SEQ ID NO: 6481 - DNA, 1646 bp, Myxococcus xanthus
tgctctacgggagcgacccgggtggagaccaaggaggagttcgccgacaagacgcgcagccgggcgctgctggcggacgtcggcttcggcgtgggactggccggtgtcatcaccgccatcgtcctctacccgaaggatggccccccggttgcgggtgaggtgcgagtcacgatggcgcccaagggcgctggagcaggaatggcggtgagcttctgatgcgcgcgctgcgattgatgatgacgggaagcaccctgctgatggccgggtgcagcttcaccaccgccagtgggctgaccgagtgcgagacgtcctctgactgtgaaaccgcgcaggtatgcaccgctggctactgcctgccgcagccagagggctgtggagtggtctatggcccggcctccgcggccaacgccattcccctgggcgccgcggtgccgctgagcacctccgacggcccggacgagtccgaggtgcaggcgctcaacgccatcaagctggcgctcgacgaaatcaaccagcgcgagggcgtcaacggccggcccttcgtcctccacatctgcgacacgcgctcggagccgaaccgcgccgccgagcaggcccagtggctgatgcgtgagcgccaggtgccgatgatcttcacctccagcagcgcccaggcgctcgcggtgtcctcgttcaccgtgcccaacggcgtgctgatgatgacgtacagcgccaccagcccggacctcgccgccatcaacgaccagaacggcaccacggcaggcctcgtctggcggacggccccgtccgacgtgctgcagggccgcatcatcggagacctgctccagggcgccatcctggtgaacggcgcaccgctctacgacagcatctccaaggtcggcatcagctacgtgaatgacgcctacgggcaaggcctcttcggcgtgacgctggggcgcatcgacaccacccagcggaccgtgacgtccgcccagtacgcccgcaacagcgccgacgtctccagtgtggtgcagcacatcaccaccagtctgccggatgtcgaggtcctcatcggcttctccgaggacaacgcgcgcatcatcaaccagacggctgccgcgggccggaacacccagcggtggttcttcaccgacgccggcaaggaccggggcctcttcacctcgctgggcgccaacgccgcgctcgtggacgattcctacggcacgtctccagcgcaggcccgtccagacctcgtctatcaactgttcgcccagcgcttccgctccgccttcaaccagacggacccgggccagtactccttcaccgcgcacgcgtatgacgccatgtacctggtggcgctcggcgccgcgtacgccgccggtcccgacgtcaacaacccgcaggccatcaccggcgcgcgcatggcggacggccttgcgctcgtgacgccgggcgaggcaggcacgtccctgaactacaacctgggcacggagggcttcgcgggcgctcgcgcggccatccgcaatggacaggtcatcaacgtgacgggcgccagcggcgacctcgacttcgacgccacgggcgaggcgccgtccgagtacgagctgttccgcgtgaaggacggcgggttccagacggtgcagctcatcgcgccgcccacggagtga

SEQ ID NO: 6482 - DNA, 255 bp, Myxococcus xanthus
gtggtcccggcggagggcgggtggagctcggtggtccggattccgagggcgcccggtgaggaggccacctgcctggccctgctggacgcgggcgtgcgggtgcagccgggctacttctacgacttcggcggcggcgccttcctcgtgctgtcgctgctgccccagcccgaggatttcgcccgccgccgtcgaggtgctcgcgcggacgttggggccctgaggccccgtcacgtcactccgtgggcggcgcgatga

SEQ ID NO: 6483 - DNA, 915 bp, Myxococcus xanthus
atgctcgagctccgtcacttcaagctgattgccgcggtcgccgacacgggaagcctggccgctgcgagccggcagcttcacctcacgtcctcggcactgagtcaccaactccgcgatgccgaggagcgcctgggcgtgcagctcttccagcgtcgccagcgccgcctgctcctgaccggcgcaggcgagaagctgctcctctccgcacggcgggtcctgagcgaggtggcccaggccgaggcggtctgccgtgcgcacccgcaggacgacctgctccggctcagcacgggctgctacacggtgtatggctggctgccgcccatcctggggcggtggcaggccgagcacccacgcgtcgagctgcgcatcgtcctggaggccacgcgccagcctcttggggcgctgctgaatggcgagctggatctcgccttgaccaccgacgtcccgccgcaggcccgcctggcacagactgcactcttcgaggacgagctcatgctggtggtccccgaggaccacgcgctggcgcggcggggacatgtcacggcggaggacctggtgcgggagcacctgctcacctatgccgcgcctcgggagcagctcgatgtcttcacgcgcgtgctctggccggcgggcatcgagccgcaccgggtctcccccgtccccctcaccgaggcgctgatcgagctggtgcgtggcggtatcggcgtgacggcgctgccccaatggatgctgccgagccagcaccctggactgcagacggtccggctgacgccgcagggaatccgacgccgctggagcgccgtcacccgcgcatcccgccagcgccccgctccactgacctacttcatccaactgctccgcgagcgcttctcccgccacggcaaagcagggccacgggctgcctcacggcgatga

SEQ ID NO: 6484 - DNA, 2163 bp, Myxococcus xanthus
atgccgaaacgcggcggcggcggtcgcggcgtcacccagaagccctccaaccgggacgtgctcccggccggcgcggagtcgaaggacacggagctcttcttcaaccgagagctgtcctggatggccttcaatgaccgcgtcctccagctcgccgagtctccggagattccgctgctggagcggctgaagttcatcgccatctacgcgcgcaacctggacgagttcttcatgattcgcgtcgcccgtctgcacgagcagattcgcggcggcgtggcgcgcctggttcccgacggagcctctcccagcgacaccctggacaagctgcacgacggcatcctcaagcagacgcgccggcacggcgacgccttcgagaaggtgctccgccccgccctggccgaaaagggcctgcgcatcctctccgccaggaatctggacgccgagcagcgcgcccaggtggaccagcgcttcaaggagcagattttccccgtcctcaccccgctggccatcggcctgggacggcactttccctacatctccaacctgtcgctcagcctggcggtgctgctgagagacccggacgcggacgaggagagcgtggcccgggtgaaggtgcccaaggagctgctgccgcgcttcctgcccctcaagggcaacgtcttcgtccccttggaggaaatcatcgcccagcacctgggggacttgttccccggcatggaggtgctgagctggggcaccttccgcgtcacccgcgacgcggacttcaccgtgtccgaggacgcggaggacctgctcaaggccgtggagacggagctgcgcgagcgccgcttcggcgacgtcatccgcatggaagtccaggccggcatgagccccaagctgctcgagccgctggtggaggccatgggcctggaggcgcgtcaggtctacgaggagcacggcctggtgggcctcaacgatttgcagtccatcgccttcgccccgggcttcccggagctgaaggacccgccgtgggtccctgtcacccaggcccgcctgcgcacggacgcggacgcgccggatggcggcacggtgatgtcgtccatgcgccggggggacctgctggtccaccacccctatgagtccttcgccacctccgtggagcgcttcgtcaccgaggccgtggccgacccggacgtgctggccatcaagcagacggtgtaccgcacgtcggacagctcgcccctggtgcccgcgctgattaccgccaccgagcgcggcaagcaggcggtgtgcatggtggagctgaaggcccgcttcgacgagcgcaccaacatccgctgggccaacgcgctggaagaggcgggcgtgcacgtcgtctacgggattccgtccctgaagacgcacgcgaaggctatcctcatcgtccggcgcgagggcgacaaggtgcggcactacgtgcacatcggcacgggcaactacaacccgaagacggcgcgcctctacacggacatgggcctgttcaccacggacccggacattggcgcggacgtggcggacgtcttcaactacctcaccggttttggccggccgaagagcttccgcaagctgctggtggccccgctcaccatgcgccagggcctgctggcggaaatcaagcgcaccgtcgccgcgcacacagccgagcgccccgcgcgcatccagatgaagatgaacgcgctggtggaccccggcatcatccacgccctctacgaggcgtcccgcgcgggcgtgaaggtggagctgaacgtgcgcggcatctgctgcctgcgcccgggcgttcccggcgtgtcggagaacatccgcgtggtgtccgtgctgggccgcttcctggagcactcgcgcatctacatcttcgagcgcggcccggagctgcgttgcttcatcggctcggcggacttgatgccgcgcaacctggaccaccgcgtggaaatcctcgcgccggtggaggacgccagcctggccgcccaggtgaaagactcgctggagcgctgcatggcagacaccacgtccgcctgggagctgacggcggatggcggatggcgccgccggctaccgcgcgccggtgacgagaagcgctgggcccagggcgagatgatggagcgcgcccagcgcatggcccagttccagggcggccgtccgctgccctga

SEQ ID NO: 6485 - DNA, 564 bp, Myxococcus xanthus
cgcgtgcggctgccctttccgggcgtggacgctttctacgccgcgctccagcacggccggggcacgaacgcggacaaccccatcttttacgagtccagcagcccgtggaacctctacgagcacctggacgagttcctctccctgcacaaaatccccaccggtccgctgctgctgcgcgactggggcctgtccagccaaggcttcgcgcccggcgggggccatgggcacaaactggagaagattcgcgcggtgctcggcacgctgtcgcacctgcccttcatcctcattggcgacagtggccaggaggacgcggagcactaccgcaccatcgtccgtgagtttcccgggcgcatcctctgcgtctacatccgcaacgtgcccgggcatcagcgccgggccgaggagctggcgctcatcgccgaggacatccgcgccgcgggcagccagatgctcgcggtggatgacaccaccgaggccgcccgtcacgccgcgcgcgaggggtggattcagtggcgcgaggtgcgcgaggtggaggcccaccgccgcgaggacgccgcgcgctga

SEQ ID NO: 6486 - DNA, 1829 bp, Myxococcus xanthus
  unsure (1)..(1829): unsure at all n locations
cgcctcagcggcctacgagggctgtcgtcgggtgggcgagcgcatcgcagaccccgaagcgtgccatgccggctccaaaccccgcaaggcaagagcagagccacccacacgcgtgttatgtgtctgagttccttggcaccatcactttccccgttccgtcccatcccgggtgggcccacgccggacccgcttcacgggagcttccgttctcccctcaatcgagcccgcgccgaggacgccgcgctgcgagccgatggactgctcgccgacgaggaactcacgcagttgctcacgtcgccccgcgagcgccgggtggtggtgcagcgggcgcgggacatcttcgtcaaccgcaacctgcgcatggccagtgtcgaactgttcggcttcgacatggattacacgttggccatctatcacatgcgccggctggagcagctgtcgttcgacatgacgctggcgaagctggtgagcgagtacggctatccgccggtggtgggcgggctgctgtacgaccaccacttcgtgatgcgcgggctggcggtggaccgcgtcaacggcaacatcctgaagatggaccgcttcggccatgtgggccgcgcgtaccacgggctgcgcccgctgaagcgcgaggtctcgcgtgagctgtaccggaacaagcgcgtgcggctgcgcaacccgcagttcgcgtggaacgacacgttgttcgcgctgccggagacgtgcctgttcgcgggcatcatcgagctgctggagtcgctgggccacacggtggactacggcaagctctacgacgacatccgggaggccatcgacacggtgcaccgggacaactcgctcaagcgcgaggtgcgcaaggacctggcgcgctacgtgttcctggacccggagctgggaccggcgttgcacaagctgcgctcgggcgggaagcggctgttcctgctgacgaactcccgcgtgggactacacggacgcggtgatgaagtacctcctggacgggcagctcgcggagtacccgagctggaggaactactttcgacgtggtggtgacgtcggcgggcaagccgggcttnttcaccgactcgcaccccttgctggagctggatgcctccacggaggaaggccgcgtggtgggcgaggccacgtcgctggagcgcggcaaggtgtactcgggcggcaacctggcgcgcttcgaggagctgacgggctaccggggcgagaacatcctgtacgtgggcgaccacatctacggcgacatcctgaagtcgaagaagtcgtcgctgtggcgcacgtgcatggtggtccaggagattgaggacgaaatcacgtacacggcgacgcggcaggaggagattggaacgctgtcgcaggtggaggtgctccgagagcgcctggacgacgaggtgaaccaccacaagacgctgctcaacatcctggatcggcgactggagcgagaacagctgacaccggacgagcggctgggcgtggaggagctccgcaagcagacgaaggcggagctggaccggatgcggcgggccttgaaagaggccaacgaggtcgcggacacgctcgagcaggacgtggaggaaggcttcaatccgtactgggggctgctcttcaaggaaggcaacgagaacagccgctttggctaccaggtggagcagtacgcctgtctgtacacgagccgggtgtcgaacttcctgcaccattcgcccatgcagtactaccgctcaccgcgggacaagatggcccacgagcaggccggagccctgtccgcccggctgtccccgatgggcagcgaaggccccccgaagggcgccgggaacgagtag

SEQ ID NO: 6487 - DNA, 279 bp, Myxococcus xanthus
atggcttacgacggcgagctggtgaagatggagaacggtcgctgggcgcggttccagcggtgccaggtgtaccgcccgggcgtcgaggacgcgggcgagacgatgctgctgatcgccgtggagctcgatgagcgctatcagcgccagctcgacgaggcggctgactccctggctcagtaccgctatcagggcgttcccgtgcaggtccgtttcgattcgggttcccagggcatcactctgcagcccgagcagacggtgtccgcacccgcggtgcactga

SEQ ID NO: 6488 - DNA, 213 bp, Myxococcus xanthus
atgccgctgtatttccgtgaaggcgtggcgaacatgtggatcatcgatcccgttcgccagtccctggaggtctaccggcgtgggaccacgagctgggtccggagccagttgttcacggggaacgtcaccgtgaacgcggagccgttcgaggtcctccccttggacctgggcttgttgtggacgccgcgaatggaaggcaccgtgcagcagtga

SEQ ID NO: 6489 - DNA, 298 bp, Myxococcus xanthus
atggccgttgtcgtactggtcgcaaccctcttggtgggcgacgcgttcgcagccacctttggagtcacgccgtcgggcgcgtccgccgtcttctacgtcgacaccaacgcctgggcggacatccactacgtccgcaacaatcaggggcagctcaactatcggatgggcatcgtcaacggccggaaccagtacacggtgacgggcctgtccgcgggcgaaaccatcgactactccttcacgtactgggacgagtcctgcaactgtgcccgtgacacggcgtggacgcgctacacgcatt

SEQ ID NO: 6490 - DNA, 585 bp, Myxococcus xanthus
ggctcgttcgggttccacgcgggcatggcgcacctgcggcggatgcggctgcgggcgggggagccggatgccttcgttcgggtggcggagcttcgcgccggggactcggtgctggactgcacgttggggctggcgcaggacgcgatggtggcgtcactggcggtggggccctcggggcgcgtggtggggctggagcggagcctggcgctgggggcggtggcgggggaggggctgcggcgctatgcgctgggcgaggactcagggctcattgaagtggtgcatgcggatgctcgcgagtacctgaagacgttgccgtcgcgcgcgttcgacgttgtcttcttcgatccgatgttcgcgaagccgcgcaagtcacagccggcgttcgacatgctgcgccgcttcgcggaacacgcgcccctgacgcaggagacgctggaggaagcccggcgcgtggcgcggcggtgggtggtggtgaagggcgcgaagtacaccgacgaccttcgcaagctgggtctggaggacgagcccggctcgcgcttcaccgacgtcatctggggccgcgtggggcccttcgtcgagccgtga

SEQ ID NO: 6491 - DNA, 495 bp, Myxococcus xanthus
atgggcgcgacggggctgaaggtgtccgtcaaccgacgccgcaaggtggtccgtctggcgtacgtggctcccttcaccgagggacggcagggcgcacactggtatgcggcccaccatgcgctcccccggctgctttcccgggcgacgaacgccgccgtccaggcctacgtctatgatccagacgaaggcgagcaggtcatcgcgtacggcaacggccggcgcgtgggcggtgagcgggtcgtctacgaggacgtggagctcccggtgccgctggaccagatggacgacgcggccttcaagcacatgcaggagcgctggccggtgggccacctggcgtacgtgttcggcctgacgcgcaaggagctgctgcggctgccgcgcgtggctccgggccacgagctggcgctggagggccgtgacgcagaaggggccgccgtcctggaggccctcctgccgacctgccaggtgacgctgccggagtccgacgccctctga

SEQ ID NO: 6492 - DNA, 531 bp, Myxococcus xanthus
atggcgaacttctacgaagcgcgctcactccggatggagcaggagctgcctcggattcccggcgccccggcactcgacccgaagattctcgaggtctactacgcggcgctggagcccatgcgggagccgcgcgcggtgctgctcggcttgctggccgttgcctgcgcctttgtcagcgtgtccgcggcgcgcatgctgagtccggagaacctgcaccgcgacgccttgagccgggtcctgagccgcgcggccatcatcgccgccgggctgcgcaccatcgacggcgcgcagatgtccgtggccaagcagcgcctcttcgcggcgctggcggagccgatgagcaagatgcccgagttcccaccggacatcaccgtcgaggcctctcgcgaaatcctgagcgcgatgggcgtggggagcgccatcttcggcaccgtggtggtggcgggcaccttcgcgcttctggggcagtacttccgcagccagcgcgtccgcgaggccatggccgtgcaggacgggccgcaggaggagtag

SEQ ID NO: 6493 - DNA, 315 bp, Myxococcus xanthus
atgagctccggggacgagaagcgcggcgagaccttcgtgatgcggggggaagcgcgctccgcgtccgaggagtcgatttccttcagcaccttcatcgtggggctgggcaccgcggtgctcatccacctgggaggtgcgcccaatcctgaaacgggtcagacggagaaggacctgccgctggcccggcagaacctggacctcttgtccatgctgcgcgcgaagacgcggggcaacctcacagccgaggaagagaagctcttcgacgggctgctcgcggacctccgcctgcgctacgtggaggcgaccaagcggtga

SEQ ID NO: 6494 - DNA, 378 bp, Myxococcus xanthus
atggcggattcggcggacccgaagtacctcgataagcgcaccgcggagcggtacgtgcgctcaggccagctcgacgaggcggagtacgagcgccacctccagggcctgcccgacgtggcggagaagtccgtccccgttgagacgctcatgctcgacgacgccgacgacttcgacgacgaagaggatgacttcgaggacgagggcgacgatacgtccgacgacagcgatgaggccgagacctccgccgccgccgagtcgacggatggcgacaccgccgaggccgacgacgccgagagcgacgacgaggccgagagcgacgacgaggccgccaccgcttcgaacgagacctccgacgatgaggggccggtctccgcatga

SEQ ID NO: 6495 - DNA, 1728 bp, Myxococcus xanthus
atggacaccaccggactgaaggagcgggcggaggcgtggcgtcaggcggacccggatccgtccaccgcggcggagctggcggcgttgctggcgaaagcggactgggccgagctggaggaccgcttctcgcaggacctggagttcggcaccgcgggcctgcgcggcgtgctgggcgccggtcccaaccggatgaaccgcgccgtcatccgccgcaccaccgcgggccttgcgcgctacctcaaggagcaggtgccggacgtcgccacccggggcgtggtggtgggccgtgacgcgcgcaacctgagcgcggagctggccgaggacaccgccgcggtgctcgccgccgagggcatccccgcccatgtcttcccggagccggtgcccacgccgctggtggcctttgccgcgctgcacctcaacgccgccgcggccgtcatggtgacggccagccacaacccgcccgagtacaacggctacaaggtctattggggcaacggcgcgcaaatcatcccgccgcatgacacgggcatcgcctccgccatcgcccgggtggagcccgccaaccgcgtgccgctgctgacgccggccgatgcgcgcgccaagggcctgtggcgggatttgcctgcggccatcggcgatgcctacgtgcgcgccatcctggggctgcgcgtggtgggcaagggctccgagtcgctgtccatcgtctacaccgccatgcacggcgtgggcggcgactgggccgtgcgcgccctgcgcgaggcgggcttcccgcgcgtcacccccgtggccgagcagcagcagccggatggccgcttccccaccgtgcgcttccccaacccggaggagccgggcgccatggacctggccaccgccaccgccgagcgcgtgaaggcggacgtggtgctggccaatgacccggacgcggaccggctggccgtcatggcgcgcgacgcggacgggtcgctgcggctgctgacgggcaacgaggtgggcgtgctgctgggccactacgtcctcacccagggggcgaagcagggcaagccccacgtcgtcaccaccatcgtctcctcggcgcagttgggagacatcgcgcgctcgctgggcgccgcgtgtgacgaggtgctcaccggcttcaagtggatcgccaaccgcgcgctggagcgcgagcaggccgagggcacccgcttcgtcttcggttacgaggaggcgctgggctacaccgtgggcacggtgacgcgcgacaaggacggcgtgggctcggcgctcgtcatggcggacctggcggcgtggtgtcaggcgcgcggcaccacggtgctgggctacctggaggagattcagcgcgcgcatggcctgtacgtgggcgcgcagcgcaacttcacgttccccggtgcggcgggcgcgcaggtcatccgcggcatcatggacgcgttccgtgcctcgcctccgaaggacattggcggcgacgccgtccgtgccgtgagcgactacaagaagggcgagcggggcctgcctccgtccaacgtcgtcgcgctcgagttggagagcggcggccgcgtcacgctgcgcccctccggcaccgagccgaaaatcaaatactacttcgagctgaaggagacgctcgccgacggtgagcccctggctcaggcccgtgcgcgcgccgagtcccggctggcccgcttcatcgatgctttcctcggcctcgcgcgtgagcgcgggcagccggcatga

SEQ ID NO: 6496 - DNA, 246 bp, Myxococcus xanthus
atgatgcaggccatcgcctccaaccggaaccggaacatggatggcgtgctggcccgcgtgctcaaggcgctgggcaagctgcgcgacgacccggacgcgttcggtgagtgcgaggagtgcggcgacgagattccgctcgggcggctgcgcgccatgccctacgcggagttctgcgtgacgtgccagggcaacaaggacggccccaagggtcgcgccacccgcagcaagctgaccgactacacctga

SEQ ID NO: 6497 - DNA, 378 bp, Myxococcus xanthus
atggccaccaacgccacggagacgttcgcggccagcgccaacatcttcctcgtcatccttccgccgcccgtggcccagccggacttctccgtcaccatcgagccgcgccagttggacctgttcgccggtcagaacgagaaggtgcgcatcaccgtgacgcgggcggagggcttcaccggccccgtcaccgtcgccctggaatcgcccacccgccgcatcagcatgcccacggtcaccatccccgcggaccagacgttcgtggagccctacatcgacaccgaccgcggcatgacccgcgtgcccgtcgccgcctccatcaccgccaccagcgaggacggacggcaggccagcacgggcaccaccatcaacgtgcgctag

SEQ ID NO: 6498 - DNA, 513 bp, Myxococcus xanthus
gccggctcgtccacggtgcccatcgccgtggtgggtttcccgctgggcgcctcgctgccgtccgccaaggccttcgaggcccgggagtccatccgcgccggggcgcgggaaatcgacatggtgctgaacgtcggcgcgctcaaggcgcacgactacgcgctggtgcaccaggacatcgccgccgtcgtggaggccagccggcccgtgccggtgaaggtcatcctggagacggccctgctgacggacgaggagaaggtcatcgcctgctcgctctccaaggccgcgggcgccgccttcgtgaagacgtccacgggcttcggtccgggcggggccaccgaggcggacgtggcgctgatgcgccgggtggtgggcgacacggtgggcgtgaaggcgtcgggcggcatccgctccgccgaggacgcgatgaagatgctgcgcgcgggggccaaccgtgtgggtgcgtccgcgtcggtggccatcgtctccgggcagacctcctccgcgaagtactga

SEQ ID NO: 6499 - DNA, 363 bp, Myxococcus xanthus
atgggttcggtggacgacctggagcacatcctccgcaacaccgcggtggatgaggtgtacatcgccggcaacacgctgaagcagggcgagtccatgcaggcggccatcaagctggccgagcgcttcggcgtgcccttcgcgctgcccgcgcacagcttccgcctggaccgcgcccgcccggtggagcgccgcgcggtggcggacggcttcctgcacttcgcggcggtgagccccaagccgcaccagatggcgatgaagcgcctgttcgacatctgcgtgtccgcggcgaacgcagtgggcgctgctgccgctgttgggcatggtggcgctggcggtgaagttcacctccaagggcacctcttc

SEQ ID NO: 6500 - DNA, 384 bp, Myxococcus xanthus
gctctaaagagcgtccacgccgccgccgtgctcgacgccaacggccacctcctggccgcccatgaggacgtgggccgccacaacgccgtggacaaggtggtagggacgctggtgctggccggcaccgtgcggggcccccgggctccccgcctcccgttgacgcgtcagcccgtggtgctcgccgtcagtggacgcgtcagctttgagatcatccagaaagccgccatggcccggattcccatcgtcgcgggcgtctccgccgccagctccctcgcagtggacctggccctgcgttctggcatgacgctggccgcgttcgtccggaacgagcgcttcaacgtctacaccgggctcgaacgccttgtcgcaggtgtaacctcttga

SEQ ID NO: 6501 - DNA, 2699 bp, Myxococcus xanthus
atgccgaaggccctgtcgctcatcgagaagctgacgctgcgctcgggcggtgatttcgcgccggcgatcgagcagatcgaggcgatggcgggcgaggtgaaggaccgcaccgcgcaggtggacctgtggctgcgcgtgggcacgctgcgccttggccggatgaacgacgcggacggcgcgctggcggccttcgagaaggccgtggcggcggacccgtcccgcgcggacgcggccagcctggcggccgagcagctcctggagaagggccgggctccggaagccgtcgcggtgctggagcgctatctgggcacggtgaaggaccgctccacccaggcgggcatgcggctgcggctggcggacctgttcctgacgcagctcaaggacgcggacgccgcgcgtgagcacctggaagcggcgctgaagctggaccccacgcaggcgttggcggccttccaactggcgcggctgttggccgaggacgacgagctggaagccgtggtgccgctgctggacctggccctgctggcgccacgtccgcgcccggagcgggtggccttctgcgaagcgctcgcgctgatgttcgaggagaaggacgacgcgcgcggggccttcgaggtgctgtcgcgcgccctggagctggatccgggccgtccgctgctgttgggcacggtggtggagcacgcggagaaggcccaggtgcagcccgcgctggcgctagccctgcaacgcgcggcggaagcggcgccggtggcggaggtggcggcaacgatctggcggcagttggcccagttgctccagggccccctggcggacccgtcgcgcgcggaggccgcatggcgggaagtgctggcacgcgcgccgggtgacgcggccgccgtggaggcggtgaagtcgctgcaggcggccgcggcgctcgcggacgacccgaaggcgcggctggaggcggacgtggcccggcgcgaggcagccggcgcggcgcccgaggacctggagccattggcgcgtcagttggtgcagctcgcgccagaggatgcggcgggcgtgcagcgactgcaggcgctgtgcgtggccttgtcgaagttcgacgaggcagcggcgctcgcgggacggttggcgggcctggcggagacgcagctggagcgcaacgagtggacggcgcgccaggcgaagctgtacgccgagcggttggggcgtcaggaggacgcgacggacctgttcctcggcctgctctccgagaacgtctccaccggcgtggtggtgggcggactggagcggctggcggcggcgggcattcgcacggcggaggtgacagaggcgctggcggcgcactacggccgcagcggcgaccaccagcggcaggtggcggcgctccagcagcagttggaggtgacgacggagcccacggcccgcaagcgcctgttctcgttgctggccagcatccatgagaagcagctcgcggacagccgcgcggccttcgacgtccaggtgcgcgcgctgcgcgaggacgcgaaggacgagggcacccgcgcggaggcgctgaggctggccagggacttgtccgcgcacgcggagctggggcgtgtgctgcgcacgctggcctccgagtccgaggaccccgcggtggccgtgccgttgctgctcgaggccgcgagcctggcggaagagggcgcgctcgccgcggaggccatcgcggcgctggaagcgggggtgacccgtgcgcccgagtcgaacgcggtgctgcagcggctggtgcgtctgtacgggcgcgcgggtcggtccgcggacgcggaaggactgctgcgcaagcgcatccagggcgcgcgtgggcaggagcggttggagctgctgcttcagttggtggacctcaactcggagctgggacgcgatgcgcaggcggccgaggcgctgcagtccgcgctttcgcacggcgccgaggaaggccggcatctgccgcgtctggcggagctgtacgagaaggcgggccggacgcgcgagctgggagacacgctggcgcggatgattgcgctggccgagtccgcgggtgacgcggacagagtggcgcgactgaagctgcgccgtgcgcacctgctgcaggagtcgcaggatggcagcgcggaggcggtgcagagcttcgcggacatcctgctccagcgccccacggacccggatgcgctggcggcactggaggccatgctcgcctcgggctcggcgcgcgaggccgctgcgcgtgtgctggtgcctgccttcgagcgcaccaaggaccaccgcaagctggtggccacgttggatgttctggcggaagtggcgaaggacgacgccgcgcgagtgcaggcactgcgacacgcggcgcaggtgcacctgacgcacctgcggcagccggagctggccttcgcggcgctggcgcgcgcactgcgcctggcgcccggtgacgcggggctgcgctcgtcggcgcggcaggcggcggaggacgcggactcgctggacagctacgcggaaatcatcgcggagctggcggaggaaggggacgtcggctccgcgcgactggcgctgctgcgcgagctggccgaggtgcaggagaagaagctggacgacaaggccggcgcggtgaaggcgctgcgcgacctgctggccatcgagccgggcaacctggactgcctgcgcgcccttcagcgcttgcatcgcgcgggggaggaatgggc

SEQ ID NO: 6502 - DNA, 738 bp, Myxococcus xanthus
atgcaccccgtactcgcccgcttcctcgccgccgatgccgctcgggagacgctcctcaagcagcagtcgggcggagacctctctgtggaagagcaggccttcaccgacgccgcctccgcgaacccgaagcacaagtccgtgctgctgggcgtgggcggccgcaccctgtccaccgatgcccaggcttcgctggtgctgctggcggcccacgccgcggtccgcgcgctggaccaggacgccaccctggcggagcccacgaagaaggcccgcgaggccctggccgaggaaggcgccagtccggaggagacggacgcgttcctggcctccatcctcctggaggaggccttcggctacgagcaggacgtggacgcgttcgacagcgaatacgtgaaggaggcgctgggcgaagtgcccgcgctggcctcgctcaccaaggaggcggtggacgcgctcttcctcacgttcgtgaaggccgccgccaacgacgcggagcggaaggtgcgtgagggcatggcccgcgccctcttcgacatcgcgtggtcggaagggcccgcgcccatcaaccccgagcacatggaggccgtgctcgacgcggaggtggtggaccggcccgaggaggagcaggaggccaaggtgcaggcgaccgcgcagctgctccaggcgctgtccaaggagggcctcatcggccccatccgcttgtcccgcctgcgggccttgctgggtgaggacgacgcgtag

SEQ ID NO: 6503 - DNA, 777 bp, Myxococcus xanthus
atgcgttccgccgtcgcctttctgtccgccttcctgctgttcggtaccgggtgtgcgtccctcacgcagggccaggccggtgagcctgactatgccgccgtcgcagatgaaaacctgcggctcggctccgaggccctggagaacaaggacttcttccgcgcccagaaatacttcgagtacgtccgaacgaagttcccgtaccaggaggccgcccgcgaggccgagctgaagctggccgacgtggacttcgagcgcgaagccttccccgaggccaaggagcagtaccagtccttcatcaagctccaccccacgcacgccaaggtggactacgccgccttccgctccgcgatgacccacgtgcgggcctacccctccgagttcttcgccctgccgccgtcccgcgagaaggaccagggcgaaatccgctccgcgttggtggccatggaggagttcctgcgccagtacccccagtctcagtacgtggcggaggcgaagacgcagcgggaggacgctcggcgccggctcgcctcgcacgaactgtacgcggcccagttctatcagaagcgtgagcgctggaaggccgtggcccagcgcctggaagggctgctgcgccgctacccgggcacggagtacgaggaggaggccctcttcgacctgcacgacgcgtacgtgaagctgaatgacacggagaaggcgcaggacacgctgcgccaggtgctgcgtcggctgccgggcacgcccgccgcggagcgcgcccagcgtatgctgggctcgtga

SEQ ID NO: 6504 - DNA, 522 bp, Myxococcus xanthus
gctaggtatcccgccatgcatccggaggacgaagggcccgacgctgttcgccgtgccacggacgcgtgcctgaagctcctgtccatgcgcgggcgcagtcgccgcgagctggagcaggccctggcccggaagggcttcaccgaagcggtgtgcgaggccgcgctcgcccgcgtgaaggcttggggctacctggacgacgaacgcttcgcgcgtgagcgcgccaccctgctcctgggccgaggccggctggggccggaggcggtggcccaccggctgcgggcgcacgggctggaggaggggacggcccagcaggccatctccgaggcgagcgacgcggtgtccttcgacgcgctggccacggcgcgggcagtgctggagaagcggggactgctcggccgcccgctgggggccagggagcgggcccgcgcaggccggctcctggacagccggggcttctcggaggacgtcatctaccagttgctcggagaagcttcgctggacccctcggggccggaggaatag

SEQ ID NO: 6505 - DNA, 3120 bp, Myxococcus xanthus
gtcaccttcacggtgacggataaggtgggcaacgccagtgctctaagaagctcctccttcacggtggatactacggcgccggaacacgccatcgacagtggcccggcggtggtgacgaacgtggccaccgcggacttcgtcttttcgtcgaacgagtctccggtgacgtacgagtgctcgctgaacggcgcgcctttcacggagtgcccagcccaggcgcagttcggcccactgccggacggtgactacacgcttacggtgcgcgcggtggatgcggccgacaacgaggacccgacgcccgccgagtacacctggacggtggatgcaacgccgccggtggtggtcatcaccacgcccgcgaacaactcggtgctggacgtgcccgtggtgacgtattccggaacgacggaggcgggcagcaccgtgacggtggtggtggatggcgtcccggtgggcacggtggtggcggacccgtcgggcaactggtcgctccccgtgagcgacacgctgtcggaaggtccccactcggtgtccgtcacggcggaggacgaggcgggcaataccagcacgacggtgacgcacacgttcatcgtggacgcggagccgccggagacgacgttcacctcgacgccgcccgcgctctccaacagtgattcggcgacgttcgacttcgactcggacgaatccccagtgacgtacgagtgcagcctggacggcgcggcgtacgtgccgtgctcggacccggccaccttcacgggcttggatgacggcgagcacaccctggcggtgcgcgcagtggatgaggatggcaacgaggacccgacgccggccagctacacctggacggtggacacctccgcgccggacaccctcatcatctccggcccgccgctgacggaagcgcctggcaccgcgacgttcgacttcgattcggacgaatccccggtgacgtacgagtgcagcctggacggcgcggcgtacgtgccgtgctcggacccggtcaccttcacgggcctggcggaaggcagccacacgctgagcgtccgcgcggtggatgaggcaggcaacgtggacggcacgccggcgatctacaactggtcggtcgcggtcgacacggatggcgacggcctgacggatgccgaggaggttgtgctgggcaccgacccggagaaccccgacacggacggtgacggactgccggacggcatcgaggtgaataccgcggggacggatccgctcgacgacgactcggatgatgacggcatcctggatggcaacgaggacgccaaccacaacggcatcgtcgatgagggcgagacggacccgaacaactgggataccgatggcgacctgctgtcggacggtctggagctgggcctcgccgagcctcagggcgccaacacggacatgacgcgcttcgtggcggactccgacccgaccacgacgacggacccgctcaaccccgacacggacggcggcagcgtgcgtgacggcatcgaggacgccaaccgcaacggccgggtggacccgggcgagacggatccgctcaaccccgccgacgacgtcgactccgacggtgacggcatcgacgatgcgaccgaaatcgcgtggggcctggaccccaacgacgcggacagcgacgacgacggcgtgccggacggcatcgacggcatcaccgacacggatggtgacggcctcatcgatgcgttggacccggacagcgacaacgacggcatcctggacggcacggagatgggcgtgacgctggagagcgctccggcggacacggaccgcacctcgcccaatttccgtccggacgcggacccgagcaccaccaccgatccgaagaacccggacacggacggtgacggcctgctggacggcgaggaggatgccaaccacgacggccgcgtcgacagcacggagacggacccgaacaacccggacacggacgctgacggcctgacggacggcgtggaggtgcgtggctccaaccccaccaacccgctgaacccggacacggacggcgacggcttgctggatggcgcggaggacgccaaccgcaacggctccttcgacaacggcgagacggacccgaacaacgccgacacggacggcggcggcgtgaacgacggcgaggaagtcaccggcgggaccaacccgctggaccgcaacgaccacttcgtcatctacggccgtgggtgcagcacgagcggggccgacaccttccctccagtggcgctgctagtgctcgggctgcccctgctgggccgtttccgccgctcggcggggcgggccggtggggcccctgtggccgccgccgtgctggcgctggcggtcctgatggtttcgcggccggccgtggcgcaggtgcccacgctgtccgcgtcccagtccatcgacgtgcagcagtacaagccggggccgagctcgaaggacatcctgggcgtccagagcgcccaggtgcattcccacctgggttggaacgtgggcgtgtccgtcaactacgcggacaagccgctcaacttcatggacccacgctcgggccggttcatcaccgcgctggtgcgcagccaggtgggtgtggacctgatgggctcggtgggcctcttcgaccgcttcgagctcggcgtgctgctgccggtgacgctccagcgttcgcaggcggcgcccatggtggacccgtccttcgcccagggcgtgggctcgggcggcatcggtgacctgcgcctggtgcccaaggcccgcctcctggaggagggctccttcggcctggccctgacggtgccggtggtgctgcccacgggcggcggctccgacttcctcgggggctcgggcgtgggcgtgcagccgcgcctggtggccgaatacggcgagcggtttcgcgtggccgccaacgtgggcgtggacttccgggagaagcagcagctgcgcaacctgaacctgggcaacgcggtgtcctacggcgtgggcgccgagctgcccttcacggtgagcgaggtgccgctggcgctcgcggccacgctggtgggcgcggtgaacctggagcagcaggacaccgaggagcgcccgctggagctgttggcggcgctgaagtaccgcgcgctgggcggcttgaga

SEQ ID NO: 6506 - DNA, 300 bp, Myxococcus xanthus
gggcagtgcagcaccgccgcgctgctggggttgctgttcgcgcagtcgtgctctggcctctacctggcggtggcgctgcgctggggctcggcctggtacgtccacttggtggtgccgtacctgcgctcggtgctggccttccagccggacgcgtcgctgctggcgcaggcgcccttcatcgtccagttccacaccctgttcgggatggtggtgctggcgctggctctcttcatccgcgcgcggcccgagcccatcaccgcgcccctgctcgtcacgcctcgggaggagaccgcccgctga

SEQ ID NO: 6507 - DNA, 399 bp, Myxococcus xanthus
atgaactgccacacgcaggtgaagacggactcgcccgaaatccagaaggtcgcggccgcggtggcggagaacaagccgctggcgtgggtgcgcatccaccgcctgccggaccacgcgtacttcaaccacgccagccacgtgggcgcgggcctggactgccagacgtgccacgggcccgtgcaggagatggtgcgcgtggagcagaaggagcccatgacgatgggctggtgcctggattgccaccgcgacacggcggcgaagcaggtgtccgcgccgccgccttccgcgccccgcgctggagagctgctggccctgtcgtccggcgcacccgcaccggagccattgaaggcccctcgaatcctgcagccccccacggactgctcgagctgccaccgctga

SEQ ID NO: 6508 - DNA, 894 bp, Myxococcus xanthus
gtcttccattcggacagctacgaagtcccgttgcctcccggccaccgcttccccatggagaagtaccggctgctgcgcgaggcgctcctggagcggggcgtgctcaccccggaatccctcaccgaatccacgccctgcccacgccaggacctcgcgcgcgtccacacgccccgctacctcgacgcgctgtcccagggcaccctcaccgacgccgagcaacggcgcctcggcttcccctggtcccccgagctgatgcggcgcttctccgccgcggtggcgggcaccctcgacgccgcccgcgcggcgctccaggacggcatcggcggcaacctctccggcggcacgcaccacggctttccggaccacggcgagggcttctgcgtcttcaatgacatcgcggtggccatccgcgtgctccaggcctcgcgtgacatccgccgggccgtggtggtggacctggacgtccaccagggcaacggcaccgccgccgtcttcaccggcgacgactccgtcttcaccttctccatgcacggagaaaacaacttccccttccgcaagcagccctcccacctcgacgtgggcctgccagacggcacgggagacgcggcatacctggacgcgctcgccctgcacctgcccgaggtgctcgacagcgcgggcgcctgcatcctcttcttccaggcgggcgtggacccgctcacggaagacgcgctgggacggctgtccctcactcacgccggactgagagcgcgcgacaggctggtgctcgaggccgcacgccaacggggcatccccgcggtgctcaccctgggcggcggctacgcgaaacccctgtccgccacgattgatgcgcacgtgggcacctatgaagtggcccgtgcgctgttccgctga

SEQ ID NO: 6509 - DNA, 1633 bp, Myxococcus xanthus
atgtccgacccacttcccaagtattggcagagcctggcggagcgcgctggcgaccttggcgcgctcgcacagacgcaggacgaattcgcggagccgctccccgtgggcgtcgccgccacgcctccggatgcgaacagccgccgtgacttcttcaagctgatgggcctgagcgccgcggcggccatggtggcctgccagcgcgcgccggtgcaggaaatcatcccctacgtggcgcgcccggatgaagtcacgccggggctggcgctctggtacgcgtccacctgcaacgggtgcagcgcccggtgcggcctgctgctgaagacgcgcgatggccgccccatcaaggtggagggcaacgacgagcaccccgtgtcgcgcggtggcgtgtgcgcggtgggccaggcgtcggtgctgtcgctctacgacgcgagccgcgcccgttaccccacccgcggcgccacgcgcgtgtcctggacggacctggacgcggacgtcacgcaggccctgcgcaaggccaccgaggcgggaaagggcatccgcgtggtgttgccctggcacctggggcccacggcggaggcggccgtgaagcgcttcctggccgcgtaccccaccgcgcggaccgtgcgcgacgaagccctgggggagctgtccgccatcgccgacgcccaccgcgtcacgcatggcgtgcacgccgtgccggactaccgcttcgacaaggccgccgtcatcgccagcttcggcgcggacttcctggggacgtgggtgtcgcccgtggcgttcacccggcagtacgcggagtcgcgcgacgcggcccggcgccggacgatgtcgcggcacttccaggtggagccggtgatgacgctcaccggtgccgccgcggaccgccgcttcgtggtggcgccttccgatgtggcgctggtgctggcggacctggtgcggcggctggcggtgaaggcgggccgcgaggtgcccggactggggtcgctgccgccgcccgcgctggacgaggccgcgagggtggagctcgcggactcgctgtgggcccagcgtcaggacgccctggtggtggcgggcggtgatgacgtggccacgcaggtgctggccaacgtcgccaacgcgctgctgggcaacgagggccacacggtgtcgctggcggacggcacggcgctggacgcggacgcgctgtccttggggacgctgctgaccgagctgcgcgccggcagcgtgggcgcggtgcttttcatgggcgccaatcccgtctacagcgacccgcgcggcgcggagctggccgcgttgctgaaggacgtgccgctcacgctgtccaccagcgaccggcgggacgagacggctgtgcacgtgggcctccatgcaccggagtccaccgcgctggagtcgtggggcgacgcggaggtgcgccggggcgtcgtgtcactgcgccagcccgcggtggcgccgctacatgagacgcgcagcggcgtggagtcgctgctccagtgggcgggagcgccccagccgcactacgacttcctccgcgctcgctgggaggcggaggtcttcccccaggccagcggcctggggcagggcttcatcgctttctgggacgatgccctccgtcggggcgtgctgagagcac

SEQ ID NO: 6510 - DNA, 2613 bp, Myxococcus xanthus
atgcacttgaaccgagtgctccgggaaaccggagttgttgtcgccgcaggtctgctgtacggatccgcggctttcgcgcagtcgagcacgatcatcggtacggtgatcgacgctcagagtcggcagcctgccgctgacgtcgttgtgaccgccacctcgcccaaccttcagggtgagcagacggtcgtcaccgacgcgcagggtaactaccgcatcccccagttgccccccggcgactacaccctgcggttcgagaaggagcagttcaagccgtacgctcgttcggccatccagctgcgtctcaaccgcaccatccgcgtcaacgtggagctgctccccgaggcgctcggtgaggtggttgagatcgtcggcgcgcccccgaccatcgacgtgggttccacgacgatgggcgtgaacgtcgatcaggagttcatcaagcgcatcgccgttgcgcgtccgggtggcaagggcggcgcgacccgctccttcgagtccctggccgagctcgcgcctggcgcccagaacgacaactacggcgtgtccatcaacggctcgacctcgcctgagaacggctacgtggtggacggcctgtccacgaacgacccggccttcggcgtgaacgccagcccgttgagcatcgagttcgtgcaggacgtgaacatcatcaccggcggttacatgccggagttcggccggtccaccggcggcgtcatcaacgcggtcacccggtcgggctccaacgagttccacggctccgtgttcgcgaactggacgccgggcaccctcgagggtacccgcaagcagattcgtgaagagggcacggtcatcaccggccagaaccagctgcagaacctgggcgacttcggcgccaccctcggtggtccgatcctcaaggacaagctgtggttcttcgccggcttcgcgccgtcgttcacccgctaccagcacacccgcacgctcaatgcgctgcgcgtcgatgacgaaggcaacacgatcaaggacgagaccgacttcacggtcgcggacgcgatccccggttccgccaggaagtactacgccgactcccgtaccattcagtacatgggtaagttgacgtacctcatcaaccaggaccacaacgtgtcgttcgccctgaacggtacgccgacctcgacgggtggccttgggaagctgagcgtcaatccccagtcgggaggcctgcggggcgtgctggctacccgtcggggtgacttcggtcttacggagacgaaggccaacacgacgtctctggccctgaagtacgccggtgccttcgcggacaagaaggtcctcgttgatgcgaacctcggctggttccaccagaccgcgtccaccctgccgggtgacggcagcaacctgggcgatcgcacgggcctggctggctactcgcggatggtgtacaccaccccgcgcgcgctgaccctgttcgaagccctgcccgaagggcaggagggtgcctgcggcagcacgccggaagagcaactgctccgctgcccggtgacgggctacggggtgggtggccctggcttcatgagcgaccagacgctggatcgctaccaggccaacgcgaaggccacctacctgctgaacgcgctgggcacccacgtgttcaaggcaggcgtggacgtcgagttgctgtcgttcgaccaggtgaaggcgtacggcggcggcgtgttcttccaggagggttcgaactacggggttgctggccagggccccgccgtgcacgatgcgcgtcgctacgggtatcagaccggtcctgactctgcggtgacgcagttcacccaggttgccaagacgaccagcaccacggtcggtggcttcctccaggactcctggtccatcgcgaaccgggtgactctgaacctgggcgtccgctacgacgtgcaggcgctctacggcggcaatggcgacctctcgctgctgctcggcaatcagtggtcgccgcgtatcggcgccatcgtcgacccgttcgccaacggccgcgcgaaggtgttcgtgaacttcgctcgttactacgagcaggtcccgctcaacctgatggaccgcgcgttcccgggtgagaaccgcatctccgcgcgtcgctccctcgcggagccgggccagggcacggcgacctcgtgcgacccgtccagcttcgagagccagcaggctacgtgcaacaccgactcgaacctgcttgccattccggagagcagccgcaacgtgaaccgcttctacacgggcggcacggttggcgggacgccggtcgacccggacatcaaggcccagtcctctgacgaaatcgtggtcggcgccgagtacgaagtgctggcgaacacccgcctgggtgcgagctacacgcacaaggacatgaactcggtcatcgaggacatgagccgcgacgacggcaacacgtacttcctcggtaaccccggcagcggcttcgccggtgagttcccgacgccggttcgtaactacgacaacgtcaccgtctacctgaaccgtacgttcgccgacggctggctcgcccaggccaactacacctggtcgcgcctgtacggtaactatcctggtctgttccgtcctgagacgggccagctcgacccgaacatc

SEQ ID NO: 6511 - DNA, 1482 bp, Myxococcus xanthus
gcgcggggctccaacttcgtggaccgcccgaagggcaacttcgtggaccgccccacgggcctgccccagggcaccccgtcggcgctgccggcctcggccttcaccttcggctccggccacgtcgccgtccgtcccttcgcggcgagcgcggcccgcgcgcccgtgacgctgacggcgtccgccacgcccagcgcgaaggtgaacgacctccagacgacgacgtccaccgtgtccttcgaccaggacgtgaagctggactcgctgaagctgaacctggatctggcgcacaccttcaagggtgacctggtcgtcaagctgaccagcccctccggcaagacggagacgctccacaaccgcaagggcggcagcgcggacaacatcaagggcagcttcgacctggccgccttcaagggcgagtccaccaagggcacctggacgctctcggtcgaggacaaggcgcgccgcgacacgggcaccctgaagagctggagcctggacgccgccggccagacgacgggcacgggccccatcgaggagccgaagccccagctctccggcccgccggtcatcgccgtgttcgacggcggcgtggacttcaagcactccgacctggatgacgcgatgtgggtcaacccgaacgaggtcgcgggtgacggcatcgacaacgacggcaacggcgtcaaggacgacatctacggctacaacgtcggctacaacagcggcgacgtgatgcgcggcagcggcacggaccacggcacgcacgtggccggcatcatcgccgccgaggacaacggcgagggcaacaccggcgtcgccgcgggcaaggcgaagatcatgagcctgggtggcctgtacaacggcgcggacctgctcacgaacttcgagcgcggcgtcgactacatggtgaagatgaagaccgagcacggcgtgaacatccgcgccgtcaacgcgagcttcggcaacgagtaccgtgacgcggcctccgtgaagcgctggacggacgcggtgcagaagctggctgacgcggacatcctcctcgtcgcggccacggcgaacggctacggcagcaacctgaacgacgtggcggacatgcccgccaacatcgacctgcccaacgtcatcaccgtggcgtccatggacaagaagaacgacaagctcgcggacttctcctcctacggggacaaggtcgtggagctggccgcggtgggtgaggacgtgctgagcaccgtcccgggcggcggctgggaggagatgagcggcacctccatggccaccccgacggtggcgggcgccgcggcgctgatgttcgccgaaaaccccaatctgacggccgcgcaggtgcgtgacctgctggtccagacggtggaggtggactccgacctcaagggcaaggtgagcaccagcggcaagctggacatcgaggccgccgtcgccgccgccaaggccacgctcgaggacgacaccgcggtcgccgggcgctga

SEQ ID NO: 6512 - DNA, 450 bp, Myxococcus xanthus
atggatgacccgctcagcctggaccggcaaatctgcttcccgctctacgcggcggcccgggcgatgacgcaggcgtatgcgccgctgctgtcgcggctgggcctgacgtacccgcagtacctggtgttgctggtgctgtgggagacggacggggagacggtgaaggggatgggggagcggctgtacctggactcggggacgctcacgccgctgctcaagcggatggagtcccagggcctggtgcggcgggagcggagcgcggaggacgcgcgctcggtgcgcatctacctgacgtccgaagggagggccctgcgccgcaaggccacgtccattcccgaagcgatggcctgcaagttggggctgacgctggaggaggcgacccgcctgcgccgcgacgtccagcgccttttcgaagtgctttcgcagtctcacgttgattccgcgaagtaa

SEQ ID NO: 6513 - DNA, 438 bp, Myxococcus xanthus
atggctcccgtcgctatctctccgctgtacagcacctccgccaccgcccacggtggtcgcaacggccgcgtgaagtcggaggacggcgtcctggacctgcccttggccatgcccaaggagctgggtggcgcgggcggcgccgtcaccaacccggagcagctcttcgcggcgggttactccgcctgcttcgagagcgcgctgcggctggtggcgcgcatgcaggggaagaacctgggcaacgacgcgggcgtgcgcgccaccgtcaccatcggcaagacgccggacggcggcttcgggctcgcggtggagctccagggaatcctgccgggaatccccaatgacgaggcccagaagctgatggcggcggcccatgaggtgtgcccgtactcgaaggccacgcgcggcaacatcgacgtgaaggtctccgtcgctggctag

SEQ ID NO: 6514 - DNA, 1286 bp, Myxococcus xanthus
atgctgtgcgcggccctggcccttggcacgagctgcaagagcgtggagccccacaccacgccctccgaggacaccaccgcgccgccggaagtttccacccaggagcccgtgacggagacgaagtcggagaccgagacggcgacggaggcgccaacgcggcgcggcaactcgccctggctgcgggcacgcgtgggcgaccgcgtggcgtattccttctccgccaaccgcaaggccatgggccggcagcagcccggcaccgtgccagaggccgcggtggccggcgtggtgacgctggaggtcgtggcggtggagttgccctgggtctgggtgacgctctacttcaccgaggatggcggcgcgccgtcgcggcggccgatgctcgcgcggccgctggtggtgcccgtgcgcgcggatgagtcgcgtgcgctggaggtcccccgcgagggcaagcagagcaccgagcagctcaccgccgcgggccgccactgggaggcgaagcgctacctcaacgacaagcggatgatggacgggcccctggagaaccgcctctacgcggcgacacctgggccgctgtacctcaccaatggcctgctcgacgcgagcaccacactggctggcttcggcatgggcggcggctcacagctcaccctggtggaagcgcgccagggacaggagggtggcaccggcttgcctccgacgctcgcccgcccttgggggccgggcacctggttcgacatgcggatggagacggaaggcaccacgtccgtgctgcgcacctgccaggccgcggagcgaggcttcatcctgcgtcagcaagtgacgccgcccacctcgggagcggcgtgcccggacttcgcccaggcggaagccgtgcccctggaggaggcggtgctcgcgcgcatctgggagtcactggacgcacggcaatggccccctgctcccgagggcctcgcaccggcgaagcgagagacgctgacggtgggcacgcaccgcgtgccggtgctccagttcgagaccgcgcaaccccaggcgaacaacgtccgcgtacaggcctacgccgccgacccctgggaggatgcgctagcggggctggcccacgagggcccgcttccagcccgctgctcgaccacgtcacgcccggtggtggcggcacgcagatcacggcctggggcgtgtgggtgccgggcgtcacgccgtaggcgccttgtgtcccggcacgcgcgcgcttgtcgaacagcgcgcgcgtgctctggcttcctttcgcgccgaccaatgacatggccacc

SEQ ID NO: 6515 - DNA, 1359 bp, Myxococcus xanthus
atgaacgacgtgctgaagtcactgacggtgctcgacttgtcgggcggctcggtgtcggcggtgagctacgactccacgaagccgctggagcagctcctggcggaggccaccatccgcatcccggaggacggcagccttacggcgctgctggggcagatcaagggcgcgcgcgtgcgggtgcgcgtgggcggcgcgcaggtggagggctccatcatcggcctggactcgctggcggtggcgtccggtgagacgagcctgatgcgcccgttcctgtcgctgctggtgggcgcctcgctgcggaccttcgacatcctggacgtgtcggagctggagttcctggacgaggcggtgcgcaaggatttggagttctacctggccacggtgctgtcctcgtacaagaaggactccaagcggatggccatcctcacctcgggccagggcgagcgcgagctgttcgtcagctacgtggtggagtcgccggtgtggaagacgagctaccgcatcctcctggacgagggcgagccgccgctgctccagggctgggcgctggtggacaacaccggtgacgaggactgggtggacgtgaagctgtcgctcattgccgggctgccggtgtctttcgtgcatgacctgtacaacccccggtacatgaagcggccggtggtggaggtgacgacggaggccgccgccgcgccggtgattccggaggagagcttcggcagcgccggggacatgatgatggagcaggagatggccgcgccgatgatgtccgccatgcccgccgcggcccccatggccgcgccgcgccgctctcgggcggagaaggccatggtgggcggccctggccgtggaggcccgagtcggcgcgaggccatggagacgagcgccgcggtgacgacgctcacgaaggaggtgggggacctcttcgagtacggcgtggaccgtccggtgacggtgcaccgcaaccagagcgcgctggtgcccatcctgcacaagcccttcgagggcaagcgggtgctcctctacaatcgggccacgcgtgagaagaaccccatggcgtgcatcgagctgaagaacaccacggggctgacgctggaaggcggcccggtgacggtgtcggaggacgagcgctacgtgggcgaggcgatgctcgacacgatgaagccgaatgaccggcgcttcgtgccctacgcggtggagttgggctgcgtggtgtcgattgaagaccgcacggaggacgggccggtgttccgggtggcggtgaactccgggatgctggtggcggagtatttccacgtgcggcgcacgatgtacctgtcgcgcaacaaggggcagcgggcgcaggtgctgtacgtggag

SEQ ID NO: 6516 - DNA, 1620 bp, Myxococcus xanthus
cgcaagcgcgtgcccgaagtgcggcagatgacgatgacggactgtggcgccgcctgtctggccatggtgctggcctaccacggccgccacatgggcctggacgcggtgcgcgaggtgacaggccccggacgtgacggcgccagcgcgaaggcgctgaaggccgcggcccagaagctgggcctgcgcgtgcgcgccatctccgtggacctggaccggctgcccttccttcctccggccaccatcctccactggcgcttcacgcactacgtcgtcttcgagcgcctgggccgcggctgggtcgaggtggtggaccccgaccagggccgccgccgcgtctccatggagcagttcagccagtgcttcaccggcgtggcgctgctgctggagccgtccgagaacttccagccgggccacacgcggcgcgggccctaccgctacctggtgcccctggtgaagcggcaggccggcacgctggtgaaggtgctcgcgctgtccgccgtgctccaggtgctgacgctggcggtgccgctgctcaccggcatggtggtggaccgcgtggtgccccggcaggactactcgctgatgggggtgctgtccgcggcgctcgcgggcgtgttgctcttcgagctgctcacgtcggtggtgcgaggccagctcctggtggagctgcgcacgcggctggactcgcagatgacgcaggggctgctggaccacctggtgagcctggcctacccgttcttccagctccggcccgcgggcgacctgctgacgcggctgggctcgcagcaggccatccgcgaactgctctccacgggcctgctgtccagcgcgctcgacggtgcgctggtgctcctctacctgggcctgctgctggtggcggatgcgtcgctggggctgctggtggtggggctgggcctgttgcaggtgctggtgttcgcgctgccccgggccagacaacgcagccacctgtcgcgcagcctggacatgggcgtgcgcagccagagctacctgatggccatgctgtccggcatgcagacgctcaaggcctttggcgtggaggaccgcatggtgggcagctactccaacctctacgtggacctgctcaacgtggagttggagcgaggccgcctctccgcgtggctggacgcgctgacgggcacgctgcgccgcgtgtccccactggtgttgctgtgcgtgggcgcgtggcgcgtgctggacggcgcgatgtccctgggacagatgctgagcatcaacgcgctggccaccgcgctgctggtgcccctgtccaacctgctgggcaccggcgggcagctccagttcctgagcacctacctggagcgcatcaacgacgtgctggacacgccccccgaacgcgacgcggcgcaccggggccgcgcgcccacgctgcgcggcgccatcaccctggaggacgtgcgcttccgctacaacccccactccgcctgggtggtgcaaggcgtgtcggtcagcgtggagccggggcagatggtggcgctcgtcggccgttcgggcgcgggcaagagcaccctggcgcacctgctgctggggctctacctgcccacctccggacacgtccggtacgacggcgcggagctgggcgaa

SEQ ID NO: 6517 - DNA, 216 bp, Myxococcus xanthus
atgcagccacccaccgacggccgcccctccatcttccgcaaggaagccctggcgcactaccagcgcgtcgtgcaggacgaaggtgacctgctgcgcatcggcggacagtggacgcggtggacgttcgcgctcctgttcgtcttcggcctcgcgctggcgatgggtgtcctggcgtggccggcgctcattgccccggaaggaaacgtgccgccatga

SEQ ID NO: 6518 - DNA, 210 bp, Myxococcus xanthus
atgagcaagaaggaacacatcctccgtgcgtggcgtgaccccgagtacttcaacagcctgtcgtcggaggagcgcgcggccctgcccgccaaccccgccgccgagctggaattgagcgacgaggtcctggagagcatctcgggtgcggacagctgcgagcagttcggcagctactactgcacgccgtgcccgccctacgtgtgcatgtag

SEQ ID NO: 6519 - DNA, 216 bp, Myxococcus xanthus
atggagggcccgttgggtgcgcgcacgctcacccccacgctgcggcccgtgctggaggccctccaccacgtgctcgcgggcggcgaggtgtcggtgcaactgctccagcgcggcaacgcggacatcgtcaacgaactgaacctccgggccgaacgcgccaccgaggagtcgtccagcctgggtacggggggtgacatcctgtccgccaccgtatga

SEQ ID NO: 6520 - DNA, 786 bp, Myxococcus xanthus
atgcccatcgccgagctgaatggacagggaatctacttcgaggactccggtggaaacggccggcccatcatcctgggccatggcttcctcatggaccaccggatgttcgacgcgcaggtggcggcgctcgctcccgagttccgcgtcatccgctgggatgcccgcggcttcgggcagacacgctgggacggcaagcccttcacgccgtgggactcggccgcggactgcgtggcgctgctggaccacctgggcatcgagcgagccgtcgtgggcggcatgtcccagggcggatacagcgcgctgcgcgtggcgctgaagcaccccgagcgcgtccgggcgctggtgctgctgagcacccggggcaccaacgacgacgcacccacccgcgccgcctaccagcagtccgccgacatctgggagacgcagggccccatcgacccgctggtgcaggggctggcacaggccatcatcggggacacgcgctacttcgacacctggctgccacgctggcggcaaatccccggcggacacttcgccaacgccatccgctcgctcatcgaccgggacgacatctccggacggctgacggagattcgctgccccgccatcgtcttccacgggctggaggaccacggcatgcccccggtccacggcgagcacctgcaccagacgctgcccggcagcgtgcgcttcgtcccggttcccggcgccgcacacgcggcgaacatgacgcacccggaagccgtcaatccggcgctgctggagttcctgcgcgcccacgcctga

SEQ ID NO: 6521 - DNA, 216 bp, Myxococcus xanthus
atgagccagaagaaggaccacatcctccgcgcgtggcgtgaccccgagtacttcaacagcctgtcgtcggaggagcgcgcggccctgcccgccaaccccgccgccgagctggagttgggggacgaccttctggaggtcatcaccggcggcgacttctgcctgcccggccagtccagcgcccagtgcacgccgtgcccgccgcgtcactgtctctga

SEQ ID NO: 6522 - DNA, 375 bp, Myxococcus xanthus
gcgctggactccaccctggcgagggggttcggccgcaaccacggtctgtgccacggagacctgggcaacgcggacttcctgttggaagcggcggccacgctcggggactcgaagctccaggagcgcacgaatgcggtggcgggcggcatcctgcgcggcatctccgagcacggctacctcttcggcctgcaaggcagcacggagacgccgggcatgatggtgggcctggcgggcatcgcctacggactggcgcggctggccatgccggagcggttgccctcgctgctgacggtcgcgcctccacgaatcgtccgaggtgaagggctgggcaccccggatggccgtccctccagccgcaaccaggagctgtcatga

SEQ ID NO: 6523 - DNA, 177 bp, Myxococcus xanthus
tggctggtgaccgacccggtgcaggcgcaggaccagctcatccacttcatgaagaacctctccatggcgggtggagcgctgttcatcgtctacttcgggtccgggcccttcagcctgcggcgcaagaaggcggaagggctggggagcgggaggctgggcgttccgctgcggccttga

SEQ ID NO: 6524 - DNA, 555 bp, Myxococcus xanthus
atgtccacggtgccactgggcatggccatcatcgaccgcgagctgcgcttcgtcgccgccaacccggcgtacctgttcgtctttgtcagcaagctggacgagctgcttggccggagcgtcttcgaggcctttccggacgacccctcggacccgaacaacgccaatctccggcagctccgggagtccttcctgcgcgtcctggcaaagcgggcgccggacatcctggccctgattccctaccgcgtccccgagttgacgaatcagggcgtcgtcccgacgtaccggtactggagcgccacccacatccccctgctcgatgcctcgggcgaggtggcctacatcctccagcacaccatggacgtcacggagctccagcggctgcaggaggccgtccagtccgtgaccggcgccaccggcacccgcaagcctccaccgtcgcaactggaagcaggcgtcttccagcgcgcgctgcaagtccaggaagcgaaccagaacctggaccaggagcggcgccacctccgccgactgttcgagcaggcgcccggcttcatgtgc

SEQ ID NO: 6525 - DNA, 237 bp, Myxococcus xanthus
atggaggactacctgccatgggacctgaagctcccgccgggcgaccggcccggaggggagtgcctctatcggcgagagtcctacgacgtgacagcggctccgtacgaaggcggaatcatcctcgtgagcatctcgctggaccccgacgcatgcgagagaaagggtgccccctacgacatgggggcgcggtatgcgatcgactcgaagacctggcgaatccttgcggtccagcgctga

SEQ ID NO: 6526 - DNA, 453 bp, Myxococcus xanthus
atgaagctcccgggcgcgaccgacagggattacggacaggagtactgcggcctcatctactcccgaggcgacggcatctaccgcgtcagccatccctctcccctcggccgatggcaactgcgcagggaagcgacgaagaagtcctgctttcccgttcgcaaggtcatcgaccccgaggcccggtctctctccatcctcgccgactaccacagtcatccctggcacccttcgccgctatccgagccggaccggcgcgcagccaatcaactctggctcatcaagattcagttcgattcggcgtgccacatccagaagctgatcccccacctggatgatgtagacaggcccggcgaggtctactcgcgccgagggaagcagtgggtccgcatcgggctcatcaagcccgcagacaaaccgttcggcttcatcacccccgtcggacgcgaggactga

SEQ ID NO: 6527 - DNA, 711 bp, Myxococcus xanthus
atgcatgccgagcatgacggcctgcgcatcgcgcagctgtcggacgtgcacgtggggcaggccacctcggcgctgcgaatccgccgcgcggtggaggcggtcaacgaggagaagccggacctggtgttcctcaccggcgactacgtcacgcacagtcccaaaccgttgccgcgcgtgcgcgagctgctggctggcatcgagggccccgtctacgtggtgctgggcaaccatgaccactgggtgaacgcaccgtacctgcgcgagtccttcgaacggatgggctacacggtgctgcagaatgagcaccggcaggtgcacgtgaagggcgcgccggtgacggtgctgggcgtcgacgacggactcaccggccgggacgacgtggaggccaccttccggggtgcgccggtgtccggcacgcggctggtgctggcccacacgccgcccacggcggagaagctaccggcacacgcggggctggtgcagttctccgggcacacgcacggcggccagttcgtggtgcgcggtctgacggaggccctcttccgccgcgcgggtcagccgtacatccgcggccactatcacgtgaatggcaaccagttgtacgtgaaccggggcctgggcttcggcttcggcggcccctacctgcggcggggcagcgagccggaggtggccttcttcacgctgcgacaggccgccgtcagcgccgggtag

SEQ ID NO: 6528 - DNA, 921 bp, Myxococcus xanthus
ggcttccggatggaggacctggacgacccggagctgcgaatcccctacgccgcgttggacggcctcctggagcgggcggcggagctgtccggggacgccaacctggggctgcacatcgcccgcgtggacgtggtggacctggatgacccggccaccttcgtcgtcctcacctgcgcgacgctgcgggaagccatggagcggggctgccgctaccagcgcgtctggggagacggagagcgcttcctgatggaggagacggagcgcggcgtgcgcatgcgcttcacacccgtgggcgcgccccggcccgcacaccggcacctggtggacgcggcgctggtgcagttcgccaccggagtaagggccttcacgggcgtggacgtccggccgctcgtcgtgcgcttcacccacaccgcgcccgcggacctccgcgagcacgaggcgctcttcgggtgtcccttggagttcggcgctcccttcaacgccatcgagttctcccacgaggacgcccagcggcccttcatccacgggaacgcgctgctcaacgccatgttccaacggcaggcccagcgcgcgttggagcggctgccggacgtgtccacgaccaccgagcgcgtccggcaacaggtccggcgcgagctggccggcggggacttctccttcgtggccgttgcccgggccctgcggcagccgccgcggacgctccagcggcggctcgcgggcgaggggcagagctatgcggccatcgtcgaagccctgcgccgagagctttccgagtcctacctccagcgccgcatgtccatcgccgaggtgtccttcctcctcggctatgcggacccggtggccttccaccgcgccttcaagcgctggtggggggtgagcccggagggcttccggagggagcggctccaggccccacgctga

SEQ ID NO: 6529 - DNA, 2196 bp, Myxococcus xanthus
  unsure (1)..(2196): unsure at all n locations
gctctaaagaccgcggcgcgcaaggtgcccggcgtggtgaaggtgctcatggccgaggacatccccggcatgaacgacaccggccccatccgccacgacgagccgctgctggcggaccgcgaggtgctcttccacgggcagattgtcgcgctggtcgtgggcgagtccgtggaggcctgccgcgcgggcgcccgcgccgtggaggtggagtacgagcccctgcccgccatcctcacggtggaggacgccgtggcgcggagcagctaccacaccgagccgcacgtcatccgccggggcgacgtggacgccgcgctggacagcagcccccaccgcctgtcgggcacgctggccattggcgggcaggagcacttctacctggagacgcaggccgccttcgccgagcgcggtgacgacggcgacatcaccgtcgtgtcctccacccagcacccgtccgaggtacaggccatcatctcccacgtgctgcacctgccgcgcagccgcgtggtggtgcagtccccccgcatgggcggcggcttcggcggaaaggagacgcagggcaacgcgcccgccgcgttcgtcgcgctggccgcgtggcacacgggacgctcggtgcggtggatgctggaccgcgacgtggacatggcggtgacgggcaagcgccacccgttccataccgcctatgaggtgggcttcgacgaccaggggcggctgctggccctgcgcgtccagttggtatccaacggtggctggtccctggacctgtccgagtccatcctggaccgtgcgctgttccacctggacaacgcgtactacgtgccggcgctggcgtactcggggcgggtggcgaagacccacctcgtctccaacaccgccttccgcggcttcggtggtccgcagggcatgctggtgacggaggaggtcctggcccgcgtggcccgggccgtggggctgccggcggacgaggtccgcgagcgcaacctctaccgcggcaccggggagacgaacaccacgcactacggccaggagctggaggacgagcgaatcctccgcgtctgggaggagctcaagaagtcgtcggagttcgagcgccggcaacgcgacgtggcggcgttcaacgcccaatcccccttcatcaagcggggactggccatcaccccgatgaagttcggcatctccttcaccgccaccttcctcaaccaggccggcgcgttggtgcacgtgtaccgggacggctcggtcatggtgtcccacggcggcacggagatgggccagggcctgcacaccaaggtgctgggcgtggtcatgcgcgaactgggcgtcacggtggacgccgtgcggatggcgaagacggcgacggacaaggtgcccaacacctccgccaccgcggcctccagcggctccgacctgaacggcgccgccgtgcgggtggcctgcgtcacgctgcgggagcggctggccccggtggccgtgcggctgatgtcggaccggcacgggcgcagcgtgacgccggatgccctgctgttcagcgatgggaaggtgggcctgcgcggtgagcccgagctctccttgtccttcgcggacgtggtggaggcggcgtacctgtcccgggtgggcctgtcctcgacgggctactaccagacgccgggcatcggctacgacaaggccaagggccgcggacgccccttcctctacttctcctacagcgcggnggtgtgcgaggtggaggtggaccgccacaccggcatcaagcgcgtgctgcgcgtggacctgctggaggacgtgggcgattcgctcaaccccgccgtggaccgcgggcagattgaaggcggcttcgtccagggcctgggctggctcacaggcgaggagcttcgctgggacgcgaatggccggctgctcacgcactccgccagcacctacgcggtgccggccttcagcgacgcgcccatcgacttccgggtgcggctgctggagcgggcgcaccagcacaacaccatccacggcagcaaggccgtgggcgagccccccctgatgctggccatgtccgcgcgagaggccctgcgggaggcggtggccgcgttcggccaggccggtggcgacgtggagctggcctcccccgccacgcacgaagcgctgttcctcgccatccagaagcggctggcgcgcgcggcggcggagggcgggcgcgaggcggcctga

SEQ ID NO: 6530 - DNA, 606 bp, Myxococcus xanthus
atgcggctgttgttccgaatcacccccgtgctgttggggctggcgctggcggcctgctcgggcatccgcgtcaacaccaactatgaccccacggccgtcgagcgcatcgatgacttccgccggtacgcttggctgccgcagccccagggcaaggacgcccgcgtctacaatgacatcattgacgtgcgcgtgcgcatggcggtggaccaggagctgaaggcccgtggctaccagagggtggacatgagcgaggacccggactttctcgtggggtggcagggcgccatcaacaccaaggtgtctgtcgacacggtggactccttctatggctacccctggggcccatactggagcccctggagttccttctacggaccctacggctatccgtacgggatggggggcccgcgcacctatgtccgcgaatacgacgtgggcacgctcatcctcgacggcgtggatgcccgggagcagcggctggtctggcgcggcacggcccaggcggagctccaccgcaacctgtcgcccgatgcactccagaagaagatcaacgacgccgtgcacaagatgctgtcgcgcttcccgccccgcccggaagcgtcctga

SEQ ID NO: 6531 - DNA, 1656 bp, Myxococcus xanthus
atgagccgccccgccgtgcccggcttcttccggcacctgtggctgctgtgggggctgcgcttcgacatcgggttgaatcagggccccggacgcagccggctgctggcggtggccgcattcgccgcgtcgagcgcgccgggcctcttcctgggcctgacgttcttcgcgctgatgcggctgcggcccatcgcggagagcgacgtgtggccctacttcatcctcaacctgctgtgcttcgtcaccttctcggtgtgggtgacgtggccgctgttgtccgcgggtgtggatgaccactccgagctgagccgctacgccgccttccccatctcccccttccggctgctcatcgcgtcgacggtggccagcctcttcgagccgcgcgcgctcgtcttctacgcgccgctcaccggggccgcgctgggcttcgcgtccgtctatgtgctgtacatgccgtggctggcggtggtcctctacgtcctcttcgcgctcctgtgcgcggcctggagccgggtggcgctgtacgccgtcatcaacgtgctgcgggcgaagcacagcgcggaaatcatgggcggaggactggcgctcttcctcctgggcgcgtcgttcattccgcccatcgacacctcgtggctgacggcggtgggcgaggcgggcgtggacgcgctggacatgtccctcatcatcaacgcggcggtggcgctgggccgcgtgcccccggggctcttcggagacgcgctggcgcagctcgcctggcaccggccccgggcggccatgttcgaggcggcggcgctgctcttcttcgcgggcgtgggcatggcggtggcctacgcgctgctgatgcgctttcaccggcaggcgggccgcgcggggggctcgagcaaggactcgggggatagcaacccgttcgccaccacgcggacgcgctacaccacgctggtgacgcgcgaggccctggacctgtggcgcaacccgcgcgcgcggctgctggcgtcggtgcccttcatcctggccatcctgctgaagctgctgtccggaagggacttgttcgtgttcctcctgggcggctcggcggatgcgtggctgatggggggcctgtgcatctacggcgcggtggtgattgcgtccacgttctcccagaacaccttcgcgtacgacggacagggcttcgcggccttcctggcggcgcccctggacctggcggacgtgctgcgcgcgaagaatcaagtgcagggcgcggcggcgctcgggatggcggcaatggtggcgctcttctaccgggtgtacttcggcttcggcaccgggctggacatgctgtgcgccatggcggccgtgggcgccgtggtgcccatgctgctggccgcgggcaacttcctgtcgctgtacttcccggtgaagttccacgcgagcctcaagcggcgggacaaggttccgctgacggcctccatgctgggcatcctcgcggccagcgcgggctgcatgcccttcggctgggcgctcaagctggcgggcaaggaagggcccacgtggcacacggcggcgatgattctcctggccgccgcgttgaacgtggcgctgtatcgcggggtgcttcccctggcgctgcggctgctggagcggcggcgtgaagtggtgctccaggcggtgacgcgggagtag

SEQ ID NO: 6532 - DNA, 1002 bp, Myxococcus xanthus
tggtacgcggtggcgcggtcaccggcgctcgggacaggacggcccttgggaatccagcgcctggggcggcggctcgtgctctggcgggacgccgcgggcgaggcccactgcgcggatgcggcctgtccccaccggggcgcggaccttgggctcggacgcgtgcggcagggggcgctcgaatgcccctaccacggcttccgttacggcggtggcggcgcctgtctggccatgccctgtgaggggcctgacgcgaagccctcgcgaggcctcgcgctgcgcatgcatccggtgcgagaggcgcatgggttcatctgggcatggctggggggcagggcgcccgcgtcccttcccgcgttgccctggctcgcggacgcgccggaacctgattcgagcagcgccgcggtggaggaggtctggaacgcacgcttcacccgggtcatggaggggatgatggacctccatcactttcccttcgcgcaccggcgttatgtcccgccgggctacacgcggttggacccctatgaggtccacgtggacgcaggggctattcgcaccgtcggctggctgcgcaaggagacacgtccgcctgggacggggttccgtttcgccatcgacgtgggctacccgggcgtcctccacctgcgcttcacgccccggctggtcgccgccgtcgtctgcacgcccgtggatgccgagcacacgtggatcgcggcgcgcttccaccagcaatacgtccggctgccagggctccggtggctcgctgcccggctggcgattgcgttcgagttccgcttcatccagccggacgactaccggatggtccgctccagcctgcctcgctccggtgcgctgactcacggcacgctcattcgggcggaccgcgccatcgtcgcgtggcatgagctgcatcgcgcggcgctcggcgacactcctggcgcatcctgatagaagcgctgcgtccgatgccccgtccccgcgccagcaggctcgaccccgagcgca

SEQ ID NO: 6533 - DNA, 309 bp, Myxococcus xanthus
atgtcgcaggcgcgcacccatccgaagcttcaggcggcgtggctgcgcttcgaagggccgctggtggcgtggttccagcgcgtcctggcggacgggcgcgcgctgggcgcggtgcgtggcgatgtgccggagtccctgctgctgacgtccctcatgggtatcggacaggtcacggatgggtggctgctcgaacagtgggcgcacagcggcgtgccggcgctccagcgcggggcggagcaggtgttctccctcttcgaggacctgctggtccccaggcccgtgggcccgcctcccgcgaagcggcgctga

SEQ ID NO: 6534 - DNA, 282 bp, Myxococcus xanthus
atgcgaaacctgttcccctggcgggcggggccgtcaatcatctggcgcatgcccccgccatcatggacttctcccgtgccccggaatgtgcagcgacgggtacgggcgctcgtcttcgtcacggtgttcctggacctggtgggcttcggcctcatcatcccgttgctgccgttctacgtggagtccatgggcgggacggccacgacggcgggtgtgctgctggcgttgttctccttcgcgcagctcgtcgcctcgccggtctggggcggctgtcggccgggg

SEQ ID NO: 6535 - DNA, 576 bp, Myxococcus xanthus
ggcttcgatacccccggcatggaccgcgacatcgtgccgggcaacgacttctacggcttcgccaacggcacctgggtgaagcggacggagattccgccggaccgctccagctacaacatgttcaccacgctggcggagcaggcggaccagcgcaaccgcgagctcatcgaggagcagcgccaggcccccgagggcagcgaagcccggaaggtgggcgacatcttcgccagcttcatggatgaggcggccatcgaggccaagggcgtggcgccgctcaagccggagctggagcgcatcgccgccatcgggcagcgcaagcaactggccacggtgctgggcgccaccctccgcgcggacgtggacgcgctcaacatgggcgacgtcaccacggaccggctcttcggcctctgggtggccgaggacctgaacgagccgtcgcgctacgccccctacctgctgcaaggcggcctgtggctgcccgaccgggactactacctggtcgacaacccgcgcttcacggagctgcgcaagagctaccaggcgcacatcgcgtccatgctaagatggccggcttcg

SEQ ID NO: 6536 - DNA, 2196 bp, Myxococcus xanthus
gttggcgcgtgtactgcaccgggccccttcgtgcccatcgacccgtcagcaccggcacaaggcaagtccttcatcctgaaggacagcgacgcttccgtgctgctcaccgtgcaaccgctggcggacgcctggaagccgcatgttctgcatctgttgtgcctggacacacggggcgtcgaacctggcgtaacggcccacggatgacgtcacggtggaggtgcgcggagagaacctcgcgtacgtgatctacacgttcggctccacggtcacgcccaagggcgtcatggtgcagcaccactagctggcctcgctgtacgtggcctcgaacctcgagttccacctggggcaagagccggggcagtggatcagtctcaacgcgccgctctacttctacgtcagcatggaccagctcgtccatctggcggacgggcactgcttgtgcctgctgcccgacgacacacggagggatccggaggcgatgctggcgtggctggagcaacagcgcgtggacgtcctggactgcacgcccgcgcaactgacgcttctgctccaggccgggctgctggagcgtgcccacgtcccgtcgcggattctgtgcgcgggtgaagccatggacccgtcgctctggagccgcctggcgaacacggagcgcacgacggcgttcaacgcctacggccccaccgagagcaccgtgtacgccacctatgcgcgcgtgcagcacagcccgagtccggtccctgtcatcggcaagccgctcgcggggactcgggcattcgtgctggatgcgcgccagcaactggcccccctgggcaccgcgggcgaactctatctggcgggggatggcctggcccgaggctacctgggccagccaggcctcaccgcggagcgcttcgtcccccacccgttcgcgtccacgccgggcgagcggctctatcgcacgggcgacaaggcccgctggcggcatgacggcacgctggagtacctggggcggctcgacttccaggtgaagctgcgcggcttccgtatcgagctgggcgaaatcgaagcggccctgcgtgcgcacgaagcggtccaggacgccgtggtgctggcgcgcgaggacgtgcccggcgacaagcggctcgtggcctacatcgtgggcggctccgccaccgtggaggcgctgcgtcagcacctccagcagcggctgcccgagtacatggtgcctccggccttcgtctcactgccggccctgcccctgaaccccagtggaaaggtggaccgcaaggccctgccctcgcccacgctcgcggacacccggagccaggaggcccacgtggcgccgcgggatgggctcgagctgcggctcgtgcggacctgggagcagctcctgggcgtggagcccatcagcgtgcgctccagcttcttcgagctgggaggccactcgctgctggccgtgcgtctggtcgcggccctgcgcgagtccctgggccggccgcttcccctgtccgcgctgttccaggcgcccacggtggagcagctcgccgcgctcctgcgccgcgaggacgcgggaccgacgtcgtcactggtcccgttcgacgcgggccggagtggaacggaggttccgttcttctgcgtgcaccctgtcggaggcaacgtcctggcctacgcggagctggcccggctgctggggccggagcgcccgttctacggactccaggcgcaagggctcgacggcagcacgccgccgctgggcacggtggaggagatggccgccgcctatgtggaggccatccgcacggtccaacccgccgggccctacctgctgggcggctggtccgtgggcggcgtcattgcctatgaaatggcgcgccagcttcgcgagcgtggcgacacggtggccctgttggcgctcatcgacgcctacacgcccgcggtgctcaacgccgccgaaccggagcccgacgccgcgcaggtcgtctccgctttcgcgagcgacctgctgggcatcgggttcacggacctggccacgccggacgcgtccctgtcacccgaggcccaggtagaagcgctctgggaagccggtcagcgcgcgggcgccttaccgcccggaatggagcccgcgcacctgcgggccctgctccaggtgttcgaggccaacctctgggccggccgccgataccagccgcccgcgctgaacccgggccgggtgttgcg

SEQ ID NO: 6537 - DNA, 1875 bp, Myxococcus xanthus
atgagcggagcgtccagaagcctgaaggtcgacgggaaggtgctggagggaatcagccggggcccgctgccagcctcgcgcaaggtgtacgtgcccggcgtgctgcacccggacctgcgcgtgcccctgcgcgaaatcagccagacgcccacgcgcctcggccacggcccggacgcgaaggagacggccaacccgccggtgcacgtctacgactccagcgggccgtatacggatccggccgcggagctcgacctgcggcaggggctgcccgcgctgcgcgagtcctggatcctgggccgcaatgacaccgaagcgctgtccggcgtgagctccgaatacggccgcgcccgtgaagcggacccgcgtctggcgggcctgcgcttcgcccaccgccgctcgccgcgcgtggcgaagtccggcgccaacgtcacgcagttgcactacgcgcgcaagggcatcatcaccccggagatggagtacgtggcgctgcgggagaatctccaggtggaggcgtcgctcgcggcccagcacccgggccagtcgtggggcgcggcgattccgcgggtgattacgcccgagttcgtgcgcgacgaaatcgcgcggggccgcgccatcatcccggccaacatcaaccacccggagctggagccgatgatcatcggccgcaacttcctggtgaagatcaacgccaacatcggcaactcggccgtcacgtcttccatcgaggaagaggtggagaagatggtgtggtccatccgctggggcgcggacacggtgatggacctgtccaccggccgaaacatccacgagacgcgcgagtggatcctccgcaacgcgccggtgcccatcggcaccgtgcccatctaccaggcgctggagaaggtgggcggcaaggcggaggacctcacctgggagctgtaccgcgacacgctcatcgagcagtgcgagcagggcgtggattacttcaccatccacgcgggcgtgctgctgcgctacgtgccgtggacggcgaagcgcctgaccggcatcgtcagccgtggcggctccatcatggccaagtggtgcctcgcccaccaccgggagaactgcctgtccacgcagttcgaggaaatctgcgaaatcatgaaggcgtacgacgtgagcttcagcctgggagacgggctgcggccgggctccatcgcggatgccaacgacgcggcgcacttcggtgagctggagacgctgggcgagctcacccagattgcctggaagcacgacgtgcaggtgatgattgaaggcccgggccacgtgcccatgcacctcatccaggagaacatgacgaagcagctggccgtgtgcggcgaggcgccgttctacacgctggggcctctcaccacggacatcgcgccgggctacgaccacttcaccagcggcatcggcgcggcgatgatcggctggttcggcacggcgatgctctgctacgtgacgcccaaggagcacctgggcctgccggatcgggacgacgtgaaggaaggcgtcatcacgtacaagattgccgcccacgccgcggacctggccaaggggcatccaggggcccaggcccgggacaacgcgctgtccaaggcccgcttcgagttccgttgggaggaccagttcaacctgtcgctggaccccgagcgcgcccgcgccttccacgacgagacgcttccggcggaaggcgcgaaggtggcgcacttctgctccatgtgcggtccgcagttctgctccatgaagatcacgcaagaggtgcgtgacttcgcggcgaagcagggcgtgagcgacgacaccgcgcttcagtccgcgctcgatgagaagagcgcggaattcaagaaggctgggagccagttgtaccgctag

SEQ ID NO: 6538 - DNA, 346 bp, Myxococcus xanthus
acgccgatgccgacccaggatgagaagacgatggggctgctcgctcacatgggcaccatcctggccaacttcgtgggcctgggcttcgccgtgccgctggtgctgatgctgacgaagggcaaggagtcctccttcgtccgcgcccacgccgtggagtcgctgaacttccagatcacggtgttcatcgcggccttcgtcagcgccatcacggtttgcatcggcattggcgccgtcctgctgcccatcgtcggcatcgtcgccatcgtcttcgccatcatcgcgggcctgaaggcgaacgagggtcagctctacaagtacccggtcaacattcgactgggtgaagtag

SEQ ID NO: 6539 - DNA, 325 bp, Myxococcus xanthus; identical to SEQ ID NO: 48

SEQ ID NO: 6540 - DNA, 726 bp, Myxococcus xanthus
cgccccaacatcggcatcaccccggactggagtccggccggagaacagccctttgcccgctatgagctgaaggttccgtacgcggacgccgtccttcgcgcgggcgggctgcccttcgtgttgccgtattcggacgagccggcctgcgtggagtcctatctggaccgcatctccggggtgctcgtcacgggcggcgcgttcgacattcctccgtcggcctacggcgaggatgcgcgcgagggcttgggggcgctgaaggaagggcgtaccgctttcgaggcggcgctcatgcgcggcgcgctcaagcgcaacatgccgctgctgggcatctgtggcggcatgcaactgctcaacgtcatcctgggtggcacgctgtaccaggacatcggccgtgaggtggagggcgctcgcgagcatgagcagaagcacgaccgcacgcacccgcagcacccggtggacgtgaagagcggcacgttgctggcggaggcggtggggtatggccagttgatggtcaactccacccaccaccagtcggtgcgcggcgtgggcaaggacgtgacgattaccgcggtggcgccggatggcgtggtggaggccatcgagtcctccgtgcacaccttcgccgtgggcgtgcagtggcaccccgaatacatgtccacgaccattccggtgcacgtggggctctacaaggcgttcgtgcagaaggcgcgcgagcatcgccggtga

SEQ ID NO: 6541 - DNA, 180 bp, Myxococcus xanthus
atggtgcccgcgcgcgcgcagctcgaggccgcgcagcgggccctggaggacacgggcgcgtggtgggtggtggacccggtggtgcgcacctcccggggcgagccgctgacgcgcctgtccgcacgggcctacctgtctctggccgggcccgcgcgtggtgctcacgccgaacctggatga

SEQ ID NO: 6542 - DNA, 795 bp, Myxococcus xanthus
gcggtcgacgcccgcggactgcagaagcgctttggcggcttcagcgcgctcaacggcctggacctgcagattccccgcggcgccttctacgcgtacctgggccccaacggggccgggaagtccaccagcatcgccttgctgaccggggtgtacggtcccgacgcgggctccatccgcatgctcggggtggacgcggtggccaggcccatggaagtgaagcgccgcgtcggcgtggtgccggaggagctgagcctcttcgagcggctcaccggccggcagtacctcaccttctgcgcgcgcatgtacgggctggacggcgacgaggccgccgcgcgcgccaccgagctgctggagctgacggagctcacctacaaggccggcgcgctggtggcggagtactccaagggcatgcgccggaggctcgccatcgccgcggcgctgatccacgcgccggagctggtgctgctggacgagcccttcgagggcatcgacgtgctggccgccggcgtcatccgcgagctcctgcgcgagctgagtcgccgaggggtgacgctgctgctcaccacgcacgtgctggagatcgccgagcggctggccacgcacgcgggcatcatccgcggcggccgcatgctggaccaggggccggtgggctcgctgctgtcgcgatacgagtgcccgtcgttggaggcggtgttcgagaagctcatctccgtaccggcctcgcgcaacgcgcgcctgtccttctacggtgaggcgcccgcgtccgtgacgccgctgcgccaggagaccgcatga

SEQ ID NO: 6543 - DNA, 183 bp, Myxococcus xanthus
atgttcatccaccgtgagacgtctgacgaggcgggccccgacgggcattcggcgcagcagtttaacaccgtcatccccgtggagctcatcatcgccaagcagcgtaacggccccattggctccatcgacctggtgttcctggccgagtacacccgcttcgagagccggtcgcggagcgagtag

SEQ ID NO: 6544 - DNA, 1083 bp, Myxococcus xanthus
atgctcagtgcctcaggccaggaccgctcgccctccatccgtgccgtggggcgagcactcccgccgcactacgccagtcaggaggagctcatcgccgcgttccgcgagctgtgggccacgcgccacttcaacctggagcggctggaggacctgcaccgcgccgtccaggtgggaggacggcatctggcgttgcccctggaggcttatccgccgctgctgacattccaacagcgcaatgacgcctggattcgctcggccacggagctgggcgaaacggtggtgcgcaaggccttggacgcggcggagctcacgcccggggaggtggaccacgtcttcttcgtcaccgtgacgggcatcgccacgccgagcatcgacgcgcggctggccaaccgcatgcgcttccgggaggacttcaagcgcacgccgctcttcggactgggatgcgtggcgggcgcggcgggcgtggcccgggcggcggactacctgcgcggctttccggagcacacagcggtcgtcatcgccgtggagttgtgttcgctcacgttgcagcgcgaggacctgtccataccgaacatcatcgcgtccggcctctttggcgacggcgcggcgtgcgcggtgctccgcggcgcggcggccccaggtgcgcgagggccgcgggtggtggcgtcgcgctccgtgttctacccggacaccgagcgcatcatgggctgggacgtggtggacaccggcttcaaggtggtgctgtccgcgaaggtgccggggctcgtgaaggaccacatccggggcaacgtggatggcttcctcgcgcagcatggactgaagcgcggggacatccggcactgggtggcgcacaccggcgggcccaaggtgctggaggccttcgaggaggcgctggagctggcaccctcggcgctggagcgctcgtgggcctccctgcgcgaggtgggcaatctctcctccgcgtcggtgctcttcgtgctcggagagacgctggagtccgttcgcgcgcagccgggggagtggggcgtgatgatggccatggggccgggcttcggcgcggagatggtgttgctgcgatggtga

SEQ ID NO: 6545 - DNA, 135 bp, Myxococcus xanthus
atggtgacctccacgcatgccctcttcctgggcttcatggccgcgctcgtcgtggagcggctggtggagctggttctctccaagcgcaacgccgcccgggccttcgcgcgcggcggggtggagactttagagcac

SEQ ID NO: 6546 - DNA, 429 bp, Myxococcus xanthus
atgaaagtccccgttaccgcgacaggccggccattggacttttcgaccgcgggaatcagcgccacccccatcgtccacgtcaaggtggcaacccgcctctcggagctggcgcccgacgacgtgcagttcatccccgtggacgtcgaaggccagccggatcaatacctcatcctcgtagcgacgaagctcattcggtgcattgacccgaacgcgagcagagaagtccgctactggaagccggagcacggccaacccgagcgagtgggcgaataccgctccgtcgcgggcctgcgcatcgacccgggccttgtgggcagcgccaagctgttccggacatggggctgggacatcgccctgattgtctctgaagacctcaaggtggccatcgagcaggagcagaccacgggcgcacgcttcaccgaggtgtag

SEQ ID NO: 6547 - DNA, 169 bp, Myxococcus xanthus
atggacaccttcggctacgacgggctccacatcgattgggagccggtggaagcggccgacaagccgaacctgctcgcgctggtgaaggagctccgcgcggcgaagccgaacatgctgctcaccttccccatcgggtggctcaacagcaacttcgccagcgacgcgttag

SEQ ID NO: 6548 - DNA, 96 bp, Myxococcus xanthus
atggtcctggtgtacgggctcgtggtggcgccggtactgcacgcggtggtggagcacggcgatggtggtcatcaccactcccatgcccatctttag

SEQ ID NO: 6549 - DNA, 219 bp, Myxococcus xanthus
atggcatgtggctcggagcaggagcccaaggcgtgtcccggtaccgagggggcgtcccagttgccgacggtggtgtccgcggcgcgaagcgaggcggccctgacggacgatggcggggatgacgtcatcatcgccttccggcagcgcgtcttcgcctccgcgcaggccaacacggatgctttcgccaacgaggtgacgcgcgctgcaggtcagggaagc

SEQ ID NO: 6550 - DNA, 378 bp, Myxococcus xanthus
atgtcccacatcctggtcgtcgatgacgacgcgagccaccgcacgctcatctgcgatgcactcgaggaaatgggctatcccacggttcaagcggccaacggtcgtgaggcgctggacctgctggagggagacatgccctccgccgtgctgctcgacttgcggatgccagtcatgagcggttggggattgctcgacgcactcaagaagatgccccgtgcgcggggtctgcccatcatcatcatctccggctacggcttcgaatgggaggccgagctcgtgggcgccgcgggctacatctccaagcccgtggacctggacaaggtgcggatgacggtgcagcagattgccggtccgccggagatgtcgctcgtccactga

SEQ ID NO: 6551 - DNA, 1605 bp, Myxococcus xanthus
acggagaccttcgacgtcctcatcatcgggggcggtgtcaccggcgcgggctcggcgcgggatgccgcgctccggggcctcaaggtggcgctcgtcgagcgtgacgacttcgccagtggcacctccagccgctcgtcccggctcatccacggcggccttcgctacctggagcacggccacctgggcctcgtcttcgaatccagcatcgagcgccaacgtctgctgcggctcgccccgcatctggtgcgtccgctcgccttcatctggcccgtgtacgcgggcgcccgcgtgcctcgctggaagctcaacgcgggcctcatgctctacgacgccctctccctcttccggaacgtgaagggctaccggcggctcaacgcccggcaggtccacgcggccgagccaggcctgcgcaccgaccacctcaagggcggtgcccgctactacgacgcggccacggacgacgcgcgcctcaccctggccaatgccgtgggcgcgtccgaggcgggcgccgtcgtcctcaaccacgcgtccgtgaaggcgctcgtcctggagcagggacaagcgcacggcgcgacggtggtggaccacctcaccggcgaggaggtcaccgtgcgcgcacgggccctcgtcaacgccacgggcccgtggagtgatgaaatccgccggctggatgcgccgaatggggcgagcccggccgtgcgcggcagcaagggcgtccacctcgccgtaccgcgcgagcgcatcaaccaccgcgacgccttcacgctgctgtcccccaaggacggccgggtgatgttcgtgctgcccgccgacaacttcaccatcattggcaccacggagacgtccacgcgcgcgcaccccgcggaggtccgcgccagcgagtccgacgtggcctacctgctggagtccgccaacgccttcttccccgaggcgcgcctcactcgcgcggacgtggtgagcgcgtgggccggcatccgccccctggtggccagcggctaccacggcacacaggccgacgcgggcagtgccagccgcgagcacgccatcgacgtgagcccctccggcgtgctcgccatcagcggtggcaagctcaccacctatcgcgtcatggcgcgcgacgtggtggacgctgtggagcgccgcctgggccagcctcgccgccgctcgcccacggatgtgttgcccctgccgggtggagacatccgcgcgctggacgccgagttcgccgcggcgcgcaccgaggtgggagacgacgccacagccgtccacctggtgcgcgcctatggcagccgctggcgccgcgtgtgggccctgacgcgagaggacgccgcgctgtcccggccgctcgccgaggggcttccctaccgggccgccgaggccgcctggggtgtcacccacgaactggtgcacaccctgtcggacctgctcatccgccgcctcaaggtggcgttcgagacgcgcgaccaggggcaggcggccgcgcgtgtggcggccgaggtcatggcgccccggttgggctgggacgccgcggagacgcagcggcaactggacgtctatgccgccgatgcgctccgccttttcggtgtggatccggccgaggcgtga

SEQ ID NO: 6552 - DNA, 3282 bp, Myxococcus xanthus
gactggtactacaacgcgggcttcgacgaggcctccggcaacgcgcagatgcagaacttcggccgtggcggcatcgagggtgacccgctgcgcgtcgaggggcaggactacaacggccgcaacaacgccaacatggccacgccggcggacggcatctcgccccgcatgcagatgtatgtcttcgacggcatgcccctcctccaggtgacggcccccgcatcgctggcccgcgcctacgtgaacggggatagccgcttcggggcccaggagtacacgctggacggtccggtgcaggtgctcgcgcccacgggacggacactcggctgcacgcccttcgaggcgggcacgttcgccggccacgtggcgctgctcgaccgcggcgcctgcgacttcgtcaccaaggcgctgaacgcgcaggacgccggcgccatcgcggtcctcgtggccaacaccaatgccggtgagggccctctctccatgagcggagacgacgcacgcgtcacggtgcccgtggcctccatctcccgggagacggcggacctctggaaggcggaggtggccgccaacgcgagcaccgtccaggtgcgcctgcaccgctccaaggacctggaccgtgacggcacgctcgacaacaccatcatcgcccacgagtggggccactacatcagcaaccgcctcatcggtaacgccagcggcctcaccaacaaccagggccgctccatgggcgaaggctgggcggacgtgcacgcgctgctgatggtggtgcgtgaaggggacgactacgcgcgcggagcctacgccgtcggcggctacgtttcgggcggtggcggcggcgacggctactactacggcgtgcgccgcgcgccttacgccaccgcaccgacgctggcgtcgagccgcaacgcgctgaccttccggcacatcgagaacggcaatccccttccgacgagccacccgctcgcctacggtcaggcgggcctcggcaactccgccgtgcacagcagcggcgaggtgtgggcctccatgctctgggagtgctacgtgtcgctcctccaggcccaccccttccaggaggcccaggaccgcatgaagcactacctggtcgccgggtacaaggccacgcccgtctcccccaccttcctcgaggcgcgcgacgcgctgctcgcggtcaccgccgcgagcgacccggccgactaccagcgcttcctccaggccttcgccaagcgcggtgccggcatgggcgcgaaggcgccggaccgtgactccatggaccacgtgggcgtggtggagagcttcgcggcgggcaacttcatcgaggtcacctccctgcggctcgatgacgccctggagggctgcgacaaggacggcgtgctcgacgtgggcgagacgggcctgctgcgcgtgagcgtgcgcaacgtgggcagcggttcgctgggcgccttctccggcaccgtctccaccaccagcagcacggccacgctggagttcccctcgggcaacaccctgaccttcagctcgatgggccgcggcggcacggccaccgccaccctcccggtgaggttggccgccgcgcagccgaacgcacacgccggcctgcgcatcaccttcgacgagccctcgctccccgccagcgcgagcagcacgacgtttgaccctcgggtgaactacgacgaagtgcccggcgcggcggcggaggacgacttcgagggcgccctgtcgtcatggacctcgtccacgtggctcaacccctacggcgaggcggactggaaggtccagggtccggagggcgggcgctacatgcacgcgcccaacccggcagtacaggcggacctcttcctcatctccccctggatgaaggtgaatgagaccggcgccttctcgttcagcttccgctaccgccactcgttcgagtccgacatctaccccggcggctccatcttcccgtactacgacggcgccgtcctcgagttcacccacgacggcctgcagtggtacgacatcgccgcgatgggcgtggcctccatctactccatcgacccgacggacggctccccgggctacatcgagcaggggcccaacccgctgatgtaccgcaacgcgtgggtgggccagaacgtcacgcaggagaacggcaagacggtgcgcttcccggagtggtccaccgccgagctgcggctggcggacatgttcgccggcaagaacgtccagttccgcttccgcattggtaccgacaccgcggtgggcgcgtacggcttcgacctggacgacgtgcgcttcaccaacgtggagcgcatgcccttcagcggccgggtggacgagcagggcgacggcgccacctgcaaccagcggccggtggccaacgccgggcgcgacgtcggcagccccagcgccccggtgtatgagcgcgtgaggaaccccgagacgggggcactggagctcgtgcgccacacgctggacggcaccgccagctatgacccggagggccagcccctcacctaccactggacgcaggtgagcgggccggcggtcaccctggtgaacgcggacacggccaccccgtcgttcacggcggatgtgcccgacgactccatcctgacgttccagctcgtggtgcgcgatggcctggagaccagcgcggcacaccaggtccgggcctgggtcctcaacgtcaaccgcgcccccacggcggtggtgaccgcgccggcggaggtggcggagttctcctcggagcccgtgacgctggacgcccgcgcctcgagcgacccggacggggagctcatctcctacaagtgggcgcagacgtccggtcccgccgtcgcgctcaaggcgggctccagcgccacgccgagcttcaaggtgcccgaggtggccgtcgatactcagttcaccttcacgctggtggtgaaccactgcagggaccagagcaagacggccaccgtgacggtgatggtgcgcaacgttgaccgggcgcccgtggcggatgcgggctccgagcaggtggtggacccgctggccaccgcgagcctcagcgcgacggctggtggacccggacggggatgccctcacctgtacgtggcgtcaggtggagggccccgcggtggagctgcagggagccgacacggccaccccgtcgttcaccgcccccgaggtgcgggcggagacggtgctgcgcttcgaggccatcgccagcgcgaacgggctgtccagcgccccgatgacggcgacggtgacggtgcggcacgccaacaaggcgccccaggcccttccgcggctggtgggtga

SEQ ID NO: 6553 - DNA, 426 bp, Myxococcus xanthus
atgacggcgacggtgacggtgcggcacgccaacaaggcgccccaggcccttccgcggctggtgggtgacgctcggtcgggggcgcaggtgacgctcgacgcgtccgcgtccagcgacccggatggcgacgccctcaccttcgggtggaagcaggtggcgggaccgtccgtcaccctctccgcgtccgagggtgcgcaggtgacgttccgcgcgcccgaggtgaagcaggccgtgacgctgcacttcgagctcaccgcgacggacgcccgcggcggcgccagcacggcggtgctcggggtgacggtgcagccgtcctctagcggctcctcgggtggctgctccagcacgggcggctcatcgcctgggctgctgctctccctgttcgggctgctcgtgggagccgttcgcacccggcgacgcgcgtag

SEQ ID NO: 6554 - DNA, 2863 bp, Myxococcus xanthus
gtgggcgcgacctggggcgtcatcgctccggatgaagtggggccgccgaacatcgggcgttccatgccccacgtggacacctatgtgctcgacgaggcgctccagccggttccggtgggagtcgcgggcgagctgtacgtcggcgggccgtcggtggcccgtggctatctggaccggccggatctcacggccgagcgcttcatccccgacccccacggcggcgagcccggggcccggctctaccgcacgggcgacatggcccgccgccgcgcggatggacggctggacttccaggggcgcgcggacgcgcaactgaagatccgtggcttccgcatcgagccgggcgaggtggagacggcgctgcgcgaactcgccggcatgcgccaggcccacgtcacctcgtggcgtccttccgtggatggcgagccgcggctggtcgcgtacgtcgtgccaccgcccggagacatccttccaccgggagagctccgggcacgcctgcgcgagcagctccccgagcacatgattccggtcgacatcgtcccggtggaggcgcttccgctgctggccacgggcaaggtggacgtgcgggcgctgccgcggccgtcgctcgccgtgtcgccagcgggcaagcctcgcacgccgctggaagagaccgtggcgcgcgcctgggcggaggccctggggctgcccgccgtggacgtgcatgcccacttcttcgacgacctgggcggcagctcgctgtccgcggtgcgcgcgtgctcgcggctgggcgaggcgctgggccaggacgtccccatcacccacttcttcgaacatcccaccatccacgaactcgcccgcaggttgcaggccgaggcacgccccgagcccacctctgacgtgaagcaccagtcgcgcgcggaggcccgccggcaggcgctccagcggcgcggaaggaacccccggggccaggactgagcacgacaccatgagcgagaacaacggcagcgcgggtagcgacatcgccatcatcggcatcgccagccgcttccccgggagcgcggatgcgcgggccttctggcgcaacctccgcgaaggtgtggagtccatttcccgcgtgcccgtcgaggcgctggagccctctccgctgatgtccgaggcggtgcgccatcatccggacttcgtgccagtggcggcggagctggaaggtggagaccgcttcgacgcggccttcttcggcatggccccgcgcgaggcggagtggatggatccgcagcagcgcgtgttcctggagtgcgcctggacggcgctggaggacgcggcgctcgacccggagcgcttcgcggggaaaatctcgctctacgcgggcgcgagcgcatccctgcacggcctggcgatgttggggcaggggaacctggacccggcctcgttctacgagctgatgagcacctccgcggagaacctggcgacgcgggcgtccttcaaactgggactgcggggcgaaagcctgtccctctacactgcctgctccacgggactggtggccgtccacatggcctgccagagcctgctgatgcgccagtcggacgtggcgctggcgggcgcggtgcgcctggcgatgccgcagcgctcgggctacctgttccaggaggggatgatcctgtcgccggacgggcactgccgcgcgttcgacgcgcgcgcggcgggaacggtgccgggcaacggcgtggcggtggtggtgctcaagccgttggaggacgcgcgcagggatggtgatcgcgtgtacgcggtcatccgcggctcctccatcaacaacgacggcggcctgaaggtcggctacacggcgcccagcgtggaggggcaggcggacgtcatcggcgaggcgctggccttcgcgggcctggacgcgggcgacatcggctacgtggaggcgcacggcacgggcacctcgttgggagaccccatcgaggtcgcggcgctcacgcgggcgtaccggcggcacacggaccggaaggggtactgcgcgctggggtcggtgaagccgaacgtcggccacctggacacggccgccggtctggcggggctcatcaaggccacgctggccctggcgcatgaggaactgccgcccacgctccatttcgagcggccgaatcccgccatcgacttcgcgaacagcccgttcttcgtcgtcgaccgcctgcggccctggccccggggcccggtgcctcgccgcgcgggcgtcagctcgttcggaatcggagggacgaacgcgcacgcggtgctggaggaagcgccgcttccggagcctgcctcgcccagtgtccggcccacccaactcgtgacgctgtcgggccgctcggcggaggccttggacgccgcggtgcgggacctggcctcctggatggaggccgcaccgaccgacgtggcgctggaggacgtggccttcacgcgcaacgtgggccgccgtgccttcgagcaccggcgcgccttcgtggcgaaggaccgcgcggagttgctggcgaagctgcgcggcccggggaagtcccaggtcgtggagcacgtcgtggcggcacgcgagcagggcgtggccttccttttcccgggccagggcgcgcagacggtgggcatgggacgcgcgcttcacgcagcggagcccgtctaccgtgaggccctggaggcctgcctggaggggctgggggcccggttgggggcggcggtgcgtgacgtgctgtttccctcgcctggagccgaggccgccgcggagcagacgttggccgaccctggcatcgcgttgcccgccttgttcgccgtggagtacgcgctggcgcgtcagtgggaagcctggggcgtgcgcccgcgcgcgctgctggggcacagcttcggg

SEQ ID NO: 6555 - DNA, 1125 bp, Myxococcus xanthus
gtcacctcggtgtttcagcccatcgtggacttgctgcgtggcgaggtcatcgggcacgaagtgctttcgcgaggacccggcgagttccgcgagccgcacgtgctcttcacgcaggcgcgattggaaggctacacgtgggagctggagcgcgcgtgctggacgtccgcgctgcgctgcatctccacgctgccggaggcgcaacgcagcgcgcccttcttcttcaacgtcagcccggacgtgctgagcgacccgcgattcggggatggctccacggaggagctgctcgcgcgctacgggctgaacccgaagaacctggtgctcgaaatcacggagaaggcggcgttcgaggacaacgcgctgctgcaacggctgacgcgacagtgttcggcgctgggcttcggcatcgcgctggatgacttcggcgcggggcactccggactggtgacgctggtgaacagcgcgccgcagttcatcaagctggaccaggcgctggtgcgggacatccaccgacacagctaccagcagcacctggtgaagtcgctggtgtccttcgcggccagcgtcaacgcgacgctgattgcggaaggcgtggagacgtggaacgagttggccgtgctgctccgcctgggcatccggcacgcgcagggctacctggtggcccgccccgctcccgtccccgtgcttcccagcgtcgagttcgaggcgcggcgccatgaagccatgcgcgcgctcgacttccgcgaggacgaggacgacgagacggtgggcagcatcgtcatccgccgcaactgcgtggagcggcccgtgacgcccgaggagttggagcggctgttccagcagaaggccgacgtggaccatgtcgccgtgctgcatagcgaacggctggaggcgctggtgttgcggcgcgcgacggccacgaagggcgcggcgcaggtggctccgctcatcgtcgaggaccggatggcgctcaccaccctggcgcggctcgccatggagcgcgcgcccgaagcgctctatgacccggtggtcgtcacggatgcccagaagcgattcctgggtaccgtcaccatgcagcaactcattcgccgcatcacggagttgctggaacggcgcacgccggcctga

SEQ ID NO: 6556 - DNA, 780 bp, Myxococcus xanthus
gctctcagggccacgccggcgctcctgggcgcgggggtggcgggcggcatcctgggcctcttcgtgggattgagcgcggtggccgcgcacctggcgctttcagcggacccggtggaggcgcgcgtggaggcgctgttgccgcagctcgccggtgacttccatgcgctgaccgagcgggcgttgaacctgtaccggcaatgcggtcagtccctggcgatgctccctcgcgagcccgctcgcgaggaactggcgcgcaccctgggaaagatgacgcgcgacgccgcggagctcgcgtctgaatgggcgggggtggaggcccaaatcgaggagcgcgcgcaagcggacctccaggccgaacgcgaagacctggagcgcagcgcccgcgccagcacggatgccatcgcgagacgccaactcgagctggccgcggcctccctgggtgaggaggtggagcggctgggcggcctgaaacaacggcgcgagcgcatcctcgcccgcctgagggcagaggtggcccagttggaacgagcccgtgtggccctgctgtcactgcgcagcgggcaggcccaactcaaggccgcggagctctctgccctggcgcgccgcttccgggccctctcctccctccagcgggaggaagcccagtccatggaggacgtatcttcaatgattcaaggggcttccatgcactcgtctccgctggaagtcagacaggccgagggcgaggaaagcccggcgtctggcccggcaagcgagcagccgagggtcggcgagtcttga

SEQ ID NO: 6557 - DNA, 435 bp, Myxococcus xanthus
atgcgcgacaagccgcccgctgagccgcccagctccgaagtcacccccgagaagacgtacctgcgccggcgcgagctgctgaagaacgcgggcctcttcgcgggcacggccgtcgccgtcgccggagggctgcacctgctgggccgcaagcagacgcgccccatggagcgcttcgtcccggacgcgggcctggtggagcaaccggtggcgcaggcgatgggccccttcgacacggacgagccgcgcacgccctacgaggacgtcaccacctacaacaacttctacgagttcggcttcgacaagaacgacccggcccgcttcgcgcacacgctgaagccgaagccgtggagcgtcgtcatcgacggcgaggtgcataaaccgcggacggtggacgtggagcagctcacgtcctggttctcccggaggactttagag

SEQ ID NO: 6558 - DNA, 828 bp, Myxococcus xanthus
catgcgcggcgggccggcgatggccagaaagcaggtgagatggagacttccgcccgccaactccgtccagcgccgcccggtccctggggcgtcgtcatcgcgctcatcatcatgggcgcgtggggtgggcaccttgcctgggcgctgacacgagcggagctgccgtgggtggagccgctcacctggctgcacgtcgctctccaggcctggctgtgcacgggcctcttcatcaccggccacgacgccatgcacggcacggtgtccggccggcgctgggtgaacgaggccgtgggcacggtcgcctgcttcctcttcgcggggctgtcctaccgtcggctggtggtgaaccaccgtgcccaccatgcccgacccacgagcgacgcggacccggacttttccacccacagccagtccttctggccgtggctgggtaccttcatggcccgctacaccacgctgccccagcttggggtgatggcggccaagttcaacgtgttgctcttcctgggcgtctcccagccacacatcctcggctattgggtgctgccctcggtgttgggcacgttgcagctcttctacttcggcacctacctgccgcaccggcgcccggagacgccggacatggcccctcaccacgcgcgcacgttgccgcgcaatcacctgtgggccctgctgtcgtgcttcttcttcggctaccactgggagcaccacgagtccccgggcacaccctggtggcggctgtggcgcctgaaggacgcccgggcccgtgaggccgcgctgacgcagagcaccgggacgctcccgggacaggaaggcaccgcccggtaa

SEQ ID NO: 6559 - DNA, 1557 bp, Myxococcus xanthus
ctacgggtggacctgaaggcgctgccggagtccgagcgccgcgccctggcccgcattgtccaggcctcgaagctgatggacacgctcttcctgcgtcagcggtgggcgggcaacgagccgctgctgctggacctggtccaggacacgacgccgctgggccgcgcgcggctgcaggcgttcctgttggacaaggggccctggaacagcctcgacgaggcgcggcccttcatcccgggcgtgccggccaagcccgcgtccgcgaacttctatccggctggcgccacccaggcggaggtggaggcgtgggtgaagtcgctgcccgaggcgcagcagaaggaggccaccggcttctacaccaccatccgccgcggcacggatggccgcttcatcacggtgccctacagcgtggagtaccagggcgagctggccctggccgccgcgttgctgcgtgaggccgctgcgctcacccagcagcccacgctgaaggcgttcctcacctcgcgcgcggacgcgttcctgtccaacgactactacgccagcgaggtggcgtggatggagctggacgccagcatcgagcccaccatcgggccctacgaggtctacgaggacgagtggttcaactacaaggccgccttcgaggccttcgtgggcctgcgcgacgacgcggagacgcagaagctggcgaagttcagcgggcagctccaggggctggagaacaacctccccatcgacccgaagctgcgcaacccgaagctgggcgcgctggcgcccatccgcgtcatcaacagcctgttctcctccggtgacggcaaccggggcgtgcagacggccgccttcaacctgcccaacgacgagcgggtgtcggagaagatgggctccaagcgcgtgatgctgaaaaacgtgcaggaggccaagttcgagcgcgtgctgctgcccatcgccaaggtggccctcaccccggcggaccagaaggacgtctccttcgatgccttcttcacgcacatcttgaggcatgaggtgaggccgggcctgggccccagcaacttcgcggtgggtggcaaggccaccaccgtgcgcaaggagctccagtcggcctccagcgccatcgaagaggcgaaggcggacatctccggcctgtgggcgctccagcgcctggtggacaccggcgtcatcgacaagtcgctggagcgcaccatgtacacgacgttcctggcctccgccttccgctccatccgcttcggcgtggacgaggcgcacggcaagggcatcgccgtgcagctcaactacttcctggacaccggcgcggtgaaggtgaacgcggacggcactttctccgtggtgccggcgaagatgaagaaggccgtcatctcgctgacgaagcagctcatggagattcagggccgcggcgaccggaaggccgccgaggcgctgctggcgaagctcggcgtggtgcgcccgcccgtgcagcgcgtgctggagcgcctcaaggacgtgccggtggacatcgagccgcgctacgtcaccgcggaggagctggtacgcgacgtgaagaagtag

SEQ ID NO: 6560 - DNA, 822 bp, Myxococcus xanthus
ggactgccgcccgtggtggacgcgcacgtccacctcttcccggaccgggtgttcgacgcggtgtggcgctggttcgaccagtacggctggcccatccgctacaagctgcacacgcgacaggtcgtgtccttcctcctgtcgcgaggtgtccaccgggtggtggcgctgcattacgcccaccggccaggcatggcccgcgcgctcaacgcctacgtggcggaggtggcccgggaagagcctcgtgtgctggggctcgccaccgtgctcccgggcgaacccgatgccacggccgtgttggaagaggcgttcgacgcgggcctgcgtggggtgaagattcattgccacgttcaatgcttctcacctgacgcgccgcaccttcacgaggtgtatgccgcgtgcgcgaaggcgggccgtccgctcgtcatgcacgcggggcgggagccctccagtccccactacaattgcgacacctacgcgctctgcgccgcggagcgggtggagcgcgtgctgaaggaccatcccacgctgaagctgtgcgtgccccacctgggcgcggacgagttcgacgcctacgcgcggctgctcgagcggcacgacaacctctggctggacaccaccatggccctggccgggtacttccccgtccccatcccccgccgcgcgctggaggtccggcccgagcgcatcatctacggcacggactttcccaacatcccctacgcctgggaccgtgagctgcggacgatgctggggatgaagttggatgacgcggtactcgcgggcatcctggggcagaatgcgctccagttgtacggagcgtga

SEQ ID NO: 6561 - DNA, 444 bp, Myxococcus xanthus
atgacgcccctgggctggctgggcctcaccgccgcccggcgcaagctggtgcgcggcctgtccggccacgtgctggaggtgggcaccggcaccggcctggcgttgcccggctacccggacaccgtcaccgccgtcaccgccatcgacgtggacgaagcggcgctcgcgcgcgcccagcgacggcggcccgacgcgcggctgctgtatgccagcgtggagtccctgcccttccccaccgcctccttcgacgccgtggtgtccagcctcgtcttctgcagcgtggaggccccggcgcaggcgctgacggagattttccgggtcctgcgcccgggcggcgcgctgcgcatgctggagcatgtgcgcgcgccctcgccagcgctggccaccgtgcaggacttgctcacccccgcctggatgcgggtgagcgggcggtgccggctggac

SEQ ID NO: 6562 - DNA, 168 bp, Myxococcus xanthus
atggcctacgtggacgcccgctacttcggactgacgcccgcgcagtacggctgcatcgcgctggcgctctacggcatctggggcgtcctgcggcctcaggcgccgggcgcggcctcctcgccgccgccgtcgtcgccgaagagcccgggaacggtaggcgtgcggtag

SEQ ID NO: 6563 - DNA, 970 bp, Myxococcus xanthus
ctccgggtccgctacctgggcaagaagggtgagctgtccggcgtgctgggcggcatgggcaagctgcccccggacgagcggcgctcgctgggcgaggtggccaacagcgtgaaggcggagctggagaagctgctcgccgaggccgtggagcgcgccgaggcggccgcgctggaggcccagcttcagggcccgggcctggacgtgacgctgcccggacgcggcgtggcgctgggcagccggcaccccgtgtcgcggacgatggaggagattgtccggaccttctcgcggctcggcttcgacgtggccagcggccccgagatcgagctggactacttcaacttcgaagcgctgaacctgccgaaggaccaccccgcgcgggacatgcaggacaccttctacgtggacgaggccacgctgggccacgcgaagaaggcggacagctccgcgctgctgcgcacgcacacgtccccggtgcaggtgcggtacatgctcaaccgcaagccgcccatccgcgcggtgatgccgggccgggtgtaccggcgcgactcggacatcacgcacacgccgatgttccaccaggtggaaggcctgctggtggacaagggcgtgacgttcgcccgagctgaagggctcgttggcggcgttcgtgacggcgttcttcggttcggacacgcgcacgcgcttccgccagtccttcttccccttcacggagccgtccgccgaggtggacatcacctgcacgaactgcgcgggcaagggctgccgcatctgcaatcagacggggtggttggaggtgctgggcagcggcatggtgcaccccaacgtcttcacctccgccgggtatgacccgaacgaggtgacgggctacgcgttcggcatgggcgtggagcgcatcgccatgctgcgctaccgcatcgacgacctgcggatgatgttcgagaacgacgcgcggttcctcgagcagttctga

SEQ ID NO: 6564 - DNA, 1691 bp, Myxococcus xanthus
atttcggtgaagtggctgggcgattacgtggcgctgccgccgtccgaggacgagctggcgcgcaagctgaccgccgcgggcctggagattgagggaatggagcgccccgcggaagcccttcgcggcgtggtggtggcgcaaatcaaggagtccgtgcagcaccccaacgcggacaagctgtccgtcacgcaggtggacatcggcgggacggcgctgctccaggtggtgtgcggcgcgaagaacttcaaggtgggcgacaaggtgccgctggccaccgtgggcgcgaagctgcccaacggcatggacatcaagcaggcggcgctgcgcggcgtggacagcttcggcatgctctgctcgtccaaggagctgggcctgagcgaggagtccagcggcctgctcatccttccggcggacacgcgcgtgggcacgcccatcgcggaggccgtggggctggatggcgtggtgctggaggtgaacgtcacgccgaaccgcccggacgcgctcagccacctgggcgtggcgcgcgaggtgagcgtggtgacgggctccgcgttgaaggtgccccagccgaagcccgcggagtcgggcacgcccgccgccgagcaggtgaaggtgcgcgtggaggccccggaccgctgcccgcgctacgtggcgcgcgtggtggagaacgtgaagattggcccgtctccgcagtggatgcaggaccggctgaaggcggccggggtgcgcgccatcaacaacgtggtggatgtcaccaactacgtgaacctggagtacgggcagccgctgcacgccttcgacctggagaagctggccggtcaggagattgtcgtccgtacggcgacgcgcggcgagaagctcaagacgctggacggcaaggaccgcgtcctggacgtggatgacctggtcatcgcggacaaggaccgggcgcaggccatcgctggcgtcatgggcggcggcgacagcgaggtgaccgagggcacccggcggctggtgctggagtcggcgaacttccagggttccacggtgcggcgttcgtcgaagcggcacgggctgcacacggaggcatcgcaccgcttcgagcgcggggcggacatggacgccgtggtgccggccattgaccgggcggcacagctcatcgcggagctggcggggggcacggtggctcctggccgcgtggacgtgtacccggcgccgaagccgcctcggaaggtgacgctgcgcttcgcccgggtggagcaggtgctgggcgtggccgtggcggagaaggaggtccgccgcatcctggaggcgctgggcttcaaggcggtggaggaggggacggggcaggcgacgtacgaggtgcctcgggcccgtgtcgacgtggagcgcgaggaggacctgttggaggaggtcgcgcgcatctacggctacgacaacattccggcgacgctcccgcggggactggccacgctggccccggagcccgcgaatgccgaggccgagcgccgcatgcgtcaggcgctggccggggcgggcttcgacgaggtggtgaactactcgttcgtcgcgccgcgcagcctggaggtgctgggtggggcggagaagccggtggcgctgctcaatccattgagcaccgagcagtcggtgatgcgcaccaacctgctgccgggcctgctggagaacctgtcccgcagcgtgcggcaccaggt

SEQ ID NO: 6565 - DNA, 1143 bp, Myxococcus xanthus
tgttccaagcagaaggaagaagcgcccccctccggcgcccagacccccgccgctgggaagacggaaaagaaggccctccccgtggggctcgtcatcgacgtgggcgggcgcggagaccactccttcaatgacgcggcgctccgtggcctggaactgtgggccgcgggcaagcgctacgagggcggcaagtacgtggacgccacccccgatgaggtccgccagtccctgccgccccacctgagctcggacgccgccagtttcaaggcgctggccatccagcccatcgtcctgcagagcaaggcccaggaggactacgtccccaatctccagctcctggtggaccagggcgcccggctcaccgtgggcaatggctacatgctggccaacgcggtgcgcacctccgcccaggaaaacccaaaggcccagttcctgctcatcgacagtcaggtgctggacgcgcagggcaaggccatgaagctgcccaacgtgcgcaccgtcctcttcaaggagcaggagggcagcttcctcgtgggcgcgctggccgggctggtgacgaagacgaacaaggtgggcttcgtgggcggcatcgaggtccccctcatccagcgcttcgaggtgggctaccgcgcgggcgtgaagacgaccaacgcccaggcgtcccaggcgctcatgtccgtctacacgggcagcttcaacaacatggccgccggcaagcaggtggcgcaggacctcatctccaagggcgcggacgtcctcttccacgccgcgggcgcggacggcatcggtgtcatccaggcggtgaaggaagcgcgcgccgcgggcaagagcgtgtacgccattggcgtggactccgaccagtcgcacgtggcgccggacgccatcctcacgtcgatgatgaagtactccgacctggccgtgtatcaggcggcgaaggacctggtggacggcacgttctccgcgggtgagcaggtgctcggcctcaaggagaacggcgtgggcatggcggaggtgcgggtggacttccccggcaaggcggaggcgctccagaaggtggaggccctgcgtcagcgcatcatctccgggacgatccaggtccccgccgtcccggcggacctcgcctccttccaggctgccgccccctga

SEQ ID NO: 6566 - DNA, 352 bp, Myxococcus xanthus
atgctcgtgcccacgctgtcggtggcggagaacgtggtgctgggccgagagcccacccgcaacggactgctggacctggagcgcgcggtgcaggacgtgtccgccacctgcgcccgcttcggcttccagttggagccccgggcgcgagtggacacgctcagcgtgggctcgcagcagaaggtggagatcgtcaaggcgctgcaccgcggcgcccaggtgctcatcctcgacgagcccaccgccgtcctcacgccgcaggaatccgacgagttggcgcgggtcatgcgcggactggtcgcgcagggccacaccgtggtgctcatcagccacaagctgaaagaggtgctcggcg

SEQ ID NO: 6567 - DNA, 879 bp, Myxococcus xanthus
gaactcatcaaggccaagcgggatggcggccggctggaaccggcggacatccgtgcgttcatcgaggcgtatacggcggggacggtggcggactaccagatggcggccatgtgcatggccatcttcttccggggcatggactcccgggagctgggcgcctgggcccgcgccatgctggagtccggtgaggtcctggacctgtccgacacgccgggtgtgaaggtggacaagcattcgacgggcggggtgggtgacaaggtctccctcagcctggcgccgctggccgccgcgtgcggagttccggtgcccatgatttcgggccggggcctggggcacacgggtgggaccctggacaagctggagtccatccccggcttcaacgtcaacctgccgacgtcggagtaccggcggctggtgcgcgaggtgaactgctgcctgattggccagacggcgcaggtggccccggcggacaagaagctctatgccctgcgggacgtgacggcgacggtggactgcatcccgctgattgcgtcctccatcatgagcaagaagctggcggagggcatcgacgcgctggtgctggacgtgaaggtgggcagtggcgccttcatgaagcgcgacgaggacgcgcgcacgctggcgaagacgatgattggcctgggcgcggagatggggaagaaggtcgtggccctgctcaccgacatggaccagccgctgggccgcaaggtgggcaacgcgctggaggtcatcgaggcggtggacatgctccgcggcaacgcgccggaggactacaccgaggtgacgtatgccctcccggcggagatgctggtgctgggcaagaagaccgccccggtggaggaggagcgcgagaaggtgcgc

SEQ ID NO: 6568 - DNA, 834 bp, Myxococcus xanthus
caggccttgcattccggatcggatgtccacagcttcctcaaccaggtctgtggccaggcctacgcgtccatctaccagccgccgcgcgagcgctggcccgcggtgcgggacttcttccgccgcgagttccccgccaccttgcgccgcgagcgtggcttcgtgggcgccagcgccgtgctgttcatcctgggcatcctgctgggcgccctggtggtgctgtgggagccccggggcgccgagctgctggtgccctccggcgtgcgccactacgtggcgcagggccgcatgtggacggatgacatcctgtcggtggcgccgcccaactcggtggcgtccggcatcgccaccaacaatctcaccgtcaccattgtcaccttcgccctgggcctcaccggcggcctgggcacgctgttcctgctggtgaacaacggggtgcatatcggcgccatcagcgcgctgtgcgcccgcgagggcatgctggggggattgctggacttcatcgccgcgcacggcccggtggagctgtccatcctggtcatcgccggcggggcgggactgatggtgggccaggcgctcatcgacccgggggagctgcctcggggacaggcgctggcggtgcgcgggcgggaagcggtgaagctggtgctgggctgcgcgcccttcctcgccctcatcggcgtggtggagggctacgtctccccaggggacatgttccccacctggctgaaggcggggctgggcctggtcctgggggcgctcttctgggcctacctgctgcgcgcgggaaggacggaggcggaggccacgggcgctccggccgacagcgcctcctga

SEQ ID NO: 6569 - DNA, 81 bp, Myxococcus xanthus
atggacgacgccgccctcctgcggggcctcctgggggcggtgcggcccgcaccggaggagattcgggccatcgccatctaa

SEQ ID NO: 6570 - DNA, 228 bp, Myxococcus xanthus
atgaagctgcccggactgttccgcaaagagcgcaccaccatccaggctgccgacgcgcaggaccacgccgagcggctcctcgccgagtcgctgcgcatgctgggccaggtctgcgccaaggtcgcagacgccatcgaggcgcagcggctgtcccgccaggggtatccgcacaacacctacctgcgacggaccgacggcgacgaggacgacaccgccaagaaggcgtag

SEQ ID NO: 6571 - DNA, 528 bp, Myxococcus xanthus
atgaaaatcactccgctcgacatccggcagaagcggttcgaaacggccctgcgcggcttctctcgccgtgaggtggaggcctacctcgagctcatcgccggtgaattcgaggaggtggtgaaggagaacatcgcgctcaaggaggaagtgaagcgcacccagttcaaggtggagcagcaccaggaacgggagcgcaccctccaggagaccatggtcaccgcccagcgcatcagcgaggacctgaaggacgccgcgaagaaggaagcggaaatcatcatcgcggacgccgagcatcaggcggagaagatcgtccacggtgcccaccagcggctggtgcaggtggtggaggacatcaacgagctgaagcgccagcgcacccaattcgagtcgcaggtccgctccgtgttggatgcccaccagaagctgctggagaccttcaagagccccacgttcgcggaccgcgactacgcgcgcgtcgaggacaacgtcgcgtatctgtcccagaagaaggccaacggcgactcctga

SEQ ID NO: 6572 - DNA, 495 bp, Myxococcus xanthus
atggccgcgctcgtggacggcgtggcgcacggcgagcccttcgagacggcctttggcaaggccttccgcacctcgctgttggtggaggagaccgactggcgtgaaggcctggccgcgcgctacggctggctcccgctcaccaccagctccgcgctcgtctggctgagcgcgtccttcctctgcgtggccgcctatgcccgccgccgccagcagcgcgccgcgaagctcgcggagatggcggcccaggatgccgcggaggacgccgcgctgcggctgctggccgcccaggccgcacaggcccaggcgcaaggcaccgccgtgagtgccggggactccacctggccggactggcccgcgggctcgcagggcacggaagcccacctggaagcccaggacagcgaggcgcccgcggacagcgccatcagcgacctcccgggtgaactggacgacgaagacggccttaacggccggccgccgaagcccaccctccactga

SEQ ID NO: 6573 - DNA, 355 bp, Myxococcus xanthus
atggtgctggcggcgcccgattcggacgcgtcgcggggcgcccccacccagttggacaacctggtggagcccttcatccgcgagctgggccggacgctcgcgggcgaggagtccagtccctggagccgcacgcgcgcggtgctgcgcttgtcggcgcaccggggcgcccgctcgctctatgacgaattcgcggcgctgcggcgctgcctggtggatgcctccgaggtgctcggtggcggggattgggagcgcgagcgcatcaaccgcgccgtggacgaagccgtggactccgcggtggcgctcctcccacggatgaaggacccgcgagcggatggcccacgggtgcccatcggtc

SEQ ID NO: 6574 - DNA, 123 bp, Myxococcus xanthus
atgcgcgagctgaacgcggcctatgagcgcatcctccggcaccgccagcgcaagcgtcaggaggcgctgtcggccggagcgcccgtggcctccgcctccgtccttcccgcgcgcagcaggtag

SEQ ID NO: 6575 - DNA, 291 bp, Myxococcus xanthus
atgaacacacgggagtccctggcgatgggcgaaacacacgaagcaggttggccgctgtccgcggcccagcatggaatctgggtcggccagcagttcgacctcacgagcgccatctacaacgcgggtgagtgcatcgaaatccgcgggccgctcgtcgtggagcacttcgagtctgccttgcgtcaggccatcgacgaggcggaggcgctccacgcgcgcttcgtccccggcgcctccggccccgtgcagttcgtgcagccccgcgcgtcgtggcagctacacgtcgccgac

SEQ ID NO: 6576 - DNA, 900 bp, Myxococcus xanthus
atggcgctccccgccatcgctccctatcccatgcccggcaccaccgacctgccgaagaacaaggtctcctggacgccggacccgagccgcgccgtactgctcatccacgacatgcagcgctacttcgtggaggccttcacgcagggccagtcgcccgtgacggagctggtcgccaacatccagcggctgcggcagcactgcacggcgctgggcatccccgtcgtgtactcggcccaaccgggtggccagacgcccgagcagcgcggcctgctgctggacttctggggcggcggcatcaacggcggaccggaccagaagcgcatcatcgacgcgctgacgcccgccgaaggcgacatccagctcaccaagtggcgctacagcgcgttccgcaagacggacctgatggaccagatgaagaagctgggccgcgatcagatcctcatctccggtatctacgcgcacatcggctgcctgcagacggccagcgacgccttcatgagcgacgtgcggcccttcctcatcgccgacgcgctgggtgacttctccctggcgcaccaccagctcgcgttgagctacgcagcccagctgtgcgccgtcaccaccaccacgcagcaggtgctcgacgcgctgggccccgtctccacgtccagcacactcacccgcgagcaggtgcgcgcagaggtggcggagctgctccaggagtcgccggaggcgctgggtgacgacgacaacctgctcgagcgcggaatggactccatccggctgatgacgctggtggagaagtggcgggccgctggcgcggagaccaccttcgtggagctggccgaacggccgacgctcgccgactggttcacgctgctctccctgggcaacacgcccgcttcccggaacgccgcgtag

SEQ ID NO: 6577 - DNA, 687 bp, Myxococcus xanthus
atgcgggtgaagcccacgctgggctgcacgctccagcaggtgttcggcatggccgagggcctggtcaactacacgcgcctggatgaccccgaggacgtcatcgtcagcacccagggccggcccatctccccggacgacgaaatccgggtggtggacgaggacggcgaagacgtagcgccgggcgagacgggccagttgctgacgcgcgggccgtacaccatccgcggctactacaaggcggaggcccacaacgcgaaggccttcaccgacgacggcttctaccacaccggtgacgtggtccgcgtgacgccccagggctacctggtggtggagggccgcgccaaggatcagatcaaccggggcggcgacaaggtcgcggccgaggaggtggaaaaccatctgctggcccaccccgacgtgcacgacgccgcggtggtcgccgttccggacgcgttcctcggcgagcgcacctgcgccttcgtcatcgcgcgcggcacgccgccagcgcccaatgtgctcacggccttcctgcgccagcgtggtctggccgccttcaagattcccgaccgggtcgagttcgtcgaggcgttccccaagacgggcgtcggcaaggtcagcaagaaggcgctgcgcgacgtgctcgccggcgctccctcccccactccggtttcgcgcgcgacgcgctga

SEQ ID NO: 6578 - DNA, 1005 bp, Myxococcus xanthus
cccctggcggtgggcgcggtgcccttcgacggctcggtacccgcacagctcgtggtgccgctgtctctccttctcgccgggccgctggtgttcgacaaggacgtcccggtgcagcggccgttcagcgccagctacaccgtccagccggtgccggagcccgccgcgtacctgaacggcgtcgcgcaggccctgaagctgatgcagagcgggccgctccagaaggtggtgctgtcacgttcgctgcacctcaacgccgccgcccccatcgacctgcggcagctgctgcgcaacctcgcgcagcgcaacccgtcgggctacaccttcgccgccgacctcccccagcaggatgggacccgcggcgcgggacttcgcacgctcattggcgccagccccgagctgctcgtgtcccgctccgggttccaggtggtcgccaatcccctggccggctccgcggcccgcagcgcggatccgctggaggaccaggagcgcgccgccgcgctgctgaagtcgcccaaggacctgcacgagcacgcggtggtcatcgacgccgtcgcggaggcgctgcggccgtactgcaagacgctgaacgtgcccgccggtccgtcgctcgtgaacaccgccaccatgtggcacctgtccagccgcatcaccggtgagctggccgacccctccatctcctcgctgacgctggcggcggccatgcacccgacgccggcggtgtgcggctatcctacacggctggcgcacgaggcgattggctccatcgagcccttcgagcgcggctactacaccggcacggtgggctggtgcgacgccacgggtgatgggcagtgggcggtgaccatccgttgcgcggaggccagtgagcgcaccctgcgcatcttcgcgggcgcgggcatcgtggtgggctccacgcccgagtccgagctggcggagaccgaggccaagttccgcaccatgctccacgccatgggcctgggccacggtgccggggtgcagtcatga

SEQ ID NO: 6579 - DNA, 675 bp, Myxococcus xanthus
ccggtgcggcgcgagttcctggacctgttccaccaccggctgctgtcgctgctgtaccgcatcgagtcgaagtaccgcgtcacgagcgagacggacacatccttctcggaccagtggtcccggcgcctgctggcgctgggcgggttcgacacctacgagaaggccctggagggtacgctgccgacctggcgcctgctgcggattgccccgctgctggccagccgggcgaggacgtccgagcagttggaggtcgcgctcgaggacgtgctgggcgacgacctggagggcgcgcgggtgtcggtgcgccagttcgtgggccgctgggtggacatcgacgcccgggcgcggctgggccactccaaccaccaactggggcgcaacatgctgctgggcggcaaggccttcgaccggacggggaagattcaaatccacatccggccgctgccgccgcgcgcctacaagcggctgatgcaggaaggggacttgctgccactggtgagagaagtggtagccctcttcgtgagggaccccctggagtacgatttggagctggggctcaccgaaggcgtgcagcaccagttccggctctccagccgggagccgagtcagctcgggcgggacacgtggctgggcctgagtcagcagacgcagatgagtgtccccgtggtgaaatga

SEQ ID NO: 6580 - DNA, 2542 bp, Myxococcus xanthus
  unsure (1)..(2542): unsure at all n locations
attcgcgtcgatccgaaagcgctcgtccgtcgcctgacgcccacctctacccgtctgctcgaggccgccgtggcccgggccagcgcgggacggttctatgaaatcgtcccggagcacatgctggtgcagatgctggagccggaggactcggacgtcgcgcgcatcctccagcagttcggcgtggaccgccgccacctgctggccagcatggagcgcgccctccagggcctgcgcgcgggcagctccggccggcccgtcttctccgagacgctgttccagtggttcgaggaagcgtggctcctggcttccgtggagcagggcgccacgcggctgcgctcgggcctgctgttcgcccagttcgtcagccggcgcgcgcgctacaccgcggagctgttccccgagctggacgccatcagccgcgacgagctgatgagctcgctggacgtggtgctgcggccctcgcccgagaatgtcgaggtcgcctccgcggatgccgccgccagtggcgccgcgggaggcgcggccagtggcgcgggcggccgtggggatgaagccctcaagcgcttcgccacgtccttcaccggccgggtgcgcgaggggaagatcgaccccatcttcggccggcaccgcgaaatccggcagatggtggacatcctctcccgccgccggaagaacaaccccatcctggtgggcgagcccggcgtgggcaagacggcgctggtggagggcctggcctgggccatcgtccggggcgaggtgcccgacgcgctgaagaacgtggagctgctggggctggacctgggcctgctccaggcgggcgcgggcgtgcgcggcgagttcgagaaccgcctcaaggccgtcatctccgaggtgaaggcctcccccacccccatcatcctgttcatcgacgaggcgcacaccatcatcggcgcgggcggctcgcagggcggcacggacgcgtccaacctgctcaagccggcgctggcgcgcggtgagctgcgcacgctcgcggtcaccacctgngccgagtacaagaagtacttcgagaaggacgccgcgctggagcggcgcttccagccggtcaaggtggaggagcccagcgaggaggacgcggagctgatgctgcgcggcctgcgccccacgtaggaagcggcccacggtgtcatcatccgcgaagaagccgtcgccgccgcggtgcgcctgtccagccggtacatctccggccggcagctcccggacaaggcggtggacctgttggacacgtccgcggcccgcgtgaagattgagctgtccacccggcccgaggagctggtgcaattggaccaggagatttcggcgctggagcgcgagcgagacacgcgcaagcgcgacctcgccgagggcacgggcggcccggacgaacagacgtccctggaggccgccgaggcgaagctgagcgccacggtggatgcacgagccacgctgcatgcgcgctgggagacggagcgtacggccgtcgcggcgctgatggaggcccgcaaggccctgcgcgaggccgctccggacacggactccgcgccactgaaggcggccgtggacgaagctgcggcgaagctggcggccacgcgcggcgaggtgccgctggtacacgcggacgtggacgcggacatcgtcgcgcgggtggtggcgggctggacgggcgtgcccgtggggaagatgcgcagcgacctgctggagtcggtgctcaacctggaggacaagctccggggccgggtgcggggccaggaggcggcgctgaagaaggttgcggaaatcatccgcatctcccaggccggcatccgcaacccggacacgcccattggcgtgatgctcttcgtgggccccagcggcgtgggcaagacggagacggcgctggcgctggcggacgcgctctatggcggcgagcgcttcatgacgacgctcaacatgagcgagttccaggagaagcacacggtgagccggctcatcggctcgccgccgggctacgtgggatacggcgagggcggcctgctgacggaagccgtgcgtcagcggccctactccgtcgtgctgctggacgagtgcgagaaggccgacctggaggtgatgaacctcttctaccaggtgttcgacaagggctcgctgacggacggcgagggccgcgcggtggacttcaagaacaccgtgctcatcctcaccagcaacctggcctcggacctggtgatgcggatgttcgaggacggcgcgcagcccacctccgatgaggtgctgtcggtgattcgccccgcgctcagccagcacttcaagccggcgctgctggctcgaatgacggtcgtccccttcgggccggtgcagcgcgacgtgatgcgccagattgccgagatgaagctggccaagctggtgagccggctgcgcacggcgcacaacgtggagacgacgctggcgccagagttgctggacgagcttgcgcgccgctgcacggagtcggagatgggggcgcgcaacatggagcagattctccagggctcgctgatgccggcgctgt

SEQ ID NO: 6581 - DNA, 1197 bp, Myxococcus xanthus
tgctctaaagactgggccgcctacgcgtccgaggacaagatggtccggcaccagcacgtggccgaggacttcatcgaacagctcgccaccgccaccaccacgcgcgtgcaggacgactacaccgcgctgctggagcgcaagcggcgcgacgtgcccggcgcgtcccacgtggagccgtgggagcagacgtacctcaaggaacaggtgcgcgcggagcgttaccgcttcgactcgcgcgacctgcggccctacttcgaatacacgcgggtgaagcagggcgtgctggacatcacctcgcggctcttcgggctcacctaccgccgcgtcccggacgcgccggtgtggcacccggacatcgaggcctgggacatctacgagggacccacgcgtctggggcgcttctacctggacatgcacccacgcccgaacaagtacgcccatccggcgcagtgggacctggccaccggccgcgcgggcaggacgcttcccgaaggcgtgctgacaggcaacttcccgcgtcccggcgcccaccccgcgctgctccagcactcccaggtgcagacgttcttccacgagttcggccacctgctgcaccacgtcctcggcggccggacgcgctgggccggcctgtccggctcgcgcacggagcgtgacttcgtggaggctcccgcccaggtgctggaggagtgggcctggcgcccggagtcactccagacgttcgcccggcacgtcgtcaccggcgagttgctgcccacggagaccatcctccggatgcggcgcgcggacgccttcggcaagggactgtggcttcgccaacagctcttctacgcggccgtcagcctccagctccatgcgagcgaccccgcaggcgtggacaccaccgcgcgggtgaacgcgctccaggagcgctacatgcccttccccgcagtggacgacacctacgcccatctctccttcgtccagctcgacggctactactcctccgcgtactacgcctacctctggtcgctcgtcatcgcccgggacctgctcacaccgttcctggagcacgggctgatggacacctccaccgcccagcgctaccgggacgccgtgctggggccgggcggctcccgtgacgcggcggacctggtccggtcattcctgggcagggactacggcttcgaggcgtatacccgttggctggacgacgcctga

SEQ ID NO: 6582 - DNA, 753 bp, Myxococcus xanthus
gccgtgcccatgtcgtccgccgtgccccaccgttacagcccccctgtgctcacgctcaccgcgcacccgcgctggctggagtcgatgttggagtccgtgcgcgacgagtggaacgcggcctgctggcctccgttgttccgcgcgacggctgacggccagcgtccgccgctgcgtcactggcggcgggtgctgtcccacttctttctcatcgtcgagtccttccccaaatacatgggcctgtcgctggcgaagacgacttacggccagcgtcccggcgacgcgagcgcccgccgctggctgctgcagaacctgggcgtggaggcgaagcatgccgagtggttcatcgactggatgcgcggaatcggcctggcgccggaagatgtcttcacccagcgtcccctgccggaggtgcgagcgctgcatgagttcctgctcgacacctgtgcgcacgggacactggccgaaggcgtggccgcgtccaactgggcggtggaaggcatcaccggcgtgtggacgcgggaggtggtggaacccttccgcgcctatgccgaggacggcgcgcgcatcgacgcgtattcgatgatgtggctcaaggtgcacgcgcgttatgacgatcagcacccggaggaggcgcttgaaatcatcaagctgtccaccgacgcgggcaccggtgagcccttccgcgtccaggccgcggccaggaagtcgctgcagatgtatgccgccgcgctccacgcgtgctgcaacgactga

SEQ ID NO: 6583 - DNA, 1791 bp, Myxococcus xanthus
atgaatgccgaagacaaggtcatccaggagtaccggggacgtgcgctcaaggtgttcatgttgtgggtgctgccggtggcgcccatcgccgcgtatctcaatggcatggccatgggcgtggcgggttggtcgggcctgattgcggtggcgtgggtgctgccgcccatcatcgtgggcctgggcatcgcctatcccgcgtttgtgatgcacgtgctggtaaacggcgcgctgcgggagcggccggaggacacgcccggcgcgcggctggagcgaatcctgcgcctgccgtggcgcgcggcggtcgcatcctcgtggggcgcgtgcacgctgggaggtctctggttcagcctccacgtgtgcctgctgtggaagaaggacctgtccctggtcgtggtgggcacgctcatcggcatctgcttcggcgtggtgcagggctttcccatcagcgtcaccctggagcggttgctgttgccgctggcgctggaggagcagcgcaaggacccgacgatggcgctcaagggcggaggcttcttctggccgcggcaggcctggttcatgcccgtcaccttcattggctccagcatctgcgcgttggtgctgagcgggtgcgtggtgctggtgaagctgcaaggcgtccggaacgaactgcacaatgctctggtggcggagggcgcgcacggctcggcggagacgctgatgggcatgggcggcatgctggcgggtgaattggcgttcgggctggcctgggtgggcggattgctggcgattcccgccgtcaccacctggatgctggcgcgtcgtcaggcacacgcggcgggcgcggtgggcgtggccatcgagtcactgtccgcggggcgcgtcgtctcgcccgcatgggtgtccacggatgagatgggggacttgtcggctggtatgaacgcggtgctcgttcgcctgcggcagttgcccctggcgctcaatgcctccgccacgcggctgagcggcgcggggcgccaccttcgggattcgcacgatgagcaccagcagagcctggtccgtcaggcgtccgcgctgcacgaggcgcagatgacgtcggaggagattcggcgcacgtcgctgatggccgtcgagcgagcggaggaggtgcttcaagtggcccgccgctcggaggccctgggacagcagggagagtccgccgtggagcggagtctcaacggcctggcggacatccgccgcgtggtggacggcatccaggaacggctgacgcggttggcccagagcaccacgcagattggcgaaatcaccgagacggtgaaggacctggcggaccagtcccacctcctggcggtcaacgcggccatcgaggcggcgcgctcgggcgagcaggggcggggcttcgcggtggtggcccgcgagattcgcggcctgtcggaccagtccatccaggccacgcggcgcatccgcggcatcctccaggacatcagcacgggcatccgcgacgcggcgaagatgggggaggccggcgtgcagaccattggcacgggcctggaccagatgcgggcgtcaggggactcgctgcgggagctgtctcgcatcgcccaggagaactccaccgcggcccggcagattgccgccgcggtgacacagcaggatgccggcttcacgcaaatcttcgacgccatcgcggacctgtcgcagctcatggacgccacgctgaagcggttggagtccacacaggaggccaccgacacgctgagggtcgtctccgacgacgtggcgcggatggcgcggcagttcaacgcgacggggtga

SEQ ID NO: 6584 - DNA, 1113 bp, Myxococcus xanthus
cggaaatgtccggagctggcgcccgacaggctggagctcccccgtgtctccgccggggagcgcgccgccagtcaggtgctcttcaccggctcggacggacagcgctacaagacggggtatgcgcccatcctgtacgagggccgcgtggtgggcgccgtgggagtggaggccagcgccgccttcttcggtcccctgcagcgactgtcacgcacctacgccatcatgggcgcggtggcgctgagcgcgctcgccgtcatcgcgttggtgacggcgcgcggtctggcccggccgctgcggcggctgatggcgtccgcgctgcgaatcggccggggcgacctgacgaccccggtgccaccggagcccacgctggaaatcggcgtcctcgcgcgcgagctggaggacatgcgcggcgccctggagagccgggaccgtcagttgaagatgatgctcgcgggcgtggcccacgaggtgcgcaaccccattggcggcatcgcgctcttctccggaatcttgaaggaggacctccaggccggcgcccacgccgacgcgggcgcgcacgtggagcgcatccaacgcgaggtcgcctacctccagcgcatcgtcgaggacttcctcgccttcgcccgcgagcagcccctggcccgcgcgcccgtggaggcccccacgttgctctccgtcgcctgcgagctgatgaccaccgaggccagcgcccgcgacgtcgtggtggacatcgacgcctcccccgcggtgctggaagctgacggcagcctgctcaccgcggcgctggtcaacctggtgaagaacgcggtgcaggcttcccccccgggtgggcgcgtacaggtgtccggcgcgtccaaagacggccactacaccatccaggtccgcgacacgggccccggcgtgcccggcacggcgcgcgagcgcatcttcgagcccttcttcaccacgcgcgagaagggcaccggcctgggcctgccactggcgcacaagattgcgctcgcgcacggcggcgcgctgcggctggactccgcgcctggagacacgcgcttcatcctcacgctgccgttgggtggaaagccgggccacggcgtatccgtcaccccgtcgcgttga

SEQ ID NO: 6585 - DNA, 136 bp, Myxococcus xanthus
atggacgtgtccgccgggaagaagggcggcaaggccgcgaaggaggacctggaggccaccgtcaaggagcgcatcgccccgcgaaagcgcgcccccacggaggacaccctgggcttcgcccgccgactttcgccga

SEQ ID NO: 6586 - DNA, 192 bp, Myxococcus xanthus
atgagctcggacgagaagtggctggtggcctcggtgaaggagatcgaaggcgccgtgcaggccgcgctcgaaatcgcggagacggggctgcgcacgtacacctgcgccgcgttcctgctcacttcggatgatcggagcctcaagctgtacgactgccgctccggctccgagcgcgtgcaacgcgagcgcttc

SEQ ID NO: 6587 - DNA, 282 bp, Myxococcus xanthus
atgacggcgaggcgaaagttcctgttggtagcggtaggggtggctgcggccctgagcctcgtgtccgtcgtggacgcgaagggcttccgccgctacctctcgctccggcaggacgtggagtcggtgcaggcccgcaaccgctccctgtccgcccagaatgaggccctgcgcaatgagattgccgcactgcgcaaggatccggccgcgctggagcgcgccgtgcgtgaggagctcggcttcgtgaagccgggcgagctcgtcttccacctggagtccccatga

SEQ ID NO: 6588 - DNA, 516 bp, Myxococcus xanthus
atgtcccgcgtgctgctacggggtgccgtcgtggcgctggtggcgctggccggctgccggggcacccggccggtggacgcggggtacgccttcctcaacgcgctggcgctgccgtcggtagggcccacgccgcacgacgtgcgcgcgctggacgggaaggtggtgctcgtctcgttcttcgcgacgtggtgcttcccgtgcctggcggagatgcccacgctggaggcgctccagaaggactatggcccccggggcttccaggtggtggcggtgggcatggacctggagggggagaaggtcctggcccccttcgcggaccactatgcgctgcgttacccggtgctggtcgcgaaccaggcgatgattgagggccacagcgccttcggggccatccagggcctgcccaccaccgtgctgttggaccgccggggccgggccgtggccggctggcatggcgtggaatcccacgccgatatggcgaaggccgtggagaagctcctggcccagcccgagtag

SEQ ID NO: 6589 - DNA, 438 bp, Myxococcus xanthus
gaggggcttgcccgctacatggcccagcacggcctgaagagcacgcggcagcgcagcctcatcatcgacacgttcttcgcggtgggaggccacctgtcggtggaggagctgtggaacaaggtgcgtgaacaggacaccaaggtgtccgtcgccaccgtttaccggaccatgaagctgctcagcgagtgtggcctggcccacgcgcgcaacttcggggacgggcagacgcgctacgaggcggccgcggggcgcgaccaccatgaccacctggtctgtacgcgctgcggcaccatcatcgagttcgagaacgagcgcatcgaggcgcttcaggacgccgtggcccgcaagcacggcttcaaggtgacgtcgcacaagatggagctgtacggcctgtgtcgtgactgtcagcgggccgggtcggccgcctcggaggcctga

SEQ ID NO: 6590 - DNA, 474 bp, Myxococcus xanthus
ctgctgccccagctcccgccggagctggctggatacacgtggcacgccgtgggccgcctggacgtggattccacgggcctgctgctcttcaccaacgacgacaagctggtggcccacgccacgtccccggacgcgcacctgcccaagcggtacgtggccaccgtcttcagcaccgcgagcgacgagcgggtggagcctctgcgccggggcatgacgttggatgatggccccgcccgccccgcgaaggtgaacgtgcgggacgagcacacggtggaggtgacgctcacggaaggccggcaccaccaggtgaagcggatgctcggcgcggtgggccttcccgtgcgcgcgctgcaccgcgaggccgtgggcagcgtggacctggaaggcatccccgaaggcaccttccggctgctgacggacgacgaggtccgcgaggggcttcgctacgaaggacgcacgcccttcggcccctag

SEQ ID NO: 6591 - DNA, 546 bp, Myxococcus xanthus
cccatgggttacatcccggtcctcgcgccgagcatgggccttgcctggcgctccaggggtgttccggtgttggacttcaccaaggcggggtggctcttgccactcctgacggagacggtcgccttcgaggcgggcgcgccggctccgtccgcgccgccgctgggctccgggcgggcccgggctcgcgcgtacctgcggcggacgctgcgcgccagtggcctgctgtacggcacgcccgcggacgcaccctccgcggcggacgtggcgcagcccaccgagctccaggcgcttcatgcgtggcgtgggcccaggcctgctatcttcgcgggcttcaacggacacctgagggacgacaccatgcgaagcgggctgaagcggaactgggcggcgttcgcggtgggcggcctgctcggcgcatgggtgctcggctgtggcggctcaacgacggaggggctggagtcgttggagcaggggaccgcgccgcccccgtccgtctccgtggacctgtcgagcgtggacctccgcacccggcttgaaagcgcccca

SEQ ID NO: 6592 - DNA, 2985 bp, Myxococcus xanthus
gctctaaagatcaatcccgctacccgcgccaacgaattggtgttcctgaccaccgactgggagcgtcagaaggccattcattatctctggcaggacccggccaccacgctctggcaggaggagaccatccccctgtacagcagcgacaaggtgcaggaggtcaacagctacagcaccaggctcagtttccgcgtcaacggccaacccccggcggcgcgcctcccgttgaccctgaccagcgccagctaccagagcctgttgatcaacggcctgaaatacaccgtggacgccggcgcgagcgtggaggtctcgaccaacgtcaccggtgagctggacatcatccagcaaatccaggacctggcggtctccaccttcacgctgaccagcagcgcctttacggacacgctgcggatcaaccccgcgagcaacgtctacaagaagctggccgccgtgcggaccggcgcggacatccccgtgctgccgcccacgctgccagaaggcgtgacggccgaccagatcgccagtgccatcgcccagatgatggccttccagccagagcagtcctaccccaccgaggtcatcagcgtcgtggggcccacgcctcaggccaagagcggggcgcacatggcgcggccgccccatgcgttcgcgctgtccttcggtccgcaggggctcctccgataccactcgggcgccgaggcgtcccagctcaagcgggtcggggacgtgggcgagtggatcgtcgacaccgtgggcgacgtggtgcagttcatcggcaatgtggtggaccagattggccacatgttgttcgaggtcgcggagacggtgatcaagatcaccctcaacgtcgctggccgcgtcatcaagttcgtcatccagagcttcgagcagctcttcgctttcctgacggcgctgttcaaggcgctgaaggttggcatggagaagctgattggctggctcggcgaactgttcggctgggatgacatctgggccacgcacctcgtcatcgcgaagacgctcaccggcgccctggatgcgctgtccaaggaggtgcaggaggactcggcccggctcaagaagaagatggcgcgcatcatcgccgagcagttgggcttcgcccgcgagaacttcgcgagcatgaaggtgccagcgagcgtcgcgtccatggtccccagtgaaatggccgcggccacgcagcagagtcaccccggcatcaacttcgacacgcccatcgcgagctggtccagctaccagacgcagtacagcggcatgctcctgggcggcggtcccgtgggagacctgcccgcgccggtgcagaagttcatcgacgacgtgctgattcccacctccttcgtcctcgtgaaggccattgaagaggactgggagaacctgaaggccgtgttcaccggggaggggaagaccgtcgagcacatcgtcaccttcctccaggggctggcgaagaccatcatcgacacgctggagatactgctgctgggttgcgtcgactacttgctcgacctcgtgccgtgggtggtgagtctgttgaccgagccggtcaacatcccgttcctctccggcttctacacgtggctgaccagcgcgctcgggaagggcgaagcccccccggaggagctgtcggcggtgaacctcatgtcgctgctggtggcggttccctatacctacctctacaagctcgccaacgacggccaggcgcccattctctggggatccgctggacctctggacgagcatgacgcaggtggacacggcagagggcgcgagcaagaaggaggccagcatcgcggcacggcgctattcggtgattggcgcgggaatcgcttcgattgctggctggctcgcatcgctgatgggcttcgtgcgagtcagcgtggatgcggcacggctgaaaggagcgcttggcaagtgcctgctggtctccagcctgaccatgggggggattgccgccgcattcagcttccccatccaaagctccgcgatgcagggcactgcgtaccagatgcggctcctcgtgtgggtcgcgagcctcctgcgtctgggctccacggcgcttcccatcagctccgccgcggtgcgtggcacgatcaaggcatgcttcgacgctggcatcggcgtcaccgccatcagcagcgacatcctcggctctccgcgcaactcgacctggtgcagcgacgtctgctccaacctgggcggcgtcatcaccggcgtcagcacggcgattgtggcggtccagcccgaggccgcggtcaccatcattgccggcatgggcctgtcctatctgggcggcaatctggtggctctcatcaccgcgctctcgacgaacatcgtcaaggcggaagccctctacttccagaacttgggcggctgagtcgccttcagcctcgcgtcgaggagcgccaccagggggtgcccatggcgctcctcgcacgcgggggcgtgggcccgcatgtcgcgcggcacccagccatgcttcgtggggagggaacgaaggccctaggggccgaagggcgtgcgtccttcgtagcgaagcccctcgcggacctcgtcgtccgtcagcagccggaaggtgccttcggggatgccttccaggtccacgctgcccacggcctcgcggtgcagcgcgcgcacgggaaggcccaccgcgccgagcatccgcttcacctggtggtgccggccttccgtgagcgtcacctccaccgtgtgctcgtcccgcacgttcaccttcgcggggcgggcggggccatcatccaacgtcatgccccggcgcagaggctccacccgctcgtcgctcgcggtgctgaagacggtggccacgtaccgcttgggcaggtgcgcgtccggggacgtggcgtgggccaccagcttgtcgtcgttggtgaagagcagcaggcccgtggaatccacgtccaggcggcccacggcgtgccacgtgtatccagccagctccggcgggagctggggcagcag

SEQ ID NO: 6593 - DNA, 548 bp, Myxococcus xanthus
ggcatgaacgactccgccacattgctgccggaagaagaagcccggtcgcagatcctggccctgtgcgcgccccttccctccgagtggctgcccctggatgacgcactgggacgcgtgctcgccgaggatgtgacggcgcagcggacactccctccctgggacaactcggccatggacggctacgcggtgcgcagcgcggatctggcgggtcccctacccgtccggctcatcgtcggagagaccatctacgccggcgcggtgggccaccaggcgctggcctccggggtatgcgcccgcatcatgacgggaaactcccctccccgcgggtgcggatgcggtggtgatgcgagagcggacacggcccgtggtccagagcggcgcggatcaggtcgacatgctcgaagcggtggctccgggccagttcgtgcggccccggggcgaggacgctcgggagggacaggtgttgctggcacgctgcacgccgctgggcatccccgaactgggcctcctctgggcccagggccgacaagccgtgccagtctttagag

SEQ ID NO: 6594 - DNA, 1233 bp, Myxococcus xanthus
cgccggggccgtttcagcgaggtcgaagaggatggcctgctagaaggcatcctccacgtccaccgggatggcttcggcttcgtgcatccgctgtcgggggaaggggacaacgtcttcctgccgccgcacgaggcccagcgcgcgctcgacaatgaccgggtggtggtggccgtctcggggcggcctcctcgcctggagggccggatcgtccgggtggtgcagcgccgtcgcgagctggcggtgggcacctacgtcgtgaagggccgctacgccgtggtgtaccccacggattcgagcttgcccggccccatccgtgtgccgctgacgcagatggcgcgcgaaggggacctggtgaaggtccacctgggcattggtgcccagatgctggacccggaccgggggctgcacggccaggtcgccggctccctgggcaaggccggcactccgagcgccgaggtactgggcgttgcctactcgcaggggttctccgagcagttcccgccggaggtcatggcccaggcggacccctacctggtgacggtgaccgaggaagaggtccccgacgagcaccggctcgatctgcgcgccattcccctcatcaccatcgatggtgaggacgcgcgcgacttcgacgacgctgtctgcgtggaggaccgggcggatgggtggcggttggtggtggccatcgcggacgtgacgcactacgtgtgggaaggcagtgcgctcaacgcggaggcgctgcgtcgcgccacgtccgtgtacctgccggaccgggtgctgcccatgctgccggagcggctgagcaacggcatctgctctctacgcccggacgaggaccggctgtgcatggtggcggacatgacgttcgaccgccggggccaccgtcgctcctacgacttgtatccggcggtgatgcgcagcgtggcgcggtgcacgtacaacgaggtgcaggacgtcctcgacggcaaggacgtgccgcaccgcaacgcacacaagccccacttcgagcggctgatgtcgctggcccgcgcgctgatgaagatgcgcaaggagcgcggcgccatcgacttcgacctgcccgagcacaaggtggtgctggacgaggacggcctgcccgcgcgcatggacaagcgcgagcgcaaggacagccaccgcctcatcgaggagtgcatgctcgccgccaacgaggcggtggcgaccttcttccagaacgagggcctgcccacggtgtac

SEQ ID NO: 6595 - DNA, 1380 bp, Myxococcus xanthus
atggccaagcccaagtccggggccaagaagacgactcccgctggcaaggctggcgcaaagcccgctgcgaagaaggactccgctgcccggctggatctgatcaagaacgcctccaagcgggcggcgaaggcggcgacgaaattggcgaaagcggcatcggacgtaacgaagggggccaagagcgcggtgaagaaggccgtgcaggagaaggccaccgcgaagaaggccgcgcccgctgggaagacggcctcggcagcgaaggccgcccccccggcagcgaagaccccgaaggcacctccggcgaaggcgcctcccgcggcgaagtccgccgcgagcgccaaggcggcgaaggcgagcgcggtacccgccgcccctccggtggagaagccccgtcctcgcgccaccaagttgccgcctccgggcgagccgctcaccaagcgtgaaatggagcagttgctgacggccggcgaaggccgcggcgtcacgggcgagggcagcctcaagggccgcctggtggtcaccaatgacatgccgcacctggtggtcgtcggccgcgacaagcgcgagctgaccttcctcctccagggcccggatcaggaagtcctcccggcctacgtggaccacaaggtctccgtcagcgggctcatccgtaagacgaccaaccacgctggcgtggtggacgttcgcaagtactcggccaagaagccggatgccgaggtggtggaggccgccccggcggagacggaggcgcggctgcgctacctgtcgcccggtgaggtctccatggtgacggcggccggcatgggcgcgggcatcaagggcttcgcgggcgtgcgtggcaacctggagatgacgggcgaggagttcgtgctcgtcgtgtccaatggcggcacgcgccagcaggtatcgttcatcatcgagggcaaggccgctggcaaggccctgcgcaagcacgtcgggtacacgctccaggtgcagggcgtcgtcgacaagacgtccggctggggcggccgcatcatggcggagaacgtggagctgcgtccgtccgaagcgcgcgccgtgtctcgcgacgagatggagctggtgcacatcgagggagaggtccccacgtccgtggacgtgcgcctcaaccacggcctcaccgtgcgcctgcccgagcaccccggcttcacctgggccatcgagcccacggtggccaagcgcgtgggcctgcgcgaagccaacttcgagcccgcgcccgaggacggtcctggtacccgcgagttcttcttcaccccgcgcaacccgggcgccttcgatgtggagttcttcctggccaaggcgctgtcgcccggcctggtggaccgctccttcaaaatcaacgtcacggtcaagccctga

SEQ ID NO: 6596 - DNA, 1416 bp, Myxococcus xanthus
atggtgctcacacgtggggtcgacgcgctggaggtgcgggtggacgcactgctcggcgagcacctggaggccgtgcgacggcgggtggactctcgcttcgccgtgctgatggtggggcagtggctggtcgccatcgcggtggcggcggtgctgtcgcccttcgcctggcaggggacgtcgcgggtggtgcatccccatctgcaagtggcggtggtgctggggggcctgctgtccgccttcccgctggtgctggtgcggctgcgggccggggacgtcgtcacgcggcacgtggtggcggtcgcgcagatgctctgggccgcgctcttcatccacctgacgggcggccgcatcgaaacgcacttctatgtgttcggctcgctggccttcctggccttctaccgggacccggcggtgatggcgaccgccaccgtcacggcggtgctcgagcactgcctgcgcggcatctggtggccggagtccatcttcggcgtgtcgaatcccgcgtggtggcgcttcctggagcacgccttctggatggtgttcgtcaacggggtgctggtgattgcgtgccgcgagacgctgggggagatgcggcgcgtggcggtgcagcaggtgttgctggagggcgcgtacgcgaacgagcgcgtggaccatgagcatgcgctggcacgcgtgcgccgggagatgagctcctaccgcgagcaggccgcgcgggtggagaagctggcggcggtggggcggatgacggcgacggtgagccacgagctgcgcaacccgctggccgcggcccgcaccgccaacgccgtggtcgtccgtcacctgcgcaagctggacgtgacgctggcggaccagcggctccagcgcttcctggaaatcatcgagcgcgagctggcggtgtgttcacgcatctcctccgagctgctggacttcgcccgcgagcgtccgctggagctgcggccctgctcgctgcacgcgctgatggaggaggtgctggacgtggtgccgggccgcgaaggcgtgcgcatccagaacagcgtccccctctcgctggcgtcaccctgggtggaccgggagctgctgcgcaaggtgctcatcaacctggtgcagaacgcggtggaggccatgccggcgggccgtctgggccgggtggacgtgttcgcggaaggcggcaatggcagcgccttcatcatccgcgtgtccgacaatggcatgggcatcccggaggcgatgcaggagcgcatcttcgagccgctcttcacgacgaagcccgcgggcacgggcctgggactgtcagtcgtggccagcacggtgcggcagcacggcggcaccctgcgcgtggagagccgggaaggggagggcagcgtcttcaccctctgcctcccggcgggttgccccgccgccgaggtcgccctctag

SEQ ID NO: 6597 - DNA, 327 bp, Myxococcus xanthus
atgcggaccattggcgcccggtccgcgcaggacttcctgagcaccgtggtggggcgcagcttcctggcattgtccggtggctgcccgcgccggctcgtcagcaacctgccgtccggctacagcaccgccgtcagctacggcgagcgcgacgtggagtgggtgggcgagcgccagggccgcctcaacatgttccgcgacttcatgccgcacagctaccatgagggcgtgctgcgcgcggcgctggccgccattggcgcccgcgacacgcacatccgcgggcgtgccacgggcctgctggacggcgagtacgaggtgtcctggagctag

SEQ ID NO: 6598 - DNA, 693 bp, Myxococcus xanthus
ggtccccatggtgcccggcatgatgcccatcaccaactacgagcagattcaacgattcacgcgcctgtgcggagccaccgtgcccatgcgcctggcgttgcagctcgagcgggtgaaggacaacccggaggccatggcccagctcggcgtggcccatgcgacggtgcagtgcatggagttgctgtcgcgcggcgtgcctggcatccacttctacacgctcaacaagtccccggcgacgcggatgatcgtgagcgcactgagagcccgttcatgagtggtcctggaatccacctgcccccaagcgacccgcgtagcaaggtcctcaacatcatccgtccgcccgccttcttcctgctgtgcgtgggcgtgctgaacgtcatctacaacatcgcgggcttcgtgctggcggcgctgaaggtgacctcgcccttcgtccccgcgggcgcggaggcgtccacgctggaactgtcgcccacgctggcgctgatgctcctggtgggcatcctctgcggggtgctgtccgcctggggcgccatcagcgcgctcaacctgaagggctacggactggccacggtgggcggcatcaccgcgctctacatcctgtctcccggctgcgtcattggcgtcccggtggccgtgtggatgctcttcaccttgcgtcgcgacggggttcgcgaagccttccaggcctga

SEQ ID NO: 6599 - DNA, 189 bp, Myxococcus xanthus
gtgcgcagcatcgccgaggccgtgagtcagcaggacgcgggcatcgcggagttgttcgccgcgctcagctcgatggccgacctggcggaccagattgtcgaccggatggccgcgagcgagcagtccgccatccagctctccgcggcgtccgctgagctgagcgctatcgtcggccggtaccagctctag

SEQ ID NO: 6600 - DNA, 798 bp, Myxococcus xanthus
gccagcgagcccggcacggtggacctggccgcgctgtcccgcgcgctggtgacggccgagcgccgcacggccacggactggacctccgccgcgccgtccaggcgcgccgtgctggaaggcgcctgggagcggctgctgtgggcgggctcccgtctgggcgccgcgggcatggccgactccgcgcgcaccctcctccagggtggcgagacggcggctccgggcaccgtgcgccaggaggccgcgcgcgccctgggccggctgggcacgccggggggcacgctgacgctcaccggacaggccccggcggccgtgctgacgaacgagaaggagcgagccgccgcggcggacacgctgcgcaagtcgctggtggacccggacgcgcgggtgcgggcggcggcggcggatgcgctggcgaagctcgcccccgagcgcgccactgcctgggcactggaagtgaagcccttcgacgcggtggccttcggtcccatgggggcccggacgtcacgggagctgctggccacctccgagggtcgccggctgtcggtgccgacgctgctgggggctcacgcgctggagcccctgaagtccctggccaccgacgcgaagccggagacgcggcaggacgcgtgggccgcgctgggccgcctgggcggagacgacgcggcgaagctgctgcacgaggccgccttcgacaagtcgcaaaccgaggagctgcgcaaggccgcctggcgcgcccacaaacgtgcacgccgggccgctgagcgcgcccggaaccggaaggaagggaacccgtcgtga

SEQ ID NO: 6601 - DNA, 924 bp, Myxococcus xanthus
atgggccccggcctgccggtgttctgggtcatcgacatgggcgcggccacgctcacgctgggcctcacgggctggacggagagcggctggtcctccgccgcggccttcgacgtgctgatgccccgcgcggtgccggacggattggcggagcagcttcgcaaccgactgcggaccgaaggtcccctgcccttcgacacgctcgccgccaatgccggcgcgcccaaggagtccgtgcgcgcggcgctccaactggagtgcctgcgcggacgcatcctcttcgacgtggcgcgcggccagtaccgtccgcgcgagctgatgcccacgccggtggacgccgccgtcatccgctacggcaacgagctggaagcacgggcgcaccgcctgctgggcggcgacggcgctccgggcgcgggcgaggtgaagctgaccaaggtgcacgacgtggtgggagagggcatccgcatccacggcgaggtggtggaccgcgaggccctgcgcagcttcttccccagcttcacgttggatttggaaggccgcgtgaaggacgccagctgcgggtgtccgcaccaccggcgctccggcctgagggaaggcccctgcgagcacctgctggcgttgcggctggcctacgcgcgccgccgcgcggaggaagaggcgctgcggcagacgcccgagggccgcaagctcatccgcgcggagacgcgctcctacgtgcggcgcgacgcggagagcggcctggagacggtgtaccgggtttccctggatggtcaggtggtggcggtggagtggggcccgcgcacgggctcgccgcgtcaccagcggctctggttcgactcggatgcggaagcgcgcggagcgtacttcgcgcgcctggagaagttggcggctgacggctacatcgacgcggcctcggcattggtgtaa

SEQ ID NO: 6602 - DNA, 538 bp, Myxococcus xanthus
gctctaaggctgctgatcgtggacccggagtcgcgcgtgccatgtgcgccgggtcaggtgggcgaaatctgggtctccggtggaagcgtcgcgcagggctactggcgcaagcccgaggacagcgtggacatcttccaggcggtcccggtgggggctgaggccggtccgaagtacctgcgcaccggcgacctggggctgctgctggaggacgggcagctcatcgtcaccggccggcgcaaggacctcatcatcctgcggggccggaacctgtatccgcaggacgtggagagcatcgtggagcgggcccaccgcaaggtgcgtccaggctgcatcgcggcgttcgccatcgagactccagagggcgaggccctggcggtggtcgcggaggtgtcgcgagacgtggcggagggcgcggacccggccgcgctgggcgccgtggcggacacgctgcggaaggccattgtcgcggagcttcaggtccagccgcacacactggcgctgctgccgccgggctcggtgatgaagacgtcgagcggga

SEQ ID NO: 6603 - DNA, 504 bp, Myxococcus xanthus
ggagctacgcactggcagcagctcgtcttcgagtacgtggcccccgagctccaagtggagatggcgaagggcgtcatcgagttccagcagtactgcatccgcctcatcgaggaccggaagaagaacccgcaggaggacctcaccagctacctggtggccgtggagagcgacggcgaggccctgacgatgcacgagctggtcatggccgtgggcgcgtccatgctgtcggccggccatgagtccaccaccgcgctgatggccaacgcctggaagctggccctgcagcatggcctgtggcagcggctgcgcgacaaccgcgacctggtgccgaagttcctcgaggagtccagccgctacgactccgtctcccacgccatgattcgcaccgcgaaggaggacgtggagctgggcggggtgaagattccccagggctcgcgcctgctgctcctcttcgccgccggcagccgggacgaatccctctgcccccattccagcaagctggac

SEQ ID NO: 6604 - DNA, 1209 bp, Myxococcus xanthus
atgagctacctcgttctcgcccgcaaatggcgcccacagaagttcgacgacatgaccggacaggagcacgtcgtccggacggtcgcgaacgccatcaagatagaccgggtcgcgcacgcgtacctgttctgtggacctcgtggcgtgggcaagacgacggccgcgcggctgctcgccaaggcgctcaactgtgagaagggccccaccgcccagccctgtggcgagtgccgtgcttgcacggagattgccgccggcaccagcgtggacgtcgcggaaatcgacggtgcctccaacaacggcgtcgagaacgtccgcgagattcgcgagaacgcgaagtacctgccccagcgggaccggcacaaaatctacatcatcgacgaggtccacatgctgtcgggagcggcgttcaacgcgctgctcaagacgctggaggagccgcccgggcacgtgaagttcatcttcgcgaccaccgaggcgcacaagctgccggacaccatgctgtggcggtgccagcgccacaacttccgggggattccggcggcccggatgcttcagcgtctccaggaaatctgcaaggcggagggcgctggtatctccgaccgctcgctgtcgctggtcgtgcgccagtccgaaggcggcatgcgcgatgcgctgagcctcctggaccaggtgctcgcctcgtgcggcgccaccccctccgacgaggaagtggccgatgcgctgggcgccatcgaccggacgttggtgcaggacttcgccgatgcgctcgtccacaaggacgcgaagcgggtgttggagcgggtggaggaagtcttcaaccgcggcctggacttgaagcgcctggccgaggagctggccttccaactgcggcatctcttcgtcaccaagacgctgggcaaggcgcccgacgagctggccgagtccgagcagaaggcgctgatggcgctggcgcaggacgcggaggccgcgcagctcacgcgcttgttcgacgtggtgcacggctgcatctgggacgtgtcgcgtgcggcccagcctcggctggccctggagatggcgctgctcaaggccatccagttgtcgccgggtggttcgattcccgagctgcttgcccgcgtggacaagctcgcggcggggatgggtgaaggttccgcgaagtcgaacgctggagcgccgggaggtcgctccagtcccacgaactttcgcgcctga

SEQ ID NO: 6605 - DNA, 822 bp, Myxococcus xanthus
atggccctggggctggcggtggtggcccgttacccgtcggccatcttcgtcctggcggcgctggtgtggttggcggcggcgaggcggtggcgactgctcgccttcacgtgcgctggaggactgggcgtggcggtggcgctcggcgcgctggactgggcgacgtggggctcgccgttccactcctttatcgcctatgcccgcttcaacgtcttttcgggcaaggccgcggctcagttcggagctgacgcacccagcttctacgtgaagccgctactcaccgccgtgccgctctgggcctgggccgccgtgcccgtgggaatcgccgcgcttcgccagcaccgcgccctgtccctgccgctgtggtgcgccgccgtgtacaccggcgtgctcctggccaccgcgcacaaggaggagcgcttcctctatcccggcctggtgctgggcgtgctggccgcggcgccacccgtggcggcgggcctcgtccagcttgctcggccaaccgggcggtggggcctggccggactcgcgctggccgcgagcatgaccgcggccgccttcttccctcccggggacctgcgggcagaccagttccgcgcgattgtcgccgccacccggggcaatgcgcgggggctgctcatcgtcaatgagggcttgtggggctcgggcggctacttctacctggggaagcggattccctggctcacctgtgactggccccacgacggcgcgttcgaacgtgcgctgcgggacaggacgttcaaccgaaccgtcacattcgaggaccgcgcgctcgccgagctccaggccggcggcttcgaaatc

SEQ ID NO: 6606 - DNA, 1947 bp, Myxococcus xanthus
cagacgaagggcacgcccgcgccggctggcgtggagcaggtgttcgaaatcgccttcgacggcgccgagcgccgaccgcgtcgcgccacgcgccagcagcccgcgcgcggagaggtcgaaatcaaggtcacccacgtgacgctgacgcgcgccgcggccgtgcaaggccggcgtgcgtccgacacgcactggccgctgaaggtgggcggtgtggtcgtcgcggtaggcgaggccaccccgggcttcacgtccggccaggtggtgcaggcgctggtcgcgcaagaagcgcccgtggtgggcacgcacgtggtgctgcgcctggaccgggacttcgtcagcgccggcacgtcccagggacggctgctgcccttcctaagcgcggagtacgcgcttcatgtgcatggccacatccaggcctccgaacggctcctcgtcatcggggacgccggtggcgtggggaccgccgtgatcgaactcggccgtgccgcgggagcccggacgggcatcatcctggacggcgacacgcggcaggtgccagagggcgttcgcgtcttcgaccggcgctcgccatccctcccggaagacatcctggagtggacggacggcgcgggcgtggacctgttggtgaacgcgtcctgcgacgcggagcccaccatcaccagtgtgctcggggccttcggccgcttcgtcgatgcgggcccgctcgctccggcggagggcctgttctccaccgcctggccccgtggcgcggcctgcgcacgcgtggacgtcgcggccatgctgcgccagcgtccccaggaggtcgccgcgcggctccagtccgtcctcggtcggttccagacactgccggcgctgccgtccgagtcctggcccgtcacccgcgccgaggaggcaccggcgtggctggcggagcattcgcgggaccagggcctggcccggctcacgctgacgttcgccgatggtgagccgctcgcgctcgcgccggcggcggacgagccgctcttcgatgcgaacgccacgtacctcgtcaccggcggcttcggcgggttcggccttgcgctcgcccggtggatggtcgcggagggtgcacggaacctcgtgctcaccggccgcaagggcgcctccacgccggaagccaagcagttggtccaggacctggaggcggccggcgctcgcgtcaccgcggccgccgcggacgtcagcagcatggacgacatgcgggcgctgttcgcgcgcatcgacgccacgcacccgccgctcaagggcgtgctgcacacggcggccgtgctggacgacgcgccgatgcccgacctgaacctcgagcgcatccagcgcgtcatgtctcccaaggcgggcggcgcgtggattctccacgagctgacgcaggaccggccgctggacctcttcgtcctgttctcgtccgtcgccgcgctgattggcaacccgcgtcagggcaactacgtcgcggcgaacagcttcctcgacgcgctcgcggagcaccgggccgcgcgagggctggcggccatcagcatccactggggcgtgctgggtgagttcggcatggcccaggacgaagcggtgcgaacctacctcgaatcgctcggcctcaacccgatggcgcccgccaccgtgttgaccgcgctcaagcgggtgctgcgcctgcgcacgccgcagttgggcctcttcgacgtgcagtggtccaagctgggccgcgccgccccacacctgggcaagtccgccaggacgtcacacctgctgggcagtgcccagggtggcgcacagagcgaagcggagcagctgcgcggacatctgtcggggctggcccccgaggcccggcagccaaagctggagaagttcctggtcgaacggctcaccaccattctccagattcccatggagcgggtggaaccgcagaagcccctgtccctgctgggcgtggactccctg

SEQ ID NO: 6607 - DNA, 561 bp, Myxococcus xanthus
atgcatggcgagaagccgttccttccccgggaggtgctgattggcacccccgaatcagaggtcatgttcagcaacatccggcgagcgatgcgcctgaccgtggaattgaacaagcgcaccttcgatgatgccgaggaaatcaggacgctcttcagtgagctgaccggccggaatgtcgacagcacgttttcgctcatcccgccgttctataccgaccatggcgtcaacatccgcgtcgggcggaatgtgttcatcaaccagtgctgcacgctgatggatatcggtggaatcgacatcgctgacgacgtcatgattggcccgaaggtgaacatcatcacgtcgagtcatcccctggagcccgccaggcggcgggcttcagcggtcgcgaagcccatcgtgctcgaacggaatgtctggattgcggcggccgtcacgattttgccgggcgtgacggtgggcgaaaactcggtggtgggcgccggagcggtggtgaccgaggatgtagcgccgaacagcttcgtggcgggcgttcccgccaagctggtgcgacacctgacttga

SEQ ID NO: 6608 - DNA, 936 bp, Myxococcus xanthus
gtggatttcgatggggtgaggaccttcattgcagtcgccgacacgggacagttccaagaggcggcatcaaggctgtcactgactcagcaagccgtctccaagcgcatcgccgcgctcgaggccagcctcggggcgcggttgttcgtccgggcgccgcgcggcgttcagctcaccatcgacggacaggtgttcctgcctcacgctcgaaggctcctcgaagcggcggagcgggcagccgattccgtgcgccccggccgccgtcggctccgtgtcgacgtggtcaagccgaacctcgggagcgcacgcatccttcgtgatttccacagcgcacatcccgagattgaaatcgacgtcgtcacacatctcttcgacgcgaagaccgcgttggccgctgtgcggactgggacgatcgacgcgacgtttcgcgccatcacccggcccgcgcagcaactgaccgacggcctcgtggcgacccgagttctcgacgacgccgtggagttcctcacgagcgatacgcacagactcgcggcagcgacttcgctgacgccggccgagctcgcgaagcacaaggtctggatgcccttcatcgtcccaggaacagagtgggccgcctattacgacgagctcgccgcgagattcgggctcaccatcgacaccctcggtcccgacttcggcatcgatgcgctcctggaggtgattgccggctcctcgagcctggccacactcgtaggtgaacacatccggctggtgtggccggccgagtacaacctccgccgcattcccatccgcaacccgatgctcgtgtacccacattccctggtctggcgttgcgacaacgcgcaccccgcgctcgcgaagctccgcgcctacctcgacgcccggaaggaccgctatcgggatcccaaggcgtggtcacccccatggacggaccgctga

SEQ ID NO: 6609 - DNA, 393 bp, Myxococcus xanthus
atggccttgttgaatgattaccaggacgtgctcgacgtggcgaagaacgtgggcgccaaggtcgagtcgcgcgaggagaacggcaagctcatcatcaaggggacggtggactacgcctgggaccgagaccggatgtgggaccagatcaaggccagacattcgaactggcagaacgaggtcatggtcatgctcaccgtcacgcacgagacgccgtacggcctgtacaccgtcaagtcgggcgacacgctgagcaagctggccaaggacatctacggagacatgaagctgtacccgaagattttcgaggccaacaaggaccagctcaaggacccggacaaaatcaaggtcgggcaggtgctgaagctgccgcccaagtccatcgccaacgcctga

SEQ ID NO: 6610 - DNA, 573 bp, Myxococcus xanthus
atggccgagcgcacccgcgcggagctgaccggcgccatccgcgacttcgacagcctcttccaggggcgcatcaagctgacgcccgagggcaccgtcacccatgagggccgcacggcctggcgttacgtggtgacgctggcccccgccgcccaggcggacgcgtcccggcccctgccgcccacgccccaggccaagaaggggggagtggacgagacgacggtccgccgggccaacttcttcgcccaccgcctgccgcgctcgctggacggcgaggtgctggtggattccgccacctccgtggtcctcaaggcccggctggacgggcgcatgggcgtgcccggggacaagacgcccgaggcggccgagctgcgcctgacgctggaggccgccctctccgaggtaggcaaggacccacggctccagccgcccgaggatttcctcccggacgcggacaagccccagggcatcgccgatgcgctcgacaccttcggtatccagcgcaagaagccctcggactcggattcggccagcccggagtctgccccggagcccgaggacgaagagggcacctga

SEQ ID NO: 6611 - DNA, 495 bp, Myxococcus xanthus
ctcaagcggcatggcctgcgcgccaagtacagctggggacagaacttcctcggagacgaggacgcgctggaggccatcgccgacgcgctgaacctgcgcgccgatgagccggtggtggagctgggcccgggcctgggccacctcacgcgcttcctggccgccaccggggcccgcgtcaccgccgtggagcgggaccgggacatggtgatggtgctggagaaggaggccatccccggcgtgcgcgtggtgtccggcaacgcggccacggtggacttcgcccaggtggctggcgcgcccgacgtcgcggtggcgggaaacctcccgtaccacctcaccagccccattctcttccgagtgctggagcagcgggcccatgtctcgcgcgcggtcttcacgctccagaaggaagtggtggagcggctcgccgcggagcccggcaaccgggactacggtctgctgacggtgctgctgggcatgcactacgacgcggagaac

SEQ ID NO: 6612 - DNA, 996 bp, Myxococcus xanthus
ttgctcgtcctaggactggaaacctcgtgtgatgagactgccgccgccgtcgtggaggacggccgccgcgcgttgtcggatgtcgtctccacgcaggtggacatccaccggcggtggggtggggtggtgccggagctggccagccgcaaccacatcgtccaggtgctgcccgtcgtccacgaggcgctgacgcgggcgaacaagacgctcgacgacgtggacctcatcgccgtcacgtccggccccggactcatcggcgcgctgctggtgggagtgcaggtggccaagggcttgagcctggcgacgggcaagcccttcgtgggcgccaaccacctggagggccacctgctggccatccggctgttggaggtggcgccggagccgccgttccttgggctcgtcgtttccggcgggcacaccagcctctacgaggtgcaggcctacgggcagtaccggctggtgggcagcacgcgcgacgacgcggccggcgaggcatatgacaagaccgctcgcatcctcggcctgccgtatccgggtgggcagcccatcgaccagttggcgcagcaggggaacccggaggccatccgcttcccgcgcgcgctgccgggcgacaacttcgacgtgtccttctccgggttgaagacggcggtgctgcaccacgtgcagaagcacggcgtgccgcaggggcaggcgctggcggatttgtgcgcgtccttccaggaggccgtggcggacgtgctgtcgaagaagctggtggccgccgcgcgccggttgggccacaagcagttggtgctgtgcggcggcgtcgccgcgaactcgcggctgcgggcactgtgtcaggcgcgagccgaggagcgggggttgaacatgttcctgcccccggtgcggctgtgcacggacaatggcgccatgattgcggtggcggggtatgaggcgtaccgccgcggcctgcgcggagatttccgcctcgccgccgacccggcctggcgcatgtag

SEQ ID NO: 6613 - DNA, 1005 bp, Myxococcus xanthus
cccacgccaagggcgccactggccagcacggtcgaaccgtctctcgcatcctcggtgccagctccggctgtcgtggagacgcagcccgccgagccggccgccaccgcgcccgcgacgcccggggaggtcgccccggatgcatccgcgaagcccacggacgccggagtcgtcacgcccgtgaagtcagcggacgccgccccggttgcgcccgcgacgcccgtttcttccgtgcagtcggccgaaaggaagccggcggccactcacaccagtgacgcagccgtggccaacgcgggtcgttccaatcgcaccgggctcatcatcggcgcggcggtggtcctcatcggcgcggtcgcggccgttgtcgtggggacgggcagcggtccgtcggaggcgcctccttcgaagcctcccgtggtggagacgcaggcgcccgtgaacgacgacgccaagcagacaccacctccggagcaggcaccaccgctcgaagaggccacggccaaggcccccgaggctccgccggagccgcccgccgctacaccggatgcgggtacggccattgccgaggcgccgaagccacccgaggcgacacccaccgaggcccccacgccgtcggagcccgccgtggatccggaggtcgagttcgccacgctggtgaagcaggcgagggcggccgtcgtcagtcagcggttccggtcggcggcgggaagctatcgcaaggcgctggcgctcaagccgacggccacggaggcgaaggcgggcctgggcatcgcgctggtgaacggcttcaccacggacggggcctaccgcgaggcggccaagctgttgcaggaagtcgtcaaggaagaggactccaacgcccgtgcctggctgtcgttgggcatggcgctacagttcaccggcaagaattcccaggcggccgacgcctacaagcagtacttgttgctggaaccgacggggtcttccgccgaagaggtccgcacgttgctcagggggctgggcaactga

SEQ ID NO: 6614 - DNA, 1677 bp, Myxococcus xanthus
atgccgacgccggtggagctgggcccggagcaggcgctgctgctgtctcggtgtgatggttcggccagcgccgtgagcatcgcgcgggagctcacggccggtgattcgcccgccttcgcctcgcaggatgaaatcttcacggcgctcgaacaagcggtgggtttcggtgtcctgctctggggctgggaggtgccgctcgtcatccggcccgaggtggtgctgcgcggtgcgttgatggccatcgaggatgcagacgcgcgggcccgtgcgctggcgccgctggaacgtctggagcgcgcgcgggccgctgtcgaagccgcggctgggacgcccacggccctggatggcgcggtcgcggagctggaggctgtgttccaggaggtggcgggggcgccgccgacgcgcgcggcgggccagacgtatgcctcgcggacgctcatctacgaggactgtgagcgggatggcgcgttggtgctgggcgctccggtgattggccggctcggagccgtgctggagctggtgctgaccggagcgcggtggctggtgggggaggtgacacggggtacgcgcgcgggcctggatgcgctcttcaaccggttgtccgaaggtggcgcacctgtgtcgctcacggcgctccagctcgccttcgtccagggactcaaggacccggcctctgaagcggagctgatgcccgtggccaaggccgtcgccgagcatcgtcggcgctggcgtgagctctttgccctggatccggaggtccgccgccaaacgcgcactgtcgattcgctccggccccgcgtgctcgaggccttcggcgaggtgggcccggcgtggcgaagccgctggcatgcctcaccggacgtgatgattgacgcggccagcgaggaggccgttcgcgccggggactaccagttggtgctcggcgaactgcatttgtgcaacagcatctcctcgctcttcgtggaacagcacccagcgcccgaggaactcttcgcgctcgcggagcggtgtgccaccggggtcgacgtggtgcccgtgttcccgaagtccgagtggagccagcggacgctgccgtgcctcttcccgcgagacagcctctactacctctccgggcaggagccgccgccccagccgggcgctcgcgcgctccgcgtgggggacatggtggtggagcggcgtgacggcacgctggaggtcctcgaccgcgtgagcgggcgccgcttcgacttgatggagttcatggccgtgttcttggagcagcgctgcgccagcatcttcgacctggcgctggccgatgactactcgcctcgggtgacggtggatggcgtggtcgtcgcccgtgagcgctggagcgcgcctgcttccgagctgggcttcgccggactcacggacccgatgacgcaatggctggaggcccggcgttggcagcagggactgggcattccgcgctttgcgttcttcaaggtggcgacggagcgcaagccgtgcttcgtggacttcgacagccccttgctggtggagatgatggcgaagctggtgcggcgcacggcggaggagtcgccggcttcacgcgtccagttctcggagatgctgccggaccccgagcacctctggctcaccgatgcggctcagcgccgctacacgagcgagctgcggctggtctgcgagatgtcttga

SEQ ID NO: 6615 - DNA, 507 bp, Myxococcus xanthus
atggagcaacggctgcgcgtccgtcagccgcggacgctgcgcgatttcttctccaacgttgtcgacaccgtgcggcgcgacgtcaactgggaaggggagtgcaacatcggcatcctcttctccccgagcaccttgccggaagcaggcccggcggagcaggtgagccggttcttcaccgctcagctccaggaactcctccagcccgaaggcgcgcgcggcgaggttctcctggccacctatggctcggtggaatcagagcccggcgcccacctcacgctccggggcaagcggctgcacgccgttgtggagtacgacgcgcgagacaggctggcgatggcgggagcgacctacgtcgcgcaggcccacggcgcgttcgaggcccggacggttagcctcctggacgggccggcgcaaggtgcgctcgacgacaagcacagcctcgagctgttctgggagcacgagacggcagacgagctgaccgaggcgaatcaggaggtggcccgctag

SEQ ID NO: 6616 - DNA, 462 bp, Myxococcus xanthus
ccgcacgctttctacacgtgtctgtatgaagcggtgcgcggcggcaacgtggccgtccaccccgcggcgccgactccggcgcaggcgcccgccgtggagggcatggcctgggagctgctgtccgcggaggagcgctacaacctgctgttgtccctggtgcaccgggccctgcgcgaggccggaaaggacacggacctgctgcgcggcttcctcgacgcgccgccgcagggactggaggacgcgtacgccggggtgacgctggcggctgacgggcgcgtggacgtggcgcggctgagggccaacctctccacgggaggcgaggcggtgggccgggccctcacgttggaggccctggacgccttcgtgtcctatgcgttgttttcagcgcgcaacgtcctgcccgcggacgtggcggagcggctgtccaacacctaccgcaccctccaaggaggactggcctag

SEQ ID NO: 6617 - DNA, 618 bp, Myxococcus xanthus
atggtcgcgattcggaagtgggtgtggggactcctggcgctgacggcggcctgcagtggcgctcgccaagcggtgaagcacgcggggaccggcggctccgggcccgccccatcagcggaggcggcgagcgaggacagccgctcgacgacgcgccgctacgtggacgaggacctgggcttcgaaatcatccggcccacggcggactggcagttggacgagacgaatgagcgcacgccggaggggctcgccattcccgtcatcctccgccacaacgtctccggagcgcaggtggtgttgcaggtggcgcccgcggtggcctctcccacgcagttcgcggagcggctcactgaagggctccgccagcacccgggcttcaccaccacggacccggcgcccattccgctgtcggacaccgcggtgggcttcgatttccaggtgggggatggcgtgcacggcaaggtggccgtgcgtgaaggcatccccgggcgcgtgttgatgatgctggccacctggccggcgcaggccgcggcggacgtgccccagagcgtggatgcgctcatccagggcgtccgcccgcttgcggggccggcgacggcgtggaaggtgccccagcgctga

SEQ ID NO: 6618 - DNA, 1596 bp, Myxococcus xanthus
atgaacttcagcttcgtctcccgcgatgccacacggacgagcggcgacctgctcgtcattcccctcttcgagggcgagctgggagacagcgccccgtcctccctctcctcggcggatggcgccctggaaggacgcctgcgcggcgccgccacccaggagggcttcaagggacgcgcggaccagagcctggtgatgcacaccctggggcgcacgtcgtccgagcgcgtgctgctgctgggcctgggaaaccgcgcccgcttccacccggaagtgctgcggctggccgccggccgcgccgcgaagacggcgcagcggctcaaggtcacctcggtggcgttcgccctgccggccaccgagtccacgcaggacgcggtgcgcgccgtggtggaaggcgtggcgctgggcgtctaccgcttcgacaagtacaagtcctccgcgcgcgaggagaagaagggcgccgcgaagctgggcaaggtgtccctgctgctccccgagggcacggagcgcacgcgcgagctcgatgccgcgctgacgctggcgcagcgcgtcgcggaggcgaccaactgggcccgtgacctcgtcaacgagccgcccaacgcggtgacgcccacggtgctggccgaggccgcgcgtcaggccgcgaaggaaggcgggctgaaggccaccatcggcggccgccgcgacatcgagaagctcgacatgggcatgttcctcggcgtcaccgcggggagcaccgaggagcctcgcctcatccacctgacgtacatgcccaagaacgcgcgcgacgccaaacagccgccgctggcgctggtgggcaaggccgtcaccttcgactcgggcggcctgtcgctcaagccgacggacggcatggtggacatgaagacggacatggcgggctcggccgcggtgctgggcgccatgaaggtcatcgccgcgctcaagccgcccttccccgtgcacgccttcatcggcgcgtgcgagaacatgccggccggcaacgcctacaagccgggtgacatcctcacctcgcgcctgggcaagacggtggagatcaccaacacggacgcggaaggccgcctggtgctgggcgacatcctgacgtgggccaccgagcacaagccggccgccatcatcgacctggccacgctcacgggcgcctgcatcgtcgcgctgggcaactacatcgtcggcgccttcggcgaccacgaggagacggtgacgcaggtgctccaggccgcgcgcaccgcgggcgaggagatgtggcgcatgcccatcagcgacatgcagaaggacgccctgcgctccgaggtcgccgacatgaagaactccggcgagcgctggggtggctccatcaacgccgccatcttcctccgcgagttcgtgggcgagacgccgtgggtgcacctggacatcgcgggtccggcgagcagccccaaggagcgtggctacctgagcaagggcggcaccggcgtgggcgtgcgcaccctggtggagtacgtccgcctgcgcgcgcagacgcaggacaccgcgcccgcagaagcagcgcccgaggccaaggccagcaaggccaagccggcccggaagcgcgcgaagtag

SEQ ID NO: 6619 - DNA, 156 bp, Myxococcus xanthus
cccacgctcgggacgacggagacgctcatcgccgccctggaggccgcgggggtggatccgcagcgccgcgcggagacgctgactcccgaggagttcgccgccatcgagcgcgcgctcggccccctgacgccggctacgtccacgcccgcggagtag

SEQ ID NO: 6620 - DNA, 645 bp, Myxococcus xanthus
atggactaccggtatatcgtggtggaagggcccattggcgtgggcaagacgagcctctccaatatcctcgcggagcgtctggcgggacggcgcatcctcgaagtggtggaggagaaccccttcctgtccagcttctacacggaccggcagaagttcgcgttccagacgcagatcttcttcctgctgtcgcgcttccgtcagcagcaggagctgttccagcaggacctcttcagctcgatgacggtcagcgactacctgttcgccaaggaccgcatcttcgcgcacctcaacctggacgcgcacgagctggccctctacgagcgcgtcttcgaggcgctggggccccgcgtggccaagccggacctggtcatctacctccaggcccgactggacgtgctcctgcaccgcatcaagaagcgcggccgggagttcgagcgcaagttcgaccccacgtacctggaggggctcgtccactcctacaacaacttcttcttccactacacggacaccccgctcctcgtcgtggatacctccgacatcgacttcgtgaatgtcgaggcagacagggaagacctgcttgccaccatccggaaggcgaagccgggcacgcagcattacgttccgaaggcttcccgccggggctga

SEQ ID NO: 6621 - DNA, 321 bp, Myxococcus xanthus
atggcgaagtccacgccggacgtcctgcccgaagcgggcgaggtgacgtggacgcgcggcatgggcgtggaggcgtgtctcatcgcgtgccgcttcatcctggagcacacccgcacgcgcacggtggtggaccccttctgtggccacggcaccgtgctggccgtggccaacgcgctgggtctggacgcggtgggcgtggagctcagccgcaagcgggcgcgcaaggcccgcaacctgcgcgcggagctgatggacggcacgcttgtcctgtcaggcgcccatggcacgggcgcgcctgtgggcgacgacgacgcgctgtag

SEQ ID NO: 6622 - DNA, 348 bp, Myxococcus xanthus
atggagcgcaaggtcggaagtagcacggtgacggccaaggaggtcaaagcggcgctggagaaggcgcgtacgctgtcggccgaagaagagaaggtactgcgcatgcgccacggtgctggcgcttccagcacccgtgcaccgctgccccgtgccgccggtgacaaccaggagctgggcgacgagctgctcctcatcgagatgcagctgatgaaggcgatgcgcgctcgcgcgggtggcaagcccgcggccaccgccagcagcaagcccgtcgccgccacgcgcgcgcgggatgccgccgccaatcccaccaaggacaagattgtccgggcgctccgcaagaagaagtag

SEQ ID NO: 6623 - DNA, 889 bp, Myxococcus xanthus
gtcaccatccacacactgaagcgcttcaagcagatcggtcagaagatctgcatggtcaccgcttacgacgccacgttcgcccacatcctcgaagaggcaggcgcggatgtgctgctgataggcgactcgctgggcatggtcatccaggggcatgactccacgctgccggtgacgatggaccagatggtctaccacacggccgcggtggcccgtggcgcgcgccgggcgcacgtcgtggccgacctgccgttcatgagctaccaggtgtcgaaccaggaggcggtccgcaacgcgggccggctggtggcggaaggcggcgcgggcagcatcaagctggagggcggcgctgagttcgcggacacggtgcgggccatcgtccgcgcgagcatccccgtcatgggacacctggggctgacgccgcagtccgtccacaagatgggcggctacgtcgtccagggccgcggcgaggaccaggcgcggcagattctggacgacgcgctggcgctggagcaggccggggcctacgcgctggtgctggaaggcgtgcccatggacctggcgcgcacggtgacgcagcgcctgtccatccccaccatcggcattggcgccggcgtggactgtgatggccaggtgctcgtctgctacgacctgctgggcatgaacccggacttcaagccgaagttcgtgaagcgctacgccaacctccacggctcgattaccgaggccgcgggcgcgtacttcgcggaggtccgcaagggcgcgttcccggacgaggagcactccttcaaggcgaccaagaacatccggctggcgccgggggctccggctccggcggcccgggtggagccgtccgcgcccgccgaggctggcgagaagctgggccccgtct

SEQ ID NO: 6624 - DNA, 279 bp, Myxococcus xanthus
atgagcggcagacagcgggcgaagacagtggtgcggctggaagaggcccgccagagcacgcccacccagcgagcgcccacacctcccgtggagccggatccgctctatggcgtggtgttgctcaagacggccatggagctgaagcgccgacaggacggcaccgtggaggacatcctccgcggcgtgctcgcccggatgcgcatccccgaagccgagttcttcgcctacctggagcagcaaggcggcctgctccaggcactgggcatgcgcggacgctag

SEQ ID NO: 6625 - DNA, 969 bp, Myxococcus xanthus
gctctacagatcgttctcattgtcgccgagcagcagccggacgggaacctccgcaaggccacccttaacgccatctccgccggtaagcagctcgcggagaaggccggtggtgagcttcacatcgccctggtggggaaggacccctcgaaggtcgctgacgagctcaagggttacggcgcgaaggccgtccacctgggcgccgccgccgagctggagcactacctggcggagacctacgcgcccgccatcgccgccctggcccaggagctgaaggcggactacatcggcatggcgtccaccgcgcagggcaaggacctgctgccccgcgtggccggccgtctgcgcgccgccatggccaccgacgtcatggccatcaacggcagcggcgcggacatcaccttcacccgtcccatgtgggccggcaacgtcttcgccgacgtgaagctcaccacgccggtgaaggtgctcaccctgcgcgccaccgagttccccgccgccgctggcggtcagggcgccgccgaggtgaagaccttcagcccgaaggtcgaggcctccaagacgaagttcgtcgacttcaaggaagtgaagagcgcgcgtcccgagctgaccgaggctcgcgtcgtcatctccggtggtcgcggcaccaagggcgacttcaaggagattgaaggcctggcggacgacctgggcgccgcagtgggcgcgtcccgcgcggtgtgcgacgcgggttgggttcccaacgacctgcaggtcggccagacgggcaaggtggtggctccggcgctctacatcgcggcgggcatcagcggcgccatccagcacctggcgggcatgaagagctcgaagaccatcgtcgccatcaacaaggaccccgaggcccccatcttccaggtggcggactacggcatggtggcggacctcttcaaggtgctgcccgagctgcgcgcggagctggcgaagctgaagtag

SEQ ID NO: 6626 - DNA, 704 bp, Myxococcus xanthus
atgcgctgtggcccgggctcgctggcgaccggggacgtcgcgctgatgcggcaggggcgcgagctggtggcgcacgtggtggtgtccacgcggccgtggcggacggcctcgctgctggggccccaggacgccccgggaggcgtgacgctgggccgggtggtggccatccgcaggggccgctgggtggttccactgcccagaccgctgcgtccggcgctgcggctggcgcagcaggccgcatccacggcgtgggcctggcctcggacccggctagtgtctcggggtgtgtgggacttcctcttcgccggatggtcgctgccgcttcgtcgccgtctggtggggccgttggaggtgcggctcctgacggccggtgacctggacgcgctcctggccttcgccagtgagcggctggtggtgtctccgggcttcctgcgccgtcaactgcgcgagcgttggggcttgcaggacgcggagcgccggggcgcagcggcgggcgccttcgacgcccagggacggattcacggcttcgcctgggtggactcctaccggcaggagggcttgcagttggagggggtctgggtgcgctccctggtggtggcgccccgcgtgcggcgaatgggcgtggccacggagctgctggagtgcctgatggaggaggcccgacgccaggggcagtcgcacgtcttcgcggacgtggacgatga

SEQ ID NO: 6627 - DNA, 519 bp, Myxococcus xanthus
atggcgcctcggcctggctggtggagccgccactggcgctgggtccttccgctgggatgcctggggctgctcgcctcgtgtatcggcctgggagtgcttgccacgtacctgggcttctcctccctggggcagtccgacgcgcaccaggaagccgtggccatcgccagcggcgacgcgctggtgcagcgcgcgctggggacgcccatcgaaagcggcctgccccggcgcagctccgtgcagagccgcaacggtgtctctcgcgcgcagttctccctcccgctcgagggacccgacggcaagggcacactgcatgcgcagggtgagaagcgcggagacggcccctggcagttcagccacctcatcgtcgccctgagcgacggcacgctcatcgatctgctccgagccgaaccgcccaagcgccccgagctgccactgcccgccgagccgccttacgcggacgaggccccggagcccggagaagtggcgccgcgcgacgcgggccgcgacatcgagctgtga

SEQ ID NO: 6628 - DNA, 156 bp, Myxococcus xanthus
atgctcgtcgccagttcggtgctgttgttcgtctacagcgtgcgccaccgcgaccacgagcacgccgaccggctctcgctcttcccgctcgaagacgacagcgccgctccggcgccgcgcgctcccgagcctccgccctccgcttcccaggagtga

SEQ ID NO: 6629 - DNA, 2202 bp, Myxococcus xanthus
ttccgccggcaaccgggcggggcgggtctgacggtggacccggccctaggcaaggggcggatgctgtggcggcccggcgccttcgacgtggcggagttccttcggggcggggagggctttggctacctcttcggacccagccgcaagcgcccggagcgcacgagcctggacctgcccatccgcctgggcatctgcgccgcgctgtcgatgaacgtgatgctgttctcggtgagcttctacgtggggctcacgccggaggatggcgatgtcttccgtctcttcacacggctgagtctgtggctgtcgtccgcggtcgtggtggtgggcggctggcccttcttccgctccgcgcttcagggcttgcggcgcggcgtgctgcacctggacctgcccattgccctgggcatcctgctggtgttcggcatgtcgctggcgcaggcgcgcggagggcgcggcgacctggcgtacttcgacacgctcaacaccttcgtcacgctgatgctggtgggacggtggctccagcagcgtgtgttggagcgcaaccggcgcttcctgctggatgacgacggggcggaagggctcttcgtccgcagggaagagggcgcgcggctcgccaccgtgcgcgccgccgaggtggccgacggcgacgtgctggtgattgcgccgggggacctggtgccggtggacgcggtgctgctcgattcgggggcccgcgtgtccacggattggattacgggcgagcccggcgagcgcgcggtggggcaggggggggcgttgcccgcgggcgcgttcaacgccgggcgcgaggccgtgcgcatccaggcgaagcaggcgttcaccgactctccgctggtggcgttgctccgccgggcgcccacggccgcaggggggcccgcgctgcacacccgcttctgggaccgcgtgtcgcgccgctgggtcgtcacggtgctcttcgtctccgcgttggggctcgcgctgtggtggcccgccgggccggacaaggcgctggaggtggcggtggcgctgctggtggtgacgtgcccgtgcgccattggcatcgccacgccgctggcctacgagttggtccaggcgcgcctgcgccgcggcggcttcttcatccggagcacggacctgctggaccggctgccgcgcgtgcgaaaggtgctcttcgacaagacggggacgctgacgctggggcggctggagttggtggaccgcgccgccgtggcggggttgacggccgcgtcgcgcgacatcgccttcgacctggtgtcgcgcagcaaccaccccgccagtcgctgcctcgcggccgcgctggctcgggaaggcgcgcgcttcaactcggaggcgcgtgtgtcggagctcgcgggccaggggctcgagctgaatcgagaaggcgtgcgctggcggctgggccgcgcggactgggccaccgaggcggtggacacagggcatccggagcgcgagcccacggatggcgcgtcgtgtgcggggggcagccccgcgagccgccactccaggccgagtgggcgtgtggaggtcctcctctccggttcgggcctcgccgcgggcccggtgctgacccgtgacggcgtgccagtggccttcttccagctccgggagtcggtacgtcccgacgcgcgccgtgaggtccaggcgctccagggagagggccgcgaggtgtggctcatctccggggacagccacggccgcgtgagtgacatggccgccgcgctgggcatccccacccagcacaccctgagcggccagcgtcccgaggacaaggcggaggctgtcgcgaagctggacgcggcggacacgctgtacctgggtgacggcgtcaacgacagcctcgccttcgagcgagccctctgcgcgggtacgcccgccatcgaccggccggtgatgcccggcaagagcgacttcttcctcctgggcgaaggcctgggtgccatccgcgaggcactgcggttgtcggcccggttgcgccaggtggtgcgccggctgctgctcttggcggtgagctacaacgtggtggccgtcgccgtgtgcctcgcgggttggatgacgcccctgcgcgccgccgtggccatgcccgccaccagtctggccaccgtgctcttcacggtgtggtggctgtccgcctcacgtgagcgcgccgccgcctcgcccacgccgccgctgcgggaggtgccggcatga

SEQ ID NO: 6630 - DNA, 2877 bp, Myxococcus xanthus
gctctaaagcgccaccccttgctcaagctgcaggctggcgcggtgcttggctacgtcgacagcaggagcaaggccattggggatggcttcgtccactgggaaatcctggcgccatccgatccagggcagctcaaggccttcctcgacttcgcgaaggacacgctggggctgggagacttcttcaaggtcttcgaggaggcggaccagaacaatttcttcgacccttcgaagggagaactcgacgcgctgatgaagctggcgcccaagtcgattcacgctgcggggaaccccgaagaggagtgtctcgatcgcttcgagcagacgtatcaccacggcgcgctcaaggagattcttcgctcacctcgcgcgctcgcgttctcgtccgatgatgcgcctggtgatgccggcgagccttcgtttcccgcggagcttgtcatcaccaactacaaggacgcgctccctgaagggacctactggctcaagctgaccttcgagcctcccttgggcgaacggtacgtcgcttatgacggaaaacagagccgtctcaacgtgcgcttgccggctggggctcgacgaatcttcgtggagccggccgacggccccggctttctgctgcaggtgggcggcggtgctcaggatgcactcgaacaggaactccagcacttcaagaggctggcatccgtccgttggcgaaacgtggtgctcaggcatctgaacgagtggttgccggagagcatcgtcgttcaggtgatgaagcatctggagattcacggtcagcttcgaatggggagccagatcgccgacatccagcagccggacgaggccaagaggctgctgggacgctacgcggaggcagtcggattctgggcccacccggaggaagtgcccttcctcgggcccgtgggggacaacggtggcaagaaggcgcttttcgcagcggcgcctgacgtcgaccaattgcccgcgaaggggctggtcgacaacccgcacccagtcaccttcgcctggctcctgatgctcatggtccggcatggcctcgtccggttctcggagctgccggcctggcgcccgagcaactcgaaggacgtgctcgcggtggggtggctcccggcacgaagcgatcatcccgcataccgggtgggggaactcctggacgtgggggccgtggtgcgcgggagcggagacgacgaggtggagctgcatgtgctgcatgagggcacacgctgcttcctcgcgagcggaagttgcaccgagggtgctttcttcgcgcaggtggagttgccgggttggggggcctgcacgctcgacatgccgggtgcccggcttgtgggaaccgcgacattggaggtgctcccgccggtgttgctgggtgggcgcgagtcggcggaggctcttgggagccaggttgtttcctcggctcgatacgctcccgagtctcacaaggatggaacgttctcctggcgtattcccttcagggagaactgcccaaagcttcttcggggttgggtgcttctgagcgcatgggcgaaggccacgaaacaggaagggctgcacccggaggcacctgcgttcgatctggcccgtgtggccatccccgtacaggggcgggaggactccgcgttcaatgaggcctccggactccgcgtcgttgacggcttcattcaaaggggggcgctcaagaagctggaaacgtatgtgacgcggcacttcacctaccgcgccttcttgaaggccgctgcttccaagacagagcctccgttggcctgggcgctcgtggaggcggtggagcgtgtccagtgcgcgtattcagagaggcagttgctggcgttgtccgcgctggccgaggacggattgtccatcgtgctcacggccacgaatgcccggcgattgaaggatgccgccgagaaggttcgagaggatggctggttcaccgccttggaggacgcggccaagggggcgattcgcgtccgagtcccagcgccagcggagggacgtcatcctggtgaacttgtcatccggttcgacgccagcgctgctttctcggagctgcggaagggcatgccaggtacccatgaggtccatgtgaagttcggcgcgttcttcccgaacgggggaagcgcgcgggactcgcgtctggtgacggcggatacgctggggagccggtgtgaacctgtgacgctcgatgcgctgcggagcggcgccaaagcgggggcgctggaggtgtggtccaccgaggtgtcggaggtccttcacatcccttcgctcgaagcgcccaaggtcttcgtcaccgcccgggggattcagctttcctcgcggttgctgggtgggaatcggaccttctgggagaatgctcgacccatcatcaaggtgggccacagttccctcgatgaaaccgccgcacgtcagtccgtcatccagaatgggtgcgtggtgcggaccttcgggttcgaggatgcgcaggttcaggggcgaattctcatcccgaccgccgaggtggtgaacaagcatgtgctcctggggcacgaacggatcgacgtccagcccgcgaagggccgtgcttgcaccatgcagcgcaacgcgaggctcgaagctcggtctcactaccatgatgccttcagcctgaaggtcgccgtcacgacggaggccgtcccggtgagcagacccttccgactggaactcgcgagtccgtcgctgccaggcgacccgcccgggcttccgctgaagctcaagaggggcagcgttgtctacaaaccggaacgccaagggcaaggtctgacggatgtggaaggggtgctccatgcggacgtggatctcaatgacgtcgaggccgccttggagggcgccagggaatacgtgctccgtgtcgtccccttagag

SEQ ID NO: 6631 - DNA, 543 bp, Myxococcus xanthus
tggcccaaggcgcgcggcatcaccattctcgcgcgcaccgcgcacggccagggaacgggcaccgcggtccaggagctggccgtccccacggaccaccgcctcaagggcgtcaccgccgacgcggagatggccgtgctttccgcctcggagcccatccgcctggcggagctgctggaattcctggatgcgcgccccgtgcgcgggcggacgctggactgcgagggctcggtgggtggggtacgcaggacggtcatcaccgtgcccctggcggacatccacggtgcggacgcgctgcgccgggagctggccacgcgcttcggtgacgccgtgtcctggcgcgaggacctgggcaccgtcacctgcgtgggcgtggggttgaacgccgactgggcgccgctgcgccgcgcgctggccgccgccgaggagttgggggcgcacgtccacgcggcccatacgtcgcctttgcaactgacgctgctggtggacaaagcacacctgaaggcgctgacggcccggctgcaccgagagctcttgggagggtag

SEQ ID NO: 6632 - DNA, 933 bp, Myxococcus xanthus
atgaagcgccggacgttccgagtggaaggggcgttggtggggaaggccgtggcccgtgcggtcgcggatgagttgggactgcccgagcccggggcacgggggctggtggaggtgggcgccgtctacgtggcgggcaagcggagccgggatgcgaatgcgcggctgacagccgggcaggtggtgacggtggtgctggaggagggcgggcagagccccctgtccgaggcgccccccgcgcccgagctgcgcgtgttgtacgaggacgcggacgtcatcgcggtagacaagccggctggcgtgtccgcgcagcccaccgaggggcgcgtgggggacagcctggtggacctggtgggggcgaagctgggacgccccgcggggctggtgcaccgcctggaccgggagacgtccggcgtgacggtgttcgggaagacggcggaggccacgtcggcgctggcggccgagttccgggagggacgggcgcgaaagcgctacgtcgcggccaccgggccgggtttgcccccgtcgggcacggtggacctgccattgtccaaggacccgtcgcgccctggccgctggcgggcgacccgggcggccaatggtgtacccgcgctgacggacttccacacgctgtcatcggggccggcgttctgtgtcgtcgagctgctgccgcacacgggccgcacgcatcagctccgcgcgcacctgacggcgctgggcgctccgattctgggggatgcgcgttacggcggcgcggcccgggcggaaggcgtggaggcaccgcggtgcttgctgcatgcccaggccctggagctgggacatccgcgcacgggcaagctgctgcgcatcgaggcgccggtgccggaggacctgatgcggttcttcctggccgctggcgtgccggcgccctcgggggccattcgcggcgccgagtga

SEQ ID NO: 6633 - DNA, 3211 bp, Myxococcus xanthus
gggcgccggcagggcgggcctcgcgggcgacgcgcaggagactggccgacctgtcgggcgctgcgcgaggagctggaagcgcaagtccgcctccgcgaggaagcggagacgctcaccgccgaggtggaggcccaggtccgccggttcgaggatgcctgcgcggaggcggagctgcgggccatcgacgcagaggcccgcgcggaggcagagacgcaggcccgtgaggcagcggagcttcgcgccgcggcgagcacgcaggcattgcaggcgctcgaagcgcgcctggagtcggaggccgcggggcgagtcgtttcggaggcccgcgccgaatcggagtccaaggcgcgtcagaccgcggagcgccgggtcgagtccgccgaggacctgaccgcggtgtcggaagcgcgcatcgacgcggaggctcgtgcccgcgaggccgcggaggcccgcgccgaggtggaggcccagtcgcggctcgaagcggacacgcgtgcgcagagcctgtcgcgagcccttgaggaagtagagactcgcgcggagctggcggggcgtgcacaggcggaggcagaggctcgcgcggagcaggctgcgcgtgcgttggcggagtcggaagcccaatcggaacggattgctcgggccctggctgacgccgaggcgcgcgtgcaggcggagaacggtgcggacgcccgtgtggagtccgtggccacggcgctggccgaggccgaggctcgagccgagattgaatccgcggcccgcgtggatgccgaagcacggctggcgtcagcggaggcggcgcttgccgaggcctccgcgcgagcggagattgaggccacggtgcgcgccgaagccgacgcccgggtggaatcggtcgcgacggctctgactgaggcggatgcccgggcggagattgagtccgcggctcgcgtggacgccgaggcgcgtctggagtccatcgccacggcgcgtgccgaggccgaggcccgagcagagattgaagcagcggcgcgtgccgaggcagaagcccgggccgagattgaggcaacggcgcgcgtggaagcggaggcgcgtgctgaagccgaggcgttggctcgccaggcggcggaagcccgagccgaagccgagacacgagcacgtgaggaagcggaagcccgcgtcacctccgaatctgatgcgcgcaccggattggaagcggaggcccgtgcgaacgcagaggcccgcgcgaagaaggcggaagctcgggctcagcaagaagcggagctacgtgcaaacgcagaggcccaggctagcagcgaggctgcggcccgggcggaggccgaagcccgagcggagcaaggcgccgctgtacgccttgaagccgaagcccacgctgagcgcacgacagctgcgctgaaagaagccgaggcccgagctgagagcgcagtagccgcattgcaagaagccgaagcccgagctgagagcgcagtagccgcattgcaagaagccgaagcccgagctgagagcgcggctgccgcattgaaggacgacggtgctcgagctgagatttcggccgtcgcgctgaaagccgcggaggctcgagccgagagcgaagcagcagcacggcaagccgcggaggcccgagctgaaagcgaggccgtcgcgcgacgcgaagccgaagcccgcgcggaaatcgcggccgaggcgcgagccgcagccgatgcccgcgccgaagcagaggtcgccgcacggtccgaaatagaggcccgcgccgagcgcgaggcgaagttgcgtgcggcaatcgaggtccgtgcggagagcgaggcgtcctcgcgaaccgacgcagacacgcgtgcttctcgtgagtccgaggcccgagccgcagccgaggcccgcgccgagcacgaggccacgttgcgcgccgaagccgaggtgctcgcgaaggcggaggcccaggctcgcgagaaggcggaagcacaggctaccgcggaggcggagcgccgcgcggaagccgaagcccgagccgaacgtgaagcgcaggcccgcgccgaagccgaagcccgcgccgagcgcgaagcgcaggcccgtgctgaagcggaatctcgcgccgagcaggaggcccagcagcgcgccgaagcagaagcacaggcaaggcgagaaggagagtccctcgccgccgagaaggcacgtgcccgaacggaagaagaacaccgcgtcaccgccgccgcccaggctgaatccgaggcccaggcacggcacgaagcggaagcccgcgccgaagccgccctgaagtccgccgaggaggcggaagcccgagccgaagccgaggcgaagcgccgtgccgaggccgaagctcgcgtccagcaatccgcccaggccgaagccgaagcgaccgcccgcgcgaaggccgaaggccgccaccgaacggccctcgaagtccgcctggacgcggaggcaacgcagcgagcgacgctggaatcccggctcgaagaagagtcccgcgcccgcagcgagtccgagtcccggctcctcgcggagaacacccgaatctccgaggaactcgccgagctccgcctggagcaccagcagtcccgagagaacttggcgaaagagcgtgaagcacgcgagtccctcgaacaatccctggaggcactgcgcaccgagtccgccgaacagcgagcccgctccgagcgcgaacgcctggagctggaggagcgcgcgctccgagacgcggaggaagccgctgcccaggcccgagcatccatgctgcccctggaagcacctcccggcagacccgagctggccgtggcccgcagtggcagcgtcacccaggatggcctgacgaagctggtgctccggctctgtgaggcccgcatggagatgcggttggagctgaaggtgatgaacgccctgcgcgtcctctggctgcgggacggggcgctggtgggggccgtctcctccgcgcaaggggagacgttggtcgaccgggcccgcgcggacgggctcatcgacgcgcggcaggaaggcgagctgcggctggtgcgcagcgccaccacggccgcgctgctggacgcactgcggggccggggctacctgcgggagtccgaagccgtgcccctggtccagcgctacaccgagcaggtcttcctggacgcgctggcggagccctcgacgctctaccgcctggtatcggagccggcgccgcacgaggtggcgcttgccgccgccacgcgtccgc

SEQ ID NO: 6634 - DNA, 936 bp, Myxococcus xanthus
tgggcatgccccgccggtacgcggactacccggaggagttccagccgctgcacgtggcgtccaccgctggggcgtccctgctgggcttcggcttcctcatcgtcgccatctacctgggctggtcgctgcggcatggccgcgcggcggggcggaacccctggggcagcgagggctatgagtggctcagcgactcaccgccccccgagttcaatttccatgcgccgccttggtttcccaggccgccccacgactacgcgaaccctggcgccaacacggaggtggagcatgcggcatgaggcgagccagcgcccggtggagccccgtgccctccactttggagacgaggcgtcccgccaggacgccgcgcacctgggcatgtggatcttcctggccacggaggtgctgctcttctcggtgttgttcaccgcgtatgccctgtaccggctgacgtatcccggtgtgttccagcaggcgcccgcgcacatggacgtgttcctggggacgctgaacaccttcgtgctggtggtcagcagcatcctggtggcgctcgcggtggatgccatccggaatggacgcgacttcgccgcggcggcgttgctcgcgctgtcggtgctgctgggcatcgcgttcctgttcatcaaggccgcggagtacacgaagcacgtgcatgacggggcgctgcccggcgcctggtacgcctatgaggcgttcgcccttcccggcgccaacctctacttcacgctgtactgggtgatgactggcgtgcacgcggtgcatgtgctcgtgggggtgggcgtgctcgtcacgctggcgttgcggacgctggcgggggagttcggggcccgcttccacacgcccgtggagctgggtgggatgtactggcacctggtggacgtcgtctggttgttcctctggccattgctgtacctgacgtga

SEQ ID NO: 6635 - DNA, 366 bp, Myxococcus xanthus
atgcggggcggggtccgggtgctggccgtcggagccgtgttgctggcgctggccacgctgtccttcgggctgtcgaggctgcacctgggggtgtgggcggtgccggtcgcgctcggcatcgcgctgtgcaaggccgtgctgattgccttcttcttcatgcacctggtggagcggcccggcgggccccggctcgtcatcggcaccgcgggtgtcttcgttggcatcctcgtggggctggtgttggcggaagccgcggcccgggcgtgccccatgttgccgccagggccctttccggtgtcgcggtttccgggccccgaacgaataggcccccctcgggtggagcagccttggcaggtcctgccctga

SEQ ID NO: 6636 - DNA, 228 bp, Myxococcus xanthus
atgctgggcctgctcgcgggcctgacgctccaggccgtcatgcccgtgctggtcgtcccctgggccgcgcccccgctggagcgagcgggaccgcccatcgccgcgttcctgctcctgcacctggtcttcggcgcgtgcctgggcgtcctgacgcctgtccggaaggccttgctcctcctggatgcgaagcgccgtgggatccggacactcccggtaccgccgtactga

SEQ ID NO: 6637 - DNA, 372 bp, Myxococcus xanthus
atgaaggaaatcatcaccgcggtgttgctggtgttgggggcgttgctgatgctcctggcggggctgggcctgttccggatgccggacctgttcctgcggctccacggggccgcgaaggcgtcctcgctgggcgtgggcctgctgatgggcgcggcggcgctgggcctgggagacgtcagcgtggtggcccgcgcggcgctgggcgtcaccttcgtcttcgtcatgacgcccgtggccacgctgctcatcgcgcaggcggcgtttcgcgccggcatcccgctctgggagcgcacgcaccagaacgacctggaggaacaccaccccgctggaggtccgtacgagccacgcctggggcccgacggcgaggaatga

SEQ ID NO: 6638 - DNA, 282 bp, Myxococcus xanthus
atgagcgactggctgcagaccatcacccagggggccctcggggccatctccgtctcgatgctgttctcgctccaccggctgctccgaggtccgtcgctgacggaccgggtggtggcgctggacctcttctcgctccagacgtcggcggtcatcaccgtctatgccctttggatgggacagcccgagctggtggacgtggccctggtgctggccgtcatcgggtccatgggcaccatcgtcatcgccaggtacctctacagcgcgcagaggggcacgccatga

SEQ ID NO: 6639 - DNA, 474 bp, Myxococcus xanthus
atgaccgcgttcctctggaacctgatgctggcgctcctctgggccgcgatgctggggaacgtcacttcggagaacctcctcacggggttcatcatcggcttcgtgctgctggccctcatcgacacgcagcatgtgccctcgcgctatgggacgcaggcgtggaacgtggtgcggctggtggcgggggtgggctgggacgtgctggtcgccaacgtgcgggtggcctacgagattgcgacgcccaagctcctcacccgtcccgccatctaccgctacgacatggaggcacgcacggacgcggagatcacgctgctgacgctcatcgtcaccttcgcgccgggcacgctggccctggaggtgtccgaggaccgcaaggccatctacgtccacgtcatgttcgccaccacccgggaggcgttctgccaggagctccgcgagcgcgtggagattccactgttgagggcactgcgatga

SEQ ID NO: 6640 - DNA, 330 bp, Myxococcus xanthus
gccaagctggccgtcatccaggccgcgctgcgggccgaaaactggatcatcgcgggaacggctgtcgtcgtgggcctgctcaccctcttctccatgatgaagatctggcgcgaggccttctggaaggcgccgccggaggaccagccgcaggaacccacccggccgctgagcctgggagacggcgtgctcgggccctgcatggcgatgacactgttcatggtcgtcctgggcctgggcgccgagccactgctggagctggcggacgccgccgcgggccagttgctggacccggaggagtacgtgcgggcggtgctggggggacgcccatga

SEQ ID NO: 6641 - DNA, 1545 bp, Myxococcus xanthus
atggccacgacccgttcttccgccgccgctcagcccgccctgggcgagcaacagccgattgtcacctccgaggagcaggcccccgcggcagcgcccgcgaagcccgccacgcacgacacggtgccaccgccggccctgctcgacttcatgatgaagtcgtggaagccgcgctcgaagaagctgcccccgaaaatcaagcaggcggaggccttcaaagcccgccgccgggcgctctccaagctgttccccggcgagacgctcatcattcccaccggccacgagaaggtgcgcgccaacgacaccaacttccgtttccggccgggcagcgacttctactacctcaccggcaacctggagccggactgcgtcctcgtcctccagcccaaggagaagggtggccacaccgacgtgctcttcgtggagccgaacccgggccgcaccgacgccacgttcttcaccgaccgcgtgaagggggagctgtgggaaggcccccgcctgggcgtgaaggagagtcaggcccgctacggcgtggaccaggcccggagcctcaacgagctgccggccttcctctccggcctcagcggcgcggagagccgtcccacgcgcttgctgcgcggcctgtcgcccaaggtggacggcgccgtcccggcgccgggtgagaaggacaaggggctggcccaagcgctgtcggagatgcggctgctcaaggacgcgcaggagctgcgtgaactccagacgtccatcgactccacgcaccgcggcttcgaggacgtcatccgtggcctgaagacggcgaagacggagcgctacgtggagggcatcttcaacctccgcgcccgcgtggaaggcaacgacgtgggctaccgcaccatcgccgcctccggcgcccatgcgtgcatcctgcactggcaccacaatgacgggccgctcgttcccggcgacctgctgctgctggacgcgggcgtggagggccagacgctctacaccgcggacatcacccgcaccctgcccatctccgggaagttctccaaggagcagcgcgaaatctacgagctggtgctggaggcgcaggacgcggccttcgccgaggtgaagccgggcaacgacttcatggagcccaaccgcgcggccatgcgcgtgctcgcggagggcctggaggccctgggcatcctcgaggacgccgaggaggcgctcaaggacgagcaccagttctacaagcgctactcgctccacaacgtcagccacatgctgggcctggacgtgcacgactgcgcccaggcgcggcaggagacctacaagtacgggaagctccaggccggcatggtgctgacggtggagcctggcctctacttccagatggacgacctcaccgtgcccaagcgctaccggggcatcggcgtgcgcatcgaggacgacgtcgtcgtcaccgcgcgcggctgcaaggtcctctccgccgacatcccccgcaaggcgaaggatgtggaggcgtggatgaagtccctctgggcggcggacaaggccgcccggaagggcaagaagaagtag

SEQ ID NO: 6642 - DNA, 696 bp, Myxococcus xanthus
atggaccgcgccagcatcttcggggtgatgcgcctcatccggcgctggcggccggacaaccggtacctgctgcgcaacgtggccatccctggcttcggcgtgcaggccgcgctgctggggctgtacctggtgggcgtgattccgccgctgcccgtggccgtgcagttcgcgggcatctaccaccaggtggagcgggtgagcccgggcatctaccacctgtcctcggtggactccggcgcctggtacaagccgtggacgtggggcgggccggacttcctgatgcagccgggggacaagccctactacttcttccgcatcttcgcgccgaagcacttccagtcgtacaaggtccgcgtgcgctggtacttcgacgacccgcagaagggctggacgacgtacggcaacggcttcatggccaccgtcagcagcaacggcacggacggcggctaccgtttctacgcgacgacgtccaacctgaagcccggcaagtggcgcgtggtgctggagacggaggccgggcacgaaatccaccgtctcaacttcaccgccgggccggatgcgaaccccgggccccgcgtctacgaggtcgccgtgtccacgctcaaggacgtgaagcctctggcgctgtcggagtggcaggagcgggccgcggccgcggcggcgaaacccgccaccgccgcgccgaagccgaagtag

SEQ ID NO: 6643 - DNA, 933 bp, Myxococcus xanthus
atgtttggagacgcgggccccgaggacttgctcgtcgcggtgcacgcggagaccggcgcggtggcgtggaaggagcccgtgccgcccgtccatgcgccgctggtggtggatacggagggcaacgtctatggcggcgcctccgatgtcctggagcagcggacggagctcttctcgtacgcgccggatgggcagctccgctggcggacgcagcgcacgggcgtgctcgagcccacggccgtggacggagggacgttgatgctgggccgcgcggagctggtggatgcggccacgggagcgccaatcgccacgctggcgaccgcctccgctgagtccttctattactcgctgggccgctccagttcgaccttcggccgcacggcgatgcaggcggaccggctcctggtcctgcccgacatgcggtgcaccaccgagggctgccccaccaccacgcatccggggggcacgttcctctatgggctggatccctcgagcggcgcggtgcgctggcaccgggccgtgggcacctggccgatgtcaccgcttctcacccagcgtggctcgctgctgctggtggaccggccagtggccgagacgtgcggcgagcacgcctgtaccggtgaggaagccgcgctcggttcgttcctgcgggagctggaccaggacgggaacgagttgtccgcctgcgcgctgctgggaaaggcgccgtacatcaccccgcccgcgctgcaccggggacgcgtggtgctgggggcctggacgaactggaatgccagcaatgactggacgcagcggatgagcatccgcgccttcgacatgacggcgcccgctgagcctgcctccagcggctgggtgagcgcgggcggcggtaattcccgctcgggccagacgaagcccactggcgcggcggctcaggcgcgagccccaggccgataa

SEQ ID NO: 6644 - DNA, 915 bp, Myxococcus xanthus
tcgctcaagctcaacctggacatcgagcacacctaccggggcgacctgaaggtgacgctgacctcgccgtccggcaagagcgcggtggtgtcgaaccgcaagggaggttcgtcggatgacctgacgggcgccttcgacctgtccgcgttcaagggcgagcccacgaagggcacctggacgctggaagtgcaggacgcggcgcgcggcgacaccggcacgctgaagtcgtggggcctggacatcgccccgcagacgccggtgacggagcccgaggcgccggaagagcccgaaggtggcctgttcgagggcctgcgtgacggtgcgctgctggacgcgctccaggactactcgtccggcaagaaggtggtcagctacaacgaggcccgccggctgatgttctccagcctggacgtgaacgagaacggcaacgtcgtctgcgtctacacgggcgccgaagtcaaaggcggcaagattcccaacaactcggtgatgaacaccgagcacacctggccccagtcgaagggcgccacgggtgcggcgaagagcgacctgcaccacctctaccccaccgacagcaaggccaactcccggcgcagcagcttcccgttcggcgaagtggtcaacgtgcggtggagccagaacggcgccaagctgggcaccgacgcgcgcggcaacatggtcttcgagccgcccgacgcccacaagggcaacgtggcgcgcgcgatgttctacttctccgccacctacaacaaggccatccccaacgacgaggaggcgacgctcaaggcgtggaacaagctcgacacggtggacgccgccgaaatcgagcgcaaccgccgcatcgccaccatccagggcaactccaacgccttcgtcgaggactcggcgctcgcggaccgcgtgaaggacttctag

SEQ ID NO: 6645 - DNA, 1044 bp, Myxococcus xanthus
cccgacgtcgcggacccgatgctgggccgggtcctgaacgagcgcttccgcatcctggagacgcttggcgccggaggcatgggtcgcgtctacaaggccgtgcagtcaccgctggaccggctggtggcgctcaaggtgctcaatccgcagtacggagagggcaaggacccgggcttccagaagcgcttcttcctggaggccagcgtcaccgcgaagctgcgccacccgaacaccgtcaccgtcatcgactacggcaagacggaagacggcatctactacatcgccatggagtacctggaggggctgacgctgggccagctcctcacgcagatgggcccgctgccgtggccgcgcgcgctcaacatcacccagcagatcgcccgctcgctgcgcgaagcgcacaaggtcggcctcatccaccgcgacctcaagcccgccaacgtcatggtcctcaatcaggagacggaccacgacgtggtgaaggtgctcgacttcggcctggtgaagtccttcatcggcgacgcggcgcccgtgtcacaggacacgtccatcacgcaggcgggcatcatcctgggctctccgcagtacatggcgccggagcaggcgcgcaacatcgccgacccgcgcagtgacgtgtacagcctgggcgtggtgctctatcagatgctgatggggcggccgcccttcctggccgcgcagagcatcgacgtcatcgtcaagcacatcaacgaactgccgcccgccttcggctcgctctaccccaaccatggcatccccggagaggtggaggccctggtgatgaagtgcctcgccaagacgccaccggagcgctaccagtccatggacgaggtgatggaggccatgcgccgcaccatgtccacggtgggcgtcagcggcgccttcagtggcgcacgcttcgcgggcgcgggcatcagcggcgtcggtggcagcggccccatcagcgggccccacggaagcggcccccacggaagtggcccccacggcgcggccggctccggtcccgccaccgtggcgctggacatc

SEQ ID NO: 6646 - DNA, 870 bp, Myxococcus xanthus
atgaatgcccgcctgtccgagctgctctccggtgcgccgccctatccccgccgcgtcgtctgcctcaccgaggagacgacggaggtgctctaccggctgggcacggaggagctggtggtgggcgtgtccggcttcaccgtgcgtccgccccaggcgcgcaagaagccgcgggtcagctcgttcctggacgcgaacttcgagcgcatcctggagctgaagccggacctggtgctgggcttctctgacttgcaggcggacatcggccgcgagctggcgaagcggggcgtgcccgtctacctgttcaaccagcgctccctcgcggaaatcctgcagtcagtgcggctgacgggcgcgctggtggggcggcccgaggccgcggaggcgctggccaccgagctgaccgcgaacctggagcggcacgcggacgcggcggagtcgcttccacgccggccgcgcatcttcttcgaggagtggcatgagccgctcatctccggcatccgctggtgttcggagctggtggagctggtgggcggcgtggacgtgtgccgggagtcgcgcgcgtcgcagggggcgcagggccgcatcttcgcgccggaagaggtggcgcggcgcgacccggagggcgtcatcgccagttggtgcgggcgcaaggcgaagcgggagaaaatcgtcgcccgccccgggtgggccggggtccgggcggtggtggatgaccagctctacgaggtgaagagctcgctcatcctccagccggggccagccgccctgtcggatggcgtggaccggctggcgaaaatcgtcgcggcggtggcgcggggcgagaagctgccgcccctgcgcgatggggaactgcgctccgcgggggcctag

SEQ ID NO: 6647 - DNA, 3390 bp, Myxococcus xanthus
ctgctgttgacccacgcgaaggtccgcacgcgcgtgtcattggatgccgcgcgcgtcctccatgttgagacggtgttcgcgcagacaggagattcaggccgaggcacctcaatggcgccgctgcgggcttccgcctcggagcgggtctgcctcgagccgtggacagggcctcggggtgagcagctctgggccatccacacccaccgcaccgtggcggagctgttcggtcgtctggacgcggatgcgaccacgaaggaaggcgtctggctcgcggcggaggagccgcaggttcccggcactgggctggaggtcctctgggccctgacacgcgggctgcgggtggtgttgccggcggagcgtgcgcgcttcacgccggtgggggctggcgcggagcctgctcgacggcgcctggacttcagcctgtcgttcttcgccaacgacgaggactcgctgggcggccgcaaataccgcctgctgctggacgccgcgaagttcgcggatgcgaatggcttctccgcggtgtggacgccggagcggcatttccatgcgttcggcggtctgtatccgaggccggcggtggtgggcgcgggggtggccacggtgacgcagcgcctgggcatccgcgcggggagcgtggtgctgccgctacacgaccccatcctcgtcgcggaggagtgggccgtgctggacaacctgtccgatggccgcgtgggcgtgtccttcgcttcgggctggcacgcgaatgacttcgtgttcgcgccggaccggtacgcgcgccggaaggaggtcatgcaccgaggcatcgaggaggtgcgcaccctgtggcgaggcgggacggtgcgccgacgcaacggcgcgggcgccgaagtggccctctcactgcggccacgcccggtgcagcagacgctccccatctggctcaccgctgccggaaacccggagaccttccggctggcgggcgagctgggggcctacgtgctcaccaacctgatgggccagcacctggaggacctggaggggaaggtggcgctgtaccgcgacgcatggaggcaacatggccatgcgggacggggacacgtgagcttgatgctgcatgcgtatctcggcgacgacccggccgaggtccggcggagggcgcgccagccgctgctcgactacttccgcagctccgtggacatcgccgcgggcttcatggccggcatggggctcgacatggacccccgttcgctgacgcccgcggacatggatgcgctgctggcgcacggcgtggagcgatacgtggagagcggcggcctcttcggtacgccggactcttgcggtcccatggtggagcgtgtccagcggctcgacgtggatgaaatcgcctgcctggtggatttcggcgtggaggtggaggcgaccctggaggggttgcggcacctcgacgccttgcgcggtcgccattccccggagcccggactcgcggtccccatgccgtcgctgcgggaaggcccgggtgcggcggaggccctgctggcgctcgtgcgcgaggcgggcatcacccacctgcactgcaccgcggcgctggcgcgctcgatgctgacgctccccgacgcggcggaggcgctccggcctgtccgccacgtctggctcgaaggcgcgtccgaagaagcggcggcatccctggtgcgcgccatgtcctggcgtgtcgcgcaccggcagcaggacctgggcctggggacctgggcgctcgccgccgagccgggagatgcctcgcgctgggacgtcgtggatgggcgcggccagcccgtgccggtgggcgtcatcggtgagctggtggtgaagggcgcgggcgtgcctctcgggctctggaacgcgccggactccacccccgtgcgcatcctcgctggaagcacggatgccgcgaggcggatggccacgggccggcgtgcgcggcgcaagcgggatggctcgctggagctgttgcccgccctacctgtcccggagggcaggccgacaccaccgaaggtgatgggcgctcgggatggcgtggcgaagaagtccgaggcacccgcgtccatcacccgggtcccccggggccgtccgctgccgttgtccttcgcgcagcagcggctctggtacctggaccggctggagccgggcaacgtcgcctacaacaacgccgtcgcgttcaccgtgagcggcgccctggatgccgcggccctggagcgagcgttgaacgcggtggtgcgccggcatgaggccctacggaccacgttctccatggatggcaccgaggcggtgcagaccatcgcgccgtcgctggaggtctccatctccctggaggcggtggagggcgccagtgcagcggacgtcgcccgctggacacgtgaagaggcgcgccgtcccttcgacctggagcgggggccgctgctccgcgcgaccttgctgcggctgggaagtaccgagcacgtcctgctcatcacgctgcaccacatcatctcggatggctggtccgcgggcgtgatggtgcacgagatggctcgtctgtatgaggccgagctgacgggccggcctgcctccttgcccgccctgccggtgcagtacgcggactacgcgctctggcaactggagcagatgcgaggctccgccctgaaggccgaacaggcgtggtggcgcgacgtgctggcggatgtccccgtgctccaactccccgtggaccgtccgcgtcctccgttgcagacgcacgatggcgagcaactgcccttcgccgttccgaagtccctcaccgacgccctggtggcggtggggcggaaggagggcgccacccccttcatggtgctgatggccgcgtggcaggtcctgctgcatgcgtacaccgggcaggacgacttcgcggtgggcacgccggtggcgggccgcgaccggcccgaagtcgaaccgctgattggctgcttcatcaactccatggccctgcgcgccgacctgtccggcgacccctcgttcgcggaggtcctggggcgggtgcgaagaacggcgctggacgcgttcgcgcaccaggaggtgcccttcgagaagctgctggaggtgctgcacgcgccgcgcgacctcagccacacgcccgtcttccagacgatgctgattctgcacaacacgcccgccgcggcgttgtcgctcgtcgggctccagctccgcagccgtcccgtgcatgcgggtgcgaccaagctggacctcgcgctggaagtcaccgagacgcccgaggggctgcgaggcagcatcgagtacaacaccgggctcttcgacgcggagaccatcgcccggctgtcgggctcgctcctccggttgctggaggccgccgcgggcagcccggaagtccggctgtcccagctcgacttggctggaccgccgcgg

SEQ ID NO: 6648 - DNA, 483 bp, Myxococcus xanthus
gctctcaaggccaccgcgggcggcagcagcacgggcatcgtctccgcgtacttcaccgtggatggcggcgcgcccatccccgtcatgcccgacgcgggcggcggctacgtcaccacccagcttcacctcacggaggggacgcacgtggtccggctgagcgtcgtggacgcgctggggcacgtgacgtggcgcgagcagacggtgtccgcggacttcacgccgccggtgctcgtcatcctgtcgcccaccgagcaggagaccaaccccgacccggtcgtctcgatggtcatccaggagcaggacgccagccccgccacggtggtgacccagggaatcgtgacggaggacgtgcccgcgggcagcaacgtgctgcggcacacggtgaacctggtgcaccgcgactggtcgctcgtccacgtccgggccacggacgccgcgggcaatacgaccgaggtggtggcgcgcgtatacgtggcgccctga

SEQ ID NO: 6649 - DNA, 2247 bp, Myxococcus xanthus
atgcggttctcggaccccaacttcgaggatgtgcggacgcgcgctcgcaccgtctcggcgctggcccaggtgtcgggagcggcgagcgtcgccgtcacgggcgccgacgagccggccttcgccacgctggcgctcgcctcacgcgacttcttccccgccttcgcggtacggcctgtccaggggcgcctcttcgcggaggaggagcagcaggagggaggtgctcccgtggtgatggtgagccacgccttctggaagcgctatctgggcgcacggccgctgccccttccggacaccctcaccttcgaggggcgcgcttacaccgtggtgggcgtgatgcccgagtccttcgactacccggtgggcacgcagctgtgggttccgcgggagctggtgccccccctgcccagccgcaccgcacacaactggcgggtggtgggaaggctggcggacggcgtcgacctccaggccgcgcgagtggagctcacacacatcgcccgcgagctcgaagcccagtacggccaggacacgcggatgcatgacatcgccgtggagcccttgcaagagagcctggtgggccgcgtgcggtccacgctctacctgcttgcgggcgccaatgccttcctgctgctggtggcgggcgccaacgtcacgaacctgctgctcgcccgcgcggccacccgtgcccgggagctcgccattcacgtggccctgggcgcggggcccggagcgttgatgcggcgattcctcatggagtcgctcctgctctcattggcgggaggcgcactgggggcggtgcttgccgcctggggcgtgcgcgcgctgctcgcggccgagccgggccacctgccacgggtcgacgaggtgggggtgaacgccacggtgctcctcttctccctcgggctctcgctgctgctcgcactggggctggggttgctgacggcgctgcgcgcggcgcggcagcccccgggggccgcgctggcgggctcggggcgcacgcacagcggaggagggagcgccgagcgcacgcgccgggccctcgtcgtggggcagctcgcgctcgcattggtcctcctggtgggcgcggcgctgctcgggcggagcctgatggggctgctctcgctggacccggggtatcgcaccgaggatgtcgcggtgctcagcctcgtgctccccccggcaaaggacgaggcgcaggggcggcacaacgtgcagttgcaggagcacctcctctcgcgactggcggcgctgcccggcgtgcgcgcggtgggcgccgtgagcagcttcccgctcgagggaagcccggcgggagatggcaccttcatcgtgctcaaccgccccgacgaggtggggaacttcgaggacttcgggcggctggcgcgcgagcccgagcgcaccggctccgccgagtaccgcgtggcgagcgagggctacttcgccgcgctcggcatcccgctcgtgcgcgggcgtctgttcgatgcacgcgacaccgtcgacgcgccgcacgtggccgtcatcagcgagtcgctcgcgaaggcccgctggccccacgaggacccgctgggcaagctcattcagttcggcaacatggacggggacctgcgtcccttcaccattgtcggcgtggtgggggacgtgcgggagcaagggctggatgacgcgcccaggcccatgttctatggcggctcccggcagcgtctgcgggcctcctcccgcttccacctcgccgtacacgggccaatgggctccgctgccctggtcaccgcggcgctgccggtgctgcgagagcttgcccccgagctgccctcgcgcctgtccacggtggagggattgctcgcgggctcgctcgcccccaggcgcttcagcctcctgctgctgggcgccttcggtgcgatggcgctgctgctctcggtggcgggcctcgcggccgtcgtgtcctacgcggtggcgcagcgcacgcgggaattcggtatccgcttcgcgctgggcgcgacgacggaagacgtgctggggctggtgctccggcaggcggcgcggctcgcggggctgggaatcgtgctcggcgtgctgggggccctggggctcagccaggtgctcgcggggctcgtgtacggagtgagcaccacggacccgctcgtcttcctcgtggtggcgctcctcctgctcggcgtggcgctgctcgcgagctggctgccggcccgacgtgcttcgcgcgtggacccgatgaccgtgcttcgctcggaggcctga

SEQ ID NO: 6650 - DNA, 783 bp, Myxococcus xanthus
atcatctgcatctccaaccagaagggcggcgtcgggaagaccaccaccgccatcaacctcgccgcgagcctggcctccgcggagcgccgcacgttgctggtggacatggacccgcagggcaacgcgggcagtggcctgggcatcaagcaggacaacatcaccggcaccatctacgaagcgctgctcaatgaccggcccatccaggagctgctccaccccacggagctgcgctacctccaggtggtgcccgccacgccggacctcaccggcgccgaggtcgagctggtcaaccaggacaaccgcgagttccgcctccgcgacgccctgcgcccgctggctgccgaatacgactacatcatcatcgactgtccgccgtcgctcggcctgctgacgctcaatgcgctggccgccgcggactccgtcctcatcccgcttcagtgtgagtactacgcgctcgagggactctcgcagctcacccacaccatcgacctggtgaagcagggcctcaacccggacctgaagatggagggcatcctcctcaccatgttcgactcgcgggcgaacattgcccaccaggtcgtcgaagaggtgcgcgggtacttcaagaagcaggtgttcgaggtcatcgtgccgcgcaacgtgcgcctgtccgagtgcccctccttcggaaagcccatcatcctgtacgacatcaagtcgaaggggtgtgagagctacctcgcgctgggccgcgagctgatgaagcgggacacccccaagagccctcgcaggcgcgtggcttga

SEQ ID NO: 6651 - DNA, 876 bp, Myxococcus xanthus
atgcagaagcgggccctggggcgcgggctgtccgccctcatcccccaggcgggcgccaccggggccggcaagggtgagcaggcccccaaggccggcgtcctcaagctccccatcgagtccatccaccgcgacaaggaccagccgcgcacctactttgacgaggagaagctcaaggagctctccgaatccatcaaggcgcagggcgtgctccagcccatcctcgtccgcaaggacggcgacggctaccgcatcatcgcgggcgagcgccgctggcgcgcctcccaggccgccggcctcaaggaagtgcccgccatcgtccgcgacgtgacggaggtccaggccttcgagctggccctggtggagaacctccagcgcgcggacctgaaccccatcgaagaggcggagggctacaagcgcctggtggacgagttcaagctcacgcaggagcaggtcagcgtgcgcgtgggcaaggagcgctccacggtggccaacgccctgcgcctgcttgcgctgcccacggacgtcaagggcatggtggcggatggttcgctcagcatgggccacgcgcgcgcgctcctgggcgtgccccggctgccggagctgcagaacctggccaagcaagtcgcggacaagaagctctccgtgcgtgacacggagcggctggtccagcagagtcgctccagcgggaagaaggacgcgggcaaggcggcaccgaagcagagcccgcaggtgaaggcactggtggaggagcttcagcggcgactgggtaccaaggtccggctcaccgaacgaagccccggaaagggcaccatcgaggtggacttcttctcgtacgatgacctcgaccggctcttgaagcttctcaggaaggagtag

SEQ ID NO: 6652 - DNA, 99 bp, Myxococcus xanthus
atggaccgcggtgtcatcttcgagggctcgctgaagatggagaacctgggcaccgctggcgcccggccgcctccgcctccgggtggcgagaagaagtag

SEQ ID NO: 6653 - DNA, 473 bp, Myxococcus xanthus
atggcgccagcttcactgctggcgctcaccctcctgggcggctgcaagggctgtggccaggaggatgctgcttccggtaccggagaggatgacggccgtccgtcctccatccgctccggtgtgaaggtgccgctgccggatggctggtccgcgctggtcgcgccggatgagagcttccaggcgggcccgcccggccggcccgtgttgcgggtggacctgcggcgcggggacggcgagcagctgccctctgtggacaccctggtcgaccgcgtccgcgaggagctgaaggacttcgagctctcgctggaccaggaagaagagacggagcgctactcgctgctgcgcatcaccctggcgcccaagctggcggatgggggcgtgggcccggaagcccctggcttcttcggcgcgcggcgcgtgggcaacgacttgttcctctgtgccagcatgccgggcgcgtcccttagagaacg

SEQ ID NO: 6654 - DNA, 762 bp, Myxococcus xanthus
atgacgacgacctccaagacggtggtggtaacgggcgcgagccgaggcattggccgcgcggtggcgctgggtttcgcgaaggcgggccatgacgtgtgggccctggcgcgttcgacggaagcgctggagtcgctccggcaggaaggcggcgagcgcatccggccgctcgcggtggacgtggccgacgaagcggcgctgattgccgcgagccagcgaatcctcgccgagggtcctccgcgcgtactcgtgaacaacgcgggcatcaccgtctccgcgcccctggcgaagacgcgcaccgaagacctggcccgcgtcatggccgtcaacgtgacggcgcctttcctcctctgccgcgagctgatgccggccatggcccaggcgggcggcggacgcgtcatcaacatcggctccatggccgcggtgcggggcgtgaagtacacgtccgcgtattgcgcgtcgaagcatgcgctgctgggcctgacgcgcgcgctcgcggtggagtacgcgaagaagcaagtcacggtgaacatcgtgaatccgggctgggtggagacggacatgttcgccggtgcgacctcggccatcagcgcctccacgggccgcagcgaggagcaggcgcgcgaggccctcgcgtccatgaacgccatgggccgcatcatcacgccggaggaagtcgccgcgctgtgcctgttcctcgcgtcggacgcggcgggcggcatcaccggctcggcgtacgccatcgacggtggcgagctgggctga

SEQ ID NO: 6655 - DNA, 1305 bp, Myxococcus xanthus
tctgtcgacgtgaatcgcttcgcgcccctggcggagcggatgcggcctcgcacgcctgacgagttcatcggccagtcccacctgctgggcccgggccgtccgctgcgccagctcatcgagcgcaaggccatcgtgtcctccctcttctgggggcccccgggcgtgggcaagacgacgctcgcgcggatgatggccaccggtgtggacgcggagttcgtcatcctctccgccgtgtcggacggcatcccccgcatccgcgaggtggtggccgaggccgagcgcctgcgcaaccagtacagccgccgcaccgtcctcttcgtcgacgaaatccaccgctgggcgaagaacgtgcaggagcaggcgctgccccacgtggagagcggcctcttcgtcctcctgggcgccaccacggagaacgtcagcttcgaggttcgccccgcgctcgtcagccggtgccgcgtgttccagctcaaggaactcaccgtcgcggacatccagtcggcgctgacgcgggcgctcggtgattcgaagcggggcttgggcgcgcgcaacctatcggtgggggagggggcgctgacgctgctggcgaagggcggcgtgggcgacgtgcgcaaggcgctgggcgcgctggagctggcggccagcctcaccgcggacggcgcggagattacgcccgagacggcgcgcgaggcagtgggcaccagtctgtcccgtcacgacaaggacggcgaccagcactacgacttgctgagcgcgctgcagaagtcgtgcaggggctccaacgtccagggcgccgtcttctgggcggcgaagctgctccagacgggcgacgtggcgtcactgtggcgacggctcaaggtgattgccgtggaggacgtgggaatggcgatgccggaggccatcagcgtcgtgcgtgactgcgaggaggctttccacgccatgggcatgccggaggggcgcatctgcgtggcgcacgccgtcgtcctgctggccacggcgaagaagagcaaccgtgcctatgcggcgctggacgcggcgctggcggcgctccaggagcatcccaacgcggagcctccgcttcacatccgcaacgcgcccaccgagctgatgaaggagctgggacacggcaagggctaccagacgccctggaacttcaaggaccactacgtgcccgggcagacgtacctgcccgccccgctggagcgttccgtcttctatcgcccgagcaaggaaggctacgaggcggagattcacgagcgcatgagccactggtggcgcgaggacaaggcgtcccgaggcgagtag

SEQ ID NO: 6656 - DNA, 642 bp, Myxococcus xanthus
atggccggcaccggagcggacgcgaagctgtacgcggcggacttccggaacggtcgaatcgacgtcttcaactccagcttcacgcccatgccgatgccgggcgccttcgcggacccgtctctgcccgccgggtacgcgcccttcaacatccaggacatcgagggcaccctctatgtctcgtatgcgcagcaggacaaggagcgtacggatgatgtccccggcgcgggcgcgggctacatcaacgccttcgacatgaatgggcagttgctgcggcggttcgcttctcagggcgcgctcgatgcgccgtggggaatggccctggcgccggcgggctttgggcagttcagcaaccacctgttggtgggcaacttcggggatggcgccatcaacgcgtatgaccctgcctccggcgcctgggcaggcgcgctcactcggccggacggacaccctgtcaaggtcgacggactctggtccttgcacttcggcactggtgtgcagggcctacccgccgagacgctcttcttcacggcggggcccgcggacgaggagcagggactctatggccggctcgacatgacgcccgtgtgtccgcagggcggcctgcccccgtggaaggcgcctcacgagcctgaggcgcagtga

SEQ ID NO: 6657 - DNA, 1026 bp, Myxococcus xanthus
ctctcaagcaattggtgggcgccgctcgcgcccccgcagacgctggagtacgggccgcgtgagacggcgacgccggcctatgacgccgtcagccggacgaccgtcgcgctcacgcgggacgggttcgcccgcggcgtgggtcccgacggccaggtgaagtggaagtacaagacgggcagccgcttcaacgccggggcccgggtggtggacggcgtggcctatgttccgggcggggacggcgtgctgtacgcgctggacgcggcctcgggcgaggagaagtggaagtacgtcgcgggtgaggccctggccacggtgcccgtggtcgcgaatggcctggtgctcgtggcctcggagagcgacacgctcttcgcggtgaagatcgcggatgggcagtgggcctggcagtaccgccgggatccgcccaccggcttcaccgtccgcggcgcttcgcggcccctggtgcgcgaaggcgtggcctacgtcggcttctccgacggcttcgtggtggcgctcagtgtcgacgacggcggtgtcacctgggagcgctcgctgtccggcgctggctccgagttcctggacgtggacagcagcccggtgatggacgccgccgggcagctctacgtcgcgtcgtacaagagtggcatcttcgcgctcgagtcggagtcgggcgacctggtgtggaacaccgccgtggccggcatgacgtcgctgctggtcagcggccaggtgctcttcgccgcgggtgacggccgtgtggatgcctacctggcggagacgggacggctcctctggtcgcatcccctgggggaacgggcagccttcgctccggtgttcgcccagggaatgctgctcgtgcccacgtccagttcgctgctgttcctggagcccaagacggggcgctcgcgcgtgtcgtggaaccccgggagtggcatcaccgcgccgcccttcgcggcgggcaggcaggtgttcgtgctgtcgaacaacggctacctgtactccctgaacatgaacgggattgacgggtga

SEQ ID NO: 6658 - DNA, 426 bp, Myxococcus xanthus
atggttccggctcgcaggacggtccgcgtggtggcggcgctgattccgcggccggaggatggacgccagttcctggtgcagcagcggctccccggtggaagccgcgccttgctgtgggagttccccggcggcaaggtggaggccggggagacggacgcggccgcgctggcccgtgagtgccgcgaggaactggacgtggagctcgccgtgggccggcggctctgggagggccagcactcctatccggacctgacggtggagttggtgttgttcctggcccggattgtctcgggcgagccccggcccctgggcgcccacgcgctggcgttccacacgccggcgcagatgcagtcactgccgttctgcgaggcggacatcccgctcctggacgacctggtggcgggaaggttgggcgcgctcgattga

SEQ ID NO: 6659 - DNA, 648 bp, Myxococcus xanthus
atggacgcgctgccggaggccatggcggcccggcggctgtgggtgacgttcaacggctcgtgcttcgacgtacctgtcttgcgtgactactttggccccgcgcgatttccggtgccggatgcgcacatcgacttgcggttcgtgacgcggcgcctgggcatgggcggtggcctgaaggaaatcgaagggaagattggcgccgagcgtccgccgcacatgaagggcgtgaatggctacgacgcggtgctgctgtggcgcgcgtaccagcgccgcggcgatgtggaggccctccggttcctcgtcgagtacaacctgtacgacgcctttcagctccggacgctgatggacgtggcatacaaccgcggcgccgacgacttgaaccaggatgttccccggctgccagtcttcgagcgtggcgacgtgctttacgacgtgagccgcatcatcctggagttggggccaaccgagcgcgatgctgcagacccttgctcgcgtccgggccatggagcagggcggctgagcgggcttggtgactgtgcccggttcaccgtcctggcagcggccgtgcaatcgcgagtaccggacggtgaacacctgtgcgtgcgacgtgtcgcggtttggtggaatgacctggggaggcgtttgtag

SEQ ID NO: 6660 - DNA, 606 bp, Myxococcus xanthus
atgcccgaaacgtcgctgccggaacgggacgccgaggtccgcagcctggcgagccagctttcgcctgaccccgagctcgcgcggtggatggacgaaaaagacctggtacgtcgcttcacggccgcggtgaacaacatcgcggagggttcgagcccgcgcacggtgctcgggttcctggcgcccacgggggctttccaggtgacccaggtggacggcaccacggtcatcgatccggcaagctacgcacgctacgacaccgtggcccgcgtgattggctccatcgacacgcagtccgcggccagcgtgtaccgtgagctgaagccgctgattgaccaggcccacgcggagattgcgccgccgggacagacattcagcagcgccttgagcgcggccgtccaacatctgctcaaggtgcccgtgcaggaaggtccggtggaggtcgttcccgaaggcgcgctgtatgcctatgcggctccggagttcgagggcctgagccccgcgcagaagcatctgctgcgcatggggccccagaacatgcagctcatccaggccaagctgcgggaactgaagagctcgctgggtctgccgccggtcgcggaccgctga

SEQ ID NO: 6661 - DNA, 1404 bp, Myxococcus xanthus
acgctggcgcagttcgggggcttccacttcgtcacgaagctggagccctctgcgccggtggtgcgtgatgcgacgccggctccggacgcgcgcttcgtgccgctggggagcccgctgcgcgtgagcttcgaccggccgctggacccggccaccgtcaacgcgcggacggtgggcgtcgagggcgtcacggggctggtcaactacgagtcctccacgaacacggtggtgttccggcccgtgccgcccttcgcgcccgccacgaactacacggtgacggtgaaggacgtgcagacgccgcagggggcgggcctcgcctcgccgcacacgtacacggtgcgcacggtggctcccggagtgagggtgagcgcggggcgtcccggtcagccggggatgcccgtgttcgccacgggcccccgggggacgctggccgtgtggaacgaggacacggggacagccatccaggtccgcgcggccttcgacagcggctcgggcttcggggactccgtcctggtgggggaggggcgctcgatgacgctggcgccgcaggtgtccgcgtggggcgagcgcttcgtggtgggctggtcggaccgctcgctcgcggggggcgccgtcgcgctcttcgatgggacggacttctcgcccgtgacgcccggcatcagcggccggcttttcggggtggggaaccatctctatgccgtcaatgggaagaccttccgggtccatgctgggacgcagtggtcggaggtcttcacggcggcgaacctggggtcgcccgtgttcctcctgcagaatggagaccgggtgctggtgtcgtcggggcggaacacgacgttggaggtctcggtcgtgttcgacggggtgcggtggctggagtccacggtgtcgtcctcggtggacgcacagtacatccgggtgggggacagcttcgggcgggcgtgggtgtccaaccagggagtggagttcgcgctcttcaaccgggacacgcgcgagtgggggctgggggagctcatcacgtccgagcagatgacgagcctgcgcatcgcctcggatggcagcaccatcacggcggtcctcggcgatacgggtgggcttttcgcggcggtgcgcgcgaacggggcatggcaggccccatcgctggtggacaacctggcggttcgcgacatctgggcggtggtgccccaccgaggcaactacgtcgcgttgtggaccggcatcaacagcgccacgctggtgcgcgccgtctcgcagacgggaggctcgtggagctcgacctcgaaggccgtggtcgcgtcggggttgagcagcgtgctcgacgtgcgggcgtcgggggatgacctgctggtcctgatgcagaagaaccagccgtcgtccacggctgaaatctggggcgcggcgctcacgtag

SEQ ID NO: 6662 - DNA, 960 bp, Myxococcus xanthus
atggagccggtgcgtgtggggccggcgggcacgaaggtccgcgtggcggtggacgacaacggggtggtggtggcgtatctccagccgtccacgcagacggacctgatggacatctgggtggtgtcctccgaggcgggggtggtgggggcgccgcaactgttggacagcgtggcggccacggacccggacctggcgctggtgcatggccccagcggcttcatggcggtgtggggcgagtgggagattcgcggagcgcggagcgtggatggggtggcgtggcgggacctggcgaccctcatcccgagggtgttccaggaggcgcgttggtacaacacgcggctggtcacggtgggtgagtccttcgcgctgtcggcgcagcgcaacgagctctacctgaacatgagcatccacaccgcgggcgtgtggcagcccatcgcggccccggtcatgcccagtgacgtctacgagttcgtcgcggcgggcaactcggtgatgttgatggcgcccttcgacgacgagttccgctacatcttccacaacggcatcgcctggtccggccagaacatcgtcaaatcgccggcggacggccaaggtgtgctcgcggcgtctccgagcgggttccggatgcacaccgacaagagctggtggcggtggagcgggacggagtggctgaaagaggcgacggatgtcagccgtccctattgggggggcagcctgcgctgtgacgcgaagggctgcggtctggcgacgggaggcgcgttcaatatgccggtgaacctggcgctgtcctatgcgccgggcacgcgctctttctggacgggggcctcgcccgcgcagggagacttccccgtccaggcggggagtgtgacgtgggacttcgtggcggacacctaccgcgtcacgtggcgccagcccgtgcagcagggtgtgctcgcgctgcacgccagcacggccctgtga

SEQ ID NO: 6663 - DNA, 1071 bp, Myxococcus xanthus
atgtgcactgattatctggtcgagaccgaggactcgagtgctgtcgtcgttggccgcagcatggagttcggcatcgacctcggttccaagttccggttccacgccaaggggcatacggtccagtctccgggttccctcacgcacctgcatggcctcaagtggacgacgaagttcgactacgtcggcctcaccgtcacgctctatggggtcaccgtcatcggcgatgcgatgaactcggaaggcctctccgccggagcgctgtggatgcccacgtccacgtatccccaggccgccaaggacccgtcccggggactggcgcccgagctcttcgtggagtgggccgtgggtaacttcgccaccgtggacgcggtgaaggaggccctggcgaacggagacgccgagctgtggcacagcgactggatgtcgagcaagattccgctccacttcgccctccacgacgcgaagggcaacagcatggtcgtcgagttcaccgaccggcagatgttcctgtacgcgtcgacgggtcatgacaactcgccgctgaacatgcacaaccccgttgctgtcctgaccaaccacccgaccttcccggaccacctggagaacctcaagaactacgcgaggctgtcgtcccgtggcgccacgcccgtgaagctgggaaccggcacattcgcacctcacggctgcggcagcggcctcttcgggattcccggcgactccacgcctccctcccggttcgtccgggccgtctacctccgtgagttctccgagaagcccaagaacgcggccgaggcccgctccctggcgctgcacctgctcaacaccgtcgacatcccctacggcaccagccgcgacttgaacgaggccacgggcaaggactctctcgactacacccagtgggtcgtcgtgaaggacctcacgaaccgcacgttcggcgtccggacctacgacagcctggggctgcagacgctggacctgcgcacggtcgatttcaagaaggcggatggcaagacgctcgccgtctccccggtggattcgcagctcgacgccaacaagcagctggcgagctga

SEQ ID NO: 6664 - DNA, 477 bp, Myxococcus xanthus
atgaaggccggaaccctccccgagcccctccccctccgcagcacgacggagacgacccgccccctgggcgcgcgccccgccacgggcacggctccgcagcgcgtgctgttggtggatgacagccgctccatccgcacgctgctgaagatctacctcatggctcgcaacttcgagttcctcgaagcggagtccgccgaggaaggcctcaaggtgtcggaagcggagccggtggacctggtcctcacggacttccacatggatgggatgaacggcgcggacttcgccgcgcagattcgcgccagcgccaacccgcgtctggccaaggtgcccatcctgatgatgacgggcgacccgaacgtggcggaggtgcgcgcgctgggtcagaaggccggcatcagcgccttcgtccgcaagccggtgagctgcgcgcagctcatgacgctggtggacaccatcctcccgctgccgcgcaagtag

SEQ ID NO: 6665 - DNA, 879 bp, Myxococcus xanthus
atgcagaacctgcgcgacaagctattgaaggcgggcctcgtcaccgaggaccaggccaagaaggtggagacgaagcccagccaggcggaagcccggcggcccggactccaggagggcggccgttcaagcggcaaccgtcctcccccccgccgtgatgacaaccggacaccaggcggcccgccccgaggcgagggtggaggccgtccgagtggcggccgtgacgccggccgtcgtgagggcggcggacgtcctggcggcggcttcggaggtgccccccggcacggcggaggtccccagcacgggcggccggccgcggcggcggcggagcgggccatccccaagctgccccccatgccgggctccaaggcctaccagcgcgccgagtccaagcggcaggtggagctggaccgcgccctgcgcgagctggtgctgggctcccaggtccccgtcgaggcgggggagacggcgttctacttcatgacccgcaagggcaagctgcgccggctggagctgagcccggcgcaggcgaagcagctcgaggagggcgagctgggcgtggtggagcgccccgagcccgcacagatcgagcactcgctggtgccttcgtcggcggcggagcagatgttcgcgctgtcgaagaagtcggtgcgcttcctcaaccgcaaggagaaccccgtcggcttcatgaacgacgaggagctcaaggcccagcaggccgccgaggccgcgggcaccgcgcccgagctgcccgacgagcccgaaggcgggtccgaggcttcggcggagactgcgtccgaggcttcggctgagactgcgtccgagggcgaggcggccccgaccgagccgaaggccagcagcgaagaagcccagaacggctga

SEQ ID NO: 6666 - DNA, 864 bp, Myxococcus xanthus
atgctccgcggcttcatcgatgtggacggctgcggctcggatgcgggcgcggactgccgccggtccgacttcaacccctggtacggcgtcaccagcgagcccaacgcgggtgacgtgggtggcgcagcggtggacgcgaccggcagaccgctcacggtggaagtcgtggcggacgcggacggccagccgcagcccctcaccggcgtggcagtgagcttctccgacaccgcgcgcgtcgtgagggaccggcccacgttccaggtcgtgcagggtgacgggcagctgggcagctcggtgaagcagctgcgcctccagccgctgtccctccacgacggcgcggtggaccagcgcccggaaggcttcgccgtcagctacctggacgcagacaacgacggcacccccgatggcttctggccgcgcgtggtcgtgcgcaagctggcggacgacgccagcaacctggtggacgagaacgacctggaccgtgatggcgtcccggatgacaccggcgtggactacgcccgcgccgatggttcccaggacggcgtaccggatgtcgtcgtgctcaacgcgcgcctggtgccagacagcatcagcgccgcgctcaccgacgagaacggcaaccctcgcatggaaggcgccgtcgttccggagctggtggtggaagtgcgaccccaggcactggatgcccgggtacctaccaaccccgtgccgctgcgtgagctgccccgaggtcgctacgcggtggtgttgatccaacccagtggacagacatggcgtgtgcccaatgaactggcacccgccctcgcgtctggactggggcttcctgctgtggaaagtcaggctttcttcctggaggttccctga

SEQ ID NO: 6667 - DNA, 1422 bp, Myxococcus xanthus
aagtggagtcgggactacgccagcggcctgccggacgtgacgctgcgcggccccgacccggacctgggcgctcgcggcgcgcgcgcgtcgctgtccgccgtgtacaccttcgccgaagggcgccaggtgggcctgtccggcggcgtgaatcgcttcaccacggaaatctatccgccgggcctgctgcgcaactacttcatcgacggcgtcaacgccttcgccaagggcgacgtggagctggggccgctgaagctgaagacgttctggaaccacatctccagcgacgcagggccccagtatgaagccacgggccagcggtcgctggtgacgtcgctcaactccaacctcttcaacgccgagctgctcttcgcgcgcgacttcgagctcgcgggcacgcaccagctcaacatcggcgtggagggccgcctcaagcgcgtggactggggagactacctgggcccgctgcgcgagcaggtgcacgcggccttcttcgtccaggacgagtggcgcatcgtggagccgctggcgctggtggccagctaccgcgtggaccggcacccgctgctcaacctgggcagcccgggcctggcgcactcgccgcgcatctccgcgctgttcaagcctttcgaaaaccacgccttccgcgcgagcgcggcctccgccttccgtgagcccacgttcctggagagctacacgcagctgacggtgcccgtgccgggcatcaacggcgtcagcacgctcaccaccggcaatcagcaactgcgtcccgagcgcctcaccgccttcgagctgggctggcgcggcgaggccccggagctgggcatcgacctggacgtggccgtgtaccagaacacggtgagagacctcatcggtctgtccggggtgtcgcggctgccgccgggccagtcgtatgacccgggcaccggttcgtacctgctgggcagttcgtccttccagaacgaggacgccatctacaccgcgcgcggcgccgaagcgggcgtcaccctggcgccggtggacggcctgggactgaagttgagcgcgtcgctgcaggacgtgacgtcggaccgcgagtcggcggccgagtgcggcccgtgcaaccaggcgccgcagttccggctgtacggcggcctcacctaccgctcacgcgcggacctggagttcggcgtggacgcggcctacacctccgcctccacgtggattgagcgcgagcccgccgccgcggaccccactcgcatcgaactggtgtccaacccgctgcgcgcctacaccgtggtgaacgcgcgcgtgggctacatggccgtcaaggacaccgtcaccgtcgcgctggtgggcagccacctgggcggcgcgcattcccagcacccctttggcaatcgcatcgagcggcgcgtctacgcgaccctgacggtgactccatga

SEQ ID NO: 6668 - DNA, 309 bp, Myxococcus xanthus
gcgcacgtgctcaagcgactggccaaggcccaggtgctcatcctcgatgacttcggccttgagccgctcggcgctccggagcgcaaggagttgctcgaagtcctggaggaccgctaccagctcgcgagcaccgtggtgacatcccagcttgagccgaaagactggcacgccgtcatcggcgacgcgacgctcgccgacgccatcctcgaccgtctggtccacaacgcccatcgcatcaagctgggcggagagtccatccggtacgtggagacaaatttgacgaagggccgcaagcaggccaagggatga

SEQ ID NO: 6669 - DNA, 87 bp, Myxococcus xanthus
atgggtctgctgggagagggggagcgaaagagcgtggagcccatcgccgctcgcgcgtgtccggaccccgagcgagtggatgccatg

SEQ ID NO: 6670 - DNA, 357 bp, Myxococcus xanthus
atgaagcacctgaaggtgctggagcagggtgaggtggtcagcgagcgagacctcacgggagcggaaatccaacgtctgggcccgctcttcgaacaagccagccgcgcccccgcccccgtcgtcatggttccgcaggcaggtgggccagacggtctcgcggtgacgctcgcgttcgaggacgaagagtctcctcgcgtgcgcatcgcggccgagcggcttccggcccagggcgctggccccctctatgacgccctgcttgaggaactggaccgcctgctcacgaccgagctgcatgcctgggctccgcgtcgcgcacacgcggtgctgccgcaccagttgcgcgaagaagagcagtag

SEQ ID NO: 6671 - DNA, 768 bp, Myxococcus xanthus
atgaaggacgacgccaaggccacgccggcggagctgagagaagccgcgacgctgctgctgaatggggcgccagatgacgcccatgcactggtcttggaggcggagcgccggaatcccctggaggtcgaaacccagctcctgctggcgagaatctgcgacgtcgagcggatgagccggtgtgtgagcacggccctgtcacgagcagagacgctggccccacgagacgcgcggccggacctgctccgagcggagctacaagagaaggacggtgacgtcgtgggcgcagccgaagcgatggagcgggcgcatgaaaaggcgcccggcgacccgctggtcggactgcgctacgtccacctgctgagcgcggcgaagcggggcgaagaggcgctggccgtcctccaaaagcttgaagggcgcctgccgcatgccaggttcctggtggaacaaggcagggtgcatagccgggaagggcacgacgccgaagcggtgaagctcttccgcgcggcggtggccgaggacccgaagctcagcatgggcttcttcgagctcgggctcgcctggcatcggctgggccaggtggacaccgcagaagaggctttgcgccaagcggaccgactggaccgggcagaccccaaggcgctggcggccctctgcgcgattcaggtcgaggagcggcgcatcgacgatgcccggctcacgcgaatggaccttgagcggcgcttttccggccagccggagctgattcgaaagtcctgcagcatcccctga

SEQ ID NO: 6672 - DNA, 303 bp, Myxococcus xanthus
atgaacgtcgacgaacacatccagcgtgctcgtgagctgctcgcccggaaccagcccgagatggccgagtccgctctcagcgacgccattgatgccgctatcgccgccgaggacatcgtcctgctgacgcgggctcgcttcgctttgggggagttgctcttccatcaagggcgtgatgcggaggcggttccctacctgcaggccgtcgtgcgcaccgagcgcgtcgatggagccgtggacgtcgaggtgaaggcctccgcccgcatgctccgacagatccgcggcatcgagcctcgggagtag

SEQ ID NO: 6673 - DNA, 426 bp, Myxococcus xanthus
atgaccgtctacagcgagaccggcgagagcgccgcgttccgcgccatcgatggacagcccgtcagcgccaccaacgaaacgctgaagctgtcctaccgtatcgtgccagaggtcatcgcccccgacaccgttcgctacaccatctacaatggctatgacctcgagtcggccgctcccatcgaggtcatcgaggcccgtgcggacggaaagatccaccaggggctccgcgcctccttcaaggtctccgtgacgaccgtggaagaccgagcgatggacatcaacccgctggaagccccatctgacaatgacaaggccctcaagtgctgtgtcacctgcggcggctggcgctactgctgtacgcccgccgcgggctactgctgcaccgtctccacggcgtgcggcctcggctgccgtgtctgcaattga

SEQ ID NO: 6674 - DNA, 2655 bp, Myxococcus xanthus
cgcagggtgcctgtgctgctcaggcagcaacggctgctccgggggcttgccgccaccgaggcacgcgtggtgtgtctggacgcggatgccgccgccctcggcgccgagccggaggtgaaccccgggcgtgtcacgacgcccgattcgctcgcgtatctcatctacacctcgggctccaccggcaagcccaagggcgtgatgattgaccaccggaacgccgtggccttcttgcagtgggcccagagtgtcttctcgccggagtcgttggcggggacgctggcgtcgacgtccatctgcttcgacctgtccgtcttcgaaatcttcacgcccctgtgctgtggggcgaaggtcatcgtcgcgaagaatgcgctggagctgcccgaactgcccgcggcgaaggaggtgacgctcgtcaacaccgtgccctcggcgatgggcgcgctgctgcgagggggcggggtgccggcgtcggtcaccatcgtcaacctggcgggcgaggcgctggcgggagcgctggttgactccatctacgccctgggccacgtgagagatgtcttcaacctctacggcccgagcgagacgacgacctattccacgttcacccgtgtgaaccggggcgagacgccgaccatcggccggcccgttggaaatacccaggtctacgtgctggatgcgaaccgggagcccatgcccgtgggggtgccgggcgaggtctacatcggcgggcatggtgtcgcgcggggctacctgggccggacggagctgacggcggagcggttcgtcacgtctcccttcgccggggacgcgggcgcgcacttgtaccggacaggagacctggcgaggtggctgccggacgggcaactcgaatacctgggccggatggaccaccaggtgaagctccgcggcttccgcatcgagctgggtgagattggcgcggcgctgcaggagcacccaggcatccgcgacgcggtcgtcgtcgtgcgagaaggcccgggcgctgacaagcagttggtggcgtatgtggtgggccgcgacgggaaggcccccgagccgggtgcgctgcgcgaccacctcaagtcccggctgcccgagtacatggtgcccttcgtgttcgtgggcctggaggccttgccgctcacgccgaacgggaaggtggaccgcgccgcgctccccgcgccggaccgtgtgggctccgggacggcgaaggcccacgtcgcgccgagaacgcctggggaagccacgctggcggacatctggcgccaggtgcttggggtggagcaggtgggcgtgcacgaccacttcttcgagctcggaggccactcgctgctgctctaccgggtgctcgtcctcgcgcgggccgcgtcgggcgcggacatcccgctgagggccctgttgcagtcgccgacgctggaggagatggcgcgcaccatcgaggccgcgaagacgggctcgctgccggtccacgacgtggtggcggagctggaggcggacgccgtgctggaggcagggctgctgccgggaacggcgcttccgtccacctccgggcccgcgcgcgccgtgctgctgacgggcgccacgggcttcctcggcgcattcctgctcgaggagctctgccggaagacgcaggcgcgcatccattgcctggtccgctccaagtcggagcaggaggggatgcagcggattcgcaagaacctggagagctactcgctgtggcgcgacgacctggcgtcgcgaatcgtccctgtccgaggggacatcggccagcccctgctgggcctgtcggaagcggagttccagcggctgtcggaggaggtggacgccgtctaccacaacggtgcgctcgtcaatttcatctacccctacgagtcgatgcgcgcggcgaacgtgctgggtacgcgggagattcttcgcctgtgcgtgcgcacgcgcatcaagccgctgcactatgtctccacggtgtcggtgctgcccgtggggcgccagcttcccttccgcgaggatgagccgctggaagcggctgcgagcctggtgggcggttatgcccagagcaagtgggtggcggagaagctcgtgcgtgaggcctcgcagcgaggactccctgtgacgattcaccggccggggcgggtgacggggcacagcaggacgggtgcgtggaacacggacgacctggtgtgcaggaccctcaagggctgcgtccaactggggagtgcgcccagcgtggacgcgctgctggacgtgacgccggtggactacgtgagcagcgccatcgtggacctgtccctgcgtcccgagtcccttggtcagaccttccacctggtcaacccgcagttcgtgcgagcggacgagatgtggagccacatgcgagcctttggctacgggctgcgcgtgctcccctatgacgagtggctcgcggagctcggcctcgcggcgccgtccgaccgtgagctgggagacctgctcctgttcctccagcaggtgccgcccgaggaccggagcgtgggtgggccgcggatggtggtctgcgacagcgggcacacgctgaaggcgctgggaggaacagggacgtcgtgtccgaccgtggatgccacgttgatttcgacgtatctctcctcgctggtgcagcgtggcttcctggctgctcccgctgggtggtag

SEQ ID NO: 6675 - DNA, 2937 bp, Myxococcus xanthus
ttcgacacgctcttcaacttcatccacttccacgtcgcgggagggctgtcccaacagaaggggctgcgcttcgtggacgagatgctgggcgcagcctggatggaactcccgctcggagtcaccttcacccaggacccggacacctcgtcgctgtcgatttccatctccactacgggcactcggcacgaagcggagcggacgcgggagttggggcagtactacctgcgcgcactggaagccgtggccgcgggaccaggtggccgctacgatcaggcagcgctgctcccaccggccgaccgcgacacgctgctgggggcgtggaatgccacgctccgagaggtcgcctgggaaggatgcttgcacgagcggttcgaggaccgtgcagccctttctcccgattccctcgccgtgctcgacgatgagcactcgctcacctatgccgaactcaaccgtcgggccaaccaactcgcatgggccctgcgtactcgaggcgtagggcccgaagtccgcgtgggcttgtgcatggagcgctcggtcgacatggtcgtcggcgtcctcgccatcctcaaggcaggcggcgcctacgtccctatggatccggcctatcccgcccagcgcctggcctacatggtgagcgactcaaacgtcggctgcgtgctcacgcagcagcgcgtcgcggacaagctcgccgggcacaaggtggaagtcctctgcgtggacgacgccgctcccacgaacgagccgcggtccgaatccaatccaccgaggctcagtgaacccgaacacctcgcgtacgtcatctacacctcaggcagcaccggcaagcccaagggcgtcatggtacagcatgcctcggtgatgaacctgcgcgcggcgctggcggccgccgcttacgcaggcatggacaagcccctacgggtcagcctcaacgcgtcactgtccttcgacgcctccgtgcaacacctagtgcagctcgcggacggacatgcgctgtgcgtggtgccgcaaaccgctcgagaggatgcgcgcatcatgctggcgtggctggagcagaatgacgttgacgtgctggactgtgccccgtcgctgctgcgcctgctgctggacgagggcctcgcggcccaccggcccttgcgagtgttggccgggggcgaagcactggacgaggcgctctgggcccggctctccgcccatccccgcatcgagtgcttcaacgtctacggccccacggagtgcaccgtggactccacgctgcgtcctgtgcgcggagcatccctgcctccatcgctgggcggtccgttggcgaacgctcaaacctacgtgctggacgcgtacctgcagcctgtaccggtaggtgtgccaggtgagctctacattggtggagcgggcttggcgcgtggctacctgaatcgtcctgagctcaccgccgaccggttcattcccaatcccttcagcacggcctccggcgcccgtctctatcggacgggagaccgggctcgctggttgccccagggcgaactcgagttcctgggccgcatcgacttccaggtgaagctgcgcggcttccgcatcgaactgggagagattgagtccgcgctgcgccaacaccccgcggtgcgcgacaccgtggtcctggtccgagaagacacgccagggctgcagcgcttggtggcatacgtggtcgcggagcccgcggccaccgtcgactccggtacgttccggccgttcctcaaggaacggctgcccgagcacatgatgccctcggccttcgtcaccctggaggctctaccactcaacacgagcggcaaggtggatcgcagggcgcttccgctacccgaggaaacgtctccgcggcatgaggtctacgtcccgccgcgcgacgcatacgaacttgagttggcgcgtctcttcgaggaactgctcggtgtctcgccaatcagcgcgaagagcgacttcttcgaactgggcggtcactcactgctcgcggtgcggctgctgtccatgctgcgagcgcgaacgggtcgaacgctgccagccgcggcgctcttccagacccccactgtcgaggggctggccgccttcctacggcgcgaacccgcgctttggacgccgctcgttccgattcaacgcagtggctcgcgactgcccttcttctgcgtccaccccgtgggaggcaccgtgttctgctacaccgagctggcgcgcaggctcggccctgaccagcccttctacggcttgcaggcccaggggctggagggaacactgcctccgctcgagtccatcgactccatggcggccagctacgtggacgccatccgcaccctgcaaccccagggcccgtaccgattgggaggatggtcactcggagccgtcatcgccttcgagatggcgcgcctgctccaccagcgtggtgagacggtggaggtccttgccctgattgagcccagttccacctcgctggcccaaggtgtcaccaccaacgacgactcggccgctgcaacgatgttcgcgctggacctggcgctcacggcgggtatcgcgtcagcaatgaccgtggagggggcagtgagtgacccgcaggcactggtggaacgcgtgctccaggaggaccgcgaggcgggtgttttcgtcccagacgccggcatggagcacttccacgcgctgcttcgtgtcttcaccgccaacgtccgtgcgctccaacagcacacgctgggcaccttcccaggctccctcacagtcctacgcggcagcgacaccgaactggagccttccgaggcggaagaccgcggatggagccgccatgcaactcaactggcggtgcacgtcgttcagggagatcactacaccgtcctgcgactccccggggccgatgcgctcgcacgcgtcctgaccgagcttctggcgcgcgccgatacgaccgagtcagtatcccagtag

SEQ ID NO: 6676 - DNA, 1521 bp, Myxococcus xanthus
atggaccgtcccctgcactccgtccgtacgcggctggacgacttcctcgccgagctcgccacgctgaactaccggcaaggcgccgggctcgcgctggatgtttcccccagccagctccacgccgccttccccgagctgtcgtctccggacaccttcgccgccgccaacgaggcgctcgccaaggcccaatcgaagaacgagcccctcaccgtccgccgcatccgactggtgcgtgagctggtggcctcgcacgtcgaggacgcgctcgccgcccgtcacgtggaggccattgcctcgctggaggcccaggcccggctgatggtggacgaccagacctactccttcggcgaggcgctgggccgcattccccacgagtccgcccggggccgccgcgccctgctggagcgcgccaccggcgagttcctctggcagaaccgcacccgttacggtgaccggcgcgatgcggccctgcacaccgcggagcagttgggcgcgaagaactaccccgccctgcgccaggacgtcaccggcatcgacttcgccaaactggccgagtccgccgcgacgatgctcgcgcgcacggaggacgcctaccgcgacgtgctcgcctacgtcctcaagaaggtggacccactgctgcgtccactgcccggcggagaggcccgcaggcatgacctgcaggccgcgcttcaagcaccgtggatgggcggcctcttccggcgcgaggacgccttccccgccgtggtgcgctggctgggcgagtggggcctgacgcccaacgccggaggccgcatccgcatcgacgacgaggcccggcctggcaagtcaccgcgccccttcgtcgccgtggtgcgcgtgccagacgacatccgcctggtgctccagccgcgaggcggcatcgacgggctggccagcctgctacatgagatgggccacgcgcagcaccgcgcccacgtctccgacacgctgcccatggagctgcgccggctgggcgacgcgtccgtgacggaggcccacgccgccgtcttcgaacggctgctcctgtcccccgagtggctcaagcgctacctgggactgcccaccgtggccgcgcgggacacggtgcgactggccgccttccaggcccttgcgctgctgcggcgtcacgcggccaagctgacctacgagctgtccctcacgcagcggggcgcctccacggaacgcgcggacgaatacgccgacgggcagcgccatgcgctcttcgtcgagccacaccctggtttcttcctccacgacgtggacccgcaactgtacgtggcgcactacctgcggtcctgggccctggagacccagctcaccgcgcgcatcacggagcagttcaacgaggactattggaggaaccccgcggccgccgcctggttgaaggggctgtacgcgcgtgggggcactgacgatgcggaaggattggccacggagacgtcaggcacgccgttggcgttgcccgaggccggggagcgcctcgtggccatcctcaaccggtag

SEQ ID NO: 6677 - DNA, 714 bp, Myxococcus xanthus
gcgagctggcggagtcgctgtgcgcgctcgtggagcaccatcctgaccgggacgacctgccgccccgctgtgcccagggacaagagcaatgcgccactgcccggaatgtctgcgcgcgatgcggcccctgagcggcacggcccgggtgcacagaagcaggctccgtgtttagactgcgacggttcccgctgtcctgaacgaggtcctcccgtcatgtccccccgctccgccctgctcctggtcacctcgtggctcgtcattcccgggcaggccctcgccgccgacagcacggagctgactccggagaaggtggcggaaatccgccgcgacgaggcccaggccctgtccgaggtcaacgcggagtacggcaaccgcaagtcgtcggagatgagcaccgcggagcgccgggaggccatcgacaagcagaaggccgcctccgcgtcggtgctggagaagcacggcgtgtcgggcaaggacttcgcgcgttacgaggcgcgcatgtcgccggcggacaacgcccgcgcgaaggcggaggagcagcggctggcggaggccgccaaggccgcgaagcagcccgcgcccgcggccgccccggaagaggtccacgtccagcagggcttcagcgaccaggacccggtggagttggaggccacggagggcgcggagccgtccatcgacgtcggcgtaccgaaggacgccgaactgccgcagtag

SEQ ID NO: 6678 - DNA, 399 bp, Myxococcus xanthus
atgcggcagctcaactccgacgcgcgcatcatcaaggagctgtcgcacctgctgctgcgcagccgcgtgcggccgtactacctgcaccagatggacgtcgccgagggctgcgagcacctgcgcacgcccatcgccaaggggctggaaatcatccagcagctccggggctacaccaccggcctcgccgtgccgcacctcgcggtggacctgccggggggcggtgggaaggtgacgctccagcccgattacgccgtcgagtacggagcgcaggagacggtgttccgcaactacaagggcgagcgcttcacgtacccggaacccgaggagacggactgcacctgcccgtatgacggcgtgtggcaggagcgggccccgcgctacggctaccgcaagggctga

SEQ ID NO: 6679 - DNA, 1080 bp, Myxococcus xanthus
atggatacctcagtgcttccggcgggtctcccgccggagccgacggccgctcgcgcgtcgctcagcgccgaagggcgcaaacggctgtttcccaacgccacggacgcggagtgggcggactggcgttggcagcagcggcatgcggtgcgaggcctggagcagctggagcggtacgtgccgctgacctccaacgagcgcgcgggcgtgcaggagacgtccgcactgttccgcatcggcatcagtccgtactacctgtccctcatcgacccggagcatccgttctgcccggtgcgcatgcagtccatcccggtgagggccgaggcgcgcatccgtccgggcgagctcgcggatccgctgggtgaggacaagacgcgcccggaggagtgcatcgttcacaagtatccggaccgggtgctcttcctcgcgctggatacgtgctccgtctattgccgtcactgcacgcggcggcgcatcacgcagggcggggtggcggagctctccaaggaacagctccgccggggcgtggactatgtccggagccatcccgaggtgcgcgacgtcctcatctccggcggggacccgttcatgctcagcgactcccggctggaggagttgctcgcgccgctcagcgagattccccacgtcgagatgattcgcatcggcacgcgcgtccccgtgtgtctgcccatgcgagttcaccgacgccctggcgaaaacgctccggcgctacgcgcccgtcttggtcgtcacgcacttcaatcatccgaaggaagttacgcccgaggcgcgcgaggcttgcgaccggctggtggaccacggcgtaccggtggagaaccaggccgtgttgaatgcggcagctcaactccgacgcgcgcatcatcaaggagctgtcgcacctgctgctgcgcagccgcgtgcggccgtactacctgcaccagatggacgtcgccgagggctgcgagcacctgcgcacgcccatcgccaaggggctggaaatcatccagcagctccggggctacaccaccggcctcgccgtgccgcacctcgcggtggacctgccggggggcggtgggaaggtga

SEQ ID NO: 6680 - DNA, 252 bp, Myxococcus xanthus
atgggctacatgccgggcttcgccacgccgcgcatcgtctgtgacgtgcccttcgtcgggaagcgctgggtgcaccaggtggcggagtatgaccgcgagcgcggcatctcgtactggaccaagaactaccggaccggcatcgaactgaacgatgcggatgcgctcagccggaagtacgaatacttcgaccccatcgaccagctgtccgaggcggggcaggcctggtggcgggagcagcagaaggcggcgtaa

SEQ ID NO: 6681 - DNA, 822 bp, Myxococcus xanthus
  unsure (1)..(822): unsure at all n locations
atggagcgcgaccagcgcgagcgggcgacgatgtcgctgctcgtgcctccgcagatgctcaacaccatgaatcttgaggacctgtggcgtgacccggtgcgtcgttacatgctaccggcctacgcggaccgcctcacggagtggaccaaccatcccaaggccagccgtgacagtcttcacgagcaggacatgtgggtggtggaaggcttgacgcaccggtatcccaccaaggtgctggcggagatgctgccgacctgcccgcagtactgtggtcactgcacgcgcatggacctggtgggcaatgacgtgccgcaggtcagcaaacacaaatttggcatcgggcccaaggaccgctacgcgcagatgctcgactatctgcgtcgcacgccgacggtgcgcgacgtggtggtgtcgggtggcgacatcgcgaacctgcccatccagcagctcgagccgttcgtcagctcgctgatggacatcccgaacatccgggacatccgcctggccagcaaggggctgatggccatcccgcagcatttcctccaggactccgtcctccaggggctggaccggctggcgaagaaggccgtcgagcgcggcgtggacctggcgctgcacacgcacgtcaatcacgcgcagcagctcaccccgctggtgggcaaggccgtgcgcaagctgctggagatgggcttncgtgacgtgcgcaaccagggcgtgctgctgcgcggtgtgaatgacagcccgcaggcgctgctggacctgtacttcacttgttcgaccacgggaagttcctgccgtactacttgtacatgttcgacatga

SEQ ID NO: 6682 - DNA, 717 bp, Myxococcus xanthus
ccgccgcccgagaacaagcccccagtggcaccgccgacgaacacgggtgtcgtcattgccgcggggaccaccgagcccgccgctcccgcggaggatccgggcggcgacgaggcacctgagaacgcgcctgtcgacaatgggcagacgccgcctcccgccacggatccggctcccgcgcccgttcaggtcgcagctgtcttcaagggtgatgacggcgcggagatcgccgtgaatggcgagcgcctggggcggattccagacgcgcgcatggcgaacctggaggtggggaagacctacgcgttcaccgcgaagctcgcgggctacaagccgtactccggtgagttcaaggccgacggcagcagcaagcaggtcacggtcgcgttcgagatgacgaaggagccgcagcccgagcccaccgtggccaacgtgcggccgccgccccagactgcgcccaagcctccgcctgcccccaagccgccgagggctcccaaggtgatgggcaagttcgcctgcagcacaaagccggcgggcgcggacatctacgtcgatgggaagaagacgaatcgccagacgccggtgacacttggcagtccgttgatgctaccggtgggcaagcggaagatttcgttcaagctcaacggcaagacgaccaagcccgtggtggtcgacatcacggaagataatgtagccaagctggtcaatgttcccatcgagtga

SEQ ID NO: 6683 - DNA, 2343 bp, Myxococcus xanthus
atgcaggtgggcggcgcgcgccccttccaggccgagtacatcaccgaggtcctctacgaccgggtggggctgctctggataggaactcgcgagggcctctaccttcacgacggccagcgcttccgcaagttccagtacgagctgggcaaccctgcttccctggcgagcaacgcggtgcgcaccctccacgaggacgcccaggggcggctgtgggtcggcacgatgacgggtgggttgagcctcgtggaccgggctcgctggtccttccggcacttccgtcacgactccagcaaccccgccagcatcccccatgacggcgtgttcaccctggcggacgccgacgatgggcgcctgtgggtgggcacccacaggggactcgcgctgttggatccggagacgggagtggcggagcggattccgctccagcctggcgggggccaggagttcgtgatggccctgaagcacgaccgcacgggggcgctctgggtgggcacgctctcgcgaggactgttccgacgcgggcccggcgccacgacgttcgagcccatctcttccgaagagcgaggccctggctccagggacatcttcagcctcgcggcggacccggacggcgggatgtgggtgggcacccgtgacgggctctatcgggtagagcgcgacgaggcctacctgcgccgcgcccggctgtctccaccggaggttgcccagaaggtgcagctcgtcacggagctcgagcccgatggacacgggacgctgtggatcggttccttcggaggtggactcctccgcgtggacacggcgacgggcgaagtgcgtgaggagcgtctcccgtccgcggggcctggctacgagcaccgcatcgacgaaggcgcactcactttcgacgccgctggcaacctgttcatcggcacgttcgggatggggttgttctacgcgcccttccggcaggagaccttcaggacactgcgaggaaaggccgggaactcggcctccgggctgacgaacgaggacgtgtgggcggtgattccggatggcgacagccacctgctcgtgggcagcttcggcggaggcgtggaccgggtggatgtgcgctcggggcaggccgtcccactgcctgggcccgtgttggatggcgtcgacactcgaggcgtcctcagcctcctgcgcacccgcgacagggagttgtgggttggcatctcgatgggcgcctatcgcctggacccggtgacaggtcagttgctcaagttctaccgtcgtacggaacgcggggcgagcgaccatcctggcttcgtcaacacgctgctgcaggacgctcgtggccacgtctggctgggcagcgggggacaggggctgcagcgctaccggccggagaccgatgacttcgtggccttccgtcacgagccctcgaatcctcgctccctctccgatgacttcgtgacggtgctgttggaggaccggcgcgggcgcttctgggtgggaacacgctcgggcggactcaacgtctgctcggccagcgaggacacggtggagtgcatgcgtctgggcgctgactcgaagctgcacctgagccactactacgtgagcacgctcatggaggacccttcgggcgccatctgggtggggaccgtgggcggaggcctccagcgggtgtctctcgacgactccgggctgccggtgtccgtggacctctggacgagcaccgacgggctcatcgacaacaacgtgatggccatggcgcgcgcccccgacgggggcatctgggtggggactcgcgcgggcctgtcacggctggacgtggccacgggggcattcgagaactacgccgcctcggatggtctgcccagtgacgcgttcaacccggaggcggtgacgctcctgggcggcaggctctactgggggagctccaagggactcgtggacctggacccctcggtgcgcccgccccgcgagccatcgccgccgctcattctcacctccatcgaggggttggagtcggacgctctcccgagccagccggtgtgggacctccctggcctggaggtcccctggcgccagcctttctcgctcgagttctcgctgctcgactatgcgcgcaacggcgtggagtacgcctatcgcttcacggcggaggagccctggctcgcgctggggacgcgcaatcagctctcgttccactcgctcccgccgggggagcactcgctgcggctgcgcgcgcgcagcccgggccgggactgggtcgagatgcgtccgttcaccctccgcgtggcgccgcccctctggcagcggaccgatgtgcgcttcggcgcgctggcgggggtcctgctctccgtggtggtggggctg

SEQ ID NO: 6684 - DNA, 213 bp, Myxococcus xanthus
cgggcatcgagcccctggttcacccaggggagcccggcgaccaccggccagctcgcggagatccgccccggagcgggctcctccgtccccgatgcgttcaccctcctgggcaaccgcatctacttccgcgccgtcgacgacacgaactccttccaactgtggtccatgcccgccgccttctcctgccccgcgggactggctgaagcggagtag

SEQ ID NO: 6685 - DNA, 1005 bp, Myxococcus xanthus
ggtatggcctgcatgcggtgtgacgtggaccatccggccggggcgtcttgcccggaggtgcatgacggcgtcgccgtgtcagcgagctgcctggagggacagcggcacgggccgctcgtcttccggcgctggttgggggcgggggcgctgggcacggtgtacctggcggagtatctccccacggggcaccgcttcgcggtgaaggttttgcacccgcacctggcggcgcagccggccatgcagcgccgcttctacgcggaggcgcatgctttgcgcgagctggtccacccgcacgtggcccgcgtgctggacgcgcgcccggggcccggcggtctgccgtgcctgctgatggagtacgccgacggtgagtccttctcccgtcttcccatgccgctggcgcccgtggaggcggtggagctgctggggcagacgctggaggccgtggagtccgcgcacgcgcgcgggctcatgcactgggatttgtccgcggacaacctcgtcctcacgcgggatgcgcggggggagcgccgggtgaaggtgctcgacttcggcgccagcgccatcctcagctccagcctgtctcccgaggagcgggcgcgcggcatggtggtgggctcgccggccttcatcgcacccgagcagtggtccggtgaggtcgtggacggccgcgcggacgtgtatgcgctaggcgtggtgggctacctgctgctcaccgggaggctgcccttcggcatcggccgcgcgggggagctggcgcctccggagccgcatgtcctcaatcccagcgtgccgcccgcgctgtccgcggtgctgctgcgggccctggcgccgcggcccgccgagcgcttcccggatgcccgcgcgttccgcgaggaactggcgcgctgcatggacccgcgtgcccgcgcggcggagcgcgaggcggcgctggtcgacgacgtggagttgctggtggacatcgacatcacgttggatgaggacgcagcacccgtgtcctgtagagca

SEQ ID NO: 6686 - DNA, 1059 bp, Myxococcus xanthus
ctctaccccgtcatcatggccggaggttccggcacccgtttctggccgctgtcccgtcaggcgcggcccaagcagttcctgccgctggcttccaagctgccgctcatcaccgacacgtccgcgcgcctcaaggggctcgcctcggtgaaggacaccttcatcgtctgtggccccctgcacgcgaaggccgcggcgaagctggtgaaggggctgcccaaggcgaacctcctggtggagccggtggcgcgcaacaccgcgcccgccatcgccctggcggcggtgcaggtggccgcgcgcgaccccaagggcgtcatggtggtgctgccttccgaccaccacgtggcggacgtgcccggcttcaagcgcacgctcgcggacgcggcggacctggcggaggcggggcacatcgtcacgctgggcatcaagccttcgcgcccggagacgggctacggctacatccaggtcggcgaggcgctggagggcggtggccgcaaggtgcaggccttcaaggagaagcccgacctggagacggcgcgcggttacatgtcctccggtgactacctgtggaacggcggcatcttcgtcttccgcgtggacgtcatcctggaggcgttcgcgaagcacatgccggagatgaagaagggcctggacgccctgcgcaaggccgcgggcaagcggaccttcggcgcggtgctgaagaaggtgttcccgaagctgccctccacctccatcgactacggcgtcatggagaaggcctccaacatcgcggtgctgccgggggacttcggctggtcggatgtcggctcgttcgcggcgattccagaggtgcgccccgccgacgccaacggcaacgtggtgtccggcaacctcgcggtggtggtggactgccacagctgcgtggtgctggccgacaagcgcccgctgtccgtggtgggcctcaccgacatggtggtggtggactccggcgacgcggtgctcgtggtgccgaaggacaagagccaggacgtgcgcaaggtggtggaggcgctcaaggctcgcaagctgacgaagtacctgtag

SEQ ID NO: 6687 - DNA, 1131 bp, Myxococcus xanthus
gtcgggcatcccggggtgcagctcctcctgtcggaccactccgggctccggcgtgccggcgctcttgccgtttctcacgccacccatgggtgcagcagtctacacacaacgatgcccgttccggctgttagtgtcctcctccccgcgcgaaacgccgaagccactgtggcccgcgccgtccgcagcctcttgacgggcaccgtccgcgacctccgcgtgttcgcggtggacgacggctccacggacggtacgcgtgaagtgctgaccgacctggcggcgagcgactcgcgagtggaagtccttgacggccggggccaaggcctggtggcggcgctgaacctggcgctgcgtgaagccacctccccctacgtggcccggatggacgcggatgacgaggcccttcccaaacgcctggaggcaagcctcaccgccctggaggcggaacccgggttggccggcgtgggcacggccgtggagctgttccgggatgacaaacccgtgagcccctcgctccaggcctatgccatgtggctcagcgggctcacctccgcagagcgactcgaccgggagcgcttcatcgaaagccccctgtgccacccttccgtctgcctgcgccgggacgccctggtggccgcgggaggctggcgggacggcgacttcccggaggactacgcgctgtggctggagctgctggaccggggcttcgggctgcgcaacctgcccgaggtattgcttcgctggcgcgacagcgacgggcggatgacgcgaacggacccgcgctatgccgtcaagcgcttcatgtggacgaaggcgcgctacctgacgcgaggccgtggccccctggcggacgggcgcccctgcacggtgtggggcgcgggcccgagcggcaagacgctgacgtacttcctccaccaggaaggcgtccgcgtgcggcgctacgtggaggtccaccctcgcaaggtgggcacgcgcatccatggcatcccggtcatctctccccaggagctcggcgcccccggggatggacacctgttggtgtgcgtgggcgtccgctgggcccgcgcggagattcgcgaggacctcatcggacggggctgggtggagggtcgcgacttcacctgcgcggcgtga

SEQ ID NO: 6688 - DNA, 525 bp, Myxococcus xanthus
atgagtgccccggttctcatcggctacttcgacagtgaggcgcaggtgctcgacgccacccgggcggtgcgggaggcgggcttcgtcctccacgacgtgtacacgccgtacgcggtgcacggtttggatgacgccatgggcctcaagcccagccgcctcacctgggtgtgcttcggcgcgggcctgctgggctgcacgctggcgctgtcgctccagtactacaccagcgtggtgagctggccgctcaacgtgggcggcaagcccttcaactcgttcccggcgttcatccccgtgactttcgagctgacggtgctgttcgcggcgctggcgacggtggcggccttcctggcgcgggcgaagctcttccccgggagccgccgctcggtgctcccgcgtgtcacggatgaccggttcgccatcgcggtgacgccgcgcgaggccccctcggagctggacgcggccgaggacctgatgcgccgccacggcgcggtggcgacggacctgctggaggaggtggcgtcgtga

SEQ ID NO: 6689 - DNA, 1479 bp, Myxococcus xanthus
atgagcaaccagcatctgtccccgctgcgcgaaccgctcgtcaccgagccgcgctccctgggccagctcaccgaggagatctgcgcccccatggagcgggcccccacgtggaagtggtgggtggcctttggcatcgcggtgtccgtgctcggcacgggcgccggcatcgtcggctaccaggtggccacgggcatcggcgtgtggggcctcaacaagacgattggctgggccttcgacatcaccaacttcgtgttctgggtgggcatcggccacgccggcacgctcatctccgccatcctcttcctcttccggcagaagtggcgcaccagcatcaaccgcgcggcggaggcgatgacgctgttcgccgtgatgtgcgcggcgctcttccccgtcatccacatgggccggccgtggctggccttctgggtgctgccgtatccgaacgaccgcggcagcctgtgggtgaacttccgctcgccgctcttgtgggacgtgttcgccatctccacgtacttcaccgtgtcggcggtgttctggtacgtgggcctgattccggacctggccacggtgcgcgacagggcgaaggcggggattcgcaaggccgtcttcaaggtgatgtcgctggggtggacgggctcgaaccggacgtggagccgctacgagacggtgtacctgctgctggcgggcctggcgacgccgctggtgctcagcgtgcacaccatcgtctccatggacttcgccacatcggtcatccccggctggcacaccaccatcttcccgccgtacttcgtcgcaggcgcggtgttcagcggcttcgccatggtgctgacgctgatgatcatcacccgcgtggtgctgggctacgagcacctcatcaccctgcgtcacctggagaacatgacgaaaatcatcatcgtcacgggtggcctggtgtcgctggcgtacgcgacggagttcttcatcgcctggtactcgggcaacccctacgagcgcttcgccttcatgaaccgcgccttcggcccctacgcctgggcgtactggatcatggtgacgtgcaacgtggtgtcgccgcacctcttctggttcaagaagattcgcacctcgcccgcggccatcttcgtcctgtcgctggtcatcaacgtgggcatgtggttcgagcgcttcgtcatcatcgtcaccagcctccaccgcgacttcctgccgtcgagctgggccatgtacacgccgacgatggtggaggtggggaccttcatcggcaccttcggcctcttcttcacgctgttcctgctcttcgtccgcgtgctgcccatcatctccatcggcgaggtgaagagcgtgctgggcttcgcgcgtgatggccatgcggcgcagtcacacccgcccgcgaagcccgtcgccgaggagccgcaccccgtggcccaccggcccgcgtcgccggtgccgctggccatcgccacccgaaaggatgcacctgtatga

SEQ ID NO: 6690 - DNA, 1380 bp, Myxococcus xanthus
gtgctctacctccgtcggggcgtggtgacgctcggcgccgccgcggcggaagcgcccgccttccgcgaggaggggctggcgaaggcgctggccagcgtggcccgtcatgccgcggagtgggagctggtgctgtaccccacggtggcgctgcgtgacggtgcccccgcgaacaacgcctggctccaggaggtggcggaccccatcaccaaggtgacgtggggcaacccggcgtgcatcgctccggcccgcgcgaaggcgctgggactgaaggatggcgacgtcgtccaggtgcgcgcggggagcacgacgctgtcggtgcccgtgctggtgcaggcggggacgcacccctccgtcatcgcggtggcggtgggctacggccgcacgcaggccgggcgcgtcgcggatggcatcggcgtcaacggctacccgctgtcggcggtggtggacggacgcgcgcggcgcacggtgcccggcgtcacggttcaggccacgggcgagcagcagcccctggcgctgacgcagacgcaccaccggctggagggacggccgcacgtgcgcgaagcggagctggccgccttcctggccaacccgcgcgcgggcaacgaggtgcaggcggggcacggcgggggagggcactcgctctccctgtggtcggggcacgagtacaaggggcaccggtgggcgctggcggtggacctgagcgcctgcacggggtgctcggcctgcgtggtgtcgtgccaggcggagaacaacatccccagcgtggggcgcgacgaggtgctgcgccggcgggacatgcactggatgcgcatcgaccggtactaccagggggacgaagccaatccccaggtcgtccaccagccgatgatgtgccagcactgtgagaatgcgccgtgcgagacggtgtgcccggtgctggccacggtgcactccagcgagggcctcaatcagcaggtctacaaccgctgcgtagggacgcggtactgcgccaacaactgccccacgaaggtccgccgcttcaactggttcgactacgagcacgccgagccgttggagcggatggtgctcaatccggacgtcgtggtgcgcagccggggcgtcatggagaagtgctcgatgtgcgtgcagcgcatccaggagtccaaggccgccgcgaaccgggaaggccgtccgctgcgtgacggggacatccagacggcgtgccagcagagctgccctgcgaaggccatccacttcggtgacgtgaacgaccccgacagccaggtggcgcgactggcgaaggacgggcgggcgttccggctgctggaggagctgaacatcgggtcgtccatcacctacctcacgaagatccggaacaccgggtcgggaagcggcacatga

SEQ ID NO: 6691 - DNA, 753 bp, Myxococcus xanthus
atgaagacgctcccgtcctggatgctctgcctgtgcctcgcgctcgccgttcccgcgcaggcccagcgccgctcaccgccctctggttccgccggagagcggaagatttccccgcaaggccctggcgctaccagcgctggtgacgccaacgcgggtccccgccgcacgccgacgtgcgaggaggcccgccgcaatgcccgttacggcatctacttcgacaaggtggagatcgagaagctggtccagacggtcgcggacgccacctgccgcaccttcatcctgccggagaacgtgcgcgggaagatctccatcatcggcccggagaatggccgggtggaggtcaacgcggacgccttctactccgccttcctcgccgcgctcgacgccaacgggctcgccgcctaccagtacggccggttcatgaagatcgtcgacaagcgctcggcgaagcagaaccccatcccgaccatcgtcgaggagggtgagccgtacaccaccaacgagcagatggtgaccaagctgttccgcgtgcagaacgtggaagtggagccgctgcgcggcgtgctccagcagctggtgtccaaggacggcgacacgattccgtatccgcccgacaccatcatcatcaacgacgtgggctccaacatccaccgcctggagcgcatcatccaccagctggacacgcgcgccgccaacgacgagatgcgcatcatccaggtgcagtacgcctccgcgcaggacgtggccaacacg

SEQ ID NO: 6692 - DNA, 741 bp, Myxococcus xanthus
atggcgatgctcgacctggaccgtctgtcacggctgacgggcatcaagctccccgaacccgagcccgaggttcaggagcccggcggcgcttcggcggaggtggaccccaacgccgcgcccgtgaagagcggcctgcgggtcaagctgctcggcacgttggtggcgagcaaccccgactggtccttcgcctccatccaggacatgacgacgcagcgttcgcagacctacatggtgggcaactccttgcagggagccaccgtggagaacatcgagcgcgagcgcgtcatcatcatcaacggcggccgccgcgagtacatcgacggcaatccgggtgacggcgccttcgtgccgccctcgcccccggtggcccaggccaacaccgctccgcccagtgatggcagtggcatccgcgccaccagcgagaacgagtacgaagtccctcgcgcggaaatcgacaagacgctcaacaacctcaacaacgtcgccatgcaggcgcgcatcgtgcccgcgttcaaggacggtcaggcggtgggcttcaagctcttctccatccgtccggactccatctactccaagattggcgtccagaatggtgacgtcatccgtcgcatcaacggattcgacctcaacagcccggaaaaagcgctggaggtctattcgaagatgaaagacgcagcccgcatcgagatcgagatcgagcgcaacggtgcgccgatccgcaagtcgtacaacgtccgttaa

SEQ ID NO: 6693 - DNA, 1407 bp, Myxococcus xanthus
atgacatcccccacggtcctggtcgtcgacgacgaccgcgcgaacctcgactcggtcatccgcatcttccagcgtgagggcatggccacgctggccgccgccaacggtacggaggcgctggagctgctgcgccggccggaggtcgccgccatggtgaccgacctgatgatgcccaacatggacggccaggagctgctgcgcgccgcgcgcgccatccgcccggacgtggaagtggtgctgatgacggcctacggcacggtggagacggccgtggcggccatgaaggacggcgcctacgacttcatcaccaagcccctcaagcgccacgcgctggtgaaggccatccagaaggcgctggagaagcgagcgctggtggcggagaaccagtcgctcaaggcgaagttggcggagatgaacgcggcgggtgggcgctccatggtgggccagtcccccgccttccgcgccatgctggacaccatccgccaggcggccccctccaccgccacggtgctgctgctgggtgagtccggcacgggaaaggagctggccgcgcgctccgtgcacgagttctcccagcgggtccgcgggcccttcgctgccggcaactgttgctcgcttccggtgaacatgctggaggcgcaactctatggcttggagcgtggcccattcaccggcgcattggacacgcgatagggccccttctagcgtgcccacggtggcaccctgttcctggacgaagattgtgagatgcctctgcccgcctatgcgaatctgctacgggcgctgagccagggccaaatccagcggatgaggagctcgcaaacagtgtaggtcgacatagcccctcctcgccccaccaacaaggacctgcagaagaaggtggccgaaggccgcttccgcgaggacctctactaccggctcaacgtggtggagattcgcgtgcccgcgctcgcctcgcgccgcgaggacattcccctgctggcggacgccttcctgcgccgcttcgccgccaagaacggcaaggtgctgcgcggcttctcgcaggaggcgatgggcgtgctggagaattacgcctggcccggcaacgtgcgcgaactggagcacgcggtggagcgcgcggtggtgctggcgcgcggcgaggtgctggacgccagtgacctgcctgaatccgtgcgcaagggcccgctgggctcagccggacagctcgtcattcccattgggacgcccatggaggaaatcgagcgccgggtgatccatgagacgctccgtcacacccgcggagacaagacgctggccgcacggctgctgggcatcgctgcgcggaccatctaccgcaagctggagcgcgagcagtccaccggggatggccccaccgccgcgccccctggccccgacaccgacgactga

SEQ ID NO: 6694 - DNA, 1026 bp, Myxococcus xanthus
cacgagaagggtgcgcccatggcagcgaagtccgcacgcaagtcccccgccgcgaagaaggcggccacgccgcgcaagccccgccgcaagaaggcggagccgaagtcccggggcctgtcccccgcggaggtggccagcgactcggttgagtaccccacggagctgctggaggcggtgcgcgaggacggcggcgaggtgctcggcgtgtaccgcgacccgctgggcggccacccggtggtgttctccgtgctgcccatcgacaaggtggagcccacgccctaccagcgcgacgtgtccgagccgcacgtgaagcgtctggccaacgccatggagcggttggatcgcttcctggaccccgtcatcgccgtgcgcaaggacggccggtactggacgcccaacggcaaccaccgcctcaacgccagccggcgcctgggcgccaaggccattgtcgccctggtgctgcccgaagaggacgtggcctaccagattctggccctcaacacggagaaggcccacaacctcaaggagcgctcgctggaggtcatccgcatgtaccgcggcctggtgggcgcggagcgcaaggggccggagacggccttcgcccacctcttcgaggagcccgccttcatcaccctgggcgccgcctacgagcagcgcccccgcttctccgcgggcgcctaccaccccttcgtgaaggcggttgaggacttcctcgacacgcccctggaggacgccctgcccctgcgcgaggcccgggcccggcggctgctggagctggacgacgccgtggtgtccgtggtggacgccctcaaggagcggggcctccagagcccgtacctcaagaacttcgtcgtcgcccgcatcaacttcctgcgcttccgcaaggatggcgggaagccggacttcgacgccaccgtggaccggatgcaggccagcgcccggaagttcaacgtcgacaaggtgcggcgcgaggacattggccggatgggcggcgggccgctggagccggacgaggaatccgcttaa

SEQ ID NO: 6695 - DNA, 312 bp, Myxococcus xanthus
gagagctctaaagagctcgtcctgagctacgacgagtcggagacccatgccacgctggcggcgctgacggagacgggcacgaagacggagcacccggcggacttcgcgctggaccccaagcgggtcgcgcgaggcctggcgcaaatctccctgacggacatcctggcggatgaagtgcttgccgccctcttcgcggacagctcggagctggggccgctgctggcgcgcagcgagcgcatcaccgggtggatggacgccgctcctggaggagcccaccgtgtgtccctgacctggccgctgcctccgcagtag

SEQ ID NO: 6696 - DNA, 1410 bp, Myxococcus xanthus
atgatgctgttcctgcccctgggggtggacaacaccgagctggagcggctgcctcgggtgtccatcaccatcgcggccatctgtatcgtggccttcttcatctcctgggtcattccgtccaatcccctgggcgtgggtgagaacgagctgcgctccctgctggagcagtcgctcgagcacccggacctggagttccctcccgcgtgtgcggagcggctgctgtccgattcgggccggaggctggtgcgcaacatgcaccaacgcgtcgcggaatccgacggagcggagagcgtgacgaaccggcagcagggactgaatgagcgctgcgaggagctcatcgcccagcacgactcgagcctgctctcgcgcttctccctggtgcccgcgcggggactcgcccagcccggctggctcacgtacatgttcctccacttggggtggatgcacctgctggggaacctgctgttcttctacgtgaccagcctgctgctcgaggatgcctggggccggccactcttcgcgggtttctatgtcgtgggcgggctcgtggccggcgtggcccactatgccatcgacccctcatcggagtcggtgatggtgggcgcctccggcgccgtggccgcgtgcatgggcgccttctgtctgcgcttcgcccagcgacgggtccgcatcggctacttcgtctggctgctgaaaatcttccgcggcaccttccccgttcccggctgggtctggggcggcctgtggttcggcaacgaggtgctgaactactacctcctgggcaacaacacgggcgtcgcggtgatggcccacatcggcggtttcgtcttcggcttcgcgggcgcgtcgctgctgcgcgtcacgcagttggaggaacgggtggtggcgcccgcactcgccgcgaagcagggcggctgggtagccgacccgcggctggcggaggcccaggaggcactcgacaagggagaccgcacggccgcacgcgcgggcttccagcgcttgctgaagacccagccggaccacaccgacgcgttgctgtcgctgggccgcatggacctggaggacggcaagacgcaggccggcacggcgcgggtggagcgggcgctccatacgctcgcgggccgcgcctccacggacgcactgtggttcgcgatggagccattggtctcgctgctgccccatcgacgcgctgcggcccgccttcgcgtggaagctggcacaggcgctggacacggaagacgcgccgccggcttcgttggagacgacggaagccctgtacagcgtggcgggcgggggcgcgggcatcatcgcggtgcgcgcgctcatccgcgcccacggagctgcgaatggcgcactacaaggacctcgagcgggcagcagactacctcgcgcgcgccaagccgctgctga

SEQ ID NO: 6697 - DNA, 1539 bp, Myxococcus xanthus
atgagcgacgtcttcgacaagtgccgtaactggaaggactaccgtatcgcgaaggctacgggtctctatccgtacttccgtgccatcgaagcgtcgcacggtgccaccgaggtggagatcgaaggcaagcgcgtcatcatggtcgggtccaacaactacctgggcctgtccgccgatccgcgcgtgaaggaagcggccatcaaggcgacggagaagttcggcaccaccagctccggctcgcgactgctcaacggcacactggcgctgcacgaggagctggaagcgcggttggcgaagttcctcaaccgcgagtccgccatcgtcatctccacgggcttccagacgaacctggcgctggcgtccatcctgggccggcacgacatcgtcttcagcgaccggcagaaccacgcgtcgctggtggacggaatccgcctgtccttcgccaccgagcgcaagttccgccacaacgacatggaccacctggagcagctgctgtcccaggcggatccggacgcgggcaagatcatcgtcaccgacggcgtcttctccatggagggcgacatctgcaacctgccccgcatcgtggagctggcgaagcactacaacgcgcgggtgatgacggatgacgcgcacgccatgggcgtgctgggcacgcggggccggggcacctccgagtacttcgacctggagaaggagacggacctcgtcatggggaccttctccaagagcttcgcgtcgctgggcggcgtgctggccggtcccttcgaggtcatcaactacatccgccacaaggcgcgctcggtcatcttctccgcgtccatgacgccgggctccatcgccgcggcgctcaaggcgctggagatcatcgaagcggagccggagcgccgcgcccgcctgctggacatcgcggagaagatgcacaacggcttccgcgccatgggcttcgacacgggtgtgtcggtgacgccggtggtgccggtgcacatcggcgaccaggtgaagtgcttccgattctggcgcgcgctgcatgaggccggcgtcttcgccaacccggtgattccgccggcggtggagccgggccacgcgctcatccgcacctcgtacatggccacgcacacggacgcgcaactggaccgcgtgctcgacaccttcgagaccattggccggaagctgggcgtgattccggagacgcgcccctccgtctacgagccggtgcagattgcccgcccgggcacccgcatcctgtccaaccgcgcgagcgagaagtgggccgcgggctcgaacggcctgctggcggacaagggcggcatcaccctggaccaactgtcgcgcatgtcgtcgcgcgaggtggccggacgcctgttcgacgcggtggagcagctcacgtggcgcgcggccaatctccagccggaggacctgcggaagctgggcaacgcgccgatgaagctgtgggagaagcgcggcgagctgccgggcttgttgttggagaagggcgctcacttcttcatgcgcaacggcgcccactccgaccggaactga

SEQ ID NO: 6698 - DNA, 627 bp, Myxococcus xanthus
atggcgcactacaaggacctcgagcgggcagcagactacctcgcgcgcgccaagccgctgctgacgggagaagccgcgtctgcgggtgaccgggtccgggagctggacgccgaaatcacgcgggtgctggaagagaacgcatggaagaaacgggacgctgcgccaacgcccaccgtggacgcaccacccgcgccgccgcgcgtttttccctgccgcatcgtgggcatgacggccatggccctcaccgtggaggcagccaatggccagcgccggacgatggccatgacggaggtgctggcgattgccgtgggcatgctgcccgtcgccgggccgccggggacgtcgccgcgacaaaccgtgctcaccgacctggtgctctcctgggggagcgccaacgagggaccgcgggtgctgcgggtgaacgtcgcggggctcgcgctgaaccacttctatccgggtgtggcgccgcgtgaggcctatgcgcgattcctggcggacatgctggagcgcaccaacgccaacgcgcttccggacgcctcctccctgaagcaagggcagtacccgcgcttcaacagcgaggcggaactgagccagcactactacggcgggagcgcggcagcggcctga

SEQ ID NO: 6699 - DNA, 3089 bp, Myxococcus xanthus
cagcaagtgttcgcgcggcacaccgcgctcaggacctcgttcgagctgacgcgctactcggagccactccagttcgtccaccgccaggtggagcccgtgctggcggttcacgacctgcggcacctctccaccgaggagcaggatgcgcacctcgaagcgtggctcgaggaagaccgcgcgcggcccttcgactggagctgcgcgccgttgatgcgagtcacactccacctgcgcacgtccaccaccgtgcagctcagcgccaccttccaccacgccatcctggacggctggagcgtggccaccttcttcaccgagctgctcgcggacttcgtcaccctgcgcggtgacaggtgtccggagcggacagcaccggcgctccccttccgcgagttcatcgcgatggagcgagagacactccagtccccagcggtccaacagttctgggcgcagcagttggacggaatggaggtgacgtccgtcacccgaaccttgccgcccccgcccgatgcgccagcacgggggctctcccaacatcccgtgcccctggccgcgtcgacgcacgccgggctccagcggctcgcgcgtctggccgccgtccccctcaagagcgtgctgctggcggcccacctccgcgtcctcggcgccgtctgtggcaccaccgacgtggtgacgggcctggtcagcaacgggcgccccgaggtgcgcgacggcgagcgaaccctgggcctcttcctcaacagcgtcgccttccggcagcgcctgggcggcggcacctgggtcgacctggtccgcgagacgttcgccaccgagcggcgcctgctgccccaccggcgctaccccctgagccggctgcaacacccgcgcagcggacaaccgccgttcgaggtcctcttcaacttcgtgcacttccatgtgtaccagggcctgctgggcatcgagggcgtgcggctcgtcagcccggtccgctccattgaacgcctggacctgccgctggccgccatgttcggcgtcgatccggtgacttccgagctccagctctcattgcaccatgacccacggaggctggacgctggccgcgtaccctggctggcggagtgctacgcgcgcgtactggacgccatggcggcccagccccaggagcgccacgagcgcgtctgcctgctctcccccgccgagcgcgagcgcgtgctggtggattggaacgccacccgggatcccctgcccgaagacacctgcgtccaccacctcgtggagacccaggcctcgcacacgcccgacgcaccggccgtcaccttcgaggagcgctccttcacctaccgccagttggacgaacaggccaccctgctggcccggcgtctccagtccgtgggcgtggggcccgacgcgcgtgtcgccatcgtgttggaccgctcgctggagatggtggtggcgatgctgggcgtcctgaaggcgggcggcgcctacgtgccgctcgatcccgcccaccccaaggcgcggttggaagccgtgttgcaggaagcccacccggcggccgtggtgacccggcgtgagctggcgccgaacctgccggttcgagaggtcccaacgctcctcgtcgaggacgcccccgagcacccgctccctccgctgacgcgaggcgtggcgccgcgaaacctcgcctacgtcctctacacctctggctccacgggccggcccaagggcgtcatggtggaccacggcaacctggtgaatcacttcgtcacgctcgacgaacggattgaggcgcggcccgcgggcacctggcttgccgtcacgccctacaccttcgacatttccggagtcgagctggtgtggaccctgacgcgcggcttccatctggtgattcaccccgaggaacgtcacgcccgccgttcggtggccgagcagatcgagcaccacgccatcacccacctccagtgcacaccgtcgcgcgcctcgctcctgctccaatcccccgggatggcccgcgcgttggcacggctccgggtgctggtgctcggcggcgaggccctgacgcccgcgctggcggcggaactgcgcacccggctcaccgggcggctgttgaacatctatggccccaccgagacgaccatctggtccaccacccacgcggtggaggcgagcggccccaccgtccccatcggccggcccgtgagcaacaccgaggtgtacatcgtggacgcgcacggcacgcccgtgcccatgggcgccgcgggcgagctgctcattggcggagagggcgtctcgcgcggctacctccaccggccggagctcacggcggaacgcttcattccgaatccgttctcgtcccgcccgggcgccaggctctaccggacgggcgacgcatgccggtaccagccgggcgggcgtcctcgagttcctcggccgcatcgatcagcaggtgaagatccgaggctaccgcatcgagctgggcgaggtcgaaaccgtgctccgggagcaccccgccctcccggaggccgctgtcggggcgagaacccaggaatgacgacgcccggagactgggtgggtacctcgttccgtcccagcgggacactccgctcgagaacctccaagcgctggtggcgcacgtccgcgcgtttctccgggaacggctgccggagtacatggtgccctctgccttcgtgcccctggaggccctccccctcaacgccagcggcaaggtggaccggcaggcgcttccgcagccctcgtcatccctggccgagcagcgccccgcgtacatcgcgcccgcggggcagctcgaactcgacatcgccgaagtctggcgccaggacctgcgcctcgacgtggtgggccgcgacgagaatttcttcgacctggggggcaactccctgctcgccgcgcgcatccaggcgcgactgacggagaagctccagcgcacggtgacgctgctcgacatcttcacccacccgaccgtgggcgccctggcgcggcacctgtcggcgatgcccgaggccccggccatggccctggaggcgcaaacccagcggcagaaggagggcctgggccggctcaagcgcctggcgaagagggtcaaaggcgatgagtga

SEQ ID NO: 6700 - DNA, 1030 bp, Myxococcus xanthus
atgagtgacacgctggagtccgtccccgacggcatcgccatcgtcgggctcgcgggccgcttccccaaggcccgcgacatcgaggccttctgggagaacctgcgagcgggcgtgcgcggcatctccacgttcaccgacgcggagctgctcgcggcccacctgccggcggagcacgttcgtcacccccggtacgtgaaggcgcgcggcgcgctggaggacaccgcgatgttcgacgcggcgttcttcgacttcaacgcccgcgaggcggagctcacggacccgcagcaccgtctgttcctggagagtgcctgggaagcgctggaggacgcgggttacgactcgcggcgctacccggggaggattggcgtcttcgcgggcgccagcatgagcacgtacctgctggatgccctgcgcggtggggcggccctgcctgagggactgctccagttggccatcggcaatctgagcgacttcctgtcgacgcgcctctcctacaagctggacctgcgcggccccagcgtgagcgttcagaccgcctgctccacgtcgctggtcgccacgcacctcgcgtgcctgcacctgctcgcgggccaatgcgacatcgcgctcgcgggaggcgtgtccgcgcgggcccgggaggtgggcggctacctgtatcaagagggaggcatcttctcgcccgacgggcattgccgggccttcgatgcccgagcgcaggggacggtggagggcagcggtgtggggctggtggtgctcatgcggctggaggatgcgctggccgaaggcgcgcacatccgcgcggtcatccgcggcaccgccatcaacaacgacggccgccagaaggtgggctacaccgcccccagcatccagggacaagcggaggtcatcgccatggcccaccggatggcgggagtggaggcccgcaccatcgactacgtcgaggcgcacggcacgggcacggcgatgggagaccccatcgagttcacggccctggtccaggccttcggtgaggacgcgctccctggcgcct

SEQ ID NO: 6701 - DNA, 237 bp, Myxococcus xanthus
atgggcgtggcgctggccacggtcttcatggggacgggctgtggcggcatgaacccgggactggacgaccctgccggcacggacgaggcgcacggatccgaagtccaggcactgaccacctgtgaagactgccataccacctacaccgcctgcattcgccaggcccttggggacccccaggagacacaggtttggatcgaccagcggcacgagtgcgcgctgcaatactgtccgtga

SEQ ID NO: 6702 - DNA, 1950 bp, Myxococcus xanthus
atgcgtgacgtggccttcccgttgcgggacttccgcttcccctcggggctccgcgtggtggtggagcaggatgcccgctctcccgtggtggcggtggtcgccgtggtgggagcagggggctccagtgacccaggtggcaaggagggcctggcgcacgtcgtggagcacctggcgttccgttcccgccacgcgggtagtccgtcggtgtggcggcgcctggaggcgtcgggcgcgggcttctacaacgcctccaccagtttggattacacgtcctacgagacgctgggccccaaggaggccttgcccgttctcctgaaactggaaggccagcgcctggccgcgccgctcgcgggcgtgagcccggaggtgttcgcggtagagcgcgaggtggtccgcaacgagctccgccagcgcaacgagacgggctacgtgggacaggtcttcagttggttgaacgccgcggccttccccggtggacacccctacgcgcgtcctctcgccgggacgcatgagtcgctgtccgcgctcagcctgtcggacgcgcagcgcttcgcccgggcgcactaccgtccagacaacgtcacgctggtcatcgccggtgacgtggacctggcggccgtggaggccacgcttcgggcaaacctgcccgaggcctgggtggggacaggcgcacccctggcgctggaggcacgtctgcccgcgcagccggcggccccggctaccacgcccgcccagaagtcggtgcctgtgttcactgccgccgtgcccacgccggaggtgtatctgtcctgggtgctgccgcgcggcttcgacgagtccagcgcggtccaggacttcgtgcgcgccaccttcgggcaaaaccttttgggcgcggtgcgcaacgacggtgacatcgcggacatctccaccaacctgattccggggacgcgcgcctcgctgctggtggtgcgggtgcggctcagccggggcgacgacccgacgcgctcggcggggaaggtgttggaccaggtgcagaacgcgtgggtccaggagattcagcccggctccgtgctgggccgcgagttcgacttccaggcgacgcgccggcaggtggtgacgggcatggtgctggagtcagaggacctcatgtcccgcaccgagcgccgggcgttgctcacccacttcacgcaggacgtgcgctcctacacccgctcgcaggtggcgctgatggggctcggcggtggcaaggtgacggacttctcctaccagtggctacagcgggaccgggtgcgaatgattgtcgtccgtcccggtgaggtgccgggcgcggcgacggcggccgccacgctgtccgcggacgaggagccctggaccacgcccgccgagcaggtgacgccgtccatgacggcggcgctcgattcgcccgtgcaggtgctcaagctggacaatggcatggaggtgctgctcgctccgcgtccgggcctcccggtggtccgcatcggcgcggcgctgggcggtggttcgtcctacggcgcgaagtcgggggtggcggacctggccaactggggctccttccgggagtcctggttcgagggccgccccagtgactggggcctgcattcgacctcgtcgttccagcgcgaccacctgcgcgtcggcatctccggcacggccggcaacgttggcaacatgctggcgatgctggccgagcagctcgactccacgcggacctccgaggacgtggtgcgcttctaccgcgagcaggtgctgccctggcgccaggcggtggactcgaatccggagctcctggccgagcgtcacctccagaaggcgctgtatggcacgcatccctttgcgcgcgaggccaccggcgcggacctggcccaggtgtcctggacggaagccgaggcgtggctgaaggacgtgtatcgcccggccaatacggtggtcgtcatcgccggcgagctttag

SEQ ID NO: 6703 - DNA, 393 bp, Myxococcus xanthus
atgaacgtctcgaggccggtgcttgctgggggattctggaagaagaagcgcacgcagccggtgaagcgcgccaaggacgcgtcgctggtgcgttgggagtcgcagccgtggcgccgccagttacgcgacgcggcggaatacgagcacccggtggcgcgtgccgcgctggtgcaggcgctgctggcggaaggcctgacgatggacgcggacgcggcgcgcttcgcggggaccagcgaggaccgcgactgcatcagcatcgcgcaggtgctgcgcttcgccgactcgctcgtgctgcgcatggcgctggcgtgcacggatgaccacgtgctccaactggtgcatctgcgccgcgacgccgaggacctggcggagcggatgattgagtgggccaac

SEQ ID NO: 6704 - DNA, 1626 bp, Myxococcus xanthus
caggagcggttggagttgttcctgctgccatccatcttcgctccggaggcgtgggcctacaccttcctggagggactgctgagcgtcccgctggatgagtacgcgggaaagcggctggtggaagtcggcgcgggctcgggatggatttgcatcgcgctggcaaagttcacccggctggcgcacgtgcatggcgcggacctcaatccgcattcgcccgtggttgcgcgctgcaacgcgtggctcaacggagacgaggcgctggcgtcgcgtctgtccttcggggagagcgacctgttgcgcgggattccttcggatgccccatgggacttcgtggtgggctgtattccgcaggtcctccggggcgaggaggatttgccatccgagctgtcccaggccgacgagcaggcgctctacgacttgtccaactactgcacgctgcagaacgtctacgaggaccacttcgggctcgggctcatcgcgcgattgctggacgaagcgccggagcggctgtcgcccaccggacggctgctgctcaacctcgcgggcaggccagggcgcgtcatcatcgagcggatgttcacccgccgcggcttcgacacgcacgtgcgggtggcccgccgggtgatgcaggcggcggacacggacatccgtcctttggtggcgctggagcagcgaaccggccgcgagttcgagttcttcatggaagcgcgcagcccggagccgctgcgggcggccaccgcgctgggctggctccaggccgggaatccggtgtggcacgaggtggcggtgtgggaggcgcggctggcgctgcctcgcgagacgctggcgctgcgggccgctctgcgcgcgctgggcgcttctgcgttgcaggaggagctggacctgggcgccgcgtcggcggagcagttgggcttcgtcgccgacctggcggcgcggctggcgcggggcccgctgatgccctacgcgcacgaagcgggtgacgcgtccttccgccggcaggtggtgcgctacctggaccggtacttcgggctgcggctggcggaagaggaggtcttcgtcgcgcccgagcgcgagcaggcggtgtactcgctgctgatggccacctgcgacgcgggtgacgaggtgctggtgtcgcgcaacctccatccgctctacgcccgtgcgctggagaaggcgggggtgcgcgccacggtgacacacacgtcgctcgcggagattcgccggctgttgtccgcgttcgacgtgaagatggtgctgctcacggtggagaagggggagcgcaccaacctgtccgtgctgcgcgacatcgtcgcggaggcggcgcgccggggcatctgggtggtgctggatgaaagcgccttcttcaacatcaccggcggtgtggagccgcacacgctcttcgagttcctggcccgtgaggcccatgcccccaacctggtggtgctctatggcctcatcaagaacgcggtgtggccggacctggagctgacgctgctcatgccggtgccgcagccgctgcggggagatttggaagccgcggcggaggtcacctactcgcgcatcagcaccctggcgcaagcgttctacgagcgcaccttcgctgacttgctgtcgttccgcctttag

SEQ ID NO: 6705 - DNA, 609 bp, Myxococcus xanthus
tggctgttcgtggaccacgtggatgagacgttcacctcctggcccgcccccacgcctcggggctggattgccctggtggccgacccggcgctcgcgcggcggatactccaggacgcgcaggcccgggggcacggagacgcgaagctcttcgccggcctgtcctgggcgtactccatacccgcggaggcgagcatcgccgaggtgctcgacaaccccggactgatggacgccagcgccgtggcggcactggaaatcgacacgcaactctccatcctccgcgaggagacgggcctcacggacgctgacatcatccgcgtgcccttcctcttccagaacgcgtcagacggcgtgacggcgtaccagcccgccacgctgaacctgctgtcgttgacgcccacgcaggtcatcgcgccagacccgcatggaccgctcctcgatggggaggacccgttcaagacgcggttcgaggaggcgctcggggcccatggcatccacgtgcactgggtggatgcgtgggcgccgttccacatcgcccagggccaggtccactgcgccacccagagcgctcggcaggtgcccgacgtgaagtggtgggagggtggacgatga

SEQ ID NO: 6706 - DNA, 885 bp, Myxococcus xanthus
atgctggtctccctgagcgcgggtgggacgcagacgccccgcccgggtgatgactggagggccggcttgaagacgaacatctcccgggcccgccaggagaatccagcgacgttcatccggttcgacacggccgccgcccaggtggacgcgctggacgcgaagaagcggggcaccctggccgcggtgtcaccggggcttcgtgcgctggggccggaggcgctgtggcccatggtggagcggctcgccttcccaccccaggagacaccgcggctcccctcgcgtgagtccgcgcggctggccttcaaggtgggcttggtggaggccacgggggcgctgcgcgacctccgcctggcccccttgtggaaaagccttctcgaaagtccggacacccaacctcaggtccttcgcgcggtcgcgggagcgctggcgcggctggagacattggacgcggcgaacacgctcatcgccgcgtcgaagcagaaggacgcccggggcgaggccgcgatggaggccctgggcctgtgccggcggctcgtggcgacacgggcgttggcggatgcactggacgcccggccggaacgcgaagtcatgcgacggttggccaaggccctgggggatgccgggtccgcgtgggcatggaagacgtccggcgtgaaggcgcgctcggaggaaggcgccatccgtctcgtggcggccgaggcgctggtgcgggcgtacgtggacacggacggtgacgtgcggcgcgccgtctccaacgccctgctgcgcgtggatgcgccccagacgcccacgctcatcgacgcggcccggctgagcgccccgcccgcccaacaggcggcgctggacgccctggctgaacggctgcgccacaacccgctgcgctga

SEQ ID NO: 6707 - DNA, 1134 bp, Myxococcus xanthus
atgccctcggacgtgcaggtgacccctgtccgcggcgaggcggagcggatgcagttcatccgactcccctacgccctctaccggagcgacccgcactgggttcctccgctggagatggagcgccgggacttcctggacccgaagaagaaccccttcttcgagtacggcgaactggagctgttcctcgcccggcgcggcccggacgtcgtgggccgcatcgccgccatccgcaatccgcggcacatggagattcacggcacgaaggagggcttcttcggtctcttcgagtgcgtgaatgacgcgggcgtcgcccggaccctgctggaatccgccgcgacctggctgcgcctgcggggcatggacgccatgctggggccggcgaacctgtcctccaaccaggactggggcctgctcatcgacggcttcgatacgccgcccgccgtgatgatgccgcacaacccgccctactacgcggcgctgctggaggcctgcggcctgacgaaggccaaggacctgtacgcctacgagctgtcgtcgtccgcgcagccgccggagaaggtggtgcgcatcgcggagaagattcgcgtgcgcgacggcgtcgtcgtgcgtccggtcaacatgaaggacctggacgccgaggtgaagcgcatccgcgacatctacaactcggcgtgggagaagaactggggcttcgtgcccttcaccgatgcggagttcgaccacctggccaaggagctcaagacggtcgtccggccggacctcgcgctcatggcggaggtccagggcgagccggtggccttctccctgacggtgccggatgccaaccaggccatccgcgcggccaacgggcggctcaccacgttcggcctgcccatcggcctggtgaagctggcgctggcctcgcgccgcatcaaccggctgcgcctcatcatcctcggcatcaaggagggctaccggcgccgcggcctggacgccatcctgtacctggacaccctgcgcacggcgaagcggctgggctacgtgggcggggagatctcctggacgctcgaggacaaccacctggtcaaccgcgccatcgagtccatgggcgcccagcgctccaagacgtaccgcgtctacacgcgcgcgctctga

SEQ ID NO: 6708 - DNA, 702 bp, Myxococcus xanthus
atgacctcatccgttccggcgctcctcctggtggaggacgacaccaacctgcggctcgcgctgcgcgacaacctggagaaccagggcggctacgcggtggaggaagccacctgtgtgcgggaggcgcgcgagcacctgggccggcgcgacttccagctcatcctgctggacgtcatgttgccggacggtgacggctacacgctgtgccgcgcgctgcgcgaagaaggcgtggcgacgcccgtcctgatgctcaccgcgcgcaccctggaggatgacgtggtgcggggcttcgagtcaggcgcgcaggactacctgggcaagccctaccggctgcgcgagctgctggcgcgcgtgggcgcgttggtgcgccgctccggcgcggcgccggtgaaggggctgcgcttcgcgggctaccggatggacctggaccgccggaaggtggagtcgccggcgggcgccccggtggagctgacgcggacggagttcgacctgctcgccttcctggtgcgcgagcgcgagcgcgtgctgcgccgcgacgaaatcctggacgcagtgtggggccgggacgtcgtcgtggacccgcacaccgtggacaacttcgtctccagcctgaagaagaagctgggctggaacagcacgtcccgcttcgccatccagacggtgcgcggcgtggggtaccggatggaaatcgaagcggcctga

SEQ ID NO: 6709 - DNA, 1824 bp, Myxococcus xanthus
atgctccgccggttgctgcccaccctcatcgcgctcctgctgggcttcgccgggctggcctggggcctgggctcgctccagcgcatcttcgccaccgaacgggatgacgcgcaggcctcgctcgattcccgccgggaggcactggagcagtacgcgcgtgcctccctggcgcaatccctgagagaccgcctggaagcggcgcgccccgcgctggaggccgccgcgctggatccgctggcccccgcgacgggcctctacctgagagagcggggcacgcagttgctgccccggctggccctccacgacaccggcgaagacacgcccgcgaaagggcgctacgcgggcctgcgcgccggcacggagcgggcggacgaggcggaggacccgtgggcggagcggctcgcgctgattcgcgaggtggaccgggcgctgtcacgcggcgaccgccgtgcatccaccgtggcactgatggcgctgctccaacaccgcgcgcagtacgtgctggcctccacgcgcgacgtgccgggcttcctggtggtgttggagtcgctggcggagcggggtgaccccgttccccagttgatgcacgcgctggtgcgtgacggcctggcggacgggcgcagcggccgcctggatggattgcagcggctgctcctgctgcgccgcgcacgtttcacgaaggaggacttcgacttcctgcgcgagcgcatcgtggcgctctccacgaaggcaggcgtgccggtggccgacttcgaggcccgcgccgccgagctcgcgtccgaaccgctgccattgcccaggacgcttccggggcccgcgctggtgcgagcggggtggtacctggagccgcgcggcggcaatcacgtgaggggcgtggcggtggactcgggcgcgctgctccagtcgctgacacgggagatgcgcgagcgcgggttgctggaggcggacggacaggtgcggctgctcgcggacgcggagatgttgccgctggccgacctgccgctgtcggtggatacgccggagtgggcgcgggcccaaggggcgctggagcggcgctaccggctgaagacgggcatggtggccgcgtgcgcggtgctggcgctgggcatcgccgcgctggccttcgtggcccagcaccgcaagttgcgcttcctggaactgaagagcgacttcgtggcgaccgtgtcacacgagctgcgcacgccactggcctccatccggctgttggcggagacgctggagtggcggctggcggagggcacggacgcgcgcgactacccggcgcgcatcgtccgggaagcggacggtctgggcttcctggtggagaacctgctgtccttcaaccgcatcgacaaggggcgctgggtgccaaagctggcgccggtgcgcctggacgagctggtggcgcagctgcgcaaggacctggagttctggtccaaggtccccgtggagctggaggcggacgtgggggagttctccttgcgcgcggacggacagctcctgcgcctgctgctctcaaacctggcgcgcaacgcctgtgcctacaacacccgcagcccggtgcgcctgcgcatcgaggcgctgtcagatggccgcgtgcgcttctccgacaacggcgtgggcatcccccagacgcagtgggagcgcgccttcgaggagttcgtgcgcctgcctggccagggacatgatgcacccggcagtggcctgggactggccctgtgccgccgcatcatgcgcgtgcacggcggcaccctgcgcgtggcggcctccagcccggaaggcaccaccttcgagcttcgctttcctcatacggtgacgacatga

SEQ ID NO: 6710 - DNA, 171 bp, Myxococcus xanthus
ctgacgctgtgggaaggcatcggcgagccgctgcgaacccccaaggacgtggcgcagctgggggcgctcatccgcaaggcccagtcgctggacacgcgcaaggagcgcttcgagcgcctgatgcccggcggaagctcggacttcgacgacgtgccctccctgggaaactga

SEQ ID NO: 6711 - DNA, 534 bp, Myxococcus xanthus
gaagagacaggcgagcgcacgatgggacagccgcagggtgtcgtccagggagaccgccgggagttcgaggaactgctgaaggactatgacaccgccctcctcaccacccggggtgcggacggacactttcacacgcggcccatggcggtggcgaagaagcataagtccggcaccgtgctctggttcgccacctgggcggacacgcagaaagtgcaggacctggagtcggacccgcactgctcgctcgctttccacgcgtcggaggacagcgccacgtatctctccgtgtcgggtgtggcggaagtcgtccgcgaccggagggccatccatgacttgtgggagcccggctggaagccctggttcccacagggcccggatgagggtgacatcgccctgttgcgcttcacgcccgagcacgctgaatacgtccacccggcaggcggaaagctcaaggtgctcttcagcaccgcgaaggcgttggtgacgaagcagcgccccgacatcgcgcccaagaacgtgttggacctgcactga

SEQ ID NO: 6712 - DNA, 1551 bp, Myxococcus xanthus
atgtccaccggcctcctccagtcgctgtcccactccctcgcctccatcgtcgagcgcaccgcgcctggcatcgtccgcgtggagacgcggcgcaggcgcggcaccaccggcatcgtctgggatgccgagggccacatcctcaccaccagccaggccgtggagcacgagggccggctccctatcggcttgccggatggccgcaccgtctccgccgagttcgtcggccgcgacgccagcaccgacctggccctgctcaaggccgaagccaccggcctcgcgccgctgacctccgcgccgttggatgacgtgaaggtcggtcacctcgtcatcgccgtgggccgccctggccgcacggctcgcgcgacgctcggcatggtcagcacccacggcgagggctggcgcacccatgccggaggccgcgtggagcgctacctggagacggatgccgacctcccgcccggcttctccggcggcgcgctggtggacaccgagggacgccttgtcggtctgctcaccgccgccttctctcgcaccgccgccgtcgtcatcgccacggacacgctcacgcgcgtgattgcatcgctgaaggaacacgggggcatccggcgtggctacctgggcgtgggcgcctaccccgtgcgtctgcccccacacctgggcacggggaacgaacacggcctcatctgcctctccgtggacccgaacggcccggcgcatgacgcgggtctgctgctcggagacgtcctggtgagtctgggaggtcagcccctccacggcgtggaggacctgctcggagccctgagcgacgagaaggtgggcaccaccctccaggtccgcgtgctgcgcgccggagaggttcgcgaagtgcccatcaccgtgggcaagcgctcgtgaagggaggccaccgtgaaactgctgcaacacttctcggatgatttggagtcgctggtggcgcgtgcctcgcccgccgtcgtgggcgtggagcacgcacgcggccacggcaccggcctcttcctcacaccggacggctacgtcctcaccaaccgccacgtggtggtgcgcggctcacgcaagctcaccgtccagctctccaacggagaggaactgcgtggcaccctggtgggcagcgacgcccccaccgacctggccgtggtccgcgcggagggcggtgacttccccaccctgccgctcgccgagcccgagtcggtgcgcgtgggccagctcgtcatggccattggcaacccgttccacctggaacagtccgtgtcgctgggcgtggtgagcgccatcaaccgcagcatcagcctgcccgacggcgtcatgctggagggcatgctccagacggatgccgccatcaatccgggcaactccggggggccgctgctcaacatgcgaggacaggtggtgggcctcaacacgctggtgttgccctacgcgcaaggtatcggcttcgcggtgagcgccaccacggcggcgtggattgccagcctgctcatccaacgcggcaaggtggaccggcgcttcctgggcatcgccgcgacggcggtgagc

SEQ ID NO: 6713 - DNA, 606 bp, Myxococcus xanthus
atggaatgggatgtcccgctcatctacttctacggtatcgagccgggcgcctatcggcccatctggcccgtctacatctccgaggcaaacccagccgagctgagcttcaccgtcgtctccgccgcaccggatgcggaggtgctggcgccggggctccacgcggcggacccgaagctcttgaacctggagcgccgctacgccacggtccagatgaagaagcggctccatcaagccgccttccgtcagcatgtgctgcgagcctattcgcagcggtgcgcggtatgccggttcccccggccggagctgctggacgcggcgcacatcctcccggaccgggacgagcgtggcaggccggaaatctccaacggcctctcgctctgcaaactccaccacggggccttcgacacggacctgctgggcatccgccctgacggcatcatcgaaatcgcgccccggctgctcgccgagcgcgacggccccacgctggagtacgggctcaagggcttcgccggaaaggcgctgagcatcctgccggaggctcctgcccaccggccgcgccgtgagtacctggaagcgcgctacgagcgtttccgcatgacaggctga

SEQ ID NO: 6714 - DNA, 1058 bp, Myxococcus xanthus
agctctacagcggagtcgcgtgatgtgcacctcaccgtgaacaagggacgcctgtccgtcgaggcctcgcacacggcgcgccaaggattcatggtggaggtggcgggcctgcgcgtctccgtggtgggcactgtcttcacggtggagcgcacgaaggacggcgccgccgtggccgtcgcggaagggcaggtccgcgtcgaggcggaaggtcagccgccgcggcgggtcggtcctggcgagcgggtggaactgcacgcggcgacgcacacgctgaacccgcggaagatgtcgaagccggacctgcgggccatcgcggagctccgggacccggtggacgaagtccccgtaagcccgccccgccccgtcagcgcccggcccgcccccagccagaaacccgagccgaccgacgcgcccacccccatgacgccaggcgcggtagcggcggtgacgcccacgccgcgggagcccatcggtgaagccccggcgcccgagcccgcgccgccaccggcgaatgccctggcccccgtggccgccgcgggaagtaccccgaccgcgccaccggcccccgtggacccgaaccacgagttcgcgccctaccccgtgccgtcggtgaacggccccaggccgcccgcgccggagccccagccgactccggaggccgtggcgaagcaaacaccgaagcagcgcgagccgttgattcccatggcgctgatgtccaaggacgccgacgagcgattcctgggctacgcccggctcaaggtgaactcgcgcaagtgcgagagcttcctggtaggcctggacgagattgcccagcgcagcccaagggcgtcccaccgcgagcaggcgcgctaccttcgcgcgcggtgcttcgaggagaagctcgaatcgcaccgggccaaggacgaataccgccggtacctcaacgacttcccgcgagggcgctacgccaaggaggccaagacgggactgctgccctgaggcgggcgggagatgacggcctcatgtgcccgcccgcgacgcacagcacggacggtaacgggcctcggactcagctaccc

SEQ ID NO: 6715 - DNA, 150 bp, Myxococcus xanthus
atgacgctgttgcaggggccggagttgccgcagtgggccccgggccgcgcgggccggcgcattcgtgcgctggagtccgtggtgcgcgagctggtggctcgcggcaacgccaccgagccgcctcagaagctgcctcgcacgggtagctga

SEQ ID NO: 6716 - DNA, 933 bp, Myxococcus xanthus
tgcctgcgttgccgccgtcccgagagcgcgtgttattgcgcgcaactgccgccccggttggagactcgcacgcgcgtcgtgttcctccagcacccgcgcgagagccgcgtggccattggcaccgcgcgcatggcccacctgtcgctgagcaactccgagctgcatgagggcgtggacttctccggccaccggcgaatcgaggagctggccgcgcagcgggactccgtcgcggtgctcttcccgggcgaggacgccatctcggtggaggaggcgcggctgaatcctcccaagacgctcatcgtcgtggacggcacctggccgcaggcgaagaaggtcgtgtcgcgcaacccggtgctggccgggctgccgcgcatcggcttcgtgccgcgccggcccagcaactatcgcatccgcgcggagcccgcggaccactgcgtgtccaccatcgaggcggtggtggagatgctgggcatcctggaaggggaccccgcgcgcttcgacacgatgctgcgggccttcgagtacatggtggatacgcagttggaacggcaatcggcgcgcacctcacccaatcggcgccgcatctacttcgggccgtggcgtccaccgctggagctgcgcacgctggcggagcgcttcgagaagctcgtcgtcttctacggggaggcgaacgcgcaccccgcgggcggcgaggagattcccaccgagctggtgcacgcggtggcgtgccgtccggccacgggcgagcgcttcgaggccatcatcgcgccggagcagcccctggcctacagcacgccgctgcatgtggagttgtcggaggacatcctccgcgcgggcgagccccgggccgaggcgatgaagcgcttcgaggccttcctccgccccgatgacgagctggcggtgtggaccacgttcgcgctggacctgctgtga

SEQ ID NO: 6717 - DNA, 993 bp, Myxococcus xanthus
ctgctcactggcggcaccgggttcattggccagcggctcgcgcgccgcatcgtggaacgtggcgacacgctgaccctcatggtgcgtgccagttcgcgccgtggcccccttgagggactgggcgcccgcttcgtggtggcggacctgacaacgggcgcgggactggccgaagccgtgcgcgacgtggactgcgtgctgcacctggcgggtgtcaccaagtcccgcgagcccgagggctacatcgagggcaacgcgaagggtacccgccgcctggtggaggccatggccgccctgccccaccctccccggctggtgtactgctcgtcgctggccgccgccggcccgtccacgccggagcgcccgcgccgcgaggaggacccgcccgcgcccgtgtccatctacggccgcagcaagctgggcggcgaggaggcggtacgggcgttcgcggaccgggttccgtccgtcatcgtccggccgcccatcgtctacgggcccggtgacgtggagttcctcccgtcgctgctgcccatggccaagctggggctggctctgaagagcggcttcgggcccaagcgctactcactcatccacgtggatgacctctgcaccgccctgctcgcggccgcggatcgcggccccacggtgtcgaaggaagacccggcgcgcggcgtgtacgccgtgtccgacggcgtggagcactcctgggaggacgtctgcacggccatggccggggcgctcggcaagggccggcccgccgtgctgcccgtgccgcagacggtcagctacgtggtggggctgggctcggaagccgtggcccgcctgcgcggcacggtgcccatcctcaaccgggacaaggtgcgggagatgcggtgccccgcgtggacatgctccaccgagcgcgcgaatcgggagctgggcttcctgcccaccatccccctggcccagggactggccggcaccctggccgcataccgcgaggcgggcgggcgctga

SEQ ID NO: 6718 - DNA, 639 bp, Myxococcus xanthus
gcgacgaagaagcgactgtcgggtgccgaccgccgggtccagttgatggcggtggggcgaggcgtgttcgcctcgaagggttacgaggcgacctccatcgaggaggtggcccatcaggcgggcgtgtcgaagcccatcgtctacgaacacttcggcgcgaaagaggggctctacgcggccatcgtggaccgggagatggatgacctggtgacgcgcgtgtcggagagcatcgcctcgggcacgccccgcgaacggttcgagcgggcggtgctggccttcatgacgtacgccaaggaggagcccgcgggcttcgcggtgatgacgcgcgattcaccgctggcggctggacggcgaggcctgacgcgcgtcatcgacgacctcgcgctgcgggtctcggacatcttcaagagcgagttcgagcacgctggctacaaccccaaggtcgcgcccatctatgcgaacgcgttggtgggcatggtgacgcaggtggggcagtggtgggcggaggatgggcgctccttctcgattgaccacgtcgcgcgccacgtcgcggcgctcgggtggatgggattgaggcacctgccgaaggaaccggctgcttcgaatgggcggcgtggcgcgaagcgacgcggcggttga

SEQ ID NO: 6719 - DNA, 295 bp, Myxococcus xanthus
atgcctgcctccacgacatcggagcctgctccgaccgcctgtctccactgcggcagccccgttccttcggggggcgcggcgcgcgacttctgctgtgtggggtgcgaggccgtgcacggcctgctcgtggagcaggggctcacgcgctactaccagctcgcgcaaggaaagacggcgcccgcgcctgagccgcgcaaggaacgcgcgttcgcgtggctggagccgctcatgagtcgcgcggagtcgactccaggccccttgtgcgcgctcgaactggacgtgcagcttgagagca

SEQ ID NO: 6720 - DNA, 102 bp, Myxococcus xanthus
atgagcaacttcatcacggaagagaccgaagggttcgtgcggaagattggactgaaccgccctgagaagcggaacgcgatgaacatcgcgctcatcgagcaa

SEQ ID NO: 6721 - DNA, 840 bp, Myxococcus xanthus
gtccggattcccgcccgggatgggctcccactggccgcgacggtgtaccaggggctccaggacaatggcgtggtcgtccagatcaatcccgcgacggccgtgccgcgcaggtactacgacgcgttcgcccggttcctcgcgggccggggcttcacggtcgtcacgtatgactaccggaccatgggggactcggtcgtcgacgcgtccctgcgcaaccaggcccgcttccaggactggggcgagctggacacgcccgctgtgctggactgggtgacggctcggttcccctcgcaccggctggccgtcgtgggccactcggcgggcggtcagatgctggggctggcggagaacgcctcgcgcatccagtccgtgctgctgattggctcacagcacggctggtggcggcactggccactccgccaggggctggctttggccgccatctggtacgtcgcgctgcccgcctccgtcgcgctgctgggctacttcccgggccgcgccgtgggctcggaagacctgccaggaggcatcgcgaagcagtgggcgcgctggtgccgcaaccgacactacgtctccgatgacaacggcgcgccgttgaggccgtacaacgaccgcgtccgggcacgaatacggctctacagcttctccgacgacgccatcgcgccggaggccgccgcgcgtgcgttgctggactactacccgaacgcgacacgcgagcacctgcaccgcacgcccgcagagctcggcatgaagcgcatcggccacttcggctggttccgctccagcatgcccgaggtcgtctgggtggaggcggcggattggctcgaacagacgaagtga

SEQ ID NO: 6722 - DNA, 624 bp, Myxococcus xanthus
atggagcgtaaacgtcgcagcgcgaccggcgagcagagccgtcgtgccatcctggatgccgcgctggattgcttctcccggctgggctgggcggcgacgaccatcgaggacatccgcaaggtcagcggcgccagcgtgggcagcgtctaccaccacttcggggcgaaggaaggcatcgcggtggcgctctacatcgactgcctgcgcctccatcaggagtcgttgcggggtcggctggagcggaagcacgacgcggaagccttcgtgcgcaccatcgtcacccaccacatcgcctggtcccgggagcacccggaggccgcccgctatctcctgcgcatgcgccgtgaggaagccgtggccgcggccgaacaggaaatccaatccgcgacgggcgacttcatccgggaaggcttcagccggatgaaggcccatgcccaggcgggcgagctgctgccactgcctccggccgtctacatgccgctgatgcttggccccgcccaggaattgctgcgcgcctgggccaacggccaagtggagctcaaggccggcatcgagaaggtcctcgcagatgccgcctggcgatgcctgcgtccagagacagccccctccaggaaggtgccatga

SEQ ID NO: 6723 - DNA, 648 bp, Myxococcus xanthus
gcccaggccgcggagaagccgaaactgcggggggtcctgcatcagttcgccgccacgggtgcgctgggagcgggcctggtcctcgtcttgatggccccgaccgaccgggccgcgacggccgccgccgtgttcgccgtcagcctggtggtgttgttctcggtcagcgcgacctaccaccgggtgaactggtccacgcgaggcaggacgtggatgcggcgcatggaccacgcctccatcttcatcctcatcgcgggcacctatacgcccgtcgcgctgctgggcatctccggggccgcgggcaaccgcctgctgctcctcatctgggcaggcgcgctcgctggagtccttcagtcgctgttctggatacaggcgcccaaggtggtgacggcggcgttggccgtcgcggtcggctggacgctggtgccgtacttcgatgaagcacggcaagccctcacgggcagcaacctggcgctcatcctcgcggggggcgtcgcctacacggcgggcgccctcgcctatgccctgaagcggccgaacctccggcccggcgtcttcggctaccacgagttgttccacgccctgacgctggtcggtgcggggctccacttcacggtcgtcctgcggctcgtccgcgccgcgaccctgtaa

SEQ ID NO: 6724 - DNA, 411 bp, Myxococcus xanthus
atggcggtggcgctggtcgcgtccgcactggagctgggcaagcgcctgcgcccgctgccgggcatggcgaacctcgcgagacatgtcacgcgctggggcgcaaagttttcgtggacgggccgtgcgagcgcaatgggtgcggtcacaccgctgctgccctgtggcctcctctatggcgtcttcgcggtggcgctggcgagcggttcgttcggaggcggagcgctggtgctctccgcgttcgcgcttgacggcctacccgccctgctgggggcacagcttcaggcggcgctgtggaagcaccgcccgaagtggatgtccctgctgctccaacgggcggtgccgctggtggcggcggcggtgctcgtctaccgcgcggtgagcgtgaacgccggtggagccagctgtcattga

SEQ ID NO: 6725 - DNA, 2936 bp, Myxococcus xanthus; identical to SEQ ID NO: 538

SEQ ID NO: 6726 - DNA, 771 bp, Myxococcus xanthus
atgcccgcgctggcgctgctgatggccggctgtgatgagaactcggcgcgggtggtgggcgtgacgccaccggacgggctggactacgcgcacgaggagccctggcgggaaggaacgttcattccaccgccgggccccggcggacgcatcctggtcaccaacagcctggatgacaccctcagcctggtggagctggccaccgtgggcacgccggacttccgcgagctggcgcgcgtgccggtgggactcaacccggtggagctggaggggccgcaccacaccgccgtgtcgcccgcgggggacttctattacgtcggcatctccaactacgtgccagggggtggctcggggccgcatggtgcccacggcacgggcgcggatgacggctactgcctgaagctggacgcgcgcaacaaccggctcgtgggctcggtgcgtgtgaatcccaatcccggcgacgtcatcatcagcgcggatgggagcacgctgtaccagacgcacttcgacacgctcaagatttcggagatggcgcgccagggccgccccgagtcggacatgaacgcgaacctggccatcatcgacgcgcggacgatgacccggaaggccatggtggaggtgtgccccgcgccgcacgcggtgcgcctgtccgccgacgagcgcacggcctacatcgcctgctggtcggacgaggtggccatcgtcgacctcgcggaggcgaaacccacggtggcgcgggtgaaggtggtggcagcgggctcgggctttagagac

SEQ ID NO: 6727 - DNA, 297 bp, Myxococcus xanthus
atgatggcgtggctgggcaacctgctgctgccgtccgcccaggcgcatctgccgcccgtcaccggcgacttctactgggtgcaggtcaccgtgcccgggcggcgatgtccggtggagctgctgacatcgaacatggagtggcagctcgacgcggcgacctgggacacgctccgtgccgcctcgggtcaggacctccgcgtccaggtgaccagcgcctacctggtccagaaccggctgcgtgaaggtccgtaccgcctggagtcaccacgcaccatccgcgtggaggattcgcgatga

SEQ ID NO: 6728 - DNA, 414 bp, Myxococcus xanthus
atggacctcttcggtgatgacggcgtgcgccgggagtgcgtctgcctgggccggacgaacgtcaccgtcgagcactgggagccgcagcccggcccgcgcccgttgctggatgatgcgcgcttcacctcgctggccgaggtgctggaggcgccggactccacgcccgaggtgcgtcacgaggcggtgcagcggctggccgacgagcgaagccctcgcgtcgtggcggtgctgctcgcgctggtggcgcgcaagcactcgctgatggcgctgcgggtgttgtcggagtggggcgtcgtgggggcgcgcgaggcgcttcagcgggacctggcccaggtacggccggacaatccggcggacctgtggacccttacggcgttggagcggcggcttcaggcctgggcggcgcttcagtga

SEQ ID NO: 6729 - DNA, 600 bp, Myxococcus xanthus
ctgggcgtcatggagcgcttcaacgcgcgcgcgcaggccctgttgttcgatgaacgccggctggcgccggagctgcctcccgaggagacgacgcctccaggcaagttccccgaatactacgtctccgacacggtgccgctcgcgccctcgggatgggcgctccgagtgggcgggctcgtggcgcaccccaccgtgctgacgctggacgccctccagcgaatgcctcgcacggacctgcgcattcgccaccactgcgtggaaggctggaccgcggtggcgtcctggcatggcgtccgcctgagcgagctggcccgccaggtgggcgcggacacccgcgcgggctacgtggagctgcgctcgttcgacgcgggttattactcgtcctgggaccggcccagcgccttccatccgcagacgattctggcctacggaatgaacggccagccactgacgcccggccacggcgcgccgctgcgcctctattcgggcgtgaagctgggttacaagatggtgaagtacctcaccgaggtgaacttcctgcccgagcccaccggaggctactgggaggaccgcggctacgagtggttcgcgggcgtgtga

SEQ ID NO: 6730 - DNA, 927 bp, Myxococcus xanthus
cacatgccccataccgatcgcgtcaagcagatcctgtcgtggtacccgtctgacaaccccggcacgctgaccaacctggcccggctgctgaacagcggcacgctggccggcacgggcaagctcgtcatcctcccggtggatcagggcttcgagcacggcccggcccgctccttcggtccgaaccccgcaggctatgacccggactaccacatcaacctggccatcgagtcgggctgcaacgcctatgcagcgccgctgggcttcctggaggcggtggccggcaggtacgcgggtgagattcccctcatcctcaaggtcaacaactccgacaccctggccaaggtggccaaccccatgtccgcggtgacgagctccgtgaaggacgccgtccgcctgggctgcaccgccgtcggctacaccatctacccgggctccggggcgcgcaacgagcagtacgaggacctccgcgacatcatcgccgaggccaagtcctacggcctgcccaccgtgctctgggcctacccccgcggcaacctgtccaaggagggtgagacgggcatcgacgtggtggcgtacgcggcgcagatcagcgcccagctcggcgcccacgtcatcaaggtgaagccgccgcaggaccacatcgagcaggccgaggcgaagaaggccttcgagaaggccggcatccccaccaagacgctggcggaccgcgtccgcgaggtcgtccgctccgccttcaacggcaagcgcatcgtcatcttctccggcggcgaggccaagggcaccgacgccctgctggaggagatcaagcagatcaacgccggcggcggcttcggctccatcatgggccgcaacgccttccagcgtccgcatggcgagtccatcaagctcctcaaggacgtgatggccatcttcgccggcaaggcgtaa

SEQ ID NO: 6731 - DNA, 702 bp, Myxococcus xanthus
gctctacagccctacgcgctgaccgtggtggcggtggaccccgtcgccgtggacgtggtgtgggtgcgcgtctccgcgcagggctacacgcacctgctgcgcagcgatgacgggggccgcacgctgacgccggtgaccgtgttggatgacacgttcatcaacatggacctgtcctccgacggcggcaccgcctgggtgggcaccctcaactacttcttcatgggctcgagcaccggcccgctggagaagcagcccctgcctaccggcaacgcgtgcgtgctgcgcgacggcgagacgctctacggctgcggctccacctggctgcacgactgggctctggcgcgcagtacggaccaggggcgcacgtgggagcacatcttcgcgttgtacgaaatccagggcacgcagctatgcccacgtggaacccccgtgcgggacctctgcccggcccgctggccgcagctcgcggagcaactgggcgctccgctctacccggatggtggcgtggaggagccgccgccgccggatgcggggaccccagacgcgggcacgcccgacgcggggcaacagccgcccgagcagcgcccacccgagccgaagtccggtggctgcgccgccgcggcgggccccgccctgcccctgctgttgctgctgtcctctctcctcccgaggcgccgtggcccacggcgtccacatcgatag

SEQ ID NO: 6732 - DNA, 150 bp, Myxococcus xanthus
gtgctcgacgcggacaaccagattcccgacgggaagctgcccggaaagtcacggcagcgccgcacgctggtgatgaactggtggggccaccgtcccaccgacatccccgcgtgggcggacacgcgcctctaccgggcgctggcgcgctga

SEQ ID NO: 6733 - DNA, 675 bp, Myxococcus xanthus
acggacccgccgtactgcctgctcacccggcggcgcaagggcggggacctgcgagacacgcgcgcgcacaagaagatcgaccagaaccccatcgtccgcttcgagacggtgcgcgactaccgcgccttctccgaggcctggctgtcgagcgccaccgcgcacctgacgccggacgcgccgctcatcatctggacgaacctgctgggcaaggagcccatcctcaccgccgcgcgcgggctgggctacccgcacctgcgcggcgagtacgtctggggcaagcgcaccaccgacaagaacgccaacgagcagacgctgcgcgtctacgaagtcgcgctcgtgattgcccgcacgcccgcgccgccgctggcgccaggagatttgcccaccgtctgggccgtagtcggcggctatgacgatgaaggtgaagcaaagcgttggggcggccacccgcaccacaagcccttctccgtcctggagccgctggtgcgcacgtacagccgcccaggggacacggtgctggaccccttcgcgggcagtggctccatgccgtcggcggcgctgcggctgggccggcggcccgcgtgcctggaaatcgagccggagtgggccgagcgcgtcacccaccgcctgcgcgagacagcccgcgaggaagctcagcgcgccagcgcccggtag

SEQ ID NO: 6734 - DNA, 213 bp, Myxococcus xanthus
atggcggccggcgcggcgctcaccgacgcccagggcaaccggatgcggacgctccctccctggcaggaagggcccttggacgccgcgggcagctcgcccatcatcatcgtcctggaggagccggaggccgcggacttcggccggtacacgctcgagctgtgggacgagggccgcaagcggaccttgaagttggagggtttccaggcgcggtga

SEQ ID NO: 6735 - DNA, 1131 bp, Myxococcus xanthus
gtgtcgttggaccgcccgcccgagggcgccgacgcggaggcgccgcgggtgcgcatggtgcccgacgcctccacgtcctcgcggcccgtccgttctcgggagccgtccgaggtcgccgcggtgctgcccctcaatccggagccccgggatgtgcccgtggcggatgcgaatgcgcccgtcactccctcagagccgcccggagtgcccgcggtcgaggcgcccgccgtgcccgcatcggcggcgcccgtggcggagacgcccgcgccgccagcaccgcgttcgaggcgccgagccgtcatggggtgggggggagccgccctgctgggcgtggggttggtggtgttcggggtgagccgcctcgcgatgcccatcgcgggagccccggctcctgccccgcctgttcccattgagaaaggaagtcacgcagtgacgagtcgttcttcgaatccctccgagatgcccctcctagaggcggtgccgtcctctccggacgcgggcgcggtccacgacacggacgcgcaggacgaagtgtccgcgcaggtggcttcctccgacgcggagggggaagcagcccacgcgtcaccgttgaagaagcgcccgtcgccaggaagcgcgctgggtaaggccgccgccgtggcctgcctctcggccgcgtgcgccagcgggccccaggtgcgggacatgccgcctcgcatccagtgcccgacggaggtgttggactccatggcgaagctgggcttccacccgcccaagatgattggcaacgacttgacgctctccatgacgcccaaggtttccgtgcgtccggtgcccgtgccgccagacggggagcccatcaccctctatgccatcgacgaggtccggagcgcttggagcggccgcctcccgaaggggagccgcttctatgggacggtgtaccacgggaagacggccatctacgggtggttcacggaggtggagtacccggacggccggcgcatccccatctgcgccaacatcgtggacagcgccgcccgggaagccgtggggatggagtatgacccttccagcactcccggcagaccgatgatgtttccgggcgtcaacctggcgatctcccaggttcttggagaaatggggcaccgcaggtag

SEQ ID NO: 6736 - DNA, 990 bp, Myxococcus xanthus
atgaacaccgacattcgcgcgctcaccgaacgcgtgcagcaggaaagcagcttcgtcgaggtcctcaaccaggaaaccagcaaggtcatcgtcgggcagcgctacatgctggagcgcatcctcattggcctgctgtgcaacgggcacgtgctgctggagggcgtgcccggcctcgccaagacgctgacggtgcgcaccgtggcggattcgctcagcgccaccttcatgcgcatccagttcaccccggacctgctgcccgcggacgtggtgggcaccatgatctacaaccagcaggcggcgaacttcaccgtccgcaaggggcccatcttcgccaacatcgtgctcgcggacgaaatcaaccgcgccccggcgaaggtgcagtccgcgctcctggaggccatggccgagcgccaggtcaccatcggcgaccagtccttcccgttgccctcgcccttcctggtgctggcgacgcagaaccccatcgagcaggaaggcacctacccgctgcccgaggcgcaggtggaccgcttcatgctcaaggtgaaggtgggctacccgacgcgcgatgaagagaaggtcatcatggaccggatgtccggcggctcgtcgccgcgcgcccagcgggtcatcgacctgcagcacctggtccgtgcgcgcgagctcatccaccacatctacatggacgagaaggtgaaggagtacatcctcaacgtggtgttcgccacgcgcgagcccagcaagtacggcctcaaggacctggcggactacatccagtttggcgcctcgccgcgcgccaccatcgcgctggcccaggcggcgcgcgcgcatgccttcctgcgccaccgtggcttcgtcacccccgaagacgtgaaggccattgccttcgacgtgctccgccatcgcgtcgccatgacgtacgaggcggaggcggaagacctcacgccggagaaaatcatccagcgcgtgttcgaccgcgtcgaagtcccctga

SEQ ID NO: 6737 - DNA, 858 bp, Myxococcus xanthus
cgcattcgcaagctggagattcgcacccgcaaggtggtctccgacatgctcgccggccagtaccattcggtcttcaagggccggggcatggccttctccgaggtgcgccagtaccagcccggtgacgagattcgcatcatcgactggaacgtcaccgcgcgcatggatgaggcctacgtcaaggtcttcaccgaggagcgcgagctgacggtgatgctggtggtggacgtctccgcgtcgaaggagttcggctcgcgcgagcgcaccaagtcggaggtcgccgcggaggtggcggcgcagatcgcgttcagcgccatcgccaacaatgaccgggtggggctggtcctcttctcggaccgggtggagaaggtggtgccgccgcgcaagggccgcacgcacgtgctgcggctggtgagcgacatcctcacgttccagccgcaggggcgggggacggacctggccgcggggctcaactacctgacgcgggtggcgaagcggaaggcggtgacgttcctcatctccgacttccaggcgcgcgactacgagaagccgctgcggctggtggggcgcaagcacgacctggtgccggtggtggtggcggacccgatggaggaggccttcccccggctgggcctggtggacatggaggacccggagacgggcgagcgcttcgtcgtcgacaccagcgacccgcgcgtgcgaggccgcttcgcccgggccatgcaggccgcgcgtgacgagcggcgcaagctgttcaagaagctggagctggaccacgtggagctgcgcgcgggtgatgaccacggcaaggcgctggcgaacttcttccgcgcgcgggcccggaggatggcggcatga

SEQ ID NO: 6738 - DNA, 377 bp, Myxococcus xanthus
atgaaccggcttatccccctgctggcggtgtggctcgtggtggcggcgctggtggtggcggctccggcgtgggcccaggctccggcccctgcaccggcgcccgcgacgacggagcaggtcgaaccgcggaacctgtccgtgcggctggagccgcagcaggtccgcatcggtgaccccttcgtctacgaggtggtcatcacccatccgaaggaccaccgctacgaactgaaggtgccccaggagacgggggacttcgagttcctggaccagacgcgccagcgccaggacgggccggactcggcgaccaccacgttccgggtgcggatgtccgccttcgccctgagctcggtggcggtgccggcgctgcccttcgacgt

SEQ ID NO: 6739 - DNA, 891 bp, Myxococcus xanthus
atgaaggctccctcggtggggccggtggaagccgcgttgctggcccagctggccccggcggtggtcgcgacggttcactggttgccgggcggcggggccctccgggtcctggaggcgggcgccggccccacggtggtgctgctccacgggcgaggcggcgcggcctcccagtggttcacctacctgacggtcctcgcccggagccaccgcgtgctggcggtggacctgccgggctttggcatgtcgtccacccccgaaggcccgctggccactggcgaggacgcggcggccttcttcaccgcccccatcgaggcgctgctgtcccagctcgccccgggcccggtggccgtggtgggtcactcgctgggcgggctcgtggcgctggagctcgcgctgcgcggccgggtaccggtggaacggctggccctggtggatgccatgggcctgggcccggagatggcgcgaaaagcccgcctcttcttccgcgccggtcccgaacggctggcgcgctcgctggggccatgggcctgggcccagctgatgccgccacccccgacgccgctgggtgagcggctgggcgccctggagtacgaacttcacacccgcccgggcgccagccccgacgccgcgcgggctttcaaccggctcgtgcccgtggccgggcctgtctttcatcgcgcggaaaagctcgacgccataacggcgccggtgctgctcgtctggggagagcacgaggacaccctgcccgtctccatcgccgagcaggcggcacggcgccttccccaggctcggctcctgcgcctggacgcgggccacagcccccaccaggaacgtccggagcgcgtgctccccgaactgaaggcgttcctcgccgcgccccaggagcactag

SEQ ID NO: 6740 - DNA, 3442 bp, Myxococcus xanthus
gacacgggcagcattgcctacaaccacccgctggcgctccagctcacgggcgcgctgaacctgcccgcgctccagcgaagcttcgacacgctggttgcccgccacgaggtgctgcggacgacgttccgcatggaaggcggcgcgcccgtccaggtcatccacccgccctctcaggttcccatcgaggtcttggacttgtcgggtgaggccgtcgcccatcttcgtgaggcggagacgctgcgacgggtccaggaagaggtccaacgccccttcgacctggcgaagggcccggtggtccgcggcatcctgttgaagcagtccgcggcggagcacgtgttggtgctcaacatgcaccacatcgtcaccgacggctggtccaacggcgtgatggtccgggagatggcggcgatctacggcgccttccggcaggggcagccgtctcccctgcccccgctcccgttccagtacgcggacttcgcggcgtggcaacggaagtggctccaggggcaggtgctggaggcgcagctcgactactggcgtgggatgctcgcggacgcgccgccgtacctggagctccccaccgacaagccgaggccggagcagccgtccttccagggcgacaacacgcccatccaattgccggcggccctgagcgacgccgtggacgcgctcgcgctgaaggagcgggcaacgcccttcatggtgttgctctctgccttccaggtgctgctgaatcggtactccgggcaggatgacgtgctggtgggctcgcccatcgccggccgtcgccacgcgcagacggaggggctcatcggcttcttcgtcaacacgttggtcctgcgcgctcgcttcggtcaggacccgacgttccgggagctgttggcccaggtgcgtgacaccacgctgggggcgtacgagcaccaggacctccccgtcgagcggctggtggaggacctccgccccacccgtgaggagggccgcacgccgctcttccaagtgatgttcgctctccagaacacgccggttcccgagctgacgctcccggagctgtccctccggggcttcgagtcgaagcacacggtcagccgcttcgagctggagctggtcctgtcccgggcgaccgagggctaccagggcgggctcgtctacagcaccgacctgttcgacgcggccaccatcgaccggatgatgggcaacctgcgtgaactgctcctgggcgccatggccgtgccagacgagcgcgtctcccgcctcccgctgctgtcccaggcggagcggcagcagtcgctgctggcgtggaacgacaccgccacgccccgaagcccgggcctctgcgcgcatcacgtcttcgagcaacaggcggcacggacgccagacacggtggcggtgtccttcgagggacagcagctcacctaccgcgagctggacgcgcgggcgaaccagctcgcctggcacctgaaagcgtccggcgtgggccccgaggtccgcgtgggcctgtgcgtggaccgctcgctggagctggtggtgggcatcctgggcatcctcaaggccggcggcgcgtggctgccgctggacccgtcgtatccggtggagcggctgacgctgatgatgcgcgacgcggccatcccggtgctcgtcacgcaggagcacctggcggatgagcttcccgcgctcgggctgctggtctgcctggacacggactggccgctcatcgccagccaaccgcagacgccgctcgcggtggagatgtccgaggacaacctcgcgtacatcatcttcacgtcgggctcgacgggccgccccaagggcacgctgctgacgcaccggggcctgtgcaacacggcgctggccgccatccaggcccaccgcgtccacgagaagagccgcgtgcttcagttcgccgccttcggcttcgacgcgtcggtgtgcgaggtgttctccacgctgctcgcgggcgcgcagctctgcctcgctccccgggaggccatcatgcctggcgcgccgctccagggcctgttgaccgcgcaggagataacaggcgtcacgctgacgccgtcggtgctggcgcagttggagccggagacgttgccgaagctggagtccgtcgtctccgcgggcgaggcctgctcgccggagctggcgcgccggtggctgaagtcccgccgcttcatcaacgcgtacggccccaccgaggcgaccatctgcgcatcggtggacgaggccctggacaccgaccggctgggcatcggccgtgcgtgggccaacgtccggctctacgtgttggatggccagatgcagccggtgcccgtaggcgtaccgggtgagctgttcatcggcggcgcgggcgtcgctcgcggttacctgggccggccggacctgagcgccgagcgcttcgtgccggacccgttcgcggtggagcccggaggacggctgtaccggacgggagaccgggtgcgctggctggccgaagggcgactggagttcctgggccgcctggaccaccaggtgaagctgcgtggcttccgcatcgagctgggcgaaatcgaagcggcgctggccgagcacccagaggtgcaggacgccgcggtgctggtgcgggaggaggcaccgggccgcaagcaactggtggcctacgtcgtcgctgacgatgaggagcagccgcccgaacaggacgccctgcgccgggccctggagtcacgcctgcccgagtacatggtgccgtccgccttcatcatgctgaaggccatgccgctgacgcccagtggcaaggtggaccgcaaggccctgccctcgctggcgcaggagcaggtgaagcgcgagcacgtccacgtcgcgccccgcaacccagtggagcagacgctggcggacatctgggcgacggtgctgtcccgcgagcgcgtcagcatccacgacaacttcttcgagctgggtggcgactccatcatcagcatccaggtcatcgcgcgagcgctggaggccgggcttcacatcagcccccgtcagttcttccagtaccagaccatcgccgccttggccccgcacgtgggtcaggcccaggtcgtggagagcgagcagggaccggtgacgggccccgtcccgctcacgcccatccagcactggttcttcgagtggcagctcccgcacctccatcactacaaccagtcgctgttgctgggactgcgtcagcccgtcgccgcgtccgttctccaggacgcgctgcgggccctggtcgcgcaccatgacgcgctccgcctgcgcttcgagcggacccccgatggctggcgccaggagagcctggggctcgacagcaccgtgacgctgcgggaggtggacctgtccggactggacgaggccgcgcagcgcgccgcattggaggaaaaaggcctgcgtgcccaggcgggcttccggctgggggaggctccgctggtggtggccgtgcgct

SEQ ID NO: 6741 - DNA, 348 bp, Myxococcus xanthus
atggcgtgggcgttgccgggtcgggaggtcacgcgcttcgtcatcgccacggcgcaggcattggtgtccgggctgctcatccatctgacggacgggcgcatcgagacgcacttccacatcttcgggtccctggcgctgctggccatgtaccgggacgcgcgggtgctgttcctctactcggcgctggtggcggtggaccacctgcttcgcggccagtactggcccctgtccatcttcggcgtggagtccgccagtgcctggcgagcgtgggagcacatcggctgggtggtgttcgagaacgtgttcctcctgattggcgggcgaggcgcggtgaaggatgcccctgag

SEQ ID NO: 6742 - DNA, 3758 bp, Myxococcus xanthus
  unsure (1)..(3758): unsure at all n locations
ctctcaagccgggatgacttcttcgaactcggaggccactcgctgctgtccgtccagctcgcctcgcgtgtccgggagcggttgggcgtcgagctgcccgtggccacgctgttcgccacgcccacgctggcggcgctcgcggcccgtatcgatgcgtccccgaaggtctcggagcgcgtggagtccatgccccagacgcggccggagcacatccccgcatcgttggtgcaggagcgcctctggtacgcgatgcagctcccggaggcgccgcccttcgtcgtcgtcgccgcgctggtgctcgacggcacgctggacgtcgtgtgtctggagaccgccttggaggccgtgctggagcgcaacgccacgctgcgcaccaccttccgactggagcacggagcggtcttcacccgggagcatcccgtcacccggccggtgctcgtccagacggacctgtctcacctgtccgccgccgaggccctggacgccgcgcgcgccatcgccacccggcatgaccgcgagcccttcgccgtagaccagggcccgctgtaccgcttcgagctggcacggctggacgccagtggcacgcgccatgtgctcgtcgcgtccatgagccatctggtcaacgacggcatcggaatgggggccttcctggaggaactcgcccaggcctgggccggaaccacgccgctgatgcatcccgcggcgcggacgtatgcggacttcgcgctctggcagcggagccccgagcacctgctcgaggtggacgccgccgtggcctcctggaaggccgcgctggcacacgcgccgtccgtcctcgacctgccgctggacttccctcgccgcgcgcccgcgctgaacgcgaacatgcggccggagcccctgtccctcagttccgaggcgatgacagcgctccacgcgctggcccggcgcgagggcgtgtctcccttcaccgcggtgctcgcgctgatgcaactgtggctgcaccgcctcagctcgcagccgcacgtcgtcgtcgcgtcacccttctcgggccgcgttctgccgggcgccgagcggcaggtgggctacttcgccaacgtgctcccgctgtgcaccgaggtggcgggcacgccgtccttccgtgcgctcctgcgccgcgcctgggatgtggtggggcacgccacggcgaaccaggaagtccccttcaagcgcatcgcggacgcggtgcagccggatgcgcctcgcaccgcgccgccgctggcccaggccctgctgctgctggacagccccgcgtccctgtccttcaacggactgggtaccacgtacctggacggcgagagcatcttccccgcctacgacgtggtgctgcacctcatcgaacggcccgagggcggaacgctgggcttcctcgccaccgacagcgccctcttcacctccgccacggcacagcacatggcccgcgccttcgagcaactgctcaccgaggccgtgcgcacaccggacgcgcctctggcccggctgtccctgctgtcctcgcagcagcgtgcgcaggtgctggccacattggatggaggcccgcaggacattcctgagggcgcctgcatccacacgctcttcgaggcgcaggtgcgccgctcgccacacgcccccgccgtggcccatggcgattcgacgtggagctacgcggagctcaacgcccgcgccaacgcgctggccgcgcgcctgctctcccggggcattcagccagaagagcgcgtgggcgtggtgatggagccctccaaccagggcatggccgcgctgctgggcatcctcaaggcgggcggctcctacgtcccgctggacgcggggtggccggagcctcgcaagcgctcggtgctgacgcgctcaggggtgcagcggctgtgggtggatgcggaagcgctggaggcgcacgcgggcctggtgcccgacgtggaggttccgccccagcccgcgcacatcgccgaggacctggagcccggtccccggcacgtcgcggcctcgcaagtggcgtacatcgtcttcacgtccggctccaccggcgagcccaagggcgtcatggtggagcaccgcagcgtggtgaaccacaacgtcgccctagccgcgcgcttcggcttgcgcccgggcgacaggatgctccagttcgcgccgctcagattcgacgcggcggcggaggacctctatccgccgctcgtggtgggcgccacggtggtgatgcgcagcggactggtgcccgcgcacgtcatgacgccgtacctgaaggagacggacatcaccctcatcagtctgccccccacgtacatcgaggagtggattcgccagatggaatcccacggccagcgagtgcccgcgcggctgcgcctgctggcgcccggtggcgacgtgctcaagcgcgagacgtatgaagcctgggtgcgcgtgggtggtggccatgcgccgtggctcaacgtctacggccccaccgagtgcacgattacctccgcaacctgtgacatcccgggcgccgagggactgggcaccgacgccaccttccccatcggtcggcccatctcgcgcgtgcgcatccacctgctcgacgagcacctggagccggtgctgccggggctgcccggacgcgtgtacatcggcggcgcggcgccggctcggggctacctgggcgctccggacatgacggccgagcgcttcatccccgaccccttcgccaccgagcccggcgcgcgcatgtaccacacgggtgacctggcccggatgctgccggacgggcggctgcgcttcctcggccgcgcggaccatcaaatcaagattcgaggcttccgcgtcgagctggccgaaatcgaggcctgcttgcgtcagttcccaggcgtcgaggaagccgtggtgctggcccgcgccggcggttccgggcagacgcagctccaagcgttcctccaggcaccggcccagcatgtgcgcgcggacgcgctccgtgagcacgtcgcggcgcggctcccgtcgtacatggtgcccgcggccctcgtcgtcctggaggcgctgcccatcaacgccaacggcaaggtggaccggcaggcactgccagacctgtccgcgcagcccgccgtgccgcctgcgcaggagactccgggcgagcacctggagacgcccttccgcaccacgctggagatggcgatggagcggctgtggcgcgaggtgctgggacgcacggacatcggcgcgggcgatgacttcttccaggtgggcggcgactccatcctcgcgatgcggctgctgagccggctggaggaggagctgggcgtgcccgtccccctggccacgctcttccagtatccggtgttccgtgagacggccgatgccgtgcacgagctgttggccgagggccctccgcgctccagcgtggtgtccctatccggcaagcagacgccgaagtccgcgccgcccttcttcgtgttccaccccgccgacggcgagctgcactactaccggaacctcaccccgctgctggagcccggcctgcggtgctacggcgtccaggcccccgagacgcagtcgaagcacggccacgccaccttcgacgcgcgcatcgccgcgtacgtgcgggacatccaagcagtgcagccacacggcccctaccgcttcgcgggctactcgttcggcggctacccggcgctgggcgtcgcggcggcgctggaggcgcagggcgaaaccgtggagctactggccctggtggatgccctgcccgcggtggaagggcctcangggtcggc

SEQ ID NO: 6743 - DNA, 675 bp, Myxococcus xanthus
tggacgccagactcctggcggcacaagcccgtcaagtacatgccggaggactatccggacgcgcaggccctggtccagaccgaagccgagctgtcccgcctgcctccgctcgtcttcgcggacgagacgcgccagctcaccgcccggctcgccagggtcgccgaaggcaaggccatcctgctgcaaggcggtgactgcgcggagagcttcaaggagttcaccaccgacaacatccgggacacctaccggctgctgttgcagatggccatggtgctgaccttcgccggcaaccggccggtggtgaaggtgggccgcatcgccgggcagttcgccaagccgcgctccagccccatggagacgctgggcggcgtcaccctgcccagctaccgcggggacatcatcaacggcatggagttcgacgcccaggcgcgaacgcccgacccgcgccggctgctcaaggcctatcaccagtcctccgccacgctgaacctgctgcgagccttcgcccagcgcggctacgaggagctcgccgagccccagcgctggccccagggcggcatcaaccgcttgctggcggaccgcatctctcgaatccctgtcgttcatgcgggcgctgggtgtcagccccgagcctcgcagcggctccaaagccatagacttcggccctggcctttc

SEQ ID NO: 6744 - DNA, 3825 bp, Myxococcus xanthus
ggctccctccgcgccgtcatcgatgaggacgccgcctaccaggggggcgtgcagcacgccgcggaccacgccttctgggtggagcgcttcacccatggccccacgccggtgacgctcgcggagcccgcgcccatgacgccgcgattcgtgcgccagacgcggcacctgtcgcccgcggacctggagcggatgcaggccgccgcgaagcaggccgggctcacgtggccggacctggtgctcgcggcgacggcggcctggctgcaccagcacaccggtgcgcccgaaatcgtgctgggtctgccggtgatggcccgcctgggctcggccgccatccgcgtgccgtgcatggccatgaacatcgttccgctgcgcgtcccggtgcgtccggacgccggcttgttcgccatggcccgtgacgtggcggcagagctgcgcgccatgaggccgcacctgcgctaccgctacgagcagcttcgccgcgacttgaagcgcgtgggcggccagcggcggctgttcggccccgtggtcaacatcatgccgttcgactacgccctgcgcttcgcggggatgccggccttcgcccacaacctctccgcgggtcccgtcgaggacctgtccatcggcatgtacgcccgctccgatggcagcggactgcgcgtggacttcgacgcgaaccccgcctgctacagccccgacgtcctggacgcccaccagctcggcttcctccagttgttggagtcactggtggcctcgcccgagcagcccgtgcgcgcggcacctgcccccgcgcggccctccgtcgtggatggcgggcccctgccgattccgcaacggcccgtgctggagctcttcaaggagcaggcccgtgcgcggccggatgccatcgccgtggagcatggcgagcaccacctcacctatgcggcgctgctccagtccgcacaggcgctcgcggagcggctgagggccgacggcgcgcggcccgacacgctggtggccgtctcactgccccgaagcatcgacgccatcgtggccacgctgggtgtcctcttctccggcgcgggatacctccccgtggacccgttcggccccgaatcccggacgaaggccatcctggatgacgccgcgccacgactgacggtgagcagcgccgtgaaggacctcacggccggcatgcctccgcagacacccgggcagctcgcggtgcaccggcgcgccgacccggagctgccgaccacggcgacccagccgggcgcgccgctggcgtacgtcatctacacgtccggctccaccggccagcccaacggcgtgcagattgaccacgacgcactggcccacttcgtggcgggcgcgacgttccgctacgaggtgacgcccgaagacagggtgctgcagttcgcgccactgcacttcgatgccagcgtggaggaaatcttcgtctccctgtgcgccggagccacactggtgctgcgcacggacgagatgctccagtcggtgccccggctgctcgaagcctgcgccacacatggcatcaccctgctggacctgcccacggccttctggcacgagctggcctacagcatgtccacgggcgcggcccggctgccgccctcgctgcgcaccgtcatcatcggcggtgaggccgccttgcccgagcgcgtcgcccgctggcgggcctccgccggtcccaaggtccggctgctcaacacctacggccccaccgaagccaccgtggtggccactgtcgccacgctcagcggcggtcccgacgtgacgcccgccggggaagacgtgcccatcggacgccccctgcctggcgtgcgcgcggcgattgccgacgcgaagggccgcatcgtccccacgggtgaggaaggcgagctccacctgctgggcggcgcgctcgcccggggctacctgggccgcgaggcgctgacggcaacgcgcttcatcacgctcgacgccctgccgggaagcccccgcgcctaccgcacgggtgacaaggcccgactgcgcgaggacggccaacttgtcttcgtgggccgcgtcgacgacgagttcaagatcagcggccaccgcatcgacccgtccgaggtcgaaacggcgctgctcggccacccgggcgtgcgcgaggcggccgtcgtcggccaggtgctccccagcggttcgcgccggctgtgcgcgcacgtcgtcaccacgcagcccgcgcccaccgtggcggagctacggcagcacctgctgaacggcctgcctgcccccatggtgcccggtacgttcgtgttcacggagcggctgccacgcaccagcaccggcaagctggaccgcgccgagctgccccgcctgctgcccaccgaagagtccgcgaccaccacagcgggaaccacggccctggagcgtgtggtgctgaaggtctgggaagaggtactgggcgtgacgacgacgtccgcgcaggatgacttcttcgacctgggcggccagtcgctccagagcatccaggtcgccaaccggctcagcatcgagctgggccgcgagattcccgtcgccaccgtcttccgctacccgacggcggccggactggcccaggcgctggagcaaggcaccgacggcgcctccgacgccgggggcctcaccgagagcatgctcgccgacgccgtgctgtccgaggacgtcgtccccaagctcacggtggcttccgccgagtctccgcggctgcgtcaggtcgtcctcaccggagccaccggcttcgtcggggcgcacctgctccaccagctcctgcgccagacggacgcgcgcgtggtgtgcctggtccgcgctcgcgacgaggcgcacgccctggagcgcatccaggccgcgctggcgtcccagcagctctcccccgaacacctgacggagcgcgtggtggcgctgccctcggacctcacccagccctggctgggcatgagccaggcgcgcttccacgggctggcctcggagtgtgacaccgtcatccacaacgccgccgtggtcagcgtggtgcgcgaatacggcagcctccagcccgtgaatgtgcgcggcacccgcgagctgctgcgcctggccgccgcggtccgcgccaagcccttccactacgtctccaccctggccgtggcgccgcagaccgacctcagccccgacgtgccgtaggctttggtgcccgcgcacccgggcctgcgcgacggctaccagcagagcaagtggatcgccgagcggctcgtcgagcaggccggagcgcgcggactccccgtggccgtgtatcgactgggccgcgtggtgggtgcgcccgacagcgccatcgtcaatccgcaggacctggtgtggcgcatcctgctggcgggaattcccgtgggcgcgctgccccagctcgacgtcgccgaggtgtggacgcccgtggactacgtggcgggagccatcgtccggatggcgcgcgatgcccgcccgcccacggtgttcaatctgtgtcccacgcccgaggtgaagctccgtgagctgttcgcctgggtccgtgactacggctacctcgtggagcactgccccgtgggtgagtggcgcaaccgcgtggcggagcgcgccggcaccggggagaaccaatccacgctcgcctttttcgacctgcgctcgggcacggacgtgcccgcgtttggcctgggccccatccgttgtgagcgggtccatcaagcgctcgagggaacgggcatcacctgcccgcccacggaccgtgcgctgctgtaccgatacctcgactactgcattgcgcggggcctgctgccgcccgtgcccgcaacccgccttccaaccgaaacggcactcccgtga

SEQ ID NO: 6745 - DNA, 3452 bp, Myxococcus xanthus
atgcccgcacagccgttcaatctctccgcggggcccttgctgcgcgccacgctgctgaagctggaaccgtccgagcacgtcctgttgctgtgcctgcaccacatcgtctcggacggctggtccctgggcgtgctggtgcgtgaggtgaccacgttctacgaggccttccacaacggacaccccgctgccctgcccgagcttccggtgcagtacgccgactacgcggtgtggcagcgcgggtggctccagggcgaaacgctgaaggcgcagctcggctggtggaagtcgcagttggccggtgcgccccatgcgctggagttgcacaccgacaagccccggcccgcggtgctgcgtcaccacggcgcggcggtgccggtgcaactgccccaggagctcgcgctgatgctggatgcgctggcgcagcgtgagggcgtcacaccgttcatgctgctgctcgcggcattccagtcggtcctggcccgtcatgccgggcaggacgatgtgttggtcggatcgcccatcgccggccggcgccacgcggagaccgagccgctcatcggcttcttcgtgaacacgctggtgctgcgcgcccgcctcacgcccgcgatgaccttccgtcagttgctggcgcaagtccgtgacaccacgctgggcgcgtatgagcatcaggacgtgcccttcgagcaactggtgcgcgcagtgggcgtggagcgcagcccggggcacgcgccgctcgtgcaggtgatgttcgacctgcaccgcaccgagctgtccgccgccagtggcttccatgccctgggggcacggcgcgtccccatcgagacgtggacgtgtgaggtcgacctcttcctcaccgccatcgaagtgggcgagggcttcgaggtctacttccagtacagcaccgacctgttcgagcccggcaccgtggagcggctgcgcaaccactacgtgcaactcctgtcccacgcggtggccgcgcctcgcacgtccgtgggtgagctgtccctgctctccgccaccgaacgcgagcaggtgctccaaggcttcaacgccaccgagcgccccttcgactcggaggggaccatcgtgtccctcatcgaggcccaggtggcccgcacgccggacgcgccagcggtggtggcgccggaaggtacgctcacgttccgggagctgcacacccgggcgtcgaggctcgcggcacacctgaccgccgcgggcgcggggcccgaagccgtggtgggcctgtgcctggagcgctcgctggacgcggtggtgtccctggtcgccatcttcatcagtggagcgggctgccttcccctggaggcgtcgcatccaccggctcgccgcgcggcgctgctgcgccaggcccgcgcacggctcgttgtcagccgcccgggactcttcgcgggcgtggagcctggggttcccctcgtgtcgcccgacgtgcgtggagacgtggtggccgtcccccgccccccgcgcgccgagcacctcgcctatctgctctacacgtccggctccactggcgagcccaagggcgtggagctcacccaccgcaacgtcgtccactgcttcgcggcgttcgacacgtactacgccacacagccgggagactgctgggcgtcgtcgggaagcctgtccttcgacatccacctggaggagctgctcttcagcatcacccgtggcgcgcgcaccgtgctgcgcgaagtgggcccacttgggctgggccgcgacatcctcggtcacggcatcacccacgtcgtcatcacgccgtcctcgctggccaccgcgctggaggagccccgtgcggcggaggcgttccgctcgctcaaggtgctcgtgactggcggcgaggtgctgccagacccgttggtgcggcagctcgcgctcacccacacgcggctggtcaacacctatggccccacggagacgagcatcaacgtcgcggcggaaatcacgctgcccgaccgtcccgtgcgcctgggccgtccgctggaccggtgccggctgtacgtcctggatgcgaacggcgctccggtgccgccgggagtccctggcgagctctacatcggaggtacctgtctgggccgtggctaccgcgaccggccggacctcaccgccgagcgattcatcccagacgccttctccggcagggagggtggccgcctgtaccgcacgggtgaccgggtgcggtggaacggtgatggctcgctcggcttcctggggcgcaccgacttccaggtgaaggtgcgcggcgtccgcgtggagctggaggaagtggaggccgccctcctgcgccagcccggtgtgaggcaggcatcggtggtggtgcgcggcactcagcgagatgcacgcctggaggcgttcctcgttctggaaggcacggctgccggcgtcgagtcccggctccgcgaaggactgtcgcgcgcgctgcccgaggccctggtgccctcgcgcttcacggtgctgaccgccctgccgatgacgaccagtggcaaggtggaccgcaaggcactggcggccctgcccatcccggacatcgagccggaggccgcgcccgaagcgcgtccccgtggcgccgtcgaggagctactcgccctgctgttctgccaggtgctgggcctgctgcaggtgcggcgcgaggacgacttcttccacatcggaggtcactcgctggccgccacgcggctggtggcgcgagtgcgacaggcgttcgacgtggagttcccactccaggcgttcttcaccgagcccaccgtcgcgggcctcgcgcgcgagttggagacgcggcgtgacggcgcggccccgctccccgcgcccgtgccgcgtccagcggacgccgcgttggtcctgtctcccacgcaggagcggctgtggttcgtgcagcaactccatccgggcaccagcgcctatcacctcgcggaggcggtggagctggacggccctctggacgcggcggcgatggaagacgcattgcgctggctggtgacgaggcatccggtgctgcggctcgccgtgcccgcgcgcgacggccttccggcgcccgtgctgtgccccgtgcctccgcgcgtgctggaggtggaagaagcgccgtccgcggcgcagtgggcccgggacgcggttcacgcatccttcgacctggcgcgcggcccgctctatcgtttcaggctgctgcgcacggcgccggagcagcacgtcctgctgctcgccttccatcacctcgtggtggacgggctgtcgctggatgtcctggtgcgcgagctgggcgaagcctacgcggcgttccatcaacgccgcacgcccacgctgccgacgccccggctggagcatgcggacatcgccgcgtggctgcgcacccctcctgctcgggaacgggacgaagcccagctcacctactggaagcagaagctcgaaggcgtgccccggcgtgctacggctgacccagtagagca

SEQ ID NO: 6746 - DNA, 774 bp, Myxococcus xanthus
tctaaagccgcccgcgcccagccccacctcggaccccaggcgttcgccgcccggtacgccaacccgtccgtgtgtgaagccgccgcgcggcgcctccagggcgcttcgcgggatgaggcgtgggatggcctgaaggcctgcatcgagcacacgcccttcacccagctcaacgcgctactgggccgcgcctgggcgcaggacctgagggtgcgtcccgaaggcgcgaagctcattgcccgcgtggtggcccagcgcggtggcagcgtgacgggcgagctgcgctacctccaggagaagcagatccccatcttctcgttggcctccgccatggaccggccggacacgtacaagggccgctacgtgctgctgcgcgcgcaggtcgcggaccagcgctcggaaggtgagcgccccacggtgtggctggtggagcaggccctcagctccgtccagacggacgaggtcgtgggctatggcgagcgcatcgactccgtcaccacgtactcgggtgacctggccgggcagtccgtgctcacggggccagggcggatcgggggctcggtgagtacgtgcgaacgctccgggcgaacaccacgcggcgcttcgtggagaacatctccgatgagactggccgcgaggccctcggccgtctggcgagcgcctacccggtgctggagacccggcgcgactacgtcatcctcgcgcgcttcgacggtgtccgcctcacgtctggcggcgcggagacggatgacgaagcgccgcgcatcccggtgctga

SEQ ID NO: 6747 - DNA, 601 bp, Myxococcus xanthus
gaacgattcggccggtatgaacttcaagagcgggtaggccagggcggcatggcggagacgtggcgcgcccggctcctgggtgcggcgggcgtcaccaagtccgtgctcatcaagaaggtgctcccggagtacgccaacgacgaagccttcgtgtccatgttcatcagcgaggcgcgcatctccgccacgctgtcgcacggggccattgcccaggtcttcgacttcgggaaggtggacgggcagtacttcctggccatggagctggtggaaggccagccgctgaaccgcatcctgaagcgggcgctgcgttccggctaccactccctgccggtgcccatcgcggtcttcatcgccatggagatgtgtcgcggcctgcactacgcccatactcgcagtgacgagaagggcgagccgctgggcatcgtccatcgcgacatctcccccgacaatgtcctcatcggctacgagggacaggtcaaaatcgtcgatttcggcatcgcgaaggcgcgctccctgcgcagcttcaacaccgagcccggcgtggtgaaggggaagtacctgttcttctcgccggagcaggcgcggggggaagcagtggatg

SEQ ID NO: 6748 - DNA, 864 bp, Myxococcus xanthus
atggcgtgtggcggcaacgagggcaaggtcacgctgcttctgaccgacgcgccgggagacgacatccgcaccgctgtcgtcaccatctccgaaatctatctgcaaggcggcgacggcaaaggtggccgcgtggtgctgcgtgatacccccgccaccgtgagcttgctggagctcgccaactccacgtctgaactggtgtctgacgcggtggtccccaatggcgactactccgagcttcgcttcgtcatcaccggtggctacatcgaggtggcgaatgaggacggcacctcgaccgtgttcgcgtcgtcagccgactactccggcctgcccgcgggcacgcaggtggccggccaacttcacatgcccagctacggcacgtccgggctgaaggtgaagttctccgagaagctgaccatcgaaggcgagcagaaggtgctgctcgtggacttcgacgtcggccagagctttggcaaggaagcgggcaacgcgggcaagtgggtgatgaatccggtcatcaagtccgccgaggtgacggcctccggcagcatccgcgtgacggcggacacggccgcgacggtgacactgcccgtggtcgacggccaccaggtgacgctgggcgacttcaacgcggtgatgacgaacgaggcgggcagcagtgagcggctggcgctgaccgacgaggacggcgacggcacctacgaggcggtcttcaagttcctcattccgggcaccttcacggtgcacctcgagccgcccgccttcgtcagcgcctccaccacgcccgaccagccggtgacggtggaagtgggttcgggccgcgacgtggcgaatcacttcacgattacgggtgcgacccagcagtag

SEQ ID NO: 6749 - DNA, 1252 bp, Myxococcus xanthus
atgccgggacgctatcgcgtgggttcgggccgggatgcggacatcctcctgtcggaccgggcggtgtcgcgccagcacctcatcctcgatgtgaacgagagcggcgtgcgcgcggtggacccgggctcgcgcaatggctcctattgcgaaggcatgcgcttccaggagctggaggtgcgcacgggcgcggtcctcaagctgggcacctccgagctgaagctgatgccagaaagcgagcggccccgggcgcgtcccttgtccgcgcgcagcgccttcggctcactggtgggaaacagccgccgcatgcgggagctcttcacgctgctggagcggctgtccgcgggcgagtcggacgtgctcatccagggtgagacgggcacgggcaaggagctgtgcgcggaggccatccacacgcacagccctcgggcccgggggcctttcgtcatcgccgacctggcgggcatcgcccccctcgctgctggagagcgagctctttggacacgtgaaaggcgccttcacgggcgcgcactccgaccgcgcgggcgccttcgagcgcgcccacggcggcacgctcttcctggacgaagtcggcgaactgccgctggaagtccaaccccgcctgctgcgcgcgctggagcgccgacaggtgaagcgcgtgggctccaacgactaccgcaccttcgacgtgcgcgtcgtcgcggccacgcaccaggacctggagggctcggtgcaggccgggcgcttccgtggtgacctcttccaccggctcgcggtgctccgcgtcagccttccgccgctgcgggagcgactggaagacgtgccgctgctcgtcgatacggtgctgcagcggatggggcgtcctcccagcgcactgtcggaccagacgcgcgccctgctcgcgcagtacccgtggccgggcaacgtgcgcgagctgcgcaacgtggtggaccgggtggtgaacctgggcgacgaggcgctgccggacatcccggacctgccttccccccccgaggaccccaccaccctgccgccgccttcggacgacccggagagcacgcgccccatctccctggacctccccttcaaggaagccaaggaccgcatcatcgaaggcttcgagcgcgactacctgcgcgccctcatcgaccgctgcgagggcaacgtgtcccgcgcggcccgcgaggcgggcatcgaccgcgtgtacctgcgcaagctgctgcgcaagcacggcctggacacgtcaccggcgtaa

SEQ ID NO: 6750 - DNA, 921 bp, Myxococcus xanthus
aagcaggtcgacgtctacgaagtcggtccccgggacggcttgcagaacgagctgcgcacgctgcccacgcgggacaaggcgcgcctcatcaacgcactggtggccgcgggggagaagcgcatcgaggtgacgtcgttcgtgtcacccaagtggattccccagctcgcggacgccgaggagctgctgcggctggtgggccgtcgcgacggcgtcgtgttctccgcgctggtgcccaacctcaagggcctgcagcgcgcgaagaagcggggcctggaggagaccgccgtcttcatctccgcctccgaggcgcactcgaagaagaacatcaacaagagcatcgccgaggccgtggtgggcgcgcgcgaggtgacggcctccgcgctccaggcgggcatgcgcgtgcgcggctacctgtccaccgtgtggggctgcccctacgagggtgacgttccggtggagcgcgtggtggacatctgccggcagctcgtggacgcgggcatctaccagctcagcctgggagacacgattggcatcggcacgccgcgccagaccgaggtcatcctcgaggcgctgctgaagcacatccccgtggagaagctggcgctgcacctgcacgacacacgcggcaccgcgctggcgaacgcgctcgtgggcctgtccgcgggggtgacgaccttcgacgccagcattggcggcctgggtgggtgcccctacgccccgggagcggcggggaacctggccaccgaggacgccgtcttcatgctccacggcatgggcgtggacacaggcatcaacctggaccggctggtggaggccggggagattgcccaggagctgattggccggaagctggcgggcaagtacctccaggccgcgctgggcgagcgtgagaagaaagccgcccgccgggctcagacgtga

SEQ ID NO: 6751 - DNA, 708 bp, Myxococcus xanthus
atgagagaggacgagtatgaggctgctgccggcccggggggctggaacacccaacagggcttctatgtctatcgggagcgccgcctgctggtcgctggagggtggctcagtctggggtatgcgaccgaggaacactacaggctcgccaggttgaaggtggacatctccaactcgacggatgccgagtgggagatcgatgtcaagaagtcccgagcccggcctccaacggaactggaagagcgcctgagggagcttgcggatgcggtccgcaagctggctcgggaggtgttcgtccacaggggagctcgagtgcggacatcaggtgttcgcgaaatcgatgatgcctgggagtcggtcaccacccgtggtcggcttggctatcgcgttcgtagggagcatccgctcgtgaagttcgtcatcgagcgccagggcagtgatcagaagccgctcaaggcactccttcgtctgctggaggagacggtgcccgtccagcgaatctggctggatgcgtccgagaagcccgaagcccacgctgaagccttcgaaagcgagccgcccgccagggtcgcggaggtgcttggggaactctttaaggctctgcgcgcagatggcgaaacggaggagtccgctcgggagcgcatcctctccatgcgtccattcgctcagtacgcgaaggccatcaacgaattgggctcgaagaagcgctga

SEQ ID NO: 6752 - DNA, 1671 bp, Myxococcus xanthus
cccaccctgcacttcccccccgagctccccatctcgagccgggtggaggacatcaccgcggccatcaccgcccatcaggtggtcattgtcgcgggggccaccggctcggggaagacaacgcagctaccgaaagtcctgctcgccatggggcgcggccgcccgcgccagattggcgtcacccagccccggcgcatcgccgcgacgagcgtggcggcgcgcgtggcacgcgagctcggcacggagctgggcacggacgtcggctaccagattcgcttcgaggaccgctcgtcccggcagacggccgtgaagttcatgaccgacggggtcctgctcgcgcagattcacagcgacccactcctgcgccgctacgacacgatcgtgctcgacgaggcccacgagcgcagcctcacgatcgacttcctgctcgggtggctcaagcgcatcctccccaggcgccccgacctcaaggtggtggtgagctcggccaccatcgagaccgagcgcttctcgcagttcttcgggggggctccggtcatccaggtggagggccgtacctttccggtggacgtgctctacgagccgcctcccgaggacaccgagctcgcagactccgtcgccgatgcggtggcgaacgtgatctcgctcgacccggatggggacgtcctcgtgttcctccccggggagcgggaaatccgcgaggccgagaatgccctgaacgcgcgcgagctccgcggcacggtggtgcaacccctgtacgcgcgcctgtcggcctccgagcagtcgcgcgtcttcgccaccatcccccagcgccgggtcatcctcgccaccaacgtcgcggagacgtcggtcaccatcccggggatcgtgtacgtcgtggacacgggggtggcgcgcctgtcgcgctacgagtcgcgctcgggcaccacgcgcctgcacatcgagccggtctcccaggccagcgccgaccagcgcaaagggcgctgcggccgcgtgcgcgaggggatctgcgtgcgcctctacgacgaggtgagcttcaccacgcggcccgccttcaccgacccggaaatcaagcgcaccgggctcgcgggggtcatcctgcggatgaagtccctcggcctcggtgacgtcgaggacttccccttcctcgacccgccccagccgagggccatcgccgagggctggcgggtgctcgaggaactcggggccatcgagggcaaggagcgcaccttgacgccgctcgggcagcagctcgcgcgcttcccggtggacccgcgcatcgcgcggatgattctcgccggcgccgagtacgggtgcctggacgaggtgctcatcgtcgccgcggcgctcaacctgcaggaccctcgcgagcgaccacgcgagtccgcgcagaaggcggacgagctgcaccggcgcttccgtgacgagcactcggacttcacggggctcctcaagctgtgggcgttcgtgcgcgaggccgagggccgggggacgtcccatctgcggcgcgtgtgccgggacaacttcctgtccttcctgcgggtgcgcgagtggcgggacgtccagcgccagctcgaggagaccgtccgcgagctgcgcataccgcgcaagggccggggcgccccggcgcgcgggtacgtcctgcaccaggcgctcctcaccgggctactttcc

SEQ ID NO: 6753 - DNA, 1107 bp, Myxococcus xanthus
tgcgcagctcctcatggaggtcatgtaatgccgcaccgagtccttgcaatggatggtacgtctatttccggcggtgaagggtatgtcaccgcgggcttgctcaagtcgttgaaggagacgctgaccagccgcggaggcgggcagagcctgctgaacgacgtggagctgttctccggcacgtccgcgggctccttcaacgccgcgttcttcgccacctacgagaaccccgatgacgccttccccaagatcctcgacttctggggtgaggtcgtccagatgaaccgcaaggcggtgtcgctggggcggaccgccatggcgctgacgggcaacgccgcgctgctcgactccagctacatgcgcgacttcttctgcagctacttcggcgccacgttgcgcctgggagacctgaagcggaaggtggcgctgccgtccttccagctcgacggccaccgcaagtcgctgcggacctggaaggcgaagatcttccacaacaccggtccggacaacgactccgaccacaacgagctggtggtggacgtgctgatgcgcagcggttcgcctccgctctcctatcccgtctaccagggcatccgggagcagggcagcggctacgtcgacggcggcatcttcgccaacaacccgtcgctggtggcgctggcgcagatcatcaacaacatcacccgcaagagccgcacggagaaggtggagacgctggagacggagccgcccgacctgacgaacatcctgatgatgtcggtgggcaacggctgcatgtcgtcgtacctcacgccgcacttctgtaagggcgtggccaactggggcttctccaagtggctgctggacttccacgaccccatggtgctcgtgaagatgatgctggaggccggctcggacgcggcggactaccagtgccgcatgattctgcggaagaagtacttccggctgaatcccgtggtggaccagacgctctccgcggcgaacctcaagcaggtggagtccaccgtccagagcctgctgagcacccagtccaccgtctcgcagctcaaccgtgcgcagacgtggctcgggaagtcgggctgggtgtctgacgcggccaaggcggcctag

SEQ ID NO: 6754 - DNA, 1062 bp, Myxococcus xanthus
gtgctttcgttcgacctgtcccgcggcctcagcgccgccatgggcgtcgagagtccgctcttctccggcccccggggcgttcccgtgggcgtcaacgaccacctgtccttccacgaggtggacgttggcgaagagctccgccggggatggaacgggggccagggtggactggccgccctcgtggatggcgggccggagcgcgtgaacgcggaggaggtggcgatgacggtcgaggcggcccacgtcgtcatgctcctccggttgggcgagtacctccacgagcagcagcacgacctcgtcatcgtggattgcccgtccacccgcacggccctgcagttgctcaacaccgtgccagcgatgagctggtacgcacgccagcagcagacccccacgcaggcggggcgcaaggcacgcctgctggcggcgagcctccacggcgcggacgcgagcctggaggttcgcgaccggctgaacgccgtggacgcgctgctgcacgacccggaggtgacgaccctccggctggtgaccaccgcggacacggtggccggacaggaggctcagcgggcgtacacgtacttcagcctgctcggcctggcggtggactgcgtcgtcatcaaccgactcgcaccggaagccgccgacgccggctccgacccgatgcgggcgcagcagtcacacgtggagaagctccagcgcgccttttcgtcgctgctggtgttgaaggtcccgcaccaggccatggaggtggtgggggagaagccgctggaggtcttcgcggagcagctctaccagggcgaggaccccgtccgtctcacggccccgcagcctgccctgggcatccgcaaggacgcagtggatgcgtactcgctggaggtgcggctccccttcgtggcgaagagcgatgtcgagctctcccgccgcggcgcggagttcgtcatccaggtcggggccgtccggcgcaacgtcgtgttgcctcggatgattgcactcctcccgacgtcgggcgcccgcatggagggtgaccggctgatcgtgagtttccagaaagaaagaggtgtttga

SEQ ID NO: 6755 - DNA, 471 bp, Myxococcus xanthus
atgtccacgcaagatgatcgttatccgcagggttcctttggcgcttcgccggagtacggcgctcggttcgccgagctcaccaacgccctgattccgggcgggcgggggctggtgcagcagctcttccgcgcgaagcaggaggcgctcaagggcgtcgcgcaaatcctcgatgcgcagattcacgagctgcagcacatcgacgcggccatcgaggaccgggcgaagcaggcgcacacggctccggcggcgggtcagccgaaccggtccggcgtgtcgtttggcgacgtgctccagaaggcgggggacctgatcctcgcgaagcggccgaaggggacgacgggttccgaggctggcgcccggcccagtgaccgccgtgcgcctccggagagcgctacctctccggattcaagcagcccggcctctgcgtccagctctgcaccggaaccgctggaaaagatctccatcagctag

SEQ ID NO: 6756 - DNA, 777 bp, Myxococcus xanthus
atggagtcgatgacgcccttgcaacgggcggcattggccatcaagaccctccgggcgcgcgtggatggattggagcgcgcgcgctcggagcccatcgccgtcatcggcatggggtgcaggttccccggcggcgcgaacgacccgcgcgcctattgggagctgctgcgcggcggcgtggatgccgtgagcacggttccgccggaccgctgggacgtggacgcgtactacgcggcggacccggacgcgggctggaagatggtggtccgtgagggtgggttcctcaaccaacccatcgccggcttcgacagtgagttctttggcctgtcgccgcgcgaggcgaactacgtcgacccgcagcagcgcttgatgctggaggtgtcgtgggaggccctggaggacgccggaatcgccccgggctccctggtgggcagcgacacgggcgtctatgtcggcttcctgagcagtgactacgggcgcgttcccttcaacgcggtgcagacacgggacctgccgtacatggggaccgggaacgagctgagcttctccgcgggacgtgtgtcctacgtcctgggcctccaggggccgtccatggtggtcgcgaccgcgtgctcctcggcgctcgtctccgcccacctggcctgccaggcgctgcggcagggggagtgttcgcttgcgctcgcgggcggggtgaacgtgattctccggccggacaacaacatcgtcctgtcgaagatgcgggcgctggcgccggatgggcgctcgaagacgttcgatgca

SEQ ID NO: 6757 - DNA, 582 bp, Myxococcus xanthus
gcgctctatgacgctttcgcccagggccagccgtcgccgctgcctgtgttgccgctccaatatggggactacgcgtcctggcagcggggcaagcttcgcggtgacgcgctcgacgcgcacctggagttctggcgcaagcggctggagggcgcgccgcatgaactggagctgctcacggatcgcccgcggcgctccgcgaccggacgggctgctcagcgcagggccttgttgcccgtgtcatgggtggaacgcctcgagtcgctggcgcaggccgaaggcgccacgttgttcatggcagtgctggcggggctccaggtcctgctttctcgttacaccgggcagaaggacctgctcattggcgcctcgcacacgaaccggggcaggaaggagacgaaagggctggtgggcctcttcgccgagtcgcttgtcctgcgagcggacctctccggccggccgggctaccgtgaactgctgcgccgcgcgaaggcggacaccgaggaggccttcgcgaacgcgcatgttcctttcgaaccgctgctgagtgcactgggcgtggagcaggacccgacgcgcgcaccgatg

SEQ ID NO: 6758 - DNA, 99 bp, Myxococcus xanthus
atgttcctgctgcccggtgagctgcccgcgaaggtacagccctccgccgccgtggtccccggtgggggcatggtgggcctgtccgggacgttgccttga

SEQ ID NO: 6759 - DNA, 1341 bp, Myxococcus xanthus
atgtacaccgagtcactccgcgcgttcctcaagcccgtcctgccctacatggatgacgaggccgtgtcggaaatcatgatcaacggcccgaccgacatctggattgagcgcaagggccggctcacgaaagtggatgcatcgttcaccgacgaaggcctgctcggcgccgcgcgcaacatggcccagttcgtcggccgcatgctcaacgaagagcgcccccgcctggacgcgcgccttccggatggcagccgcatccacgtggtgattccgcccatcgcgcgcaagggcaccaccatctccatccgcaagttcttcaaggagaagctgacggtccaatccttgatgaagttcgggtcgctcacgccgcagatggcgcgcctcatcgaggccggcatcgccaccaagctcaacatgctggtggccggcggcacgggctccggcaagacgacgctgctcaacatcgtgtcgtcgctcatccccgacgaggagcgcatcctcaccatcgaggactcggccgagctccagctcaaccagtcccacgtcgtgcccttcgaaagccggccgcccgacaagttcggcaagggcgcggtggacatgggcgatttgctccactccgcgctgcgtctgcgccccgaccgcatcgtcgtcggtgaggtgcgcggcggcgaggccttccacctcatgcaggccatgaacaccggccacggcggctcgctggccaccacgcacgccaacacgcccacggacacgctgcgccgcatcgagtcgctgtgcctcatgtccggcgtggagctgcccatggtggccgtgcgcgcccaggtggccagcgccatcaacttcatcatctgctgcgagcgcctccacgacggcagccgcaagacgattgccctgtcggaggtgctgcccctcaacgagaagggcgactaccgcacccaggacatcttcgtcttcacgcccgtcaccaaggacgaggacgaccacatcctgggctaccacgcgcccaccggcatcatccccaacttcgtcagcaaggcgcgcgcgtacggcttccacgacctggacgagtccttcttcgacccggccacctacggcctgccgccgccgcccaccttccacgcgggcgagtcgtactcggtgcgctgggccccgtccctgaagcaccgcgagcagggaaggccagacccggaccacttcaagcaggagtgggccgccttcgagcagcgcctcaagcaggacgcccgcgacgcgaaggccggcaaggccgccgccgcgccgcctccgcctcccgcgccggccgtgcaggtgcaggtgcccgcgagtcaccccaccccgccgccctag

SEQ ID NO: 6760 - DNA, 483 bp, Myxococcus xanthus
atgctcagcctgcactccgactcgcgtggcaccgccacgctatggtctccaaatccggaccaggagtgcaaccggcaggactccgcccctggcttcaccgtgctctggtccgagtccgcggaagccaccgcgctcctccacgccggccgcgcgggcctggcgcgctcgctggcgcaccggctgggccaggcgggtttcccgccctatgatggcgtggactacgaaggcctctacgccatcgactccgagcaccccggcgtcttcgtggcccgagagcccacgcacaggcagatcttcgtacttcgaaagccgcgaatcccctccgtcatcatcgagacccaccatgcgctcgacttcgaggaggccgcacggtggagcgagcagcggacgctggaagccttcgccgccgccgtggcccagggactcgtggatgcgctcgcgcccgaagcgcccccccagccacgcacaacccgcccccgctga

SEQ ID NO: 6761 - DNA, 729 bp, Myxococcus xanthus
atgagcttcttcggagagctctaccttcgcagcacgctgccgttcctgtcggaggccgtcaccgcgcgtgaggcggactacctggcccgagccttcgcggacgtggcggggccggcgccggtggtggacctggggtgcggccatggccgccacgcggcgcggctgaacgcggtggggcctctggcggggcgcgtcatcgggctgaagttgcacgcactgtcgttggccatccggcgcccgggcttcccggcgatccagggggacctgcgggccctgccgtttcgcgaggcgtccctggcgggggcctacgcgtggtactcgacgctggccgccttcacggacgccgagcacaaccacatcctccgcgaggtcgcgcgcgtgctgcggccaggaggacggtgggtgttccagacggtgccgttcgagcgactggcggcgtcccccggggcggccttccgcgagacgctgccggatggaagcgtcctggaggaggagagctgcttcgacgcctcgacggggcgggacgagggacgtcggacgctgacctccccggagggtcgatgcctgcgcgcatcctattcccttcgttactatccccttgcggattgggtgcggctgttggaaagcacgggattttccgtcgtctgggtgcacggtggcctggcgggtggtccgctggacgcgcagtcaaccgacctgatcgtgggagcggagcggcgccatggctga

SEQ ID NO: 6762 - DNA, 111 bp, Myxococcus xanthus
atgcacctcgttcctccggactggaaggacccggacacataccggaacgtggactggttgaagctgctcgtgcggcgccacggcgcgctgacggtggttgaaccggcgcat

SEQ ID NO: 6763 - DNA, 1293 bp, Myxococcus xanthus
gtgaaggcgtacgtggtggctccgggagaagaggaaggggccctgaaggagtacgtgaggcagaagctgccggagtacatggtgccgtcggtggtggtggtactggaggcactgccgctgacgcccaatggcaaggtcgaccgcaaggcattggctgctaccgacctgcagtcgcgcgttgccatcgagtccttcgtcgcgccgcgcacggaggccgagcacgcgctggcgggcatcttctcggaagtgctgggtgtgccccgtgtcggtcttcatgacgacttcttcgaactgggaggccactcgttgttggcaacgcaggtcgtggcgcgtgtccgtacggaactgggcgtggacatgccgctgcgcgcgctcttcgaggcgcccacggtgttgcggctcgcggtctggttgcaaggctcggacacgacgggggccgcgcgtgactgtgtggcattgcagcccgaaggtaccggcacgcctgtgttcttcgtgcacgccgtcggaggcgcggtggggccgtatcgtgcgctggctcggcgcatgggacgcgagcggcctctctacggctttcaggccgcggggctcgatggacgcgagcctcctctggagcaggtggaggcgctcgcccgccgctacgttgaagcaatgcgcgagcgtcagcccgagggcccctatgtgttgggcggctggtccctggggggcgtggtggctttcgagatggcgcgcgagctggagcgtctggggcagtccgtggcgctcctggtgttgctggatagcttcgctcccgacgagaacgcgcctacgcgggaacccgatgcggcgttgctgctcgcgggaatggccatggacctggcacggacggcaggtgtcgagtccaccctacgtccggagatgctctcgggcctgaccgaagaggagcaattcaccgccctcgtcgagcatgcgcgacaggccgggtggctgcctcccgaggtcgaggcgtcaacgctccgtgcctggcgtgatgtgactcgcgcgaacctgcgggcgttggcggcctaccgtcccggccccgttcggtgccccgtgctgttgctgcgtgcgaaggatgcgcaacgctcccgggcggtggagccgtcccacgggtgggcccgctgggggctatcgggtctcaccgtggaggacgttccgggggaccactacagtgtgctcagggagccgcaggtggagacgctggcgcgccgccttgtcgaacacgtcggtgccgccactgggcggcacgaggcggcggggcagcaacgcgaggggtga

SEQ ID NO: 6764 - DNA, 234 bp, Myxococcus xanthus
atgctgcccagcgtgcatacgctgctgaagctgtgccacgagctccacgtctcagcggatgagctcctggggctctccgcgaacgccgtcaacgggggcgcgcgtcccggtgagccgcccacctcgccgcaggagcgccccgaggtccggcgcctgctgcgcaccgtgcgtccgctggagcccgcgaaggtgaagctgttggggctggtggccaacgcgctgaaccgccgctga

SEQ ID NO: 6765 - DNA, 1113 bp, Myxococcus xanthus
atggcggtcggccggaatttgctggtgaagctgtgcgtggcgatgggcgtggtggcgctgccgctgctcgtcgtcatcctggggttcgtcttgccgcagctgcgggagcagcttcgcgcggaccgcatcctgggactgaggcaggcggtggagacggcctacggcgtgttggaggtctacgaggcccgtgagcggtcgggcgcgctgacgcgacaggaggcccaggcgcaggccgcggcgctgctggagcaactgcgctactcacaggtggagtacttctgggtcaacgacctggacacgcggctcgtcatgcatccgcacctgccggacatgctgggcaaggacctgaagggctaccgcgacgtgcgcggcaagccggtgttcgtggacatcgtcacgctggcgcgggcccagggccagggctcggtgtcctacgaagccacgcggccgggctcgccggaggccattccgaaggagagctacgtgaagctcttcgcgccctggggttgggtgctgggcacgggcgtgtacgtggaggacatcgagcgcgaggtggcggcggtgcgccagcgcatcctcctggcggtgggcggcgcgctggcgctcgcgctgatggccggtgcatatctgtcgcgccgggtggtgcggccggtgcgggagctggcgcaggcggcgcaccgggtggcgcgcggtgatttggaggcccgggtggaggtgcgctccacggacgaggtgggccagttggcggcggccttcaacaccatggtgacgggactgcgcgaggtggtggcggcgctggtggatgcggcgggcgccacggcggcggacgcggagcgcatccgaacctccgcggatgcgttgtcggtgacgacgcgggagcagtcggactcactccagcgcgcggcgcagacggtgcagggcatgagcgcgcgggtgtcgcagggagcagaggcggcgcgcacggcggcgaagacggcggcggacaacggccaggtggcgcgcgagggtggcgcggcggtgggccaggcgctgcggaagatggcggaaatcgtggaggtggtggagggctcggcgcggacggtggagcggttgcaggcctctggccgggtgacg

SEQ ID NO: 6766 - DNA, 1374 bp, Myxococcus xanthus
ctcaagctgccggacatcagcggctacgaggtctgcgagcggctgcgcgccaatccccagaccgcggccatggcggtgctgcacacctccgccacattcgtcacctccgacaagaaggtgcgcggcctggacggcggcgcggacgcctacctcacccagcccttcgagggcgcggagctcatcgccacggtgaagtcgctgttgcgcctgcgccacgcggagcaggtggcgcgccaacgcgccaacgcgctggcggagatggaccgccgcaaggacgagttcctggccatgctggggcacgagctgcgcaacccgctggccgccatcatgacagccattggcatcctggagcgcaggcccaccagcgatgacaaggaagcgcggatgcgcggcatcatccaacgccagacaaaccacttggcgcggctggtggatgacctgctcgacgtcagccgcatcacccgcgacaaggtggagctgcgccccggcagcgtggacctggtgcccgtgctgcggcaggtgctccaaatcgtgcagcccatggcggattcgcgtgggttgggtttggacgtctcgctgccttccggtccgctctggctgcaggcggatgccacgcggttggagcaggtcttcaccaacctgctcgacaacgccatcaagtacaccgacgcgggtggcgtccacctgcgcgcggaacaggaaggcgtgggcggcgcggcccaggcggtggtgcgggtgaaggactctggcatcggcatcccgccggaggtgctgccgcacatcttcgagctgttcgcgcaggcggacacctcgctggagcgctcgcgcggcggcctgggtattggcctgacgctggtgcgcaagctgatccagctccacggcggcgaggtgacggcgcgaagcaacggccccggccacggcagcgagttcgtggtgaagctgcccctggaccacacgatgggcaagtccgcgcccgcgcgcgacgcggtggacctccgccgcggccggcgcgtcctggtggtggaggacaactcggacgcgcgtcaggccatgcgcgacctgctggagctgtggggccaccaggtggcggtggcgccggacggcctccagggcgtggcgctcgcgatggcgcagccgcccgagctggcgctggtggacatcggcctgccagggttggacggataccgggtggcgcagacgctgcgcgcccaggtgggcaacggcatccggctggtggccatgacgggctacggcagcccccatggacgggaccaggcactgcgcgccgggttcgaccggcatctggtcaagcccgtgaagcctgacgagctggaccgaatcctctccgagctgtgagggattgaagcggcggag

SEQ ID NO: 6767 - DNA, 486 bp, Myxococcus xanthus
ctggcggcggaggtgctgcacgagctgcgacaaccgctgctcggcgtgaaggcctacgcccaactcctcgcggaggacggcgccgcccccgggcccctgcgcctgctgctggcccaggtggagcggatggagcagatcgtctccgacttcatccgcctgtcgagcgagcgaccggcgtcccaacagcgcctctccctggcggcccccatctgggcggcggcgaagcacttcagcatcaacccggactcctcgcgcatctccctggaggtggaagccccggaggacatcaccatccagggcaacgcgcgcctcattgaacagctcaccctgaacctgctcaacaacgcgcgcgacgccatggaggggcgcggccgggtgaaggtggtgctcacgatggagggcccctcccctgccctctacgtggcggactggggtcccggcatccccgaggagctgcgagcgcgcatcttcgagccctacatcacc

SEQ ID NO: 6768 - DNA, 393 bp, Myxococcus xanthus
atgccgcagaccaacccgttccactcgctggtcccccgcaagatgacggacaccgagctggcccgctccatccgtctcaacatcgaggcggagctggacgccatcaacctctacgcggcccatatcgacgcgacggacaacgaggacgccaaggccatcctccagcacgtcatggacgaggagcgcgagcacgccgccctcttctgggagctcatcgcccggttggatccagagcaggccgcgcacgcgaaggaggccgtggagaagtaccggctcattacctccggcgcgtcgcacgaggccgtggaggccgtgggcaaggagggcgcggcgccgtctccggcggacgtcaccccggagaagcgcctcaccgtgggcagcctgcgccggtag

SEQ ID NO: 6769 - DNA, 1374 bp, Myxococcus xanthus
atggcgcgaatcctcctcgtcgacgacgaaaagatcgcccgcaccctgtacggcgactacctcaccgccgtgggacacgccgtcacggcggtgggcacgctacaagaggcaaaggaagcactcgcaggcgaccgtttcgacgcggtggtgacggacctcatcctccccggtggtgacggcatggaggtcctgcggcacgtgcgggaacatcacccgggcgtggaggtggtggtcatcactggcctggagaaggtggaccccgccgtgcgcgccatcaagagcggcgccgcggagtacctcgtcaagccggtggccccggaggccctgcagcacgccgtgcgccgagcgctcaccacgcgcgacctgatgcaggagaacgcgtcgctgcgccgccatgtggccatgttggaggcggggcaacgcatcgccaccaccctggaccgcgagaagctggcctcggccaccgccagcgcgctgcagagcatggcctccgccagcgccgtggtcctgctggagcgcgactctgccttcgcgctgcggcgccacggcaccagcggcctgtccaccgcgctggaagagccgctcatcgccgagctcatcgaacgcctgacgaacgaacgcggtccgcgcgagctggacggcatggacgcgccctttcctcgcgcaatctccttccccgcgctggagggtgacgccgtgctgggacacgcggtgctcttcttcggcggcacgggcgcggagtgggcgggcgagacggccagcttcctggttcgcaactgggcgctcgcgctgcgcaacctcggccgcttcgccgcggtggaggacctggcgtacgtcgacgacctcacgcgcctgttcaacacccgctacctgcacctggtggtggaccgcgaggtccaggacgcgctccagtcacagcgcaccttcagcctgctgttcctggacctggaccacttcaagtccatcaacgatacccatggccacctcgtgggctccaaggtgctggtggaggcggcgcgcgtggtgaagggctgcgtgagagaccacgacgtcgtcgcgcgctacggcggagacgaatacgtggtggtgctgcgcaacaccgactccggcggcgcgctcaaggtggccgagcgcatccgacgcaccatggagacgcacaacttcctggcgcgcgaaggcctgtcgctcaagctcaccacgtgtatcggcgtggccagcttccccgagcacgcccaggacaaggccacgctgttggacctgtcggaccgggccatgtaccgcggcaagcggggctcgcggaacgtcgtctacatgcgggcgaaggacctgaaggccccaccggccgagcgccggcaggcccactccgcgtcctga

SEQ ID NO: 6770 - DNA, 720 bp, Myxococcus xanthus
atgccgggcgccaacggcagcagcctgcggggtgtgctggaggtgaaggacctctgcgcgctgctgggcgggccgcccgagcaaggcccgggcatggtggtggtgctcgacgtgagtcccaccctggcggtgcgcgtgcgctccgtggtggaggtggcggacgtggcccgcgcgccgttcttcctgctgccaccgggattggcggactcgctggctccgctgagccggggcgccgtgctgcacaagtcgcggctgtacctggagctcatcgcggaggcgctgccgcaccgggtggggtcgatgtcgccggcggttgccgcccggcccgtgcactgggcggaggcggctccggaccgcgcgctcgtcttcgagtctcagagtcgattgttcggagtccccctgggtctggtgtcgcaggtcatcagccggggagaggccttctgcgtcctgcccgtgccgagtggaccggtggctggtatttttccgcatgatcaggtgctgtggcccgtctgctcggtccccgcgttgctgggggaagcgcccgtgccggaatccttcatcgtcctcacggaactggccgggcggaacgtggggctgacggccacgcgggtgctcggcgtcatgcaacgattcgagccggacgacaccgcggggagcttccgtgctcccgggttgagcgagcctgtggcgttcctggacctgcaacgcatgttttcttga

SEQ ID NO: 6771 - DNA, 1263 bp, Myxococcus xanthus
atgcccaagaatctgctggtcgccgatgactcgctcaccatccgcaaggtgatcgggatgatcttcgcgaccgaggactttcaggtgaccgcggtggacaacgggctggacgccatctcccgcacccgcgagctgcgtccggacgtcgtcctcgcggacgtcatgatgccgggcaagagcggctatgaggtctgcgaagcgctgaagaacgacccggccacccagggcatcccggtggtgctgctggccggcacgttcgaagcgttcgacgagaatcgcgctcgcgccgcccgcgctgatgaccacgtcaccaagcccttcgagagccaggtgctgctcgacaaggtgaaggcgctggtcggccagaagtccaacacgatgcccgcgtcggccgccacgcaggtgcgccacgcggctcctcagcccgccgcggcgcccgcgcccgttgccgccgctgctccgccgggggcccgtcccgcgcctccgccgggggctcgtccgggtgttcctccagggccgggcgtgccgcgtccgccgggcgcgggtgtgccgccgccgggcgcgcgtcctccgggacctgggatgccgccaggcatggcgcgtcctccggggccgggaatgccgccgccgggtgcgccgggcgcgccgcgtcctccgggacctgggatgccgccgggcatggcgcgtcctccggggccgggcgtgcctccgggcgcgcgtcctccggggcctgggatgccgccgggcgcccgtccgggtgtgccgcctccgccgggtggtcccgcgccgggccttccgccgcgtccgggaatgccgccgggcgccgtggcgcgtccgggcgtgccgcctccgccgggtggtcccgcgccgggtggcttcgcgcgtccgccggttggcgcgccgcagcctcctcctggagcggcgccgcagcccgccgcgcggggcagggatccgttcgggttgggggcgcccgcgcccgccgcggcccagccgtccatcagcatcgaggactcgctgcccgaccagggtgacgcggaggagatctcgctggacatcgccacccccgcgcccgtcgcggccaggccggcgagcgcccgtgcgcctgccgcggatgggggcgaggccctgctgcgcgaggcgctttcgaaggcttcccgcgaggtcatcgagaagattgcctgggaggtggtaccgcagttggcggagaccatcatccgtgaggagctcgagcggctcatcaaggaccgagagacccagcactga

SEQ ID NO: 6772 - DNA, 1197 bp, Myxococcus xanthus
acgtccatgtccaggcccgtagccgcgcagcgagtcacccggttcgccactactgtcttctccgagttcagcgccctggccgcccgccacggcgcggtgaacctggggcaggggttccctgacttcgacggcccggcggccatcaaggaagcggcgcagcgcgccatccgcgacgggggcaaccagtacgccatgggcgcgggcgcccgggagctgcgcgtggccatcgccgagcactcggcgcgcttctacggccagacggtggacccggacaccatggtgacggtgaccagcggcgccaccgaggccatcctcgacacgctgctggggctggtggacccgggcgacgaggtggtggccttcgagcccttctacgactcctacgacgccaacatcaccttcgtgggggccaccgcgcgcttcgtgccgctgcgcccgccggacgcggaccacgcgcagtggtggttcgaccgggacgaggtccgcgccgccttcagcccgcgcacccggctgctcatcctcaacacgccgcacaacccgacggggaaggtgttcacccgcgatgagctgacgttcctgggcgagctgtgcgccgagttcgatgtgaaggtcctctccgacgaggtgtacgagcacctcgtcttcgagcccgcgcgccacctgcgtccggccacgctgcccgggctggccgagcgcaccgtgacggtgagcagcggcgggaagacgttcagcctcaccggctggaaggtgggctgggtcatcgcgccgccgccgctgcgggacgcggtgcagcgggcccaccagttcgtgaccttcgccaccgccgcgccgctgcaggccgccatggcggaggcgctgcggttgccggacgcgtacttcacggagctgacggcgtcctacgcggcgaagcgggagcggctgctcaccgggctgcgcgaggccgggctgacggcgttcgccccggagggcagctacttcatcctcgcggacatcacgcgccagggcttcgccgatgacgtggccttctgccgccacctggtgtccaaggtgggcgtggcggccattccgcccagcgtcttctatggcccggcgcaccggcacctggggcaggggctggcccgtttcgccttctgcaagacggatgcggtgctggacgaagccgtgcgccgcctgcgcgcgggcctgtcgccgcgatga

SEQ ID NO: 6773 - DNA, 126 bp, Myxococcus xanthus
atgaccgataccactgaactttcgaaggcctacgagcccaccgaggtcgaggctcgccgctacgcgttctggctggagcgcaactacttccgcgccgaggcgccctccgacaagccgccgctttag

SEQ ID NO: 6774 - DNA, 1476 bp, Myxococcus xanthus
atgtcggtggaggtgccgcccctggcgcgcgcgctcacgggcgagtgggtggcggaggcccgctggcgggtgcgccggccggatgggacgcacgtcctgctgcgcgcctccgcggtgccgctggagcacgacgcgggcccgacggctggagcgctgcttcgcgcatgtgaggtggcctcggccgtggggttggacgcggtgggctcggcgcggctgctggcggaggccggtgcgctgctgggcgccgcgttcgacgatgaggccgcgccgcggttgctccgcttgctggtgcccgcgctcgcggacgcggcggtgctgtacctgggccagcccggcgggccgccgcgcccggtgacggcgctgcacgccgagccggagcgccatggcctgctggaggagatgctgcgctgctacccattgccgcctgagcgcgtgctgccgttgttcggcactggccagtcggagcggttgcgggtgacggaggcccacgtggaggccaccgcgcgggacgcggagcacgcgcggctgctgcgggggctgggcctgcgctgctacctgggcgtgccgctggtggcgcgcgagcgcgtcatcggcacgctggccctcttccgcgcggatgaagcccgtgacttcagcgcggaggagctgcggctggcggaggaggtggcccgccgcaccgcgctctccgtggacaacgcgcagctcctccaggaggcgcgcgaggcggtgcgcctgcgcgacgagttcctgggaatcgccagtcacgagctgaagacgccgctgacgccgctgcacctcaaggtgcaattgctgcagaagcaggtggatgggatggcggcccacaaccagccggtgtccgccgagcgcgtgtcggagacgctggaggtggtgcagcggcaggtgcgcaagctgacgagcctggtggacaacctgctcgatgtgtcgcgaatcaccgcgggccgcctgcggctggaagtggaggagatggacctggccagcgtggcggcggaaatcctctaccgattcgcgccctccgcctcgcagttgaagtgtgagctggagctgcacgcgccggtgcccgtcatgggccggtgggaccggctgcggctggagcaggtggtgaccaacctgctgtccaacgcgctgaagtacggcgcgggacaccccgtgcgcgtggtggtgaaggcggaggggctcaccgcccgcctgacggtgcgcgacggcggcatcggcatctccacggaggatttgccgcgcatcttacagctcttctatcgcgcagtgtgtgacaggcactacggcggcctgggcctggggctctacatcacccggcagattgtggaggccttcggcggcacggtgcgcgccaccagcgagccggggcagggctccctcttcgtgctggagctgccgcgcggcgacatccccgaggaatggctgacggcgcacggcgcgccggagccgtcgtcgtcctga

SEQ ID NO: 6775 - DNA, 342 bp, Myxococcus xanthus
atgcagaagccgcactccacgcctgactggacctccaacgagcaccgttaccgaggtgtcatcgacagcctgcgggaagtggtgttccagacagacctggcggggacgtggaccttcctcaacccggcctggacggacatcaccggcttcagcgtggaggagagcctgggccgctccttctcggatttcctccacccggatgaccgggagcgcgacccggagccgctccagaaactgttcgcgggggaagtggagttcgtgcgccatgagatgcgctacctcacgcgcgacgggagctaccgctgggtggaggtgttcgcccggctgatgcacgacgacgac

SEQ ID NO: 6776 - DNA, 288 bp, Myxococcus xanthus
atgtcattggaggccgcggagacgcacgtgctgctgagcgtgcgcgacgagggcatcggcatccctccggagaacgtggcggacctgttccggcccttcgcgcgcgcgtccaacgcccaggcgcgccacttcggcggactggggctgggcctcttcatctgccgcgaaatcgtggagcgccacggcggcgccatctgggcggagagcccggggccccagcgcggcagcagcttccacgtgcggctgccccgccgcgccgagcccgcggcatccgcgagcgcggcctag

SEQ ID NO: 6777 - DNA, 549 bp, Myxococcus xanthus
gtccaggcgggccaggacgtctacgccaccctcgaaacgaaccagggcgccatcgtcgtgcgcctcttctccaaggatgcccccaagacggtggccaacttcgtgggcctggccacgggcgagaaggcctggacggacccgaagacgggccagcgcgtggagggcaagccgctgtacgacggcgtcatcttccaccgggtgattccgggcttcatgattcagggcggcgaccccacgggcaccggccgcggcgacccgggctaccgcttcgaggacgagttccagagcggccgcaccttcgacaagaagggcctgctggccatggccaacgccggccccggcaccaacggcagccagttcttcatcaccacctccacgccggactacctcaacaaccgtcacaccatcttcggtgaagtggtgtcgggctacgacgtggtggagaagatttccaacgtgcagcgcgacccgcgcgacaagcccctggagccggtcgtcatccagaagatcgcgatgagcgaccaggccccggccggcagcgggaactga

SEQ ID NO: 6778 - DNA, 651 bp, Myxococcus xanthus
cccgaactggtcgtcgtcctctcccatggcctgggcgcgcccgccaccgacctggtgcccctggggccggagttgatggcgttccagccggcgctggcggaccgcgtgcggttcgtcttccccggcgggcccatggcctgggcgcacggagggcgcgcctggttccccctgcccgacgcggtgatgcggggggagcagcgcgactgggagcagttcgcgcgcgacgtgccgccgggcatgcccgccgcgcgcagggcgctgatgagcaccgtggacgcgctgtgcgccgcgatgaagctgccctacgggcgcatcgtgctgggcggcttcagccagggcggcatggtgtccacggacgtggccctgcgcctggatgagccgcccgccgggctgtgcatcctctccggcacgctgacgtcggagccggagtggcgcccccgcgcccagggccgcacggggctgcccgtgttccaggcccacgggcgctacgacccgctgctgccccttggcagcgccgagcggctgcgggacctgttcgtggcatcgggcctcaccgtggacttccacgcctacgacatgccgcacgccatcgtcaccgaggaactggaggccctggccgcgttcctcgccgcgcggctgggaggacgctga

SEQ ID NO: 6779 - DNA, 414 bp, Myxococcus xanthus
atgttccacgcgaaggagctcacggtgtccagccggggccgcggcttcaccgacatcaccgcggacgtccagcgcgccgtcgcggagagcggcgctcgccaggggctgtgcaccgtgttccttcatcacacgagcgcgtccctgctgctgtgtgagaacgcggacccggacgtgcgccgggatttggagtccttcttctcgcggctggtgaaggacggagacccgctcttcgtccatgacgcggaggggccggacgacatgcccgcgcacgtgcgcaccgtcctcacgcagaacgcgctgaacatccccgtgaaggacggccgcgcggacctggggacgtggcagggcgtctacgtctgggagcaccggacctcaccgcaccggcgccgcgtcaccgtgtccgtggtgagctga

SEQ ID NO: 6780 - DNA, 1947 bp, Myxococcus xanthus
gccgacgttgagtgtgccgccgttcctccgtaccgtgttaggtccatgcgccgttggcttccgctcgttctgctgctgcctggaattgcctgcacgccgcctcccggcccggaggacacctcgcccgatgcctctctggcgagagtggccgcgccccggggcgcggaggaacgcggtaacacaccgagtgtatctgtgtcggcatccagggccgcggtgttcgacggcggcgctggcccagggacgccaggggacggcgtggaggtccgcgcacctcacgccgatagcaacgctcctggggacctccccgcggatgcccggcgcacggcagcggatgcgctgttcgcggcgtggcagcgcaccgcggcggatggggggactgacggcggcgttgatggttcggccgaggcggcgctgtctccgccgctccgcacgcatgacgatggggcggccgaggcgcgcgacgaggtgccggcgctgaccatcgaccccgcgctggacgaccttgcccagtccgaggaggaagaggacacgccgggcggagaggagctccccctgcccgagcagctcacggtcatcccggatgaactgcacccgggcgaggaactggtgctcggcccggacggcgagccgctcgaggacacggggttggtgctcgaagacgtcgacccaggactggagcccgtgagcggcgcggatgacggagggacgtacgccgtgcccttcgctccggacgcgggctcgctgcgggtgcgccgctccatcgtggtccgccaggagcctcggcaggacgcaccggcactgggcaccgtggcgcaggacatgcgcgtgcgctggcagggcgaaacggcggtgcgcggcccggactgcgaggcgtggattcagattgaaccgcgcggctgggtctgcgagcgctacctggagcccaacttccgcgagccccgcgtgcgcgaactccccaagctgcgcgagggcgagctgacgcccggcatctacgcccgtgtcgtaggcaagcgcgtgcgcgcctatcccagcctcgccctggcgcgcgcccggcgaaagggcgtgctgctgaagggctccgtatccgtacagctccgcgggcaggtccgcatccgccgcaggacgtactggcgcaccaccgacggccagtacctggaagcgcgggtgctgcgcgagtaccggccgtcctcctacgaaggcgtgaacgcggaggccatcgccgagctgccgccgacattcgcctgggcccagtcccgcacgcgccccttcgccgccgtggaagtacggacagcgccagacgcgaaggccgcccgcgaaacggtgctgccaccacgcacgctggtggcagtgaaggagctgtccgaggacggccactgggtgagcatcgcggaggaccaatgggtggcgcgagacgacctgcacgtcgcctggttctcacacgcgccgccgcaggtggagcccggctctcgctggctggacgtggacctggatgcccaggtgctggtggcctacgaaggtgagcggccggtgtatgcgacgctcatctcctccgggaagcagggcacggacacgccggagggcctgttccgcatctggatcaaattcgcggaggccgacatgacaggcagcggcaccgccggcaacgacacctaccgcgtggccacggtgccctggaccatgttcttccaggacgactacgcgctgcacacggcctactggcacgaccgcttcggccagcccatgagccatggctgcgtcaacctgtcgccgaaggacgcccgtgcgctctatgcctgggccgcgccgcaggtgcccgtcggttggtccatggtccacgcgacggaggacgcgccgggctcgtggattcgcatccgcggtcaggcccggccgacgggcaagccgcgcagggtggcggtcgccgcgacgcaggggggcgcgccgtag

SEQ ID NO: 6781 - DNA, 1401 bp, Myxococcus xanthus
atgagcgttctggcggcggtggtgctgtgcgcgggcaagggcacgcggatgaagtcggagaaggcgaaggtccttcaccccatcctcggtcgacccctttgcgcgtatcccctcaagcgggcccttgaactgggcgccacgtcggtggtccccgtggtgggccaccaggcggaagcggtggaaaaggccgtccgaggcctcttcccggatgcccccctgcgcttcgcgctccagcgcgagcagcgcgggacggcggacgcggtgcgctccgcggaggaggccctgaaggggtactccggacgggtcctcatcctttacggcgatgtgccgttgctgcgccgcgagacgctggaggcgctgctggccgcccatgaccaggcgggcggcaagctggccatggtgaccaccaccctggaggaccccacgggctatggccgggtcatccgcgacggtggcaaggtgacgcgcatcgtggagcacaaggactgcaccccggagcagcgcgcggtgcgcgagtgcaacgccggcatctactccgtggacgcggacttcctctggaaggcgctggctgaaatcaaaccgcagaacgcccagggcgagtactacctcaccgacctggtggagatggccgcgaagcggggcccggtgggctcggtggaggcggacgccacggagacggccggcgtgaatgaccgggtggagctggccgcccgcgcgcgcgtgctgcagcagcgcatcaacgaggcgcacatgcgcgccggcgtctcgctacaggaccccgccaccgcctacatcgaggaaggcgtcaccgtggggcccgacaccgaaatcggtccctccgtcacgctggccgccggcaccgtggtgggcaagggctgcaccattggccagggcagcgtgctgcacgcctccaccgtggcggacggcaccgtcatcaagccttactccgtgctggaagaggcccgggtgggggagcgcaacgtcattggccccttctcgcggctgcgcccagggacggagctggccgaggacgtgcatctgggcaacttcgtggagacgaagaaggcccgcatcggaaaaggttcgaaggccaaccacctcacttacctgggggacgctgtcattggttccgggtgcaacgtgggggcgggcaccatcacctgtaactatgacggggtgaacaagcacctgactgagctgggggatggtgtgttcatcggctccgacacccagctcgtcgcgcccgtgaaggtcggcgacggctcgtatgtcggcgcgggcaccacggtgacgaaaaatgtgcctccagggagcctcgctgtgtcccggacgccacaggtgaccaaggaaggttgggtggccaccaagaaggcgcggcaggcgaaggcgcgggcgggatag

SEQ ID NO: 6782 - DNA, 1671 bp, Myxococcus xanthus
ggcgcggtggccacggcctacccgcaggcgagcgcggcggcgttggagatgctggagaagggcggcaacgccacggacgcggcggtggcggcggccttcgtggcggcggtggtgggtccctaccactccggcgttggcggcggcggcttcgcattggtgcacgacgccaagagcggcgacacgaaggtgctggatttccgcgaggtggcccccaaggcggccacgcgcgacatgtacgtgaaggacggcaaggtggtgccgggcctgtccacggacggcgcgctgagcgtggcggtgccgggcgccgtcgcgggctacctggagctgctcaaggcgcacggaaagttgaagccggcggtggtgctggcgccggccatcgcggcggcacgcaagggcatgtgggtgacgccgcgctaccgcaccatggcggagggccggctggcctgtctgagccgggacgcggaggcctcacgcgtgttcctggtgaagaatgcccagggccagtgggaacccccgcccgtggggcaggtcatcccccagcccgacttgggacgtacgctgtcctccatcgcgaaggggggcgccaaggccttctatgcggggccggtggcgaaggccatccccacgtcggtccaggctgacgacggcatcctcacccaggaggacctcgcggcctacaagacgcggagcgccacgcccctggagggcacgtaccgcggccaccgcatcctcaccatgccgccgccgagcgcggggggcgtggccgtcatccaggtgctgaccgcgatggagcaactgcgcccccagggcgtgacgttccgcgacgcggaggcgctgcacctctacgcggaagccgtgcggcgggcctacgtggaccgcgcgaagtacctgggggacccggccttcgtggacgtgcccctggcgcggctggtgtcacccggccacgtcgcggacctggcgggctccatcgacccgaagaaggccacgcccagcgcgtcgctgctggcgccgaaggaaggcgtgcggggctccacgctgacggacgagcccaccaccctgacgcccgagccggagaagaagaacaccacgcacatctccgtcatcgacaaggacggcaacgcggtggcgatgacgaccacggtgaactacggcttcggctcgtgcgtggtggccaagggcaccggcgtgctgctcaacgatgagatggatgacttcgccgcgcagccgggcgtgcccaacgcgtacggcctggtgacgggcgagcccaacgccatcgcaccgggcaaggttccgctgtcctccatggcccccacgctggtgttctccaaggaagacccccggcgcgtcatgctcgcggtgggcagccctggcggctccaccatccccaccaccgtcatccaggtcatcagcaacgtggtggaccacggcatggacgtggcgcgagcggtgaatgaaggccgcgtgcatcaccagtacctgcccgacgagctgtgggtggacaagtggggcctggagccggcgacgctgtccgtgctggaggccaagggccacaaggtgcgccgcgtggagcagtggggcgacgcggaggccgtctacagcgacccgaagacggggctgcgcttctccgcgagtgacccgcgcaacgagggcgccgccctgggacaggattga

SEQ ID NO: 6783 - DNA, 681 bp, Myxococcus xanthus
atgacgcacggctggctgtctcccgtggtggacacggtgaaccccctcctcaaggacgcgcagttggtggcggccgaccagcggctcttcggcatgcaggcggcggtggtgctgtcacgcgtcgtcccggcgtggctcaacgacatcctgctggtctgctactacggccacttcatctgggcgctggtgatggggctggtgctctaccggcgcccgggcggcgcggagtacgacgagtacctcaccgcgttggggctgcttttcttcctcaactacgcggcctatgcgctggtgcccgcggtggggcctcgctacttcctggtcgacgcgttcgatgggccactccagggcacgctggcgccgctgctggattcactcatgcgcaagccgctgttcgcgcgtgactgctttccgtcgggacacaccggcgccacgatgttggtgctgtattatgcttggcggttctcccgccgcgtcttctgggtgatgttgctgccgggcctggggctcatcgctgccacgctggtgggccgtttccactacgccacggacctgctctgcgcggtgcccatggtcatggtggtgacggggctggcgctgggcgtttcccgggcggcccggcagcgcgaagtggcgaaggacgcgcgttccgtgccggtggacgctatcgtcaggccctga

SEQ ID NO: 6784 - DNA, 252 bp, Myxococcus xanthus
atgcacgtgggctggacggacactgatcccgagctccgggccattacctgctccgtgcgcgggttgatggatgacatccgccgcggactgggctccggctcaccgtgctaccagcgctacctgcgcaccctgctgcgcgaggccgccgtcacgctgccggacgcggagctgcgcgacgccttcgcgcgggagacagacccggtcatggccgaacacctggcggcggcagctggtggcccgcgcggaacgtga

SEQ ID NO: 6785 - DNA, 651 bp, Myxococcus xanthus
atggacgtggtggcacagcgcgcgttgcacgacgcggacccgtccgtgcgcgccgccacgctgcgggccatgcggcgcaccagcgcgctggagcgcaccggtgatttgtacgagcgcatggtgcgggacgagtcgccccaggtgcggcaggaggcggcgaccaacctcatcgaggacaacgcacacgtgtacgccggccagtacggcccggcggcggacacggcggtgacagccgcggtggcctccacggacccggcggtgacggcgcgcatcctggacaacctctccactgagaaaatcagcgccgagtccgcggaccgcatcacgtccctgctgcgcagcgatgacgcgagcgtgcgcaaggccgccgtcaacgcgctgggcggcgtcccggcggagcagatgcagggcgcccgcgagtccctgctcgccatgtaccgcgaggagacggacgagggcgtgcgcaaggcgctgctccagagcgtcgcgcagctcggcttcgagggcgcgattcccgacctccaacgcatgcgcgccatggacccgcgcctggcgcaggaggccgacgcgtggattcaggttctcggcatgggccttcaggagtggagcctgctcctgagggagaagcagcggttgcagcaggctccgtga

SEQ ID NO: 6786 - DNA, 531 bp, Myxococcus xanthus
atgcgtagcagcacctggaagaactccctggccgcgctggccgcgctggcgctcatccccgcgtccgtgacggcgcacaccgtcaagggcacccacaccggctcggtgacggccctgaccaactacagcagcggcacgttccacggcgcggtggacatcggcgcgggcggccgttgcaactactggggcgcggagacgggcgtggtgggctccgtctactgggcggtgaccatccgcaccaccggcgtcgtctgcaacggcaacggcagcggcaaccagaacgaggcacgccacgcctgggcgagcggctggacgttccgtcagtggcacttcatcaagacggcggactcccgcagccgcacgtgtgaccgctgccaggtgggcaacatcggcggcaccggcaactccaccggtccccacgcgcacctccagcaggacaagctggggacgaaggacacgtcctggtacaagggctacgtcagcgtgggcaccgccgtcacgcgcgcgaagaccatcggcgttctggactga

SEQ ID NO: 6787 - DNA, 1314 bp, Myxococcus xanthus
atggaggacagcgttgcctcctaccagaacaccggcacggggcacggcatcatgcgcgtgaagaaatccgccgctgggcgctcgcccacccgtcagacttcgatggtggaatccccgccgatgagacacgcacccgaagactgggcccgcttcgcgagcacgcactgggagcagtcccccacgcggctgcggctgggcaccccgctcattccgcccgagcaggccttccaggggctcgtctccatcagcgcgccattccgcttcggtacgcgctttggcgccctgcccgacgtgcgcttcttcgcggacaccgcgcgtatgcgcgcgcccggcacgctcctgcccggagagcaggacgcggacgccaccgcgtatctccagcgcgtcggccgcgagctcggcgcggcgcgcggcttccagtgcttcgtggaacagccgctcatgctggactacgcgcagtgggagcgggtgcgcgccttcgtcgacggcgtgctggcgcgagtcggcgtgcccgttctgcccatcatcagcgacctgtggctgggacgcttcaccgagccgccgcagggcgccgcgcgccgggaacaccatgcccgcttcaccgcggtgctccacgggcggctgcgcgtgcgccaatggacgaaggacgcccacaaggcccggacggtggaggcccaggcgggggacgtgctgtatgcgccgtcccacgtctggcaggaggaggcgagcgacgagggcgccctggtgctgcggctgtggattccggtgcgcggcagcgagcccctggaggccgtgaaggccctggcggtgaagctcctggagaaccagggtgaggcggatgacgccgtcccgtacctgccctttcccgggacgcgtggacgcacgcccgtgccacgactggcgcacaccgcgagcgcgctgcgggccgtgacgcacggcccggacctgcggcaactgctgcgcatcgcgtgggcccagcgcgtcagcgcctccgcgctggagccggtgcctccgccgcgtgcccacgagcccctggaagaagacgcctacgtgcggaagacgccgccgggccgcgtggtgcggatgctggacagcccggggcagtggctatgggccgtcaacggccacgcgttcgccggtccaggccccttcgcggcgcacgtactggacgcgctggcaccgggcgtccccgtgcgggtgggcgccctgtgcggcctggggcgaggcgcgtcccaacgcgagcaggtgcgggccttgctggaaacccttcatgcgctgcgcggtatcgagcgcgtgccgtcgaaggaggcatga

SEQ ID NO: 6788 - DNA, 573 bp, Myxococcus xanthus
atggcccgcatcgacctccagcgccggttcgactgggacaccttcgtcacgcgctactggaaccagcggccggtgctctaccaggcgacgggcatcaatcccttcatggacacggacgtgttcgacgcggcgctcggggcctcgcgcggcgccatggagccgcccacggcgctcgaggcgcgcacggacgtccagttcaccatcgaccaggggcagcccgtccaactcgggccctggcttccccgcgacaccgacggctcgctggacggctacgactcgcggctcgcggacgcgctgggaacacgtcgctacgcgctcatcatctccctgctgcattcccacggcttcggactctggtcccgcgagcgggccttcttctccgacctctggcggcgcgtggggctgcccctgtcaggcggcatcaccacgctgttccatgggaactacgagcacagtccggtgggcgtccacctggaccgcttcaccacgttcctcttagccatccgggttgctcgactttgtggcatggtgcgcgtagactggccggagcaatgcccgtcaccaccgtggtga

SEQ ID NO: 6789 - DNA, 573 bp, Myxococcus xanthus
atgaaactctatttcaaccccagaagccgcgcggtcattgccaagtggatgctggatgagtgcggcgcgcagtatgaaatcgtccccatcgacttcgagaagaaggagaacaagtcgcctgagttcttgaaaatcaaccccgctgggaaattgccagccttggtggacggagacacgcggctgttcgagagcgcggccatctgtctctacctggcggagaaattcccggacgcgcagctcgcgccgaagccgggtgacaaggactgggggcgctacctgtcgttgatggtgtactccacgtcgcagctggagccctccatgggtgaccacctgatgaagctgccgacggggcccgcgcggggctggacggacttcgagacggtgctgaacgtcgtcgagggcgaactgggacaggggccctacctgttcggtgagcgcttcaccgcggcggacgtgatggtgggttcgatgttcatctggatgcgcatcttcggcagccagacggggcgtcccgcgctggaggcctacatcgaacggctgctggcccgcccgaagggcatgaagctgggctga

SEQ ID NO: 6790 - DNA, 1023 bp, Myxococcus xanthus
atgagcagtcttcccgccatctccgagctgacgttcgacgcgctctcgagcgaggcccacggccttcgcgagcgcctcaaccgcttccgcctggcgctgggccgtcacttcgtgggcaagcagacgctggtggacctgatgacggtggcggcggtggcgcaggagccgctgctgctcgtgggcccaccgggcacggccaagtcggacctggtcctcaagttccgggacgcgctgcgcatccccaacgaggattacttcgagtacctcctgacgcgcttcaccgagccgtcggaggtgctgggccccatcgacatcaacctgctgcgccagggccgctacatccggcgcgaaggcggcaagctgcccacggcccggctcgtcttcctcgacgaggtcttcaaggccagctccgccatcctcaacgcgttgctcaccgtcatcaacgagcgcaaattctaccaggacggcgcgccgcagccggtgaagctgaaggtgctcttcgccgccaccaacgagctgcccgaacacgccgagctgggcgcgctcaaggaccgcttctgcctcaaggccgcgtgccgtccggtgcaggaccgctacttcctggagctgctggactccggcctggattcgcagacgcaccgggagatgaaccagaagccctgggcggaaggacacgccacgctggacgacgtgctcaaggcccatcgctacctgacgctgatgatgggcaagcgcgagacgggcccggacggccgcgagctgcgcgaccgcgacctgttcttccgcgatgacttgctgcgcgagttccgccgcgtggtgcagacgctgacgcgcgaggacggcgtgttcatcagcgaccgcaagctggtgaagctctaccgcctgctccggacgcgggcgtggatcttccacggcggtgcggtggagcggcaggacctccagctcctctcgtacctgggcgagacgcgggaagaaatcgacctgctggaggagaaggtaccccggctgctgggcctctcgtaa

SEQ ID NO: 6791 - DNA, 633 bp, Myxococcus xanthus
atgctgggggatgccctgacgctggcggccctcttcggccgcgcggaccacgcgatgacgctggcggcacggctgcgcaaggtgctcactgcgctggctcccacgtcgcccgcatggggccagggcatcttgggtgtgagcctgcgcggcctgcgccgggtcggcctgtctcgcgaagccgccgagatggtggacgcggcgcaagaacgcctgacgggacccaagacaccgctgacggcgcggctcggcgtcgcggcgggcctgtccatgcaggggcgcacggccgaggccgtcgacgtgttcgacgccgccttcgagtcactgggcgcggcgaagggcggactccctgagcggctggcgctgatgcgcagcctcgcgagcgcactggcacatgcccccgtggagctggcgcttccggggctggcgcgcatctcggaagggctgccaatcatcacggacagctacaacaccaacagccacttctgcctctccgtggtggagctggcggacgcactggtgcagggccacgtggaggtggcgcaaggcaccggagagcgtgcacgaagctggctcgacgaagacgaattcctggtgcgacggcgcatccatcgggagctggaggagcgcacatga

SEQ ID NO: 6792 - DNA, 756 bp, Myxococcus xanthus
atgacgggaaagctgtctagggccctggctgtggtgtcactgctggcctccacgagcgcgagcgcgcaggaggaggcgcaggcgctggagtcctccgcgcgggatgagcgcaggggcctggagctcaccgtgggtgtcggcttccaggtgggcgccggctacgtctaccgggagggtgcggggctggaccggcaggtccgcgacctgaagctcagcgacgcggccaatggtggcatcgccttcctgctggaggcgggctaccgcgtcaactcgcgctggtacgtgggcgcgttcggccagtactcgcacgtgctgacgaagacgaacccgtacacgtgcccggaaggctacgactgctccacgtcgcaaatccgcttcggtcctcacgtgcagtatcacttcgcgccggacgcctcgttcgaccccttcgtggggctgggcgtgggcatggtcctgctcaacaacaaggtctccggtcccatcacccagcccgcgcccggaacggtggagattgacagccagtcgcgcggccctgaattcgtgaacctgaccctcggcggcaagtggcggctgtcggattcgctgtcgttcggcccgtacctgacgggcacgtatgcccgctacaccacgcgcagcggcacctcgacggtgaacatccccgccgtcaatctcacgcaggagacgccgctggagcaggtgggtgatggcccctatggcttgctcatgctcggggttcgtgggacctggaacctctaa

SEQ ID NO: 6793 - DNA, 1548 bp, Myxococcus xanthus
atgaaaggcagtgacctccgggaaggcgtcgttcgcgtgttgagccgggatcggcagcgcgtcctcgggacagggttcctcgtcacggagcgcctggtggtgacgtgctggcacgtgctcgacacgctcagcgacagcgagcgcgacgccatctgcctggaggtgctgcaaagccacgagaaggccacggcgcggctgcggctcgatgcatcgagccccacggaggtggcggacctcgcggtgctgacgctgacgcgcccgctccgagggccgtccacgccgctgcccctgggcagtgcggagcggagcgcggaccaccgcttcgccacgttcggatttccacggggcttcgatgacacgggcacgtgggcccgcggcaccatcggctacgcgacgggggacggcgactttcgcaagctgctgctgcacggctcggatatccgggagggcttcagcggcgcgcccctcttcgatgagcagacgcggcgcgtggtgggggtggtgcgcttcaaggccgtggcctcggaggcgcgggaggcgtacgcgacgcccacggagcagctgctcgcgcgctgtccggagctgcgtgcttcggaggactgcccctaccgggacctggcgtcgttccgtgaatcggacgcgcggttctggaagggacgcgggcgggtgctggacgaacaattgctgccgctgctcgcgaggctgccccgattcgtggaggtctctggcccttcgggcagtggcaagtcgtcgctgctccacgcggggctgattcccgcgctgcgggacggaacgttcattccgggcagccagcactgggacgtccgggccctgcgcccggggctggagccattcgccgcgctggatggcgcgggcctgcccgctggagaggggttggtcgcgcgcgtccaggcgtggcgggccgcgaatccggagccagggaagcggctggtgctggtcatcgactcgttggaggacgtgctccttcgcggaagcagcgcggagctggcgcaacagcaacgattcctccagcagctctccgcgctcgcggatgagtctctgccagtgacgtgcgtggtggcgctgcgcgagggcttcgacgcggtgctgtccgagcgcgcgccgaggctgcgcaccttgctcggtgagcaccgggtgcaggtgccatcggtgctgacgccctcggagctgcgggacatcatcgccggcccggcccgggaggtgggcctgcgcttcgacccacccgaggtggtggactccatcgccctcgccgcgcaggaggagttccgcgcggagtccggcgcgggcgctcgcgtcaccgtgcttccgttgctggaggtcgcgctgacgcagttgtggcaggcgtcgcgggatggcgcgatgaccttggaggcattcaacgccagcgcggggctgctcggttcgctggcacgctgggcggacagtgtctacgaaccgctgaagccctcggaacgcctgctggcgaaccggctgctgctggagctggtgcaattgggtgaggcggacagcggactggaggacaagggg

SEQ ID NO: 6794 - DNA, 2208 bp, Myxococcus xanthus
atgcccgaggtccgctacgtcgagcaccgctatgacgtggacttcttccgtcgaaatgcgctgctgttattgcccatcgagaaactcgctgcgctgcgccaggacctgacggcgcgtgtgcgttacgagcggcaacgcgccaacccgttcttcttcgatttggggggcacgtcggagccgccggacttcgaggccatcgcgaagaagtacgcgccggacgcgcccatgcgcgcgacgttggccagcgcggacggcactgaagtctatttgatgatcaagccgtccgggacggccggggatttggggttcgcgcggcgcttcgtggaccaggccatgggcaccggaggcacgctcgcggcgcagcgctatccgggcgtgacgctgcaagccacgggcaactttcaggggcgcatcgaagaggacgcggtgatgcgcggcgacctgtcgcgcgccggtacgttgtcggcgctcatcgcggtgggactcatcctgctcgccacgcggcgtgtcgcggcgctggccgtggtcggcatccccgtcatggtgggcgtggtgttgacgttcgcggcggcgcagctcgccattggccacctcaacatcgtgacggggttcctcgtcgccatcttgattggcctgggcatcgagtacggcgtccacctgtgcatgcggtactgggaggagcggcgcgctcacccggcccgcgaggccatcgtcacggcggtgcgcggcaccttcagcggcgcggtgacgtccgcggtgacgaacgcggcggcgttcttcgtgctgctgctggcccagttccaggccttcaaccagttcggcctgctggcgggcctgggcgtgctgctcgccgtgctggcgacgtatgcgatggggccgtcgctgctggccctcgcggagcgcctgcgcccggcccgcgtggacgtggcggccgaagccaccgcgccccaggtatcccagccggagcgggcgtggcggcgctggcccacgggcgccatcgccgtgctggcgctgtcggtggtgggcttcgccgcgttctccgtctccgtggcgcctcaactgggcttcgagacggacatgcgcaagctcaagggcgagtccccggcatcgcgcctggatgaccgcgtcaccgaacagttgggccagcccctcaacccggccatcttcctggtggatgacgtggcgcaggcggcgcaggtggaggccgtcatcgcggaggtgaagcagcgcaacggcgcggactcggccatcctcgactccgcgtctctcaacgacttgttgcctaccgatgtagagcgccgggaggtggagctggcggccctgcgcgaggccttccagggcctggaggacctgcccgcggagcttcgcgaggacgcgcggctccaggagttccagcggatgctggaggcgaagccctacggcctggatgcgttgccggtggaggtgcgccggcgcttcgaggccacggacgggaagggcaccttcctgctcctgttcccctccgtctccaactccgacaccgaggagctgcggcgctgggccacgcagatcgaccaggtggtggagggcgtgaaggcgcgcggcatcgacatggccgtgctggacagcaaccgcatcgccgcgcgcatcttcgcgctggtgagcgcggacgggccgctcatcctgtggtccgccgccgcggtggtgttcgtcgtcatcctggtgagcctgcgcagcttcaagcgcgcgttgctcgtcaccgggccgctgttcctgggcatgacgtgcctggcgggtggcatgtacctcttcgacgtccagctcaacttcatcaacgcggtggtcctgccgaacctgctggccatcgccgtggacaactcggtgcatctcttccaccggtacgaggaagaggggcccggctcgctcggcaaggtggtgcgccacacggggctggcggccgtggtggccacgctgtccaacgcggccgggtatggcgcgctactggtcgccaaccaccagggcctgcggagtatcggtcagattgcgctgctgggggtcatgtgcaccttcttggggaccacggtcttcttccccgcgctgcttgccttgctggagcggtggagggggcgcgagaatgtggtggcggggaagggagcggtcgttcagagcctcgaactcggcgattctggcgcgcaagccgcgccgccgggggagcgtaagtcggcgtga

SEQ ID NO: 6795 - DNA, 897 bp, Myxococcus xanthus
atgtcgggcatgaacgtcacgttggagcatgcccgcgccctggacgccctcgcccgccatggcaccttcactgccgcggcggaggccctgcgaaagggacacacggcggtgatgtacgcgctgcgcacgctcgaggcgcagacggagctgacgctgctcgaccggcgcggctaccgcacccggctgacgcccgccggggaacggattctggagcactgccgcaagctgctggccgccgagcgcgagttggatgccgcgtgcgcggagattcgcgctggctgggagcccgcgctgcgcatcgtcttcgacggcatcttccccgccgagcccctgctgcgcgtgctgaaggaattgcgcgccgagggcgccagcacccgcttccacgtctccgcggagttcctctccggcgtggaggcggccttcgtgcgcgaggaggcgaacctgatggtgacgctgctgccgcccaccgtgccgggcctgcgcacgtaccgcctgccggagctcaaggccatcctggtggcccaccggggccatcccctggcccggcggcggggaccgttgaaggacgaggatctggccgagcacctggtgctcacggtgcgcggctcggaccctcggctccagctcagcaccggcgagctggaggcacgctccacggtgcatctcaatgacttcgcggcgaagaaggcggccatcctggaggggctgggcttcgggtggctgcccgaatacatggccacccgcgagctgcgccggggcgagctgaaggccctgaagctggcgggtgacgccacccacgcattccgcccccagctccaccaccactcgggcatccccctggggcgggccgcccgccgaatcgtgcaagcgctcacggagacggaatccacctcttga

SEQ ID NO: 6796 - DNA, 109 bp, Myxococcus xanthus
atggacggccgcaccacggggatgttcgcgtgcgacagccgtggcgggccgacgggaggcgacaggggcgagggcggccaaatgaccgccgtcctgccgctgacgggct

SEQ ID NO: 6797 - DNA, 1390 bp, Myxococcus xanthus
gaaaaaacagaagagccatcccagaagaagctggatgactcacgcaagaaggggcaggtctggaagagcaaggacctcagcggcgtgggcgtgctcctggtggggctggccgccgtcaaaggcagctgggacatgctggagacagagctgacgtcgctcttcctgttctccttcgaccacctgacgaacccggtggacctgtcggtggccaccgggcagctgctcttcctggggctgcgcgcggtggtgctggtgtcgctgccggtgctggcgggcggagccattgtcggcgggctgatggagtacctccaggtggggacgctcttcaccatggatccgctgattccgaagatggagaagctcaatcccatccaaggcatgaagaacctgttcaacaagaaggcgattgttgaactgctgaagaacctcatcaaaatctcagtcaccgcctacgtcgtctacggcgtggtgcgcgactccatgcccatggtggccgaaacgttgcggcaggacacgcgcggcatcatggccatcatgggagagctggtgacgcgcgtggccacgcgggtggcgctcctcttcgtcctcttcggcgtcttcgacgtctggtggcagcgcaagtccttcatgaaggacatgatgatgacgaaggaggaggtgaagaaggagtacaagcagagcgagggcgacccgcaccacaaggccaagcgcaaggagatgcatcaggagatcatggagggggcgcagatggaggccgtgcgcgaggccgacgtcatcgtcaccaacccggaccacgtggcggtggccctcaagtacgaccgggagaaggacggcgcgccgcgcgtgctggcccggggcatcgacttcaaggccgagcgcatcaaggccattgcccgcgagcaggacgtgcccacgctgcgcaacgtgcccctggcccacgccctgctgcgggtggaggtggggcacgaagtcccggaggagctgtacgacgcggtcgccgaggtcctcaacttcgtctacggcttgaagtccggtcagccagcccccgagggccgcgcgtgaggaggccgggtgtggctatcatgcagggacaacggggccttccatgagtgacgacgccgaaatcgccatcgcgttgaagtacgacaaggagaaggacggcgcgccgcgcgtggtggccaagggcatgcggctcaaggcggagaagattcgcgagattgcccgcgagcacaacatccccctcatgcggaacgtgaacctggccaatgcgctctaccgcgtggaggtgggccaggaggtccccgaggagttgtatgacgccgtggccgaggtcctgaacttcgtctacgagctacaacgtgagcaggcggccgcggctgccaggcgctag

SEQ ID NO: 6798 - DNA, 819 bp, Myxococcus xanthus
atgaacgtcgcggacctcgtcgcagagctgggcacccgggccaacgtctcggccgtcatcttcacggtggcgctggtgatgtgccgggtgatgcccgtgctcatcttcagccccttcctgggcggcgaggtggtccccaccgagctgaagatgggcatcgggctgacgctctcaatcgtcctctaccccctcatcgcgggctcggtgacgtccatccccctgagcgctttgccgtacatcgcgctgatggcgaaggaggtgttcgtcggcttcaccatcgccttcgtcgtcaacacgttgttcgaagccgcgcgcgtggccggcaacctggtggacaccatgtccggcagcaacaacgcgcagctgtacgtgcctcagctcgggcagcaggtgacgctgttctccagcttcaaggtgcagttggcggtggtgttgttcctcacgctgaacgggcaccacctggtcatcgaagcgctggcggacagcttggtggcggtgccgctggacggcttcccgcgcttccacgacgggccgtggcccttcttcgacctgatgattcgtgtgttcgcggacctgctccgggtgagcctggcgctggccgctccggcgatgctggcgaccttcctcaccgacgtggcgctgggcgccatcaaccgcgtggcgccgcaaatccaggtgttcttcatctccatgtccgtcaagcccctggtgagcgtgctgctcgtcttcctggtgctcggcgccctgatggaccgcatgcagggggagatggtcgtcatgctgcggaccctcaaccaagccctgcggctcttgtcctga

SEQ ID NO: 6799 - DNA, 264 bp, Myxococcus xanthus
atgaatcagctcacgttcatcacccaggaggccctgttcctggtgctcgtcgcgtcggcgccgccggtgctgatgagtctgttggtggggttcatcatctccctgttccaggccaccacgcagatccaggagcagacgctcaccttcgcgccgaaggtcgtcgccgtgttcggcgtcctcgcattggccggcccctggattggaagccagttggtgcgcttcacgttccacgtcttcgacaggttccccgcgctcatcaaatga

SEQ ID NO: 6800 - DNA, 219 bp, Myxococcus xanthus
gccttcgtggtgtccgaactcaaggaggccttccagataggcttcctcttgttcgtgccgttcatcgtcatcgacatggtggtggccaacatcctgctggcgctcggcatgcacatgttgtcgccgaccaccatctccatgccgttcaagctgctgctgttcgtgctcgtggacggctggtatctcatcgccaagggcctggtcgtcggctacctgtag

SEQ ID NO: 6801 - DNA, 93 bp, Myxococcus xanthus
atggatggcctgcaggtgctcgcggaggtggcgcgcggctggccggacgtgcccgtcatcctcctcaccgcgcacggcacggtgccgctggcg

SEQ ID NO: 6802 - DNA, 606 bp, Myxococcus xanthus
atgattgcgtccctgcttgccgccaccctgcttgccgccgcgcccggcccactgacggtcgtccaatccgggaatgcggacgtgcagaaggccgccaacgcgcccggtgccaccgcgcagtcgctggccaccgtcgtggagaagttcgtcgacttcgaggagctggcgaagcgtgcgctgggtgacaagacctgggccggcctccagcccgcccagcgcaaggagttcaccgagacgatgacgggcctgctgcgcgcgtcctatgcccagaaggcgctggggcaggcgcaagcccaggtgaagtacggcgaggagggcatcgacggtaacgaggcctccgtgggcaccacggtgacagtgaagaaggacgccatccccgtcgagtaccgcctgtaccgcacgtcggcgaccggggcgtggcgcatctacgacgtcatcaccgacgaagtgtccctggtggacacgtacaaggggcagttccgcaagctgctcgccgacaagggcttcgacggcctgctgtccacgctgaagagcaagcggacgcagttggagaaggagaacgcgacgtcggcgcagaagagcgcggggcagaccgcggtcccctga

SEQ ID NO: 6803 - DNA, 1533 bp, Myxococcus xanthus
atgacgggtgggatgtggatcagcctcctggcctgcgcgggccagctcgccttggcgggccttgccctggtgcgcgtgggcaagagtccgttggcgctgccgctgtcgctgctgtccatcgccctgtcgacgtggaacttctccggcttcgcgctggtgcgcgcggacgaggacggctggcggctggtgggcttcaccgcgggcttgatgacggtgccgtgcgcgctgcacttcatcctgtccttcgtgggacggcgacgaagcctcgcctgggccatgtacggggcctatgccctcttcggcgcgttggcgctcgccatgctggtggcgttgggcgcccccacgctggaggcgcacctgctcacgctgcgcttcgggctgctcgtctccgcgctggccattcccatcctcggtggaggcttcgcgctcctgggattccacgtgctgcactcgcgacacccggacgagcgcgcccgcgcgggcctggtgctgttggggctcacgctggtggtggccctgctgatgacggagctggcggcggagctgggcctggaggtggtgcggctcggccacgtgggcacgctcctgggcttgccggtgatggccaccgcggcgctgcgcttcggcctcttcggagacgacccgggtgcgccccggctcgcgctgcacgcggcgggcatcgcggggctgggggtgctggcctatctcgccgtggtgcggctcttcgtcgcgcaggcgggcacgctcatcatctgcaccacggcggtgacgttcgccctggtggcggcgacccgccggggcgtcaccgcctacgtcagccgaagcgagcgactggagcggctcgccacgctgggccgcttctccgcgcagatggcgcacgacctcaagaaccccatcgccgcgatgaagggcgccgcgcagtacctcaaggaggagcacgcgcgcgggcgttcgtgggacgggcaaggcgagttcctggacctgctgctggagcaggtggagcgcctggaccgggtggtggacacgtatcagcggctggcgcgcgtggagcccctgccaaagccggtggacctgcgccggctggtggagggcgtgctgtcgctccaggtcttcgccagcccgggcaaggtcgtcatcatccgggagctggccgccggcctgcccccctgcgcgggggaccaggacctgctggccaacgccctggagaacctggtgcgcaacgcctgcgaagcaatgccgggaggtggcaccctcaccgtgcgcgcgctgcgtgacggtgccgacgtggccatggaggtagaggacaccggcgagggcatggacgctcgaacacgcgagcgtgccttcgacgacttcttcaccaccaaggcctcgggcagcggcctggggctggccttcgtccggcgcgtggtggaagcgcatggcggcgaggtgctcctgacaagccgggaggggcgcggtacggtggtccggatgcgcctgcccgtcacggacgcgagcctgggcggcgcaggcgtgggagaagccgcgtga

SEQ ID NO: 6804 - DNA, 1656 bp, Myxococcus xanthus
ttcctcgtcttcccgaaccccggcgccgcgcagaacgcgcagccgccccgtcccaagcccgcctcgctggagagccgccccccggctccgcccgcgagccaggacgtgccggactggacgctggcccaggcccgcgcggcgctgaaggaagccaccaaggaccgcgaccgcctcatcgacgtggcgctgcgcttcggccgcaggaccttcgactacgtcgcctccttcgccgtgctacggggcggcgccacgggcctggaggctcgcggcgagggcatggcgggagagcagctcacgcaggtgtccatcccgctggatgccagcagcgtcttccgcacggtggccgtcacccgcggcagctacgcgggcccgctgcccccggacgcgctcacgcggcactacctggagctgttcggacgccagacgccgcgcaccgtcttcctgtacccggtcgaggtgaagggccggctggtggccatcctctacggtgactgtggccagcggcccatcagccagcgccgcctgtccgactacatcctgttctgccaggacctgccggcggccttccaggagctcatcctcttccgcaagcagcgcgtgtcggagctgcgcgcgccggacgagatggagctcaccatcgacgtggacctgcccgtggcccccgcgcccgcgcctgcccccgcggtggtcgccggcctgggctggagccccttcttcggccgaggcgccaccggcaacatgggccgcgccgccgcgctgccgccgcgcgcgcagtcacaagaggagcgcccgccgccggacttcgcgccgctgctgcgccgcctcaccggtccggacgccgcgcagcgcgccaacgccatggcggagctggcgcgctcgcccgaggccagcgcccgggtgctggcccagcacttccccggccccacggcctggagccggctgcccgtggtggagctgcccgaggcggacgagctggggcccatccccggcgcgctgtcccggctgggccgccccgccgcgcaggccgtgtcgccgctgctggactcccaggacgcggacacgcgctacttcgcgctgctcaccgccggcaacctcccctacgtggagttggtggacggcgtgctgcgcggtctgttcgacctggagccggacatctccagcgccgcgcgcgtggccgccgccgcgctcaagcagttgccccggctggacgcctccctgcgcgacctgcgccacgagctgagcagccgagacccgctgcgccgctcgctggccgcgcgcgccctgggcacgctgcatgaccgcgacgcgattgagggcctcatccgtctcacgggcggcgacgacgagatgtgcgcccaggcctcggcggaggcgctgcgggaagtgacgcgcgccacgctgggactggacccgcgtcagtggtcggcgtggtgggcggagaatcgcagccgccgccgcgcggactggctcgtctccgcgctgcgccaccgggagttggacgtgaggctggcggccatcgaggagctgagccgcgcgctgcacgacacgctgggctactacgcggatgcccccgaagccgagcgtgaacaggcggtgcgccgctgggagtccgcggcggtggagccggccaacgcgcgtcggctgggcatgctctag

SEQ ID NO: 6805 - DNA, 1176 bp, Myxococcus xanthus
ctatctgctgtgcgctctacaggcgtcttcacgggcggggatgaccgccgcacgcaccgcttcggcctcgcggcggatggctcgcccgcgggcgaccacgatacgtcccagcacggcatcgacctgctgacggaatcactcaaggccggccgtccccgccgcgaagccgaggtgcgcgaggccgccgcgctggaggagacggaggcgctggacttcctcttccaggtgctgtcctcggaaaaggacgcggaggtccggcggctcgccgtgcgcgagctggcggacaagggccgcaccgccgcgcgccccaagctgcgcgagcggctggacgactcgcacccgatggtgcgcaaggccgcgctggacgcgctcgtcgcgctggagccggagtccccgctgtccgcgccgcgcgcggcgctgggctcgcagcacccggaagtgcgcgtgttgggcctggagttgctggcgaagctgggaggcacgtccccgctggtgccgggcctcatcgccggccagctcgcggacaaccagggcgcggtcggcctggccgcgctggacgcgctcacccaggtggtgccgggcgacggcgccgagccgctgcgcaccgccttcgagcgcggcccctcccagctcaaggtggaggtgctcatccgcgccgtggcgggcgggctgcttggccacgcgcagttgcaggccctggtggcccgcgcgctggatgacgcggaccccggcgttcgccgcacggccttcaccgtgcgcgtcatggagcgccgggcgctgtcccacgcgctggagtcacgcgacgaggactttggccggggcaccaaggaagtctcccgctggctggtccagcgcgcgcgccgtgcgcagggcgtcgcgggaaatccgcccatcaccgatgcggagctccagtccgcacgcgatgcgatgcccgcgcagggcaccacgggcgcggccatcaccgagagcgacctggagccgctgctggccgccatggcctgccgcacgccggacacggccgtgcgcggcgctcgcggcctggcacaactgggtgacgcacgggcgctgggcgcgctgctccagctctcccgcgagccggacgccgccatccgccgggtggctgcctcctccctccaggcactccaggacgcgcgcgctcgcgagcgactggtgtga

SEQ ID NO: 6806 - DNA, 1035 bp, Myxococcus xanthus
atgctggacgacgagaacgcggacgtgcgcgccgccgcgctggacgcggtggtggcgctggacgcggacgcgtcgctggcgtcggcggaagccgcgttgcgctcgggccacgaggacgtgcgcgtgcggggcctggaccggctggtgaagctgggcgcggcgacgccgggcgcggagccgctgctgggcgacgcgctggaggacgagtccggcaaggtgcgcggcgaggccttccgcacgctgtgggcctggaacgagaaggcgccggagaaggcgctggaccgcgcgctggcgggccgcttccccgacctgcgccaccgggcggtggaggtgctggcacagcgcgccgccgaaggctgggcgctggagcggctgaagaaggccgtggaggaccgcgacaccagcgtggccaccgccgcgtatgacgcgtgggtgaagcacgtgggcaaggagcacgcggaggcccacttggcggcgctcgccaccacgcacgcgccgctgcgggagcacgccgcgaagggcgccatccacgcccccatcgagcccctgcgctcgccgctgctcaagcgcgtccaggacgaggaagtccccgtcgccgtggccgcgctggaggcgctggacaagctgggtgcccaacgagaacggacccctgctggccgggctctccgcggcgccgctgccggtgcgcgtgcgcgcggtggagctgctggctccgcgtggcgccgaagacatcatcgagccgatgcgcgcgttcatcaccgacaaggacctggagcggctctaccctccagccttcctggtgccgctgcgcatccgcgccgcgcgggccctggcgtcactgggctcgcggcgcctgctgaccttcttcgccaccgtgctgctgccgcacgagctgggcgacctccaggagcagggcggccgcgggctcgccaccgccgctcgccggggcgacgaaggcttcctgctggacgcgctgggccacgccaacgtggcggtgcgctcctgggccgcggacggcctgtcccgcctgggtga

SEQ ID NO: 6807 - DNA, 2230 bp, Myxococcus xanthus
atgaaggactggccggccgaagaggagcgcgtgaagtacgtcgtcgggctcgccgaggccctgtccagcctccagcccgagcagcgctacgcggcggcccaggtgctgctgctgcgcgacaagccgctggagtacttccgccacgccaagaaggtggcgcggccgagcacgctggatgcgccctggaagccggagacggcacccaccagttcgcctgtgcaggccgcacccgcgaagaactggctgcggcgcatcttctccgccgtgaagacggacgcccccgccgcctcacccgaggcctccgcccaggccgagcggcagcacctgcgccggctggccttcggtgcctacgtcggcctgctgcggcaggtgtccacgggcgacgatgagagccaccgcgtgcgtcgcgacgcggtggaccgcgtggtgaagctcacgctggagggcttcgccggcacgcccgccgccgtggccgccctgctgcgcgccctggaggaccctcaccaactggtgcgcaaggccgcgctggccgggctgaaggagctcttccccgccgggagcgatgagccgctggcgctggccctggcctcgctggcgccggacgtggcgcgcgcggcgctggatgaactggccacgcggggtgacgccgcgaagccgcgcatcaccgccgcactgaactcgccgctgacggacgtgcgccgctacgccttcgagctgctggagaagctcagcccgcccggcagcctggagccgctgctggccgcgctgagcagcgagcacgccgacctgcgcgtgggcgtcatcgagcggctggcgggcgccaacgactcgcgcgtcaccgaggcgctgggacgcgccatggccagcgagcacgaggacctgcgcctgcgcgcctcggagctgctggcgtggcgtggcgatgaccgcgcggtggaggtgctcgccacgttcctgcgcgcggagaacgcgagcgccgcgaagcgcgccacggaggccctggcccggctggccacgcccgcctcggtggccgcgctggccgcccggctgcccgcggcccaggattaccatgagcgcaagcggctggtgacggccctgggcaacacgcgccggcccgaggcgctggaggtgctggcccgccagtgccagacggacgcagagggcgtcatccgcagcgagtgtgtcaccgcggccatgacggtggccggcagcgacgtgaagaagcgcgacgtgaagctggccgtgtcgttcctgcggcaggccgtgaagagcttcgacgtcgccgtgcggctggaggccctgcggcacctggagcacggcgcggaggccggccagtcggagctgctggtcagcctcttcacggaccgcttccccaccgtgagcggcgcggccgtggaggcctacgcgaagcgcgtcatcgagcacggcgccccggcggagccgctggaggcggtgctgcgcggcggctcgcgcgacctgatgctgccggccgcggaaggcgtggccttcaagggcggcgccagcgcgctgcggcccctgatgctgtacgcccgcgcgggcgaggacggccagcgcgagcgggccctgctggccctgggcacgctgggtgacgcgcgcgccctggccgagctggagacggtggccgcgggcggcacggcggaagcgcccgtggagccgagcatggtgtcggccgccatcgagggcctgggccggctcgccgcgaagctgccggacggcgaggagcgccgccgcgtcgaggagaaggtggaggccgccgcggtggagggcgccacactggtgttgcagcaggccggcgtgaagggcctgcgcgccatcggcggggagcgcgcccgggtgaaaatcgaggcgctgctcggcgatacgagcacggcgctgctggtgcagctcaccgcggcccaggagctggggaagctcaaggacaccgcggcggagacggccctggccgccgcgctggacgcgccccagcaggagctgcgcaaggaggcgcgcaaggcgctcgacgtgctgttccccaccgagcgcacgcgggtggagttccacgcggtggccagccgctacccggacatatgcgagcccgccgtggtctacctggccaacgaaggcgacccggcgctgctggtgccctggctggccacgctagacaacgtgacgctgcggttgcgcctgcggcgcgggctcgcacgccggggctgcctgcccctgccggaagtgg

SEQ ID NO: 6808 - DNA, 1643 bp, Myxococcus xanthus
atctgtctcatcgcgcttccctggtctctgtaccgccatccatcggctgccctgggcgcgctgtgcgcctacctgaagcaggaggagcccactctcgaggtggtgtgccggtctgactttctcgacgcggcggccgcgctcggcttcggctgttacgaccggatctcgcaggcctcttacgacgtcggcgaaatgttgtacgcagcgctgtgttttccggagaggaaggagcaggtgcgcaccttcttcatctcgcggatggaggagtcaggtgcgccgctcacgggagcgggcagcttcctcgacccggagatccacggcgagcgccctacctggtcgagcgcgttcgacgtcatccaggcccgcttggaggcgcacctggaccgcgtggcggaagaggtggccggacgctaccaactcgtcggtttgacgacttgcttcggacagctcttcgcgaacctggcgctcagcatgcggatcaagcggcgctccaccggaacgaggattgtgctcggaggttcgacggtctccgagcgcgtcggtccctcactcttgaaggagctcgactgcttcgactacgtcatccaaggcgagggcgagcagccgctgctggcattggcgcgcggactggccgcggcagaggacgtcagcggcctgaaggggctcatcacgcgagagaccgccagcgtcctgcctcgcggcgcgcccttctgggaggtatccgacgtcaacaacctgcccatccctgattacagcgagtacgcgacccgggcggaggcgctcaacttcctctggctgatgacggtggaaggctcccggggctgttggtgggatcgggcgaagcggaccggcaaccccaaggcgacgtgtcacttctgcaacctgaacgtgcaatggagtggctaccgcgagaagggggccgagcggctcgtctcggaggtggtggccctcaacgagcgctaccacaacaacgttcttttcttcctagacaacatcatccggctcaagggcgtggatgagttcgcgcaacggctcatcgataccggcaaggactgggtcatcttctatgagatgcgtgccaacatccgtccccacgagctgttgatgttgtggcaggccggtgtccggttcgtccagttcggcatcgagagtctctccgagtcgtatttgaagcggatcggcaaggggacgtcggtcatcaccaacctgcaggtgatgaagatttgccatgagctgggaatctcgaacggcgcgaatctcctcaccgacttccctggcgggcggccagaggaagtggcggagacctgcgagaccatccagcggtacgcgcttggctacgagccactctcggccaaccgtttctggctcggacgcggagccaccgtccaggtgttgagccaggagtatggggttcgcaacctgcgcaatgccgacttctaccgggccgggttgcccgaggcgctctacgagcggctggacctgctcgatctgtcgtacgaccaggacggacccgtggctgactggagccacgtccgcgcgctctgcaagcagtggggggccgcttactccgccgcccgcgccagcgagtaccggcacctgctgacgtacctcgatagcgggcagtccatgcgcatcttcgatgc

SEQ ID NO: 6809 - DNA, 2457 bp, Myxococcus xanthus
acgctggtggagcttctgcgcgagcgagctcaacaagcgccggacttcggcctctacaccttcctggttgatggcgagacgcaggaagaccggcagacatacgccgcgctggatcgtcgcgcccgggccatcgcggcccggttggcggagctgccgccgggcacccgcatcctgctcctctatgtgccaggggtggagtacatcgccgcgttcttcggctgtctctacgctgggatggtggcggtccccgtgtacccgccacggcacgaccgctcgctcctacggctccaggcgatcgccaccgacgcccaggccaccgccggcctcatccggagcgaacacctggagctgctccgccagttctatccaatcgcccccgagctggctcaactgcgctggatcgtcacggatgaagtcgacgatcgcgcctcggatgcgtggactccgccgccgctctccggcgactcactcgccttcctccagtacacctccggctcgaccagcctgcccaagggagtaacgctcacccaccgcaatctcttgcacaacctggaggcgatccggcggtgcttccggcaggaccagacaagccgggccatcatctggctgccgccctaccatgacatggggctcatcggcggaatcctccagccgctctacacgggctacccggccgtgctcatgtcaccgatggacttcctccagcagcccctgcgctggctgcaagccatctcccggtaccgcggcaccaccagcggaggacccgacttcgcgtatacgctgtgcgcacgaaagatccgtccggagcagcgcgagggtctggatttgagcagttggcgcgtggccttcaacggtgccgagcccatccgtcccgagaccctcgatcgcttcacccatgcgttcggcccggtcgggttccgccgcgagatgttctatccctgctacgggctcgctgaggcgacactgatcgtctcgggctccgaggtggggcaagccccccacgtcgcgtccttcgacggacaggcgctccagcggggccaggccatcccggtggaggccgggcacgccgcggcacacccgttggtgggctccgggcggaatgtgatcgacggcaggttggctgtcgtggatccggagaccttcgagctccggcgcgatggggagattggcgaaatctgggtctcgggttcgagcgtggccggtggctattggggccaacccgaggccaccacgcggaccttccaggcccggctgcgcggcacgggcgagggcccgtttctccgcacgggtgaccttgggttcctccgcgacggtgagctcttcgtcaccgggcgcgcaaaggacctcatcatcatccgcgggctcaaccacttcccccaagacatcgagttcacggtcgagaaatgccacccggcggtgcgccccggctctggcgcggcattctccgtggaagcggatggcaccgagcagctcgtggtcgtttacgaggccaacgcgcagcgcgcggaaagcggcctcgacgaagtcatcagcgcgattcgcagaacggtggccgagcagcacgagctgatggcgtcctcggtggtcctgatcgaacccggctcggtacccaagacgtcgagcgggaagattcaacgacatgcgtgccgcgcggcgttcctcgcgggcgagttgcaggtcctggcacacgccacactggacacggcaaggacagggcccctcaccgcggcagagaacgcgccgcccggcatcgaggactcgccgctgtggcgcgaagtcgcggaggaggtctcccaggttctgtcgttgccagttgccgccacggcgggcctggaggaactggtcctggactcgctgtcgagcgtggagctccagcaccggctccagctccgatggggcgtcatcgtgccgttgccgcgcctgctgggcagccgcaacctggcggagatcgccgctggggtcgaagcggcgcgcgcagccggtgcgcgctggcagcccgagcgcccggccagcgcggaggtaggtgacttccctctgtcacacggccagcgcgcgctgtggttcatgcaccagctcgcgcccgacagcgccgcctaccacatcgccgcggcgctccgcgtcttggagccgctcgacgagggactgctccggcgcgcggtgcaccggctcgtcgagcgccaccccagcctgcgcaccacgttccatgcgcatgaagggacgcccttccagcgggtccacccggaaggagaagccggcttccgctacgaggacgcctccgcctggagtgacgacacgctgcgcgcccggctccgcgaagaggccgcgctcccgttcgagctccagcagggtcccctgcttcggctccggctgtaccgacgaagcgagaccgagcaggtgctgctggtggtggcgcatcatctgatcgcggacttctggtcgctcgggcagctaacccgg

SEQ ID NO: 6810 - DNA, 3433 bp, Myxococcus xanthus
ctggaggacctggagaccgcgtactcgcagctggagcgaggcgctccggtgtcactgcctccgaagacgacgtccttcaaggcgtgggcggagcggctgttgtcgcatgctcggacggatgaggtggcgcgcgagctgccgctctggaaggcctcgcgtgacgtcacttcgctccctgtggacctgccaggcggcgaggacaccgcgggctcggaagcgctggtgacggtgacgctgggtgtggacgaaacgaagccgctggtgggcgaagtgcccctggcataccgggcgcgcgtggatgaggtgctgctcacggcggtggcacgcgcggtgtcccgctggacgggaagccgcaacgtgcggctggagctggagggacacgggcgcgaggccctcttcggtgacgtggacctgtctcgcaccgtgggctggttcaccagcaccttcccgctggaggtggagttgccggaggcgggaagtccaggagacgcgctccggacgctgcgggatgcgcggcgactgttgccggtgaatggcatgggctacggcttgctgcgctacctgcgcgaagacacggcccagacgctgcgcgccgcgccgcgcgcggaggtggggttcaactacctggggcagctcgacgcggcggctcggggggcggagcgcttcctcctcacggaggaaccaagcggcgcgtggcatggcgcgggaggccgccggccgcaccgtctcgaggtgaatgccgtggtgtccgaaggccggctgaaggtggcctgggcctacagcacgcgcgtccaccagcgggcgacaatcgaagccgtggctgacgacttcctgtcatcgctgcgcgagctgatggagggccggagtacgccggacgcggcgcgccgttcgcctggggactttccgctcgcgcgcctctcgtcctcctccctggatcgcttgctacggcagttcccggccgtggaggacctgtacccgctcacgtcgcttcagcagggcatgctgttccatgtcgcgcttgcgccccaaggctcgggtgtcttccatgagcaactggcgtggacgtcacgcgggaacgtggatgtcgccgcgctgcgacgggcgtgggcggtggtcatcgctcgcaacgccgtcctgcgaacgtccttcatccacgagggactgccggagccgctccaggtggtccatgccaaggcggacctgccctggacggagcacgacctgcgcggtgttcccgccgaggagcagcgcgctcggcttgaggcgctggtccgtgaggaccgtgcccgtggcttcaacctggcgcccgcgcctctggcccggatggaggtggtccgcctggccgagcaggagtaccgcttcctctggagccaccaccatctggtgatggacgggtggggcgtgggcgtgatgttgcaggaggtcttcgcctgctacgcggcgctgacgcaggggcgcgacgctgccttgcctcgccccgcggcctggcgcgactacatgtcctggttgcagcggcaggacttgtctcgtgccgaggcgttctggcgggaggaactcgcgggcttcaccacacccacgccgctccccggcgcccggaccgccgcgcccgggatggaggccgccgtcacgggtgaggagattctgtggctgtcgcaagaagccacggccgcgcttcaggccttcgcacggcgcaacgcggtgacgctcaacacgctgacgcagggcgcgtgggcgctgctcctcgggcgccatgcgggccaggaggacgtcgtcttcggcgccacagtctccgggcgtcccgtggacctgccagacgccgagtccatggtgggcctgttcatcaactcgctgcccatccgcgtggggctgtcctccaacgcgctggtggtgccctggctgcagaagctccaggcacggcagctggagatgcggaagtacgagcacagtccgctggtccaggtgaagggctggagcgacatgcctcggggcctgccgcttttcgagagcctgctcatcttcgagaactatccgctcgacacctcgctgggacagggcgtgccggggctggaggtggtggacgtggagagccgtgagcagggcaaccacccgctcattgcctatgtggttcccggtgacaggctgcgcttgagcctggcctacgctcccgagctgcatggctcggacgtggtggccgagttgctggagcactggcgcatcctgctggaggcactggcctctggcgtggagcggctcgccgacgtggcgttgccgggagacgccgagcggcttcaggccatggccaaggcgcaggtgggatccatggggcacgccgcggagtacgtcgccccctcgacaccggaggagctggcgctggcggggatctggacggagctgctcggccggccgcgcgttggcgctcgggacgacttcttcgccttgggcggacacgccgggatggccgcgcggattgtggcgcgcgtgcgtgaagcgttgggcgtggagctgccgctgccggcggtgttcgagtcgcccacgctcgctggcatggcggaagtggtgtcccggatggcgggctcgatgaagcagctcgcggatgacgccatcgcaccggcgtcgaggtcgctggacccggccgcgttggaccaactgtcggacgaggaactggacgcgctgctggacgcgaccgaggtggagagctgagccatggggaatgagacggacaagaagcccacgctcacgcgcgaggagaagctcgcgctgctcgcgaagcggttggagaagaagccccggcctgcgttgccgctgacgttctcccagcaacgggtctggttcctggtgcagcgcgcacccgggctgcctgcctaccacctgccgctggtcctggagctgtccggccgcctggacgaggccgtgctggagcggagtttccaggaagtggcgcggcgccacgagtcgctgcgcacgcacttcggcgaggtctccggcacaccggtgcagttcgtcgatccccaagcacgcctgccgttcacggtggaaggactggaagatgtccccgaagcggcgcgcgaagccgccgtgcggcagcgcatccagcttgagctggaaacaccgatcgacctgtcccgcggcccactggctcgcggggtgttgatgcgcgtggctcctgagcgccatgtgcttctggtggtggagcaccacctcatctccgaccatgagtccatgggcgtgctcacccaccagatggcggcgctctatgacgacttccaccagggccagccgtccgcgctgtctgccatgccgttccaaaatggggactacacgtcctgccagaagcgcaagcttcgaggcgacgagctccattcccacctggagacctcgcgcaagcgactggagggcgcaccgtataaaccgcacctgataactgatcccccgc

SEQ ID NO: 6811 - DNA, 1359 bp, Myxococcus xanthus
atgcaccgcctgctgagcgcgcgcggcaccaccgtccccgaaggcgtgctgctggtgctcttcgccctgtgcttcgggtggattgcgctgtccttctggacggcggtggcggggttcctccaactcgccgtgagcaagcggctgcccggcctgcgctggcccacggaggaggagtccgccacgcggctcacctcgcgcacgtcggtggtgatgccggtccacaacgaggacccggcctccgtcttcgccaacgtgcaggccacctacgagtccgtggaggccaccgggcagttggacgccttcgacttctacatcctcagcgactctacccgcccggaggcgtggatcgccgaggaactcgcctgggccgacctgtgccgccgcgtgggtggccagggacgcatcttctaccggcgccgcacggacaacaccggcaagaaggccggcaacctccaggacttctgcgagcgctggggccggcactacgacttcaccatcgtgctggacgccgacagcctgatggacggccgcacgctggtgacaatggcgcggctgatggagctcaacccgcgcgcgggcatcctccaggcgccgccgctgaacgtgggccgcagcaccctcttcgcccggctgcagcagttcgccgggcgcgtctacggcccggtggtggccgcgggcgcggcggcgtggcagttgggcgagtccaactactggggtcacaacgccatcatccgcacggaggccttcatccagcactgcggtctgccggtgctccccggtcagcagcccttcggtggccacatcctcagccacgacttcgtggaggccgcgctgatgcgccgcgccggctacaccgtgtggctggtgacggagctgggcggcagcttcgagcagccgccccccagcctgctggactacgcacagagagaccgccgctggtgccagggcaacctccagcacctgagcctggtggccgcgggcggcctgcaccccatcagccggggccacttcctgatgggcgtgatgtcctacgcggcgtccccgctgtggctgctgttcctgatgtccggactgattgccggcctctacgacgggtggctgtccttctccaacccgcacctgctggaggacctgggcccggaggcgctggcgttcgacaccacgggcgccgtgcggctgttctccgtgtccatggccatgctgttcgcgcccaagtgcttcgggctgctgctggcgctggccagttcccaggactcggcgctcatgggcggccgggtgcggctgatgctgagagtggtgctggagagcgtgctggccacgctgatggcgccggtgatgatgctgttgcagtcgcgcttc

SEQ ID NO: 6812 - DNA, 1752 bp, Myxococcus xanthus
atgcgcagacacctggatcatggcgtgacagtggcgctgatgctcgcggcgggcgttgccggagcgcagctcacccccggctcggccgggacggggagcagcccttcaaccggcaccggaagcacgccggccccctccacgcccggcactacgcaagcgccggagacgccggacctggggacgccgggctccgacgcgccgacggcggtgcctggcactggggcgccgggagggacgcggcccacgcctcgcgtggggaccggggggcgggacctgccgccgagtccgccgggcattgcgccgagctcgattgaggagacgccgggttcctcccagccggggcgggccatttcacccgcgccagccctggaaccctccgccgaggcggagcaggtgaaggagggcgtcacgggtgcgccggactcggaggagaaacccgcgcggagggagccgctgacgctggcgcggctggtggcgcgggctcgcgaagcggactcccgggtggaggaggcgacggcggagctgcgcaagttccaggcgctctaccaacaggcgcggtgggcctggttccccaagttcgaaatcaccgtgggcgcgggaggccccacgccggaggcccgcaacgacggcctgggtggacctcccaccacggaggccacctataagggagacctgaacttcggccgcgtcggcgtgacgatgttctccaccggcaacgcggtgctgccgctctacaccttcggcaagctgacggcgctggagaaggcgggcgcgcaggggccggtgctgggggccgcgctccgcgagcgcacgcgcaacgaggtcggcttccaggccgcgcaggcgtacttcggctaccagttggcgcggaacgggcttcagcagattgaagaggtctcgaagcggttggaggacgctgcccagcgcatcgaacggctgctcaaggaggactcggcccaggtgtccgcggtggactcgtacaaggtccgcttcttccggcagattgtcgaagcgcgcagggcggaggctctgcagggacgtcagttcgcgctcgccgccatcggcctgctggcgaacgtggggcccgaagacgcagtgacggtggtggacgaagacctggagctcgaagaggacgtgccggtgcccagcctggagcaggccatggtgcgcgcggagcagtcccgtccggaattgacggccgtcgccgccggcatcgccgctcgcgagcaggaggtcttcatccgcgagcgcagctactacccggacctgggtctggctggcttctatgatgtgcgcttcaccaccagcaccacgcggcagcgcacgcccttcgcgtttgatccgtacaacgaccgcaccgggggcgtgggcctggtgatgcgggggacgttcgacattcccatcaaggacgcccagctcgagcaggcccgcgcggagctggacaagctgcgcgcgcaggagaagcagattcgcgcgggcatccgcctggaggtctccaaggtgcacggcgagctggtggccgcctggagtcgcgcccgggcctttggcgaggcggagcggagcgcccgccggtgggtgacggccgccttcaccgcgttcgacctggggaccggtgacactcgtgacctggtggacgctttcacggcctatgcccaggcttcaggtgacaaaggcaagagctggcacgacgttcgagtaggtatggccgccctcgcgcgggtaaccggggcgccgctggctccgggtgaataa

SEQ ID NO: 6813 - DNA, 93 bp, Myxococcus xanthus
atgccggagcagcagctcgtgctgtggccgctgggtgagcgcctgcgccgctggctgcgcgccggacagccggacatgtccgtctcccgctga

SEQ ID NO: 6814 - DNA, 1455 bp, Myxococcus xanthus
ttctccacggagacggtggtggagcgcgcgcgggcgctggcggcccggccctaccaggcgccgccgaagtcactgccgaaggcgtacacgcagctcaactacgaccagtaccgcgacatccgcttccgtccggagcgcgcgcactggcgagacgcgggcctgcccttccaggtgcagttcttccacccgggcttcctgttccagtccccagtggtgatgaacgtcgtggaggcgggccgctcgcagccgctgcgcttctcccaggacctcttcagctacggcaaggtcgtcaacaaggcgtccctgcctcgcagcggcgtggacggcttcgcgggcctgcgcttccaccacccgctcaaccgcccggacatcttcgacgagctcgcggtgttccagggcgccagctacttccgctcgctgggccagggcaacctctacggcctctccgcgcgtggcatcgccatcgacaccgcgcagccgagccccgaggagttcccggagtttcgagagttctggctggagcgcccggcctccggcgcgggccaggtggtggttcacgcgctgatggacggcccgagcatcaccggggcgtaccgcttcaccatcaccccgggctcgaacacggtgatggaggtgcaggccaccctcttctcgcgccgcaccatcgacaacctgggcgtggcgccgctcaccagcatgtacctgttcggtgagaacgaccgcgcgaagttcgacgacttccggccggaggtccacgactcggacggcctcctcgtctggaccaaggacggcgagcaactgtggcgcccgctgcagaacccgcggcaggtgcgcacctccagcttccgcgcggagactccgcgcgccttcggtctgttgcagcgcgatacggccttccacaactacgaggacctggaggcccactacgagcgccgccccagcgcgtgggtggagcccgtgggcgaatggggcgcgggcgcggtgcggctggtggagattccgacgccggacgagacgcacgacaacatcgtcgccttctgggtaccggacgcgccgctcaccccgggcacgccgctgcgcgtggcctaccgcctgcactggggcgccaggtcgccctgggagagcaccggcggcgtcgtcacctcgacgcgcatcacctccgccatcaccccgggcatgcccgtgggcgaaggcgtcacgccggccacgcgccgattcatcctcgacttctctcgcaccgcccgcgccgaggacgggccggtggaagccgtcatcaccgcggccaagggccaggtgctgcgctccaccatccagcgccacgaaccttgcgggggttggcgcaccaccttcgagctggagcccgagggcaccagtgaacccatcgagctgcgcgcgttcctgcggcgcggttcggagaccctcaccgagacctggagctatctatggattccgtga

SEQ ID NO: 6815 - DNA, 1827 bp, Myxococcus xanthus
atgcatgacctcgtcatcggcatcgacctgggtactaccaacagcgccgtggcgaccgtggaagacggacgcccgcgcatgattcccccgcgcgcgggtggccggttgacgccgtccacgctgggcgtgaacaaagctggcgagcgcgtggtgggcgtcgcggcacaatccctgggcgaggagcacccggactccgtggtgtgggccaccaagcgtttcctggggcgccgctacacgccggagctggttcaggaggcgaaggcgctggtgccgtatccgctggtggccgggccctctggcgacgtgcgcgtgcggctcgccgggcgggtgatgcccgtcacgcaggtgtccgcgatgattctgggcgagctggccctggacgcgcaggcgcacttcggccgccccgttaccaagtgtgtcatcacggttccggccaacttcgacgacaaccagcggcaggccacgcgcgaggcggccagcatcgccgggctggacgtggtgcggctggtgaacgagcccaccgccgcggcgctggcgtatggcctgtcacgcggcttcgaaggcaacgcgctggtgttcgacctgggcggtggcaccttcgatgtgtccatcctcgaggtgaagtccggtgtcttcgaggtgcgcgccaccggcggcgatccgcggctgggtggcgaggacttcgaccagcgcatcgtccagtggctcctggcgcaggtggacgatgagctgcggcacgtggtgtcgcaggacgcgcagagcctgcgccggctgaaggtggccgccgagtccgccaagcgcgagctcaccgagaaggaagaggcgtccatctacgtcgccgggttgggcgaccactcggcgcccggcaagcggatggcggagctggagacggtgctgacgcgctccttcttcgaaacgctgtccgagccgctgtcgcgccgctgcctcgatgtctgcgagtcggtgatgcgcgaggcgaagatggacccccacgcggtggacgtggtgctgctggtgggcggcatgacgcgcgtgccgctggtgcggcggttggtggcggactttttcggccgcgcgccctccacggacgtgcacccggaggaggccgtcgcgctgggcgctgcggtgcaggccgacgagctcgtccgccagtccggtcaggcgctgctgctggacgtcgccgcccagagcctgggcgtgggcgtcatgggtgggcgcgtgaagcggctcatcccgaagaacaccggcgtgccggtggtggcgcgggacatcttctatccgggcagctccggccagcaggaagcgcgcatccccgtgtatcagggcgagagcgagttccaggacgagaactacaagctgggcgaggtggtgctgaagcgcctccacgtcgccgcgcgcggagaggtgccgctggaggtcgtcttcgagctgtccagcgaggccatcctgtccgtcaaggccacggacctgacctcgggcaacatggaggccgtgcggctggaggcccgtgcggggctgccgcagggcgaggcggagaagctgggcgcggagcaggcccactacgcgcgctcgcagggcgtggtggacgcgaagcgcgcggaggagctgttccgcaagctgctggagcgcggggagaagctggcgcggttgctccagcgcagcgcgcaggagaaccccagcccggaggcgcaggccaccctgggcacggtgcagcgtctgttggatggtggccgctctgccctcgacagcggcaacgcggcgcagtgcgccaccattgccaagcagctcacgcggttgttgtccggtcgccaggagcctcgcgcctga

SEQ ID NO: 6816 - DNA, 882 bp, Myxococcus xanthus
atgagccctcctcccaacgcgcgtgacaccgtgttcgtggtggatgactcccgtaccgcccgggaggtggtgcgcctgcacctgacacggctgggctgcgaggcggtggcgctggagggcggcgaggcgtgcatggccgagctggcccggcgcaccccggcgctcatcctgttggacctgcgcatggagcgcatgcagggggacgaggtgtgccggctggtgaaggcacacgccgcggggcgcaacgtgcccgtcatcatgttcacctccggcggcgagccccacgaggtgatgcactgctggcgcgcgggcgccgacgacttcctgcccaagccggtggcgctgggcgccctggaggcgaagctggccgcggtgcgccaggcccgggagcgtgtccgcgagggcccgccgcgtgggcgccgggtgctgctggtggagggcggccgtttcctgcacaccttcctgggcggctcgttggagcaggagggcctccacgtcctctacgcccgggacatgggggacgcggcgaacctggcggcggagcacggcgcgcagttggatggcttcgtggtggacgtgtcgcgcacgccgcgcgaggcgctggccctggccacgaagctccacgacgcgcacccgcgcaagccgctggtgctgctgtcgcgcgcggaggagtcgcaggaggtgctcgcccgggcgcaggcgctgggtggcgcgccgctcctggagaagcgtcacatgggtgcggacgagctgctcggctgcgttctggggcgactggttccgggccacgccccgctgcgcgccgcggagcgcgtgcccttcttcacggtggtggagttcaccacgcccaacggggcaacgctgtcgggcttcagccatgac

SEQ ID NO: 6817 - DNA, 312 bp, Myxococcus xanthus
gccatggtgaacgtgtcgatcgcccgccgctacgcccgcgccctcctcgatgtcgcttcggaggcgggccgcactgacgccgtcgccgagcagctcaccgccttcgccgacgtcatcgcgaagaacgccgagctgacggatgtgctcgtcaaccccgcctacacccgtgagcaacgcctgcgggtggtggagtcggtgatgcaggccatccccggcggcgtggaggccacgctggccaacaccctccgcctgctggtggaccgcaaccgcctgggctacctggcggacatcgcccgcctcttccgcgacatg

SEQ ID NO: 6818 - DNA, 2106 bp, Myxococcus xanthus
atgaagaagccgaccctctttgggaagtacctgctcctcgagcgcatcaacgtcggcggcatggcggaggtgttcatcgcgaaggccttcggcgtcgagggcttcgagcgcatcctggccatcaagaagatcctccccacgatggcggaggacgaagagttcatcacgatgttcatcgacgaggcgcggatcagcgttcagctgaaccacgccaacgtcgtgcacatcaacgaactcgggaagtacgacgacacctacttcatcgccatggagtacgtcgccgggcgcgacgtccggaccatgttggagcgctaccggcgtcgtaaggagatcatgcccaccgcccaagcggtgttcatcgcctccaagatctgcgacggcctggactacgcgcaccggaagaaggacgcccgcgggcaggacctccacatcatccaccgtgacgtgtcgccccagaacatcctcatttcctatgagggtgaggtcaaggtcatcgacttcgggtatcgcgaaggcggcgaaccgttcgcagaagacgcaggcgggcatcctcaagggcaagttcgggtacatgagcccggagcaggtccggggtatgcccatcgaccggcgcagcgacatcttcgccgtgggcgtgctgctgtacgagatgctcacgggcgagaagctcttcgtcggcgagtcggacttctccaccctggagaaggtgcgcaacgcggaggttccgctccccagcgagttcaacccgagcatcccgcagggcctggagaaggtggtcctcaaggcactcactcgcgaacccgaggaccgctaccagtgggcgtccgacatggccgaggacctgatgcggttcctcctggccggtgacgccatctactcgtccaagcacctctccagttacatgaaggaggcgttcgccgaggacatgctccgcgaggcggagaagatggagcgctatgccggtatcgagcgccccgaccagattgaggcctcgggcatcacggtggctcccgggttcaatcggcaggcggcgcggcgtgcgccccctcctgccgtggtggtgacgggaacacccgcgggccgtgcgtccacctcaccggcgcagcctgtccaggactacatcccgcctcccaccgccgaggaactcgaggagatgggcgttggcgcgggcgacaagacgcagattgtcgactcctcgcatacgttcatgtctcccgaaacccgcgttgccgacagcagcgtcgtggtggacgacagcatcacgggccggacggagaaccccatccaggaccatgggacgtccggttcctacaactccttgcgcgcccccgcgcccgatacgtcctcgcgcaggggcaagagtggccccaaggcgcaggtcgtcatcagcaacgaggaaggcgaggcctactccggcgccacgatgattggccccgcgccgtccgcgccgccgacgcgctcgcgcggctcgtctccctcgctggacgaagagacgggcagcaggccagcgcccgtgtcgggccgcggccggagcggaaagcgcgctcccgagcccgaagaggatccgtctgactacgagcagccgcccgaggacgacagcagcgccggctacgacgcccaggacgactacggtgacgaaggtcatccgcacgacgacctgaacgagcccgaggaagaggtgacgggctcggttcccctccccccggaggaggcgcctccacctgcgaaggtcgctgcgcccgcgaaggcgaaggcgaagacgaaggtccccgccaaggggaagcccgcgctcaacctcaagacgctgccgaagccggtgctgttcgccgccgccgcggccatcgtgctgttgctcgtcgtcggcgtggtgatggccaccaggccgtccacgggcgaggtcaccttcatggtgtccccgtccaacccttccgcgcgcatccagctgaatggccaggaggtccagctcaacacgctgctggcactcccggcagggcagtaccgggtcacccgcgaacgctccgggtcagcaaagcgcgggccaagacggtgggatgtcgtcgccgggaagcagggatcgtcgtttcggcttccgctgggaaagctgat

SEQ ID NO: 6819 - DNA, 1017 bp, Myxococcus xanthus
accatctttggccaggcgattccggaggacggtgccacgccgctgcacctggcgctgcgggcggcggcccatgcggagccggtgctggaggcgccggccccgcgcgtcgccgcgcccgaggggttggacgttcgcgtgagtctcgcggagggctggacgcgggtggtggccaacgacgtgtcggtggatggcttcttcgccgcgtgggagggcgcgctgccgccgctggccgcgcgcctgggcgtggagctgtccttcgcggggcgcaccgtgacgtgcgagggcgacgtcgtccgccatgtcacgggagacgaggcccggacctggggcgtggccgcgggcgcgttcatccacttcgctgagcccgcaccggcgctgtgccagtgggtggcgtggatgctggaggaggggcgccggccggagccgcgtcccgatggggagctggcgcggctgctcgcccgggccgcggaggccgcgaaggacccttatgtcctgctgggcgcgcggcccgacgccgacttcgaggagattcgccgccgggccagcgccgccctgcgccggctggagggcttccgcgtccgtccgctgccgtccgggcagcgccgcgcgctggaggcgctgcgggggcgggtggagtccgcccgccgcaccctgcgcgagccgctcacccgcgccggcttcgacgccgttcggggcaccctgccggggctggcccgctgcgtggaagcagggctgccggacgaggaggtggagcccctgcgccacgccttcctgtcggcccggccgggctcggaggcccaggcccgggcgctcttcacccagggacacgcgctggaggtgcagcgggccctgcgcgccgccctctctcgctatgcgagcgcgctggcgttggatccactcaacgtgtcgtggctgcggcactaccaggagctgcgccagcgggcacaggggctgacgccttccatgcccctcgtgcttcacgaggggaccatggcccctgcggccctgcttccgtag

SEQ ID NO: 6820 - DNA, 1371 bp, Myxococcus xanthus
atgaacgcgcacatcttccgcgaatacgatatccgaggcttggtcgataaggacctcaccaccgaggtggtggagctgctgggcaagggcctgggcaccatcatccgtcgccagggcgggcgctccatcgcggtgggccgcgactgccgcgagtcctccacccgcttccgggacgcgctctgcgcgggcctcacctccacgggcctcaatgtgttcgacgtgggcgtggtccccacgccgctgacgtacttcgccgccaacaccctgccggtggacggcctggcgatgattaccggcagccacaacccgcccgagtacaacggcttcaagattggcgcggggaagacgaccttccacagccacgagattcaagccctgcgcaagctcatcgaagcgcgggacttcgaggtgtctcccaagccgggcaccgtgacgccgtacgacatcatcacgccctacaaccacttcgtccgccagacggtgaaggtgggccgcaaggggatgcgcatcgtcatcgacgccggcaacggcacgggcggcgccatcgcggtgccgctgttcgagagcatgggcttcgacgtggtgcccctgttctgtgagatggacgcgacgttccccaaccaccacccggacccgacggtggtggagaacctggaggacctcatcgcggcggtgaagcgcgagaaggccgaggtgggcatcgcctacgacggcgacagcgaccgcatcggcgtcatcgacgaccagggcaacatcctctggggcgaccagttgatggtgctcttcagccgctacgtgctgaaggagagcccgggcgcggccatcgtcggcgaggtgaagtgcagctacacgctgtacgacgacatcgcgaagcgcggcggcaagcccatcatgtggaaggccgggcactcgctcatcaagtcgaagatgaaggagacgcaggcggagctggcaggagagatgagcggccacatcttcttcaagaaccgctacttcggcttcgacgatgccatctactccaccgcgcgcctgctggagattctcacgcacgagaaggcgaccatgtcggagctcctgtccgacgtgccgaagacgtacgccagcccggagctgcgcttcgacacgaaggaagagaagaagttcgagatggtgaagcgcgccacggagacgctgcgcgacgcgggccacgacatcatcgacgtggacggcgtgcgcgtgacgttccccgacggctggggcctcatccgtgcctccaacacgcagcccatcctggtgctgcgcttcgaggccaacacgcccgagcgcctcaaggaaatccaggccctcatcgagggcaccgtggagaaggtcaaggtcgaggtcgggggctga

SEQ ID NO: 6821 - DNA, 540 bp, Myxococcus xanthus
cgcatcctcgccatcagtggcagcctccggacggggagcttcaaccgtcagctcctggccattgccgttgcccacgcccgctcgctgggcgcggaggtggacgtggtggacctcaagacgctggagctccccctctacgacggcgacgtggaggccaaggccctgcccgctcccgtggaggagctgcgcgagcggctgggcaaggcccagggcctgctcatcgccagcccggagtacaactcttccattccgggcggcctgaagaacgccatcgactgggtgtcccgcccgcccggcaggctcttccaggagaagtgggtggcgatgatgggcgccacgcccggcgtcttcggcaccgcgcgcatgcagccgcacctgcggcaggtgatggcctccgtgggggcgcacgtgctgcccacgcaggtgcacatggcccgcgtgtcggatgccttcactccggacgggaaactcaaggacgaggcgcgccagaaggaagtggaagggctggcggccgcgttggtttccaagctgaagccctga

SEQ ID NO: 6822 - DNA, 534 bp, Myxococcus xanthus
catgaccccgagcgaagggatcgcatcatcgaggccgcgctggcggtcatcgccgaagggggcgtggccggcacgtcgcaccgccgggtcgccgagcgcgcgggcgtccccctgggctcgatgacctaccacttcacgagcatggacgaactgctgcacgaggcgttcagccgcttcgcccagcgcatcagcgagcggttcgccgagcggatcgccgcggccaccgaccttgacgcgttggtctccgccatcgtccacatcgtgcacgacgacctcgcggcggggcaggacgagctcgtgctcacgctcgagctctacacgctcgcggcgcgccaacgcgccttccggcaaatcacccacgactggatgcgccgcagccgcgccgtgctggaacggttcgtcgacgccaggatggcgcacgagctcgacgccttgattgaggggctgttcatccacgtcagcctcgaccccgccccccgcagccgcgacctgacccgggacgccgtgcgccgccttctctcgcgctccccctga

SEQ ID NO: 6823 - DNA, 797 bp, Myxococcus xanthus
acgctcggaatcgacctgggggggaccttcgcccgcgccgccgtggtggacgaggttggcaaactgatcgcctcctcgaaggtggctttggtggagcgcagtccctcgggggtcgtggagaccattgcccaggcggcctcggacgcggtgatggccgccggtgtgccgctgggcgcgtgcggtgtggcggccgccgggcagattcacaaggactcgggcgtgctgtcggtggctcccaatctgggctggcgcaacgtgccgctgggcgcgctgctcacggaccggctgggccagccggtgcgcgtggtgaatgacctggccgcggcggcctggggcgaactccacgccggcgcgggtcggggctcccaggacatgctggtggtgttcgtgggctcgggtgtggggagcgccatcatcgcgggcggacggctcgtagatggcggtggcggtgtggcgggcgagttgggccacatcaaggtggttcccggcgggcgccgctgcggctgtggtgagctggggtgtctggaggcctacgccggtggccacaacctcatcgcgcagacgcgggagttgctcgccagcggtggtgcgccggaggtggcgcggctgacgggcggagacccggcgcgcatcaccccggtgacgttggagcaggcggcggaggcgggcgacgtggcggccggtgaagtctacgcgcgggcggcgcagttcctggccctggccgtggccaaccaggtgacgatgctcaacccggcgcggctggtgctgggtggcggcgtgctgagacactgccgtag

SEQ ID NO: 6824 - DNA, 342 bp, Myxococcus xanthus
atggcacagctgcaagcggatgagatgctctacattcccaatcgaaggcggctcacgcacgaccggctcgacgcgggaaatggccagcaggtcctgcacctcttctatggcgaggtggagctcatcttcgacgagccggacatcgcgcccctgggcgagaagctgctccaggtcgagcaatttcaagcctccgatgccatggcgtggtcggacggcgcgccccattcctgggacaagatccgggacctgctcgaaacattgatcgaacagcgggtgttgaggcgggtctcggatgcgcccacgggccgcaccgcggtgtccttccctgaccggttgggggag

SEQ ID NO: 6825 - DNA, 1272 bp, Myxococcus xanthus
gcggtctggtggacggcgttcgccgatccggctctcgacacggccatccaagagtgcttcggcgacaacctggtcctgcgcgaggtgcgggagctgatctacgagaaccagctcgaccccaacgtgccgcaaggttggtggtacccgctccaggtcggcatcctgaaccctgcggggctgagtcatgtcgttgccaacgccaaccttccgcccgcgccgccaacccgggccgagtacaacgtcgccaccgtcggtttcggcgtgacctaccaggtcgacctgtttggagccctcggtgcgcagcggcgcgcgggattgaacttcgccgagcagcagcggcagctcaccgagggccgcgtccaggacctcgcggtgcggatcacccaggtctggttcgacatcctcgaggcccgcgcgctccgggacctcacgctgcggcagatcgactacaacaagaaactgctccggctgattcgagcgcggttcgagcagcacctcacgccccggctcgtggtgctgcagcaggagcagttgctggtgaacctcgaatcgcaggtgccgctgatcgccacccggaacgcgctcttgaattcggagctgaaggcgctgctgggccgggtaccaacccccgccgacgacgtcattccactcgatcgacagcttcccgatctcccgcccccaccgaaactcggaacgccgggcgacctgaacgtgaacacgcccgagatgcggctcgcggagcttcgcgtcgccgaggtcgagcaccgcatcaacgcgaacctggcgagctggcttccgacgatccaactggtgggcaacgtgggcgctttgaaggtcggcctctcggagccggccctggccgagtccgtcgtcggggtgaacctgacctgggccctgttcgatggaaggcgcgtcaccgagtacatgcgactgccgatccagctccagcgtcgcgaaatccaataccagctcgcgctgcacaccgcgatcggacgggtgcaggatgccgtggttcgggaggagaacgaggcgacgagcctgcgcagcctgcgtgcgcaggtccagctcgggcagcagctcctggacgaggcgaggcggctcttcgagcaggggcattcggactatctgacggtgctcaccgccctgacgaatctggtcgggcttgagcgcgcaagtctgcaagcgcaacggctgctgctcaaccatcgcgtcgaggtctatcgctcgctcggcggcacctggtcgcgcgacgtcacactgaagcgggagtga

SEQ ID NO: 6826 - DNA, 2562 bp, Myxococcus xanthus
gctcgtctcgggcggccaaggtcagcgcgtgcgcctggcgcgcgcgatgcttcgctccggcgtgcgcctggccatcctcgacgagccctttcgcggtctcgatcgcgaccggcgcgcgcggctcctcgccgagtcccggcggctctgggcagacatcacactcctctgtgtcacccacgacgtcgagcacacccaggagttcgatcgcgtgctcgtgatcgagaacggtcggatcctcgagaacgggccgccgaaggagctgctcgcgaacaaagagtcgcggtacgccgtgctccttcgcgccgaccaggagaatcgcacgctgctctggggcggtgggcgttggcgccattggtggctttcggacggccaactggtggagaggccggcgccgaagccggtggagacgccggtcgcggagcccgccgcaggcggtttggagctggcgggatgacgcgctcgcactccgacctgttgtggccggtcgagcgattgcccgacgcgctggagcagctggcgcagaggcaaggctatggcagggccgcgggcgagatcgctccgcccgcggcggccgtcgagccgagccgggtctggatgttcgcgctcggagatcgactcggcgtggagctcgagccgatcacgccactctaccacgagctgcccgacgtccttgcacgcgccgcgccctgcatcctccaggtccggcgagacggcgtcccgtcctatctggtgctgctgggtacgcggcgtgggaagctgcgcctgctcgcgcgcgacgccacggcggtttcggtcccgacgaagagcgcgatcgcgctcctgcgcgaagagcaggaagccaccgtcgccgaggtggaccagctgcttggcggcgtggagatgtcgccccgtgcgcgcgagcacgcccgctcacagatgctgctgcagcggctcggccaggcgcagctgcgcaccggctggatcatgcgccccaggcgcaccgcgagccggcggacgctgctcggcgacatcccttctctcgtcgccggcatcctcgtgagccacacgctcctctcgctggtgctggctggctcgttctggttgctcggtcgcgccgcgctccaggcccacctcgagaccggctggttcctggggtggatcgcggtgatcgcgtgcgcgattccgctccgcatgctcgaggtgtggtggcagggcgtgttctcgatccggctcggaacgctgctgaagcagcagctccttgcgggaaccctcaagctgacccccgacgaggtgcggctcgacggcatcggccgccatttcggccgcgtcgccgaggccgaggtcgtcgagcagcttgcggtcggcggcgccctgctcgcggtgttgtcgctcgtcgacttgatcctggcgggcgtcatcctcgtgctcggtgcgggagggtggccccaaacgatggtgctcgtcctgtgggtcgtggtcgcgttcgtcctcgcgcgccgccactacggcgtccagcgggcgtggtcgagcgcgcgcgtcgagatcacccacgacctgctcgagcgcatgctcggccatcggacgcggctggcgcagcttccactcgagcgctggcatgatggcgaagacgtccgcttgagctcctactccgagatctcgaaggtcatggatcgccggaccatgcagctgaccgcgctcctgcgcgacggctggttggtgctcgccctgctgaccttgctgccggcgttcagcagcggtacggccaatgccagcgcgctggcggtgtccgtgggcggcatcttgctcgcgctgcgagccttcgacgaggtcgccgtctacttccagcaggtctcccaggcggcggtgtcgttcgagcagatccgcgacttgttgctcgcggtgggccgccccgagctcgaatcgaaagtccctctcgaaatggagggaggcaagcccaccgacgccgccggcggaaccctcatcgaggcgcggggcgtgaccttccggcacgacgcgcgcacccggccggtgctcgagaactgctcgttccagatcgcgcagggcgaccgcatcttgctggagggcccatcgggcggtggcaagtcgacgctggtgtcgctgttgacgggcctgaggacgccgcagggcggtgtgatgctgctgcacgcgttggaccgcgcgacgttcggctcctcgggctggcgcaagcgcatcaccgccgcgccgcagttccacgagaaccacgtcctgtccggcagcttcgcgtacaatctcctgctcgggcgcgagtggccgacctcgcccgagctgcggaccaaggccgccgcgctgtgcaaggagctcgggctggacgagctgatcgccaagatgcccgccggcctcgaggagatgatcggcgagaccggctggcaactctcgcacggcgagaagagccggctctacatcgcgcgcacgctgctgcagggggtcgagctggtcatcctcgacgagagcttcgcctccctcgatcccgagaccatgcgggtcgcgcagcgctgcgtcctcaaccacgcgaaagccctcgtggtcgtcagccacccatga

SEQ ID NO: 6827 - DNA, 304 bp, Myxococcus xanthus
atgcgatgctggcaatggaagtccttccaggcgctgtccctcgacgagctgtacgacgtgctcgccctgcgacaggaagtcttcgtggtggagcagcgctccatctaccaggacgtggacggtttcgaccggagcgcggaacacctgctgctccacacggagtcgcagggcccccggctgctcgccgggtacttgagggtgctgccccccggtgtgaagtatccccaggagagcagcctgggccgcgtggtgacgtcgccccgcgcacgggccccagggctggggcgagagctggtggcgcgtg

SEQ ID NO: 6828 - DNA, 150 bp, Myxococcus xanthus
atggtggtgtcgatcgccgcgtcgctgacgctgtccgtgcacgtcccggtgtcgcgtcgggggctgctggtggcgcattcggtgctggggggcgcgctgtgttcatccttctctccggaggcttggagcgccctcgcggacagtctgtag

SEQ ID NO: 6829 - DNA, 633 bp, Myxococcus xanthus
taggcgcgcatgcgtgtcgcccgtctcatgcgggcagcgcaccttgagggcgtcagccgccgcaggtggtgcgtcaccacgacgcgcgacgagcgcgcacgccctgcgcccgacctggtcgaccgcaacttcgcggcccctggacccgaccacctctgggtggctgacatcacgtacattccgacgcacgccggtttcctctacctcgccgtcgtgcttgacgcatggagccgtaaagtcgtcggttgggccatggctggccacctcaagacggagctcgtcgtgcaggcactcgacatggctgtggggcagcgtcagccccaaagcgtcgtgcaccacagcgaccaagggacgcagtacacctcgattggcttcgggcttcggtgcaaggaagccggcgtgcgcccatccatgggcagcgtcggcgacgcgtacgacaacgcgatgtgtgaaagcttcttcgccacgctcgagtgcgaactgctcgcacgccgccgcttcacgtctcacgccgaggcgcggatggccgtcttccgcttcatcgagggctggtacaatccgctccggcgccactccgcgctcgactacgagtcacccgctggttacgagaagaagcaccgcgctgccgcttga

SEQ ID NO: 6830 - DNA, 465 bp, Myxococcus xanthus
atgaaggcgttcaaccatgcggacgccggggatgtgggcaccgctgagaagttcgaagcgctcaagaaggccagtcggtcctccacgacggacatcgccgccaaggcgcacggcgacagcaacaacaaggcacagaagcggctcaaccaggggatcaagacaggcgccgagaagaccgcggacagcgcgttcgacgcggccatcgagaaaggtgccaaggccgcaggcggaaagctggccaagttcgcgggacgattcgtgcccggcgcgaacgtcgccgtcgccggcttcgacatcgccacagccatcgcgacgtccaactccaaggacgccagcccaggcaagaagataacagcgtggacaaccgccgcagggtccgtgctcgcggccacgaacatcccggtggtgagtcaggtcggcgcggccttctccacagtctccgacctcgtcgggagcttcttctag

SEQ ID NO: 6831 - DNA, 585 bp, Myxococcus xanthus
atgaaggcggcctaccaggtgacgctactgggggagtcatctccagaactcttcgccgcgctgggacgcggaggcacgctcgacgaggtcatggagtacatcgccggggaactcatcgcccagcgggacgcgcagtacctgtgggacttccaggaccacgtgatgagggaggtggctcggcgcacgcatgtcgaggtgccacggagcctcatcgacgaagaaatccgccagcggtgggccgaggccgagtatccaatcctggtgagcctgggcctaccgcacgagcgggtccgggaaggactggatggctggctgctcgacgactccacccggagcgaactggagtaccggctgcggctggcgcttgggcttcgggccatcgccgaaagagaccacatccagtccgagcgggagtccgcggaggagctgttcaacagcctcgcggagagagcccaactgagccgcgttgagctggggcgcctgctccagtccgacaagaatctcggccggaggttcgacacgctgacgatgcacacggcggtcgtcagccacatcctgtccaaggccgacgtttcgcgggagtaa

SEQ ID NO: 6832 - DNA, 627 bp, Myxococcus xanthus
tggctcatccgagtcacccactggctcaacgtaccgctgctgctcatcatggcggccagcggactccagatacttgtcgcctatcccatgctcggaccacagggccggccctacggctggtatccctaccagggcatccctccacccgaatggatgcggctggggaactggctggccggcgcccgtcactggcacttcgccttcgcgtggttcctcatcctcaacggcgtggcgtacgtgctctacctcgccctcagcggtgagtggcgccgccgcctcttcctgccccgccgcgacacacgcaacgccctggacacgctcgccttctacctgcgcgtgcgaaaacacgcgcccgcgcaggggctctacaacggccttcagcggctggcgtacacgggcacgctggcgctgggactgctcgcggtgctctccgggctggtcctctacaagcccgtgcagttcggcgcgctcacttcgctgctaggtggctacgacgcggcgcgcgccatccacctcgtcatcctggcgctgctcgccctgttcaccgtgggccacatcaccctggtgctgctccacccgcgaagcctggcggagatggtgacgggcggaaggaagccggatgcctag

SEQ ID NO: 6833 - DNA, 1191 bp, Myxococcus xanthus
ttcctcaccaacggcgccatcctcgccaacctcctgccgcgctatccgcaaatcaaagccgacctgggcctcagcaacgcgcaatacgggctggcggtcgccgcgttccccagtggcgcgatggtggcggggctcgccgccggagcgctcatccgcggcttccgctcctcacgggtcgccgtcgccggcacgctattgacgagcctgggcgtgctggtcgcgggcctcgcatcatcatggtgggtgctcgccgtttcgctcttcttcgcgggcggcatggacgccatcaccgacgtggcgcagaactcccacgggctgcgggtgcagcggctccatggccggtccatcctcaactccttccacgcggtctggagcatcggcgcggtggtcggcggactcatgggcgggctcgccgcgggactgaacgtgcaccggggcctgcatctgggattctccgccctgctcttcgccggggtgtccttgatggcgctgcgctacacgctccccggccccgagcccatcgtcgccgtcgagcctgagcccgcggcggcgcacctggacagcgttcccgcacggcgccagccgacggggcgcatctggctggtgattgccgcgctggtcttgattgccgtcggcggcacgctcgtcgaggacgcgggcatgacgtgggcagccgtctacctctccggaacgctcggcgccacggcagccgtcgcttcattcgggttcgtcgccctcgtgggcgcgcagttcgtgggccggatgctgggcgatggactggtggaccggttcggtcagcgcgccatcgctcgggccggcggggccaccacggcgctgggcatgagcgcggcgctcctgcttccctcgatgccgggcaccatcgcgggcttcgcgctcgcgggcttcggcgtcgccacgttggtccccgccgccatgcacggcgccgatgagctgcccggcctgagaccgggaacgggactcaccgtcgtcagttggctgatgcgcctggggttcctcgcgtcgcccccgctcgtcgggctcgtcgccgacgccgtgggcttgcgtgtggggctgctcgtggtgccgctcgcggggaccatcgtcgtgttgctctcgggagtcctggccaccgtccgcgccaccgccaccgcgccgggtggccaaggcccctccctcccgcagccccattga

SEQ ID NO: 6834 - DNA, 675 bp, Myxococcus xanthus
ccgttgagcgaccccaccgtgtggggggccgcgctgaaggacccgcttgtcccagtggacgtgagcgacgggggccgcttcgtcctggtgacgcatcgccattccgaccacttcgaccgggtggccgtccgtcaggcgctgggggacagcgggacgctggtgtgcgccccagacatggccgcggcggcttcggcgtcgggattccgcgtgcggtccgccccgctctacgagcccatcttgctcaatgacttcaccgccaccgccgttcccgcggcggacggctatggggatccccaggtttcgtgggtcgtctccggtggaggccgccgcatcatccactgcggcgacacgctgtggcatggctcctggtggcacatcgggcgacagttcggccccttcgatgcggcattcctgcctatcaacggggcgcgcttcggctggcgcaagcccgtgagcgacgtgcatgccgtcctgacgccggagcaggcggtggccgcggccttggtgttgggagcaaagctcctcgtgcccatccactacggcctcgctgcctcggaggactaccaggaggtcccggacgcggaagcgctgcttctggccgccgcgcgcacgcggaaggtgaacgtggagctggcacgtccgggggagtggctgacctggcgggcccggacctga

SEQ ID NO: 6835 - DNA, 159 bp, Myxococcus xanthus
atgacgtcgctgctgtacctgacgaagcggcagacgcagttgcccgaggccctgccggaggagtccttctcggtgggcgcgacggcgctgctcgtcctggcgtcgctgcggctgagccggcgggccatcaagctggagcggcaggagctcttcgactag

SEQ ID NO: 6836 - DNA, 1656 bp, Myxococcus xanthus
atgaccatcgaaaaggcagggctgtacacgcgcaacggcacgcaggtccccctgcaaggtgtcgaagtcacgggcgagctcctcggcggccacgcgcgcgtccgcgttcgccagcgctaccgcaacgaggagtaccagccggtggaggccatctacaccttcccccttccctcggatgccacgctgtccgccttctccatgacgtgcgccgggcggcgcatcgaaggcgtggtgcgagagcgtgaagaggccttccgcacctacgacgacgccgtcacggccggccatggcgccgcgctgctcgacgaggagcgccgcaacgtcttcaccgcccaggtgggcaacctgctgccctatgaggagaccgtggtggaggtggagttcctccaggccgtcaccgccgaggaaggcagcgtgcgctggatgctccccacgctggtggcgcctcgctacatccccggcgcgaccacgggcgaccgcaccggccacggcagtgaagagcccacggcccaggtgccggacgcggaccgcatcaccccgcccgtgggtaacgtgcactacggcctgcgcatggacctgctcgtggacctgggccgcgaggtggtggtggagagcccgtcccacgccatcaccaccacccgggaggaaggcacccgcgtgcgcgtcggcttctcgcgcggcgaggtgtccctggaccgcgacctggtgctgagcctgcgcagcccggacagcagcgcggtgttcacgccgctcgtcacgcaccgcaagggcgagggaggcccgggcaccttcgcgctcaccgtggtgccggacctgctggccctggcctccgcgccgcccaagcaggaggtggtgttcgtcgtggacgtctccggctccatggccggtgagagcctgccccaggcccaggccgcgctccggctgtgcctgcgccacctgcgcgagggcgaccggttcaacgtcatcgcgttcgagaatcgcttccagtcgttccagcccgagcctgtgcccttcacgcagcgcacgctcgaagaggcggaccgctgggtggccgcgctgaacgcggatggcggcacggagctgctcgcgcccatgcgcgccgcagtgcaggcggcgcccgacggcgtcatcgtcctgctcacggacggacaggtggggaacgaggcggagattctgcgcgccgtgctcgaggcgcggaagactgcgcgggtgtactcgttcggcatcggcaccaacgtcagcgacgtgctgctacgggacatggcgaagcagacgggcggtgacgtggagttcatccacccgggcgagcgcatcgacgacaaggtcgtggcgcagttctcccgtgcgctggcaccgcgtgtcaccgagctggaagtccactttgatggcgtggagtgcgcggagctggcgcccgccgagctaccgcccctggtggatggcgtgccctggacgctgctgggccgctatgcctcgcccgggacgggcacggtgacgctgcgggggcggtcgggacaggagcccttctcgcttaccgtccgcgtggacctgcccgcggtgtcggaccggccggcggtggagaagttgtgggccgccgagcgcatccggggctgggaggccgcccagctcgtcggacgccgcgcggagtccatgaaacag

SEQ ID NO: 6837 - DNA, 840 bp, Myxococcus xanthus
atgcaactgactggactgttcggagtgttcatccccgtcgccatcctgttcctgctcttcctgtcgggggtgcgaatcgtcaacgagtaccagaacggcgtggtgttccggctcgggcgcttcgtgggcctcaaacgcgcgggcttccgctggctcatccccttcgtcgagcgcatggtcatcatcgacctgcgcatcgtggcccgggacgtgcctccacaggacgtcatcacccgggacaacgtcagcgtgaaggtcaacgccgtcgtctacttccgcgtcatccacgccgacaaggccgtgctccaggtggaggactacctctatgccaccagccagctcgcccagacgacgctgcgctccatcctgggccaggtggagctggaccagctcctctccgagcgggagcgcatcaaccacgagattcagcaggtgctcgatgcacgcaccgacccgtggggcgtcaaggtgtccaacgtggaggtgaagcacatcgacctgcccgcggagatgcagcgggccatcgcgcggcaggccgaggctgagcgcgagcgccgcgcgaaaatcatcgccgccgagggcgaacaccaggccgccgagaagctctccatggccgccaaggtcctcggccgctacccggccaccctccagctccgctacctccagacgctggtggaaatcaccaccggtggcaatcacaccatcctgcccatcccgctagacctgctgcgcacgctcagcggcgtgaaagcccacatggagcgggccgacgatggacatgaagaccggcgatacaccgaggatgaggaagagggccctcccgcgggcggcctgtcctga

SEQ ID NO: 6838 - DNA, 657 bp, Myxococcus xanthus
gcgcacatcgtcacgatggagcccacgctgtcccagcgcaccgtgcacgcgctcgccaatcccgccatcgtctacctgctgttcctggtggccgggctggggctggtggtggagctgtcacatccaggcgccatcgccccggggctcatcggcgtggtggcgctggtcctggcgttggtggcgtcctccgcgctgccggttcgcgcgggcgcagtgctgctgatgatggcgggcgtggccctcatcgtcgcggagctgttcgtcaccagtgggctgctcggcgccgtgggcgtggtgctgctgggcctgggcggactgttcctcgtggaccgcttcaacccggagtggttcgtggaccgctcctttcaagtgtcgtggacgtggctggtgcccaccaccgtggcactgggaggtgcggcggcttacgtcgtctaccggagcgcgcagacgcggcggctcccccagcgaggtggcgacctggggctcgtgggagagcgaggcaccgccctggccccggtgacaccggagagcggcgaggtgttcgttcatggagagcgctggcgcgccacgtccaccgctcccatccgctccggcgcacacgtcgtggtgcggggcatggaaggactcaccctcttcgtcgacgaggtaccgacctga

SEQ ID NO: 6839 - DNA, 729 bp, Myxococcus xanthus
atgtccatgccagaccagccgaaaacggatgtggaaaaggagctcacggatctgcgccgtgagattgtcgaggcacgcaacctcgtcatcaagagcgacaacctgctcaagaacctccatgcggaggtgaaggcggttggcaaacgtcacgaagatttccagaagcgccagtggctgtcgtccgcggtggcctacgtgctgttcgcggtcatctgcgtgggcgccgcgctgatgatcaccagcgcgcgcagcaccagcgccaccaacgagaaggagcgcctggagaagacggtcgccgacctcaccggccaactggagaagcagcgcgcggacaccgcggcgcaccagtcggtccagcaggaggcgaacaaggtctacaagatgatgaccagcctgcccggtgacgagcgcctcaagggcatcgacgcgctggtgaagctggacacgtcgcggctgagcaacctggagcgccaggccctcaatgaccgcgccgccgtgctgcgccgggagacgggcgacgccgcgttcgagcagggcaagattgccttccgcaagaacgagatggacagcgtcatctccaacatggagcggttcctggccatgaacccgccgcaggaccaggcgctggacgcgtccttctacctgggtacggcctacaacaacacccgtaaccacgagaaggcggtgccgctgctcgcccgcttcgtggacggggaccgctttagagca

SEQ ID NO: 6840 - DNA, 825 bp, Myxococcus xanthus
atgcgtggtgcgctgcttcgtcgcatcacttcgccgccggcggaccaccttcctggaaatcgcgctgagccccaagcgcccctgacgccaaagccgccattgatgctccgtcgccttcttccgctcgcactgctgctttccgctcccgccgccgctcaggattacggatacggtgatgaggacgtgtccacctcgctggatggggtgggccgcatcaccatccagggcggctggcgcatcacccccaacaagacgctctacgacggctggtactcgcgctccgccaaccaggggctgccgcgtgcccgggaagtggcgggcgggcccacggtggtggcgtacttcgcctacgccatctccgacctgctggaggtgggcatcgacctgttcggcacgcagagtcgcctgtacctcaacgagccgggtgtcgacggcgggccgccgcaggcccggcaggtggacgtgctgggctacggggcgctcatcggcctgcgcttccagacggtgattccgcagttgggcccccatgggctcgtgcccttcgcgggcttgctgacggggcccacgctcgcctcgtcggagcgcaagggtgaggagctccaggaaaccaccacccagacgtggatgggcaacgtgggcgccacgttgcgcctgacgccgcgttggggcatcactgccgactaccggctcgcgttcctccgaggtccggtggggccgtccacggcgcgcgtcggttctttcagcctgggagggagctggctctcgctgggcgtgacgtacagctttccagcagagccatcacggctgctccctgggagcctgtag

SEQ ID NO: 6841 - DNA, 1860 bp, Myxococcus xanthus
atgtcccggattgcccgtctcagcgacgtcctcatcaacaagattgccgccggcgaagtggtggaacgccctgcctccgtcgtgaaggagctggtggaaaacgccatcgacgccggtgccggtacggtccgcgtcgagctggacggtggaggcgtggaccgcatcatcgtgtcggatgatgggcacggtatgggacgctcggacgccgtggcgtgcctggagcgccacgccaccagcaagctgcgcgagctggacgacctgttccacatcgactccatggggttccggggcgaggccattcccgccatcgcatccgtttcccggttcacacttcactccgcggccgcgaactccgaggtgggcacgcgggtgtcggtggagggcggtgggccaccgctggtggaggacgcgccgccgcggacgggcacggtcatgactgtggaggacctgttcttcaacgtgcccgcgcgccgcaagttcctgcgccggggcgacacggagctgaagcacgcggaggaggccgtggtgcgcctggccctggcgtacccggaggtgggcttcttcgcctcgcacgagggcggcacgctcttctccagcgcggcctgcccggatgacccgcgcgagcgaatcgccgcggcgctgggctccacgtcgcatccgcacctgttccccgtggaggagcgccggctgggcgtggccgtcacggggttcgccgcgtcgcccgagttcacattcaacaacgcgcgcggcctctacaccttcgtcaaccgccgctacatccgggatcgcggcctcattggcactattcagcgcgcgtaccaggacttcctcgccgccgggcgccagcccgtggtggtgctgcacatcgacgtggacccgcgcgcggtggacgtcaacgtgcacccgcagaagcaggaggtccgcttcgccgacgcccggggtgtccaggaggcgttgacggccgcgctcagccgcatgctgcgcgccgcgccgtggctgggctcgggcgtggagggcgccgcgccccaggccggccagcccatggacgccgcgcactacgcgcacgccgtggagcgcttcctcacccgcgcccaggaagccgcgtggggcggcccgctgcccaccgccatggacgcgccgggccccggtccaggggcgccgtccctggggccgctggggcagggggctcggccgggagcgctgcccttcgccgccgcggtggggcaggcccccgccttcggtcaggcgcagccgcaactcaacgaggcacctccgccgggctacttcggcgcgctgcggcccctgggcatgctggggggccgcttccatgtctgcgagggaccggggggcacgctggtggtgatggatccgcacgcggcgctggagcgcgcgcgcctgacgggctacctgcgcgcgttggagtccggcaagccgcctccggcgcccacgctcttcggcaccacgctggagttgcccgtcgcggcggccaaggctctggtggagggcagggaagccctgtcccgcctgggcttcgacgtggagccgttcggcggcaccacggtggcgttgaagacggtgccgccgggactggaaggggcggacgcgcgttcgctgctggaggccctggcgcgggcgcttccgccgaagagcgcgacgttggacacggtgtcgctggcggaggcggtgcgggtgatggcgtgccacgcagcgaagcaggccggcgccgtgccgctctccgacgcgcagttccgcgcgctgctcggggagttggaccgggccgacttccaccccacgtgcagccacggcacggtggtggtgttggagatgcccttgctggagctggagcggcgcgcccgctga

SEQ ID NO: 6842 - DNA, 2409 bp, Myxococcus xanthus
  unsure (1)..(2409): unsure at all n locations
atgtccgaatcccagcggctggtgcgggacggcgaggcggcgcaggtggccgccagcgccgccagcgcctcgggtgacaagaaggaggccgaggagaagtaccgcaaggccctggccctcttcgaacaggcactgaccgccgagcctggctccgtggccgccgccgccggcctgggtgccagcgccaacgcgctcaatgactggcagcgcaccgtggaccgggtgcagccggtgctgacggcgaacccctcggagctggccctggcctatccggtgagcgtggcgtacttcaagctgcgccgcttcccggaggccgtgccgctgatggagcgggtggccacggccgacaaggccgaacacctcatcgttcattactacctggccagctactacctctacgtccagcagggagacgcggcggccacgcggctgaagcgctacctggcgctgcgtccgcaggccctggcacccaacgacttccagattcacgagctgctgggtcgcgcccatgtgctgcgcggggatgccgcggcggcgcgcgcgtccttccagcaggcgcaggcgggccggccagagtcgccgtcggtgcaactgggcctggcgcaggtgctggagctggagggcagggccgtggaggcgcgcacgttgctggagggcgtcaccacgcgcttcccgcaggcgggtgatgcgcgcgagaagctggcccgtctgtacctgggcgcgggggacgtcgcgaaggcggacacgcaggcccaggcggtgatgaagctgggcagctcacccgcggcgcacctgctgctgggtgacgtgcgcttcgcccagaagaacgcggccgccgcggaggcggagtatcgcaaggtgctccagctccagccgggcctggtgctggggcagatggcggtgggcaaggcgctccaggcacagggccggcacgaggaggccatccagttcctggagggcgcggtgcgcgcgggcgccaacagcctggagctgtgggccaacctgggctcggtgaatcgccgcgcgggccgcttccagcgcgcggtggaggtgcaccggcgcgtggtggagatggcgccgcgtcaggccctgggctacgtgctgctgggcgcggaccacttcgccaccggccagtgggaccaggccatcgaggactacgccaacgcgctgcaggtggagccggaacacgccggggcgaagcagtggctggcccgggccctggcgcaccgggcgcgggacagggcgggcacgggacggctggaggacgccgtccgggatttgcgccgcgcgtacgacctggaccggggcgcacccatggcgcgccggctgggcgcctcgctgctggagacgcgcgcctacgcggacgcgcgcaaggtgatggagcagggcgtgatgctgccgggcgccgcgtggcgtgacagcttgctgctggggtacgcgcggctggccacgaacgatgcccaggcggcgctggaggccttcaaccgcgcggccgcccagacggaggagcccgacgaacaggcggaggcctccgtcggcgccgcgctggccgaggtggagctggggcaggtggacgcggcggtgcagcgcctcaccgcggtgggcccgtcgcgcgccgcggcgcaggtggcgggcgccaaccttccgcgcgtgctggtgcgccgggcgctggtgcgcctggaggccggagatgccgacgccgccgagcgggatttggacttggtggacaagctgggcacgggcaaccgcaaggagctggtgcggctggcccagttcgtccgcggcctggcgcgcgcggagtcggggcgccacgcggaggcgagcgcggccatcaccaaggcccttgcgtccacgcagccctgggcctggcccaacacgcgcgcgctggccaccgccttcgtgctctacaagaaggggcaggtgcccgccgcgcgcaagcagttgaccgcggcggcgaagaagccgatgcccggacagcccaagtggctgacggcgatgacgggcgcgctccaccgccgcgaggcatcccaggcgtacaatgccggcaacatgagggcggcggagaaggccttcaaggccgcgctcgccggcaatccggacgacacgcaggtgcagcacaacctggcctgcgtcgactggcgcaagggccgcacgacagacgccgtggagacgtggcgccggctggagtcgagcgtgccggtggccgcgctcaacctgggcatcgacgcgcaggagcgccgcaaggacgcgggtgaggccgtggaggcatggcgccgctacctggccggcggcagcggcccgcgcatggcgcangtgcgtgagtggaaggaacgcctgcagagtctgcacggcctggccgagcccgccgcgggcgcgcccgcggacgccaccgtggaggagaccccatga

SEQ ID NO: 6843 - DNA, 894 bp, Myxococcus xanthus
atgcaactggccgccggcaacctgagcgcgcgggcgggaacggcgcagggcgcgggccgcgaggtggtgacgctgggcgtggtgttcaaccacatggccgagcgcatcaaggtgctgctggaggacgtgcgggccaaggcgcagttggagcgagaggtgtcgctcgcgcgcaccgtgcaggagacgctgctgccggggcgcgagggcgtgcaggtggggccgctgcgcatcgccggcctggtcgtcaccgcggatgcgtgcggcggcgactggtggttccgggccgcgctggatgaccggcgcatcgtcattggcattggcgacgtgacgggccacggcctgtccacgtcgctggtggccaccagcgccaccagtggcttcgcctcggcgatgacgctgcgcgagccgtcgcaggtcaacgcgcagatgctcatcaccgccctcaacgtgacgctggccaacgtgggccgcggtgagcaccagatgtccagcgcgctggccgtcatcgacgtgtccaacggctacatcgactacgcggcgggcgcgcaccccagtccgctggtgttcaacaagcgcagcggtcagattgcatcgctgcccgcgcgcggcccgctgctgggcgcctccgtcgaatcccagttcacctcgcgccaggcccagctgcggccaggggacgtggtggtctggtacacggacggcctcaccgaggcgcgcgacaacgcgggcaagctctacggcacccagcgtctggccgccgcggtccaggcgcacgcccacctgtccgcggaggcgctgcgtgacgcggtgctggcggacgctcgcgccttcagcgccggccagccgcagcgggacgacatcaccgtcgtcgtggccgagttcagccccgccgcctga

SEQ ID NO: 6844 - DNA, 792 bp, Myxococcus xanthus
atgattacccgcaaggaattggagcgcagcgcgctctaccagcgcagcaaggagttggacctgagcctggagcacgtcatggcggtgctcctgcccgtccatcctcaactcctgggagccttcacgctctaccgggaccgccggctggctttctcggagaaggacgccgccttcctgacgagcctcacgccccacctgctgaacgcggtgcgcaactgccgcgacatgcagacggcctcgacgggctcccggctcctggaggagctctacagccggccggacgccgcctacgtcgtggtggcgccgccctcgcacgaggtgctgcgctcacgccgggccgccacgctgctggagcggtggttcaagccctcggacctgcattcctcggggattccgctcgtcctcatggagcggctgggggccctaacgcggatgacgccggacgcgcagctccaaaacaatctctgggtctccctccacggcgattcgtaccgcgtggtgcggttcgtcgagctccccgaaaccgaaggcccgcgtcagtgggccctgattctgaacgagattcccttgtcgattccgctccccgaaaccatgcgcatgcagctcacggcccggcaggtcgacatcgcccggggcatgctccacaactggtccaacgagcagattgccagcgagctgggcctctccgaggacaccgtgaagacgcacgtgcgcgacatcttccgccgcctgcaagtcgataaccggacggacttcctctaccaggcggcgcacctcaacaagcccgtctga

SEQ ID NO: 6845 - DNA, 1147 bp, Myxococcus xanthus
ctacacccaggccctgtccggtgctgatgcaccatcaaggcctgccgctgcccttccatagaactggcgaacctgctggggataccctgggcgctcaagttcctctgggccccgcccatggaccggcacggttcggcgaggtggggccggcggcgcggctacatcctgccgctgcagtgcctgtcgtcggggctcctgctggcgctcgcgctccccgaaggcggcctggacatggcggctgctgatggccgcggtgctgggcatcaacctcctggccgccacgcaggacgtggccaccgacgggctggcggtggacctgctcgcgccggccgagcgcggctggggcaacggcatccaggtggcggcctatcgcgtcgggatgattctgggcggaggcgtgatgctcgctgtcttcgacgcggtgggctggcgccccacgttcctcgcgttgggcacactgctgctcctggccaccgtgcccattgccctcttccgcgagccccccaccgcgcccccacccgctcagagcctgggcctgcgatggtggttgaagcgtccgggggccgccgcgtggctcacgctgctcgtcgtctacaaggcgggcgaagccctggccaccgggatgctgcgtaccttcctggtcgacgagggcctgtcgctgacggccatcggttggctgttgggcggcgtgggcttcaccgcgggactcgtgggggcgctgctgggaggcggtttggtggtgcggctcggacggcgacgggcgttgctcgtcttcggaggcatccaggccggcgcggtgctgctctacgcactggcggctcgaggccccacgtccctgcccctgctcaccctcgtctgcggcgtcgagtacgtcgccagcggcatggccaccgcggccgtcttcaccgcgatgatggacgcctgccggccggaccacgccgccacggactacaccgtgcaggcgtccctggtggtgctggccacgggcgccgccgccgcgctgagtggcttcagcgcccaggcccttggctatgccggccacttcacgctggccgcgctcctgtgcgcggcgggcacgctgtacgccgccctcaccttccacccgccccggagcctggcctccgaggccgctcccgaggtgtcgtga

SEQ ID NO: 6846 - DNA, 498 bp, Myxococcus xanthus
atgaccatcgccgtctacgccggcagcttcgaccccgtcaccgccggccacatgtccgtcgtccggcaggcggcccgcctcttcggccacgtcgtcgtggtggtggccgtcaacccggacaaggagagcctgctgtccgccgacgagcgcgtggccctcctgcgtgaagccgtggcgcaccaccccaacgtcaccgtggcccgcacgcaggggctcatcgtcgacttcgcgcgggacatcggcgccagcgtcctgctgcgcggcgtgcgcggtgccatggatgcccagttcgaaacgacgctggcgcagaacaaccgcgcgctggcgcccgagctgtccaccctcttcctcccagccgaagcccacctggccgaggtgagcagcagcggactcaaggcgcgcgtggcgcgcggcgaggacgtttccgccttctgtccgccggccgtcgcgacgaagcttcgggagcgactcgatctttccctccggagcctgccttga

SEQ ID NO: 6847 - DNA, 618 bp, Myxococcus xanthus
atgcgcgaggcgtccgagtcctccggcgtgcccctggacgcggaccgcgtcagcgccgtggccctcacccacctgcacgcggaccatgcgtcgggcctggagagcctcggctacttctccttcttcgtgctgcagcggaagctggaggtgctggcccaccccgccgtcgcggaccggctgtgggaaggcaacctggccgcgggcatggagtgcctcatcgagcggtgcggggagccccccaacgacaagcacttcgaggactacttacgccacacgccgttcttcacggagaccgccgtgcggaacggaccctttctcatcgagagccggatgacgtaccaccacgtgcccaccaccgcgctgcgcatccacgcggggggccgctgcctggggtacagcgcggacaccgccttcgacgagggcctcatcgactggctctccaaggcggacctcatcatccacgagacgaactacggcgtgcacacgccctacgagaagctggcggcgctgcccgccgagctgcgcgcccggatgcggctcatccactacccggatgacttcgacaccagcgcgagcgtcatcgaaccgctcgcgcagggccggcgctacaacgtctga

SEQ ID NO: 6848 - DNA, 378 bp, Myxococcus xanthus
atgacgaagaagacagcgctggcccgacgtgaggccctgctcgcgttggccgcggtccttgccagcggatgcgccacgagccccccctcccccacgcccgcaccgccttccggcacggtgcgcctgacgctccttcacctagcggacgtctaccaggtccaggccgtcgaggaaggaagggggggcatggcccgcgccgccacgctgcgcaagcaggtgcttcgcgagagcccccacgtcctgacgctgatggggggcgacacgctgtctccgtccgtggagtcgctggtggaggtggacggcaaggcgctcaagggccggcacatggtggacgcgtggaatgcgttcggcctggactatgcggtgctgggcaaccca

SEQ ID NO: 6849 - DNA, 1896 bp, Myxococcus xanthus
ggcaccacgttccgcgtctgggcgccgatggcgagccgggtgttcgtctcgggcgatttcaacggctggggcacctggattgagctgggcaacgagttcaacggcaacttctctggcgatgtggcgggcgcggtgaagggccagaagtacaagttcatcacccgcaaccagtggggcagcgacgcgtggcgggcggacccccgctcggcgtggcaggagaactccaccggctccagcatcatctacgaccacggcgagtactggtggaacgcgcagcagtacagcagccctggcttcaacgagatgatcatctacgagatgcacgtcggcacgttccacgactcgcccggcttcggccccggcaactggaacagcgcgattgccaggctcgaccacgtccgggacctgggcgcgaacatgatcaaggtcatgcccgcgtacgagttcgccggtgacttctcctggggctacaacgctgccttcccgttcgcgccggagagcgcctacgggcaccccaatgacatgaagcgcttcgtggacgaggcgcacatgcgtggcatcggcgtcatcttcgacgtggtgcacaaccactacggccccagcgacctgcccatgtggtgcttcagcggcgactgcctgggctcgggcggcgagtacttctacaacgactggcgcaagagcacgccgtggggcgacacccgtccggactacggccgccccgaggtccgcgcgtacattcgcgactcgatgatgaacctcacccattccttccggggtgacggtctgcgctgggacgccaccaagtacatgcgcacgcagaatggcagcgacaccaccgccatccccgacgcgtggcgcgtgttccgctccatcaaccgcgaaatcaacgccacgcagccgtggaagatcagcatcgccgaggacttcggcggtggtgactttatcaccaacgacgccacgtccgacacctcgggcggcgcgggcttcgactcgcagtggggcggcgacttcgtgcacgccatccgcgcggcggtcatcgcgtcgaacgacagcggccgtgacatgaactcggtgcgcaacgccatcacccagcgctacagcgggcggcacaccgcgcgcgtcatctactcggagagccacgacgaggtggccaacggcaaggcgcgcgtcccggaggagatctggccgggcaacgcggggagctgggccgccaagaagcgctccacgctggcggcgggcgtcgtcttcacctcgcctggcatcccgatgatcttccagggccaggagttcctcgaggacggctacttccaggacacggaccccgtggactgggggaagaacagcacttacagcggcatccggacgctgtaccgcgacctcatccgtctgcgccgcaactggttcaacaacacgcgcggcctgcgcggcggcaacgtcaacgtccaccacgtcaacaacagcggcaaggtgattgcgtaccaccgttgggagagcggcgggcctggggatgacgtcgtcatcgtcgccaacttcagcggcacgtacttccccagctacaacatcggcttcccgcgcgggggcatgtggtacgcgcgcttcaacagcgactggaacgggtactcgggcgacttcggcaacacggcgtcgattgacaccgtggcctacagtggcgcgaaggacggcctgtcgcacaacgcgtcgttcgccatcggtccctactcgctggtcatcttctcgcagtagcgcctgacggcaccgggcgcccggggtggaatctcccgggcgctcgttcgcgcctcagacgttgtagcgccggccctgcgcgagcggttcgatgacgctcgcgctggtgtcgaagtcatccgggtagtggatgagccgcatccgggcgcgcag

SEQ ID NO: 6850 - DNA, 2928 bp, Myxococcus xanthus
tgctctaaggacgttcccctggagaagattgtcgaggcgctcggggtcgagcggaacctgagccacgccccgctgttccaggtgatgttgatgctgcagaacaccccggagggccacctgagccttccggggctggcgctggagcccatcgacctggagatcgagagcgcgaagttcgacctcaccttgagcttcgagcccacgcgtgaagggctggccggcgtcatcgagtacagcacggacctcttcgacgcggaccgcatcgagcggatggtcgcccacctccaggtgctcttcgccgacgcggtggcgcatccagagaagcggctgtcagagctcgcgctcctccccgagcaggagcgcggcgtcgtcgccgcgttcacccaggggcgcctggtggcgcccacccgccacgtcccagcccaccggttcgtggaggaacacgcggagcgaacgccggatgccatcgcgctcgaactggggcaagagcggctcacgtatggcgagctgaaccgccgggccaaccgcgccgcgcaccagctcatcgcgatgggcgccggcccggagatgctggtggccctggccgtgcctcggtcgttcgagatgctcatcggcctgctcgccatctggaaggcgggggcggcctacgtcccgctcgacctctcgtacccgaaggatcggctcgacggaatcctggaggactcgggcgccgcgctcatggtgagcacccatgcggcggagcagaagtggcgcgcgccgcaggtgcggacgctctggctggacgagcccgcggatgccgcgcccaccggcaatcccgacagtggcgttcgcatggagaacgccgcctacgtcatctacacctcgggctccacgggcagacccaagggcgtgattctggaacaccgggggctcgcgaacgtcatcgagatgcagcggcacgaactgggcgccgacgcaggctgcgtcatgctccagttctcctccatctccttcgacgtctcggtctgggaaatcgtcatggccctgaccaacgggggccggctcgtggtggcccccgcggacacgctgctcgcgggcgacgaactggccaaggtgctgctggctcacggcgtcacgcacatggtgctgcctccgacgtcgtatgcagcgctccccaccgaccgcgagtaccccgcgcttcgcatgctgacgtccgcgggagaggcccttccgccagaggtcgtccacacgtgggcgcggcccggcgtcctgttcgtcaacgcctatggccccaccgaggtgtccatcatcagcacgctcggccactgccggcaggacgacccgggagctccgcccatcgggcgccccgccctcaacctggaggggtacgccctggaccgccacggcgcactgctgcccattggcgtcccgggcgagctgcacatcggaggcgtcggtgtcgcccgcggttacctgaaccgcgaggagctcacgcgcgaaaagttcatcccgcatccgttcaagcccgacgcacggctgtaccggagcggagacctggtccgctggcgcaaggatggcaacctcgagtacctcgggcgcatcgaccatcaggtcaagctccgtggctatcgcatcgaactgggtgaaatcgaagcggtgctcgcctcctaccccggtgtggcgaaggccgtggccaacgttcattccgcgggcgcccaggggggcgtgaaggccctgattgcctacgtcgtctcgacccagcccgtggatgtgcacgcgctccgcgagtacgcccggaagaagctcccggagttcatggtgcccgcgcagttcatccacctggaggagctgccgttgtcatccagcggcaaggtggacaagcgacgtctaccgccgccgcgcttcgaggcgtccgcgagcgagacgcgcttcgtgcccccgcgtacacccaccgagcagacgctggcctcgctgtgggagtcgctcctggagcgccgcccgattggcgcggaggacaacttcttcgacttgggcgggcactcgcttctggccgcgcaggtcatgagccgcgtgcggaggacattcggcgtcgacgtgcccctctccgccatcttcgagcagccgacgctgacggcactggcggcggtgattgccgccaaggaggccgcaccgcagcttcctccgctggtccgactgacgagccccggggaccggcccctttcgttcgcgcaggagcggctgcgattcctcgccgagctcgaaggccagagcgcggcctacaacatccccttcgcgttcacgttgcgcggctcgctggacgaggccgcgttgcgacggagcctccagcgcgtgctggagcgccatgaggtcctccggacgaacttcccgctcgtcgacggtctgccggtggcccgggtggccgacgcggtgctcacgctgaccacagaggacctccgccacgctggcgcggtaagcctcgaccagcggctggccgaggagtccgcccggcccttcgcgctggacgtgggccccgtggtgcgcgtgcacctgttcaagcgcgcggacgacgaacacgtgctcctcgtggccatgcaccacatcgtgtccgacggctggtccttcggcgtgatgatgcgtgagttctccgcgttctacgccgcggaggtccggggtgagcccctggcgcttccggaccttcccatccagtacacggactacgcggcgtggcagcggagctggctcgacggccaggcccgggaacatcaactagggcattggcgcaaggcgctcgcgggtgcgcccgccgagctggacctgcctactgacaggccccaagacggggaccagattcacccgcgtgccaccgagccgctggcgttggcgcccgacgtgacccagggcctcacctcggtctgacgtgagcaaggaacgacgggctacatgggattg

SEQ ID NO: 6851 - DNA, 477 bp, Myxococcus xanthus
atggccctctccgtgcagtacttccaccgcgaggagttcgagacccgcacgcttcgcgcgctgggaggtgccgcctgcatgggcctggtcgcgggggccgttccggacctgcacctgacaccggagtacctcgccatcgtggccgcggcgcaggcgtgcgtgaagcccaccggggtccaccccctggcgctgcgcctggcgctgacggtgctgcccgccctgccctacttcttccgggccccggagccgttgcccgtgagcctcgcgggcgcgctcgccgcggcgatggtggcctggctgggccatggacgggagcagccgggacaacccgccgcggtggccaccagcgccgccgccgcgggcctgctcgtcccactgggcctctacgtccaacaggtgctggaggcgcgcttcctggggagagacggcctgctgtcggcgctggtgggcttcctcgtcgtgggcctcttctggagc

SEQ ID NO: 6852 - DNA, 1437 bp, Myxococcus xanthus
atgaaccgctcactgctgctggtcgccgcgacgggagtgctcgccgtgggcgcgctcctgctgggcacgccgcccacgccgcccggaccaccccctcccgccgtcacggacaccagccacacggtgcggcgcccggaggacccgcccgccacgcggaccctgacgctggtgacgtccaagccggaggacggcgccctgaacatggcgggcaagctgtccggcgcgtacgtgcagacggggcccagcgaggccttcgcgtggatggagctgaaggcgcgtccggcggagaccggccagcgggtgcccgtcagcctggcgctggtgctggaccgctccggctccatgaacggccagaagctggccgacgcccggcgcgccgccacggagctggtgcagcgcctgaagcccgaggaccggctggccttcatcgactacggcaccgacgtgcgggtgcagcccagccggcggatgacggaggaggcgcgcgaggagctgctgaccctcatctccggactgcaggatgacggcagcaccaacatcagcggcgcgctcgacgccgcggccaacgccctgcggccccacatgcgcgagtaccgcgtcagccgcgccatcctgctgagcgacggacagcccaccacgggcatcgtgtccgagccgggcctgctggaccaggtccgccagttgcgccgcgacggcatcaccgtcagcgcgctgggcgtgggccgggactaccaggagacgctgatgcgcggcatggccgagcaggggggcggcttctccggcttcatcgacgactcggcgcggctggcggaggtcttctcccgcgagctggaccaggcgaccagcaccgtggcgcgaatggtggagctgcggctggacgtcccgcccgaggtgcaggacgtggaggtcatgggcatggcgtccttccgcgagggcaacgtgctgaaggtgccgctgtacgacatggccagcgcccagacggtgcgcgtcatggcgaagctgacgctgaacacctcgcggacggccggcgcgctcgcgctgctgaacgcccgggtgcactacgtcgacgtggcgcgggacttgccgacggagacggcgctgcagctcaccgcggaggtgacgagcgacctggaccgcgtgcgcgagtacctggacaaggaggtgcgcgtccatgcggtccgggcgatgggtacccagcacatggtggccgccgcggaggagatgaagcggggcaacaaggcgaaggccagtagcctgctggacaacgcccggaccattttcggcacctccgcggacgcgctgtccggggagcttgcggacgtccgccgctcccaggcagccttggcgggcgcgtccagcgcggaggaggcgcaggccgagtcgcgcaacctcctcaagaagtccatcaagaacttcggccagaacaatacgtactag

SEQ ID NO: 6853 - DNA, 2256 bp, Myxococcus xanthus
tgcgcgcccggcgtgaagcccgaaatagacaacccggacctccagaacgtgcccatggagcccgcgctgcggcgctggacggagacgctgtcgcggggcgacgtcatcgagggcctggtggcgagcttccccgcgtcggagcgggagctgctggacccacagggcatcttgtccctgctggtgctgcccctgcgcgtgcgcggcgtgctgacggggttcgtgggcttcgacaacacctcggaggcgcggcggtgggaccggctggaggtggacctgctgtcggcggcggcgggcgccatctccatggcgctggagcggcgcgaatcagagcgggcgctgcgcgagcgcgagcggcgcttccgtcaactggcggagaacgcgtcggacgtcctctacgtgtaccggcgcgaggccccgcgtggcttcgcctacgtcagccgcgtggcccacaccaagctgggctacgggccggtggcgcactacgcggacgcggagctgtggtaccggcgcgtgcacgaggaggaccgcgcgctgatggagcagttgctggaagcgccagagcccttccagggcgcgccggtggtggtgcgcttcctccaccccgacgggcggacgctgtggctggagcacgtggtggcgccggtgacggacgcctccggacgcatggtggcggtggagggactggcgcgcgacatcaccgagcgccggcaggcggaagaagccctgcggttgtcggaggcgagcttccgcgcgctgctggagggcgtgccggacgcggcggccatcgaacgggacaaccagattgtctacgccaacgcggcgctggtggccacgctgggcttcgagcgcgcggaccagctggtgggccgccccctcacggagttcgtgcgggacatgcgcagcccggacgcggtgcgggccggcgcgctcaccggcgagcggcggctggtgcgcagggacgggcgcacccgcgtggcggaggtggtgtcgttgccgctgcgcttcgacggccagcccgcggtggtttccattgcccgcgacgtgacggagcagcgccagctccaggcgcggctgacgctggcggaccggctggcgtcggtgggcacgctggcggcgggcatcgcgcacgaaatcaacaacccgctggccttcgtgctgtccaacctgggcttcctgtccgacgagttcagccgcagcctgccgcccggggacggcgcggcggcgctccaggcgcggctcaagggcgagccggacctgggtgaatggcaggaggtgctgcaagaggcatgtgaaggcgccgagcgcgtgcggcagattgtccgccagctcaagacgttctcccggccggacgaggagcgcgtgtcgccgctggacgtgcacgcggtgctggagtcggtggcgatgatggcggccaacgaaatccgccaccgcgcgcaactgcggcgcgactacggcgacatcccgcccgtcatggccaacgagggcaagctcagccaggtgttcctcaacctcgtggtgaacgcggcgcaggccattccggagggcgcggcgcaccggcacgaaatccggctggccacgcgggtggacggcgccgggcgcgtggtggtggaggtggcggacacgggcgtgggcatcgcgcgtgaggtcatcgaccgcatcttcgaccccttcttcaccaccaagccggtgggcgtgggcacggggctgggcctgtccatctgccacagcatcatcagcgggctgggcggcgacatcaccgtggacagcgagccggagcgaggcaccctcttccgggtggtgctgcccacgccggagacggtggagcgcgcgaagccctcggagcctgattcgcgacaagcaccgcgcgcgccgcgcggccgggtgctggtggtggatgacgagcccgcggtgggccgggtgttgcagcgcatcctccgcgagcaccaggtggacgtggcgtgcagcgggcgccaggcgctggagctgctggagcgcgggctggtaccggacgcggtgctgtgcgacgtgatgatgccggacctgacggggcgcgacgtgtacgaggccgtgcggcgcgagtacgcggggctggagcgccgcttcgtgttcgtctccggcggcgcgttcacctcgggcgcgcgggacttcctggccagcatccccaacctgctgctggagaagcccttcgacgaagcccgtgtccgcggcgtggtggaagagctcgtccggcagcgactgccggcgcacgacgcctga

SEQ ID NO: 6854 - DNA, 4320 bp, Myxococcus xanthus; identical to SEQ ID NO: 577

SEQ ID NO: 6855 - DNA, 1782 bp, Myxococcus xanthus
gacctgaccatcctccacatcaacgaccaccactcgcacctcgcgggttccagtctggagctgaatgtgacgaacgccgcgggtgacaccgtggccgcggaggttgaatcctcgggtttcgcgcgcgtcacgtccgcgatgaaggagctggcggccggtaaggagaacgtgctcaagctccacgcgggtgacgccctcaccggcacgctgtacttcaaccgcgcgggccagattggcgaggccgacgccgcgatgatgaacacggtgtgcttcgacgccttcaccctgggcaaccacgagttcgacaagggcgacaccgagctgaagcgcttcatcgaccgcctgcatgccggccagtgtcagacgcccgtcatcagcgccaacgtccagttcggcgcgggctccgccctgcacacctccagggctgccggctacgtggagcccttcaccgtcgtcgaacgggggggccagaagattggcctcgtcggcctgacgattgcgggcaagacgaaggagtcctccagcccggatgcggacaccacgttcgaggccgaggtgcccgccgcccagcgcgccatcgatgcgctgcgggcccagggcatcaacaagatcatcgtgatgagccacatcgggtaccagctcgaccggaccatcatcccgcagttgagtggcgtggacgcggtcatcggcggtgactcccacacactgctggggcctgccgccatggagaccttcaacgtcggaacgcccgcggggccctacgcggagtcgctgcgcaaccgcgacggcgaaaccgtgtgcctggggcaggcctggcagtactcgcaggtcgtcggagagatgaccctccgcttcgacgccgagggcgtggtcacctcctgtggcggcacgccccacgtactcatcggcaatcagttctccattgacgggacgcccgtctccgaatccgacaacgccgcgatgctggccagcgtggccgtcagcggcttcctgcgggtgacgcagccggatgccgccgccgcgcaggtgctggcgccgttccagggccggatcgacgagtacagccggacggtggtggccacggcggacgacgagctttgcaatcgccgcgtgccgggaaacacggagccgggccgctccagcgtgagctgcaacgccctgggggaggtccacagccggggcggcgacatccagcaactggtggcgcaggcctacctggaggtggcgaacgcggattacggcggcgcggacatcacgttgcagagcgcgggcggcgtgcgccggccgctgcagggaccggtgacggcggcggacgtcatcgaggtgctgcccttcggcaacatgctgttccggctggacgtcactggcaccgaggtgaagtcgatgattgaggacgggctgcacgccacgttccgggagggaggcaccacggggccctatccgtacaccggcggcctgcgcttcgacgtcaacgccgctcacgctcgcggccagcgcgccagcaacctggaggtgctggaccagacgacgggccagtggaacgaacttcagccgaccgccacctatcgcctgttcgtgctgagcttcaatgccacgggtggtgatggctacgtgacgctggccaacgtgccggccgagcgccgctccgacatcggcgtgctcgatgccgacgtcctccagacgtacatcgaccgtcaggccgagcgcaagcccggcacgaacctgcccgtcctgcacaaggtggatgcttcgctctacagcacgaagtcgttcgtcgagtag

SEQ ID NO: 6856 - DNA, 885 bp, Myxococcus xanthus
atggacaagtcgcaggtgctgctgtcggagctccagttcctggtcgacggcacggagtccagcctggacctgggcgagtccggcaaccggctggtgtggacgggccgcatcgccaagggcgccacgtcccgcttcaccatccgctaccgcgcccgggggctgaactcattcgtgtaccgcttggatccagcgctgcccgcgcgggacgtgcgcgtccacgtcgccgtcgaaggaggggagaactacgactacccgtcgggtgtgctggccgcgtcgtcggtgaacaccacggccgacgcggtgacgctggattgggccttccagtcgctggagtcgggagtgaacctgggcgtcatcctcccgtcggagaaaacgttcgacgcgctggtgggcacgatggcgacccgggcctgggtgcccttcctggggctgctcgcgctgctcgcggccctggggttgcgccaccgccgttcgctcgcgctccacgagacgtacctgctggcgtccgtgtacggcttcttcttcgtgctgctggcgtacctggcggccttcatgaacttctacgccgcctacgccgtctgcgcggtgggcctgggcgcggcggtggtggtgtacgtccgctggctcttcccgaaggagcggacgtccgtgctcgcggcgctgtggggcgccacgctggtggtccccaccggcgccgtcatcctccagggctacaccggcctcatctacacgctggagatcctcgccgcgctgctggggctgatggtgctctccacccgcgctggtgtgcgggccttcctctccgacttgtccctgccaggtgagcctccgcgcgccgccgtggctcccgctgcctccacccctgtcaccccggaagcgagctga

SEQ ID NO: 6857 - DNA, 1029 bp, Myxococcus xanthus
atggaggcactggtgaagagccagctcaagggccggctcacggcggatgccctcttcgtggacggacacttcgacgtggaggtgctcgcggacggacgctggacgcaggtgcgcctgctccaactcgacgcggacacgtacccggccacgttgccctcgttggaggaaggcaccgtgggcgtcgtcgacgggtacctctgcctgctcacgcggaaggccgggcgctacgtcttcgacgtgggcgtctccatccgctcgcccggagcggggccggagcgccgggcccaactgcgcttcgggccccacgcgtccccggtgccgctggcgctggaggcggacacgtctgtcttcacgctcaccgagccgctggcttcgatgggaggcgagtctcacgccgtctatcccgtgcaaggcatgctgcgcgtcggctggcgcgcggcggtggctcgggtggcacaaagccagaagcagcaggtgcgcccgccgctcgagccgcgcatcaccgaggccaccgcgtcctgggtgtccacgctggaaggcagagccacgctgcgcgtcagctatgcgctgagcctggaccgcgagcagccgctggaactggtgctgccggaaggacaccggctggagcgcgtcaccctgaatgccattcccgtccccgtggagtcggagaacggccccctggcattgaaggtcgctccggcgcggctgggagagacgggcgggacgctggaggtggtgctgtcgcgagagctgggcgtgttccacctctccggccggttgaagctggcgttgccgcgagtctcctggccggtggcggagctccgcgcacgcgcgcacttccccgcggtgttcaactatcggcgcgagggcggcagcctggagcagtacgagtcgacggaatccgtggccgcgggggcgtcgggcctgcccgggaaggcgctgcacttccgccagttcctggtggccgcgtcctcgcccacgctggagctgggctactccgtggacatctccgacagctacttccgttga

SEQ ID NO: 6858 - DNA, 1734 bp, Myxococcus xanthus
atgtcgtggtcagcgaccggaccatcgacagccacgtgcgccgggtccggcagaagttcgcgagcgcgggcggagacgtcatcgagacggtgcatggccttggctatcggctcgccctcccctgagcgccgcgcgcgcccgcgcttgtggctggtgttcgccgccgtgggcgtggcggggttcgccctcacgctggcggggctcgccttcgtgcgcgtctacgacaaccagctcatccgccagacggagtcggagctgattgcccagggcgcggtggtcgcggaggtcttccgcgagcggctgcgcgccaccgtgccagagggcgcctacggccgcgagcgcaccgctccctggcccttccccattcccgacgacacgcgcctgcgccccatcctcccgttggtcagggcctcggatgcatccctgccgccgggcgacacgcctcggccttcacgtgttcccgcggagccgctgtcacacgcggctggactgcaactgacgccgctgctcgaacaggtgcgtgcggcgacgctggccggcatccgcgtggtagacaccgagggcgtggtcgtggccagcagcagctccgccctgctgtggacgacgctggcggaccgcacagaggtccagcgggccctgcgcggcgagcccgtcagcgtgctgcgccgccgcgtcgccgatcccgaggacaccccgctggcgtcgctcagccgcgacaccggcatccgcgtcacggtggcgttgcccgtgctggaaggcgatcgcgtctggggcgcggtggtgctgacgcgcacgcccatgacgttcgccaaggcgacgtacgcggaccggtggaacctcaccgccactggcttcgtgttgctcggcgcggtggcgctgatgtccctggccgccgcggcgctggtgggccggccggtgcgcgcgctggtgaagcagacgcgcgccatcgccatgagcgacccttcgggcttcgagcccatggcgcgccccgtggtggccgagctggccgagctctccgaatccctggccggcatggccaccgcgttgcgagacaggaaccagtacatccgttccttcgcggccaacgtgtcgcacgagttcaagacgccgctggcctccatccaaggcgcggtggagctgctgcgcgacagcgccgacgcgatgtcccccgagcaacgcgcgcgattcctcgccaacgtggacgcggatgcccgcaggctcacccgactggtgcagcgcctgctggagctggcccgggcggactccatgacggccacgcccgcgcaggtggagctgggcccgctgttggaggggctcgccctccgcgcccgcgccgacggtgccacggccatccatgtgacggcaccacccgcgggcctgaaggtgagcctcccgcaggaagtgctcgacgatgtgctgtggcagctcgtcaccaatgcccgccagcacggtggcgacaccgtccgcgtggacctgtcggtggagcaggccccggaggcggacctggtgcgcgtggtggtgaaggaccgcggcaagggcatctccgagtccaaccgtgcgcgcatcttcgacgccttcttcaccactgcccgcgagcgcggcggcacgggcctggggctgacgattgcccagtccatgctgcgcgccttccacgcgaggttggagctgcttccttccgacacgggcaccaccttcgcggtggtggcgcccgtgccccggcttcaacggaagtag

SEQ ID NO: 6859 - DNA, 1404 bp, Myxococcus xanthus
atgtcctcaatcgaccccaccgcgatcagccgtccgcgctcgccggacatcatcagcggctaccacctcgacaagcttgtcggcagcggaggcatgggggaggtccacaaggccacccagctctcgctaggccgcacggtggcggtgaagctcctcaatcccgagctggcgaaggacccgtccttcatcgcgcgcttccagaaggaagccgccgcgctcgccgccctgagccatccccacatcgtctccatcgtcgacaaggggaagacggacaccacgtactacctggtgatggagttcgtggacggcccgtcgctgcgggagctgattcgcgagccgcagttggacgtcatgggcgccctgcggcgcatgctgcagatctgccgcgccatcgagtacgcgcacggccgcggcgtcatccaccgggacctgaagccggagaacatcctgctggaccagcaggccggcggcatcgccaaggtgtcggacttcggcctggcgtcattcctggaggatgccagtccctcctcgcgctacgcgctcacgtccacgcacgtgtccatgggcacgctgtcgtacatggcgcccgagcagcgcgtggacgcgaagagcgcggacgcgcgcgcggacatcttctcgctgggcgtcatcctctacgagtggctcacgggcgaggtgccgctgggcacgttcgacccgccgtcgcggcgcaagccggggctggactcgcggctggacgccatcgtcacgcggtgcctcaagccggacccggaggaccgctacccctccgtcaccacgctcatcgcggacctggagctgctcgtcccgggcagcctgccgtcactggcgccggtgaagctgacgcacctccagcgcgtccgccagggtgtgcgcaaggtggtgcgcatggccctgcaggccgcggccgtgctgctggtggtggcggcgctgctccgtgctgggccgggagtggctgcgcagcggggagaagcccgtgccgccgcagcccggcgccgcgctgaacgcggacctgggcccgccatcgccccggtccatgcccggccggctggagacaggctccgagaagcgcacggtgtcggtgggtcacggcccggacgcgccgtcgctcctggtcgccggacggccggtggaggcggaggagaaggccatcatcttcccgcccgtggaggagcgctcgcagtcgcgcgtgggccgtgcccgcgtggacgtggtggggctggacggcgacatcgccgtgctcagcgcccgcgtgcgtgcggacgcgccgccggacacctggaagcgccgcgcctacgtcatgctctacgggccgtcgctgcaggcccccgcggccgcgctgctgctacagggcagcacgggccgctatgtggcgctcatccatga

SEQ ID NO: 6860 - DNA, 786 bp, Myxococcus xanthus
atgcccggccggctggagacaggctccgagaagcgcacggtgtcggtgggtcacggcccggacgcgccgtcgctcctggtcgccggacggccggtggaggcggaggagaaggccatcatcttcccgcccgtggaggagcgctcgcagtcgcgcgtgggccgtgcccgcgtggacgtggtggggctggacggcgacatcgccgtgctcagcgcccgcgtgcgtgcggacgcgccgccggacacctggaagcgccgcgcctacgtcatgctctacgggccgtcgctgcaggcccccgcggccgcgctgctgctacagggcagcacgggccgctatgtggcgctcatccatgacggcgcgggcgcgccgctgcggctcgagtgggccctgggcgagcgccgcggcaccatgctgggcctggcgtcgccggagggcgaggccgcgctggagctgcgggtggacgcggacggcgtcatgcagggctacgtcggcaagggcaaggaccagcgggccattggcgagccgctcaacctggggccgggctggatggagcacttcggggacgcgcccgtgcccgccttcggctgcatcgaaggtacctgccgcgcggagggcttcctctacaccgtgcggcgcgcgccgcctccggggacgacggcgcccgtgcccgacgtgccggtggcgaaggccgtggtcgccgcggtgcccgccaagcggcctgctccgccgcctcccccgaagaagcagcccgctaaggcccccgtgaagagccctcccaagcggaggtag

SEQ ID NO: 6861 - DNA, 1793 bp, Myxococcus xanthus
atgcgcaccattcgactcggcttcgccgcgctcgcactcgtcacggccctcacgggctgccaccgttccacttccacggcgacaccgcgcgtcctcgaaaccgccgcggagcaggcgcagaagggcacccaacaggcccgcacgctcgcgttcgcgggcttccatgccttgctcgtcgcgggtgacgccttgctggcgcaacagcgcttcgatgacgccattgcccgcgacgcgggagatgtctacgcgctggccggtcagtcgctgatggcacgccgcgcgggccgtcccgaccgcgccctgacggcatccctggagctggtggcgcgcgcgcccacgcacccgctggcggccgtcgcggcgcgccacgtgctggactcggtgggcacgtcgcgggcgctggacgacgacatcctcctcggcgtggagcgagcgctggcggcgggcgcgacgggcgaggccgcctatctgatgcgcggcgcgcggatgtcggtggccgtggtgcgcggcgacgcggaggcccgcgacgcggcgatgcagcaactgggcggggtgagcgaagtctcgctggtggggcccttctcgcccttccacgtgctggcctgggacgaacgcacgcccgtgagtcagaatggctcgctggcgggccccctcaccggcgccttcggtccgctgccggtgcgcacggtgcgcgcccccgacgggcggatggacctgacgggcgagcccggccagggcgacctctacgtccaggccttcgacgcggacgtgacggagccgggcctctatgtggctcgcaccgtgagcggcacctcgcatcaggtgctgatggacggggctccgttgatggagcgccgggcctgggagcgcgccaccaccaccgtcaccgcgcgcgccgtgcagttgcccgcgggcaagcaccgcttcgtcgtgcgtcaaatcaagggcggcacctccggcctgctcaccttcgccctgctgcgcgtggacgggcgcccgtccggcgtgcgcttcagcgcggccaccggcgcggcgccgcaggcctggggcagcaaggtcgagttctccgacgagacgcccggcgtgttccccaccacggagggcttgaagacggccctgcacgaggaggccggtgagctgctggccgtcgtgctggcggtgcgggacggcctgcagcgggacgcggacggcgcgcggcggctgatggcctcggtggacgccaacaccccggccctgctgtggctgcgcgcggaagtcgcctccgcggaccgcaccgtgccgtccaaggtggcgcgcggccgggccacgcgtgacctggagtccgtgctggccaaggaccctggcaacgtggcggcgctgttgctgcgcgcggagctcttcctcgacgagggccagcccacctccgccatggacatgctgaagacggcgtccgaggtggcccagcccgccggtcacccggtgttcatgctgcgcgcccgcgccgcgctggcgctggaagtggaagccctggcggaggagtcactcaccgcggcgctggaggcccagcccggcctgtgcgaggcgctgacgctccagtacagcctggcccgccgccgtgacgcggcggagcggagcgacaccctggcggcgtccctgaatggctgcccggggacggtggtgcgccaggccgaacacgcgcgcacgcgcggcgacgtggagacggcgacgaagctgtacagcgagctccaatcccgcgaccccagcagcatcagcctggccaacacgctggccaacctttactgtccaagcgccgc

SEQ ID NO: 6862 - DNA, 615 bp, Myxococcus xanthus
ctctacatgacggacccgctgtgcggttacagctacggcaactacaagatggagagcctggagtcgtcactggtgaagctcagccgggtgaagttcccgcgcgtcttccacaactgtgacgccaacggcaacggcaacgtccccttcttctgtcccaatacccgcgcggggacgtggggaagctgcggcacggacaacccgaacgatccggacatcgccgagcggcagtgcaacatcgactgcaccatgggcattggccagttcgcgggggtccactgcgccgagcgcaacacgtacaacggcttcggccagttcgtcgtggagatgaaccccaccggcgccgcctcggcgggcctggacgaatccgtccccgggcgcatccagaccttcaccgcctccgtcaacgcggaccccaccatcgtcaactgggcccagtcggacacgttcagcagggatcagcgcgtcaacgtgtcctgcgacaaggcggccaacgtgcgcttcggcgccaacggcacgccggtggcgctgacggcccagactccgctgcagcacaccatggccgcgggtgagggcgtcgtgtacgcctccgtccagaacagcgcagctattacacca

SEQ ID NO: 6863 - DNA, 387 bp, Myxococcus xanthus
cgtgctctaaagaatgaatgggacaacgcgggctgccccgcgaacggctgtgagaacaccacctgccgcaccaacccagcctgctgcagcgaggtgggtcaggacatcgtcattcccgtctccatgaacgcgttcgcgattcacgggctctgctacatgcccggctccggccgccccgtgcgccccggcgacctgacctgcatgcgggactttctcgatgacctgcccgcgctggacgccgcggccccgggcaacctccgcttcgacttcacgtcgggccggccgcgcagcctcatccaggtggagccacggacgggcctcgccaatgtgatggactgcaaccctcacgcatcgacccagaaccaggccatcgagtgcgtgaactga

SEQ ID NO: 6864 - DNA, 300 bp, Myxococcus xanthus
atgaagaactttggactgatgctcttcccactgacggtcctgctcctggcaggctccgtcgagggcgcgtcgcccatcccgggagcagaggcgccggtcagcattggccagaccagcgacacctcgtccgtcaaggacgaggatgggaatgacatcgagctgcccaagcacgatgccaagcaaactctatgcatcgggaagtgtcaggagcctgtctcgaagcgcatcagcggatgtgaagggggagaccgtaaatgccagctgcgctgtgcgcacaccatggagcgctgcgcccgaaag

SEQ ID NO: 6865 - DNA, 603 bp, Myxococcus xanthus
atcgtgccctccctggtcaccaatgtctggcaactccggccctggtcgaccttggggcctctgctgcggcgactggcgcggatgcaggtgggcgtctgcgccggcacgctcgtcggagcgtgggtgctgggcgcgcctgtgggcgcgtgggccacggtgtccctgggcgtggcgttggtggcctatgcggcctggggactcagtggggcccgactcccggtgggcccggtggcggaggcgcgcctggggccctgggtgggcgcgctcaccggcttcgtgacggcggcgacgggtgtcttcgtcatcccggcggtgccgtatctgcaagcgttgggcttcgagcgagaggagctgattcaggccatgggtatctcgttcacggtatccacgctggccctggcggcggggctctacgtcaacgccgctggcgctggggcgcagttgggccaatccctcctgatgttgcttccggcgctcgtcgggatgcaggtagggcagtggctgcgccagaagctctcgcccgtgctgttccgggcgtgtttcctggtcagcttgatgctcctcgggatgcacatggttgcccgcgaaatgcgggtggggtga

SEQ ID NO: 6866 - DNA, 2901 bp, Myxococcus xanthus
atgagcgacacacccccgaaggacaaggacttcaaggactcggtcaacctgccgcgcacggatttccccatgaagggaaacctggcgcagctcgagccgcgcatgctcggctggtgggcggagcgggggatttgggggaagattctggagcagaacgcggacgcggagcccttcgtcctgcccgacggtccgccctacgccaacggccacctgcacgcgggccacgcgctcaacaaggtcctcaaggacatcgtggtgaagtaccggaacatgtccggccgccggtgtgacttcatccccggctgggacacgcatgggcttccgattgagcaggccgtcgagaagcggctgaaggacaagaaaatcgataagcgcacgctggctcgcgacgccttcttggaggcgtgccgcgcctatgcgctggagttcgtcgacatccagaaggcggagttccagcgcctgggcgtgttcggctcgtgggagcagccgtacaagacgctcgacttcacctacgaggcccaggagattcgcgagctggccacgttcgcgaagcggggcatgctctaccgccgcaagaagcccgtgtactggtgtctgtacgaccagacagcgctggcggaagcggaggtggagtacgagaaccacacctcgccctccgtgtacgtggccttccaggccggggcggagctggccgagcgcgtgccttcgctgaagggcaaggacgtggccttcgtcatctggacgaccacgccgtggacgctgccgtccaacctggccgtctccgtcaatccggagttcgagtacgtcttctaccagctcggcacgcgcgtcatctgcgtcgcacgggagctcttgcccaaggtgctggcggaggtgaaggcggacgagctggcggtgaagcacgtggagctgcccggcggtgaagtctccgcggcggcgttggtggacccgtcgcgcatcctcgcgtacgcgcgcggcgaggagctggagcacctgacgtaccagcacccgttctacgagcgccggggccgcgtcatcctgggcgagcacgtgacgctggatgccggtacgggcctggtgcacaccgcgccggggcacggccaggaggactacgaggtcggcctgaagtacgggttggacatctacaatcccgtgcgtccggacggccgctacgacgacacggtggggccggcgctggaaggccggcgtgtgttcgaggcgaaccccgtcgtcatccagttgctggtggagaagggcgcgctgctcaacggcgccacggacacggtggcgcacacgtatccgcactgctggcgctgccgcaatccggtcatcctgagcgcgacgtaccagtggttcatccccatggacgcgcccttccatgggacgcagacgttccggcaggtggtgctggagcaggtggacaaggtgcagtgggtgccctcgtgggggcacagccgaatccgcggcatgctggagacgcggccggactggaccatcagccgccagcggacgtggggcgtgcccatctgcatcgcctactgcgagggctgcgaggaagccgtggtgtcgccggagttgatggagcgggtggcggcggcggtggagaaagagggcgtgggcgtgtggtaccgcacgccggtgaaggagttcctgggcgcggatttccaatgcccgcgctgcggcaagggggagttccgccgcgagacggacatcctcgacgtgtggttcgactcggcgtgcatgttctccgcggtgctggagaagcggcagcggattccggcggacctcttcctggagggcagtgaccagcatcgcggctggttccattcgtccatgctggtggcggtgggcacgcgcgacatgtcgccgtacaaggcctgcctcacgcacggcttcgtggtggatggccagggcgagaagatgtccaagagccgcggcaacgtggtggcgccggacaaggtcatccagcagtacggcgcggaggtgctgcgcctgtgggtggcggccagcgactaccgcaatgacgtgcgcctgtcggaccagattctgaagggcctgtcggaaggctaccggaagattcgcaacaccgtccgctacgcgctgagcaacctctacgacttcgacccggcgaagcacgcggtgccggaggtggagctgctgccgttggaccgctgggcgttggggcggctggcggaggtggtggcgcgggtgcgcaaggcgtacgaggactacgagttccacctcgtctacgcgacggtggtggacttcgtcgccggcgacttgtcggcggtgtacttcgacatcctcaaggaccggctctacacgtggcgcgcggacgggcagccccggcgcggcgcgcagacggtgctgtacgaggtggcctcggtgctgctgcgcctcctggcgccggtgatgagcttcacggcggaggaggcgtggcagacgctgccgggcaagccggcggagagcgtcttcctgggcggctttccggtggtgtccgcgaagttggacccggcgttggccgagcgctacgcgaagctcttcgcggtgcgcggcgcggtgcagggcgtgctggaggcggcgcggcgggacaaacgcataggctcatcaatggaggcgcgggtggtgctgccggcagagggcccggcgcgcgacttcctccaggcgcacctggccgagctgccgggcctcttcatcaccagccaggtggagctggcggacgtgaagggtgacgcggcgcagacgttggaagtggcgcaggccttcggcgaaggcgtccgcgtcacggccgaggtgctcccagcgcacggcgagaagtgcccgcgctgctggacgtactcggaagcggtggggcagggcggcgacgtctgcctcaagtgccgcgaggcgctggcggcgtag

SEQ ID NO: 6867 - DNA, 1401 bp, Myxococcus xanthus
atggaggaccccacggtcatcattcccgagggggtgaatgcggacgccatcctcgacctctcgctctactccgaacgcgtcctcggcttcgaggtccagcgaggacgcgagcccgctgtgggcgtcgaaggctcggggctcgaatggattgacccaggtgacagggagcgcggattctcgttcacgttgcgagttgcttcgccggacggtcgtgacgccgtgcccttgcggctggattcgcgggagaccgccgcggagctctacgccgcgaacgaggctgcgctggcacgaggtagcacggagccgctcaccgtggcgggggctcgcatcgcaccgggggaggacctgcggcgtcagttgacgacggcgcttcgtctgtcggagcctgagcctgggacggctgctccctccggtggagactctgcgtcttcatccaagcccaagaagtccattgaagccgtcagggtgcgtgagctggccgcatcggccactggctcagcgcaatccggcatcgatgaccccgtgccttgggagttgctgcgttccgtgatggtgacgggcgtcgagctcaagcttcaccagcgacagggaattgaatggctgtggcgccgcgcgcgggaagcgacgcctggtgtcctgctggcggacgacatgggcctgggcaagacactccaggttgcctgcttcctcacgctgcggcgcatgacgctccatgaacagcttcctcctggaacgcggctgaagcctcagctcgtcgtgtgcccgaccatcctgctggagaactggcgccaggaactggagcgtttcttcgtcgagtccacctgggagcccttcattctccatggtgccggtttggaggccgtcaaacgtgacggagaactgaacggcgccttcctgtcgcggcaggacctggtgctgaccaactacgagacgctgggggcctatcaacgctcgttgctgaaggtggactttgacgtcgtcgtgttcgacgaggcgcacaacctcaagaacccagacaccctgcgctcgcgcgccgcccgcgcgttgaagcgctcattcgcggtcggcctgacgggcacgccggtggagaacgagttgctcgacgtctgggccatctacgacgcgcttcagtgccggcaaccccgtgtcttcggcacgcgtgcggcgttccgagaggaacaccagggagaggaggccatcgaaaccctgcgccaacgcctggactatccctctccgggctgcaccttgctgcggcgagagaaggcggaggccctcaaggacctgcctcccaaacgcccgcagtgcaggaaggtcgagatgacggaggagcaggagtcgcaggagcggctcatcgcgcggcagatgtcctcgcggggctcgttctgggcgctttctgtagag

SEQ ID NO: 6868 - DNA, 480 bp, Myxococcus xanthus
aaaggcctgccgccggggctcgacgtggaggtgtggggcgtggacctgagcgagggcatgctcaagcactgcaagcggcggttgcggtccggagactgtgcgggcgtgcgactgatgatggcggatgcgcacgcgctgccgttcccggatgcgtcgttcgaccgggtgtttcacgtgggaggcattggcggctaccgggcacccgagcgggccctggcggagatggcgcgcgtggcgaagccgggcacgccgctggtggtcgtggacgagcagatggacccggccttccggccctcgctgttccagcgcgccgcgttccgcgcgatgacgttctactcgtgggatccacacagcccccgggagctgctgcctccgggagcgttcgacgtcaccgaggagcaggtggcgccgttttattactgtctgtcgttccggatgccggaggtagattccgcgtcggcggatgcccggcacggctga

SEQ ID NO: 6869 - DNA, 1674 bp, Myxococcus xanthus
atgcccgcagtcgcctccgtcaccaatgactccgaccccgtggagctgggcgtgaagttcaagacgaacgtgagcggcaacgttctgggcgtgcgcttctacaagggcgccgccaacaccggcacccacgtgggaagtctctggagcgccaacgggcagcgcctggccttcgccaccttcacctccgagacggccaccggctggcaggaggtgacgttctccacccctgtcgccatcgccgccaacaccacctacgtcgcctcgtaccacgcccccgtcggctcgtacgccttcgacaacggtggcctcgccagcggccaggacaccccgcccctcttcgcgctgcccggcagcaccagcggcggcaacggcgtcttcacctacggcgccgcgggctccttccccatcaacagcttcggcaactccaattactgggtggacgtcgtcttccaggccaccggcgcaccgcccccgacacagcccccggacaacaccttccgcatcttcgcccccaccgctacgcccggcaccgccaccgcttctgacaccgccgccatcgaagtgggcgtgaagttccgctcggatgtggacggacaggtgacgggcgtgcgcttctacaagggcagcggcaacaacggcacccacgtgggcaatctgtggagcgccacgggccagccgctcgcctccgccaccttcaccaacgaaacggccgtcggctggcaggaggtgacgttctcctctcccgtcgccatcaccgccggcaccacctacgtggcgtcgtacttcgcgccgctcggcggctactcgttcgacagcaacggcctggccaccggagtggatgcccctccgctgcacgccctgcctggcgccaccacatcaggcggcaacggcgtcttcgcctatgcctccacctccacgttccccaacggcagccaccagaactccaactactgggtggacgtcgtcttcgagacctacggaccgccgccccgtccgggcgtccacggcgcgggccccgtgctggtggccactgctcccggcaaccccttcaccgactaccttcgcgaaatcctggaggccgagggcatcgccgccttcgccaccaccgacgccggcaacctgggcgtctccgtctcccttgatgactacaaagtgctggtgctcggcgagcagacgctgagcgcggcccaagtgacgctcatcacccactgggtcaccgctggcggaagcctcatcgccctgcggcccgcggcgaacctccagtcgctgctcgggctcaatgcctctcagggcacgcaggccaatggctacatcctggtcaacgacacccaggccccgggcacgggcatcaccgcggagacgatgcagtaccacgggctcgcggacaagcgcaccgtcgtcaccggcacgcgcaccgtcgccacgctctactcggatgccacctccgcgacgacgttcaccgccgtcagccagcgcaccgtgggcagcggcaccgccaccgcgttcatgtatgaactggcgaagtccgtcatctacacgcggcaggcaaacccggcctgccagggacagaaccggtgcggctcctccattggcccgggggcgcgccccatcgacatgttaaggtcacaactcgtttcagccacatcagcggtcatggtgtgtgcgcaagtgggc

SEQ ID NO: 6870 - DNA, 543 bp, Myxococcus xanthus
ggcggcggcattcgggtaccgccccgaacggggctcgggcgcgtgcagctcagcgcccaggagctgcttgacctcctgctcgccctggcgctcgccgagcgactcgagtctccgctcctgctctcgacactcaagagcctgcgtcaaaagctcgccgcctcgttcccaccggaggagcgcgcacgcgtcggcaagctgcgccgtcgcatcctcgtcggccccacttcacggaacgtcaccgcgacctggaagcctccccgagcggcggtgctacgtcccctccaggagtccttcttcgagcagcacgccctggagctgacgtaccgctcgaacgacgtgcgcacggtgcgcatcgtggagccgcactacctgctgctgagctggcccgcgtggtacctgctcgtctgggaccacctgcgcggagcggtgcgcatgctccgcgtcgaccgcatcgaatccgcgagcgtccaggcggcgacgttccaggtgcgggactcgaagtcgatgctcgccaccctcggcgacatcttcgcggcgctctga

SEQ ID NO: 6871 - DNA, 1104 bp, Myxococcus xanthus
atgttcgtagcactcatcgccttcgggcgcctgtggtgtgtgacgcaccaggaggaagcgcccagtccacggcccgggcgcatggcccaggcgggtaacgccccggccggggcccccgacccctcctccgcccccgagtgccggacgctggaacgggccctcgaaagcgccctccgcacgccccaggacacccgggtcctggacgaagcgcgccagcagctcgacgcatgccgtcagccgcccgttcgcgcctgcgcgctgggcgtggccctggacgcccggtcgcccttatccgagggagaagccacaccgctgcgtggcctgctggccagcctgtgtgagcactgcccgccggccgccaattcgtgcgcccgggccgtggggcaggccctgctgaatgccgcggtggggccgaatgccgatgtcgcgagcgcgaaatggaacctggagcatgcggggccaggcctgggaggggcttgtgcctcgctcgtccagttggggctcgcacccgcagcccagtcagacctcaccgtacgacccccggtgctcgcactcgccggggagctggcgcctcactgctcgcaggcaggcttcctagatgacgcgctgctgcgcgccgccgctgtgaacctcgtggcgcccacgcccgcgctcgtcgccctggccgcggtgcccattcctcccgagacgagcgccatgaagccggaccggattgaaggcaccgagcccagcttccaggcgttcgaccgggacgaggacaccggggttccggtcggcaaggcgctcaagaccaagcgatgggaggcggacggcgcgctgcgcgcgagctacgcgcccacgctgaagcagctcgtatcggtgaggatccgcgccacgggcccgggaacggtgcgcgccatcgtccggacgcagcagggcgtgggcttgaaggacccggagaaggacttcgccttcgtcaaccccaccgtgtgccgtttcaccggcacgggtcagtgggagcagtgcccgctccaggtgccgctgcgcgacgtggacgccgtgagcgtcttccccgagcgcgcggacaccgaactgaaggagctggaggtccacggcgcccgctga

SEQ ID NO: 6872 - DNA, 660 bp, Myxococcus xanthus
gtggctgagacgttcgacgtggtgatcatcggttcgggccccggcggctacgtgggcgccattcgcgcgggtcagctgggcctgaagacggccatcatcgagaaggacaagcggctgggcggcacctgcctccaccgcggctgcatcccgaccaagtccctgctgtggaccgcggagctgttccaccatgtccgcgaagcggctgacttcggcgttgacgtgagcagcccggccatcaactggcccaacgcgatgaagcacaaggacaagattgtcaccaagggtgccaacggcatcgacttcttgatgaagaagaacaaggtgacggtggtgaagggccacggccgcatcgccggcaagggcaaggtggaggtcaccgccgcggacggctccaagcaggtcctggaggcgaagaacatcatcctcgccacgggctcggtgcccaagtccctgcccaacgtccccgtggaccacaagcgggtgctgaacagcgactccatcctgcagatcgaccgcgtccccaagagcatcatcgtgctgggcgccggcgcggtgggctgtgagttcgcctccgtgttcaaccacgtgggcagcaagacctccatcgtggagtacatgcccgcgctgctccccatcgaggacgcggacatctcccgtaga

SEQ ID NO: 6873 - DNA, 348 bp, Myxococcus xanthus
atgcaggaagctgcggcgcggctcaacacgaacctcatctacgtggggtcggtgagctcgaagtcgaaggtgcccgacgcgaacgagcgcaccgtcctcaaccagttcctcatggatgcccgccgcacctgcgtggagcaggcgtggctcatctatgaaggcacggacctgcagcacaaccttcagcgcgtcatcatctccggcgtgctcatcctcacgcgcaccttcgacaacttcctgtcggtcgcgaagtcgggtgactccatcgtcaaggacgtgagcgcggtgctgaagaaggacgccgcgccactcttcacactggccaaggagcgcggcctcgtcgcctga

SEQ ID NO: 6874 - DNA, 609 bp, Myxococcus xanthus
atgctcgacctggacgcgctcgacttcgcgaagggcaacggactggtgacggtcgtcacgcaggacgcgagcaccggtgacgtgttgatggtggcgcatgccgaccgggaagccctggagcgcacgctggccacgggggagatgcactaccggtcgcgcacgcgcggcccgtggcacaagggcgccaccagtggaaacgtccagcgcgtggtggcgctccgcgccgactgtgacggtgacgcggtgctcgcgcgcgtggcgaaggcgggccctgcgtgtcacctggggacgaagacctgcttcggcccgggccgttgggatgcactgagcgcgctggatgacacgctcgctcggcgcgccgcaccagcggagcggcccgatgatgcgcctcccagctacacacgccgcctgctggaggaccgcaacctgcgcttgaagaagctgggcgaggaggccgcggagttggtgacggcgtgcgcggacgtggacccgtcacgcgccgcggaggaagcggcggacgtgctctaccacgtgctcgtcgcggtccggcccctgggcctctcgctcgacgacgtgaaggcagtcctcgccaggcgcgcttcgcgctga

SEQ ID NO: 6875 - DNA, 798 bp, Myxococcus xanthus
tcacattcggagcctgacatgacggactcgggtaatctgatgcagcccgccgccgaggtggcgcggatagcgggtgacgcggcgttggggttcttccgcggtggcatcgcggtggacacgaagtcggacggctctccggtgacggtggcggaccgcacggcggagtcccgtgcgcgcgagtggctggaagcgcgcttcccccaggacggcatcctgggcgaggagttcggcgagacacgtccgggcgcgaagcgccggtggattctggatcccattgacgggacgaagacgttcatccgcggtgtcccactgtggggcacgttggtggcgctggcggagggcgagcgcatcctcgtgggggccgcgtacttccccgcggtgagtgagttgctggtggccgcgccggggcggggctgcttctggaacgaccagcgcgcggcggtgtccacgcaggcggagctgtcccaggccgtggtgctgtccacggatgagcgcttcccggtgtacccggagcgcggggccgcctggcgctcgctcgcgcgggatgcggccgtggaccgcacctggggggattgctacggctacctgttggtcgccaccgggcgcgcggaggtcatggtggatgagctgctgtccccctgggatggagcggccttgcagcccatcatcgaggaggccggcggtgtgttcaccgactggacggggcggcggaccgcgttcggcggaaatggaatcgccaccaacgcggccatggcgcgcgtggtgcgggagcggctcggcgccgtggagacacgctga

SEQ ID NO: 6876 - DNA, 813 bp, Myxococcus xanthus
ggttttccccagcacccgcaccgggggttcgagaccgtcacggtggtgcgtcgcgggctgctcgaccacgcggattccctgggggcggcggcgcgcttcggcggtggggatgtgcagtggctcaccgcgggcgcgggcatcaatcattcggagatgttcccgctgctccagcgcgaccaacccaacccggtggagttgtttcaaatctggctcaacctgccgcgggcgaacaagctcgtggagccgcacttctccatgatgtggaaccacgtcatcccgcggcacgttgcccgggacgcggaagggcgcgccacggaagtcacggtggtggccggaagcctgggagacgtgaaggcgccaccgccgccgcccaagtcgtgggccgcgcaggcagagtcggacgtggccatctggacgctcaagctggccccgggcgcgcggtggacgctgccggcggcggcccgtggcagcaaccggatgctctacttcttcctcggctccagcctgcgcgtggcggggcgtgccattccgccgtcacatggcatcgagctgcgggcggacgtcgcggtggagttggagaacggcgcggacgaggcggagttgttgatgttgcagggccgtccaattggagagcccgtcgtgcagtacggcccgttcgtgatgaactcgcggcaggagattcaggaggccttcgcggactaccagcgcacgggcttcgggggctggccgtggccggccaatgacccggtccatccgccagaggaagggcgcttcgcccggcacggggatgggcgcatcgaacgtccggcctga
